United States Patent 7,314,974 (EXPRESSION OF MICROBIAL PROTEINS IN PLANTS FOR PRODUCTION OF PLANTS WITH IMPROVED PROPERTIES) - sequence listing, part 10

SEQ ID NO: 30999 - DNA, 1455 bp, Burkholderia cepacia
ccgcatgagctcgacacgccccgaagaacccaaggaaacgcaatgaaaacgttgaacaccttctacatcggcggccattgggtcgagccgtccgccggcagcacgcagacggatatcgtcaatccggccaccgagacgctgaccggccacctcgcaatgggaaccgcgcaagacgcggatcgtgccatcgccgcggcgcgagccgcctttccggcgtggtcggaatcgagccgcgccgagcgggtcgcgctgctcgagcggatcatagaatgctatcgcgcgcggctcgacgacatcgccgaggcggtccgcatcgagatcggcgcacccatcacgctgtgcaagcatctgcaggccgcaatcggcctctcgcagctcgaagccgcactggaaacgctgcgccatttcgagttcgagactcgtcacgacaagagctatgtgcgccgcgaagcggtcggtgtcgcggcactgatcacgccgtggaactggccgttgaatcagatcgccgccaaagtcgcgccggccctcgctgccggttgcaccatcgtgctgaagccgtccgaaatcgctccgctggacgccgtcatcttcgcggaaatcatgcacgcggcgggcacgccgccgggtgtattcaacatgattttcggcgaaggacgggtggtcggcgcgcggctgtcgtcgcatcccggcgtcgatatggtatcgatcaccggctcgacacgcgccggcgtcgaagtggccgtgagcgccgcgcccacggtcaagcgtgtagcgcaggaactcggcggcaagtcacccctgctgattctcgacgacgccgatctgcagcaggcagtgacgagcggcgtgatgcagtgcatggcgaattccggccagacctgtgtcgcgccaacccgcatgctggtgccgcgcgagcgatacgacgacgccattgcgattgccgcggcggtagccaacgggattgtcgtcggcgatccggcggacccggccaccaggatgggcccgatctcgaaccgcgcgcaatacgagaaggtgcagcacatgatccgggccggtatcgaggaaggcgcccgcgtgattgccggcggtcccggcaggccggaaggattggcacagggcttctacgcgcgccccaccgtgttcgcggatgtccgcaacgacatgatgatcgcacgcgaggaaattttcgggccggtgctggtgatgattccgtacgacggcgaggaacacgccattacgatcgccaacgacacgcaatacggtcttgccggttatatcgccacccgtgaccccgaacgcgcacgccgcgtggctgcgcgcctgcgtgtgggatcggtgcggatcaacggcgcgatgctggacattacggttccatttggtggctacaagacatccggtaacgggcgggaatatggtcgggaagggttggccgaatttctcgagtgcaaatcggtg

SEQ ID NO: 31000 - DNA, 1125 bp, Burkholderia cepacia; identical to SEQ ID NO: 28243

SEQ ID NO: 31001 - DNA, 1197 bp, Burkholderia cepacia; identical to SEQ ID NO: 28244

SEQ ID NO: 31002 - DNA, 813 bp, Burkholderia cepacia
aagcttgacggtaaagtagcgctcgtcacgggttcgggtcgcggcattggccgcgcgatcgccgagaagctggcgagcgaaggcgcacgtctcgtgatcaacgacctcgacgccgacccggcgcacgaaacggtcgaagcattgaagaagatgggcgcggaagccgtggcttgcgtcggcaacgtaggtgcgccggacttcgccgaccgcttcatcaatacggcgatgagcacgtacaagggcatcgacatcatcgtcaacaatgcgggttacacgtgggacgacgtgatccagaagatgaccgacgaacagtggtacgcgatcatcgactgccacatgaccgcgccgttccgcattctgcgcgccgcctatccgcatgtgaaagccctgcacgcggctgacaaggaagccggccgcgacgtgtatcgcaagatcgtcaacatctcgtcgacgtccgcgctcaacggcaacgcgggacagatgaactactcgtcggccaaagccggcgtgatcggcatgacgcgcgcgttgagccgcgagtgggggcgcttcaacgtcaacgtcaattgcgtggcattcggtctgatccacacccgcatgacgacggccgacgcgcatgcaggcgcgaccgtgaaaatcgaaggacgcgatatccgcgtgggccttaatcccgagctgctcaagacgcacgcgcagcgcaatccgctgggtcgcggcggcacgcctgaagaagcggccggcggcgtctacctgttctgctcgcccgagtcgaactacatcaccggccagaccatcgcggtcgcgggcaatctg

SEQ ID NO: 31003 - DNA, 1529 bp, Burkholderia cepacia
accagcatgtatttgactcagggcctgcatcgctcgctgcagcagaatccggaccgggtggcgatttcgttcaaagggcgcacgcggactttccgcgaattcgcggatcgggtcgcgcgtctggctgccgcattgcgcgagatcggcatgaccgcggatgaccgggtcggcatgctcgcgctcaattcggaccgctacctcgaatacgtaatgggcgtgtggtggggcggcggcgtgctgaacccggtcaatatccggtggagcgcggcggagatcgcctattcgctcgacgattgcgacacgcgcatcctgatcgtggacgaccacttcgccgacatcgcgcgagaggtttgcgcgctggcgcggaccgcgccgcttctgattcacgccggcgacggcgcggcgccgaccggcatgctctcgttcgacacgttgatcgcggccgcggcgccgatgccggacgccggccgtggtggcgcggatctcgcgtgcatcatgtacaccggcggcacgaccggctttccgaagggcgtcatgcagacgcacctgaacatctggtcatcgtgcatcatgcggattgccgagtccgcgccattgcccgacaccgcggtgctgcatgcggcgccgttcttccatgtggcaggactcggccgagcgctcgtgcagttcattgccggcgaggcgcatgtcgtcattccggctttcgatgcgggcgccgtgctcaaggcgatcggcgaagagcgcgtgagcgatacgctgctcgtgccgaccatgatccaggcggtgctcaatcatcctgactttgcccgcaccgatctgacgagcctgaagcgcctcacctacggcgcgtcgccgatccccgaaacgctgctggaccggctgatcgaagccctgcccggcatccagctcgcgcattcatatggaatgaccgaggcgtgtccgagcatttcggcgaactcgccttccaatcacgacgaagcgggccgcaggagcggcctgtaccgctcgatcggtcgcggcttgccgggcctgatggtgaaggtggtcgacagcgacggcgccgaagtgccgcgcggcacggtcggcgagatcgtcgtgcgtgggccgaacgtcatggccggctactggaagaagcccgaagaaaccgcgcaggccgttcgcgacggctggctgcataccggcgacggcgcttacatggacgctcagggttatctctacatcgtggaccgcatcaaggacatgatcgtgagcggtggcgagaatgtttactccgccgagtggagagtgtgatcgcgcgacaccccgcggtcgccgcgtgcgcggtcatcggcattccgcacgacacgtggggcgaggccgtgcatgccgtggtggtgtgcaagcctggcgcgacactcgcggaagaagagattcgcgagcattgccgccaggtcattgccggctacaagtgcccgaagtcggtcgagttccgcgtgcaactgccgttgtcgggcgcgggcaaggtgttgaagcgcgaaatccgcgcgccg

SEQ ID NO: 31004 - DNA, 1101 bp, Burkholderia cepacia
gaagacttccgcgcggaagtgaagcactttcttgacggacacctgccgccggcgccggccgacgtgcgtgcccgttcctggatgggcttcgacgcggacttcagccggcgtctcgcggcgcgcggctggatcggactgacgctgccggccagttacggcggcgcgggcatggacgcgttccgtcgcttcgtgctggtcgaggaattgctggccgctggagcgccggtcgccgcgcactggatcgccgaccgtcagagcggtccgctgattctccgttacggcaccggggcgcagaaggacttctatctgccgcgcatctgtgccgcaagtgcgttcttctgcattggcatgagcgagcccgattcgggttccgacctcgccagtgtgcgcacgcgtgcggtgcgctgcgacggcggctggcgtctgaccggacgcaagatctggacgaccaacgcgcagcattgccagtacatgatcgcgctcgtgcgatcgtcgggcgtgccggaagaccggcagaagggactgtcgcagttcatcgtcgatctgtcgctgccgggcgtcgaggtgcggccgatcgtggatctcaccggcgacgcccacttctccgaagtgaccttcgacaacgtattcctcgccgacgatgcgttgatcggcgacgagggcgccggctggcagcaggtgacggccgaactggccttcgagcgcagcggccctgagcggctctattcgagcgtcgtgctgctcgactgctggcgcgcgcaactgcgccgccacggcgcaagcgatgccgacctcgccttgctcggcagcttcgcgacgcaactggccacgctgcgctgtctgtcgatcgcggtcaccgcgcggctcgcgcacggcgaaagcccggtggtcgaggcggcgctcgtcaaggacatcggcaccgagttcgaacaggccattcccgcgcaactggaagccgcgatcagcgcggaccccgcacagaccatcgaccccgagctctttcgcacggtggcctacctcagccagatctcgccgaccttctcgctgcgcggcggcacgcgcgaagtgctgcgcggcatgatcgcgcgcggtcttggtttg

SEQ ID NO: 31005 - DNA, 1404 bp, Burkholderia cepacia
aagtacctcggcgaccatgccggattgacgccggacaaggccgccgcgatcaacagcacgagcggcgaggtcctgacctatcgcgaactcgacgagcgttcgaatcgcttcgcacaatgtctgtacgcggcggggttgcggcgcggcgaccatatcgcgatggtgctcgagaacaacatgcgctgcttcgaggtgtgttgggcggcgctgcgttcgggtctgatgatcacgccggtcaaccggtatctgaccgcggcggaagcggccgccattatcgaggacagccatgcgcaagtggtggtcagttcgtacgccatgcgcgaactcgcggccggactgaccggcatgatgccgacatgccgcctgcggctgatggtcgacggcaccatttccggctgggacagctacgaggcgctcacgggccggtatcccgcaacgcgtctggcggacgaatggctgggcgccatgatgatctatagctcgggcacgaccggccgtccaaagggcatcattcgcgcgcagccgcaaggccgggtgaccgaaggttccggttccgcgcgccgcccgcagttcgagcgctatggcttcgacgcgcaaacggtgtatctgtcgccggcgccgctctatcacaccgcgccgctcggctacggaatcgaaacgcagttcggcggcggcaccgtggtcttcatggagaagttcgagccgctcgaggcgttgcaggcgatcgagcgctatcgcgtcacgcacagccagtgggtgccgaccatgctgatccgcctgctcaagctcggccccgctgtgcgcaacgcgttcgacctgtcgagccatcgcgtggcgatccatgcggccgcgccgtgtccgcaggaggtcaagcggcagatgatcgactggtgggggccgatcatcgaggagtattactcgtcgaccgaaggcaacggcgtgaccacgctcaacaccgaggagtggctggcgcacccgggctccgttggccgcgcgctgctgggcgtcattcatatctgcgacgacgacggcaacgagctgccggtgggcgaaaccggaaccgtctatttcgagcgcgaccagttgccgttccgctaccacaacgatccggacaagacccgtgccgcgcagcatccgcgccatccggcctggacggccgtcggcgacatagggcatgtggatgcagatggctacctgtatctgaccgaccgcaaggcgttcatgatcatttcgggcggcgtcaacatctatccacaagcgatcgaagacgcgctggccgtgcatcccgatgtgcaggatgcggcggtgatcggcgtgcccgatgccgagatgggcgagcaggtcaaagcgattgtcgagccggcgcccggcgtggcgccgtcggacgcgctcgcggaacggcta

SEQ ID NO: 31006 - DNA, 885 bp, Burkholderia cepacia
ctttgcaaagatcgcgttgttgtcatcaccggcgccggacgaggcctggggcgggaatatgcgctggagttcgcccgtcagggcgcgaaagtcgtcgtcaacgaccttggcggcaaaggtgacgggtcgggcgcggcgagtggccccgcgctcgacgtggtcgccgaaatcgaagcgctcggcggcgaagccgtcgccaacttcgacgacgtggccgactggaatggcgcaaagaacatgatcgacacggccatttccgcgttcggcggactcgacgtgctggtcaacaacgccggcattctgcgcgaccgcacgctcgccaacatgagcgaagaagactgggactcggtgattcgcgtgcacatgcgcggcacctttgcgccgtcgcgccacgcggccgcctactggcgcgatgaggccaaggcgggccgcgagcgggtggcgcggctcatcaacaccagttcgtcgtcgggtctctactgcaacccgggccaggccaactacggcgcggcgaaggcgggcattgcggccatgtcggtgattgccgctcgtgaactggagcgctatggtgtaaccgtgaatgcgatctatccgaccgcgatgagccgtctgaccgaagacatcttcgcgaagcggcgcgacgaattcaccgcgggcgccgcacccggcttcgatccgctggacgcgggcaacgtcgcacccctcgtggcatggcttggcagcagcgcgtcgagcggtatcaccgggcgtgtattcggtgtgcgcggcggtcgtattacggtggccgaaggctggcatgcgggcccgcgcatcgaaaaagacgggcgttgggacgtggcggaactcggcgcgctgataccggggctggtggaacaggcggcgccg

SEQ ID NO: 31007 - DNA, 1167 bp, Burkholderia cepacia; identical to SEQ ID NO: 28249

SEQ ID NO: 31008 - DNA, 1251 bp, Burkholderia cepacia; identical to SEQ ID NO: 28250

SEQ ID NO: 31009 - DNA, 916 bp, Burkholderia cepacia
ttgaacaaccgtttcgtgctcgaagaatgccttggcgtcggcggtatgggcacggtgtacaaggcgctcgacctgcgcaagctcgaagcctcggatcgcaagccatacctagcgatcaaggtgctcaacgtccagttccgcggcaacccgaattcgctcgtcgcattacagcgcgaggcacgcaaggcgcaggtgctcgcgcatcgcaacatcatcacggtgtacgacttcgaccgcgacgggccgatcgtttatctgactatggagtacctgtccggcaagccgctcagccagttgctgcgcacgccgggctatcagggcatgccggtgcgcgcggcactgccgatcgtgcgcggcatgagcagcgcgcttgcttatgcccacgaacgcggcttcgtgcattgcgacttcaagcccgccaatgtgtttctcacaacgaatgccgaagtgaaggtgatcgatttcggcattgctcgcgtgtttcagcgtccggaagaggagagcgacgcgaccgtcttcgatcccggcagcctcggcgcgttgacgcccgcctacgccagcccggaaatgatcgagcaccgcgagccggacccgcgcgacgatatctatgcacttggctgcattacgtatgagctgctgacgggacatcatccgttcgaccggttgtcggcgacgcaggcccgcaatgccgatttcaagccgcagcggcccgccaatcttgacgcgaaacaatggcgtgcgctgcgtgccgcgttgtcgttcgatcgcaatacgcgcatgccgagcgtggagcgcttcatcgccgagttcgataacgaagctcgcgcggaaaagtccggcacgctggcgaaggtggggctcgcgagtttcgcggtggtgtgtgccgcggcagtcggcgtattcgcgttccgctcgg

SEQ ID NO: 31010 - DNA, 2018 bp, Burkholderia cepacia
gcgccgcgcacgctgttcgacaagctgtgggacagccacacgattgcgaatctgccgggcggcgccgatctgttgcaggtggatcgcaatctgatgcatgagttgaccggcgtcgaagcggtacgtgtactcgaagcccgccatttgccggtcagcaaccccgagttgacgttcgcgacgctcgatcacgtgatctccacgcgccccggccgcgaggcgggggatgccgactggagcacgacaatggtcgacacgctgcgcgaacaggcggcgcagcacgccattcccctgttcgatattggcaccgaaggcaggcagggcattgtccacgtgatcggaccggagctcggtttgtcgctgccgggcacgctgatcgtctgcgccgacagccatacctgcactcacggggcattgggtgcgctcgcgttcggcatcggttcgaccgaactggtgcatgtgctggcgacgcaaaccgtacgccagaagaagcccaaaacgatgcgcatacggtttaaaggcagcgttgccgagggcgtcacggccaaggacatgatcctttacgtgatcggcgcgctcggcgccggcgcgggcaccggctacgcggtcgagttcgccggcgaggcggtcgaagcgctctcgatggaagcacgtttgacgctgtgcaatctgacgatcgaactcggcgccaagttcggcctcgtcgcgccggacgagacgacctttgcctatctgcgcggacgtccgtatgcaccgcaaggcgcgagcttcgaggcggcgctggaagactggcgccgcttgccgacggatgacggtgcgcacttcgagcgcgaagtggagatcgacgccgcggcgatcgcggtgcaggtcacctggggcacgagccccgaacacgtgatcgcgatcgacgctgccgtaccggacccgggcaacgagtccgatcccgcgcgccgtgaagcgttgcaacgggcgctcgattacatgggcgtgcatgcggggcagcatctggatgaactggcggtcgatcgcgtgttcatcggctcgtgcaccaacagccgcatcgaagacttgcaggcggccgcgcgcatcgtggcgggccaccatgtcgccgagggtgtgaccgcatgggtggtgccggggtcgctgagcgttgcgcgagaggcggaggcgcagggccttgcacagatattccgcacggccggcttcgaatggcgcgagcccggctgctcgatgtgcgtcggggcgaacggcgacgtggtggggcgtggcgagcgttgcgtatcgacatcgaatcggaacttcgtcggccgtcaggggccgggcgcgcgcacgcatctggcgagtccggccgtggctgcggccagtgcgctggctggtcacattgccgcgccggtgtcgtacgcgggagccgcatcatgaaagcgttcacgatggtcaaaggcccggccgcgtcgttaccgcgcaataacgtcgacacggacctgatcattcgcatcgaaaggatttcgcaacttgtgcgaggccagctcggcccgtggctgttcgagacgctgcgttatcgcgaaggcggtccggagcagggagaacgcgaagatttcgtgctcaaccagccggcattccggcacgcgtgcattctgctcggcggtgtgaacttcggttgcggcagttcgcgcgaaatggccgtgtgggcgctcgaagagttcggcatccgctgcgtgatcgcgccttcattcggcgacattttcttcgccaactgcctgcaaaacgggctgctgccgatctgtctcgacgctgcgtcgatcggaacactcgctgcggtcgccgctgacggcacgccgctcgaagtcgatctgcgcaccctgcaaatccgcgcggacggacttgaaccgatgccgttcgagttcgacgccgcgcgccgggcggttctgctcgaaggactcgacgaggtcgatcagacgttgcgtctggccgacgatatcgacgcgtttcgccgcacggaccgcgccaaacgcgcgtgggct

SEQ ID NO: 31011 - DNA, 774 bp, Burkholderia cepacia; identical to SEQ ID NO: 28254

SEQ ID NO: 31012 - DNA, 1227 bp, Burkholderia cepacia
cgccgatccgccccagcaggaatccctatgaacgacgccttcatttgcgatgcgattcgcaccccaatcggccgctacggcggcgccctgaaggatgtccgcgccgacgacctcggcgcggtgccgatcagggcgttgatcgaccgcaatcccggcgtcgactggcgcgccctcgacgacgtgatctacggctgcgccaaccaggcgggcgaagacaaccgcaacgttgcgcgcatgtcggcattgctggccggcttgcccactgaggcaccgggcgccaccatcaaccgcctgtgcggctcgggtatggacgcggtcggcaccgcggcgcgcgccatcaaggcgggcgaagcgcgtctgatgatcgccggcggcgtcgaaagcatgacacgtgcgccgttcgtcatgggcaaggcgactggcgcgttctcccgccaggctgagatctacgacacgaccattggctggcgcttcatcaatccgctgatgaaacgccagtacggcgtcgattcgatgcctgaaaccgcggaaaacgtcgccgttgaattcagcgtgagccgcgcggatcaagacatgttcgcgctggcaagccagcaaaaggcggctcgcgcacaacaggacggaacgctggcccaggaaattgtcggcgtcgaaatcgcgcaaaagaaaggcgacccagtgcgcgtgctgctcgacgaacacccgcgtgaaacgtcgctcgaaagcctgggcaagctcaaaggcgtggttcgccccgacggcagcgtgacagccggcaacgcgtccggtgtgaacgacggtgcctgcgcgctgttgctcgcgaaccagcaggccgccgaccagtacggcctgcgccgccgcgcccgcgtggtgggcatggcgaccgcgggcgtcgggccgcgcatcatggggatcggtccggcgccggctacgcaaaagctgctgaagcagctcggcatgacgctcgaacaattcgacgtgatcgagttgaacgaagcgttcgcatcgcaaggcctggcagttctgcgtacgctcggcttgcgcgacgacgacccgcgcgtcaatccgaacggcggagccatcgcgctcggccacccgctgggcgcatcgggtgcgcgtctgatcacgaccgcgctgtaccagctggaacggatcaacggccgctttgcgctttgcacgatgtgcatcggcgtaggccagggcatcgcgctggtcatcgagcggctc

SEQ ID NO: 31013 - DNA, 624 bp, Burkholderia cepacia; identical to SEQ ID NO: 28256

SEQ ID NO: 31014 - DNA, 987 bp, Burkholderia cepacia
cgctcgccacggaactcggcaagcagattgccgctctggcaccagacaacatcagcaaggcgcagcgcggttaccagttgcgggcgggttgagcgccgcaaagccgctcctccggcgctcgcgctgaatgccgtgcccacaccttgagcaacgcagcgtttgctgcgacacttccccgccatgacctccgcttcccgcacccgctccaatccgtcgcaggcttcgctgttcggcgacgccgcatccgagccaaccagcgccacgtcgaccacgccgcagaaatccggcgccagcgcgccgccgccaacgctcgaggcgcaattcgacgcgctgccgccggcatggcgcgcgcatctcaaaccgttcatcgaaagcgacgcctacgcgccgctctgccgctttgtcgacggtgagcgcgccgccggcaaaaccgtctatcccgccgacgtattccgcgcgctgcgcctgaccagtcccgatgaagtgaaagtggtgatcctcggccaggatccgtatcacggcgaagaccgtggcacgccgcaagcgcacgggctggcgttttcggtagcgccgaacgtgcgcacgccgccgtcgctgcgcaacatcttcaaggagatcgccgcaagccttggccacgagacgccgcgtcacggctgtctcgacacctgggcgaagcagggcgtgctgctgctgaacacggtgttgacggtggagcgagactcggccgccagccacgcaaaacgcggctgggaaaaatgcaccgacacgctgatccacgaactcgcgatgcgccatgacggcctcgtgttcatgctgtggggcgcgcatgcgcaagccaagcgcgcgctgctcggcggcaagtcgcattgcgtgctggaagcaccgcatccgtcgccgctgtcggcgcatcgcggttttctcggctgcgggcatttcgccaaggccaacgaatatctcgcacagcacggccgcgagccgatcgactgg

SEQ ID NO: 31015 - DNA, 1230 bp, Burkholderia cepacia; identical to SEQ ID NO: 28258

SEQ ID NO: 31016 - DNA, 1575 bp, Burkholderia cepacia; identical to SEQ ID NO: 28259

SEQ ID NO: 31017 - DNA, 1137 bp, Burkholderia cepacia
atggcgaaacgggattactacgaggttctgggcgtcgcaaagaacgcgagcgacgacgaaatcaagaaggcttatcgcaagctggcgatgaagcaccaccctgaccgcaatccgggcaacaaggatgcggaagggcatttcaaggaggtgaaggaagcctatgaaatgctctcggactcgcaaaagcgtgccgcgtacgatcagtacggccacgcgggtgtcgatccgaacatgggcggtgccggcgcacaaggttttggtggttttgccgatgcattcggcgatattttcggcgacatcttcggccaggcggccggtggcgccgcacgcggcggtggcggccgcgcgggcccgcaggtgtatcgcggcgccgatctgcgctacagcatggaaatcacgctggaacaggccgcgcacggctacgacacgcagattcgcgtgccgagctgggtgtcgtgcgaggtctgccacggttcgggcgccaagcccggcaccaagccggaaacctgcccgacctgtagcggttcgggttcggtgcggatgtcgcagggtttcttcagcatccagcaaacctgcccgaagtgccacggcaccggcacctacattcccgacccgtgcggccattgccacggtgccggcaaggtgaaggaaaccaagacgctggaagtgaagatcccggcaggtatcgacgacggcatgcggatccgttcggccggcaacggcgagccgggtatcaacggcgggccgtcgggcgatctgtacgtcgagattcacatcaagcagcattcggtgttcgagcgcgacggcgacgatctgcactgccagatgccgattccgttcaccactgcggcactgggcggcgagatcgaagtgccgacactcgcgggccgcgccagctttaccgtgccggaaggtacacaatcgggcaagacgttccgtctgcgtggcaagggcatcaaggggctgcgttcgagtattgccggcgatctgtacgtgcatgtgcaggtcgaaacgccggtcaagctcaccgagccgcagcgcgatctgctcaagcagttcgaaaaggcgctcgtcgagggcggctcgcggcatagtccgcaaagcaaaagctggttcgaccgggtgaagagcttcttc

SEQ ID NO: 31018 - DNA, 1959 bp, Burkholderia cepacia
atgggcaaaatcatcggcatcgacctcggcacgaccaactcgtgcgtggcgatcatggaaggcaattcggtcaaggtgatcgagaactcggaaggcgcgcgcaccacgccgtcgatcatcgcttacatggaagacggcgagattctcgtcggcgcgcctgcgaagcgccagtcggtcacgaacccgaagaacacgctgtacgcagtcaagcgcctgatcggccgccgtttcgaagaaaaagaagtgcagaaagacatcggcctgatgccgtacaagatcatcaaggccgataacggcgacgcatgggtcgaagtgcgcgaccagaagctcgctccgccgcaaatctccgcggaagtgctgcgcaagatgaagaagaccgctgaagactatctcggcgagccggtcaccgaggcggtgatcacggttcccgcgtacttcaacgacagccagcgtcaggcaaccaaagatgcaggccgcattgccggtctggaagtgaagcggatcatcaacgaaccgaccgccgctgctctggctttcggcctcgacaagaacgaaaagggcgaccgcaagatcgcggtgtatgacctgggtggcggtacgttcgacgtgtcgatcatcgaaatcgcggatgtcgacggtgaaaagcagttcgaagtgctgtccacgaacggcgatacgttcctcggcggtgaagacttcgaccagcgcatcatcgattacatcatcggcgagttcaagaaagagcagggcgtcgatctgtcgaaagacgtgctcgcgctgcaacgcctgaaggaatcggctgagaaggccaagatcgagctgtcgtcgagccagcaaaccgaaatcaacctgccgtacatcacggccgacgcatcgggtccgaagcatttgaacctgaaaattacgcgtgcgaagctggaagcgctggttgaagagctgatcgagcgcacgatcgaaccgtgccgcgtggcgatcaaggacgcaggcgtgaaggtcggcgaaatcgacgacgtgattctggtcggcggtatgacccgcatgccgaaggtgcaggaaaaggtcaaggagttcttcggcaaggatccgcgccgtgacgtgaacccggacgaagccgtggccgttggcgccgcgatccagggccaggtgttgtcgggcgaccgcaaggacgttctgctgctcgacgtgaccccgctgtcgctcggcatcgaaacgctcggcggcgtgatgaccaagatgatcaacaagaacaccacgatcccgaccaagcactcacaggtctactccacggccgacgacaatcagggcgccgtgacgatcaaggtgttccagggcgaacgcgaaatggcagccggcaacaagctgctgggcgagttcaacctggaaggcattccgccggcaccgcgcggcacgccgcagatcgaggtgagcttcgacatcgacgcgaatggcattctgcacgtcggcgcgaaagacaaggcgaccggcaaggaaaaccgcatcacgatcaaggcgaactcgggtctgtccgaagccgaaatcgagaagatggtgaaggacgccgaagccaacgccgaagaagatcacaagctgcgtgagctggccgatgcccgcaatcagggcgacgcgctggtccacagcacgaagaaggcgctcaccgaatacggcgacaagctggaagccggcgagaaggaaaagatcgaatccgcgctgaaggatctcgaagaaacgctgaagagcggttcgagcgacaaggccgcgatcgaagccaagatcgaagtggtggccaccgcctcgcagaagatgggcgagaagatgtacgcggacatgcaggctgcgcaaggtgctgaagccgcggcagcgggcgcggcgggtgcgggcggcgcgggtgcatcggcgggtggcgcgagccagcagcaggacgacgtggtcgacgccgagttcaaggaagtcaagaaagac

SEQ ID NO: 31019 - DNA, 924 bp, Burkholderia cepacia
cgtgtcgccgtgctgctgatcaatctcggcacgcccgacgcgccgacgccgcgcgcggtccgccgctatctcgcgcagtttctgtccgatccgcgcgtggtcgaaattccggcgctgctctggcagatcatcttgcgtctgctgatcctgccgttccggggcagtgcctcggccaagaagtacgctgcggtgtggatgcccgaaggctcgccgctgcgcgtgtatacagagaagcaggtggagggcttgcgccatctgctgcaactgaacgactacacggtgctggtcgattacgcgatgcgctacggtacgccgggtattccggccatgctgaaccagctcaagctggcaggcgccgaacgcgtgctgctcatgcccatgtatccgcagtattcgtcgtccaccaccgccaccgctttcgacgacgccttttcggcgctcaagcgcatgcgcaatcagccggaaattcgcacggtgcgccagtacgccgatcatccggcctacattgcggcgcttgccgcacaggtgcatcaatattggcatcagcatggccggccggatttcgccgcgggcgacaagctggtgctgagttttcacggcgtgcccaaacgcacgctggatctcggcgacccataccatgagcaatgccagcaaacgggcgcgctgctgatgcaggcgctcgaactgacgccggtggagtgccgcattacgttccagtcgcgtttcggcaaggccgagtggctgcagccgtatacggcgcccacgctcaaggaactgggcgcggcgggcgtgcggcgcgccgatgtgttctgtccgggctttactgccgactgccttgagaccatcgaggaaatcggcatggaagtgcgcgatgaattcctgcacgcgggcggcaaggattttcatcggattccctgcctgaat

SEQ ID NO: 31020 - DNA, 1041 bp, Burkholderia cepacia; identical to SEQ ID NO: 28263

SEQ ID NO: 31021 - DNA, 1314 bp, Burkholderia cepacia
gtgtccgtgtccgaagccgtgcgcgtccatcatggccgcgacgaatcgccgttcgaccctcaactgcccgacgcagtcgtgttcgcacgcactaccgaagacgtgcagaacgtcgtcaaactgtgcggccagtacaacgtcccggtcattccttacggtaacggctcgtcgctggaagggcatctgctcgccgtgcaaggcggcgtatcgatcgatctgtcggaaatgaaccgggtgctgtcgatcaacgccgaagacctgaccgtcaccgtcgagcccggcatctcgcgcaaacagttgaacgaggcgttgcgcgacacgggtctgttcttcccgatcgaccccggcgcggacgcgagcatcggcggcatgtcggccacgcgcgcgtcgggtaccaacgctgtgcgctacggcacgatgcgcgaaaacgtgctcgggctgaccgtggtgctggccgatggccgcgtgatcaaaaccggcacgcgggcccgcaagtcgtccgcgggttacgacctcacgcgcctgttcgtcggctcggaaggcacgctcggcgtgattacggaaatcacagtccgcctgtatccgcagccggaggcggtgtccgcggcggtgtgcacgttcccgtcgatgggcgacgcggttcgcgcggtcatcgaaacgatccagatcggcgtaccgattgcgcgcgtcgaattcgtcgactcgctcgccatccgctcgatcaaccgccactcgaatctgacgctgcgtgaagcgcccacgttgttcttcgagttccacggcaccgaggccggcgtaaaagagcaggccgaactcgtccaggaggtcgccgcgcagaatgccggcgagggcttcgaatgggccacgcgtccggaagaccgcagccgtctatggaatgcgcgccacaacgcctatttcgccatgctgcaactgaagcccggttgccgcgcggtcacgaccgacgtctgcgtgccgatctcgcgcctcgcggaatgtgtggaggaaacggaacaggacctgaaggcgtcgcctctgccctgcccgatcgtcggccatgtcggcgacggcaacttccacgttgcgatcctgatcgatcccaacaagccggaagaactggtcgaagccgagcgcctgaaccatcgcatcgtggagcgcgcgctgcgcatggacggcacctgtacgggcgagcatggcgtcggcttgcacaagatgggcttcctgctcgaagaacacggtgaagtcgcggtcgacaccatgcgctcgatcaagcacgcgctcgatccgcacaatctgatgaacccgggcaagatcttc

SEQ ID NO: 31022 - DNA, 1437 bp, Burkholderia cepacia
gtcgtgcaggcgctgatggccgtgttgccgacccactgtctgctgtatcgcgaagaagacaccgtcgcctatgaatgcgacggtctcgccgcctaccggcgtctgccgctcgcggtcgcgttgccggagacggaatcgcaggtgcagcgcatcgtgcagatctgccaccgcctcgacgtgccgatcgtcccgcgcggtgcgggcaccggcctgtccggcggcgccatgccgatccgccacggtgtggtggtgtcgctcgcgcgcttgcgcaagatcgtcgaggtcgattcgtacgcgcgaaccgccacggtgcagccgggcgtgcgcaacctgtccatctccgaagccgccgcaccttacggcctgtattacgcgccggacccgtcgtcgcagattgcctgcacgatcggcggcaatgtctcggagaattccggcggcgttcactgcctcaaatacggtctgacggtgcataacgtgctgcgcgtgcgcgccgtcacgatggaaggcgaaatcgtcgagttcggctcgctcgcgccggatgcgcccggcctcgatctgctggcggtgctgatcggcagcgaaggcatgtttgcgatcgtcaccgaagtcaccgtcaagctgatccccaagccgcaaacggcgcaggtcatcatggccagtttcgacgacgtcgtgaaaggcggcgacgcggttgccggcatcattgcggcgggcatcatcccggcgggtctggaaatgatggacaagccggccacgcgcgccgtcgaggaattcgtcaacgcgggctacgatctcgacgcggcggcgatcctgctgtgcgaatcggacggcacgcccgacgaagtcgccgacgagatcgtgcgcatgaccgcggtgctgcgcgaacacggcgccacgcgcatccagatttcgcgctcggaaaacgaacggctgcgcttctggtcggggcgcaagaacgccttcccggccgccgggcgcatttcacccgactattactgcatggacggcaccgtgccgcgccgcagtattggcccgctgctcacgcgcatcgaggcgatggagaagatctacaacttgcgctgcatcaacgtcttccacgcgggagacggcaacatgcatccgctgatcctgttcaacggcaacgaccgggacgagtggcaccgggccgaagcgttcggttgcgacattctcgaagcatgcgtggaactgggcggcacggtgaccggcgagcacggcgtcggcatcgagaagatcaattccatgtgcgtgcagttttcgcccgaagagcgcgacgcgttccacgcggtcaagcgggctttcgacgcgcctggcctcctgaaccccgacaaaggcattcccacgcgcgcccgctgcgccgaatacggcaagatgcacgtacgcggcggcttgctgccgcatccggacctgccgcgtttc

SEQ ID NO: 31023 - DNA, 807 bp, Burkholderia cepacia; identical to SEQ ID NO: 28266

SEQ ID NO: 31024 - DNA, 1425 bp, Burkholderia cepacia; identical to SEQ ID NO: 28267

SEQ ID NO: 31025 - DNA, 777 bp, Burkholderia cepacia
agattgagagacagggtcgcactcgtcacaggggccggatgcattggtcccggttggggcaatggccgcgcgatcgcagtgaggtttgccgaggaaggcgcgcacgtcgtcgcgatcgaccggaatctggcatccatggacgaaacgcttgaattgatacggcaggcgggagggaaggtcacaccgtacgaatgcgacgtgaccgatagtgccgccgtcgagcgcctggtcgcggatatcgtggcgcgttcggggcgcatcgacgtactggtgaacaacgtgggggcgcccgcgccgggcggcccggtccagttgagcgaagcgcagtggggcgagcagctggaactgaatctgacgacgacgttcctgatgtgccaccacgtactgccagtcatggaagggcaggccggcggctctattgtcaacatcgcatcgacgtccggcatccgctggacgggcgccgcccaggtcggctatgcggcagccaaggctggcgttattcagttcgcgcgcgtggtggcggtcgaatatgcgtcgaagaacatccgggccaactccgtggtgccgggtctgctgtacaccccgatggtcgatacgacgatcgcccgcaaccagaccggcggcgatctcgaactgctgctccgcaagcgcaaggcacgtattcctctgccgttcatgggcgacggccgcgatacggccaacgcggcgctgtttctcgcgtcggacgaggcccgcttcatcaccggcaccgagatcgtagtcgacggcggcatgagc

SEQ ID NO: 31026 - DNA, 462 bp, Burkholderia cepacia; identical to SEQ ID NO: 28269

SEQ ID NO: 31027 - DNA, 1320 bp, Burkholderia cepacia
atgtctgttttcacctcgaaagtggtgcgcaacctgttcggcaccgacgcgatgcgaaccatcttttccgacgacacgcgcgtggcgaactacctgaaaatcgaagtcgcgctggccaaggtcgaggccgggctcggcgtgattccgcaggacgcctggcgcgatatcgagcagaagtcgcatagcttcgaaatcgactgggaacgctttcgcatcgacgtggaagcggtcggctacccggtgatgcctttcgtcacccaactcgccgaacattgcggggagtccggtgaatacctgcactggggttccaccacgcgcgatatcaccgacacctcgttcgtgctgcaattgcgcgaagcgctcggcgtgctcgccgccgatctcgacaaggtgcgtcgcaagctgcgcgagatgacggcgcgacatcgttcgacgctgatgatcgcgcgcacgcatggcaagcatgcgctgccgtccaccttcgggtttcgttgcgcggtctggtatagcgaagtcgagcggcaatgcgaacgcctcgcggcattgcgcgccgagccgttcgtgggccagttcggcggcgcgatcggcacgctggccgcggtggggccgcgcggcctggaagtgcagtctgcgttaatggcggaactgggactcggcacggcagagatcgcgtggtttgcctcgcgcgaccgcgtctccgaggtggtgttcagaatcgcctcgattgcgcaatcgatggcgagcatcgccaaatcgctggtcatcatgacgcgcgacgaactcgccgaagcctccgaaggcggcggcgagcagcgtggcaccagctcggcgatgccgcacaagcacaacacggtcgtgccggaactggtgatcgtgcacggcaagatggcgacacagcaggtggcgatcgtgatggagtcgatggtgcaggacttcgagcgcgactggcaggggcatttcgagaccatcgccgtgcctcagactttccagcacgcgcatgccgccgtcacgcagatgcacaccgtgctgtccggcctgattctgcacgaagaccgcatgcgcgcgaacctcgatgtaacacgcggacaggtgatggccgagagcgtgatgatggcgctcgcgccgaagctcggccgcaagaacgcgcaccatgcgatttcgcggctgtgcaaccaggcgctggcggaagaccggccgctcggcgaagtgctgcgcgccgatccgcaggtcgcgcaatatctgggagagcacgaactcgccgatgcgctcgacccggccggctatatcggccttgccacgcaagtggtcgataacgtgctg

SEQ ID NO: 31028 - DNA, 1128 bp, Burkholderia cepacia
gaactgactgatgcgcaacgccaattgcagcaaagcgcccgtcgattggcgctagaagcgatcgccccgcacgcggcgcagaccgaccgcagcgagcagtatccgtggcataccgtcgaggcgctgcgcgagcagcgtctgatgggcatgacgctgccgcctgagtacggcggcaagggcgcgagctatttcgacacggtgctggtcatcgaggaactgtccaaggtttgcgcggcatcgggccgcatcatggtcgaatcgaatatgggcgcgatcggcgcgatcatgaaatacggctcggacgcgcagaagcagctcgccgcgcgcctcgtgctggccggcgacaagcccgccatctgcatcaccgaaccgcaggccggcagcgccgccagcgatatgcagacgcgcgccgagcggcgcggcgacacctggcatttgagcggctgcaagcactggatcacgggcggcggcgtatcgaagctgcacttcgtgttcgcgcgcgcgatcgaggacggcaaggacaccggtatcgccggctttatcgtcgtggggccggatgtgccgggcatgacgatccagcgcattccggctatgggcattcggggcgttccggaagcgcggatcgaattcgacgacatgcgcgttcggcacgacatgaaggtcacgccgccgggccgcaccgaagccggttttgccgggctgatgaacgcgtacaacgcacagcgcgtcggcgcggccacagtcgcgctcggcattgcgcaaggtgcattcgacctcgcgctcgactacgcgaaacggcgcgaacagttcggccgtcccatcgccgaattccagggccttcaatggatgctcgcggacatgtcgatccagctggaagccgcgcgcctgatggtgtggaaggcggccgcgtcgggcagcgaattcccgtcgatgtttgccgccgcgcaagccaaaatcgccgccggcgaagccgccatcaaggtcaccaacgacgcgttgcagattcacggcgcggtgggttacggacgcgatctgccactcgaacggatggtccgcgatgcgcgcatgtttacgatttcaggcggcaccgcgcagatcctgcgcacgcaggtggcgggcacgttgctt

SEQ ID NO: 31029 - DNA, 1407 bp, Burkholderia cepacia; identical to SEQ ID NO: 28272

SEQ ID NO: 31030 - DNA, 741 bp, Burkholderia cepacia; identical to SEQ ID NO: 28273

SEQ ID NO: 31031 - DNA, 900 bp, Burkholderia cepacia
tcaatgtcagccatagaaattcgtaacgtcaagaagcgctacaaggatttgcaagcgctcaagggcgtcagcctcacagttgaagaaggcgagttcttcggactgctcggtccgaacggcgcgggcaagacaacgctcatcagcatcctcgccgggctcgcgcgagccgacgaaggcagcatcgcggtgcgcggccacgacgtcgtcagcgatttccgcgccgcgcgccgcgcgcttggcgtggtgccgcaggagctcgtgttcgatccgtttttcacggtccgcgaaaccttgcgcatccagtccggctactacgggctgcgcaacaacgacgcgtggatcgacgagatcatggccaatctcgacctcaccgacaaagccgacgccaacatgcgcgcgctgtcgggcggcatgaagcgccgcgtgctggtcgcgcaggcgctggtgcaccggccgccggtgatcgtgctcgacgagccgaccgcgggcgtcgacgtcgaattgcggcaaacgctgtggaagttcatttcgcgcctgaatcgcgaaggccacaccatcgtgctgaccacgcactatctggaagaagccgagtcgctgtgcgatcgcatcgccatgctgcggcgcggcgaagtcgtggcgctcgagcgcaccagcacgctgctgcaacgctttgccggcatgcaactgttcctgcgtttctcgcaaggcgtcctgcccgccgatctgcgtgtgctcgaagtggaaagcggcacgggcaacggcaatggccgccagcatctgctgcgtctcgcgagttacgacgacgtcgaaaaaattctcgcgcagtgccgcgcagcgggctgcacattcgaagaaatcgaggtccgcaaggccgacctcgaagatgtgttcgttcaggtg

SEQ ID NO: 31032 - DNA, 1218 bp, Burkholderia cepacia
gacgaagcaatcgagcgctcggtcgcgcagattctgaacgacgtgaaggcgcgcggcgatgctgcggtgctggagtacacgagccgcttcgaccgtgtcgaggcgaagagcgtcgacgcgctcgaactgccgatgtcggagctggaagcggcgctggaaggcctcgaaccgaagcgtcgcgcggcgctcgaagcggcggcggcgcgggtgcgcggctaccacgagaagcagaagatcgaatgcggcagccatagctggcggtacacggaagccgacggcaccgtgctcggccagaaggtcacgccgctcgatcgcgcgggtatctacgtgccgggcggcaaggcggcgtatccgtcgtcagtgctgatgaacgcgattccggcgcgagtggccggcgtgcgcgaaatcgtcatggtggtgccgacgccggacggcgtgaagaatccgctggtgctcgcggccgcgctgctcggcggcgtggatcgcgtgttcacgattggcggcgcgcaggcggtgggcgcgctggcgtacggcacggcgaccattcccgcggtcgacaagatctgcggtccgggcaacgcgtacgtcgcgtcggccaagcgccgcgtgttcggcacggtcggtatcgacatgatcgccgggccgtccgaaatcctggtgctgtgcgacggcaccacggatccgcgctgggtggcgatggacctgttctcgcaggccgagcacgacgagctcgcgcagtccattctgctgtgcccggacgacgcgttcatcggccgcgtgaaagatgcgatcgacgaactgctgcccaccatgccgcgccgcgatgtgatcagcgcgtcgctggaaggccgcggcgcgttgatcaaggtgcgcgatatggcggaagcctgcgcgatcgccaacgacatcgctccggaacacctcgaaatttccgcgctggaaccgcagcagtggggccagctgatccgccatgccggtgcgatctttctcggccgctacaccagcgaaagcctcggcgactactgtgcggggccaaatcacgttttgcctacgtctcgtaccgcacggttctcgtctcctttgggcgtctatgatttcttcaagcgttcgagcgtgatcgaggtcagcgcggagggcgcgcagacgctgggcgagatcgccgccgaactcgcttacggcgaaggcctgcaggcgcatgcccgcagcgccgaataccgg

SEQ ID NO: 31033 - DNA, 1038 bp, Burkholderia cepacia
atcatccgccgcgacgtgctcgcgatgacgagctatccggttccggacgccacgggctatatcaagctcgacgcgatggaaaatccgttcccgctgccgccggtgctggccgcgcatctgggcgagcacctcgccggcgtcgcgctgaaccgctatccggcgccgcgtccggatgcgctgatcgagaagatcaagcgtgtgatgcaggtgccgcccggctgcgacgtgctgctcggcaacggctcggatgaaatcatcagcatggtgtcggtcgcgtgcgcgcagccgggcgccaaggtgctcgcgccggtgccgggcttcgtgatgtaccagatgtcggcgaagctggcgaatctcgagttcgtcggcgtgccgctgaaagcggatttcacgctcgataccgaagcgatgctggccgccatcgccgagcaccagccggcgatcatctacctcgcgtatccgaacaacccgaccgggacgctgttcgacgacgccgacatggagcgcatcatcgccgcggccagcaagagcctcgtggtgatcgacgaggcctaccagccgttcgcgcagcaaagctggctgccgcgcgccgacgcgttcgacaacgtggtggtgatgcgcacggtgtccaagctcggcctggccggaatccgtctcgggtatctggtcggcaaaccgggctggctgacggaattcgacaaggtgcggccgccgtacaacaccaacgtgctcacgcaggccgccgcggatttcctgctcgaccacgtcgacgtgctcgattctcaagccgcgcaattgcgcgaagaacgcacgaaactcgcgcacgcgatcgcccagttgccgggcgccgaagtgttcccgagcgccggcaacttcctgctggtgcgtgtgccggacgcgtcggtcctgttcgaaacgctgctggcggcgcgggttttgatcaaaaacgtgagtaaaatgcatccgttgctggccaattgcgtgcgtttgaccgtcggttcgcccgaagaaaatgcgcaattgctggccgcactgaag

SEQ ID NO: 31034 - DNA, 582 bp, Burkholderia cepacia; identical to SEQ ID NO: 28277

SEQ ID NO: 31035 - DNA, 771 bp, Burkholderia cepacia
ctagctaaacgcatcatcccctgtctcgacgtcacggctggccgcgtggtcaagggcgtcaacttcgtcgaactgcgcgatgcgggcgacccggtcgaaatcgcccgccgctacgacgatcagggcgcggacgaactcaccttcctcgacatcaccgccacctcggatcagcgcgatctgatcctgccgatcatcgaagcggtcgcctcgcaggtgttcattccgctgacggtcggcggcggcgtgcgcgccgtcgaagacgtgcggcgcctgttgaacgcgggcgcggacaagatcagcatgaattcgtcggcggtggcgaatccgcagctcgtgaaagacgcgacggacaaatacggctcgcagtgcatcgtggtcgcgatcgacgcgaagcgcgtctccgcagaaggcgaagtgccgcgctgggaagtcttcacgcacggcggacgcaaggctaccgggctggacgcggtcgaatgggcgcgcaagatggccgaactcggcgccggcgaaatcctgctcaccagcatggaccgcgacggcacgaagagcggcttcgatctcgctctcacgcgcgccgtgtccgatgcggtgccgatcccggtgatcgcctcgggcggcgtgggcaacctgcagcatctggccgacggcatcaaggaaggccacgcggacgcggtactcgccgcgagcattttccactacggcgaacacaccgtgggcgaggccaagcgcttcatggccgatcagggcatttcggtgaggttgtgacgt

SEQ ID NO: 31036 - DNA, 710 bp, Burkholderia cepacia; identical to SEQ ID NO: 28279

SEQ ID NO: 31037 - DNA, 1881 bp, Burkholderia cepacia
caagaaaccatgagctttcaggcagaagtgaaacagcttctgcacctgatgatccattcgctgtacagcaacaaggagattttcctgcgcgagctgatttcgaacgcgtccgacgcggccgacaagctgcgcttcgaagcgatcgaaaacagcgcgttgtacgagaacgatccgaacctgcggattcgcgtgtcgtacgacaaggacgcgcgcaccatcacgatcgacgacaacggcatcggcatgagccgcgacgaagcgatcgccaacctcggcacgatcgcgcgctcgggcaccaaggaattcttcggcaagctctccggcgaccagcagaaagacgcggcgctgatcggccagttcggtgtgggcttctattcgggctttatcgtcgcggacaggatcaccgtggaaacccgccgcgccggtttgccggcttcggaaggcgtgcgctgggaaagcgcgggcgagggcgatttcgcggtcgagcagatcgagcgcgccgcgcgcggcacgaccatcacgctgcatctgcgtgcggatgaagacgaactgctgtcgtcgcatcgtctgaaatcgatcattcagaagtactccgaccacgtcgcgctgccgatcctgatgaagaaggaagagtgggacgcggaaaagagcgcgatggtcacgaaagacgaagacgagaccgtcaaccaggccagcgcgttgtggacgcgttcgaagagcgacatcaccgacgagcagtacaagcagttctatcagcacctctcgcacgatcatcaggacccgctcacgtggacgcataaccgtgtcgaaggccgcagcgagtacacgcaactgctgtacgtgccgacccacgcgccgttcgacatgttcaaccgcgatcatcgcggcggcctgaagctgtacgtgaagcgtgtgttcatcatggacgacgccgagcaactgctgcccgcgtatctgcgtttcgtgaagggcgtggtcgattcggcggatctgccgctgaacgtgtcgcgcgaaattctccaggaaagccgcgacgtgaaggcgatccgcgaaggcgtgaccaagcgcgtgctgtccatgctcgaagatctggccaattcggataacgaggcggacaaggaaaagtacgccggtttctggaaggaattcggccaggtgctgaaagaaggcattggcgaagacttcgccaatcgcgagcggatcgccaaactcctgcgctttgcgtcgacgcatacggacacgcctgagcagaccgtgtcgctcgccgactacgtcgcgcgcatgaagcccgagcagaccaagatctactacgtcaccgccgacacctggcaggccgcgacccacagcccgcacctcgaagtgttccgcaagaagggcgtggaagtgctgttgctgaccgaccgcgtggatgaatggatcctgtcgttcctgaccgagttcgaaggcaagccgctgcaaagcgtggcacgcggcgatctcgatctgggcgcgctgaacgacgaagaaaaagaggcgcaggaaaaggttagcgaagagttcaaaccgctcgtcgagaagatgaaggaagcgctgaaggacaaggccaaggacgtgcgcctcacgttccgcctgaccgattcgccgtcctgtctcgttgccgacgacggcgaaatgagcggctatctgcaacgcatgctgaaggccgcgggccagcaggcgccttcgttccatccgattctcgaggtgaatccggagcacgcgctggtgaagggcctgcatgcggacagcgcgaacttcgacgactggtgccatttgctgttcgaccaggctttgctcgccgaaggtggcgcgctggaagatccggcgagcttcgtgaagcgcaccaatgcgctgctgctggcg

SEQ ID NO: 31038 - DNA, 939 bp, Burkholderia cepacia
atgacaaccgcactcgatcaactcaagcaatacaccactgtcgtggccgataccggcgacttccagcaactggcccagtacaagccgcaagacgccaccaccaatccgtcgctgatcctgaaagcggtgcagaaagacgactacaagccgttgctggaaaagaccgtcaaggcgcacgcgtcgaaaccggtcggcgcgatcatcgaccagttgctgatcgcattcggcaccgaaattctcaagatcattccgggccgtgtctcgaccgaagtcgatgcgcgcctgtcgttcgacacggaaggctcgatcgccaagggccgcgaactgatcgcgctgtacaaagagcacggcatcggccgggagcgcgtgctaatcaaactcgcttccacgtgggaaggcattcgcgcggcggaagtgctgcaaaaggaaggcattcactgcaacatgacgctgctgttctcgctcgcccaggccgccgcctgcgccgaagcgggtgcgcagttgatctcgccgttcgtcggccggatttacgactggtacaaaaagaacgccggcagcgcgtgggacgaagcgaaagacggcggcgccaacgatccgggcgtcaaatccgtgcgccgcatctacgcgtactacaagaagttcggctacaagaccgaggtgatgggcgcgagcttccgcacgccgggccagattctggaactggccggctgcgatctgctgaccatcagcccggatctgctgcaaaagctgcatgagagcaccgagaaggtggagcgcaagctgtcgccggatatcgccaaagaatcggacatcgaacgtgtgccggtcgacgagtcgtcgttccgtttcctcgtcaacgacgaagcgatggccaccgaaaaactcgccgaaggtatccgcgccttcgccgccgacgcaatcaagctggaaaagctgatc

SEQ ID NO: 31039 - DNA, 1134 bp, Burkholderia cepacia
cgtgtcatgctgctcggcgccggcgagctcggcaaggaagtgatcatcgcgctgcagcggctgggcgtcgaagtgatcgccgtcgaccgttacccgaatgcgcctggccaccaggtggcgcaccgcgcgcacgtgatcgacatgaccgatcgcgccgcgctgcgcgcgctggtggaacaggagcggccgcatctgatcgtccccgagatcgaggcgatcgcgacggacgaactcgccgccatcgaaagcgccggtctcgccgaagtgatcccgaccgcgcgcgccacgcagctcaccatgaaccgcgaaggcatccgccgtctcgccgctgaggaactcggcctgccgacctcgccgtacgcgttcgccgattcgctcgacgaactgcgcgcgggcatcgccaaagtcggctatccgtgcgtggtgaagccggtcatgtcgtcatcgggcaagggccagtcggtgctgcgcggcgacgccgacgtcgaacccgcatggcaatacgcgatggccggcggccgcgtgaatcacggccgtgtgatcgtcgaaggcttcatcgacttcgaatacgaaatcacgcaattgactgtgcgcgcgatcaaccccgcgagcggcgaggtcagcacgtatttctgcgacccgatcggccacgtgcaggtggcgggcgactacgtggaatcgtggcagccacagcccatgagcccgctcgcgctcgaacgttcgcgtgaagtggcgcacaaggtgacggccgcgctcggcgggcgcggcctgttcggcgtggaacttttcgtgcgcggcgatgacgtatggttttcggaagtgagtccgcgtccgcacgacactggtcttgtcacgctgtgctcgcaacgcttttcggaattcgaactgcacgcgcgcgcgatcctcggtttgccggtggatacgtcgctgcgggcgccgggtgcgtcggcggtgatttatggcgggctcgacgaggccggcattgcgttcgaaggcgtggccgcggcgttggcggtgccgaacgcggacctgcgcctgttcggcaagccggagagcttcgtcaagcgccgcatgggcgtggcgctcgccaccggcgagaccaccgacgaagcccgctcgcgcgcgaagcaggct

SEQ ID NO: 31040 - DNA, 1371 bp, Burkholderia cepacia
gccgccaacaccgatctcgaagtcaccgataaattcagcggcgaggtcgccacgcgtgtcgcgatggccgacgccgccgcgatcgatcaggcgatcggccatgccgtcgacgccatgccggccttgcgcgctttcccgccgttcaagcgccaggcggtgctcgaacattgcgtgaagcgctttcgcgaacgctacgacgaactggcgctcgcgctgtgcattgaagccggcaagccgatcaacgactcgaaaggcgaggtcacgcggctgatcgatacgttcaaggtggcagcggaggaagcggtgcgcatcgacggggagatcgtcaatctggagatttcgccgcgcgccaagggctatcacggctacgtgaagcgggtgccgatcggcccgtgttcgtttatttcgccgttcaattttccgctgaacctgactgcgcacaaggtcgcgccggccatcgcggccggcgtgccgttcgtgttgaagccggcgagccgcacgccggtcggcgcgctcatcatgggcgagattctcgcggaaaccgacctgccgaagggcgcattctcgattctgcccgcccatcgcgacggcgccgatctgttcaccaccgacgagcgcttcaaattgctgtccttcaccggctcgcccgcggtgggctgggaactgaagaagaaggcaggcaagaaaaaggtgattctggaattgggcggcaacgcggcggcgatcgtcgacggcgatcagggcgagaagctcgactatgtggttgaccggctcgcgttcggcgcgttctaccagtcgggacagagctgcatcggcgtgcagcggattctggtgcacgccaaggtctatgatgcgttgcgcgagaagctgatcgccagaacgaagtcgctggtgatgggcgatccgaaagacgaaaagacctttgtcgggccgatgatctcggaatcggagtccagacgccttgccggctggatggaaagcgcggtgcaggcgggcgcgaaaatcgtcgcgggcggcaaggtggagggcgcgatgttcgaggccacgctgctcgaaggcgtgcagcgcgacacggatctataccgcaaggaagccttcgggccggtggcgattctggagcgtttcgacgatttcggcgctgcgcttgcgaccgtcaacgacagcgacttcggcctgcaagcgggcgtgttcacggattcgctcgcgcatgcgcatcgcgcgtgggacgagctcgaagtgggcggcgtggtgatcaacgacgtgccgtcgttccgggtcgacaacatgccgtatggcggcgtgaaggattccgggctggggcgtgaaggcgttcgctacgcgatcgaagacatgaccgagatgcgcctgatg

SEQ ID NO: 31041 - DNA, 1395 bp, Burkholderia cepacia; identical to SEQ ID NO: 28284

SEQ ID NO: 31042 - DNA, 1920 bp, Burkholderia cepacia
tcgctcgacaccgccatcacacgcgccaccgatgcgatcctcgccgcgcaaaagccggacggccactgggtctacgaactcgaagccgacgcgacgattcccgccgaatacgtgctgctggtccactatctcggcgaaacgccgaacgtggaactggagcagaagatcgcgcgctatctgcgccgcatccagttgcccgacggcggctggccgctctttaccgatggcgcgcccgacgtcagcgccagcgtcaaggcgtacttcgcgctgaagatgatcggcgacccggcggacgcggagcacatggtccgcgcacgcgaggcgattctcgccaacggcggcgccgaagccgtgaatgtgttcacgcggattctgctcgcgctgttcggcgtggtgtcatggcgcgcggtgcccatgatgcccgtcgagatcatgttgttgcccatgtggttcccgttccatctctcgaaggtgtcctactgggcgcgtaccgtgatcgtgccgctgctggtgctcaatgcgaagcggccgctggcgcgcaacccgcgccgcgtgcggatagacgagctgttccgcggtgcgccggtcaacaccggcccgcgcgaccgggcgccgcatcagcatgccgggtggttccggtttttcagtggcgtggacatgctgctgcgcgcggtggacggcctgttcccgaaagccacgcgagagcgcgcggtgcgcgcggcggtggccttcgtcgatgaacggctgaacggcgaagacgggctcggcgcgattttcccggcgatggcgaactcggtgatgatgtacgacgtgctcggctatccggccgatcacccgaatcgcgcaatagctcgccagtcgatcgaaaagctgctcgttatcaaggatgacgaagcatattgccagccgtgtctgtcgccggtctgggacacctcgctcgtcgcgcatgcgctgctcgaaaccggcgaggctcgtgccgagcaggccgccgaacgtgggctcgcgtggctgcgtccgctgcagattctcgacgtgcgcggcgactggatttcgcgccgtccgaatgtgcggccgggcggttgggcattccagtacaacaacgactactacccggacgtcgatgacacggcggtggtggtcatggccatgcatcgctcggcggcgctcacgcattccgaggtcgatcgcgaagccatagcgcgggcgcgcgaatgggtggtcggcatgcagagcagcgacggcggctggggtgcgttcgagccggaaaacacgcagtactacctgaacaacattccgttctccgaccacggcgccttgctcgatccgccgaccgcggacgtctccggccgctgtctgtcgatgctcgcgcaactcggcgaactgccgcagggcagcgagccggcgcaacgcgcgttcgcgtacatgctgaaggaacaggagccggacggcagctggtatggccgctggggtctgaactacatctacgggacgtggacggcgctgtgttcgctgaacgcagccggcatgccgcacgacgacccgcgcatgaagcgcgccgcgaagtggcttctgtcgatccagaacgaagacggcgggtggggcgagggcggcgagagctacaagctcgactaccacggctatgaacgcgcgccgagcacggcttcgcaaacggcgtgggcgctgatgggcctgatggcggcgggcgaggtcaatcacgaagcggtggcgcgcggcgtcgcgtatttgcagcgggaacagcgcgagcatggcctgtgggacgaaacgcgtttcaccgccaccggcttcccgcgcgtcttctatctgcgctaccacggctatcgcaagttcttcccgctgtgggccctggcgcgcttccgccatctgaagcgtcatggcctgacgcgcgtcgcggtcgggatg

SEQ ID NO: 31043 - DNA, 237 bp, Burkholderia cepacia; identical to SEQ ID NO: 28286

SEQ ID NO: 31044 - DNA, 825 bp, Burkholderia cepacia; identical to SEQ ID NO: 28287

SEQ ID NO: 31045 - DNA, 1288 bp, Burkholderia cepacia
  unsure (1)..(1288): unsure at all n locations
cggctggatcgtctaccgatcggtcgattccattggcggttgctgggattaatcggtggcggcctgtttctcgacgngattcgaagtgtacgtcgccggcggtgtagtcggatttctcgtcaagacgggctgggcgaacatgcactctgcggcgatgttcgtgtcggccagtgtggctgggatggcgctcggcacgtggctcgcaggggtattaggcgaccgctttggccgtcggtttacgtatcagttcaatctgctgctgtttggtctggcgtcatttgcagccgcggtcgtttcgtcgatggatcagttgattgtcgcccgcttcgtcatggggataggcttgggtgcggaagtcgtcgtgagctatggcaccctggtcgaatatataccaccggctcaccggggcagatggtccagcggcctgtcgctatgcggtaatgcggcgctattcgtagccgcgctggtgggttatttcgtcataccggaccttggctggcggtggctgttcggtggagtcggcgttgccgccctgatcatctggtacatgcgcaaggcagttcccgagtccccgagatggctcgaatcccagggacgattcgaagaagcagaccgtatcctggacgacattgaacaggaactcgcgtacgtcggacagccgggagaagccgctgttcccgcctatgcagtggtgccggacctgccccgacgcatgctggttccgcggtttatcatcggcattatgatgagtgtggcgggtaacgcggcattctacggattgattgtctggctaccgaccttcttcttcaggcagggatttacggttggaagctcgctcggatattcgatggtcatgtccgccggaggtcctgcaggtgcgctggttggcatggctatcgccgatcgtgtccgccgcaagcgtgcaatcatcgttctgtcgatcgtggctgcattgcttggtcttgtctatccgctctgcaagaccccgttgagcgttctggttaccggctttctgcttgtgagcgcgctgtatgcgttcgtcgccgtggcgtgggcgtcatacctgccggagctttttcctacaagaatccggctgcgtgcctcggccgtatgcaacgtgaccggacggcttgcagcgatcgccatgccattcgcggtcgtccagctttacgcgaaattcggtgtgtttggcgtggtgggcgcattgggggggatcctgcttgcccaggctgcggtgattgcgttgctgggcatcgacaccaacaacgtctctcttgaggaactaacc

SEQ ID NO: 31046 - DNA, 1116 bp, Burkholderia cepacia
actgacgagcagcgaatgatccgcgacgcggcccgcgacttcgccacgcaatgcctggcgccgcacgcggcgaagtgggatcgtgacggcgacattccacaaaatatcgtttcgcagctcggtgagctgggcctgatgggaatgactgttccagcggaatggggcggtacctatacggattacgtcgcctatgcgctggccgttgaagaaatcgcggccggttgtgccgcatgcgcaacgatgatgagcgtgcacaattccgtcggatgcagccctatcctgaactttggaaccgacgagcagaagtcgctctatctggcggatctcgccagtgggcgcgcgatcggcgcgttttgcctgacggagcctcaagccggctcggaggcgcacaatctgcgcacccgtgcggtgttgcgcgacggaacgtgggttctcaacgggagcaaacagttcgtgaccaatggtcggcgtgccgcagtggccattgtgtttgcggtcacggatccggatgccggcaagcgcggcatctccgcgtttatcgtgccgacccatacgccggggttcaaggtcggcaagccggagaaaaagttggggatacgcgcatcggatacctgcccggtcacgctggaagactgcgccgtgccggagagcaccctgcttggccgtcgtggagaagggttgaagatcgcgttgtcgaatctggagggcggccggatcggcattgcagcccaggcgattggtatcgcgcgtgcagcatttgacgccgcacgctcatatgcagcgcagcggatccagttcggaaaaccgatacgggaacaccagtctgtcgcgaacatgctggctgacatgattacccgtctgaacgccgcacgcctgctcgttcatcatgcggcgcgtctgcgcagcgccgggctaccctgtctgtcggaagcgtcccaggcgaagctgtatgcatcggaagtggccgaggaggtttgctcacaagcgatccagatccacgggggatacggctaccttgaagactatcctgtggaacggcattaccgggacgcccggattacgcagatttacgaaggcaccagcgaagtacagcgcatggttatcgcaaggcagctt

SEQ ID NO: 31047 - DNA, 1772 bp, Burkholderia cepacia; identical to SEQ ID NO: 28290

SEQ ID NO: 31048 - DNA, 525 bp, Burkholderia cepacia; identical to SEQ ID NO: 28291

SEQ ID NO: 31049 - DNA, 993 bp, Burkholderia cepacia
atggcacgcaagatcacattttctcaggcaatcaacgaagcactgagtcaggaaatggcccgcgatgaaaccgtcatcgtgatgggcgaggacaacgcgggcggcgccggctccccaggcgagcaggacgcgtggggcggcgtactcggcgtcacgaagggcctgtttcacaagtatccgggccgcgtgctcgatacgccgctctccgagggtggctatatcggtgcggcggtgggcgcggccgcgtgcggcatgcggccggtggcggagttgatgttcatcgacttcatgggcgtgtgcttcgaccagatattcaatcaggccgccaagtttcgctatatgttcggcggcaaggcggtgacgccagtcgtgattcgcgccatgcagggcgccggcttgcgcgcggccgcacagcactcgcagatgctgacctcgctgtttactcacataccgggcctgaaagtggtgtgcccctccacaccgtacgacgcgaaaggcctgttgatccaggcgatccgcgacaacgacccggtgattttctgcgagcacaagctgctctatagccgcgaaggcgacgtgcccgaagagtcgtatgcgattccgttcggcgaggcgaacgtcgtgcgtgacggcgacgacgccacgatcgtcacgtacggccgcatggtgcattacgccacggaagccgcggaaaagctcgcgaaagacggtatcgaagtcgaggtgatcgatctgcgcaccacgtcgccgctcgacgaagacaccattctcgaaagcgccaaccgcacgggccgtgtcgtggtagtggacgaagcgaatccacgctgctcgatggccacggacatctcggcgctgatcgcccaacgcgcatttcgctctctgaaggcgccgatcgaaatggtgaccgcgccgcatacgcccacgccgtttgccggcgtgctcgaagacatgtacatcccttcggcccggcagattgccgacgccgtgctgaaa

SEQ ID NO: 31050 - DNA, 975 bp, Burkholderia cepacia
gtttcaacagagttgagcaaggacgaactgctgaaggcgtatcgcatgatgcgcacgatccgtgagttcgaggagcgcctgcacgtcgaattcgcgaccggcgaaatacccggcttcgtgcacctgtatgcgggcgaggaagcgtcggcggtcggcacgatgctgcatctgaacgacgcggactacgtggcgaccacgcaccgcggccacggccactgcatcgccaaaggcgtcgacgtgcgcggcatgatggccgaaatctacggccgcaagaccggcgtctgccacggcaagggcggctcgatgcatatcgccgacctgtcgaagggcatgctcggcgcgaacggcattgtcggcgcgggtggtccgctgatttgcggcgcggcgttggcggcgaagtacaagaagtcgggtggcgtgggcgtgtgtttcttcggcgacggagcctcgaatcagggcgtgattttcgaatcgatgaacctggcttcggtgtggcggctgcctgcgattttcgtggcggagaacaacggctacgccgaagcgacttcttcgacgtggtccgtcgcgaccgacaacatcgcggatcgcgcgagcggcttcggcatgccgggtgtgatcgtggacggtttcgatttcttcgcggtgcacgaagcgctcggcgaggcgatcgagcgggcgcgtcacggcggcgggccgacgctcgtcgaagtgaaattctcgcgctatttcggccacttcgaaggcgatgcgcaaacctatcgcgcgccgggagaagtgcagaaactgcgcgacgagaaagattgcctgaagcgtttcgaagagcgcgtggtgcgggcgggcatgctcagcgcggatcaattgcgcggcgtggatgcggaagtaaagaccttgatcgacacagccgtgaccgaagccaaggccgctccgctgccgactgccgaagacctgctgagcgacgtctacgtgtcctatccg

SEQ ID NO: 31051 - DNA, 1701 bp, Burkholderia cepacia
gcttcggcgacgcggcccacggcgcttgcaatgagcgtggccgttgccgtcagtctggtattcggatcggccgcagccgccgacgattacccagccgtcacctatgagcgtttgacagctgcgcagagcgaccccggctggctcacgtactaccgcacgtacaacggccaggcgcattcgccgctcaagcagatcgacaccgcgaacgtgaagaacctcaagcaggtctggagctacaagtttccggcggatctgcagcagggtttcgaagccacgccgatcgtcaacggacgctaccttttcgtgaccacgccgaaagacaacgtctatgcattcgatgcggcgaccggcaagcagttgtggaagttcgaaccgaagctcggtgcggaatcgttcaagacggcatgttgcgacgtgatcaaccgcggtgtggcgctgtacggcaagaatgtctacgtcgcgatgctgagcggcgacgtcgtcgcgctcgacgcgcagacaggcgcgctcgcctggcgcaagcagatgttcgagccgggtctcggctacgcgttctcgctggcgccgctcgcgctcgacggcgcactggtggtgggtagcgcaggcggcgaatacggcgcgcgcggttttatcgcggcattgaatccggataacggcaatgtgctatggaagcgcttcacggtgcccgcggccggcgagaagggcgcagacacgtggccgaacggcatgcaggaacacggcggcgcgccggcctggctgacgggcacttacgacgcagcatcgaagaccctttactggggcgtgggcaaccccggcccgtggctcgccgatctgcgaccgggcgacaacctctattccgattcgctactcgcactcgatccgaaaaccggcgatctcaaatggcactaccagtacacgaaacatgacacatgggactacgacggcgtgaatacgccggtgctcgcgacgatcaggtatcaggacaaggagtacgacgccatcatccacgcggaccgcaacggcttcttccacgcgatcgatcgcggcaccggcaagctgatctatgcgaagccgttcgtgacggcgacttcggtgacgggttataccgcagatggcgcgccgattcaggatgcgtcgaaatacccgaaggccggcacgacgatcgaaacctgcccgagcttcctcggcggcaaaaactggtggtcgatttcatacgacccggacaagcacatcgcagtcgttccggctttgcacgcctgcatgtcgctgtcgggcaaatcggtgaactacatggaaggcttgccgtatctcggcgaaggtttcgaaatcaaaccggagcccggcagcaagggttatggcgagttgcaggcgatcaacgtcgacacgggcaagaaagtctggagccactggagcaagctgccgtggaacggtggcgtagcgaccacggccggtggtcttgcctttagcggctcgctcgacggccacctgtacgcattcgatgaaacaaccggcaaggtgttgtggcagagcccgaagctggcaagcgggatcgtcgctcaaccttcggtgttcgaggtcgacggcaaggagtatgtcgccattctcgcgggctacggcggcgcgaatccgatctggggcgggccgatggcgaaggcggcggagaaggtcccgcgcggcggcacgttgtacgtgtttgcgctc

SEQ ID NO: 31052 - DNA, 1479 bp, Burkholderia cepacia; identical to SEQ ID NO: 28295

SEQ ID NO: 31053 - DNA, 1389 bp, Burkholderia cepacia
cagttctatatcgacggaggttgggtcgaacccacgtcacccgtctggttcgatatcgtcgatccgtcgacggaaacaccctttgaaaaactcgcgttgggcaacgcacaagatgtcgatcgcgccgtcgccgccgcacgccgcgcgtttgcaagctggtcggcgacgagcgtggccgaccgcgtcgcattgctcaagcgcatcgtcactatctacgagcgacgctacgacgagttcgccgagttgatgcgccgcgaaatgggcgcaccgatcacgttcgcgcgcaacggtcaggcggcacgcggccccgcgcatctgaatgcgctgatcgacgtgctcgaacgcttcgaattcgaggaacagcgcggcagtacgcgcatcgtgctggaaccgatcggcgtgtgcggtctgatcacgccgtggaactggccggtcaaccagatcgtcgtgaagatcgcaccggcactcgcggcgggttgcacgatggtgctcaagccgagcgagtattcgccgctgagcgcgctgctgtttgccgacgtgctcgacgaagccggcgtgccggcgggcgtgttcaatctcgtcaacggcgacgggccgggtgtcggttcggctatcgcgagccatccggatatcgacatggtgtcgttcaccggttcgacccgcgccggcgtgctggtcgcgcagtccgcagcggaaacggtcaaacgcgtcgctcaggaactgggcggcaagtcggccaacatcctgctcgacgacgtcgatctggatcaggcggtgacgcgtggcgtggccgcctgcttcacgaactcgggccagtcgtgctcgattccgacccgcatgctggtgccgcgtcatctgatgaacgatgccgcgcagatcgcaaagcgtgccgcgcaagcgtatcggctcggaccgaccgacgacccggccacgcaactcggaccgctcgtcaacgcgaaccagttcaagcgcgtgcaggcgctgatccagatcggcatcgacgaaggcgcgcgtctggtcacgggcggcacgggccggccggacggtatcgacacgggctattacgcacgcccgaccgtgttcgccgatgtcacgccgcaaatgaccatcgcccgcgaagaaattttcggaccggtgctctcgatgattccgtacgactcggaagagcaggcgatcgacattgccaacggcaccgactacggcctcgcggcctacgtgcaatccgcggacctcgcacgggctcgcaaggtcggccgcgcgttgcgtgcgggcggcgtgcatctgaattacccgcctgccgatttcggcgcgccgttcggcggctacaagcgttcgggcaatggccgcgaatggggcgaagcaggcctgcgcgagtatctggaaaccaag

SEQ ID NO: 31054 - DNA, 669 bp, Burkholderia cepacia; identical to SEQ ID NO: 28297

SEQ ID NO: 31055 - DNA, 1428 bp, Burkholderia cepacia; identical to SEQ ID NO: 28298

SEQ ID NO: 31056 - DNA, 744 bp, Burkholderia cepacia; identical to SEQ ID NO: 28299

SEQ ID NO: 31057 - DNA, 735 bp, Burkholderia cepacia
cttgtcgaccgcacggtgttgatcacgggcggcgcgactggcatcggcgcgtcgttcgtcgagcatttcgcggcgcaaggcgcgcgtgtcgcgttcttcgacattgacacgagcgccggtgaagcgctcgccgacgaactcggcgactcgaagcacaagccgctgtttctgccgtgtgacctgaccgacatcgacgcgctgcaaaaagcaatcgccgacgtgaaggccgccctcggtccgatccaggtgctggtgaacaacgccgcgaacgacaagcgccacaccatcggcgaagtcacgcgcgagtcgttcgacgcgggcatcgcggtgaatatccgccaccagttcttcgcggcgcaggcggtgatggacgacatgaaggcggccaacggcggctcgatcatcaacctcggttcgatcagctggatgctgaagaacggcggctatccggtgtacgtgatgtcgaaggcggcggtgcagggtttgacgcgtggtctcgcgcgcgacctcggccagttcaatatccgcgtcaatacgctggtgccgggctgggtgatgaccgggaagcagaagcgcttgtggctcgacgacgccggccgccggtcgatcaaggaagggcagtgtatcgacgccgagctggaaccggccgatctcgcccgcatggcgctcttcctcgccgccgacgacagcaggatgatcacggcgcaggacctcatcgtggacggaggctgggcg

SEQ ID NO: 31058 - DNA, 1518 bp, Burkholderia cepacia; identical to SEQ ID NO: 28301

SEQ ID NO: 31059 - DNA, 1092 bp, Burkholderia cepacia
tttagccagctatcgctgccgcccgcgacgctcgccaacctgacgcagctcggctacgtcgagatgacgccgattcaggccgcgagcctgcccatcgcgcttgccggccatgatctgatcgcccaggcgaaaaccggcagcggcaagactgcggcgttttcgctggcgctgctggcgcgcctcgacgtgcgcaactttgccgtgcaggcaatggtgctgtgcccgacgcgcgaactcgccgaccaggtcacgcaggaaatccggcgcctcgcgcgcgccgaagaaaacatcaaggtgctgacgttgtgcggcggcacgccgatgcgtccgcaaacggcgagtctcgaacacggcgcgcacatcgtggtgggcacgccgggccgcatcatggatcacctggagcgcggcagcctgccgctgcagtcgctcaatacgctggtgctcgacgaagcggaccgcatgctcgacatgggtttcttcgacgatatcgccaccgtcgtgaagcaatgcccgaaggaacggcaaacgctgctgttctcggcgacgtatcccgaaggcatcgtcaaactgagccagcaattcctgcgcaatccgaaagaagtcaaactcgcggaacggcacgacaacaccaagatccgtcagcgcttctatgaagtgaccgaagacgagcgtctgcacgcggtcggtctgctgttgaaccactatcgtccggtgagcacgctggcgttctgcaataccaagcagcaatgccgcgatctgctcgacgtgctgcgcgcgcagggttttcatgcgctcgcgctgcatggcgagctcgaccagcgtgaacgcgatcaggtgctgatccagttcgccaatcgcagctgctcggtgctggtggccaccgacgtcgccgcgcgcggtctcgacatcgcgcaactcgaagccgtgatcaacgtcgacgtgacgccggacccggaagtgcatgtgcaccgcatcggccgcacgggccgcgccgatcaggaaggctgggctttgagtctggcgagcatgaacgagatgggccgtgtcggcagtctcgaacaggcgcaaaagcgcgacgtcgaatggcacaag

SEQ ID NO: 31060 - DNA, 1155 bp, Burkholderia cepacia; identical to SEQ ID NO: 28303

SEQ ID NO: 31061 - DNA, 1596 bp, Burkholderia cepacia
gactttgtggtcgtcggcgcgggttcggcgggttgcgtgctcgcgaaccggctttccgaaggcggccgctactcggtatgtctactcgaagccggcccggccgatcgcttcatgtggattcatatccccatcggttatggcaagacgatgtttcacccggtctataactggggcttctataccgatcccgatccgaacatgcacaatcgccggctctactggccgcgcggccgcacgctgggcggcagcagttcgatcaatggcctgatctacgtgcgcgggcagaaggacgattacgaccactgggcgcggctcggcaatcgcggctggggctggcaagactgcctgccgtatttcaggcggctggaacacaacgaattgggcgaggggcccacgcgcggtgtcgacggcccactgtgggcctcgaccatcaaacagcggcatgagctggtcgatgcgttcattgcggcgtcgaattcgttaggcgtggaaaccgtcgaggacttcaatacgggcgatcaggagggcgtcggctactatcagctgactacccgccgcggcttccggtgctcgaccgccgtcgcctatctgaagcccgcgcggcaacgcaggaacctgcgggtggaaaccgatgcgatggcctcgaaaatcctgttcgagggaacccgcgcctgcggggtgcagtatcggcaacacggcgagttgcgggaagtgcgcgccgatcgcgaagtgatcctgactgccggcgcgctgcagtcgcctcaattgctgcaactgtccggcgtgggaccggcggcattgctgcgcgagttcgggattcccgtggtggccaatcgcgcgggcgtcggcgaaaacctgcaggaccatctgcaaatccggctgatctatgaggtcaccaaaccgattacgaccaacgatctgctgcgctcgtggaccgggcgcgccagaatgggcctgcaatgggcgctgatgcgcggcggcccgctcgcggtcggcatcaaccagggcggcatgttctgccgggcgttgccggaggaatcggcgacgccggacatccagtttcatttctccacgttgtcggcggactccgccggcggcaatgttcatgactttcccggctgcacttactcgatctgccagttgcggccgcaatcgcgaggggtggtgcgcattcgcagcgtcgatccgcgtgaagcgccgtccattcagccgaactatctggacaccgatctggaccggcgcacgacgatcgccggtgtgcgtttcgcgcgccgcgtcgcggccgccgagccgatggccgcgctgatgaaacgcgagttgcgcccaggcgcgcatgcgcagaccgacgacgaactgctggatttctgccgggagtacggacagacaattttccatccatctggtacagcaaagatgggcacggccggcgatccgctcgcggtggtcgacgagcgcctgcgcgtgtacggcacacaggggctgcgcgtggtcgattgctcgatcatgcccacgctcgtgtcgggcaatacgaacgtgccgatcgtgatggtggctgaaaaggcgtcggacatgattctgcacgacgcaagcggtgtc

SEQ ID NO: 31062 - DNA, 1572 bp, Burkholderia cepacia; identical to SEQ ID NO: 28305

SEQ ID NO: 31063 - DNA, 1206 bp, Burkholderia cepacia; identical to SEQ ID NO: 28306

SEQ ID NO: 31064 - DNA, 2082 bp, Burkholderia cepacia
gaatgcggctatgcctgcctggcaatggtgctctcgcacctgggccgcgccactgaagtgcgcgagctctccgcattcaggccgatatcggcgaacggcctgtccttgatggacctgtacgacgtggcgaccgaattcggcctcgccgtgcaggcttaccggttcgacgtcgcggatctgccgtcggtgaagcgaggctcgattctccactttggtggcgcgcatttcgtggtgttcgagaagtgcggtcatggctatgttcaggttgtcgatcctgccagcggccggcggcgggtttcgatggacacgttcgtggcgagcgtgtccggctatctgctcgaatgctcggccacccctgcaatgccgcgcattcgcgcgaaatcgcaggtgcccggcgcgttggcgcgcgtgcgggcgttgaatcccgcactgcgcaagcaactggcgaaagtcatgttcgtcgcgctgggcagccagttcgcgatcctcgccatgccctatctgggcaatctcgtactcgactacgtggtctcggctgacaacatgaatctgctgggcgtgctggtgctgacatttgccggcatcttcgcggtcggtgcgctcagtcagtatgtggagacgcgtcttgtcgaattgctgcatcagcttacgcagatcaacatgaccgaggggctgctcggccatcttctgcgcaatcccatgtcgtggttcgagaagcgccatgtcggcgacgtgttcgcgcgcatcaaggcgcaggacgaaatcagcgtacacgctacccgaaccgtgacgtcgatgtgcatcgacatcgccgtggggtcgctcgcactcgttctgatgctcgtgcaaagccgcatgctgacggccgtcgcggtgggcatgttcgtcgtctatcttgcggtcgcgctgggtatgttcgcccgcatgcgggacaaccatgcactggtgctcgaaacgtcggcgcgttgcgacgatgcattgatcgagacgatccgcgcggcgagcctgatcaagctcgcccagggcgagacgcgccgcacggcgcttttcatgatcaagtacaaggaatatgtgagcgcgctgctggcgagtaaccggctgaccagcgcgcgcgacgcaatcctcaagctggtccagtacgcggacacgattgcgatcacctggttcgccgcgcggctgatgctggccggcaccgtttccgtgggcgttttctattcgtttctgatctacaagtcgctgatgtccgagcgctttgcacacgcggtcaacggtgcgtttgcctacttcatgctgagtgtgccgactgcgcgtgtggcggatatcgtcgagtgcgaagaggagcgatacacgccgctggccgactgcaaccgcgtgaccgagatgcgcaagttcgagcgggtcgaagtgcggaatgtgacgtttcgctacggcgtgtccgaccagccggttctgcgggatgtgagcatcgatatccggcacggcgacaagatcgccattacggggccgtccggcgcggggaaatcgacgttgttcaaactgctgtcggcttccgaaccgcttcaggaaggccagatagcactgaacggcattgcatggcccaatctgaccgtcgacgagatccggcggcatgccgcacacatgcgtcagggcgacctgattctgcacggctcgattgccgagaacatcaccctgtttgcggccagcatcgacgaagaccgcgtgcacgcgctactcgaagacgtgggcttactacaggacgtcatgcgtctgcccatgcgcacacgaaccgtcattagtgacacgatcgcgaacatttcggcgggccagcggcagcgcttgctattggcgcgcgcgctctatcagggccgcagtctgctgctgctcgacgaaccgacgtccaatctcgatccggcttcggtgcagcacgtcgccgctttgctgcgccggctggattgcacggttgttgtgattacacacgaccggtcactggccgccgcgttcgacgttcgctatcgcctgatggacggcgcactggtgccggagatgcccgatcatccgcatcggttgcgggagccggcccat

SEQ ID NO: 31065 - DNA, 681 bp, Burkholderia cepacia
gacgacggcgacctcgaagccgcgcaggcggaactggccgacgtggtcagcgaggtgctggcgggtggcggacgcccgctggtgttgggcggcggtcatgaagtcgcgtggggcacatatagcggtttgcggctgcaccagcagcgtgaagccgagaatgaagccacgctgctcatatcgcgcaagctgctgatcatcaacttcgacgctcacttcgatttgcgtcagaagcgccccgcgaattccggcacgccgttcgatcagatcgcgcttgactgtgcggagcgaggggtgccgttcaattatgcgtgcttcggcatcagcgatctcagcaatacagcctcgctgttcgcccatgcggagcgacttggcgtgcactacgtgttcgacgtcgatatgcaggaaacgcaattgccgcagcgtctgaatgagcttcagaagttgctggacgcggcggacgacgtctatctgacgatcgatctcgacgtgttgccggccgccacggcgccgggtgtctcggcgcccgctgcgctgggcgtaccgctatccgtgatcgaagcgatggtgctgcgcgtgcgggcttcgggcaagctgcgcgtggcggatatcgcggagtacaacccaacgctcgatcaggacagacgcaccgcgagagttgccgcgcgactggcgtaccggttg

SEQ ID NO: 31066 - DNA, 1452 bp, Burkholderia cepacia
cgaatcgaccatctgatcaacggcaaatcgggcgccgcgaaagactacttcgaaaccgtcaatccggccacgcaagaggtgctcgctgaagtagcccgcggcggcgccgaagaagtggacgccgccgtgcgcgccgccaaagacgcgtttcccgcatgggccgccaggcccgccgcggaacgcgcgaagctggtccgcaagctcggcgaattgatcgcgaagaatgtgccggaaatctcggagaccgaaacgaaggacaccgggcagacgatctcgcagacgcgcaagcaactcgtgccgcgcgccgccgacaacttcagctacttcgccgaaatgtgcacgcgtgtcgacggccatacgtatccgaccgatacgcacctgaactacacgctgtttcatccggtcggcgtctgcgcgctgatctcgccgtggaacgtgccgttcatgacggcgacctggaaggtggcgccctgtctcgcgttcggcaatacggccgtgctgaagatgagcgaactgtcgccgctcacggccgcgatgctcggcaatctcgcgctcgaagccggcattcccgccggcgtgctgaacgtggtgcatggcttcggcaaggaaaccggcgaaccgctggtcgcgcatccggacgtgcatgccgtatcgttcaccggatcgacggcgactggcaaccgtatcgtgcaaaccgcagggctgaagaagttttcgatggaacttggcggcaagtcgccgttcgtgattttcgacgacgccgacttcgagcgcgcgctcgacgccgccgtgttcatgatcttctcgaacaacggcgaacgctgcacggcgggttcgcgcattctcgtgcaacggggcatttacgcgcgtttcgccgagcgtttcatcgagcgtgcgaagcgtttgagcgtgggcgatccgctgtccgacagcaccattgtcggccccatgatcagccagggccatctggcgaaagtgcgcagctatatcgaactgggtccgaaagaaggcgcgacgctcgcgtgcggcggtctcgatctgcccgagttgcccgacgcgctgcgcaaaggcaacttcgtccagcctaccgtgttcgtcgatgtcgacaaccgcatgcgtatcgcgcaggaagaaatcttcggcccggtcgcctgcctgattccgttcgacgacgaagccgacgcgatcgagctcgccaacgacatctcctacggcctgtcgagctacatctggaccgagaacacgggccgcgcgctgcgcgtcgccgccgccgtcgcagcgggcatgtgcttcgtcaacagccagaacgtgcgtgatctgcgccagccgttcggtggcaccaaggcatccggcgtgggtcgcgaaggcggtacatggagctacgaagtgttcctcgaaccgaagaacgtttgtgtgtcgctcggctcgcatcacattccgcgctggggcgtt

SEQ ID NO: 31067 - DNA, 1473 bp, Burkholderia cepacia
cagttgggccactatatcggcggcgcgccggccgcgccgaccagcggccgcttcaaggacgtgttcaatcccgccaccggcaaagtcaccggttcggtcgccctcgcttcggtcgaggaagtggacgcggcagtgcaggccgccaaggccgcctttcccgcctggagcgaaaccgcgccgctcaagcgcgcgcgcattctgttcaggttcaaggagttgctcaaccagcatcacgacgaactggcgatgctgatcacgcgcgaacacggcaaggtgttcacggacgcacaaggtgaagtggtgcgcggcatcgaagtcgtcgaattcgcgtgcggcattccgaacctgctcaagaccgatttcaccgaccagatcggcggcggcatcgacaactggaatctgcgtcaggcgctcggtgtggtcgcgggcatcacgccgttcaacttcccggtcatggtgccgatgtggatgttcccggttgcgctcgcctgcggcaatacgttcgtgctgaaaccgtcggagcgtgatccgtcggcgtcgctgcggattgccgaactgctgaaggaagccggcctgcccgacggtgtgttcaacgtcgtcaacggcgacaaggtggccgtcgatgcgctgatcgatcacccggacgtcgcggcgctgtcgttcgtgggctccactccgatcgccgaatacattcacacggaagcgtcgaagcgcggcaaacgcgtgcaggcactcggcggcgcgaaaaatcacctggtggtgatgccggacgcggatctggaccaggcggtcgacgcgctgatcggcgcagcctacggttcggcgggcgagcgctgcatggcgatctcggtcgcggtggcggtcggcaatgtggccgaccaactgatcgagaaactggtgccgcgcgtcaaatcgctcgtgatcaggaacggcgaaaatctcgacgctgaaatgggtccgctggttaccgccgaacataaggccaaggtggccggttatatcgcgtcgggcgaggcggaaggcgcgaagctgatcgtcgacggccgcgcgcatccggtggcaagcgaagaaggcttctttatcggcggtacgctgttcgacaatgtcggcacgcagatgaagatctacaaggaagagatcttcggcccggtgctggcagtggtgcgggtgcccgatttcgcgagcgccgtggagttgatcaacgcgcacgaattcggtaacggcgtgtcgctcttcacgtcggatggcggggtggcgcgcgcgttcggccggcagattcaggtgggcatggtcggcatcaacgtgccgattccggtgccgatggcatggcattcgttcggcggctggaagcgttcgctgttcggcgaccatcacgcttacggcgaagagggcgtgcgcttctatacgcgctacaagagcatcatgcagcgctggccggatagcatcgccaaaggtgctgaatttacgatgccg

SEQ ID NO: 31068 - DNA, 1080 bp, Burkholderia cepacia; identical to SEQ ID NO: 28310

SEQ ID NO: 31069 - DNA, 735 bp, Burkholderia cepacia
aaggttgcgctcatagccggtggcgcgaaaaacctgggcggcctgatcgcccgcgatctcgccgcccagggcgcgagagccattgcaattcactacaacagtgccggcagccgggcgcaagccgatgccacggtcgaagcaatccgcgccgcgggcgccgaagcggtggcgtttcaggcggacctgacccgcgcgggcgcggtcgagaaactgttcgccgatgcggcggccgcgatcggcaagcctgacattgccatcaacacagtcggcaaggtgctgaaaaaaccgtttgtcgagatcagcgaggccgagtatgacgagatgaccgcggtcaattcgaagaccgctttcttctttctcaaggaagcgggcaagcacgtcaacgacaacggcaagatcgtcacgctcgtcacgtctctgctcggtgcattcacgccgttctacgccgcgtacgccggcaccaaggcgcctgtcgagcactacacgcgcgcggccgcaagggaatatggcacgcgcggcatttcggtcaccgccgtaggcccgggaccgatggacacgccgtttttttatcctgccgaaggcgaagacgcggtcgcttaccataagaccgccgcggcgctatcatcgttttccagaacgggcctgaccgacattcaggacgtggtaccgtttatccgccatctggtcagcgacggatggtggatcaccggccagaccatcctcgtcaatggcggc

SEQ ID NO: 31070 - DNA, 906 bp, Burkholderia cepacia
ggacgcgtcgtcattctcggcatctacgtcaccgatctgacgtttcgcgccggtcgcatgccgcagatcggcgagaccatcgcgggctcggcgttcgcgatggggccgggcggcaagggctcgaatcaggcggtggcggccgcgcgcgccggcgccgacgtggtgttctgcacccgcatcggcaacgacgcgttcggcgcgattgcgcgcgccacgtgggccgctgaaggcatcacggcgcgcgcgtcggtgatcgaaggcgtctcgacgggcgcggcgcatattttcgtcgacgacaacaccggcatgaacgcgatcatcgtcgcctccggcgcggccgggacgatggagcccgccgatgtcgacgcaatcgaagccgacatcgccgccgcgcgggttttcgtcacgcagctcgaacagccgctcgaggccgcgcgccgcgggctcgaagtggcgcgccggcacggcgtcatcacagtgttcaatccggcgccggcgttgccgctcgacgacggcatcttcccgctgtgcgactacatcaccccgaatgaaaccgaagcgaccgcgctcaccggcgtgccgatcgcgaacgccgacgacgcccgccgtgccgccgacgtgctgctcgccaaaggcgtcggcacggtcatcgtcacgctgggcgagggcggcgcgctgctgcattcggcggcgcaatcgatcctcgtgcccgcctatcactgcggccgcgtggtggaaaccgcgggcgccggcgacggcttcacgggcggcttcgcggccgcgctcgcacgcggcgacgacgccatgaccgcattgcgtttcggctgcgcactcgcgggcatttccgtgacacgtccgggcacggcgccttccatgccgacgctcgacgaagtgaaccaggttctg

SEQ ID NO: 31071 - DNA, 1362 bp, Burkholderia cepacia
ttcatcggcggtgcgtggcatgcgcccgcggccggcgagcgctttgcctcgcacgcgcccgcaacgggcgagcggctcgcggatatcgcccagggcgatgctgccgatatcgacgccgcggtggccgccgcgcgtgccgcgcagccgggctggttcgcgttgggcggcgcgggccgggcgcggcatctgtatgcgctcgcgcgcatggttcagcgccatagccggctcttcgccgtgctcgaagcgctcgacaacggcaagccgatccgcgagacgcgcgatatcgacgtgccgctggtggcgcggcacttcctgcatcacgcgggttgggcgcagttgcaggagagtgagtttgccgattacgcgccgctcggcgtggtcggtcagatcgtgccgtggaattttccgctgttgatgctcgcgtggaagatcgcgccggctattgccacgggcaactgcgtcgtgctgaagccggccgaatatacgccgctcaccgcgttgctgttcgccgaactcgcgcatcgcgcgggtctgccggccggcgtgctgaacgtggtcacaggcgacggacgcaccggcgccgctttggtcgagcatccgcaggtcgacaagatcgccttcaccggctcgacggaagtcggccggctgatccgctcggccacggccggctccggcaaatcgctgacgctcgaactcggcggcaagtcacccttcatcgtgttcgacgacgcggatctggacggcgcggtggaaggcgtggtcgacgcgatctggttcaaccaggggcaggtgtgctgcgcgggctcgcggctgctcgtgcaggaaggtgtcgaggcgcggttcatcgcgaagctgaaacggcgcatggcgacgctgcgcgtgggtacgtcgctcgacaagagcatcgacctcggcgcgatcgtcgatccggtgcaactcgaacgcatccagtcgctggtggaaaccggccggcgcgaaggctgctcggtctggcaatcgcctgagacgaccatgcccagcggcggctgcttctatccgccgacactcgtgaccggcgtggcgccggcttccacgctggcgcaggaagaaatcttcggcccggtgctggtgacgatgagctttcgtacccctgatgaagcgatcgcgctcgccaacaactcgcgttacggactcgctgcgagcgtgtggagcgagaccatcggccgcgcgctcgacgtcgcgccgcgtcttgcatgcggcgtcgtctggatcaatgcgaccaatctgttcgacgcggcggtcggcttcggcggctatcgcgaatcgggttacggccgcgagggcgggcgtgagggcatctacgaatatctgaaaccgcgggcg

SEQ ID NO: 31072 - DNA, 888 bp, Burkholderia cepacia
ttgcctatcgtcgatgtcagcggcctcttcagcgacgacatagaccgccgactcgccaccgcccgcgaactggatcgcgccgcacgcgaggccgggttcttttacgtcaccggccatcaggtgtcgcgcggacagcagggcgcgctgatcgagcaggccaaacgcttctttgccgccgggcacgactggaagatgcgctattacatcggcaactcgagcgcgcatcgcggctatgtgcccgaaggcgaggaagtcttcgcgggcggcaagcgcgacaggaaggaagcgttcgacacaggccgcgaactgcccgccgacgaccccgacgtgattgccggcacaccgatgctcggctcgaatagctggcccgaacaaccgggttttcgcgaggcggtgggcggctactatgaagcgtcgttcgaactcggccgcgcgttgtttcgtggcttttcgctcgcgctcggcttgcccgagcagcacttcgagcgctatctacgcaagccgccgagccagttgcgcctgatccactatccgctcgatccgtcagccgaagaccggccgggcatcggcgcgcataccgactacgagtgcttcacgatcctgctgccgaccgcgcccggtctcgaagtgatgaacggcaggggcgagtggatcgatgcgccgccggtcggaaacgcgttcgtcgtgaacatcggcgacatgctggaagtgtggacgggcggcacctatgtcgcgacttcgcatcgtgtgcgcaaagtgcgggaggagcgctattcgttcccgctctttttcgcctgcgactatcacacggtggtcgcaccgctgccgcagttcgcgacacccgaggcggtggcgaagtatccgcccgtgtcggcgggcgaccatctg

SEQ ID NO: 31073 - DNA, 636 bp, Burkholderia cepacia; identical to SEQ ID NO: 28315

SEQ ID NO: 31074 - DNA, 1170 bp, Burkholderia cepacia
cagtttcactgggaagacccgttgctgctggatcagcaactcaccgaagacgaacgcatggtgcgcgacgccgccgcggcttacgcgcaggacaagctccagccgcgcgtgctcgaagcattccgtcacgagaagaccgacatcgagatctttcgcgagatgggcgagctcgggctgctcggcccgaccattcccgaacaatacggtggtcccggcctgaactacgtcgcttacggcctgattgcgcgcgaggtggagcgcgtcgattccggctaccggtcgatgatgtcagtgcagtcgtcgctcgtcatggtgccgatccacgcattcggctccgaagcgcaaaagcagaaatacctgccgaagctcgccaccggcgagtggatcggctgcttcggcctgaccgagccgaaccacggctccgatccgggcagcatggtcacgcgggccaaaaaggtcgacggcggctattcgctgtcgggctcgaaaatgtggatcaccaactcgccgatcgccgacgtgttcgtggtgtgggcaaagctcgaagaaaacggcaaggacgcgattcgcggcttcattctggagaagggctggagagggctgtcggcgccgaccatccacagcaaggtgggtttgcgcgcctcgatcaccggtgagatcgtgctcgacgaagtgttcgtgccggaagagaaccgtttcccggaagtcagcggtttgcgcggtccgttcacctgtctgaactcggcgcgctacggcattgcctggggcgcgctcggcgcggccgaagcatgctggcacaccgcgcgccagtacgtgctggatcgcaagcagttcggccggccgctcgccgcgaaccagctgatccagaagaagctcgccgacatgcagaccgagatcacgctcggactgcaaggcgtgctgcgtctcggccgcatgaaggacgaaggcaccgcggctgtcgagatcacctcgatcatgaagcgcaattcatgcggcaaggcgctggatattgcgcggcttgcacgcgacatgctcggcggcaacggcatctcggacgagttcggcgtcgcgcggcatctggtgaatctggaagtggtgaacacctatgaaggcacgcacgacattcacgcgctgattctggggcgcgcacaaacaggtattcaggctttc

SEQ ID NO: 31075 - DNA, 1275 bp, Burkholderia cepacia
tatcagtcgggtttcgcgaacgaattcgcgacagaggcgttgccgggcgcgttgccggaaggccgcaactcgccgcaacgcgtggcctatggtctgtacgccgaacaggtgtcgggcacggcgtttactgcgccgcgcgcccacaatcgccgttcgtggctgtaccggattcgtccggcggcggtgcacaagccgttcacgccgctgccctcggagcggctcgtcgccaacttcgccgaggtgccgcccacaccgccgaaccagttgcgctgggacccgctgccgatgccggccgagccgaccgatttcatcgacggctgggtgacgatggcgggcaacggcgcggcggaatcgatgagcggttgcgcgattcacctgtacgcggcgaaccgctcgatgcaagaccgcttcttctatagcgccgacggcgaattgctgatcgtgccgcaggaagggcgtctcgacattgccaccgaaatgggccggctcgaagtcgaaccgttcgagatcgtggtgattccgcgcggcgtacgcttcgcggtgagcctgccggacggcgcggcgcgcggctacatctgcgagaatttcggggcgttgctgcgtttgccggacctcggaccgatcggctcgaatgggctcgccaatccgcgcgatttcctcacgccgcatgcggcctacgaggatcgtgagggcgacttcgaactcgtcgccaagctgaacggcaacctgtggcgcgcggatatcggccattcgccgctcgacgtggtggcgtggcacggcaactatgccccatacaaatacgacctgcgccgcttcaacacgatcggctcgatcagcttcgaccatccggacccgtcgatttttctggtgctgcaatcgcaaagcgatacgccgggcgtcgatgcgatcgacttcgtgatcttcccgccgcgctggctggcggccgaagatacgttccggccaccctggttccatcgcaacgtcgcgagcgagttcatgggcctcgtgcacggcgtgtacgacgcgaaggccgagggcttcgtgccgggcggagggagtctgcataactgcatgtcgggtcacggcccggatgcggacacgttcgaaaaggcttcgcatatcgatacgtcgaagccggcgaaagtcggcgacacgatggcctttatgttcgagacgcgcacgctgatcaagccgacccgtttcgcgctcgaaaccgcgcaattgcaggcgcattactacgagtgctggcaaggcctcaagaaacatttcaatccg

SEQ ID NO: 31076 - DNA, 1596 bp, Burkholderia cepacia
gaagaccggacgatgggccgcatcctggcggacaaggcgcagcgtattccggacaggactttcctgatctggcaggaccgccggtacacctatgcggaactggagacgatcaccaaccgctacgccaacggctttatcgcgcacggcatcggctacggcgaccacgttgcggtgatgctgcccaattgcccggagtttttctgggtggtgtggggcttgagcaagatcggtgcggtggcggtgccgatcaataccgccgcgaaaggcgagctgatgcgctatttcctcgataaatcggactcggtgtgtttcgtcgtcgatgaagaatggagcgagcgggtcgccgcaatcagaagcgaggtgccgcaaatcaggcagtatttcatccacggcggcaacggtgtgccgagccttccggacaacgcggaaagcaccgtccatgcgctgtccgagctcgaatcggacgacgcgagccagccgccgctcgaccgtgtcgcttacgacgacacgcagctcatcatgttcacgtccggcacgaccggaccgtcgaaaggcgtgcaatgcccgcattcgcaaggtcatgcggtgggtcgcgcgctgacggtcgatttcggctatcgggaggacgacgtgctgtacacgtgcctgccgctctttcacggcaacgccgcgtattactcgtgttacgcggcgctctgggccgatgcggccatcgcgctcgcgccacgcttttcggccacgcgcttctgggacgacatccgccgaaccggcgcgacgcagttcaatacgctcggcgcgatgaccaacatcatctggaagctgccgcccggtccgcatgagcgcgaaacgaagctgcgcctgtgcatggcggtgccggtgcccaaagagatctactccgagtttcaggaacgcttcggcgtggtgctgacatccgtgttcgcaatgacagaaaactttgcgatgacgcgcttcacgccctcggacccggcggaaaaagccggctcggccggcaaaccgcgcggcgaatgcgaactgcgcatcgtcgccgacgacggcaccgacctgcccgccggcggggtcggtgaaatctacatgctgccgctcaaacccggcagcatgatgaagggctactacaggatgccgaaggaaacggcgcgcgaattcgacaatggctggttcaagaccggcgatcgcggctatctggacgaagacggctacctgtttttcatggaccgcaagaaggaagcgattcgccggcgcggcgagaatatttccgcgtacgaggtggagctgattctgtgccgccatccggcgattcatgaagtggccgcgattccggtcgcctccgaactgagcgaagacgacgtgatggtgtatgtcgtgctgaagcccggcgagtcgatgacgcatgcggacgtcgtgcatttcagcgccgagcacatgagctatttcatggtgccgcgctttgtcgagttcatcgacaaactgccgaagaccgccagcgaaaagctcgaaaaatacaagctgaaactcgatgccgacgcgcgccgcgcgcagctttgggaccgcgagcgcgagggaatcgaagtacgccgc

SEQ ID NO: 31077 - DNA, 1986 bp, Burkholderia cepacia
atgttcgaatccattcttatcgcgaaccgtggcgaaatcgcctgccggatcgcacgcaccagccgccggctgggcattcgcgtcatcgctgtctattccgacgcggaccgtggcgcgcgccatgttcgcgaggccgatgtcgcggtgcggatcggtccggcggacgccacgcgcagttatctcgacgccgacgcgatcatccgcgcggcgctcgaaaccggcgcgagcgcgatccacccgggctacgggtttttgtcggagagcacgcagcttgtcaaccgctgcgccgagcacggcattgcgtggatcggtccacgcggcgacgtgatcgagcgcatgggctcgaagatcgaatcgaagcgtatcgccgccgacgcgggcgtgccgtgcgtgccgggttaccacggcgataaccagaagctcgagcatctgctcgaacaggcgcgcgcaatcggcgcgccgcttctgatcaaggcgagcgccggtggcggcggcaagggcatgcggcgcgtcgacgacctcgacgatttcgccgcgcaactgagcatggcgaagcaggaagcactgcgcgcattcggcgacgaccgtgtgctgatcgaaaagctgatcctgcggccgcgccatctggaagtgcagcttgcgggcgaccgtcacggcaacctcgtccatctgttcgagcgcgaatgctcgatccagcgcaactatcagaaggtgttcgaagaagcgccggcgccgcgtctcgcgccggccgtgcgcgaaaaactgctcgacgccgcgctgaagctcggcaacgcgatcggctacgactcgctcggcacggtcgaattcgtgctcgccgaggacgccgatacgccgtacttcctggagatgaacacgcgcctgcaggtcgagcatccggtcaccgaaatggtcacgggtctcgatctggtcgaactgcagatccgcattgccgcgggcgaaccgctgccgatgcagcaggacgcggtcgctgtcacaggctgggcagtcgaggcgcgcatcaattgcgaagaccctgcgcatgggcatcggccggagttcggcacggttgcgcgatatagcgagcctgcgctggccggcgtgcgtgtcgacagtggtatcgaaagcggctcggaaatcgcgccgcactatgattcgatgatcgcgaaggtgatcggttacggcgcgacccgtacgcaggcggtcgagcgtttgcgtgccggcctcggcgcgttcgaggccgccggcatcggcaccaatcagagcttgctgtgcgcgatcgcggatcactcgctgttccgcgcgggccgcttgaccaccggctttctcgcggaagcattccccggcggctggcacgacgacccggcggacttccgctacgcggtgtgcgccgccgtgctgcatcggctcgcggcacgcgcggcgccgggtcccgattactggcacaggcaaagcggacaccgcttcatggcggcggcggggcggcgggcggccgcgcgcatgcgggttgccctggacggcgacgaacagccggtcagtgtcgaacgcgatggcgagcactggctcgtaaaaaccggcgacgaggccgcgctcgatctccaggtgcgcgcgcttgccgaggaccagttgctgctgctgccgatgcatggcgtgccgcgccgttacacgctcaccgccgacggtgcgcatctattcgtcaatcacgtcggcacgcgctggcgcgtgctcgttgtgagcgaagtggaagcgctggcgcgcgtggctgcgcaagcgggcgtgcagggcagtgaagtggcatcggaaatgccgggcgccgtgacggcaattcatgtcgcgcccggcgaccaggtggccgcgggcgacgtgctggtcgtgatggaagccatgaagctgatctttccgctggtcgcgccgcgcgacggcacgatcgccgtggtccgttgcgcgctcaacgaaatcgtgccgcgcggccatgtgctcgtgcagctg

SEQ ID NO: 31078 - DNA, 1128 bp, Burkholderia cepacia
ttcagcgaagaacacagcatgttgcgcgacgtgatacgtcgcttcatcgccaaagaggtgctgccattcgcggatcagtgggagatcaatggctatgtgccgcgcgagctgctgcgcaagatgggcgagcagggttttctcggaatccggcagtccgaagcatttggcggtgcggcaatgaatgtgctcggcacagtggtgcttgccgaagaattgggccgctccaccttcggcggttttgcgatcacggtgctggttcatacggacatggcgtcgccgcatctgcagcatgcgggcaatcccgcgcaactcgaacggctgatgcccgatctcgtcgcgggccgcaagatcgccgccgtcgccatgacggaagcgggcgcgggttccgatctggcgtccatgcgcaccacggcgcgtctggacggtgaccattacgtgctgaacggcgcgaagatgttcatcaccaacggcgttcacggcgacatctatttcgtcgcggccaaaaccggcggaccgggccgcagtcatggcggcatctccatgttcattgtcgagaagggcatgccgggcttctccgtcgcgcggccgctgagcaagcagggctggctgtcgtccgatacggcggaactggtgttcgacgaatgccgcgtgcccgtgcaaaacctgcttggcgaagagaacaagggtttttattcgctggtcaggaatctgcagaacgagcgcatcacgcttggcgcgcaggcgctgggcgaagcatccagagccatcgagatcacgctcgattacgttacccagcgcaccgctttcggccagacgctgtgggagaaacaggcgatccgtcagaagatggcgatgctgctcgcgaaggtggaagcggcgcggcaactcctttacaacactgcatggcgcgatgcgcaagggcaaacggtcgtcgcggaagtctcgatgatcaaggcgctgtgcggagaactcgtcaacgaagtgatgtacgcatgccagcagtttcacggcggcttcggctatatgcgtgaagcgccgatcgagcgaatggtgcgcgatgcccgtgtgcagtcgatcggcggcggcgcgaccgaggtgatgctcgaagaagttgcgaagcggatggta

SEQ ID NO: 31079 - DNA, 1764 bp, Burkholderia cepacia; identical to SEQ ID NO: 28321

SEQ ID NO: 31080 - DNA, 1302 bp, Burkholderia cepacia
ccgagcatgtccaacccgccgccagccgtacgccgcgtcgccataatcgggggcaaccggattccgtttgcccgctcgaacaccgcctacgcgaccgcgtcgaatcaggacatgctgaccttcacactgcaaggcctgatcgaccgctacaacctgcacggcgaacggctgggcgaagtcgcggcaggcgctgtcatcaaacattcacgcgacttcaatctgacgcgcgaatccgtgctgtccaccacgctggccaaagagacgcccgcgtacgacgtgcagcaggcctgcggcaccggactcgaagctgccatcctcgtcgccaacaagatcgcgctggggcagatcgaagtgggcattgcgggcggcgtcgatacgacttccgatgcgccgatcggcgtcaacgagcggatgcgcaagatcctgctcgaagcgaatcgcggcaggagcaccgggcaacgcgtcggcgcgctgagcaaactgcggcccggcatgtttttcaagccgctgctgccgcgcaacggcgagccgcgcacgggcctttcgatgggcgagcattgcgagctgatggcgaaacgctggaacatctcgcgcgaggcgcaggacgtgctcgcctacgacagccaccgcaagctgacggcggcgtacgcgcgcggcttcgtcaacgatctgatgacaccgtaccggggtcttgcgcaggacaacaatctgcgcgccgacctcacgctcgaaaaactcgcgagcctgaagcccgtgttcgaccgcgacgccggcacgctgaccgccggcaattcgacgccgctcaccgacggcgcctccgcggtgctgctcgcgagcgaggactgggccgcgcggcatggactgcccgtgctcgcgtatctgagctggtccgaaaccgccgccgtcgatttcttcgacaggaaagaaggcctgctgatggcgccggtgtacgctgtgccgcgcatgctggcgcgcgccggactcacgctgcaggacttcgatctgtacgaaattcacgaagcgtttgccgcacaggtgttgtgcacgctcgcggcatggcaggatgacgaatattgccgcacgcaactcggtttgccgggcgcgcctggtgcgatcgaccgggcgaaactgaacgtgaatggcagctcgcttgccacgggtcatccattcgcggcaacgggtgggcgcatcgtcgccggtctcgcgaaaatgctcgcgcaactcgacaagccggccggcaccgcgcgcgggctgatttcgatctgcgcggcgggcggccagggggtggtcgcgattctggag

SEQ ID NO: 31081 - DNA, 1683 bp, Burkholderia cepacia
atctggtacgcgtcctatccggccgacgtgccgcacgacatcgacgtcgcgcaatacgaatcggtcgtgcagttcttcgacgaatgtatcgcccggttccgcgagcgtgtggcctacgtgagcgtgggcgcgaacatgacctacggcgagctcggccgcaaggccagcgcattcgcggcgtatctgcaaagcctcggcgtgaagccgggcgagcgcgtggcgatcatgctgccgaacacgttccagtacccggtgtcgctgttcggcgtactgaaggccggcggcgtggtggtcaacgtcaatccgctctatacggtgcgtgaactcgcgcatcaactgaaggacagcggcgcgcaaaccatcatcatgttcgagaacttcgcgaagacggttgaagacgcgctgcccggcaccaaagtgcagaacgtcatcgtgaccggcctcggcgatctgcttgccgacggcctgaatctgaagggacgtctgctcaatttcatgctgcggcacgtaaaaaagatggtgcccgcgtacaacctgcccaaagccgtgccgctgctcgaagcgctttcgatcggctactcgcggccgttgacgcccgtgcgccccacgcatgcggacattgcgttcctccagtacacgggcggcacgaccggcgtcgccaagggcgcgatgctcacgcacaagaacatcatcgccaatctgctgcaggcgaaggcgtggtccgaagggcaactgaccggcgacgtcgaaacggtgctcacgccgctgccgctctaccacatctattcgctgaccgtgaacgcgctgatcttcatggggctcggcgggcgcaacattctgatcgccaatccgcgcgacatgaagcgcgtgatgatgatcatccgtcacgaaaaattcaccggcatgaccgccgtgaatacgctctacaacgcgttcctcgaaaacgaggaattctgcaagcgcgacttctcggatctcaagctcgcgatggccggcggcatggccacgcagaaatcggtggccgagcgtttcaaggcggtgaccggcaaaccgatcatcgaaggatacgggctgaccgaatgctcgcccatcgtctcgatgaatccggtcgatctggccaacatgcgtgacttcgaagggtcgatcggtttgcccgcgccgtccactcacgtgcgtttcagaaaggacgacggcagttgggcgaacatcggcgaggcgggtgaattgtgcgtgaaggggccgcaggtgatgaagggctactggaatcgcccggaggagaccgccaaggtgatcgacggcgacggctggctcgccaccggcgacatcggcgtgatggattcgcgcggcttcatccgcctgatcgaccgcaagaaggacatgatcctggtgtcgggcttcaacgtctatccgaacgaagtcgaagacgtgatcgcaacgcatccggacgtgcgggaagtggcggccatcggcgtgcccgatgccgcgcaaggcgaacgggtgaaggtgttcatcgtccggcgcaatccttcgctgacggccgaacaggtgattgctcattgccgcaagaacctgacaggctacaaggtgccgaagctcgtcgaattccgcgacgagctgccgcaaaccaacgtagggaaaattctgcgccgcgcactgcgcgacgaggaactcgcgaagcaaaag

SEQ ID NO: 31082 - DNA, 933 bp, Burkholderia cepacia
aagctcatcgatatatacagaacgatggtgctcgtgcgcgaggtcgaattgtccttgagccgtctttttgccgacagcgaggtgccgggcttcattcacctgagtctcggacaggaggccgtttccgccggcgtcgcgagcgtgctcgaagtccaggacacgctggcgaccacgcatcgtggacacggtcacgtgctggctcgcggcatcgacgtcggtgggtttttcaaggaaatcatgggacgcgtgggaggcttgtgcaaggggcgcggcggctcgatgcacgtcgccgatctggcgctcggggtgctcggcgcgaatggcatcgtgggcgccggtatcccgatcgcgctcggcagcgcggtggcgcatcacgtgcgcaagacccgcggcgttgcggtcgcatttttcggcgatggcgcgatggccgaaggcgtactgcacgaaacgatgaacatggctgcgttatggaaggcgccgctgttgctggtctgcgaaaacaacggctggtcggaattctcgcccaccgaacggcagttcgccgcccgcctcgaagcgctggcaggcgccttcggcattgcctataaacgggtcgatggcgatgacgcggtcgcggtcagcgaagcgtcggggattgcggcggccgccgcgcgcagcggagccggaccgttcgtgctcgagtgcgtcacgcatcgggtgcgggggcactacgaaggcgatccgcagaaataccgtgacccgaccgagctggacggtctggcggggaaggacccgctgaaacggatgcacacgcatctggaatcggccggcgtgtccgcgagtgagatcgatcagatcggccgggctgtgttgactcgcgtcgaggcagcgatcgaagcggcgcgtgcggacgcgttgcccgacttcgacgaggcgagtcgcgacgtctacacc

SEQ ID NO: 31083 - DNA, 927 bp, Burkholderia cepacia; identical to SEQ ID NO: 28325

SEQ ID NO: 31084 - DNA, 1269 bp, Burkholderia cepacia
ctgctcgtgcccaagctgggcctcacgatgaccgaggggaccttgatcgagtggatgatcagtccgggggaccgcttcgatgcggaccagggcctgtatgtgatcgagtcggacaaggcggccaacgaagtatcggcggaagggtctggcgtcctgctggaagtcactgccgaactgggaatgccgttgagtgtcggatcggtgatcggctattgggacgacgatccgcaagcggcaacgaatcatgcggttcgtgctgaaccctcggcgcacgcagccgccgcctcggcgtcttcacccgatagcaacgcagccaatgccgcgccgtccgcgcagacaagccgcccgcccgccgctatgaacggccagagcggccagagcggccagagcggcgcgcgcggtatttctacgccgcttgcgcgccgcctcgcgcgcgagcggggaatcgatctgaccaacctcgcgggcagcggcccgcgcggacggatccgcgcgcgcgacgtggaattggcgccggcgaattcgccggccagtgcgcctgatgtgccgttgccggcgaccgcttcgcgcgccgcgcaggtcgcgcaggccgcgacggtgcgtgcggcaacatcgatcgaaaaaaccatcgcgcgccgtctcgtcacgtccaagcagactattccgcatttctacctgtccgtcgaagccgaaatatccgccgtccagcgtttgcgctcgcagctgaatgacgcgcaatcgaatcggcgcttcaccgtcaatcatttcgtggtggcggcagtgggccgtgcgctcgcactggtgccagaggccaatcgcgtatgggacgacagcggcatcaccagctttgccgcgacggacgtcggcgtcgccgtgcacaccgaacgtggcttgctggtgccggtcttacgcgacgtcggccgccaggcactcggcgaggtcgcgcgtcacgccagcgaggcaatcgggcgtgcacaggccggacaactgaacgcggccgagatggcaggcggcgcgatcaccgtctccaatgcgggcatgcacgacgtcacgttgatgacctcgatcatcaatcctgggcagtcgatgatcctcggcgtcggcagcgttcgccaggtgttccgcccggacgcgcacgggcaaccggcgctgaagaacgaagtgggactcgtgctgtccgtcgaccatcgggtgctcgacggcgtgaccgcgttgaagtttctcaggcaggtcgtagcggcgatcgagcgtcctgccagtctgctggtg

SEQ ID NO: 31085 - DNA, 1392 bp, Burkholderia cepacia
atggacgaccattatgacgtgatcgtgatcggcggcggccccggcggctatgtcgcggccttgcgcgccgcacagctcggccggcgcaccgctttgtgcgagcgtgaccagttgggcgggatctgcctgaactgggggtgcattccgaccaaggcgctgctgcacacggccgacaccttgcgaacggtgcgcaaagccgcgcatctcggtatcgggatcgacgatccggtcgtcgacttcacacgggtgatggcacgctcgcgagaggtcgcgcagaagctcaatcgcggcgtcagccatctgctgcgcaaggcgggcgtgacggtgcttgccggcacggccgccttcgccgcggaccgttcggttcgcgtgcacggtgccgacggcgcgcttcggacgttgcaggcgcgccatacgatcgtcgcgaccggcgcggccgcgcggcaattgccggcgttgccgtgggacggcgagcggatctggacgtatcgcgaggcgctggctgcgacggccgtgccgaaatcgctgctcgtggtcggcgccggtgcgatcggaatggagttcgcgggcttctacgccgcgatgggaaccgaagtcacggtcgtcgaagtcgcgccgcgtatcttgccggcgagcgatgccgatgtctcggagttcgttgcccgagcgtgcgagcgtgacggtatccgcctacgcaccgggtgcagcgtggtccacagcgccgctcacgcggagggcgttcgcgtgatgttccgctcggagaacgctgaagagcagcgggagttcgagcgcgtgctggtcgcggttggcctggacggcaacaccgaaggactggggctggagcacacgcgagtcgcgttcgagcgcgggctgatcatcgccgatgctgccggcgcgacgagcgatcccgtggtgcatgccgtcggcgacgtcaccggcgcgccgatgcttgcgcataaggcgagccatcaggcgatcgcctgcgtcgagcgcattgcggaggtcaatcgcggcgagcgtcacgcgtcgccgaagatacccggctgcgtctacagccatccgcaaaccgcgagcgtcggcctgacggaagacgaggcgcgacgcaccggccgcgcgttgcgcgttggccgctttcccctcgacgcgaacggtaaagcgatcgcactgggcgaccccagcggctttgtgaaaacgatcttcgacgccgctagtggcgagctgttgggcgcgcatatcgtcggtcccgaagcgcccgaactcattcacggcttcacgctcgccgcgacgctggaggcgacggaaagcgaattgattgaaaccgtattccctcatccgaccttgtcagaagcaatgcacgaatcggtgctggcagcttttggcaggccgctgcac

SEQ ID NO: 31086 - DNA, 1170 bp, Burkholderia cepacia; identical to SEQ ID NO: 28328

SEQ ID NO: 31087 - DNA, 1443 bp, Burkholderia cepacia
gcgcgcacgaatccgtcccgtaccgcattgatgtacggcaatcagtcaatttcgtatggcgatctgcagcggcgcgtcgaggccaccgccgggatgttgaagggtacccgaatccgtcgtggcgatatcgtcgcgttgctgatgaagaacagcgcggccttcgtcgagatcatgctggcggtctcgcaggcaggcgccgtcattcttcccatcaactatcggctaggtccggacgaggtggcctatattctccagcattcgggtgcgaaactgctgtttcacgatgaggagttcgaagtgccccccggccttgtgcattcgcaggccgtgaccggcgcggcgcagtcggacacgagtgtgcttgccgccggtcacgaaccctgtacggaagcttatccgtcccgccccgacgatctgtatcgactgatgtacacctccggcacgacggatcgccccaaaggggtgatgcattcctacggcaacgtggcgtggaaaagcttcgatcacatcgccgcgttgggtatcacgaaagacgacaggcttctcgtagtcggcccgctttatcacgtcggtgcgtgcgatctgccggggcttgccgtgctcgcgcaaggcggcatgctgcgcatcatgcgcgatttcgacgcgcaggctgtgctggaagcgatcgagcgcgagcgtctgaccggcgcgtggctggcacctgtcatgctgagccgcattctggcattgcccgaacgataccgcttcgacctgggcagtttgcgctgggtggtcggcgggggcgagcgtacgccggaacaacgcattcgtgagttcggatccctattcacgggcgcccgctatatcgacgcttacggactgacggaaagttgttccggcgatacgctgatggagcaggggcgcgagctcgacaagatcggctccacggggcgggcgctggctcacgtgcaactggcgatcatgagcgacgatggccggatgcttgcgcccggcatgcaaggcgaaatctgcgtgcgcggtccaaaagtcacccaaggttactggaaagacccggaaaaaaccgcaagaagcttcgttgacggatggtttcgcaccggcgacgtcggctatatggacgaggaaggcttcctgtatctcaccgaccgcaagaaggacatgatcatcagcggcggcgagaacatcgcctcttccgaagtggagcgggtgatctatcagcttgccgaggtggcggaggccgcggtgatcggtgcacccgatccgcgttggggcgaacaggtgacagccgtcgtggtgctgcgagccggagcgacactgacgctggacgcgctgcggacccactgcgaaggccgtctcggcggattcaaaacgcctcggcaactgatcctgcgcgacgcactgccgcgcaatccttctggaaaggtcctcaagcgcgtgctgcgcgac

SEQ ID NO: 31088 - DNA, 726 bp, Burkholderia cepacia
gctgaattcaacggcgcgatcgccgtggtcacgggggcgggcagcggcatcggccgcgcctgtgcggagttgctgagccgtagcggcgcgaacgtcatcgtcgccgaccgggacattgaagcggcgacgcgggtagcgcgcgccaccggcggaaaaacgctggtgctggacgtgggcgaagatgcgtcggtgacggccgcggcgaacgaagtgcgcgcccggtacggtgtggcggatgtgctcgtcaactgcgctggcgtcctgcaacggacactcccgcccggtgagttggcgcagcgcgaatgggacgtcgtctcgcgcatcgacttgcgcggcacatacctttgctgcgccgccttcggcgcgccgatggccgaccgccggcgcggcagcatcgtgaacatcgcgtcggtggccgggatgcgatcgggtccgctacacgcctatggaccggccaaagccggcgtcatcagcctcacggaaacgctcgcgggcgagtggggaccgaaaggcgtgcgggtcaattgcgtatcgccaggcttcacgcagacgcccgcgctcgaacggggtttcactacccataccctgaaagccgatgtgctgcgcgacgcggcggcgctcggccatatcgtctccgcaaacgagatcgccgaagcggtagtctttctcgcttcggaacgggcgagcgcgattacaggcgtcaatctcccggtcgatgcgggctat

SEQ ID NO: 31089 - DNA, 1368 bp, Burkholderia cepacia
atgagtcgcctggttgtggtctcaaatcgtacggtcgacccacgtaaaactgctgccggcggcctcgctgtcgctgtgcgggaaagtcttcagcgcaccggtggcctttggttcggctggagcgggaaaatctacgacgagtcggatgagatgacaagccggcgtggcgttcacgtgcaaacactcggcaatgtcacactcgccacagtcgatctgagccagcaggatcatgacaactactatctcggctatgcgaacggagtgctgtggccggtctttcactatcggctggatctcgcggacttcgacacgcgcttcgctgccggttaccggcgcgtgaaccagctgtttgccgagaaactccttccactgctcagacccgatgacatcatctgggtgcacgactatcacctgattccgcttgcagcggaattacgcgcaataggctgtggtaaccgtatcgggttctttctgcatattccaatgccgccgccgatgatcatggcagccattccggaacacgaatggttgatgcgttcgttgttcgcctatgatctcgtgggcttccaggggcagatcgacgtcgagcactttacgcattacgccgaatccgaagcgaacgccagacaggtcggcccgcaacaactccgtgcattcaatcgcacattgagactgggtgcgtatcccatcggaatcgatgtggaggagttcgtcagtctcgccaatggcaaggaagcgcgcgagatgttcacgcggatgcgtgacgagtattcgcgtcgacgcctgctgctaggcgtcgaccggctcgattactccaaaggcttgcctcagcgcattcacgcgtttcgagaactgcttgcacactatccagagaatcgcgatagcgcgaccttgatccagattgcgtcgcctagccgcgaaagcgtggctgcctatgacgatcttcgtcgtcagatggacagcctgtgcggcgcgatcaacggcgactacggtgaactggactggatgccggttcgctacattcaccggcacgtggcacgcaagcgcctgcctggtctttatcgcgcgagcaaggtcgcgctggtcactccgctgcgcgacgggatgaatctcgtcgccaaggaatttatcgccgcacaggatccgtctgatcccggcatgttggtactgtcccgtttcgccggcgccgcggagcaactcaaggaagcgttgctggtcaatccctacgacacgcaaggcaccgcgcatgccatccaaagggcgctgaccatgccgctcgatgaacgtcgcaatcgtcatgctgcactgatgaaaaggattcgcgagcatgacgtccactggtggtcttccagtttcctggacacactc

SEQ ID NO: 31090 - DNA, 1134 bp, Burkholderia cepacia
atgaccgaggagcgccggctgatccaggcgtcggcccggcagttcgcgcgcgaggtggtgttgccgctcgccaaccggctcgatccgctgaaggaggatatcccgatgtccttgcgcgagcggatggccggactcggctacttcggcattctgatcccggaggaatacggcgggctcgggctcggcgtgtccgagtactgcctgatcacggaggagctatcgcgggcctggatgagcgtcggcagcatcatccgcaacctcgggctgatggtcgtgcaggggatgaccgacgggcagcggcagcgctggctgccgcgcatggcatgcggcgaattcctcggtgcgctggcgatgtcggagcccaacgccggctcagacgtggccgcgctcaccacacgcgcgataccggacggcgacggctggcgcatcacgggctcgaaatgctggtgcacatttgccgatggcgccgactacatcgtcgtgatcgcgcgcaccgcgcgggtcaccgacgtggcgaggcgccatcaggggctgtccgcgttcctgatcgagaagccccgtggcgcattgccggcgggcgtgatcggctcgccgatgccgaagatcggctactacggctggaagacgtgggagttgtcgttcgacgacgtctacgtcggccctgagacgctgatcggcgaaccgggccgcgcgttctactacgttgcccacggcctcgagacggcacgcgcgcataccgccgcgcgctcgatcggattggctcagggcgctcttgaggatgcactcgactacgcgacccagcgcgtgcagttcggccacccaatcggtgactttcaggcgctgcgtttccgtctcgccgacatggcgacgcgtgtcgagaccgcccggcaactgctgcgctcggtgtgcgagcagatcgacagcggcgtgcgctgcgagaaggaagccgcgatggccaagtactacgcagcggagatcagcgagacggtcaccagcgatgcgttacagatccacggcggcgccggctacacgacccacttcgcggtcgagcgctactggcgcgacgcacgcctgaccaagatcttcgagggcacctctgagatccagctacgcatcatttccgatcacttgctg

SEQ ID NO: 31091 - DNA, 705 bp, Burkholderia cepacia
gcgcttgtgaccggcggcgcacgcggtctcggcctcgagattgcccagcagcttgcaacgctgggcgcgcacgtcatcatcggcgcacgagacacggcgaaggccgaggcggtcgccaccgagttgcgcaacctgggccatgcagtatccgcgctcaagctcgacgtcacgagcgatgaggatcggcaggcggcctacgccgaaatcgacagagcgcacggcaggctcgacattctgatcaataacgccggaattttgctggatagccccgacggcggcacaccagctacccgacagccgagcgaggcactgcccaacgtggtgcgcgacacctttgaggcgaacttctttgctcccgtttttctaacacaaaccctgctgccgctgattcggcggtcgagtgctggccggatcgtgaacgtgtcgagcatcagagggtcgctcgcacatctatccgatccgtgctcgccggtctacccgatccgggctctcggctatgacacatccaaggccgcgctcaacgccttcactattttgatcgccgcggaactgcgagacacgccgatcaagatcaatgcggttcatcccggctggctgcgaaccagcatgggcggtgaacgggcaaacatgagcgcagaggacggtgcgcacgccgtcgtgaagtacgccagccttggtgaagacggccccaccggcggcttcttc

SEQ ID NO: 31092 - DNA, 735 bp, Burkholderia cepacia; identical to SEQ ID NO: 28334

SEQ ID NO: 31093 - DNA, 729 bp, Burkholderia cepacia
ctgcagggtaaagtcgtggtgctgacaggcgcaggcggtggcatagcgtcggccatcgtcgatcgcttcgcccgatcgggatcccgcattgtactgctcgaactgcgtacgtcgtcgctggcggacgcggagcaacgactcgctgcggcgggcatcgaatcggtttcgattgaatgcgatgtggccgatgagtcatcggtgaaaaacgcagccgggcgtacggtcgaacattttggccgctgcgacgtgctcatcaataatgcggcaacgcttgcaccggcgacgtcgatcgagaagttgctggtggccgactgggaccgtacgctcgctatcaatctgcgcggcgtattcctcaccactaaatatttgggcgctctgatgttgaatcagggttcgggcagcatcgtgaatatcgcttcgatcgcggccaccgcgcccaacgcctcgccgcaatatggtgcaagcaaagcggcggttctcgcttttacgcggcacactgcggtggaatgggggccgcgaggcatccgcgcgaacgcggtcagtcccgggttcattcgaacgccactgtcggagagcaactacgcggagccggaaatgctggcgcgtcgctcgaacatggtgccgtcccggcggctcggtcttcccggcgacattgcagaagcagtcgcgtttcttgccggcgacggtgcgtcgttcatcaacggacaggaactcgcagtcgatgggggc

SEQ ID NO: 31094 - DNA, 1284 bp, Burkholderia cepacia
cgcagcctgcgcgccgtctggcacccctgcacccagatgaagcaccacgaacgcctgccgctcgtccccgtcgcgcgcggtcaaggcgcgtggctctacgaccgcgccggccatcgctatctggatgcgatcagctcctggtgggtcaacctgttcggtcacgccaatccgcgcatcaacgcggcactgaaagaccagctcgacacgctcgaacacgccatgctcgccggctgcacgcacgaaccggccatcgaactcgcggagcgcctcagcgcgctcaccggcaacacgctcggccacgcattcttcgcatcggatggcgcgtccgccgtcgaaatcgccctgaaaatgagcttccactcgtggcgcaatcgcggtttcgccgacaagcaggaattcgtctgcatcgccaacagttaccacggcgaaaccatcggcgcgctcggcgtcacggatgtcgcactcttcaaagacgcctacgacccgttgatccgccacgcgcacgtcgtagcgtctccagacgcccgcctcgcgcaagccggcgaaaccgccgccgatgtcgctcgccgcgcgctcgatcacgtccgctcgcttttcgaagcacgcgccacgaaaatcgccgcgctgatcgtcgagccgctcgtgcagtgcgcagccggcatggccatgcacgacgcgtcgtatatcgccggactacgcacgttgtgcgatcagtacggcgtacatctgatcgccgatgaaatcgccgtgggctgcggccgcaccggcactttcttcgcgtgcgaacaggccggtatctggccggacttcatctgtctgtcgaaaggcatcagcggcggctatctgccgctctcgatcgtgctgtcgcgcgacgaaattttcgaagccttctatcacgacgacaccgcgcgcggcttcctgcactcgcactcgtacacgggcaatccgctcgcctgtcgcgcggcgctcgccacgctcgatctgttcgcagccgacaacgtgatcgccgtcaacgcacaaaaatccgcgaagctgaaagccgcgctcgcaccgctcgccgaacacgaacaagtccgcaatctgcgtcagtgcggcacgatcttcgcgttcgacgccctgatcgacgatgctcagcaggccagaacattctcgcgccgcttcttcgaaaacgcgctgcggcgcgaactgctgctgcgcccaatcggcacgacggtgtatctgatgccgccttatatcctcgacgacgaagaactcgcgctgctcgcctcgcgcacgcgcgagacc

SEQ ID NO: 31095 - DNA, 1086 bp, Burkholderia cepacia
cgtcgccgccgcaccgccgacacgccgtgcgcggcccacatgaccgtcgacggccgcgcgatcatcggcttcgccagcaacgactatctcggcctcgccgcgcatccgcaactgatcgcggccatcgctgaaggcgcgcagcgctatggcgcgggcagcggcggctcgcatctgctcggcggccactcgcgcgcgcatgcgcaactcgaagacgatctcgccgaattcgtcggcggcttcgtcgagaatgcgcgcgcgctctacttcagcacgggctacatggcgaatctcgccacgctcaccgcgctcgcgggccgcggcacgacgctcttctccgacgcgctgaatcacgcgtcgctgatcgacggcgcgcgtttgtcccgcgccgacgtgcagatctacccgcactgcgataccgacgcgctgagcgcgatgctcgaagcctcggacgccgacgtcaaggtgatcgtctccgacaccgtcttcagcatggacggcgatatcgcgccgctcccacgtctgctcgaactcgcggaacaacacggcgcctggctgatcgtcgacgacgcgcacggtttcggcgtgctcggcccgcaaggccgcggcgcgatcgcgcaagccgcgctgcgttcgccgaatctcatttcgatcggcacgctcggcaaagcggcaggcgtctccggcgcgttcgtcgcggcgcatgagacggtgatcgaatggctcgtgcagcgcgctcgcccgtacattttcaccacggcgtcggtgccggctgcggcacatgcggtgtcggcgagtctgcgcatcatcggcggcgaggaaggcgatgcgcggcgcgcgcatcttcagcaattgatcgggcgcacgcgcgccatgctcaaggcaacgccgtggctaccggtcgattcgcatacggccgtgcagccgctcatcatcggcgcgaacgacgccacactcgagatcgcggccacgctcgatcgcgcgggcctgtgggtgccggcgatccgtccgcccaccgtgcccaccggcacgtcgcgtttgcgcatttcgttatcggccgcgcactcgcaggcggatctggatcgtctt

SEQ ID NO: 31096 - DNA, 891 bp, Burkholderia cepacia; identical to SEQ ID NO: 28338

SEQ ID NO: 31097 - DNA, 1398 bp, Burkholderia cepacia
gcggcaagcggccggcgtttcgcggtcaccgacccggccaccggcaacctgatcgccgatgtcgccgacagcggtccggccgacgcgcgcgccgccaccgacgccgccgcgaaagcgctgcccgcctggcgcgcgctgctcgcgagcgaacgcgcggcgatcctgcatcgctggcacgcgctgatcgtcgccaatcgcgacgcactcggcgcgctgatctcgctcgaacagggcaaaccgctcaccgaagggcgtggcgaggtgggttacggcgcgtcgtatgtcgcgtggttcgccgacgaagcaacgcgcatctacggcgacctgattccgcagcagcagcgcggcaaacgcatgagcgcggtgaaggagccgatcggcgtggtcgcggcgatcacgccgtggaattttccgctcgcgatgatcgcacgcaagattgcgccggcgctcgcggcaggctgcacggtggttgcgaaaccggctgaagacacgccgctcaccgccatcgcgctcgtgatgctcgcgcacgaagcgggcgtgccggacggcgtactcaacctcatttcggcgtcgcgcgcggctgccgccgaaacggtcggcgactggctcgccgacagccgcgtgcgcaagatcacgttcaccggttcgacgccggtcggcaagcatctcgcgcgcgaatcggcgggcacgctgaaaaagctctcgctcgaactcggcggcaacgcgccgttcatcgtgttcgacgacgcggacctcgatgccgccgtcaacggtctgctggccgcgaagttccgcaacggcggacagacctgcgtatgtccgaatcgcgtctacgtgcaacacggcgtgtacgagcatttcgccgcgctgctgcgcgcgagggtggcggagttgcgggtcggtccggcgagcgatcccacgtcgcagatcggtccgatgatcaacgtgcgcgcggtcgacaagatcgcccgccatgtcgacgatgcggtcgaacacggcgcggtcgtgctgacgggcggccgccgccttaccgagctcgggccgcactactacgcgcccacggtgctcggcaatgcaagtgcgtcgatggcgctgtgcggcgaggaaaccttcgggccggtcgtgccgctgttcccgttcgacaccgaacaggatgccgtgcaggccgcgaacgacaccccgttcggcctcgcgtcgtatttctacagcgaaaacatgcgccggatcgagcgcgtgtcgcgcgcgctggaggccggtatcgtcggcatcaacgaaggcgcgctcgcgtccgaagcggcaccgttcggcggcgtgaaggaatccggttacggccgcgaagggtcgaagtatggactcgacgactatctgtcgatcaagtatctgtgtcagggaggattg

SEQ ID NO: 31098 - DNA, 1068 bp, Burkholderia cepacia; identical to SEQ ID NO: 28340

SEQ ID NO: 31099 - DNA, 1350 bp, Burkholderia cepacia
cagatcgccgttcatcggccgtcggacggcgcgctgctcggccatgtgccggacgcgaccgacgccaccgtcgatcacgcggtcagcaacgcgctcgctgcatggaagacgagcggctggggtacccgttcgccgcgcgaacgcgcgaaggtgctgcgccgctgggccgacctgatcgatcgcgatgcggtgagcctggcgcaactcgaaacggtcagctcgacgcggccggtcgccgaaagctatgcatcggacgtgccgttcaccgccgaagcgatccgttttttcgcggaactggccgacaagctcggcggcgatatcgcggccacgcgccgcgacagcctcggcttcgtcgcgtcggaaccgtacggcgtgatcggtgcgatcacgccgtggaatttcccgctgtcgatgtgttcgtggaaatgcggcccggcactcgcggccggcaacgcggtcgtgctgaagccgtcggaaatgacgccgttctcgacgttgcgtctcgccgaactcgcgatcgaagccggcatgccgcccggcatcttcaatgtcgtgaacggccgtggtgcgaccaccggcgcggcgctaacgcgtcaccccggtatttcgaagatgagcttcacgggatcgacccgcaccggcgccgcgatcatgagcgacgccgcgatgcacggcaccaagccggtcacgctggaactcggcggcaagagcccgcaactggtgttcgaacacgtacgcgaccttgacttcacggcgggttgcatcgcccgcggctttaccgcgaacggcggccaggcctgcgtggccggcacgcggctgatcgtgcacaagcgcattgccgagccgctcgtcggggctatccaacgtcaattgcagtcgatcaaacccggtccgctgtgggacagccgcaccacctattcaccgatcatcagccccgcccaggcgcgccgtatcgaaacgctgatcgaccagagccgcgacagcggcgcggaagtgatcttcggcggcggctttttcgacggcaccgacgaaggcttttttcatcgcccgacgctgctcgccaacgtgaccgacgcgacgcccgccgtgcgcgaggaactgttcggcccggtcctgacggtgcagacattcgacgacgaggacgagggcatcgcgctcgccggtcatccaatttacggcctcgcggcgggtattcacagcagcgacatcggccaggcgctgcgcgcgatgcgccgtatcgccgcgggcacgatctggatcaaccgttatggccgcagcggcgacatgatcattccgaccggcggcttcggccagtccggcatcggcaaggatctcggccgcgaggcgatg

SEQ ID NO: 31100 - DNA, 1326 bp, Burkholderia cepacia
gaccgcaagcatctgatccacccggtcatcaactaccgtgcgcacgaagcgcgcggcgccaccgtactcgaatccggccagggcgcgtatctgcgcgacatcgacggcaacgagctgctcgacgcgttttcgggcctgtggtgcgtgaacgtcggctacggccagcagagcatcgtcgaagcggcgacgcgtcagatgacgaagctgccgtatgccaccacctatttccacttttcgtcggagcccgcgatcgaactggccgacaagctggtcgcgctcgcgcccgcttcgctgcaacacgtgtacttcacgcttggcggctccgacgcggtcgactccgcgatccgcttcatcacgcattacttcaacgcgactggacgtccgtcgaaaaagcagatgatcgcgctggagcgcggctatcacggctcgtcgtcggtcggcgcgggactcaccgcactgcccgcgttccatcgcaacttcgatctgccgctgccgcaccagcatcatctgccgtcgccgtatgcgtaccgtcagacgcatggcgacgacgcgcaggcgctgatcgccgcgtcggtcgccgctctcgaagccaaggtcgcggcactcggcacagacaacgtcgcggcgttcttctgcgagccgatccagggatcgggcggcgtgatcgtgccgccggtcggctggctgaaagcgatgcgcgacgcgtgccggcgtctggacatcctgttcgtcgccgacgaagtcatcacgggcttcggccgcacgggtccgctcttcgcgtgcgaagcggaacaggtcgagccggatctgatgacggtcgcgaagggactgacctcgggctatgcgccgatgggcgccgtgctgatgtcggacgaaatctaccagggcattgccggcgacgcacgcgacaccgcgatcgtcggtcatggccagacctactccgcgcatccggtcagcgcggcgatcggcctcgaagtgctgcgtctttatcaggaaggcggtctgctcgcgaacggtcaggcgcaggcgccgcgctttgccgccggcctcgacgcgctgctcgggcatccgctcgtgggcgactcgcgtcatcgcggcctgctcggcgcgctggaactggtcgccgacaaggattcgcgcgcccgcttcgacccggcgctcaaactgccggaccggatcgcggcggccgcgtaccgcaaccgcctcgtgttccgcgcattcggcgacagcattctgggcttcgcgcccgcgctgtgtttcggcgaggccgaattcgagcagatgttcggccgcctgaagcgcacgctcgacgaagtgctcgacgaa

SEQ ID NO: 31101 - DNA, 756 bp, Burkholderia cepacia
ggggcagcccaaggaataggtgcgtcggttgcacggtcattcgcacagaacggttgcttcgtctacgtcactgatatcaacgatgagcttggcagaacagtggcgacgtcgattggcgattgcgctgcgtatttgccacttgacgttcgagaagaaggcgattggcagcgtgtaacgacgcatgtcctggaaaaacacggccgactggacgtattggtcaacaacgcagggattactggctttgaggctcgtgtcgtgccgcatgatccagagcacgcgagccttgaggagtggcgcgctgtacatcgaacgaacctcgacggagtgtttctcggctgcaagtacgccatacgtgccatgcgacgtcatggacagggctcgatcataaacatctcttcacgctctggcctggtcggcattccaggtgcggcggcatatgcatcgtcaaaggccgcagtccgcaaccacacaaagactgttgcgctctactgcgcgggacaaaacctcgaagttcggtgcaactcgattcacccagccgccatcctcacgcccatctgggaacccatgttgggcaccgacgccggccgcgaggaacgaatggctgcactggtccgtgataccccactccggcggttcggcacgcctgaggaagttgccgccctcgcattgttgctggcatcggatgaggcgacgtacatcaccggtagtgaattcaacattgacggtgggctcctggccgggtcggcggcaacaccc

SEQ ID NO: 31102 - DNA, 993 bp, Burkholderia cepacia; identical to SEQ ID NO: 28344

SEQ ID NO: 31103 - DNA, 1029 bp, Burkholderia cepacia
atgaaagcactcgtgtatcacggtcccggaaagaagtcgctcgacgagcggcccatgccgcaactcgccagcgccaccgacgccatcgtcaaggtgacgcgcacgacgatctgcggtaccgatcttcacattctgaagggcgacgtgcccacgtgccagcccggccgcattctgggtcacgaaggagtgggcatcgtgcagcaggtcggcgccgcggtcagttcgttgaaagagggcgatcacgtgctgatctcgtgcatctccgcatgcggcaagtgcgattattgccggcgcggcatgtattcgcactgcacgaccggcggctggattctcggcaaccgtatcgacggcacgcaagccgaatatgtgcgcattccgcatgcggagacgagtctttatccgattcccgccggtgccgacgaagaagcgctggtgatgctgtccgacatcctgccgaccggcttcgaatgcggcgtcctcaacggcaaggtgcagccgggcagcgccgtggcgattgtcggcgccgggccgatcggactggcttcgctgctcaccgcgcagttctattcgccggcccagatcatcatgatcgatcgcgacgagcgccggctcgaagtggcgagccgtttcggcgcgaccgcgtgtatcgacagccgggtggccgaaccggtcgtggaggtgatgaagcttaccgggcacgtcggtgtggattgcgcgatcgaggccgtgggcgtgcccgacaccttcgagttgtgccaggcgctggttgcgcccggtggtgtgatcgccaatatcggcgtgcatggggtgaaggcggatctgcatctggaatcgctgtgggatcgcaacatttccattacgacgcgcctcgtcgataccgtcagtacaccgatgttgctgaagacggtgcaatccggccggatcgatccggccagactcatcacccatcatttccagctggacgacgtgttgaacgcctacgataccttcggccgcgcggcggattcgcatgcgttgaaggtgatcatc

SEQ ID NO: 31104 - DNA, 1833 bp, Burkholderia cepacia
ttctgggcacgtcttgcccgcgaacacctgacgtggcgccgcccattcacgaaagtactgaacgacgcagacgcgccgttctatcgctggttcgaagacggcgaactgaacgcctcgtacaactgcctcgatcgcaatctcgccaacgggctcgcggagaaaaccgcgatcgtgttcgagtcggacgacggcaacgtcacgcatgtcacctatcaggcgctgtatcaccgcgtatgccggctcgccaatgcactgcgtgcccgcggcgtgaagaaaggcgaccgcgtggcgatctatatgccgatgtccgtggaaggcgtagtcgcgatgctcgcgtgcgcacgcatcggcgcgccgcactcggtggtgttcggcggcttttccgccaagtcgctgcatgagcgcatcgtcgatatcggcgcgtgcgcgatcattaccgcggacgagcaggttcgcggcggcaagaccctgccgctcaaaacgatcgtcgacgaagcgctcgcaatggccggcacggccggcatcaggacggtggccatctaccggcgcacgggcggccagattccgtggattgccggccgcgatacatggctgcacgaactcgaagcggcgcagccggacacctgtgagcctgagtgggtcggtgcggagcacccgttgttcgtgctctacacgtccggctcgacgggcacgcccaaaggcgtccagcacagcaccggcggttacctgctgtgggctgccgtgacgatgaagtggaccttcgacatcaaaccggcggatgtgttctggtgcacggcggacatcggctggatcacgggtcacacctatatctgctatgggccgaccgcggtcggcgcgacgcaggtgatcttcgaaggcgtgcctacctatccgaacgcgggacgcttctgggacatgatccagcgccacaaggtcagcatcttctacacggcgccgaccgccatccgctcgctcatcaagtccgccgacgccgatcattcggtgcatccggacagcttcgacctgagcagtctgcgcctgctcggcacggtcggcgagccgatcaatccgagcgcctggacgtggtatgcccagcatgtcggcggtggacggtgtcccgtgctcgacactttctggcagacggaaacgggcggacacatgatttctccgttgccgggcgtcactccgctcgtgccgggttcgtgcacattgccgttgccgggcatcgacgcggcgatcgtcgacgaaaccggtcaggaagtgccgaacggaaacggtggcgtgctggtcattcgcaagccctggccttccatgatcagaaccatctggggtaatccggaacgcttccggcaggggtatttccccgaagagctcggcggcaagctgtatctcgccggcgacggcgccatccgtgatcgcgacaccggctacttcaccatcaccggccgtatcgacgacgtgctgaacgtttccggccaccggctcgggacgatggaaatcgagtcggcgctcgccgcgcatccgctggtggccgaagccgcggtggtcgggcgtcccgatgaaaccgccggcgaggcgatcgtggcgttcgtggtgctcaaggcagagcggccgtccggagccgacgcaaagcgcgtggccgacgaactgcgcgcgtgggtcggcaaggagatcggcccgatcgccaaaccgaaggacatccgcttcggcgacgccatgccgaaaacgcgctccggcaaggtggtgcgccggctgttgcgctcggtggccaaaggggaagtcatcgtgcaggacacgtcgacggtggaaaaccccgcggtcatttcacagttc

SEQ ID NO: 31105 - DNA, 1011 bp, Burkholderia cepacia
atgaaagctgctgtcgttcacgaattcggcgctccgctgcgtatcgaagaggttcccgtcccgcaggtggggcgcggccagattctggtgaacatcaaggcgtccggcgtctgtcacacggacctgcacgcggccgacggcgactggccggtcaagcccaccctgcccttcattcccggtcacgaaggcgtgggctatgtcgctgccgtcggcgaaggtgtcaagcatgtcaaggaaggcgatcgcgtcggcgtgccgtggctttataccgcctgcggtcactgcgagcattgcctgggcggttgggaaacgctgtgccaggaacagcagaatacgggctactcggtcaacggcgcttacgccgaatacgtggtggccgacccgaacttcgtcggtcatctgcccgcggccgtctcgttcgaagatatcgccccgattctgtgcgcgggcgtgacggtgtacaaaggcatccgcatgacggacgcgcggccgggtcaatggatcacgatttcggggatcggcggcctcggccatgtcgcggttcaatatgccattgcgatgggcctgcgcgtggtggccgtcgatatctcggaggacaagctggctcttgcccgcgaactcggcgcaacgcttgcgttcaacgcttcggagtgcgaccccgcggcggcgatccagaaggaaatcggcggaacgcacggcgtgctcgtcaccgccgtatcgcgcagcgccttcgctcaggcgctgggcatggtgcgccgcggcggcaccgttgcgctgaacggtctgccgccgggcgactttccgctgccgatcttctcgaccgtgctcaacggcattaccgtgcgcggctccattgtcggcacgcgccaggacttgcaggaatcactcgaattcgccgcacagggccgtgtgcgtgcccgaatccatctcgaccggctggacaatatcaaccatgttctcgccgaattgaagagcgggaaagtggatggacgcatcgttctgaatctcgat

SEQ ID NO: 31106 - DNA, 996 bp, Burkholderia cepacia; identical to SEQ ID NO: 28347

SEQ ID NO: 31107 - DNA, 1209 bp, Burkholderia cepacia; identical to SEQ ID NO: 28348

SEQ ID NO: 31108 - DNA, 1377 bp, Burkholderia cepacia; identical to SEQ ID NO: 28349

SEQ ID NO: 31109 - DNA, 2659 bp, Burkholderia cepacia
cagaccggcgaccatccgggtcgcggtcattcagggcggccgcagaaggcaactcgatgtttgcgactatcactacgcgcagctcacgcggcatcaacggcaggtgtcgccgctcgaatcgctgtttcggggcggcctgttcgagggattgctggactcgggtatggacggctccggccccgaacccgccgccacgcgccacgacggcccggtcagcaaaggcgtcgacctgcaacagcatttcagcgaccaggcgaaggaaatactgcaacgcgccgccgaacgcgccgtgcaattcggccgtcacgaagtggacaccgaacacgtgctctatgaactcgtcgaaagcgaagcagtacagcgcattctgtcggcgctgaagatctccgccagcgaccttcagaagcatatcgaagcaaacgcgcccaaaggacacgccacgtcgaaagcgccgcaaggcgagatttccgtttcgccgcgcctgaagagtgcgcttgaacgcgcggttatcgcgtcgcgcgaattcggacagaactacgtcgggcccgaacatattctcaccggcctcgccgaagtcaccgacagttttgccggcgatctgttgatgaagtatggcctgtcgtctcaccagttgcgtcagcagacgttgaaacaggccggccaggaagaagccgcacaggcgcccagcaacacgccgcagctcgacaaatacagccgcgacgtcacgcggctcgcccgtgaaggcaagctcgatccggtgattggacgatcgaaggaaaccgagacgctcgtcgaggtgctggcccgccgcaagaagaacaaccccgtgctgatcggcgagcccggcgtcggcaagaccgcgattgtcgagggcctcgcgcagcgcatgatcagcggcgacgtgccggaaacgctgcgcgaaaaacgcctgatcgaactcaatgtcaactcgctggtcgcgggctcgaaataccgcggcgaattcgaggaacgcgtcaggcaggtgatggacgaaatcgccgcgcacaaggatcagctggtcctcttcgtcgatgaagtgcacaccatcgtcggcgcgggccagggcggcggcgaaggcggcctggatattgccaacgtgttcaagccgccgatggcgcgcggcgagctcaacctgatcggcgcgaccacgctcgccgagtaccagaagtacatcgagaaagacgccgcgctggaacggcgcttccagcccgtgctggtcggcgagccgagcgtggagcagaccatcggcattctgcgcgggctgcgcgaccgtctggaagcgcaccacaaggtcacgatcctggatgaagcgtgcgtcgccgccgccgaactgtccgaccgctacgtcacgggccgcttcctgccggacaaggccgtcgacctgatcgaccaggcggccgcgcgcgagcatctgtcgtccacatcgcgcccggcggaggtgctggaactcgaatcggaaatcgcccagatccggcgcgaacaggaatacgcggcgtcgcacaaacagttcgaacgggccacggcgctcggagagcaactgtccggcaagcaaacccggctcgacgacgcgacccaggcatggaagcggcgcgtgagtacgagcaccgcggaggtgacccgtacgctggtcgccgaaatcgtcgcgaagatgacgggcattccggttgccgacctgacgcaggaagagaaaaccagactgctgcaaatggaggaccgcctgcaccggcgcgtgatcggccaggaagaagcgatcagcgcggtaagcgatgcggtgcggcgaagccgcgcgggtttgcaggcccgccatcagccgctcgccgtgtttctgttcctcggcccgaccggcgtcggcaagaccgaactggccaaggcgctcgccgaagtcgtattcggcgacgaggacgccattgtgcgtatcgacatgagcgagtacatggagcggcacgcggtggcgcgactgatcggcgcgccgcccggctatgtcggctacgacgaaggcggccagctgaccgagcgcgtgcggcggcgtccgcatagcgtgattctgctcgacgaaatcgaaaaggcgcatccggacgtctacaacgtgctgctccaggtattcgacgacggccgcctgaccgacggcaagggccgcgtcatcgacttcgccaatacgctgatcattgcgaccagcaatctcgcctccgacgtcatcatgggcacgccgcgcaagcgtcccggcttcatcgccgcggacaacgacctcgccgccgacaagggcgcccgcaaggaccgccagccggacggcgtgcgcgaaggtgtgatgacggtgctgcggtcccatttccggcccgagttcctgaaccgtatcgacgagatcatcattttcgaatcgctgaacgccgaccagatccgttcgatcgtgcgcctgcaactcgacaaggtcgcgcacatcgcgaagagtcaggatatcgacatcgtgttcgacgacagtatcgtcgatcaactggcgaaggaggcttaccggcccgaatatggcgcgcgtgagttgcggcggcgcatccgccaggtcatcgagaatccgctggcaaagcagatgctcgacggcgcggtccgcgagggcaaccgcgtggtgtgccggttcgatccgctcgcg

SEQ ID NO: 31110 - DNA, 1785 bp, Burkholderia cepacia
gtcgtgctgctgcttctcgcgcagatcttcctgtaccggcaaccgaccgaagcgatcgcgtacagcgactttcaccggctgctggtcgcgcggcaactcgacaacctggagatcggttcggaccagatcaccggcagcgtccggatgccaggcgcggctcctttgctgccggcatccgccgcgagcggactcgccgccaatggcgagccgtggcgctttttgaccgtgcgcgtgagcgacgatcatctgatcgaggatctcgccaactcgggcgtccgttataccggtgtagccgacaggatagggttggcggcggtgctcggctggatcgtccccatactgatgctcgcggctgtgtggagtgttttcatgcggcgcggtggcggcggtttgcgtgatttcagcgggatcggcaaaagcaggcccagagtctacgtcgcacaggacaccgacgtcacattcgacgatatcgccggcattgacgaagcgaaggccgagctgaagcagatcgtcgaatttctgcgtaatgccgagcgctatcggcgcctcggaggcaagattcccaagggcgtgctgatcgtcggcgcgccgggtaccggcaagaccctgcttgccaaggccgtggcgggggaagcgggcgtgccgttcttttcgatcagcggttcggcgttcgtcgagatgttcgtgggagtgggggcggcgcgggtgcgcgacctgtttgaacaggcgcagaagaaggcgccgtgcatcgtctttatcgacgaactggatgcgctcggcaaagtgcgcggcgccggtgtcacatccggcaacgacgaacgcgagcaaaccctgaatcagctgctggtcgagatggacggattccagccgaattccggcgtgatcattctggcggcgaccaatcgccccgagattctcgatccggccttgctgcggcccggacgcttcgaccggcatattgccatcgaccggccggacctcaacgggcgccggcagatcctgcaggtccacgtgaagaaagtgacgctcgcagcggacgtcgatctggccgagattgcatcgcgcacgcccggttttgccggagccgatctcgccaacgtggtcaacgaagccgcgctgcatgcggccgaactcgacaaatccgcggtcggcatggtggatttcgacgaagcgatcgaccgggcgatgaccggcatggaacgcagaagccgcgtcatgaacgaacaggaaaagatcaccattgcctatcacgaagcgggccacgcgctggtcgcgctgagccggccacattgcgaccccgtcaagaaggtgtcgatcattccgcgcggcgtcgccgcgctcggctatacgcagcaggtgccgaccgaagaccgctacgttctgcgcaagagcgaactgctggaccggctcgacgcgtacctcggcggacgcgtggcggaggaaatcgttttcggcgacgtatcgaccggagccgagaacgatctggaccgggcaacggcgctggtgcggcatatggtgacacgctacggaatgagcgagcggctggggcttttcacgttcgacagcagtgatcccggcgtgggctatccgtcggcgggcgggcgaggcgagcgcttcagcgaaagcaccgcgaagctggtcgacgacgaagttcgacgcgaactggccgaggcccacgaacgcgtgacgcgcacgctcgccgacagccgcgcgcaactggaccgcattgcgcggcgcttgctggagtgcgaagtgctcgaccaggccacgctgctgcaactgatg

SEQ ID NO: 31111 - DNA, 855 bp, Burkholderia cepacia; identical to SEQ ID NO: 28352

SEQ ID NO: 31112 - DNA, 1590 bp, Burkholderia cepacia
ctcgagcgccgtgaggccaactacatccccgtcacgccgatcgatttcatcgtgcgcgcggcagaagtctacggtgatcgactggcagtcgtccacggggagattcgccgcaactggcgcgaaacctacgaacgctcccggcgtctcgccagcgcgttgcagcgggccggcattgaacgtggcgacacggtcgcggccttgctccccaacattcctccgatgatagaagcgcacttcggcgtgccgatggccggcgccgtgctcaatacgctgaatacgcggctcgacatttcgtcgctattgttcatgctgcgccacggcgaggccaaggcgctgatcgtcgataccgaatatggcgagttcgcgcatcgcgcttcgctggaattcccggatttgcgcgtgatcagcgtggcggacgccatgcccgccaatgccgatcaattcatccgcgcaacagactacgaagcgttcctgcaatccggcgaccccgaattcgcgtggaccatgccggccgacgaatgggacgccattgcgctgaactacacctcgggcacgaccggcgatccgaagggcgtggtgtaccaccatcgcggcgcgtatctgaatgcggtgagcaatatcctcgagtgggatatgcccaagcacgcggtttacctctggaccttaccgctcttccactgcaacggctggtgttttccgtggacggtggccgcgcgcgccggcgtcaacgtctgtctgcgcaaattcgatgcgaagacggtgttcgatctgattcgcaatgaaggcatcacgcattactgcggcgcgccgatcgtgcagagcgcgctcgcgaatgcgccggccgaatggcgcgacggcatcaaccatcgcgtgtcgacgatggtggcgggtgcggcgcccgcgccggcggtgatcgcgaagatgaaggaaattggtttcgatctcacgcacgtgtacggactcaccgagacctacgggccggccgcggtctgtgcgaaacaggaggcgtgggagacactggacgacagcgcgcgcgccgaactgaacgcgcgccagggcgtgcgctaccacctgcaggccgcggtgaccgtgctcgatccgcagacgctggcactcgtgcccaacgacggcgagacgatcggcgagatcatgttccgcggcaacatctgtatgaagggctatctgaagaacgagcgcgcgacggaagcggccttcgaaggcggctggttccataccggcgatctcggcgtacggatgcccgacggctatatccgcattcgcgatcgcagcaaggacatcatcatctccggcggcgagaacatctcgagtatcgagctcgaagacacgttgtatcgtcaccctgcggtggctgttgccgccgtggtggcgatggccgatccgaagtggggggaggtgccatgcgccttcgtcgaactcaaggaaggcgcccaggtgagcgcggaagagatcattgcgcactgccggctgtttcttgcgggatacaagctgccgaaagcggtgcgcttcggcgaattgccgaagacatcgacggggaaaattcagaagttcgaactacgcgcgcgcatcaag

SEQ ID NO: 31113 - DNA, 636 bp, Burkholderia cepacia; identical to SEQ ID NO: 28354

SEQ ID NO: 31114 - DNA, 612 bp, Burkholderia cepacia; identical to SEQ ID NO: 28355

SEQ ID NO: 31115 - DNA, 1857 bp, Burkholderia cepacia
aatggaacgacgatgtacgacttgctgaaaaccattgacgacccggcggcactgcgccgcctcgatcgccgccaattgcaaccgcttgccgacgagttgcgtgcctttgtgctcgacagcgtatcgcagacgggcggccatctttcgtccaacctcggcacagtcgagttgaccattgcgctgcattatgtgttcgacacgccgcatgaccggatcgtctgggacgtcggccatcaaacgtatccgcacaagatcctgacgggccgccgcgatcagatgcatacgctgcgtcagttgggcggcatctcggggttcccgaagcgtgacgagtcggaatacgacaccttcggtacggcgcactccagcacgtcgatctcggccgcgctcggcatggcggtcgcgagcaagctgaagggcgacaaccgcatgggcatcgccgtgatcggcgacggcgcaatgacggccggtatggccttcgaggcaatgaacaacgccggtgtcgaagacgacgtgccgctgctggtcatcctgaacgacaacgacatgtcgatttcgccgccggtcggcgcgctgaatcgccatctggcgcgcctgatgtcgggccgcttttacgcggccgcgcgtgccggtgtcgagcgcgtgctgcgcgtcgcgccgcccatgctcgatctcgcccgcaagctcgaagagcacgcgaagggcatgatcgtgccggccacgctgttcgaagagttcggcttcaactacatcggcccgatcgacggccatgatctcgattcgctgattccgacgctgcagaacatcaaggaactgcgcggtccgcaattcctgcacgtcgtgacgaagaagggccagggctacaagctggccgaagccgatccggtgctgtaccacggcccgggcaagttcaatccggccgagggcatcaagccggccgccacgccgtcgaagaagacttatacgcaggtgttcggcgaatggctgtgcgacgctgctgagctggatgcgcgcgtaatcggcatcacgccggccatgcgtgaaggttcgggcatggtggagttcgagaagcgcttcccggaccgttatttcgacgtcggtatcgccgagcaacacgcggtgacgttcgcaggcggcctggcggcggaaggcatgaagccggtggtcgcgatctactcgactttcctgcaacgcgcttacgaccagctgattcacgacgtcgcactgcagaatctgccggtggtgttcgcaatcgaccgcgcggggctcgtcggcgcggacggcgcgacgcacgcgggtgcttacgacctcgcgttcctgcgctgcattccgaacatgacggtgatggctgcgtcggatgaaaacgaatgccgccagatgctgtacaccgcattgcagcaaccgaaccccacggcggtgcgctacccgcgcggtgccggcacgggcgtggcgaccatcaaacagatgacggcgctgccgctcggcaagggggagatccgtcgcgaaacgtcgcagccggccggcaagcgcattgcgatcctggcattcggcacgatggtggcgccgtcgctggcggcggcggagcaactggacgcaaccgttgcgaacatgcgcttcgtgaaaccgctggacgccgatctggtccgtcagctggccgagacgcacgacgccatcgtcaccgtcgaagaaggctgcgtgatgggcggcgcgggttcggcgtgcgtggaagccctgcttgccagtggggttactcgtccggtactacaattgggcctccctgaccggttcatcgatcatggagatccggccaagctgctcgccgcgtgcggtctcgacgccgtgggcatcaccaagtcgatc

SEQ ID NO: 31116 - DNA, 882 bp, Burkholderia cepacia; identical to SEQ ID NO: 28357

SEQ ID NO: 31117 - DNA, 843 bp, Burkholderia cepacia
ctgatctccgcggccaatctcgcggaacggctcgccgccgcgccgggcagcgtgttcgtcatcgattgccggttcgatctggccgacccggaggcgggcgaaaaagcctatctggccgggcatctgccgggcgcgcattacctgcatctcgatcgcgatctgtcggggccgaagaacggccagaacggccgccatccgttgccggatcgtgcgcggctggtggagacgctggagtcgcgcggcctgaaacaagggcagcaggtcgtcgcctatgacgcacaaggcggcatgtacgccgcccgcgcatggtggctgctgcgctggctcggtcacgacgcggtcgcgctgctcgacggcgggctgcaggcatgggaggcaggcggttatccgctgacgcaggacgcgcccgcccagaacaccggcgacttcaaagccggcgcgccgctgtcggtcacggtcgacgcgcaaacggtcgagcgcaatctgggttcgaaggaacgcgtggtggtcgacgcgcgcgccgccgaccgttatcgcggtgagaacgagacactggatcgcgtcggcggccacattcccggggcgctcaaccgcttcttcaaagacaacctcaccgccgacaaccgcttcaagccggctcacacgctgcgcgaggaattccacgcgctgctcgccggcacgccgccggaacacgtgatactgcaatgcggctcgggcgtgacggcctgcgtgaatgcgctggcgatggaagtcgccggcctgcacggcgcggccttgtacgcgggatcatggagcgaatggagttcggatccaaagcgccccgtcgcaactggcccgaatcct

SEQ ID NO: 31118 - DNA, 789 bp, Burkholderia cepacia
gtgaacatcgatctatcgggcaagacggcgattgtcagcgcatccacggcggggatcggctttgcgatcgccaccggcattgccgcatcgggcgcgcggaccattatcaacgggcgcaagcaggacgcggtggaccacgcgatcgaggcggtccgcaagagcgcgccgcaagcggaactgcaaggcttcgcgggcgacctcggcacgccgcagggctgcgacgcgttgatcaaagccgtgccgcaggcggacatcctcgtgaacaatctgggcgtcttcggccccggcgacatcttctccaccgcggacgacgactgggagcgctacttccaggtgaacgtgatgtcgggcgtgcggctcacgcgccactacctcaaaggcatgatggagcgcaaatggggccgcgtggtgttcatctcgtccgagtcggcgctgaatattccgccggacatgcttgcttacggcttttcgaagaccgcgcagttgagcattgcgcgcggcatcgccaagcacgcggccggcagcggcgtgaccgtgaatgcggtgctgcccggaccgaccctgtccgacggcttgcgggcgatggtggaagagacggccagacagcagggcaaaacggtcgaacaggtcgccacggagttcgtgcgcgagcatcgcggcagttcgatcatccagcgagcggccaccaccgaggaagtggccaacatggtcgtctacgtgtgctcgccgcaggcgtcggcgaccaccggcgcggcgctgcgcgtggacggcggcgtgatcgatacgatc

SEQ ID NO: 31119 - DNA, 1695 bp, Burkholderia cepacia
cactcgagcgccgccaccggcggcgtcgcgaaagcgcgcacgcatcggcgcggcaaacccgcggccttgagcgacgatccgctctggtacaaagacgcgatcatttaccaggtgcacatcaagtcattcttcgacgcgaacaacgacggcgtcggcgactttcccggcctgatcgcgaagctcgactacatcgccgaactcggtgtgaacgcgatctggctgctgccgttctatccgtcgccacggcgcgacgatgggtatgacattgccgattaccgcaacgtgcatccggactacggcaatctgtccgacgtaaagcgcttcattcaggaagcgcacgcacgcggcattcgtgtgattaccgaattggtgatcaaccacacgtcggaccagcatccgtggtttcagcgcgcgcgccgcgcgaagccgggttcgaaccaccgtaactactacgtgtggtccaacaccgatcagaagtatctggaaacgcggatcatcttcatcgattcggagccgtccaactggacgcacgatccggtagcgggcgcgtattactggcaccgcttctactcgcatcagcccgatctgaatttcgacaatccggccgtgttgagggaggtgctgcaggtcatgcgcttctggctcgatatgggcatcgacgggttacggctcgacgcggtgccgtatctggtggaacgtgaaggcaccaacaacgagaacctgccggaaacgcacgcggtgctcaagaagattcgcgccacgatcgacgccgaatatccgaaccggatgctgctcgccgaagccaaccagtggccggaagacgtgaaggaatatttcggcgacgaagacgaatgccacatggcgttccacttcccgctgatgccgcgcatctacatgtcgattgcgagcgaagaccgcttcccgatcaccgacatcatgcggcaaacaccggacctcgccgaaacgaaccagtgggcgattttcctgcgcaatcacgacgaactgacgctggaaatggtcacggattccgagcgcgactatctgtggaacacctacgcgagcgatcgccgcgcgcgcctgaatctcggcattcgccgccgtctcgcgccgttgatggaacgcgaccgccgccgtatcgagctgatcaattcgctgctgctctccatgcccggcacgcccgtgatctattacggcgacgaactcggcatgggcgacaacattcacctcggcgaccgcgacggcgtgcgcacgccgatgcaatggtcatcggaccgcaacggcggtttttcgcgcgccgaccctgagcaactcgtgctgccgccggtcatgggctcgctgtatggtttcgacgcggtgaatgtggaagcgcaaagccgcgacccgcattcgctgctgaactggacccggcgcatgctcgccacgcgtcgcgcgaagcagactttcgggcgcggcacgatccgtttcctgaagccggaaaaccgcaagattctcgcgtacctgcgcgagatgccgggcgagccgccgattctctgcgtggcgaatctctcgcgcgcgccgcaagcggtggagctcgatctgtccgaattcgacggctccgtgccgatcgaaatgaccgcggactccgtgttcccgccgatcggccaactgacgtatctgctgacgttcccgccgtacggcttcctgtggttcatgctg

SEQ ID NO: 31120 - DNA, 1989 bp, Burkholderia cepacia
cttctgcccggctcgccctatccgctcggcgccagttgggatggcctcggcgtcaactttgcggtgttctcggcaaacgcgcaaaaaatcgagctttgtctgttcgatcccaccgggcgcaaggaactgcgccgtttcacgctgcccgaatgcaccgacgaagtctggcacggctacctgcccaacgcgcatccgggcaccgcctacgggtttcgcgcgcacgggccgtatcagccgcagcatggacatcgcttcaatccgcacaagctgctgctcgatccgtacgcgcgcaagctggtcggacagtttcgctggtcggatgcgctattcggttatcgcgtgcattcgaatcgcgcggatctttccatcgaccggcgcgattcggcgcccgccatgccgaaatgcgtggtgatcgacgaggcgttcgactggtcgcacgacaagcggcccaatgtgccgtggggcgaaaccatcgtctacgaaacgcatgtgcgcggcgcttcgatgctgcgcgccgatttgcgccagcatgaacgcggcacgttcgcggcgctggcttcgccggagttcatcgaccatctgctgaaactgggcgtgaccgcggtcgaattgctgcccgtgcacgcgtttctcaacgatcgctttctggtggaacgcggcctgcgcaactactggggctacaactcggcggcatttttcgcgccggagccgtcctacctcagcacgcaccggctcgacgaaatgcgcattgccgtgcgccagttgcacgcggccggcatcgaggtcattctcgacgtggtctacaaccacacctgcgaaggcaacgagatgggcccgacggtgtcgtggcgcggcctcgacaacgccagctattaccgcctgattcccggcgacgaacgccaccatatcaacgacaccggctgcggcaacaccgtgaatctgccgcatccacgcgtgctgcaaatggtgatggattcgctacgctactggtcgacggcattcaatatggacggcttccgtttcgatctcggcgtcacgctcggtcgcgagcaacacggcttcgatcccggctccggtttcttcgacgccttgcgccaggacccgatcctgtcgcaacgcaagctgatttccgagccgtgggatatcgggccgggcggttatcagctcggcaatcatccgccgggcttcggcgaatggaacgaccgtttccgcgacaccgtgcgccgcttctggcgcggcgacgccggcttgcggcccgatctcgccgcgcgtctgaccggctcggccgatctgttcaaccgccgcttcagaaagccgtgggcgtcggtcaatttcgtcacgtcgcatgacggttttacgttggccgacgtcaccgcctacgagcagaagcacaacgaagcaaaccgcgaagacaacaacgacggccacaacgagaattgcagccgcaattggggcgtggaaggcgagagcgacgacccggcgattctcgccacccgcaagcgcgtggcccgctcactgatcgccacgctgctgatggcgctcggcacgccaatggtgctggccggcgacgaatcgctgcgcacccagcacggcaacaacaatgcgtactgccaggacaacgaactgtcgtggctcgactgggcgcgcgcggaatcgccggacggtcgccagatgaccgcgttcgtcgcgcgcgtgatcgcgttgcgcaagcaacatccgctgttgcgcgaaacgcgtttcctgttcggcgatcgtgaagtgttgcccggtctgttcgacgtgggctggttcgacgagcggggcgacccgctcaccatcgaagcctggcaggatcccgaaggccgcgcgttcacattgcgccgcgccggcccaggcttgaacggcgaaacagaagtattgttgatgatgctcaacgccaacgagaaaacactgcggtttacgcctcccgcaccgcatctggaatggcatgtgctgttagacactgctgaa

SEQ ID NO: 31121 - DNA, 1206 bp, Burkholderia cepacia
acattggaaaccagaaccaacatggacgactccctgaacttcgatacgctggcagtccgctcgggcacggtgcgcagcgacttcaacgaacattcggaagcgattttcctgacctcgagcttcgtgttcgcgagtgccgcggacgccgccgagaaattcaggaattccgaagacaactacacctattcgcgcttcacgaatccgaccgtttcgatgttccaggatcggctggccgcgctcgaaggcggcgaagcctgcatggcgacggcctcgggcatggccgcgatcatgtcggtggtgatgtcggcgttgcaggcgggcgaccatctggtgagctcgcaggcgttgttcggctccacgctcggcatgttctcgcagatcttcagcaaattcggcatcacgaccacgttcgtcgatccgaccgatctggacgcgtggaaaaacgccgtgcgcccggagacgaagatgttcttcctcgaaacgccgtcgaatccgctgaccgaagtcgccgatatcgaagcgatcggcaagatcgccaaggcgtcgaacgcgctgttcgtggtcgacaactgcttctgcagcccggccttgcagcagccgctgaagctcggcgcggacgtcgtgatgcattcggccaccaagttcctcgacggtcagggccgcgtgcttggcggcgcgctggtcggctcgaagcagttcatcatggagaaggtgttcccgttcgtgcgcagcgccgggccgacgctgtccgcgttcaacgcgtgggtgctgctcaagggcatggaaacgctatcgctgcgcgttgaaaagcagtcggcgaatgcgcttgaaatcgcgcgctggctggaaacgcatccggccgtgaatcgcgtgttttatccggggctggaatcgcatccgcagcatgcgctggccatgcgtcagcagaaggcgggcggcgcaatcctgtcgttcgaactgaagggcgacacgcccgagcagatgcgcgcgaatgcatggcgtgtgatcgacaacacgaaaatctgctcgatcaccggcaacctcggcgatacgcgcaccaccatcacgcacccggccacgaccacgcatggtcgcgtgacgtcggaagcgcgcgcggcggcgggcatcagcgaaggcttgatccgtcttgcggtgggtctggagaacgccggcgatatccgcggcgatctggagcgcggactggcg

SEQ ID NO: 31122 - DNA, 645 bp, Burkholderia cepacia; identical to SEQ ID NO: 28363

SEQ ID NO: 31123 - DNA, 1107 bp, Burkholderia cepacia
gtaggtctcgtaggttggcgcggcatggtcggcagcgtcctgatgcaacgcatgcagcaggaaggcgatttcgatcttatcgaaccggtgtttttcagcaccagcaacgcgggcggcaacgcgccgtcgttcgccaaaaacgagaccaagctcaaagatgcgacaagcattgaagacctgaagaagtgcgaagcgatcatctcgtgccagggcggcgactacacgaacgaagtgttcccgaagctgcgcgcggcgggctggaacggctactggatcgacgcggcttcgtcgctgcgcatgaaggacgacgcggtcatcattctcgatccggtcaacctcgacgtgatcaagaacgcgctggtcaagggccagaagaatttcatcggcggcaactgtacggtcagcctcatgctgatggcgctcggcgggctgttccgcgaaaacctcgtcgactggatgacggccatgacgtatcaggccgcttcgggcgcgggcgcgcaaaacatgcgcgaactgctgcagcaaatgggcacgctgtacggtgcagccaaggaagatctggctgatccgtcgtcggcgattctcgacatcgaccgccgcgttctgagtgcgatgaacagcgaccgcatgccgaccggcaactttggcgtgccgctcgccggctcgctgattccgtggatcgacaaggatctcggcaacggcatgtcgaaagaagaatggaagggcggcgccgaaaccaacaagattcttggcaagccggctatgggcacgccgggttcgattccggtggacggcctgtgcgtgcggatcggcgcaatgcgctgccactcgcaggcgctgaccatcaagctgaacaaggacgtgccgctggacgaggtgaacagcatcctcgcgtcgggcaacgactgggtcaaggtcgtgccgaacgagcgtgaagcgtcgatgcgcgatctgtccccggcggtcgtgacggggacgctgacggtgccggttggccgcgtgcgcaaactggcgatgggcggcgaatatctgtcggctttcaccgtcggcgatcagctgctgtggggcgccgcggagccgctgcgtcgcatgcttcgcattgtgctc

SEQ ID NO: 31124 - DNA, 2224 bp, Burkholderia cepacia
gagcgccgcgttctacatgccgtcacggtgcagaaggaccacctcagcgttcgaggccgaagctgctgagcggccggttggcgcatcagcgcgaacctcgcgctgtcggaccataacgtgccgaccacggaccgcagccacggcattgccgatcccatctcccggctgcaagtcgacacgctcgattccaactgcgacgcctacggcatcacccagttcaagatgaacgatctgcggcagggcatcgtgcacatcatcgggccggagcagggcgcgacgctgccgggcatgacgatcgtctgcggcgactcgcacacgtccacgcacggcgcgttcggcgcgctggcgcacggcatcggcacgtcggaagtcgagcacgtgctggccacgcaaacgctcctgcagaagaagagcaagaacatgctggtgaaggtggaaggcgcgctgccgcgcggctgcaccgcgaaagacatcgtgctcgccatcatcggcaagatcggcacggcgggcggcacgggctatgcaatcgaattcggcggctcgaccatccgcgcgctttccatggaaggccgcatgacggtctgcaacatggcgatcgaggcgggcgcgcgcgccggcatggtcgcggtcgacgacaccaccatcgaatacctgaagggccgcccgttctcgccggaaggtgtggagtggaaccacgcggtcgagtactggaaacagttcaaatcggacgacggtgcgcaattcgaccgcgtggtcgagctgaacgccgccgagatcgtgccgcaagtcacgtggggcacgtcgccggaaatggtcacggccgtagacggccgcgtgccggatccggatcgcgagaaggacccggtcaagcgcgacgccttggagcgcgcgctgaaatacatggcgctcgaaccgaatgcgccgatcgaatcgatcaagccggataaaatcttcatcgggtcgtgcacgaacgcgcgtattgaagacattcgcgccgcggcttacgtcgtgaagaaactgggccgccgcgtggcgccgaacattcgtctggcgatggtcgtgccgggttcggggctcgtgaaggcgcaggcggaacgtgaaggcctcgacaaggtctttaccgacgccgggttcgaatggcgtgaaccaggttgctcgatgtgtcttgccatgaacgccgaccggctggagccgggcgagcgttgcgcatccacgtcgaatcgtaatttcgaaggtcgtcagggcgccggtggccgtacccacctcgtgagccccgcgatggctgcggctgcggctatcgaagggcatttcgtcgatattcgcaagcttggataaacacgcatgatgaagaacatgaatcgcaccactctattgcgccgcttcgcgctcggttccctggctgggctattgctcggtctggccggttgcaacacggtgcacggattcggcgaggacatgtcgcacctcggcaattcgatcagcaatcacgctgataaataagcggtttttgatttttgccggccatgcgcaaagcggctttttttagtcgctgcgcgcatcgcccggtctcgaaacaggcgcaagcgtcatggaaaaattcatcgtacacaccggcgtcgtggcgccgctcgatcgcgaaaacgtcgacacggacgcgatcattccgaagcaattcctgaagtcgatcaagcgcacgggtttcggtccgaacgcgttcgacgaatggcgctacctcgaccacggcgagccgggtcaggacaattcgcagcgcccgctgaatccggacttcgtgctgaaccagccgcgttatcaaggtgcttcggtgctgttggcgcgcaagaacttcggctgcggcagttcgcgtgagcacgcgccgtgggcgttggagcaatatggctttcgcgcgctgatcgcgccgagcttcgccgacattttctacaacaactgcttcaagaacggcgtgttgccgatcgtgctgaccgaacagcaagtcgatcacctgttcaacgaaacgtatgcgttcaacggcttcaagctgacggtcgatctcgaagcgcaagtcgtgcgcacggcggacggcggcaccgaatatccgttcgaagtcgcggcgttccgcaagtactgcctgctgaacggcttcgacgacatcggtctcacgctgcgtcacgcggacaagatccgccagttcgaagcggagcggatcgcgaagcagccgtggctggct

SEQ ID NO: 31125 - DNA, 1659 bp, Burkholderia cepacia; identical to SEQ ID NO: 28366

SEQ ID NO: 31126 - DNA, 1005 bp, Burkholderia cepacia
atgcaagccgctgtggtcgaacagttcggcaagccgctggtactgaaggagctcgccattccgacaccgggtccgggccaggtgctggtcaagaccgaggcctgcggcgtatgccataccgatctgcatgcgaccaacggcgactggccgctcaagcccggtttgccattcacgccggggcatgagggtattggtattgtcgccgccctcggcgcgggtgtgacggcggtgaaggagggcgaccggatcggcgtgccctggctgtattccgcctgtgggcactgcgagtactgccttgcggcacgcgagcccgtctgcgccgaagcacagttcggcggctacacgaagaacggcggctttgccgaatacatcgtggctgacccgaactacgtcgctcacataccggcaggtctggctgcccgcgaagcagcaccgctcatctgcgccggcatcacttcgtacaagggcatcaaggagacccaggcgcggccgggtgaatgggtcgtgatctcaggcgtcggcggactagggcacctgggtatccagtacgccaaagcgatgggcttgcaggtgtgcgccgtcgatatcgacgacggcaagctagcccatgcgaaacgcctcggcgccgacgccgtggttaatgcgaacgacggcgacccgattgccgccgtgataagggccactggcggcggcgcgcatggcgtgctgattacggcgccctctcttggggcgttcaaacagggcgtcggcatgacgcgcaaatgcggtacctgcgtgctggtcggactgccgccgggtgaattccccacgccgctgttcgatgtcgtggccaactgcatcacgattcgcggctcgttcgtcggcaatcgccgcgatatggcggaagcgctggcctttgccgccgacggcaaggtcagggccgacatcgagctgcagccgctgtcggcgatcaacaacgtgttccagcgtctgggacacggcgatgtaccgtcgcgcgtggtgctc

SEQ ID NO: 31127 - DNA, 1350 bp, Burkholderia cepacia
tatcagagcgtcaacccgaataccggcaagacattgaagagcttcgacgagctgaacgatcagcagcttgaaaaagcgctgtccaccgctcagtcatgcttccatgtgtggaagaaaaccagctatgcgcagcgcgccgcgattatttccagggctgccgggctgatgcgtgcaaatgttgacgaattcgccaaactggcaacgctcgaaatgggcaagcgcattgacgaggcgcggggagaggtcaacttcagcgccgacattctcgactactacgcgaggcatgcggaagcgttcctggcaccgacgaagctccatccgaaagtcggcgaggcccatatggagacgagtccattcggcgtgctgttctgcgtggagccatggaactttccgtactatcagctcgcgcgcgtcgcagggccacaactgatggcgggtaacgtgctggtggtcaagcacgcaggctgcgtaccgcaatgtgcgattgccttcgaaaagcttctgattgacgcgggtgcaccggtgggcgcttacacgaacctcctgatctcgcataaacaggctgaacggatcatcgatgacccgcgcattcagggcgtggcgttgacgggtagcgtcgcggccggcagaagtattgcggcgcgagctggccagaaccttaaaaagacgtcgatggaacttggcggcagcgatgcgttcatcgtgctcgacgacgccgatctggagaagaccattccgtgggcagtttggggccgcatgtataacgccggccagacctgttgcgccgcgaagcgcttcatcgtcctcgattcgattgcggacaggtttctcgagaaattcaaggccgcgctcaacgaactgaagcctggcgatccgatggatgaaaagaccacgcatggtccgctgtcgaccgaggcggccctgacgcaattgctcaagcaggtcgacgatgcggtcgcaaagggtgccacgctggtgatgggcggaaagcgcatcgaccggcccggctcgttcatgcagacgacgatcctgacggatatcaagcccgacaacccggccttccgtgacgagttttttggcccggtcgtctcattcttccgcgtcaaggacgaagccgccgcgattgcactggccaacgactcggactttggtctgggcggctcggtcttcacggcggatgccgcacgcggcaagcgcgtggcgagcggagtcgataccgggatgatgttcatcaacaacatcgactggtccgatgccgaactgccgtttggcggtatcaaatattccggttacgggcgcgaactcggcaacatgggcatccaggagttcgtcaataccaagctggtccgt

SEQ ID NO: 31128 - DNA, 1374 bp, Burkholderia cepacia
ggttataccgaagccgaagcgctgggcatgacggtgtccgatatgctgccaccgggcgccagacaggatcacctcgatttcatccgttacgccgcccacaacgaggcactgcattcctatgaaacacagcgggtcacgaaaggcggtcgcgtggtcgacatctggatcaccctgtcgattctctcggacgatcagggtcatgccgtggctattgccacgacggagcgagaactcactgatcgcagcctgagcaacgcccagcttcgggagcgtgccgaacgcctggcgcaggccgaccggcgaaagaacgaatttctggcgatgcttggacacgaactgcgtaatccgctcgctgccctgtgttcctctggagatttgctcgcctcggaaaccatcgatccgcgacaaaagtcctgggccgtcggcgtcatccagcggcaaggtcgatcgatgacgcaactggtcaacgagatgctggatctcacgcgtattacgagtggcagcatagagttgcgtcgtcaggcggtcacgctgaaagcggtcatccagagcgcggtcgaggtttgccagccgattattgacgaacggcatcacaccttgtcggtgtcgctaccggacgagccggtgttgatgtacgtcgaccccacccggctatcgcaggtcgtcgaaaacatcgtgatcaacgcagccaggtacacggaacctggcggccatatcagtctcacagcgacaagaaccggccgtcggctttcgcttcgtgtcaaggacaacggaaggggaattcctgcttcgatgctcagcacgctttttgacatgttcgtccaggggccggtgccctacggtcagcttcataatgggctgggagtcggcctgtccgtggtccggcggttggttgagttacatggcggatcggttcgggccatcagtgatggcaggacaggtagcgaattcatcgtcgatcttccgctgggcatgatcccgcccggcgtggaacaggccggtacaccgcaggaaccggtcaacgcgggtccgcgcaagatactcatcattgacgacaatgccgacgcgagcgaggccctggccatgcttctggcggcggaagggcatgtggtggagacacggctggatggccccggggggctcgaagccgcttcgactttcaggccggacgttgtgctccttgacatcggattgcccggcatggacggctatgaggtggcgaagcagttgcgcgactctgtggccacgtacgacacgatgctgatagccgtcaccggctacgggcaaccaggcgaccagctcagatccgcagaggcgggacttgattaccacctggtcaagccagtggatatcaacgcgttgacgcgtctgctt

SEQ ID NO: 31129 - DNA, 1524 bp, Burkholderia cepacia
atccgccacaatgccagattccacggtatcaaaacggctgtcgtctgcggcgacgatcgcctgaactggcgtgagtttcaccttcgtacgaacaaggtcgccaatgcactcgtgcgagccggacttcagaaaggggaccgcgtatgcttcttcatgcagaactccatggcggccttcgagttgatctggggcacgattaaggccggaggcgtggtctcgccactgaatgtcatgatggccgctgattcgctaccggccatgatcgataacgctgcgccgcgtttcatattcgtcgacagcgagctcgctggcgcggtcgatgcagtccggggcgccgtgcggaataagccggatattttttacgcggagtctggcgcggttgagggctggcaatcatacgtcgaactggttgaggccggttccgaggcggagtactttccggatctgaagctgtccgatacgatgacggtgctctacagttccgggaccactggtgttccgaaaggcagcgagcatacgcacgcagcgcgccacttctattcgctcggctgcggtcctgccctgcgaatggatccttacagcgtggcgctctgcgcaactccgctgtacacaaatggaacctggatcaccctccttccagcgctgtacctcggcggcacagtagttctcgcccgcaagctgacgcctcaagcctggctggaactggtggcgcgcgagcggatcacccatgcattcctggttcccactcagtgcatcgggatcgtggagcgtgcgtcacccgaatatgacgtttcatcgctgcagggaattctttatggtggtgcgccgatgaccagccagacagcggcggccatggcgaagaccttcccgaacacccgcatgtacgagatctacgggatgtccgaggggtggtgcacgctcgcatatcctgaggatcgcgcgcacggcaggagttccaccgtgggcaaaccggtgttcggaggcgatatttgcgtcatcgatccagaaggcagggaactgccacccggagagcaaggcgaacttgccggctggagcgctgggcttatgaagggatatcttggcgacccgcagcgcaccgcagatatcgtctggaagggcccgcatgggcgcacttatctgcgaagcggcgatatcggatacatggacacggaagggttcttcttcgtgaacggccgagtgaaagacatgatcatctctggcggcatcaacgtgtttgcatcggatattgaggaggtcttcatgcagcaccccgcggtggccgaagctgcggccatcgggattccgcatgacaaatggggtgaaaccccgatcgttatggttatcctgcggcagggccatcagatcgatgcagttgcactcaaggagtggggcaaccatcgcctcggtaagttccagcgagtgagcgaggtgaaattcgttgatgattttccacgggccaattacggcaaaattctcaagcgggtgctgcgcgagccatactgggaagggcgcgagcggagtatt

SEQ ID NO: 31130 - DNA, 1158 bp, Burkholderia cepacia; identical to SEQ ID NO: 28371

SEQ ID NO: 31131 - DNA, 1308 bp, Burkholderia cepacia; identical to SEQ ID NO: 28372

SEQ ID NO: 31132 - DNA, 423 bp, Burkholderia cepacia; identical to SEQ ID NO: 28373

SEQ ID NO: 31133 - DNA, 864 bp, Burkholderia cepacia
ggcagcattcctgccatcatcaccccgatgctcgaagacggcagtctggatctgccggcgtttcgcaaactgatcgactggcacgtcgcagagggcacgaacgctctcgtggtggtcggtacgagcggcgagtcggccacgctgtcggtcgaagaacacgtgctaatggtcaagaccgcggtcgagcacacggcgggccggattccggtgatcgcgggctcgggcggcaactccacgaccgaggcgatcgaacttacccagcgcgccaaagaggtcggcgccgacgccacgctccaggtcgtgccgtactacaacaagccgacgcaggagggcatctaccgccacttcgcgaagatcgcggaaaccgtcgatctgccggtgattctgtacaacgtgccgggccgcaccgttgccgacatgagcaacgaaaccatcctgcgcctcgcgcaggtgccaggtatcatcggtgtgaaggaagcgaccggcaatatcgatcgcgccgcgcatctcatcaagtttgcgccgtcgcacttcggcatctacagcggcgacgatcccaccgccatcgcgctgatgctgctcggcggccacggcaatatttcggtcaccgccaacgtcgtgccgcgcgccatgagcgagctctgcaaggccgctctcgccgcggacgttaagaccgcccgtgagattcatctgaaactcctgtcgctgcataagaacctgttcgtcgaatcgaatccgattccggccaaatgggcgctgcagcaactgggtcgtgtgcagggcggaatccgcctgccgcttacgccgctcgacccgcagtaccacgaagtggtacgcggcgcgctgcgcgaagcgggcctgctg

SEQ ID NO: 31134 - DNA, 1281 bp, Burkholderia cepacia
atgagtgctatcgtagatatcatcggtcgagagattctcgattcgcgaggcaaccccaccgtcgaatgcgacgtgctgctcgaatcgggcacgatgggccgcgccgcggtgccgtcgggtgcgtcgacgggttcgcgcgaagcgatcgaactgcgcgacggcgaagccggccgctacggcggcaagggcgtgctgaaggctgtcgagcacatcaacaccgaaatctccgaagcgatcatgggcctcgacgcttccgagcaggcgttcctcgacaagacgctgctggaactcgacggcacggacaacaagtcgcgcctcggcgcgaacgcgatgctggctgtttcgatggccgtcgcgaaagccgccgctgaagaagccggcctgccgctgtaccgctacttcggcggctcgggcgcgatgcaactgccggtgccgatgatgaacatcgtcaacggcggcgcgcacgccaacaacagcctggacatccaggaattcatgatcgtgccggtcagccagccgaccttccgcgaagcgctgcgctgcggcgccgaagtgttccacgcgctgaagaagatcctgtcggatcgcggcatgagcacggcagtgggcgacgaaggcggcttcgcgccgaacttcggcagcaacgacgaatgcctgtcgaccatcctgcaagccatcgagaaagcaggctaccgcgccggggaagacgtgctgctcgcgctcgactgcgcagcgagcgagttctaccacgacggcaagtaccagctggccggcgaaggcctgcaactgtcgtcaacggaattcacggactacctggcgaatctggccgacaagttcccgatcgtgtcgatcgaagacggcatgcacgaaagcgactgggccggctggaagacgctgaccgacaagctcggcaagaaggtccagctggtgggcgacgacctgttcgtcaccaacacgcgcatcctgaaggaaggtatcgagaagggcatcgccaactcgatcctcatcaagatcaaccagatcggtacgctgacggaaaccttcgcggccatcgaaatggccaagcgcgccggttacacggcggtgatttcgcaccgttcgggcgaaaccgaagattcgacgattgcggatatcgcggtcggcctgaacgccggtcagatcaagacgggttcgctgtcgcgctcggaccgcatctcgaagtacaaccagttgctgcgcatcgaagaagatctgggtgatatcgccagctatccgggcaagtcggcgttctacaatctgcgc

SEQ ID NO: 31135 - DNA, 1869 bp, Burkholderia cepacia; identical to SEQ ID NO: 28376

SEQ ID NO: 31136 - DNA, 1149 bp, Burkholderia cepacia; identical to SEQ ID NO: 28377

SEQ ID NO: 31137 - DNA, 1353 bp, Burkholderia cepacia
atggcatacgcaagcatcaacccgaatagtggcgagaccctgaagcgcttcgacccattgaccgacgcacagctcgaacaatctctcgcgagcgctcaggcatgttcccagacgtggaagcagaccacctacgctcagcgcgccgggatcctcaacaaggcggccgccctgttgcgcactcatgtggatgaattcgcgaagctggcgacgctggaaatgggcaagcgtatcaatgaagcgcgaggcgaggtgaatttcagcgccgatattctcgcctactacgcgaagcatgcggaagcgtttcttgctccgatcagactcgagccgaagattggcgaagcccatatggaaagcagtccgttcggcgtgctcttttgcgtggagccgtggaatttcccgtattaccagttggcgcgagtcgcgggtccgcaattgatggccggcaatgtcctcgtggtcaagcacgcggcctgtgtgccgcaatgcgcgatcgcgttcgaaaagctattgatcgatgcgggcgcacccaaaggcgcttataccaatctgctgatctcgcatgagcaggcccagcgtgtgatcgacgatccgcgtatcaagggcgtggcactgaccggtagcgccgcggccggcaaaagcgtcgccgcgcgagccggacagaacctcaagaaaacctcgatggaattgggcggcagcgatgcattcatcgtgctggatgacgccgacctcgaaaagacgattccgtgggcagtgtggggacgtatgtataacggcggccagacctgctgcgcagcgaaacgctttatcgttctcgattcgattgccgacaggttccttgagaaattcaaggcggcgttgtcggaactcaggccaggcgacccgatggatgaaaagaccacacatggtccgctttcgagcgaatcagcgctcgttcaactgctcaagcaggttgacgatgcggtggcgaacggcgccacgctgttgatgggcggcaagcggatcgatcgccccggctcgttcatggaaatcaccattctgaccgatatcaagccggacaaccctgcctttcgcgacgagtttttcggcccggtggtgtcgttcttccgcgtgaaggatgaagccgcggcgattgccttggcgaacgactccgacttcggtttgggcggttccgtcttcacagaagatatcgtgcgcggcaagcgggttgcgagcagcgtcgagacgggaatgatgttcatcaacaacatcgactggtccgatgcggaactgccgttcggcgggatcaaggactcgggctacggacgcgaactgggcaacatgggcatccaggagttcgtcaacaagaagctggtt

SEQ ID NO: 31138 - DNA, 1419 bp, Burkholderia cepacia
ccggatgaaacgggttgcgcgtggcacgatacgcgtatgacctacggagaactcgacgcgctggctgacggcgtcgcgcgtgcactggtgcggcgcggtctgaaggtcggtgagcgcgttgccattcttgcggcgaatcgtgctgaatatgtcgcggcgctgctcggcatcatgcgcgcgggaatggtcgccgtgcccgtcaacttcaggtttccgcccgcgctctccacctttgtgattcgcgatagcggtgcaaggctggtgttttgcgacgccgcgcgacttgccgattgcccggacgatctgccgacagtcgtattcgattcgacgggggaagacagtttcgcctctttcgtcgaacgcggcccgttcgagactttcgtgcctacgcccgacacgccggcaatgtttctctatacgtccggctcgactggcaagccgaagggcgtaatgctctcgcacggcagccatctgtgggtggcgcgtacgcgagcgcgcgcgcagccaccggaggcgcatcgctttctggtggccgcgcccatgtatcacatgaacgcgctgacgctcgtgctgatgtcgttatacgggcacggtacggtggtactgcttccgcaattcaccgcgcgcatgtacatcacggcgatcgagcgttatcgggttacgtggctcacctccgtgccgcccatgatcgcgatgatgctgcgcgaaaaggaactgctcgagcgcacggatctttcatcggcgcgcttcatccggatgggctcggcgcccgtcagcgagagcttgcttgcgcagatcggcgaggtactgccgaatgcgaagctcactaacgtctacggcacgaccgagggcggcccgatcgtgttcgggccacatccgcaagggatcgaaccgccgttgctgtcggtcggatatccgcatcccgaagtcagcgtcaagttgctcgacgcaccgccgacaggtgttgcaaccggcgtgctggccgtaaaaagccccgccgtcatgctcggttaccacaaccggccggacctgccgctgccggtgacagcagacggcttctatataacgggtgacgtatttcaccgcgacgaacagggcttctatgcgttcgtcggccgtgcggacgacatgttcgtgtcgggcggcgaaaacatctttcccggtgaagtcgagcagatgctggagacgcacccggacatcgtccaggcttgcgtggtgccggtcgccgacgacatcaagggaaccaagccggtggcgttcgtggtgcggcgcgcgggcgcgtcgctaacggaagaggaagccaaacagtatgcgctgacgcatgcgcccgcctaccagcacccgcggcgcgtgtggttcgtcgacgcattgccgcttgcgtccacgaacaagatcgatcgcgccgcattaaaagccata

SEQ ID NO: 31139 - DNA, 579 bp, Burkholderia cepacia
gcggtggaccacgtgagcttccgcatccgcagcggcgagattttcggctttctcggctccaacggctgcggcaagtcgaccacgatgaagatgctgaccggactgctgcccgcgagcgaaggctcggccaaactgttcggccgcgaagtcgatcccaacgacatcgacacgcgcacccgcgtcggctacatgtcgcaagctttttcgctctacggcgagctgacggttcagcagaatctggtactgcacgcgcagctctttcacgtgccgccgcagcagattgccgccagggtcgacgagatggtgagccgcttcggcctgggcgaggtacgcgacgcgttgccggacagcttgccgctcggcatgcgccaacgcctctcgctggcggtcgcgatggtgcacaagccggaactgctgattctcgacgaaccgacttcaggcgtggaccccgtcgctcgcgacaacttctggcagttgatgatcgagctcgcccgccgcgaccgggtcacgatcttcatctccacgcacttcatgaacgaggcggagcgctgcgaccgcatctcgctgatgcatgcgggc

SEQ ID NO: 31140 - DNA, 679 bp, Burkholderia cepacia
tacgcgaaaaccattgcgctcgacaacctcacgctggattttcccgccggccgcatgaccgggctgatcgggcccgacggcgtcggcaagtcgagcctgctggcgctcgcagccggcgcccgcgcggttcaggaaggcaccgtcgaggtgctcggcggcgacatgcgctcgcgccggcaccgtgcgctcgtttgtcctcgtatcgcctacatgccgcaagggttgggaaagaatctgtacccgacactgaccgtcgaggagaacctgcagttcttcgcgcggctgttcggccacgatgccgcggagcgccgccggcgcatcgactcgctgacccgcagcaccggcctgaaaccgtttctggcgcgcccggcgggcaaactctccggcggtatgaagcagaagctggcgctttgttgcgcgctgatccacgaccccgatctgctgattctcgatgagccgaccaccggcgtcgatccgctggcgcgcgcgcagttctggaatctgatcgcgagcatccgcaagggccggcccggcatgagcgtgatcgtcgcaacggcttacatggacgaagcgcagcgcttcgattcactcgtcgcgatggatgcgggacggatcctcgcgaccggcgaaccgcgcgccctgctcgaacagacgaacagcgacacgctggaagcggcgt

SEQ ID NO: 31141 - DNA, 798 bp, Burkholderia cepacia
ctcgaaggtcgcgtcgccatcgtaaccggctccagttcgggcaatggacgagcaatcgcgctagccctcgcgcgcgaaggcgcccacgtcgtctgctctgacctgaagaagtcggcactgaaaggcggctacgagaaggatatcgaaaccgataccgacgcagttatcgcccagcaaggtgggaagaccgcgttcatcgcggctgacgccagcaaagcagccgacgtgcagaaaatcgtcgatcatgcggtttcgactttcggccggctcgacatcatcgtcaacaacgccggcgtgttcaccggtctgcatagcatcatcgatgagaccgaagagcaatacgatttcacgatgaacgtgaatgcaaaaggcgtgtggctcggttgcaaatacgctatcacgcagttcatgaaacaggagccgctgaccacgtcaaccggcgtccaggtccgtggccgcattgtcaacatcgcgtcgatcggcggcctggtcgggttggcactcgagccggcttattgtgcgtcgaagggagccgtcgtcaatctgacacgcgaactggcactcgacttcgcacccgagcgaatcaatgtgaacgcgatctgccccgggttcctcgcaaccgcgatggtgcgttccttcctcgaaaacgacgataccaacaagctgcttcacgacctgacgccgtggccgcgtgtcggcaccgcggaagatgtcgcgaaagccgcgctattcctcgcttctgacgacgccgaatggatgacaggttccatgctcacagtcgacggcgcctttacggcg

SEQ ID NO: 31142 - DNA, 762 bp, Burkholderia cepacia; identical to SEQ ID NO: 28384

SEQ ID NO: 31143 - DNA, 1569 bp, Burkholderia cepacia
gcgcccgacgtgttccgccgcggcgcatgggtgccgatgcgggaatacggcaatgacgatgaagtcgacttcgcgatcgtcggcacgggcgccggcggcggcacgctggcatgccggctcgctgaactcggcttcagggtggtcgccttcgacgcaggcgcatggtggcgtccgctcgaagagttcgcttccgacgaaacccatcaggcgaaactgttctggaccgacgaacgaatctgcgacggcgaaaatccgctgcaactcggcaacaacaacagcggcaaggcggttggcggcagcaccgtgcacttcgcgatggtgtcgctgcgttttcgtccggaatggttcaagtcgcgcagcgcgctcggctatggcgcggactggccgctggactggcgcgagatgtggcgctactacgcgcaggtcgaggacgcgctgaagatctccggaccggtgaactatccatgggggccaccccggccgcgctatccgtaccgcgcgcacgaactgaacgcggccgccctggtgcttgcgcgcggggccgaagcaatgggcatcccgtggaccccgacgccgctcgccacgctatcggcgccgcgcgggcttgctcatccttgcgtttatcgcggcttctgcgtctccggctgcgcgaccaatgccaagcagagcgcgctggtcacgtggatcccgcgcgcgctgcgggccggcgcggaaatccgcgaccttgcgatggtcggccggattgcgaccaacgccctcgggcgagtcaacggcgtggaatatctgcgcgaagggcgctggcagttccagcgcgccaaacatgtggtggtggcgggctatgcgatcgaaacgccgcgcctcctgctgatgtcggcgaccagccagtatcccgatggtctcgccaaccgctccggcctggtcggcaagaacctgatggcccaatcgaatcaggccgtgtacgggacgatggaggaagagatccgctggtacaaagggccgccatcgctcgcgattaccgaacactggaattacaccgacgaaggcaaggacttttttggcggctactcgtacatgagccaggggccgttgccggaggtgtgggccggcgcgcagaacaagcgcggactatggggcgacgcgctggctcgggagatgcgcaattacaaccatcaggcgggcctgaagatcgtcggcgaaatgttgccgcaggagcgcaaccgcgtgacgctggccgacgaaaaggaccagtacggcctgccggtcgcgcgcgtcacctattcgtggggcgacaacgacaagcggctgatcgcccattcgctcgacttcatgcagcaggcgctcgccgcggccggcggccgggacatctggcgcgaaaccgacgacacctgtcacctgaacggcaccgcgcgcatgggcagcgatcctgccacgagcgtcgtggatgccgattgccgcagctgggacatacccaatttgtggatttgcgacggctcggtatttccgaccgtgggcggcgtcaatccgtcgctcaccattcaggcaatcgcatgccgtacggccgcgcgcatc

SEQ ID NO: 31144 - DNA, 1707 bp, Burkholderia cepacia
caaaccgtgggtgactttattatcgatcggctgcatgcgtggggtgtgcggcgaatttacggctatccgggcgacggcatcaacggcgtcttcggcgcgctgaatcgcgcccacggcaagatcgaattcgtgcaggtgcgccatgaagaaatggctgcattcatggcctcggcgcacgcgaaattcaccggcgagctcggcgtttgcatcgcaacctcagggccgggcgcatcgcatctgctcaccggcctctacgatgcccggctcgatcacatgccggtactcgccattgccggacaacaggcccgcgcggcgctcggcggccattaccagcaggagctggatctggtgtcgatgttcaaggacgtagccggcgcgttcgtggagcaggctagcgtgccctcccaggtccgtcatctggtcgaccgcgcggtgcgcacggcgctcgccgaacgcaaggtcacggctctcgtgttgcccaacgatctgcaggatcttgcgtacgaagcaccggcgcgcaagcacggcacgctgcattcgggggtcggctaccggcggccccgcctcgtgccctatccggacgatctgcaacaggccgcggaagtgctcaacgccggcaagcgggtcgcgattctggtcggcgcgggcgcgctgcatgccaccgacgaagtgatcgccgtcgccgacaagctcggcgcgggcgctgccaaggccttgctcggaaaagcggcgttgccggacgatttgccgtgggtgaccgggtcgatcgggctgctcggcaccaaacccagttacgacctgatgaccgagtgcgacaccctgctggtgatcggctcgggtttcccgtacgccgaattcctgcccaaggagggcgccgctcgcggcgtgcagatcgacctcaaggccgacatgctcagcctgcgctatccgatggaagtcaacctggtgggcgacagcgtcgagacgctacgcgcgctgctgccgttgctcgaacagaagcaggaccgcggatggcgtgaaaagatcgaaggttggactgccgactggtggaagacactcgacaaacgcgcccacgaagcaggcaggaaggggatgaatccccagcgcagcgtatgggaactgtcgcctcgcctgcctgccaatgccatcgttacaagcgattccggatcatgcgcgaactggtacgcgcgcgacctgaaagtgcagcgcgggatgatgtgctcgctgtccggcggtctcgcctcgatgggggcggcggtgccgtacgcgatagccgcgaaattctcccaccccgagcgcccggtgatcgcgctggtgggcgacggcgcgatgcagatgaacaacatggcggagctgatcaccgtggccaagtactggaagcagtgggccagtccacgctggatctgcatggtgctcaacaatagcgacctgaaccaggtgacgtgggagcaacgggtaatggaaggcgatccgaagttcgaggcatcgcaggacattccgtccgtgccctatcaccgttttgcggagctgatcggcctgaagggcatctacgtcgaggacccggagcgcatgggagcggcctgggacgaagcgctcgcggcagaccgtcccgtggtcattgaagtgaaggccgatccggacattccgccactgccgccgcatatcacgttggcgcaagccaaagccttcgcgtcgacgctgatcaag

SEQ ID NO: 31145 - DNA, 918 bp, Burkholderia cepacia
accatcgtcagcatcggcagcatcaatctggacctgcaaatgcgcgtcgaccatccggtgggcagcgccgaaacgcagcgcgcccatgacttctcgcgcctcgccggcggcaaggcggcgaacgtcgcctatctcgcgcgccgcttcggtcacgacgcgcaactgctcgggatggtcggcgacgaccgtttcgccgacgaagccgttgcgccgttgcgggacctcggcatcgacgtgtcgcgggtgcgcacggccgccgggcagcccaccgcggtatcgatgatcttcgtgcccgacaacggaaaaaagaccatcgtgctggcgtccaacgcgaatgacgcgtggcagcgcgcggatatcgacgccgcgctggaagcgatcgatgccgctcccgcgcacagcgtgcttgcggtggactgcgaaatgagcgtcgacgcgtgcgcggccgtgctcgctgctgcgcaacgccgcgcgctgtgcgtcgtgctcgaccccgcgcctccccaacgcgcccagtcgggcgcgctgcgtgcgctttggcgcgctgtgcacgcgctgacgcctaatgaggaagaagcggcggcgctcaccggcatcgagatcgcggatcaggccggcgccgtgcgcgccgctcgtgccctgcatcgtgaaggcttcgaacttgtgtgcgtgaagcgcagcgatggcggctgcattgccgtgtcgcgcgacggcgtgctggcggtgcaggtgaaaccggtcgaagcgctcgacaccaccggcgcgggagacgccttcaccggcgcgctcgccgtatcgctcgtcgagcgccgcgcgttcgcggatgcggtccggctggcgacggccgccgccaacctcaccgtcatggcgtggggctcgcaaaccgcattgccggatcgcgcccgtgcggacgcgttc

SEQ ID NO: 31146 - DNA, 630 bp, Burkholderia cepacia; identical to SEQ ID NO: 28388

SEQ ID NO: 31147 - DNA, 1374 bp, Burkholderia cepacia
ttcatcggcggcgcatggcgcgagccgggcgccggcgagcgcttcgcttcgcatgcgcccgccagcggtgaaccactggcccagatcgcccacggcgatgccggcgacatcgacgcggcggtgtgcgccgcgcgcgcggcgcagccggcttggcttgcgctcggcggcgcggggcgcgcgcggcatctgtatgcgctcgcgcgcatggtgcagcgccacagccggctgtttgccgtgctggaagcgctcgacaacggcaagccgatccgcgagacacgtgacatcgacgtgccgctggtcgcgcggcattttctgcatcacgcgggttgggcgcaactgcaggagagcgagttcgccgcgtacgcgccgcttggcgtgatcggccagatcgtgccgtggaattttccgctgctgatgctggcgtggaagatcgcgccggccattgcgatgggcaactgcgtggtgctgaagcccgctgaatacacgccgctgacggccttgctgttcgccgagctcgcgcatcgggcgggcctgccggcgggcgtgctgaacgtcgtgactggcgacggccgcaccggcgccgcgctggtcgaacatccgcagatcgacaagatcgcctttacggggtccaccgaagtcggcaaggcgatccgcgcggtcacggccggctcgggtaaatcgctgacgctcgaactgggcggcaagtcgccgttcatcgtgttcgacgatgcggacctcgacggcgctgtcgaaggcgtggtcgacgcgatctggttcaaccaggggcaggtgtgctgcgcgggttcgcgactgctggtgcaggaagggatcgaggcgcgcttcattgccaggctgaaacgccgcatggaaacactgcggattggcagctcgctcgacaagagcatcgacatcggcgcgatcgtggacccggtgcaactcgagcggatccggtcgctggtggaaacggggcggcgcgaaggctgcgcggtgtggcagtcgcccggcacggtcctgccggcgcaaggctgcttttatccgccgacgctcgtcaccggcgtggcgccggcttccacgctcgcgcagcaggaaatcttcgggccggtgctggtggccatgagctttcgcacacccgacgaagcgatcgcgctcgccaataattcgcgctatgggctcgccgccagcgtgtggagcgagacgatcggccgcgcgctcgacatcgcgccgcgactcgcgtgcggcgtcgtgtggatcaacgcgacgaacctgttcgacgcggcggtcggcttcggcggctaccgcgaatcgggctatgggcgcgaaggcggacgtgagggcatttacgaatatctgaaaccgcgtgcatggctcaatctt

SEQ ID NO: 31148 - DNA, 1005 bp, Burkholderia cepacia
tcgatgaaagtgtatcgcttcgatcaagccggcagtctcgaccatctgacgcttcacgacgaacccacgcccgagccccagcgcggcgaagtgctgatccgggtgcgcgcgtcgtcgctcaactatcgcgacatcgcgatggttcacggcacctacctgcgcgcgcagcgggcgggcctgattccgctcagcgatgccgccggcgagatcgtcgccgtgggggaggacgtggtcgacttcaaggtcggcgagcgggtcatcaatacgtttcatccgcgctggtacggtggcaatccgccacccacgctcggctcggagggctacggctcacatcgcgacggctggctgagcgaatacaaggtcgtcagccaggaagcgatcgtggcagcgccccccggcctctcgttcgaggaagcggcaacgttgccttgcgcggcgctgactgcatggacctcactgtccggattgcgaccgctgcgtcccggacaaaccgtgttgacccagggcagcggcggcgtctcggtattcgcggtccagcttgccaaactgctgggcgcgcgcgtcatcgccacgacttcttcggcggaaaaggcggcgcggctcaaggcgctcggcgccgatgaagtgatcaattatgtcgagacgccggcgtggggcgagcgggtccgcgagctcaccgagggacgcggcgtcgatcgggtgctcgaggtcggcggcccaggcacgctcgaacagtcgatcaaggccgtggcgagccgcggcgaagtcgcgctgatcggctttctcgcctcaggcgattccggcgtcgggttcaacgacctgtttcgcagcggcggcgttttctaccggatttcggtcggcgaccgctcggggctgctggaactggtgcgtgccgtcacgtcatccggcctgaagccggtcatcgacaccgtatttccgttcgagcgtgcgcttgacgcctggcatcacttcgacgaccgcgccttcttcggcaaggttgtcatc

SEQ ID NO: 31149 - DNA, 753 bp, Burkholderia cepacia
cggttgacaggaaaaacagccatcgtcacgggtggcggctcgggtttcggtgaaggcattgccaaaacctacgcgcgcgaaggcgcgaacgtggtggtcaacgatctgaacggcccggccgccgaacgcgtggcaagcgaaatcgcgctggccggcggcaaggcgatcgcggtgacgggcaacgtcgcccagcgcgaggactggcaaaagctgcgcgaggccgcgctcgaagacttcggcagcgtgcagatcgtcgtcaacaacgccggcaccacgcaccgcaacaagccagtgatggaagtcacggaagccgaattcgaccgcgtctacgcggtgaatgtgaaaagcatctactggagcgtgcaggaattcgtgccgtatttccgcgagcaaggcggcggctgcttcatcaatattgcgtccacggcgggtgtgcgaccgcgccccgggctcgtctggtacaacggcagcaaaggcgcggtgattatcgcgagcaagtcgctggcggtcgagctgggtccggaccggattcgggtgaactgcgtgaatccggtgatcggcgagacggcgctgctgtccgaattcatgggcgtggaagatacgccggaaaatcgccaacgctttctcgccggcattccgctcgggcgtttctccacgccgcaggatattgccaacgccgcgctttatctggcctcggacgaggcggaattcatcaccggcgtgtgtctcgaagtggacggcgggcgctgcgtg

SEQ ID NO: 31150 - DNA, 1422 bp, Burkholderia cepacia
gaagcccgacacttcatcggcggagaatggtccgccgcatcaggcggcgagacgatcgccgtgctcgatccctcggacggccaacccttcacccaactggcacgcggcaccgcggcggatatcgacgccgccgtgcacgccgcgcgccgcgctttcgaaggcgcgtggggcgaggccagcgcagccgaacgcggccgcgtgctgtaccggctgtccatgctggttgccgcgcgccaggaagaactggcgctgctcgaagcccgcgacaccggcaagccgctcaagcaggcgcgcgccgattcggccgccctcgcccgttacttcgagttctacgccggcgcggcggacaagctgcacggcgaaacgctgccgtaccagaccggctacaccgtgctgacgatccgcgatccgcacggcgtgaccggccatatcgtgccgtggaattaccccatgcagattttcgggcgcagcgtgggcgcggcgctcgccgccggcaatgcctgcgtcgtcaaaccggccgaagatgcgtgcctctccgtgctgcgcgtcgccgaactggctgccgaggcgggtttgcctgccggcgcattgaatatcgtgaccggctatggtcatgaagcgggcgcggcgctcgcgcgtcatccgggcatcgatcacatatcgtttaccgggtcgccggaaaccggcaagctcgtcacgcagatggccgccgagaatcacgtgccggtcacgctcgaactcggcggcaagtcgccgcaaatcgtgttcgccgacgcggatctcgacgcggcgctgcccgtgctggtgtcggcgatcgtgcagaacgcggggcaaacctgctcggcgggcagccgcgtgctgatcgaccggtccatttacgaacccttgctcgaccggctgagcggcgcgtttcatgcgttgcgggtcggcccttcgcatgccgatctggactgcggaccgctgatcagcgcgaaacagcagcggcgcgtgtgggatttcctctccgacgcgcagcacgacggcattcctatggcagcgcatggcgaggtgattcccgaggcgccggaaagcggcttctatcaggcgcccacgctgttgcgcgacgtgcccgccagccaccgcctcgcgcgcgacgaagtattcggccccgtgctcgccgccatgtccttcagcggcgaggacgaagcgcttgcgctcgccaacggcacgccatttggtctggtcgccggtatctggacgcgcgacggcgcgcggcagatgcggcttgcgcgccgcctgcgctccggccaggtgttcatcaacaactatggcgcgggcggcggcgtcgaactgccgttcggcggcgtcaagcattcgggccacgggcgggaaaagggattcgaagcgctgtatggctttaccgtgctgaaaaccattgcgatc

SEQ ID NO: 31151 - DNA, 702 bp, Burkholderia cepacia
ctgcgcgtcaaggacgtgtgccgcggtttcaacaagtcgcagggcgaactgctcgttctcgacgacgcgaacctgtcgctgcgcgaaggcgagattgtcgggctgctgggccgttcgggctcgggcaagtccacgctgctgcgtatcattgccggtctgatcgagccgaccgacggcgaagtcacgtatatgggcaagccgctcgacggccccgccaagggcgtcgcgatggtattccagaccttcgcgctgttcccgtggctgaccgtgctgcagaacgtggaagcgggcctcgaagcgcagggcgtcggcgccagcgagcggcgcacgcgcgcgctcgccgcgattgacctgatcggtctggacggtttcgagaacgcctatccgcgcgaactgtcgggcggcatgcgccagcgcgtgggctttgcgcgcgcgctggtggtcgaccccacgctgctgctgatggacgagccgttctccgcgctcgacgtgctgaccgccgaaacgctgcgtaccgacctgctcgatctgtggacgcaaggccgcatgccgatcaaggcggtgctaatcgtcacgcacaacatcgaggaagcggtgttcatgtgcgaccggattctggtgctgtcgtcgaatccggggcgcgtgatcgccgagatcaaggtgccgttcaagcatccgcgcaatcgcctggatccggcgttc

SEQ ID NO: 31152 - DNA, 1407 bp, Burkholderia cepacia
atgagcagactgatcgtggtatcgaatcgtgtcgcgccgactcaggaaggccgtcccgcagcgggcggactggcgatcggcgtgctggacgcgctgaaggaaaccggcggagtctggttcggctggagcggcgagacggtgagcgagccgagcgctccggtgatcgagaaacagggcaacgtgacgtacgcgacggtgggtctcaccaagcgcgattacgaccagtactaccgcggtttttccaacgcgacgctgtggccgacgttccattaccgcaacgacctctcgcgctacgaccgtcaggaatacgcgggctatcagcgcgtgaacgcgacgctcgccaagcagctcaaggagctgctgaaacccgacgacatcatctgggttcacgactatcacctgctgccgttcgcgcgctgcctgcgcgagctgggcgtgaagaatcccatcggcttcttcctgcatattccgtttccggtgccggaggtgctgcgcaccattccgccgcacgaagaactggtcaaggccatgtgcagctacgacgtgatcggcttccagaccgatgcggatcgccagtcgttcgtcgacttcatcgagcgtggccagcacggcacatcgagcgaggacggcatggtgcacgcgtacaaccgcttcctgaaagtgggcgcgtatccgatcggaatctatccggacgcgattgccaaggccgccgagcagttcaccgaccgcaagccggtgcgcagcctgcgcgacggtatgcgcgggcgcaagctgatcatgagcgtggatcgtctcgactattcgaaggggctggtggagcgctttcaggcgttcgagcgactgttgctgaacgcacccggttggcacggacgcgtatcgctggtgcagatcgcgccgccgacgcgtgcggacgtgcagacatatcagcggattcggcagacgctggagggcgaagcgggccgcatcaacggccggttcgcgcagctcgactggacgccgatccagtacctgaaccgcaaatacgagcgcaatctgctgatggcgctattccgtcaatcgcaggtcggttatgtgacgccgctgcgcgacggtatgaatctggtcgcgaaggagtatgtcgcctcgcaggatccggccgatccgggcgtgctggtgctgtcgcaattcgccggcgccgccgagcagttgccgggcgcgctggtcgtcaatccgtttgatctgtcgcagatggccgaagcgcttgaacgcgctctgtccatgccgctcgccgagcgtcaggcgcggcatgccgacatgatggcgccgatgcgagagaacaatctgtcggtgtggcgcgatacgttccttgccgatctgcgcaatgtcgccacggcctcttcggtgacggccaaagcggtaaagctcgct

SEQ ID NO: 31153 - DNA, 723 bp, Burkholderia cepacia; identical to SEQ ID NO: 28394

SEQ ID NO: 31154 - DNA, 1245 bp, Burkholderia cepacia
aagaaggcgctcgttgccgcttgtgtcggcaactttatcgagtactacgacttcgtgatctacggctattttgcgtccgtgatcgcgcgtctgttctttccggccgacaacgaggccgcgagcctgctgctcacgttcgcggtgttcgccatcagctatgcgtcgcgaccgctcggcgggctgatcttcgggcacctcggcgatcgctacggccgcaagacgccgctcgccgtcgcggtgatgctgatcgcgtgctcgaccacggtgatcggcctgttgcccacctatagcgcgatcgggatcgcgtcgccgatcattctcaccgccgcgcggctggtgcagggcatttctgtcggcggcgagtatggcggcgcgacttcgttcatcgccgaatatgcgccgcccggccggcgcgggttctataccggctggcagaccttcacgatcggcctcgcgttgctggtgggcggcgcggtggcgtcgatcatcaccggagcgctgtcggccgaagacctgcgcgcctggggctggcgtctgccgtttttcgcgggactgccgctcggtttcgtcgggctctatctgcggctgaagctggaggaaacgccgcacttctcgtcggtgcaacagactgccgagatcgagcgcacgccgctcgtgaccggattgcgcagagagtggaaggcgattctgatcggaatggggctcatcgccgcgccctcggcgtgcatctacatctactacatctattcgccgacgtatctgtccgtggtgctcggtttcaagctcgcggacgcgcagcgcgccaacctgtatagcctgatcttctattgcgcgctactgccggtcttcgcgcacctgagcgacgttgtgggccgtcgtccgttgatgctcgtgagttcgctcgccatcatgctcgtcacgtacccggcgtttcatctgctcgatccgcatgacttcggcaagacggttgcggcgctatgcctgatgagcctcgcgttcgcgccgcattcggccacggcgctatgcgcgatggccgagatcatgccgaccagactgcgctacaccgggctgtcggtgagcctgaacattccggtcacgctgctcggcggcacggcgccgttcattgcgacgtatctcgtgtcgcgtaccggcgatctgtattcgccggcgtggttcgtgatcggcgcaggcctgtgcacgttggtggccgcgtatgcgtataaggagacgctgcatagtggattg

SEQ ID NO: 31155 - DNA, 627 bp, Burkholderia cepacia
cttcagctgtactcgctgcccacgcccaatggcgtgaaggtgtcgatcatgctcgaagagacgggtttgccgtacgagccgcatctcgtgcgtttcgatacgaatgatcagatgacgccggagtttctgtcgctcaatccgaacaacaagattccggcgatcatcgatccggatggcccggatggcaaaccgctgccgctattcgaatccggcgcgatcctgatctatctcgccgacaaaagcggccggttcattccgcaggatgccgccggccgctacgaagcgatccagtgggtgatgttccagatgggcggtattgggccgatgttcggccagctgggtttctttcacaagtttgccggtaaggaatacgaggacaagcgtccgcgcgaccgttatatcgccgaatcgaaaagactgcttggcgtgctggatcgccaactcgaagggcgcgactggattctgggcgatacgtactcgattgccgatatcgccaccttcccttgggtgcgcaatctgatcggcttttatgaggcgggcgatctcgtcggcattcaggatttcccgaatgtcacgcgtgtgctggcggcgtttgtcgcgcgcccctgccgtggcgagggggctgga

SEQ ID NO: 31156 - DNA, 1941 bp, Burkholderia cepacia; identical to SEQ ID NO: 28397

SEQ ID NO: 31157 - DNA, 726 bp, Burkholderia cepacia
ctcgccggcggccgctatctcgtgaccggcgcgtcgtcgggtatcggccaggcgagcgcgcaactgattgcccgcctgggcggacatgtgattgccgccgggcgcgacgaggcccgccttcaggcaacgctcgccgggctccacggcagcggccacgcagccgctgcggcgtcgctcgtcgacgccgatcagaccgccgaatgggtaagccatctcgccgagacgcacggtgcctttgccggcgtgtttcatgcggcgggcgtcgagttgattcgccccgcgaagctgaccaggcaggaacaactggatcaggtgttcggcagcagcctgtatgccgcgttcggaattgcccgcgccggcagcaagaagaatgtcatcgtggacggcggctcgcttgtcttcatgtcgtcagtagccggctcgacgggccaggcaggcatgaccgcttactccgccgccaaggccgccgtcgacggtctggtccgctcgctggcctgtgaaatggcgccgcgcaagattcgcgtcaattcgatcgcggccggcgcggtccacaccgccatgcatgaccggctcacgggcggcagcccggatgaagcactcgccgcttacgagaagagccacctgctcggcttcggcgaagccgacgatgtcgcacaatccgcactgtttctgctgagcggagcgagccgctggatcaccggcacgacgctggtcgtcgacggcgga

SEQ ID NO: 31158 - DNA, 999 bp, Burkholderia cepacia; identical to SEQ ID NO: 28398

SEQ ID NO: 31159 - DNA, 1011 bp, Burkholderia cepacia
gtgcaggcacgcattctcgatatcgccggattcctgcccgagcaggtcctgacgaacgagcagctggcggcgctctatccggaatggccggcggacaagattctggccaagacaggcattcagcaacggcatatcgccgcggccgggcagaccgcggcggacctggcttatgaagcggcgcgcaacctctttgcccaaggctcggtgaatgcgcaggacgtcgacttcgtcattctgtgcactcaggcgcccgactatgtgttgcccacctcggcctgcctgttgcaggaccggctcggcatttcgactcacgccggcgcgctcgacgtcaatctcggctgctccggctatgtgtatggactttcgctcgccagggggctggtggaaaccggcgccgcgcgctgcgtgctgttgctgaccgccgacacttattcgaagtacgtacaccccctcgacaagagcgttcgcaccctgttcggcgacggtgccacggcgacggcaatcacggcctccacgaacggcgacgcgtcgatcggccccttcgtattcggcacggacggccgcggcgcgcagaacctgatcgtcaaggcagggctgttccgcgagccgaagaacgcacaaagcgcgctcgaaacccaggatgcgtccggcaacgtgcgcaccgacgaacacctgtacatgaacggcgccgaagtcatggcattctcgcttgccgaagtgcccaaagcggcgacatcgctgctcgaaaaagccggcatggaccgcgaggaaatcgacttcttcgtgctgcatcaggcgaaccgtttcatgctcgaggcactgcgcaagaaaatgaaggtcccggaagcgaagtttccgatcctgatggagcaatgcggcaacaccgtttcgtcgacggttccgctcgcattgaagcagatgaaagacgacggcctgctccagcatggcagtcgattgatgttgttgggctttggtgtcggctactcatgggccggctgcctcgtgacttac

SEQ ID NO: 31160 - DNA, 1965 bp, Burkholderia cepacia; identical to SEQ ID NO: 28400

SEQ ID NO: 31161 - DNA, 960 bp, Burkholderia cepacia; identical to SEQ ID NO: 28402

SEQ ID NO: 31162 - DNA, 1077 bp, Burkholderia cepacia; identical to SEQ ID NO: 28403

SEQ ID NO: 31163 - DNA, 471 bp, Burkholderia cepacia
actatccatatccgtcccgctcgcgcagccgacgccgcattgattcttcgcttcatcaccgaactcgcggtgtacgaaaaggcggagcacgaagtcgtcgcatccgtgaaggacatcgaagcgagcctgttttccgcaagcgccagtgcgaaggcgctgatctgcgagatgaacggcgagcccatcggcttttgcgtctactttttttcgtattcgacctggctcggcaaacaggggctttatctggaagacctgtatgtgtcgccggcatcgcgcggcagcggcgcgggcaaacagatgctgcgtcacctcgcgcgcattgcgtgcgacaccggttgcggccgcttcgaatggagcgtgctcgactggaacgaaccggccatcggcttctacgaatcgatcggcgcgagcgcgcaaagcgaatgggtgcgctatcggttggcgggagatgcgctcaagaagtttgcggag

SEQ ID NO: 31164 - DNA, 1725 bp, Burkholderia cepacia; identical to SEQ ID NO: 28405

SEQ ID NO: 31165 - DNA, 735 bp, Burkholderia cepacia; identical to SEQ ID NO: 28406

SEQ ID NO: 31166 - DNA, 303 bp, Burkholderia cepacia; identical to SEQ ID NO: 28407

SEQ ID NO: 31167 - DNA, 929 bp, Burkholderia cepacia; identical to SEQ ID NO: 28408

SEQ ID NO: 31168 - DNA, 1002 bp, Burkholderia cepacia
atgcttaaagaggcgctggcgtccgctgaaacggtcgccgcgcaactcatggatacctcgcgcgtcgaggcattggcggcgaagcttgcgcagcagccgcgtcatgtcgcgctgacggtcgcgcgcggcagctccgaccatgctgcgagttacttcgccagcctgacgatgagccgcctcggcgtgccggtcgcctcgctgccgatgtcggtcgccacgctccagcaagcgccgctgcaggtgtgcgatcagctcgcgctggccttctcgcaatcgggcaagagcccggatctggtcggcacgatggaagcgctgcgcaaagcgggcgccttgacggtagccgctgtcaacgtgtcgggctcacccctggccgacgcgtgcgaattcgagttgccgctcgtcgccggtccggaactgagcgtcgcggccaccaagagctatatcgcgatgctgtcgatttccgcgcaactcgtcgcgcattggcagaaagacgccgaactgctcgcggcgttgaagacgctgcccgaagcactgcgtgcggcaggcaagctcgactggtcgaatgccgtggaggaattgcgcggcgtggagcgcatgatcgtgatcggtcgcggtctgggtcttgcaatcgcgcaggaagccgcgttgaaactgaaggaaacctccggcattcaggccgaagcgttttcgagcgcggaagtgcgtcacggtccgatggaactgatcgaccgcgactacccgctgctggtcttcgcaccgcgcggtccggaacaggccggcttgctgcaactcgcgcgcgacatgcaggcgcgcggcgcccgtgttctgctcgcggcgccggccgacgtgccggaagccacgctgccgctcgccatcaccgctcatgcggcgctcgatccgatcgccgccatcctgtccttttacgtgatggcagccggccttgccgccgcgcgcgggcgcaatcccgatgcgccgcgccatctcaacaaagtcaccgaaact

SEQ ID NO: 31169 - DNA, 2088 bp, Burkholderia cepacia
gaaacgccgctgctggtgctgcgcgcgcgcggtggcgcggcggccgaggcttcgcgtcaggcgagtgcgacgaacgtcgcggaagaagcgcgtcagcaagtcacgctggtccatgcgggcggtctgcatgcacgtccggcggcgcgtgcccgtgaagcggcgcgcggtttcgatgcacgcgtcgaagtgcgttacgaagggcgtaaggcggcgatcgaaagcgtggtcggtttgctgggactcggcgcaggtgaaggcgcgacggtcgaattgctcggcatcggtccgcaagccagagccgcgatcgaagccattgcgcacgaattgacgcgtgaagcacagggtgaagcggaagaaaaacccgcgcgtgaaagttcgccggcgccgcaggccgtggggcatgcggcagacgaagcgctcgccccgaatacgcttgccggcgtctgcgccgcaccgggcgtcgcggtcggcaagctggtgcgctgggacgacgcggatatcgatccgccggagaaggcggccggcacgtcggctgcggaaagccggttgctcgacaaggcgattgccactgtcgatgcggacctcggcacgaccgtgcgtgacgcatcgcaacgcggcgcggtcggcgaagcgggcattttcgcggtgcaccgcgtgctgctcgaagatcccacgctgctcgacgccgcgcgcgatctgatcagcctcggcaagagcgccggctttgcatggcgcgcagcgatccgtgcgcagatcgccatcctcgcgaaaatcgaagacgcgttgctcgcggaacgcgccgccgatctgcgggacatcgagaagcgtgttctgcgcgcgctcggttatacgaacgccgcgtcgcgcacgttgccggaagaagcggtgctcgcagcggaagagttcacgccgtcggatctgtcgacgctggatcgctcacgcgttaccgcactggtgatggcgcgtggcggcgcgacctcgcacgcggcgatcctcgcgcgtcaggcaggcattcccgcgctggtggcagtcggcgacgcgctgcatgcaatccctgaaggcacgcaagtggtggtgaacgccacgaccgggcgcctcgaattcgcaccgaccgagctcgacgtcgaacgcgcacgtctggagcgctcgcgtcttgccggtgtacgcgaagccaatcgccgcacctcgcagcaggcggccgtcacgtccgatggccgtgcaatcgaagtggccgcgaacatcgccacgctcgacgacgcgaaaaccgccgtcgaaaacggcgccgattctgtcggcctgttgcgcaccgaactgttgttcattcaccgcgccgccgcgccgaccacggacgaacatcgtcagagctaccaggcaatcgtcgatgcgttgagcggccgcaccgcgatcatccgcacgctggatgtcggcgcggacaaggaagtggattacctgacgctgccgcccgagccgaatcccgcgctcggcctgcgcggcatccgcctcgcgcaagtgcgcccggatctgctcgacgatcagttgcgcggtctgctcgcggtgcgtccgctcggtgccgtgcgcattctgctgccgatggtgaccgatgtcggcgaattgatccgcatccgcaagcgtatcgacgaattcgcgcgcgagtcgggccgcacggagccgatcgaagtcggcgtaatgatcgaagtgccgtcggcggcgctgctcgccgatcaactggcgcaacacgcggatttcctctcgatcggcaccaacgatctgacgcaatacacgctcgcgatggaccgttgccaggccgacctggccgcgcaggcggacggcctgcatccggctgtgctgcgcctgatcgcggccaccgtgcaaggcgccggcaaacacggcaaatgggtcggcgtgtgcggcgcgctggcgggcgatccgcttgcaatgccgctgctcatcggcctcggcgtgaccgagttgtcggtcgatccggtttcggtgccgggcatcaaggcgcgggtgcgcaacctcgattatcagctgtgccgtcaacgcgcccaggatgccctggcgctcgaatcggcgcaggcggtaaga

SEQ ID NO: 31170 - DNA, 924 bp, Burkholderia cepacia
aagcgcaacatgagcgccgcggctccggtcgtggaggcggtcggcctgaccaaacgattcggcgcgtttactgcggtcgacgggctcaacctgtccatcgcccaaggcgaggtcgtcggcttcatcggtccgaacggagcgggcaagtcgaccaccatccgcatgctgtgcgggctgctttcgcccagcgccgggcgcgcctgcgtggccggcttcgacgtcggcacccaggccgaggcgctacgctcgcatatcggctacatgtcgcagaagttctcgctatacggcgacctgacctgccgcgaaaacctgcgctttttctgcggcatctaccgggttccccggcgcgaaatcgccgagcgtatccagcttgccatttcgaccgcgggactcgaagggcgtgaagatacgctggtgcgcacgctcgcgggtggctggaagcaacggctcgcgctcggctgtgcgaatctgcaccacccgcccgtgctgtttctcgacgaaccgacctcaggcgtcgagcccgaggcgcgccgccggttctgggacctgattcacggcctcgccgcgggcggcgtgacagtactggtgtccacgcattacatggacgaggcggaatactgccaccgcatcgcgctgatcgatgcgggccatctggtggcaatcggcagccccagtgagctgcgcgaacagaatctcgggggcaacctgttcgaggtggcatgcacgccgctgggcgcggccctcgccgcgctgcgcgaagcgcccgaagtgatcgacgccgcgatcttcggcgacaggctgcacgtgctgatgcatctgggtgcggctaacaccgtgcttcagcagtttctcgcagcccggcatatcgaggtgacgagcgtgcgcgccatccgcgccagcctcgaagacgtgttcgtccagctg

SEQ ID NO: 31171 - DNA, 1718 bp, Burkholderia cepacia; identical to SEQ ID NO: 28412

SEQ ID NO: 31172 - DNA, 1341 bp, Burkholderia cepacia
gaattgaaggcgggcctcaagcagcgccacatgacgatgatcgccctcggcggcgtgatcggcgcggggctcttcgtgggcagcggggtggtcgtgcagcaggccggccccgcggcggtgttgtcgtttctgattaccggcgcgctggtggtgctggttatgcggatgctcggcgaaatggcctgcgcgatgccggccgtcggctcgttctatgaatacgcgcggctcgcgttcggcggcaaacgcgcctgcggcaatctggccggctttctgaccggctggatgtactggtatttctgggtcatcgtcgtggcggtggaggccgtcgcgggggcgaaactggtgcagttctggttgcccgatgtccccgcgtgggcgatcagtctcgtattgctcgtgacgctcactgcaaccaacctggtctcggtcggcagttacggtgaattcgagttctggttcgcgtcgatcaaggtcgcggcgatcatggtgtttctgtttctcggcagcatgtacgtgctgggactgtggcccgcgtcgaagcacgtcacggaggtgctgccgacgctgttctcacacggcggcctgatgcccaaaggaatcggaccggtactgagcggcgcggtcgccgccacgggtttttacttcggagcggaaatcgtcaccattgcggcagccgaggcacaggagcccgcgaaggccgtcgccagggcgaccaactcggtgatcacgcgcgtgctggttttttacgtgggctcgatcctgctcgtcgtcgcgctcgtgccgtggaactcgccgaagatggcgacgccgtatgtgagcgcgctcgacgcaatgggtattcccgccgccgccagcgtcatgaacgccatcgtgctcaccgcggtgctgtcggcgctcaattcgggactctatgcggcgtcgcggatgatcttcgcgctgacccgccacggcgacgcgcccgccgcgctcgccagggtcaaccggcgtggcgtgccggtgcgcgcgattctgatcggcaccgtattcggctatgcgtcggtcgtaatgtcgtatgtctcgccggatacggtgttcgcgtttctcgtgaattcgtacggcacggtggcgattttcgtctatgtgctgattgcgatctcgcaactgaaactgcgggcccggatcgagcgggatgcgccgcagacacttcgggtgaggatgtggtgctatccgtacctcacgtgggtttccattatcggcatggtcggcattctggttgcgatggccttcattccggagcagcgccagccgctatggttcggggtcgcgagtctgggcgtgctgctgctcgcctatccgctgcga

SEQ ID NO: 31173 - DNA, 1596 bp, Burkholderia cepacia
gacgagcgctacgtgatcggcgtggacgtcggcacgggcagtgcccgcgccggcctgttcgacctggccggccacatggtggcgtccgcaaagcgtgacatcacgctgttccacgcgagcggttccattgtcgagcagtcgagcggcgaaatctggatcgccgtctgcgatgccgtcaaagacgcgctgtcacaggccgcggtgtcgccggatcaggtcgccggcatcggcttcgacgccacctgttcgctcgtcgtgctgggcgcgggcggccggccattgccggtgggtccgtcggagcaggcggagcgcgacatcatcgtctggatggatcaccgcgccgtggcgcaggcggagcgcatcaacgcgacgggtcacgaggtgctgaactatgtcggcggcaagatctcgccggaaatggagacgccgaagctgctgtggcttctcgagaacaggccggccgtcttcgcggcggcacggcaattcttcgatctgaccgacttcctgacctggcgcgcaaccggcgacctgtcccgatcgacctgcacggtcacctgcaagtggacctatctcgcgcacgagcggcgctgggacgagagctactttcgcagcgtcggccttggtgtgctggccgacgaagccttcgcgcgcatcggtcaaacggtcgtcgatccgggtacgccgctcggaagcggactgaccgcggacgccgccgcgcagctcggcctgcgcaccggcacgccggtcgccacgggcgtgatcgacgcccatgccggcggcatcggcacggtcggcgccgatggcgatcccgaggcctgcctcgcctacgtgttcggcacctcgtcgtgcacgatgaccacgacccgcagtccggtcttcgtgcccggcgtgtggggaccgtacttttcggcgatggtgccggatgcgtggctcaacgagggtggtcaatcggtagcgggcgcggcgatcgaacggctgctcgcgatgcatcccgcggccgccgacgcaaagcgccgcgcggaacacgaaggccagtcgttgccggcaatgctcgccgccctcgccgtgcaggcggcggacagtctgtcggaagcggcagtgctcgccgacggtctgcatgtggtcccggagtttctgggcaatcgtgctccgctggccgacccgcacgcccgagccgtgattgcgggtctcggcatggaagacgatctggacagcctggtcgcgctctacattgccggcatttgcagtgtcggttacgggcttcggcagatcatcgaagcgcaggcgaacgccggtgcgccgatcgcgcgggtggtgatcagcggcggcgcgggacggctcgatctggttcggcaactgctcgcggatgcgacgggcaagcccgtgctcgccacccaggcggaagaaccggtgctgctcggtgccgcgatgctgggaagcgtggccggcggccagttcggcgacgtgcgctcggcaatggccagaatgtcgcagatcagcaaaacctaccaaccggacaccggcaagatcgcggggctgcacgaggcacggtatcgcgccttcctgaagttgcaaagcgtggccagagaaatccgc

SEQ ID NO: 31174 - DNA, 1254 bp, Burkholderia cepacia
aaggccgcgccgcgcctgctggaatcggccaagggcatgtattaccgcagcacggacgggcgtgaagtgctcgacggctgcgcgggtctgtggtgcgtgaacgccggccacggccgcgaggaaatcatcgccgcgattacccagcagctctccacgctcgacttcgcgccgaccttccagatgggccacccgctcgccttcgaagccgccacgaaagtcgccgaactgatgccggaaggcctcgaccgcatcttcttcacgaactcgggctcggaatcggtcgacaccgccctgaaaatcgccctggcatatcaccgttcgcgcggcgaaggccagcgtacccgcctgatcggccgcgagcgcggctatcacggcgtgggcttcggcggcatctccgtcggcggcatcgcgccgaaccgcaaaaccttttcgggcgcgctgctgccggcggtcgatcatctgccgcacacgcataacctcgaacagaacgcgttttcgaaaggccagccggcgtggggtgcacacctggccgaggaactcgagcgcattgtcacgctgcacgatgcctcgaccatcgcggcggtgatcgtcgaaccggtggccggctcgacgggcgtgctgattcccccgcaaggctatttgcaaaagctgcgcgagatctgcacgaagcacggcatcctgctgattttcgacgaagtgattaccggtttcggccgcgtcggcaaggccacggcaagcgagtacttcggcgtgacgccggatctgatcacgatggcaaaggcgatcaacaatgccgcgattccgatgggcgcggtggccgcaagccgcacggtccacgacacgatcgtgaacagcggcgcgcaaggcgcaatcgagctgttccacggctacacgtattcggctcacccggccgcgacggcagccgcgattgccacgctcgacctgtatcgccgcgagggtctgttcgaacgcgccgccacgctcgcgccgacgttcgaagctgcggcccattcgctgcgcggcgcgaagcacgtgaaggatgtgcgcaatatcggcctgatcgccggcgtggaactcgaatcgcgcgacggcgcgccgggcgcgcgggcatacgaagcgttcgtcaaatgcttcgaagcgggcgtgctggtgcgcttcacgggcgacattctcgcgttctcgccgccgctcatcatcaacgaagagcagatcgcgcacatcttcaagaccgtgggcgacgtgctggctacggtg

SEQ ID NO: 31175 - DNA, 531 bp, Burkholderia cepacia
gcagctgttcgcgtgctgctgcgctgggccggcgacgatccggcgcgtgaaggcctgatcgacacgccggcgcgcgtggtgcgctcgtacgaggagttttatgccggctaccaggtcgacccgcgcgagatccttgcccgcaccttctccgaagtggacggctacgacgagatgatcgtgctgaaagacatccgcttcgaaagctattgcgaacatcacatggtgccgatcatcgggcgcgcgcacgtggcgtatctgccggagcatcgcgtggtgggcatctccaagctggcgcgtctcgtggatgcattcgccaagcgcctgcagatccaggaaaagatgacggtgcagatcgccgacaccttgaacgaagtgctgcaaccggcgggcgtcggcgtgattctcgaagccgcgcatcaatgcatgtcgacacgcggcgtgcacaaggcaggcgtgacgatggtcacctcgcgcatgctcggcacgttccgcacggatccgtccacgcgtcgcgagtttctgtcgatcgtc

SEQ ID NO: 31176 - DNA, 2040 bp, Burkholderia cepacia
ctcgaccagctgtgtatcaacacgatccgcacgctgtcgatggacgctgtgcaaaaggccaattccggtcaccccggtacgccgatggcactggcacccgttgcctatcacctgtggcaaaaccatctgcgctacgaccccgacgagccgctctggcctgatcgcgaccgcttcgtcttatccgtgggacacgcgtcgatgctgctgtattcgctgttgcaccttgcaaacgtgaaagccgtggacgacgacggcaacccgaccgacggacccgcagtttcgctcgacgatatcgaacatttccgccagatgggcagcaagacaccgggccacccggagtaccgcatgaccaccggcgtcgagaccaccacgggcccgcttgggcaagggctcggcaatagcgttggcatggcgatggcggcgcgctggtacgagagccatttcaacaagcccgatgcgccgctgttcgactatcgggtctacgcgttgtgcggcgacggcgacatgatggaaggcatctcgcacgaggcggcttcgctcgccggccacctgaagctgtccaatctgatctggatctacgacagcaaccgcgtgacgattgaaggccacaccgacctcgcttatagcgacgacgtggaaacccgctttcgcgggtacaactggcacacgctgcatgtgagcgatgcaaacgacgccgccgcgctggaagcggcattcgtcgaagcgaaaagcattaccgacaggccgacgctgatcgtggtgcacagcatcatcggctggggggcgccgcataagcaggacacctcggcggcgcacggcgagccgctcggcgtagaagaagtggcgctcgccaagaaagcgtacggctggcccgaggataaattcttctatgtgccggacggtgtgcacgaacgcttcgcggcgggcatcggcgcgcgcggcaaggcggcgcgcgaggaatggcaggcgaagtacgacgcctacagcagaaagtaccccgaactcgcgcgtgaattcgcgcagatcgaagcgcacgaattgccggccggttgggacagcgacattcccaccttcgacgcggacccgaaaggcgttgcgtcacgcgaatcgtcgggcaaggtgctcaatgcgattgccgcgcgcgttccgtggatgatcggcggcgcggccgacctttcgccgtccaccaaaacgaatctgaaattcgagggcgcgggcagcttcgaatacgacaactacggcggctgcaatctgcatttcggcattcgcgaacacgcaatgggcgcggcggtgaatggcctcgcgctgtcgaatctgcggccgttcggctcgaccttcctgattttcagcgactatatgaagccgccgatccgcctctcggcgatcatggaagtgccggccatctacgtgttcacgcacgattcgatcggcgtcggcgaagacggtccgacccatcagccaatcgagcagctggcctcgctgcgcggcgtgccggggctgaccgtgctgcgtccgggcgacgccaacgaagtggccgaggcgtggcgcgtggcgcttgccgatccgcggcggccgtcgtgcatcgtggtgtcgcgccagccgttgcccacgctggaccgcagccgctatgcggccgcgaagggcacgcagaagggcgcctatgtgctcgccgatgcagccgacgggcaaaagccgcaggtgatcctgatagccacgggcagcgaactctcggtctgcgtcgacgtgtatgagaagctcacgagcgaaggtattgcggcgcgcgtggtgtcgatgccgtcgtgggatatcttcgagcgccaggacgaggcctatcaggactcggtgctgccaccggatgtggacgcgcgcgtggcggtcgagcaggcggcctcgcttggctgggaccgttatgtggggcgtctcggcgcgcaggtggtgatgcatacgttcggcgcgtccgcgccgcttgccgaactgaagaagaagttcggcttcacgccggagcatgtgtacgaagcggcaaagcagcagattgcgcgg

SEQ ID NO: 31177 - DNA, 1623 bp, Burkholderia cepacia
agcggcgactggtgctggatggaaggccgcgggcgcgccgcctacgaccaccacggcgtgccgctgatgatctacggcctcggcatcgacatcaccgaacgcaaggaagcgcagacggtgctgctgcgccaggccgcgatcttcgagcacctgagcgacgcgatcgtgatcaccgatctgcgcggcaatatcaccgacttcaacgtgggcggcgaacgcatgctcggttatcgcatgcgcgagattctcggcaagccggtcgcaatgttcctgccgccggaacaggcgccgggcattcgccgggaagcgctggcggcgctcgccgccgaaggcacatggcgcggcgagttgccgttcgtgcggcacgacggttcgcgcggggtctgcgaaaccgtggtcaagccgcttgcgaacgcgcgtggcgacatctacggcgcggtcagcatcaatcgcgacattaccgagcgcaggcgcgccgaacagcagctcacgcggctgaacctcgaactctccaaagccgaccgccgcaaggacgaattcctcgccacgctcgcgcacgaactgcgcaatccgcttgcgccgatgcgcaacgtgctggagattctgcgtttgaaggagtttgccgatccgcaattgagctggtcgcgcgatgtgttcgaccggcaactgcaacacatgacgcacctcgtcgacgatctgctggaagtctcgcgcatcacccagggcaaactggagttgcgcaagcagcggctcgaactggcccgcgcgatgcaatcggcaatggaagcggcgcggccgaccgtgcaggcctcgtcgcaccatctgagcgtgacgttgccgcgcgagccgctgtatctgattgcagaccccacgcgcctgtcgcagatgatcctgaatctgctgaacaacgccgccaagtacacgccgcctggcggcagcatctcgctggcggctgagcgcgaaggcgacgaagcggtgatcgtggtgcgcgattccggcatcggcattccgggtgagcatctggacagcgtgttcgaaatgttctcgcaactcgcgccggcgctcgaccgctcgcagggcggcctcggtattggtctcgcgctcgtgcgcggcctcgctgaactgcatggcggcacggtcgcggcgttcagcgagggtccgggcaaaggcagcgagttcatgatccggctgccgctgaccgccaccgccttgcagccctccgacagcgcgccgcccgaggcgccgcacgcggccggcctgcgcgtgctggtcgtcgacgataacgcggacgccgccgaaagcctcgcgatggtgctcgaactcgagggccatgaagttcgcaccgccggcgacggcattgccggcctcgcgctggtcgacacatttgcgcctcaggcggtgattctcgatatcggcttgccgggcctgaacggctacgaagtggcgcggcggattcgccacgattacccgaacgcgggcattctgctgatcgccgtcaccggttggggccaacagcaggacaagcaaaccgccgtggccgccggcttcgatcatcacttcaccaagccggtcgatccacgcgagttgcaacgggtgttgtgccggcagcaggtatgagcagcg

SEQ ID NO: 31178 - DNA, 852 bp, Burkholderia cepacia; identical to SEQ ID NO: 28418

SEQ ID NO: 31179 - DNA, 1959 bp, Burkholderia cepacia
ggcacgccttttccgctcggcgcgacatggaacggaagcggcgtcaacttcgcgctattctcggcgcacgctaccaaggtcgaactgtgtctgttcgatgaaaccggtgaaaacgaaatcgaacgcatcgaactgccggaatacaccgacgaggtgtggcacgtgttcgtgccgaatctcaaaccgggcgcggtctacgggtatcgcgtgcacggaccttacgagccggagaaagggcaccgcttcaatccgaacaagcttctgctcgacccgtatgcaaaagcgcacatcggcgagctcaaatgggcgccggagattttcggctatacgctggattccgaagagggcgacctgtctttcgatgaacgcgacagcgcgcccttcgtgccgaaatgcaaggtggtcgatgccaatttctcgtggagtcaccccgagcgcaatgcattgccgtgggaacgcgtgattttttatgaagcccatgtgcgcggatttaccaaacggcatccggaagtaccggaaaatctgcgcggcaccttcgccggactggggcagcaggtcgtgctcgactacatcaagaaccttggcgtgacctcggtggaattgatgccgatccagaccttcgtcaacgacagttatctgctcgataaaggactcacgaactactggggctacaacaccatcggttttttcgcggccgatccgcgtttcttcgcgtcgtcgatcgattcggtgggcgagttcaaggagatggtggaccgctttcacaacgccaatctcgaagtcattctcgacgtggtctacaaccatacggccgaaggcaacgagcgcgggccgaccatctcgttcaaaggtatcgacaacgcgtcgtactaccggctgatgcctgacgagccgcgctactacatcaacgacaccggcaccggcaacacgctgaacctgtcgcatccgcgcgtattgcagatggtgaccgacagcctgcgctactgggtgacggaaatgaaagtggacggtttccgtttcgacctcgccacgattctcggccgcgaactgcacggtttcgacgaaggaggcggttttctcgacagttgccggcaggaccccgtgctgtccagcgtgcggctggtggccgagccgtgggattgcggtcccggcggttatcaggtgggcggctttccgcccggctgggcggagtggaacgaccgctttcgcgataccgtgcgcgaatactggaagggcgacgaaggcaaggtcccggatctcgccacgcgtctcaccggttcgggcgacaagttcaaccatcgcggccgccgcccgtgggccagcgtgaacttcatcgccgcgcacgacggcttcacgctcaacgatctggtttcgtacaacgacaaacacaacgaagccaacggcgaggacaacaaggacggccattccgacaacaaatcctggaacatgggcgtggaaggcccgaccgacgatccggacattcgtcagcaacgcgagcgacagaagcgcaatctgctcgccacgctgctgttgtcgcaaggcacgccgatgattctcgcgggcgacgaattcggccgcacgcagaagggcaacaacaacgcctattgtcaggacaacgagatcagctgggtcgattgggaagcgatcgacgacgacggccgcgcgctgatcgagttcgtcaggaatctgaccacgctgcgccaccgtctgccggtgctgcggcgcggccgctttctgaccggcgaatacaacgaggcgctggacgtgaccgacgcgcgctggatctcgccggacggcaaggatctctcgcaggagcaatgggacgatgcgtccatgcgctgctttggtctcgtgatcgacggccgcgcgcaggcgagcggcattcgccgtccggcttcggacgcgactttgctgctggtgctgaatgcgcatcacgacgtcgtcaatttcacgctgccc

SEQ ID NO: 31180 - DNA, 996 bp, Burkholderia cepacia
gacacccgtagcgagctgcaagccaccatcaaggcaatggttcaacccggcaagggtcttctcgccgccgacgaaagcggcccgaccatcgccaaacgcttcaagacgatcggcctcgaatcgagcgaggaaaaccgccgcgcctatcgcaacctgctgctcaccacgcccggactcggcgaattcgtgagcggcgtgattctctacgaagaaacgctgggccagaaagcggacgacggcacgccgttcccgcagctcgccgcgaaaaacggcatcgtgcccggcatcaaggtggatctcggcaagattgcgctcgcgctcgcgccgggcgacgagatcaccgaaggtctcgacggactcgcccgccgtttcgtcgattacaagcggcaaggcgcgcgcttcgccaaatggcgcgcggtctacaacatcacggcgagcctgccgagccgtctcgcgatcgaggcgaatgccgattcactcgcgcgctacgccgcgatctcacaggaagcgggcatcgtgccgatcgtcgaacccgaagtgctgatggacggcgagcacaccatcgagcgcagcgccgaggtcaccgaggccgtgctccacgcggtgttccatgcgctgcaccggcatcgcgtcgtgctcgaacatattctgctgaagccgagcatggtgatcgccggctccgaacacgcgcagcagtcgtcgactgccgacattgccgcttataccgtgcgggtgctcaagcgcacggtgccctcggcggtgccgggcatcgtgtttctgtccggcggccaatcgcctgaagaggcgaccgcgaatctcgacgccatgaaccgtctcggcgcgttgccgtggaatctgagcttttcatatggacgcgcgttgcaggaaccgccgctgcaagcatggaaaggcgagcggagccacgtcgagcaggcccagcaggcgctgctcaagcgggcgcgtctgaatagcgccgcggcactgggcaagtacgag

SEQ ID NO: 31181 - DNA, 1011 bp, Burkholderia cepacia; identical to SEQ ID NO: 28421

SEQ ID NO: 31182 - DNA, 1977 bp, Burkholderia cepacia
atgtctgcgattgaatcggttcttcaggaacgccgtgttttcccgccctccgctgaaacagtagcggccgcgacgatctccggcatggacgcgtaccgggcgctcgccgccgaagcggaacgcgattacgaaggtttctgggggcgcctcgctcgcgagacgctaagctggaatacgcccttcaccaaggtactcgacgaatcgaaggcgccgttctacacgtggttcgaagacggccggctgaacgcgtcgtataacagcatcgaccgtcacgtcgaagccggcaacggcgcgcgcgtcgcgatcattttcgaagccgacgacggcaccgtcaccaacgtcacctaccaggatctgctgcaacgcgtgtcgcgctttgcgaacgcgttgaagaagcgcggcgtgaaaaagggcgaccgcgtggtgatctatatgccaatgtcgatcgaaggcattgtcgcgatgcaggcttgcgcgcggatcggcgccacgcactcggtcgtgttcggcggcttctcgtcgaagtcgctcaacgagcggctggtggacgtgggcgcggtcgcgctcatcacgtcggacgaacagatgcgcggcggcaaggcgctgccgctgaagaacatcgccgacgaagcgctcgcgatgggcggctgcgaagcggtcaggagcgtgattgtgttccagcgcaccggcggcaagatcgcctggaacgcagaccgcgatctgtggatgcacgaactcacgcaggccgaaccggatcaatgcgcgccggagtgggtcggcgccgagcatcctctgttcattctgtacacgtccgggtcgaccggcaagccgaagggcgtgcagcacagtaccggcggctatctgctgtgggccgcgcagaccatgaagtggaccttcgactggaagcccaccgacgtgttctggtgtaccgccgacatcggctggatcaccggccatagctacatcacgtatggtccgctgacgctcggcggcacccaggtcgtgttcgaaggcgtgccgacctatccgaacgccggccgcttctgggacatgatcgcgcggcacaaggtgtcgctgttctataccgcgcccactgcgatccgctcgctgatcaaggccgccgacgcggacgcgaaggtgcatccgaagagctacgacctgtccacgctgcgcatcatcggcacggtcggcgagccgatcaatccggaagcgtgggtctggtattacgagaacgtcggcggcagccattgcccgatcgtcgatacgtggtggcagaccgaaaccggcggtcacatgatcacgccgctgccgggcgccacgccgctcgtgccgggttcgtgcacgttgccgctgccgggcatcatggcggcggtggtcgatgaaaccggccaggacgtgccgaacgggcagggcggcattctggtggtgaagcgcccgtggccgtccatgctgcgcaacgtgtggggcgatccggaccgctacaggaagagctactttcccgaagaactcggcggcaagctgtatctcgccggcgacggcgcggtgcgcgacaaggagaccggctacttcacgatcatgggccgtatcgacgacgtgctcaacgtgtcgggccaccgcctcggcacgatggagatcgagtcggcgctggtgtcgaacccgctggttgccgaagcggccgtggtggggcgccccgatgcgaccaccggcgaagccgtgtgcgcgttcgtggtgctcaagcgttcgcgtccggaaggcgaggaagcggtgaagctcgccaacgaactgcgcaactgggtcggcaaggagatcggtccgattgccaagccgaaggacatccgtttcggcgaaaatctgcccaagacgcgttcgggcaagatcatgcgccgcctgctgcgctcgctggcgaaaggcgaggaaatcacccaggacgtgtccacgctggagaaccccgcgattctcgaccagctcggcgagtcg

SEQ ID NO: 31183 - DNA, 1248 bp, Burkholderia cepacia; identical to SEQ ID NO: 28424

SEQ ID NO: 31184 - DNA, 1188 bp, Burkholderia cepacia
ctgttctccgccgtcgaacttgctccccgcgacccgattctgggcctgaacgaagccttcaatgccgatacgcgcaccaccaaggtcaaccttggcgtcggcgtgtacttcaatgaagaaggcaagattccgttgctgcgcgccgtgcgcgacgcagaaaaggcccgcgtcgatgccgcgctgccgcgcggctacctgccgatcgaaggcatcgccgcttacgatgccgctgtgcagaagctgctgctcggcaacgactcgccgctgatcgcggcgggccgcgtcgtgacggcgcaggcgctgggcggcacgggcgcgctgaaaattggcgcggacttcctgaagcgcctgaacccgaacgccaaggtcgcgatcagcgatccgagctgggaaaaccaccgcgcattgttcgaaggcgcaggtttcgaagtcgtgtcgtacccgtactacgacgcgcacacccacggcgtgaatttcgacgccatgctgagcgcgctgaacagctatgccgccggcacgatcgtcgtgctgcacgcgtgctgccacaacccgaccggcgtggacctcaacatcgagcaatggaagcaggttgtcgaagtggtcaaggcgcgcaatctggtgccgttcctcgacatcgcctaccagggtttcggcgacaacatcgaagcagacgcagcggccgtccgtctgttcgccgcggcggaactgaacgtgttcgtgtcgtcgtcgttctcgaagtcgttctcgctgtacggcgagcgcgtcggcgcgctgtcgatcatcacggcaagcaaggaagaagccgctcgcgtgctgtcgcaactcaagcgcgtgatccgcacgaactattcgaacccgccgacgcacggcggctcggtggtcgcggccgtgctcgcgtcgccggagctgcgcgccacgtgggaaacggaactggccgaaatgcgcgatcgcatccgcgccatgcgcaatggtctggtcgaacgcctgaaggcgagcggcgtggatcgcgacttcagcttcgtgaacgcgcagcgcggcatgttctcgtactcgggtctgacggcgccgcaggtggaccgtctgcgcgaagaattcggcatctacgccgtgagcacgggtcgcatctgcgtggccgcgctgaatacgcgcaacctcgacgcggtggccaacgcgatcgctcacgtattg

SEQ ID NO: 31185 - DNA, 765 bp, Burkholderia cepacia; identical to SEQ ID NO: 28426

SEQ ID NO: 31186 - DNA, 1389 bp, Burkholderia cepacia
aagaaacctatccacaaagtgctgtacgtccaggtgatcgtggcgatcatcatcggtatcgggctcgggcatttctacccggatctcgccgtcgacatgaagccgctcggcgacggcttcatcaagctgatcaagatggtgatcgggccgatcattttctgtacagtggtgacaggtattgccggcatggaggatatgaagaaagtcggccgggtgggcggcaaggcgctgctgtatttcgaaatcgtctcgaccttcgcactggtgctcggccttatcgccacgcatgtactgaagccgggcgtcggcttcaacatcgatccggccacgctcgacggcaaggccgtcgcctcgtacgccgcgaaagcgcacgggcagaccacggtcgacttcctgatgcacatcattccggatacgctcgtctcggcgttcgcgcagggcgagatcctgcagatcctgctgatcgcgctgctgttcggcgcggtgctcgccacggccggtgagaagggcaaggtcgtgacgggctttatcgacgggctctcgcatgtgctgttcggcatcgtgcgcatcatcaccaagctggcgccgatcggcgcgttcggtgcgatggccttcacgatcggcaagtacggtatcggctcgctgttgccgatgctcaagctgatcggcacgttctatctgacctcggtcgtgttcgtggtggtggtgctcggcatcatcgcgcgtgcggtgggcttcaacatcctgcgcttcgttgcgtacatcaaggaagagatgctgatcgtgctcggcacgagctcgtccgaagcggcgctcccgcaactgatgctgaagctcgaacggctcggctgctcgcgttcggtggtgggcctcgtggtgccgaccggttactcgttcaatctcgacggcaccaacatctatatgacgatggccgtgctgttcatcgcgcaggcgaccaacaccgacctgacatggacgcagcagctcacgctgctcgcggtcaccatgctgacctcgaagggcgcgagcggcgtgacgggcgcgggcttcatcacgctggcggcgacgcttgccgtggtgccgaccattccgctgtcgggcatggtgctgattctgggtatcgaccgcttcatgagcgaatgccgcgcgctgaccaacattgtcggcaacggtgtggcgacggtggtcgtgtcggcgtgggaaaaggaactggaccgcagcaagctgaacgccgccttgcgcggcgacgtggcgatcaaagagccggccggcgtttaaacggcgcatcggcaacccgctccagcgcaaccccgacggccgcggataccagcgtatgaaaccggtgtccgcgcgccgaacctccgtgccgtcggccgacgaagcttgcgc

SEQ ID NO: 31187 - DNA, 1167 bp, Burkholderia cepacia
atcgtcatcgtgggcgtggcccgcacgccgatggcggcattccagggcgacttcgccacgctgagcgcgccgcaattgggttcggtggcaatccaggcggccgtgcagcgcgccggccttaaacccgaacagatcgacgaagtggtgatgggttgcgtgctgcccgccggcctcggccaggcgcccgcgcgtcaggccgcgctcggcgccggcttgccgctcgccaccggcagcaccacggtgaacaagatgtgcggctcaggcatgcgcgcggccatgttcgcgcacgacatgctcgccgcgggttccgtcgacgtgatcgttgcgggcggcatggaaagcatgacgaacgcgccgtatctgctgcccaaagcgcgggcgggaatgcgcatgggccacggtcaggtgatcgaccacatgttctacgacggtctcgaagacgcctatgaaaaaggccgtctgatgggctccttcgccgaggaatgcgcggcttcgttcgacttcacgcgcgaggcgcaggacgcgttcgccgtcgagtcgctcgctcgtgctaagcgtgcgaacgaggacggttcgttcgcctgggaaatcgcgccggtgaaagtggagagccgcaagggcgaagtcaccatcgatcgcgacgaacagccgttcaaagcgaacatcgagaagattccgacgctcaagcccgcgttcagcaaaaccggcaccgtgacggcggcgaactcgtcgtcgatttccgacggcgcggccgcgctcgtcatgatgcgcgagtcgacggcgaagcgcctgggcgtccagccgattgcgcgcgtggtcggccactcgaccctcgcgcaggaaccggcgaagttcaccaccgcgccggtcggcgcgattcgcaagctgttcgagaagaacggctggcgcgccgacgaagtcgatctgtttgaagtcaacgaagcctttgctgtcgtgacgatggccgccatgaaggagcaccatctgccgcacgagaaggtcaacgtgaacggcggcgcctgtgcgctcggccacccgatcggcgcgtcgggcgcgcgcattctcgtcacgctgatcggcgcgctgaaaaagcgcggcggcaagcgcggcgtcgcgacgctgtgtatcggcggcggcgaagcgacggcaatgggtatcgaactcgtg

SEQ ID NO: 31188 - DNA, 1110 bp, Burkholderia cepacia
cttgatcaggatcacctgatggtgcgcgatgcactgcgcacgttcgtccgcgaagcaatcacgccgcatgcggcgacatgggaccgcgagcgcacgtttccgaaagacgtgcaccgccagctcgcgcaactcggcgcgtatggcgtgctggtgcccgaaacatacggcggcgccggcatggacgcgctggcgctcgcgctaattctcgaagaaatcgcagccggcgacggcggcacgtcgacggccatctccgtcaacaactgcccggtgtgcagcatcctgctgacctacggcaacgacgcgcagaaacgcgagtggctcacgccgctcgcgcgcggcgacatgctcggggccttttgcctgaccgaaccgcaagccggttccgacgcctccgcgctgcgcaccaccgcgacacgcgagggcgacgagtacctgctgaacggcgtcaaacagttcatcacgagcggcaggaacggccatgtcgcgatcgtcatggccgtgaccgacaaagccgcgggcaagcgcggcatcagcgcgtttatcgtgcccaccgatacgccgggctatgtcgtcgcgcgggtcgaagacaagctcggccagcattcgtcggacaccgcgcagatcattttcgaggattgtcgcgtgccggccgccaacctgatcggcgcgcaaggcgaaggctaccggatcgcgctgtcggggctcgaaggcggccgcatcggtatcgccgcgcaaagcgtcggcatggcgcgcgccgcgttcgaagccgcgctgagctatgcgaaggagcgcgagagcttcggcgtgccgctcttttcgcaccaggccgtacaattccgcctcgccgacatggcgacgcaactcgaggccgcgcgccagttgatctggcacgccgcctcgttgaaagacgccggccaaccctgcctcaccgaagccgcgatggccaaactgttcgcgtccgaagccgccgagcgcatctgttcggccgccttacagattcatggcggctacggctatctgagcgacttcccggtcgagcggatctaccgcgacgtgcgggtctgccagatctatgaaggcaccagcgacatccagaaaatcctgatcgcg

SEQ ID NO: 31189 - DNA, 987 bp, Burkholderia cepacia
cgtcgtaccactctcacgaagtacctgatcgagcagcagcgcgagaccaacaatctgccggccgatctgcgccttttgatcgaagtcgtcgcgcgtgcgtgcaaggcgatcagctaccacgtcagcaagggcgcgctgggcgacgcgctcggcacggcgggcagcgagaacgttcaaggcgaagtgcagaagaagctcgacatcctgtcgaacgaaatcctgctcgaagcgaatgaatggggtggcaacctcgcgggcatggcgtccgaggaaatggaacagttcttcccgatcccggcgaactatccgaagggcgaatacctgctcgtgttcgatccgctcgacggctcgtcgaacatcgacgtcaatgtttcgatcggcacgatcttctcggtgttgcgctgcccggacggccagcagcctaccgaacagtcattcctgcaaccgggcacgcagcaggttgccgcgggttatgcggtatatggtccgcaaaccgtgctggtgctgaccaccggcaacggtgtgaactgcttcacgctcgaccgcgaactcggctcgtgggtgctcacgcagagcgacatgcgcattcctgtcgaaacgcgtgaatatgcgatcaacgcttcgaacgaacgtcactggtatccgcctgttcagcaatacatcggcgagttgaaggacggcaaggaaggttcgcgccaaagcgacttcaacatgcgctggatcgcgtcgatggtggcggacgtgcaccgcattctgaatcgcggcggcatcttcatgtatccggccgacaagcgcacgccggacaaaccgggcaagctgcgcctgatgtacgaagccaatccgatggcctttattgtcgagcaggcaggcggtgccgcgaccaatggcgagaagcgcattctggacatccagccgaaaagcctgcatgaacgcgtggcggtattcctcggttcgaagaacgaggtcgaccgggttacccgctaccat

SEQ ID NO: 31190 - DNA, 1518 bp, Burkholderia cepacia; identical to SEQ ID NO: 28430

SEQ ID NO: 31191 - DNA, 1176 bp, Burkholderia cepacia
atgaaggcgccatcagtttatttgcacgcgctcggcatgatcaacgcgctcggcggcgacctcgacagcattgtcccggcgcttgccgccggccgttcgccgggtatggcgaacgcgcatacggggatcggcgaggcgttcgtcggcagcgtgctcgcgccgctggagctggcgccgcgcgccgaactcgcccgctacgactgccgcaataaccgcttgctgctcgccgcgctggcgcagatcgcgcccgctgttgaagcggcgcgcgaacgttacggcgcgcatcgcgtcggcgtggtgctcggcaccagcacgtcgggcatcgaggccgctgaagccgcgttcgtctatcaggcgcaggccggcgatcttcccgcgaacttcaactaccggcagatggaaatcggcaccgccgcgccgttcgccgccgccgcgctcggcctgcacggtccggcgttcaccatttcgaccgcgtgcacatcgagcgcgaaagcctttgcgtcggcacgccggctgttgcagttgcaactatgcgatgcggtcgtggtgggcggtgtcgattcgctgtgcgagctcacggtgcagggtttcgcatcgctcgaatcgaccagcaacgtgcgcagcaatccgatgagccgcaatcgttgcgggatcaatgtcggcgaaggcgcggccgtgttcctcatgagccgcgacgaggcgatggtgcgcgtcgcgggcgtgggcgaatcgagcgacgcgcatcacatttcctcgccggacccgcagggcgtgggcggcgaactcgcgctgcgcgcggcgctcgcggatgcgggtgtcgaatcggcggcgatcggctacgtgaatctgcacgccaccgccacgcgcaagaacgacgagatggaagcccacctgatgtcgcgcgtctttcccggcggcgtgccgaccagcggcaccaagccgttgaccggccaccagctcggcgcggcgggcgcgaccgaactcggcttcgcctggctgacgctggcgcgtgagaacgtgccgttgccgcgtcatctgtgggacggtgaagccgatccggcattgccgccgctggatctcgtggaaagcgagcggtttttgccgcaaggcggcgcgcagtacgcaatgagcaattcatttgctttcggcggcagcaacgtcagcctgattcttgcc

SEQ ID NO: 31192 - DNA, 717 bp, Burkholderia cepacia
agccggcgtgttctcgttaccggcgcaagccgtggcattggccgcgcgattgcgtacaagttggccgccgacggcttcgcggtctccgtgcattgccgcacggggcgcagcgaggccgacgcggttgccacgggtatcgccgcgcagggcggcacggcgcgcgtgttgcagttcgacgtgcgcgagcgcgccgtgtgccgcgaagtgctcgaagccgacgtcgcggcgaacggcccgtattacggcatcgtgtgcagcgcgggcgtgacccgcgacgcggcgttccccgcgctcagcggggaagactgggacgtggtgatcgaaaccggactcgactcgttctacaacgtcgtccatccgttgaccatgccgatggtgcgggcccgccagggcggccgtatcgtcacgatcgcttcggtgtccggcgtaatgggcaatcgcgggcaggtgaactacagcgcggcgaaagccggcctgatcggcgcgaccaaggcgctcgccgtcgaactggcgacgcgcaacatcaccgtcaattgtgtcgcgccgggtttgatcgaaaccggcatgctcgacgagctgccgctcgaacaggtgttgaagacggtgccgatgaaccgcgtcggccagcccgccgaggtggcctccgtggtcagcttcctgatgtcggatgcggcctcgtatgtcacgcgccaggtgatcggcgtgaacggcgggatg

SEQ ID NO: 31193 - DNA, 1218 bp, Burkholderia cepacia
aagcgcgtcgtcattaccggcatgggcggcgtcacggcattgggcgacagctgggacgtgatcgaaacgcgtctgaggagcggcgtgaacgccgtgcggcgcatgcccgaatgggactacttcgagtcgctgcatacgcggcttgcgtgtccgctgccggggttcacgatgcccgcgcattatccgcgcaagaagacccgctcgatgggaccggtctcgatgtactcggtgcgcgcgagcgaactggcgctcgccgacgcgggcctcgccgacgacgccaccatcaaggacggccgcatgggcgtcgcgtacggttcgtcgtcgggctcggtgcagccgatccgcgctttcggcacgatgctcgaaaccggctcgatgagcgacgtcacctccaacagctacgtgcagatgatgccgcacaccaccgcggtcaacgtcagcctgttctgggatctgaaagggcggatcattccgacctcgtgcgcgtgcgcctcgggcagccaggcaatcggctatgcgtatgaagcgatccagaccggcaagcagacgctgatgctggcgggcggcgcggaggaactgtcgggcccggcggtcgccgtgttcgatacgctgtacgccaccagcacgcgcaacgacgagccgcatctgacgccgcgtccgttcgacgccgcgcgcgacggcctcgtggtcggcgaaggcgcggccaccctggtgctcgaagaatacgggcacgcggtggcgcgcggtgcgcggattcacgcggagatcgtcggcttcggctgcaattcggacggcgcgcatatgacgcagccgaccgccgaaacaatggcgctcgcgatgcaactcgcgctcagggatgctcagctcgcgcctgaagcgattgcctacgtgaatgcgcacggcacctcgacggatcgcggcgatattgccgaaagccacgcgaccgcgcagaccttcggcgcgcacatgccgatcagttcgctcaagagctatgtcggccatacgctcggcgcgtgcggcgcgctcgaagcctggtggaccatcgagatgatgaagcgcaactggtatgcgccgaccttgaacctgacccgcgtcgatccggcctgcgcgccgctcgattacatcgccggcacgggccggcagatcgatgccgaatacgtgatgagcaacaacttcgcgttcggcggcatcaacacgtcgctgattttcaggcgcgtt

SEQ ID NO: 31194 - DNA, 1218 bp, Burkholderia cepacia
atggcgctgcaacgcgtggtcgtgaccggtatggggatcgtgtcgtgtctcggcaatacgctcgacgaagttgcctcggcgttgcgcgcgggccgctcgcgcattcagcggatcgacgcctggcgagagcgcggcttcgcttcccaggtggcgggcgttgcgtcggttgcgcacgaaccgccgtttgagcgcaagctcgaacgcttcatgggcgacacggcgcggttcgcctgtcacgccgcgcgcaacgcgatcagcgacgccgggctcgatgccgcggcgttgcgctcgccgcgcgccggcacggtgatcggttcgggcgtcggcacgatgtccacttacgacgcggcgatggcaaccgcgcacgctcgcggtgtcgacaaggtgccgccgtacacggtgccgcatgcgatgagcagcaccgcgtcggcgaacgtcgcgcaggtgttcgggctcgaaggcgtcagctattcgccgtcatcggcgtgtacgacctcggcgctcgcgatcgggcaggcgatgcagctgatccagaccggccgccagcagatcgtgctggccggcggcagcgagtcgctgcacgacaacatgacgctcatgttcgacgcaatgggcgcgctgtcgcgccgcttcaacgacacgccgcagcgcgcatcgcgtccttatgacacggagcgcgacggcttcgtgatcgcgtcgggtggcggcgtgctggtgctcgaatcgctcgagtacgcgctcgcacgcggcgcgcgcatctacgcggaactcaccggattcggcgactgcacggacagcgccggcatggtcgcgccgcgcgcggcggggatcgcgcgcgccatgcgcggcgcgctgcatgaagcgggcaagcggcccgattacgtcaacacgcacgcaccgtcgacaccgctcggcgatacggaggaattgcgcgcgttgagcgaagtgttcggcgcggcgttcgatcgtcgcgtgccggcgttttcatcgaccaaggggatgacggggcatccgctcggcgcttgcggcgcgcacgaggcgatctacacgctgctgatgatgcgtgacggcttcattgctggcacggcgggcatcgacacgccggagccggccgtcgacggcatgccgctcgtgcgcgtcacgcgtgaggcgcgtatcgacacggcgatgtcggtttcattcgggttcggcggcagttgcgcgagcctggtgttcgaa

SEQ ID NO: 31195 - DNA, 2820 bp, Burkholderia cepacia
gacgacacggactacggcacgcccgagcgtcacgccgacatcgacgtcacgctggaaatcgacggccagtccgtcaccgtgccggccggcacctccgtcatgcgcgccgccgtcgaagcgggcgtcaacgtgccgaagctctgcgcgaccgattcgctggaaccgttcggctcgtgccgcctgtgtctcgtggaaatcgaaggcaagcgcggctatcccgcgtcatgcacgacgccggtcgaagccggcatgaaggtgcgcacgcagaccgatcgtctgcagtcgctgcgccgcaacgtgatggagctgtacatctccgatcacccgctcgactgcctgacctgccccgccaacggcgactgcgaactgcaggacatggcgggcgtcacgggcttgcgcgaagtgcgctacggcttcgacggcgcgaatcacctgaaggataagaaagacgagtcgaacccgtacttcacctacgacgcgtcgaagtgcatcgtctgcaatcgctgcgtgcgcgcgtgcgaggaaacgcaaggtacgttcgcgctgaccatcgccgggcgcggtttcgaatcgcgcgtggcggccagcgaaaacgtgccgttcatggaatcggagtgcgtgtcgtgcggcgcgtgcgtggccgcatgcccgaccgcgaccttgcaggaaaagaccgtcatcatgcttggccaggccgagcattcggtcgtgaccacgtgcgcgtattgcggcgtcggctgctcgttcaaggcggagatgaagggcaaccaggtcgtgcggatggtgccgcacaagaacggccaggccaacgaaggccacgcctgcgtgaagggccgctttgcgtggggctacgcgacgcacaaggaccgcatcaccaggccgatgatccgtgcaaagatcaccgatccgtggcgcgaagtgagttgggaagaagcgctcacgtatgcagcgtcggaattccgccgcattcaggcgaagcacgggcgcgattcgatcggcggcattacgtcgtcgcgttgcacgaacgaagaaacgtatctggtgcaaaagctcgtgcgcgccgcgttcggcaacaacaacgtcgacacctgcgcgcgcgtgtgccactcgccgaccggctatggactgaagaccacgctcggcgaatcggcgggcacgcagacgttcgcctcggtcgataaagccgacgtgatcatggtgatcggcgcgaatccgaccgacggccacccggtgttcggctcacgtctgaaacgccgcgtgcgcgaaggcgcgaagctgatcgtggtcgatccgcgccgcatcgatatcgtcgatacgccgcatgtgaaggcgtcgcatcatctgcaattgcgcccgggcaccaacgtggcagtggtaaacgcgctggcgcatgtgatcgtcaccgaagggctggtgaacgaagcgttcgttgccgagcgttgcgaaacgcgcgcgttcgagcaatggcgcgatttcgtcgcgctgccggaaaacgcgccggaggcgaccgaggcggcgaccggcgtgccggctcaagccgtgcgcgaagccgcccgcatctatgcgaccggcggcaacgccgcgatctactacggtctgggcgtcaccgaacacgcgcaaggctcgacgatggtgatgggcatcgccaacctcgcaatggcgacgggcaacatcggccgcgaaggtgtgggcgtgaatccgctgcgcggccagaacaacgtgcagggttcgtgcgacatgggctcgttcccgcacgagctgccaggctatcgccacatcagcgacacggtcacgcgcacgctgttcgaggaagcgtggaacgtcacgctgcaacccgaacccggtctgcgcattccgaacatgttcgacgccgccgtgcacggcaccttcaagggtctgtactgccagggcgaagacatcgtgcagtcggatccgaatacgcaccacgtgtccgcggcgctgtcggcgatggaatgcattgtcgtgcaggacattttcctgaacgagaccgccaagtatgcgcacgtgctgctgcctggttcgtcgttcctcgaaaaggacggcacgttcaccaacgcggagcgccgcatctcgcgcgtgcgcaaggtcatgccgccggtaccgggttacgccgactgggaagtcacggtgctgctcgcgcgcgcgctcggctatgaaatggactacacgcatccgtcgcagatcatggacgagatcgcgcgtctcacgccgaccttccacggcgtctcgtacaaaaagctcgacgaactcggcagcatccagtggccgtgcaacgagaatgcgccggacggtacgccgaccatgcatatcgacaccttcgtgcgcggcaagggcaagttcgtgatcacgaagttcatcgcgacgccggagaaagtcacgcgcaaattcccgctgctgctcaccacgggccgcatcctgtcgcaatacaacgtgggcgcgcagacgcgccgcaccgagaactcgcgctggcacgacgaggaccggctggaaatccatccgcacgacgccgaagaacgcggcatcaggacggacgattgggtcggcattgaatcgcgcgcgggacagaccgtgctgcgcgccaaggtgaccgagcgcatgcagccgggcgtcgtttatacgacgttccacttccccgaatcgggcgcgaacgtgatcaccaccgatagctcggactgggcgaccaactgtccggaatacaaggtgaccgcggtgcaggtgatgccggtcgaacagccgtcgcaatggcagagagactattcgcgtttcaacaccgaacagctcgatctgctgaagcagcgc

SEQ ID NO: 31196 - DNA, 780 bp, Burkholderia cepacia; identical to SEQ ID NO: 28437

SEQ ID NO: 31197 - DNA, 1308 bp, Burkholderia cepacia; identical to SEQ ID NO: 28438

SEQ ID NO: 31198 - DNA, 837 bp, Burkholderia cepacia
tcctacctggtcggtctgattggctcgggcatcggcggatcgctcacgcccgcgatgcacgaggaagagggcagccaactcggcctgcactacgtgtaccgccgcatcgatctggaagcgttgaagctcgacatcgccgcactgccggatctgctcatcgccgccgagcgcatgggcttcaacggtctgaacatcacgtacccgtgcaagcaggcggtgattcctttgctcgacgaactgtccggcgacgctcgtgcactcggcgcggtcaacaccgttctgttcaaggacggcaaacgcattggccacaacacggactggtccggtttcgcccgtgcgttccagcgcggtttgcctgacgtgtcgctggaacgtgtcgtgcaactgggcgcgggcggcgccggcgcggcggtcgcgcacgccgcgctgaccttgggcgcgaaatcgctcacgctattcgatgtggatgcttcgcgcgccgcctcactcgcccgcgaattgcagaagcgctttcccgccgccgcgatcagcgccggcagttcgctcgccgggtcgctcacagctgccaatggcctgattcacgccacacccaccggcatggcgaaattgcccggcctgccgctgccggtcgaattgctgcaccgtgacctgtgggtagcggacatcgtctatttcccgattcgcacggcgctgctgcaggcggctgagtcactcggctgccgcacgctgagcggcggcggcatggcggtgtatcaggcggtcgacgccatgcgcatcttcaccggtctcgaacccgacgccgagcgggtgtatcgccattttcagtcgttgttgcag

SEQ ID NO: 31199 - DNA, 423 bp, Burkholderia cepacia
gcgtcggtactggtcctcaatggaccgaatctcaatctgctcggcacgcgcgagccggccatctacggctcggaaacgctcgacgacatcgcgaagctctgcggcgatgcggcagagcgtctgaatctgtcgatcgacttctgccagtcgaacgccgagcatcaactgatcgactggctgcacgcggcgcggaccaaggtcgacggcatcgtgatcaatcctgcagcttatacgcatacctcggtggcgattgccgacgcgctttccgcgatcgaaaagccggtcatcgaagtgcatatttcaaacgtgcatcgccgcgaggcgttccggcatcactcgtatgtgtcggcggcggcggacggggtcatcgtcggttgcggcacgcagggctatgtgctggctttggagcggatggcggccatt

SEQ ID NO: 31200 - DNA, 864 bp, Burkholderia cepacia
atctgggaaggcgtattgcccgcagtcaccaccaaattcaacgcggatttcagcatagaccgcgcatggaccggcaagaatatcgaggcgcagatcgcggcgggtgtggacggcatcatcgtgtgcggatcgctgggcgaagcgtcgacgctctcgctggatgaaaagctgcaggtgctcgacgtcgccgtggaggcctcgcgcggccgtgtgccggttctattgacgatcgccgaaaacagcacgctcgacgcgtgccgccaggccgaagccggcagccgtcacggcgcggccggctacatggtgctgccggggttgcgctatctgtcggaccgtcgcgagacgctgcaccatttccgcagtgtcgccgacgcaagcgcgctgccgctgatgatctacaacaatccgctcgcctatggcgtcgacatgacgcccgacatgttcgcggaaatcgccgacgagaagaaggtcgtcgcgatcaaggaatcatgtggcgacgtgcggcgcgtgaccgacctgatcaacgcggtcggcgaccgcttcgcgattctctgcggcgtcgacaatctcgcgatggaagcaatattgatgggcgcgcatggctgggtggccggtctcgtgtgcgcgttcccgcgtgagacggtggtgatctacaagctgctgaaggcgggacgcttcgaggaagcgcgggcgatctaccgctggttcgcgccgctgctcgcgctcgacgtctcggcaaagctggtgcagaacatcaagctcgccgaagccattgtcggcctgggcacggagccggtgcgcccgccacgtctgccgctggccggcgacgaacgcaaggctgtcgaagcgctgattcgcaaggcg

SEQ ID NO: 31201 - DNA, 1088 bp, Burkholderia cepacia
agtgccgcgcagcgcgatctcgaaggcggccacgccgcccaggaaaaacaatggatcgccgacgcggggcttctcacgctcgcggtgccgcgcgaattcggcggcctcggcgcgcgttggcccgacatctacgagacggttcgcaagatcgcgcaagtggacagcgcgctcgcgcatctgttgggcttcacgtgcctgcaggtggtcagcgtcaatgtatggggcaatcctgaacaacgcgcccgctttctgagcggcaccgtcgaaaaccggtggtggtggggtaacgccgtcaatccgctcgacacacggctcattgccaccgcaagcggcgacggcggctacctgctcgacggccagaagggattctgctcaggcacgcgcggctcgcagatgatgacggtctccgcgcaggatccggtcaccggcaaaccggtgttcggtgtcctgccgaccacgcgcgaaggcattaccgttcacgaagactggaatccgatcggccagcggcagaccgacagcggcagcgtgtcgttcgtgcgcgtcaagctcgaaccgcatgaagtcatggagcggcccgacacaccgcacgcgagtttgcgcacgctgatttcgcaactggtgctgaccaacctgttcgtgggcattgcacagggcgcgctcgacgaagcgcgagcctacgtcacgcagcacggtaaggcgtggatctattccggcgtggacaaagccaccgacgatccctacctgatccagcgcttcggcgaaatgcgcctgcaagcggtcagcgcggaagcgctggccacgcgcgcggcctggctgctcgacgacgcgtggcaacggggcgcggcgctttcccccgaaacccgtgcgcaggttgcgctcgccacttcggaggcgaagatcgtcgcgcaccgcgccgcgctcgacgtcagcgaacagctgttcgacgcctgtggtgcccgcgccacgcacgcgccgctcgcgctcgaccgtttctggcgcaacgctcgcgtgcacacgctgcacgatccgctggactatcgcgtgcgcgacgtcggccgctacgcgctcaccggcacgttgccggaggt

SEQ ID NO: 31202 - DNA, 1503 bp, Burkholderia cepacia; identical to SEQ ID NO: 28443

SEQ ID NO: 31203 - DNA, 1449 bp, Burkholderia cepacia; identical to SEQ ID NO: 28444

SEQ ID NO: 31204 - DNA, 1275 bp, Burkholderia cepacia; identical to SEQ ID NO: 28445

SEQ ID NO: 31205 - DNA, 1191 bp, Burkholderia cepacia
gtgacacgccagaccttcgacgaagtcatggtgccggtgttttctcccgccgccttcgtgccggaccgcggtctcggctcacgcgtctgggatacgcagggccgcgactatatcgacttcgccggcggcatcgctgtcaccgcgctcggtcatgggcatcccgaactgctgaaagtactgcacgagcagggcgccaagctgtggcacatcggcaatggctacaccaatgaaccggtgctgcgtctggccaaacgcctcgaagagctgactttcgccgaccgcgcgttcttcgccaactcgggcgcggaagcgaatgaagctgcgttgaagctggctcgccgcgtcgcgttcgagcgtcacggcgcggataaattcgaaatcgtttcgtttacgcagtcgttccacggccgcacgttcttcacggtgagcgtcggcgggcagccgaagtattcggaaggcttcggcccggtgccggccggcatcacccacttgccgtataacgacatcgaggccgcgaagaaagccatcggcgcgcaaacctgcgcggtgatcgtcgagccggttcagggcgaaggcggcgtgatcccggcggatccggcgttcctcgcggcattgcgcgaagcctgcgatcagcacggcgcactgctgatttttgacgaggtacaaacgggtgtgggccgcagcggctatttctacgcgtaccaggaaaccggcgtgacgccggacatcctgaccacggccaaggcgctcggcaatggcttcccgatcggcgcgatgctgaccaccaacgaactggccgcgtatttcaaggtcggcgtgcatggcaccacgtacggcggcaatccgctgggcgcggcgattgccgaaaaggtggtcgaactgatcagtgatccgaagctgctcgaaggcgtgcgttcgctcagtgaagcgctgaaaggccatctcgcgaagctgaacgatcgcttcggcctgttcacggaagtgcgcggccgggggctgctgatcggtgcggaactgaccgatgcattcaagggccgcgcgaaagatttcgtcaccgccgccggccagcatggcgtgatcatgctgatggccggtcctgacgtgctgcggttcgtgccgtcgctgatcatgccgctcgacgacatgaacgaaggcttcgcgcgtctggccagcgcgatcgagggcattgtc

SEQ ID NO: 31206 - DNA, 1518 bp, Burkholderia cepacia
cgtcgaggcgggcgacctcgtgcgcgtgctgccgcagaaacacaaacagggatgatcatgagcgagcttttcatcggcggcgaatgggccgccggcacaggacccgcattcgcgtcgcgcaacccgggcacgggcgcggcggtgtgggaaggcaacagcgcgtcggctgacgacgtggaccgcgcggtgcgcagcgcgcgccgtgcgttcgccgcctggtcggcgtcgagtgtcgacgaacgttgcgccgtggtgcgtcgcttcgccgcgctcgtgaccgaacgcaaggaagcgctggccgaagcgatcggccgcgaaaccggcaagccgttgtgggaagcgcgcacggaagccgcttcgatggcggccaaggtcgagatttcgattcaggcctataacgaacgtactggcgagaagcgctcggcaatggcggacggcacggccgtgttgaggcatcggccgcatggcgtggtggccgtgttcgggccgtataactttcctgggcatctgccgaacggccatatcgtgccggcgctgatcgcgggcaatgcggtcgtgttcaagccgtcggaactcgcgcccggcgtggccgcgctcaccgtgcagatctggcgcgacgccggtttgccggcaggcgtgctgaacctcgtgcagggcgagaaagacacgggcattgcgctggcgaatcaccggcagatcgacggcctcttcttcacaggtagttcggataccggaacattgctgcacaagcagttcggcggccgccccgagatcgtgctggcgctggaaatgggcggcaacaatccgctcgtgatcgggccggtggccgatgtcgatgccgccgtgcatcacacgatccagtcagcgtttctgtcggcggggcagcgttgcacgtgtgcgcgccgcatcttcgtgccgaacgacgcagcgggcgatcgcttcctggagcgcttcaccgaggtcacctcgcgcatcactgtcggcgaatacaacgccgatccgcaaccgttcatgggcgcggtgatttcggtgcgcgcggcgtcgcgtctcgtcgccgcgcaggaacgcttgctggctgacggcgccaaagcattgctgaagatggagcaacgcgatccgaagctcggcttcgtcacgcccgcgattctcgacgtcacgaacgtggcgaatcggccggacgaagaacacttcggtcctttggcgcagatcatccgctacggcagctttaacgaagcgctggaacaggccaacgacaccgagttcggcctctcggcgggcctcctcgccgacgacgaagcgctctgggcgcacttccagcgcaccatccgcgcgggcatcgtcaactggaaccggccgaccaacggcgcctcgtcgggcgcgccgttcggcggtccgggccgctcgggcaatcaccggccgagcgcgtactacgccgccgactactgcgcgttcccgatggcttccgtcgaaagcgcgcaactgcaaatgcccgcgagcgtctcgccgggccttcaattc

SEQ ID NO: 31207 - DNA, 561 bp, Burkholderia cepacia; identical to SEQ ID NO: 28448

SEQ ID NO: 31208 - DNA, 645 bp, Burkholderia cepacia; identical to SEQ ID NO: 28449

SEQ ID NO: 31209 - DNA, 900 bp, Burkholderia cepacia
gcggcaatcggcgtgggcgtgatcggcagcggctgggtggcgcgcgcgctcgcacacgggctcgatgtgatcgcgtgggacccggcgccgggcgcggagaagcagttgcgcgagaacatcgcgaacgcctggccggcgctgcagcgcgcgggcctcgccgcgggcgcgtcgcccgagcgcttgcgcttcgtcgacacgatcgaagcctgtgtcgggcaagcggatttcattcaggaaagcgcgccggaacgcgaggaactgaagctcgcgttgcatgagcagatcagccgcgcggcgaagccggacgcgatcatcgcttcgtcgacgtcgggtcttttgccgaccgacttctacgcacgggcggtgaatccgcagcggtgcattgtcggccatccgttcaatccagtgtacctgctgccgctcgtcgaagtggtgggcggcgaaaacaccgcgccggcaaccatcgacgccgcgctgcaggtgtatcgtgatctttcgatgcggccgctgcgcgtgcgcaaggaagtgcccggcttcatcgccgaccgcctgctcgaagcgctgtggcgcgaggcgctgcatctggtcaacgaaggcgtggcgaccaccggcgagatcgacgacgcgatccgcttcggcgcgggcatccgctggtcgttcatgggcacgttcctcacctacacgctggcgggcggtgacgcgggcatgcgccatttcatgcagcagttcggaccggcgctggagttgccgtggactaaactgatagcgccgaagctgaccgatgaactgatcgaccgggtagtggacggcacggctgaacaggtcggcccgcggtcgatcaaacagctggaacgttaccgcgacgattgcattacgagcgtgctggcggcgatcgcggag

SEQ ID NO: 31210 - DNA, 1437 bp, Burkholderia cepacia
ttgaccttgaaagacccgtcgcttctgaaaacgcacgcgtacatcgcgggcgaatggcaaggcgcggacgacggctcgaccttcgaagtgaagaaccccgccacgggtgaaatcatcgcgaccgtgccgcgcatgggcacggcggaaacccgccgcgcgatcgacacggccaacgccgcgtggcccgcctggcgcgccacgaccgcgaagcagcgagcggtgatcctgcgcaaatggcacgacctgatgatggagaacgccgacgatctggcaaagatcctcaccacggaacaaggtaagccgctcgccgaagccaaaggcgaaatccagtacgccgcttcgttcctcgaatggttcgcggaagaaggcaagcgcgtgaacggcgacaccatcccgacgccggccaacgacaagcgcatcgtcgtgacgaaagaaccgatcggcgtgtgtgccgcgatcacgccgtggaacttccccgcggcgatgatcacgcgcaaggtcggtccggcgctggcggcgggctgcccgatcatcgtcaaaccggctgaagccacaccgctctccgcgctcgccctcgccgtgctggccgaacgcgccggcgtgccgcgcggcgtgttcaacgtcgtcaccggcgagccgaaagccattggcgcggaaatgacgggcaatccggtcgtgcgcaaactgtcgttcaccggttcgacgccggtcggccgtttgctgatggcgcagtgcgcgccgacagtcaagaaagtgtcgctcgaactcggcggcaacgcgccgttcatcgtattcgacgacgcggatctggatgccgcagtggccggcgcgattgcgtcgaagtatcgcaatagcggccagacctgtgtgtgcacgaaccgtttctatgtgcacgacaaggtctacgacgcgttcgccgaaaaactgcgcgtcgccgtcgaacagctcaaggttggccgcggcaccgaagacggcgtgacgcaaggtccgctgatcaacgaagccgccgtgctcaaggtcgagtcgcatatcgaagacgcgctcgccaaaggcgcgcgcatcgtcaccggcggcaagcgtcatgtgctcggccacggcttcttcgagccgaccgtgctcgcggatgtcacgccggccatgaaggtggcacgcgacgaaaccttcgggccgctcgcgccgctgttccgcttctcatcggacgaggaagtgatccgcctcgccaacgatacggagttcggtctcgcgtcgtacttctatagccgcgatatcggccgcgtctggcgggtcgccgaagcgctggaatacggcatggtcggcatcaatacgggcctcatctcgaatgaagtcgcgccattcggcggcgtcaagcaatcgggcctgggtcgcgaaggttcgcattacggtatcgatgattacgtggtcatcaagtacctgtgc

SEQ ID NO: 31211 - DNA, 1263 bp, Burkholderia cepacia; identical to SEQ ID NO: 28451

SEQ ID NO: 31212 - DNA, 786 bp, Burkholderia cepacia
attcgggaagcaatccgtatcgaacggttgagcaagacgttcagcaacggccgcaaggcgctggacgaaatcgatctgcgtatcgagccgggcgagatggttgcgttgattggcgcctcgggttcgggcaagtcgacgctgctgcgccatatcgcgggcttcacggcttcggatgcgcagccgtcgcagatcgagattctgggccggccgatccagcagaacggccgcatcgtgcgggaagtgcgcagcattcgccgcgatatcggcttcgtgttccagcaattcaacctggtgaaccgcctctcggtcgaaaccaatgtgctgatcggtgcacttgcgcggctgccctggtggcgccgtctcagcggccgttttccacgcgccgagcgggccttgtcgatagccgcgctcaacgaggtcggcattggcgaacatgcgcgcgaacgcgccgccaatctttccggcggccagcagcagcgtgccgcgctcgcgcgtgcgctggtgcagcgcgcgcgcatcgtgctcgccgatgaaccgatcgcctcactcgacccggaatcgtcgcgccgcgtgatggacatgctgcgcacgctgaacatcgagcatcggctcacggttctggtgtcgctgcatcaggtcgagatcgccatgcagtattgcccgcgcacgattgcgctgcggcgcggcaaggtggtctacgacggcccttccgccgcgctcacaccggccctgctcaaaacgctctatggcgacgaggcgcgcgaactgatcgatgaagccgcccag

SEQ ID NO: 31213 - DNA, 927 bp, Burkholderia cepacia; identical to SEQ ID NO: 28453

SEQ ID NO: 31214 - DNA, 519 bp, Burkholderia cepacia
gttcgcgattcgggcatccaaaggaccagtgcattccccgacataacgctggacgattggcagcaggtactgtcgaccaatctgaccgcccagttcctgaccgcgcaagcgcccgtgaaggaattccggcgacgcggcccgcggcccgcttccagagcgctcggcaagatcatctgcatgagctcggtgcacgaggtcattccgtgggccgggcacgtcaattacgcggcgtccaaaggcggcgttcagatgttcatgaagtcccttgcacaggaggtcgcgccggaacgcattcgcgtcaactccattgcgccgggcgcgatccgcacgccgatcaacaaggacgcatgggacaccgacgccgcgttgcagaaactattgaagttgatcccctaccgccgcgtgggcgaatcccaggacatcggcaaggccgctgtctggctcgcctcggatgaaagcgactacgtggtcggcacgacgttgttcgtggacggcggcatgacgctctaccctggtttc

SEQ ID NO: 31215 - DNA, 720 bp, Burkholderia cepacia
aatcgtacggtgttggtaacgggcgcttgcggcggcatcggcagcgtgttgtgcaagcgtttcgtggagcagggcgatacggtgctggcgctcgacatcgacgccgcggcgctgaacgcgttgaccgcacaactcggcgaggcgcatgtcacgccggtcgcggtcgatctcggcgatgccgccgcggtgcagcgggcagtggccgcggcagtcgaggtgcgcggtccggtcgacgtgctggtcgccaacgccggcgcggcacaaggtctgacgctggccacgacggatgccgcgagctggcagcgcgacattcatctgaatctgaacggcacgtatcacacggttgaagccgtgcgcgcgtccatgatcgagcggcagcggggcgtgctggtgctgatcggctcggtgaacggcatggccgcgctcggtcatccggcctacagtgcggcgaaggccgggctcatcggttatacgaaggcgctcgcgctcgaactgggccgctacggcattcgcgccaacatcgtgtgtccgggcacggtgaagacgcaggcgtggcaggcgcgcgtcgagaagaatccgcaggtcttcgaagacctgaaaaagtggtacccgttgcgcgatttcgcgacgcccgacgacattgccgacgcggtactgtttctcgcctcgccgatggcgcgcgtgattaccggcgtcgcgttgccggtggacggcggcctg

SEQ ID NO: 31216 - DNA, 1623 bp, Burkholderia cepacia; identical to SEQ ID NO: 28456

SEQ ID NO: 31217 - DNA, 1788 bp, Burkholderia cepacia
tatagcgcacccatcaaggacatgctgttcgtgatgaaagaactggccggtctcgaacacatcgcgacgctgccgggcttcgaagatgcgaacctcgacaccgcgcaggccgtgctcgaagagtcggcgaaactgtgcagcgaagtgctggcgccgctgaatgtcgaaggcgatcgcaatccaagcagctggaaagacggcgtggtcaccgcaacgcccggcttcagcgaagcgtttcgccagttcggcgaaggtggctggcaaggcgtgcagcatccggtccactacgaaggccaggggctgcccaagctgattgccacagcctgtatcgagatgctcaacgcgtcgaacctgtcgttcgcgctgtgcccgctgctcaccgacggcgcgatcgaggcgctgctcaccgcgggcagcgaggagcagaagcagacctatgtgcccaggctgatttccggcgaatggaccggcacgatgaacctgaccgagccgcaggccggctccgatctcgcgctggtgcgcacgcgcgccgagccgcagggcgacggctcgttcaaactgttcggcacgaagattttcatcacgtggggcgagcacgacatggcgaagaacatcgcccatctcgtgctggcgcgcacgccgaacgcacccgaaggcgtgaagggcatttcgctcttcatcgtgccgaagtttctcgtcaacaaagacggttcgctcggcgagcgcaacgacgtgcactgcgtgtcgatcgaacacaagctcggcatcaaggcgagcccgactgccgtgctgcagttcggcgaccacggcggcgcgaccggtcatctgatcggcgaagagaatcgcggtctcgagtacatgttcatcatgatgaacgcggcgcggtttgcggtgggcatgcagggtgtgggcgtgtcggatcgtgcttaccagaaggcggtggcatacgcgaaagaccgtgtacaaagccgtcccgtggatggctcagcgaaacagccggttgcgatcattcagcaccccgatgtgcgccgcatgctcgcgaccatgcgtggtctcactgaagcatcgcgcgcgctcgcttatgtggccgcggctcattgcgatatcgcgcaccgtcacgcggacgaagccacgcgcgcggaacaccaggcgatctacgaatacctcgtgccgatcgtgaagggctggagcacggaactgtcgatcgatgtgacgagcctcggcgtgcaggtacatggcggcatgggcttcatcgaggaaacgggcgccgcgcagtactaccgcgacgcgcgcattctgcctatctacgaaggcacgaccgcaattcaggccaacgacctgatcggccgcaagacggtgcgcgacggcggcaaggtggcgaagtcgctgctcgccggggtggctgaaacggttgaggcgctcggcgcgcagcaaggcccggcgttcgcgtcgatgaagaagtatctcgcgcagggtcatcgctcgttgagtgcggtggtcgagttcgtggttgcgaatacgaagagcgatccgaatgcggtgttcgccggcagcgtgccgtatctgaagcttgccggcatcgtgctcggcggctggcagatggcgcgtgcgctgctcgtggcggcagagaagcgtgacgaagacccttcgttctacggcgccaagatcgcgaccgcgcagttctatgccgagcatgtgctgccgctggcgtcggcgctcgaagcgtcgattgtcagtgcgaagggtggcgagagcgtgctggcgctgtctgaagatcagttctgatgg

SEQ ID NO: 31218 - DNA, 1176 bp, Burkholderia cepacia
agagaagttgttgttgtcagcggtgtgcgcaccgcgatcggcaagtttggcggaagcctcaaagacgttgcgcccaccgaactcggagcgctcgtggtacgcgaggttctcgcgcgcgccggcgttgcgggagacaaggttggccaggtcgtattcggcaatgtgatagcgaccgaacccaaagacttttacctcgcgcgcgtggcagcgctcaacggcggcgtcggccaaacgacaccggcgttcaatgtcaaccgtctgtgcggctcgggtttgcaggccatcgtctctgccgcgcaatcgattctgctcggcgatgccgacatcgcgatcggcggtggcgtggaaaacatgagccgggcaccgtacatcgcgcccgacgcacgctttggcgcgcgaatgggcgacgcgcgcctgatcgatatgatgctcggcgcgttgagcgatccattccacacggtcccgatgggcgttaccgcagagaatgtcgcaaagaagtatggcattacgcgtgaacaacaggacgcgctcgcagtcgagtcgcatcggcgcgccgcccatgcgatcgccgaggggcgcttcaaggatcagatccttccggtaactcgcaccgtgaaaggccggcccgtcgtattcgataccgacgaacatgtgcgtctgcaactggatcccgctgagatttccggactgcggcccgtcttccagaaggaaaacggcacggtgaccgctggcaacgcgtccggcatcaacgacgcagcggccgccgttctgctgatgtcgcgtgaagcggcggacgcaagtggcgtgaaaccgctggcccggctcgtgtcatatgcgcatgccggcgtcgatcctctctatatgggcattggcccggtgcccgcaacgcgccttgcgctccagcgcgccggcctcggcatcggcgatctcgacgtgatcgaggcgaacgaggcctttgccgcgcaagcgtgcgcggtggcgcaggaactcgaattcgatccgcgcaaggtcaacccgaacggctccggcatttcgctcggccatccgattggagcgacgggtgcgctgattaccgtcaaggcgctatatgaattgcagcgtatcaaagggcgctatgcattggttacgatgtgcatcggaggcggccagggtattgcggccatattcgagaaccta

SEQ ID NO: 31219 - DNA, 840 bp, Burkholderia cepacia; identical to SEQ ID NO: 28459

SEQ ID NO: 31220 - DNA, 1881 bp, Burkholderia cepacia; identical to SEQ ID NO: 28460

SEQ ID NO: 31221 - DNA, 2340 bp, Burkholderia cepacia
gacctgctagccaatctcaaccccgaacaacacgccgccgtcacgctccccaacgagccggcgctcattctcgccggcgcgggcagcggcaagacccgcgttctgatcacgcgtattgcctggctgatccagcatgggctggcctcgcccgccacgattctggcggtgactttcaccaacaaggccgcccgcgaaatgatgtcgcgcctctcggcgctcctgccgatcgacacgcgcggcatgtggatcggcaccttccacggtctgtgcaaccgcatgctgcgcgcgcatcaccgcgacgcgggcctgccggccaccttccagattctcgacaccgcggaccagctttccgcgatcaagcgtctgatgaagggcctcaatatcgacgacgaaaagtacccggcgaaaaatctccagtacttcatcaacaacgcgaaagaacaaggcctgcggccgaaagacgtcgacgccacggacaacttcaaccgcaaattcgtcgaactctacgaagcctacgaccagcaatgccagcgcgaaggcgtggtcgactttccggaactgctgctgcgctgctacgagctgctcgcgcacaatccgccgctgcgcgcgcactaccaggcgcgcttcaggcacattctggtcgacgagttccaggacaccaacaagctgcaatatgcgtggctcaagctgctggcgggcgaggccaactcgatcttcgcggtcggcgacgacgaccagtcgatctacgcgtttcgcggcgcgaacgtcggcaacatgcgcgacttcgaacacgagttcaacgttcgccacctgatcaagctcgaacagaactaccgctcgcacggccatattctcgacgccgccaatcagctgatcgccaacaactcgcggcgtctgggcaagaatctgcgtaccgacgcgggtcacggcgaaccggtgcgcgtgtatgaatccgccaccgactcgcaggaagccggctggatcgtcgaggaaatcaaggcgctgatcagcaccggcacgtcgcgcagcgaaatcgcgattctttatcgcagcaacgcgcagtcgcgcacgatcgaacacacgctggtcaatgcgggtatcgcgtaccgcgtgtacggcggcttgcgctttttcgagcgtcaggaagtcaagcacgcgctcgcctatctgcgcctgatcgacaatccgaacgacgacaccgcgttcgcgcgcgtcgtcaatttcccgacgcgcggcatcggcgctcgctcgatcgagcaactcgcggacgcggcgcgtcagtacaactgctcgatggccgcggcgattccgtacgtggcgggcaaggcggggtcgagcctcgcgggcttcgcgaacctgatcggcaagatgcgcgccgaaacgcagcagatgagcctgccggaaaccgtcgaatacgtggtgcgcgcaagtggtctgtcggagttctatcagaacgaacgcgaaggccaggaccgcctggagaacttgcaggaactggtcaacgcggccgcggcgttcgtcagcgaagagggctacggcatggacacgccggcgcgctccattccgctgcgtccgggtgcgaccgccgcgcccgaactggcggtcgccaccgacgatccgaataccatcgtgttcgacgcgcccggcatcgccgatccggcgcaaaacccggacacgatgacaccgctcgccggcttcctgtcgcacgcgtcgctggaggcgggcgacaaccaggcgcaagcgggccaggaagccgtgcaactgatgacggtgcacgcggccaagggccttgagttcacggcggtgttcatcaccggtctcgaagaagggctgttcccgcacgagaacagcgcgatggaatcggacggtctggaagaagagcgccgcctgatgtacgtggcgatcacgcgggccaaggagcggctgtatctgtcgttcgcccagagccgcatgctgcacggccagacgcgttacaacatccgctcgcgtttcttcgacgaactgccgcaggaaacgctcaagtggctcacgccgaagatcgagccgggcgcgcgctggggtggccgttcggacaacgcgggttatgggcgcgactggttcgcgcggccgggttacacgggcgccgcgtcgtcgacgcccgcgccgctgccagcgttcgcgaacgaacagcgtgcagcggaaacgggtttccgcgtgggccagcaggtgttccacaccaaattcggcgaaggcacgatcaccgcgctcgaaggcggcggcaccgacgcaaaggcgcaggtcaaattcaagcggcacggcgagaagtggctggcgctcgcggtcgccaaactgcaggcggtg

SEQ ID NO: 31222 - DNA, 852 bp, Burkholderia cepacia
aaagttacaaaggcagtttttccggtagcaggtcttggcacccggttcctccctgccacgaaggcgagcccgaaagagatgctgccgatcgtcgacaagccgctgatccagtacgcggtcgaagaggcaatggcggccggcatcaccgaaatgatcttcgtcacgggccgcagcaagcgcgcgatcgaggaccacttcgacaaatcttacgaaatcgaagccgagttgcaggcgcgcggcaaggacaagctgctggaactcgtgcgcagcatcaagccgagccatgtggactgtttctacgtgcgtcagccggaagcgttgggcctgggccacgcggtgctgtgcgccgaaaagctggtgggcgacaacccgtttgccgtgattctcgcggacgacctgctgtacggcacgccgcctgtcatggcgcagatgatcgaggtgttcgatcactatcacagctcggtgatcggcgtcgaagagatcccggcgcaggaaaccaagtcgtacggcatcgtcgacggcaaggagtgggaagattcgatcatcaagatgtcgggcatcgtcgaaaagccggagccgaacgtggcgccgtcgaatcttggtgtggtgggccgctatgtgctcaagccgcgcatcttcgaacatctgcgtgcgctgaagccgggcgcaggcggtgaattgcagctgacggacgcaattcaatcgctgctcgccgacgaacaggtgctggcgtacaagtatcacggcacgcgtttcgactgcggcagcaagctgggttatctgaaggcgacggttgaattcgcgctgcgtcacccggaagtggctgcggatttcgaagaatatctgcgcacg

SEQ ID NO: 31223 - DNA, 993 bp, Burkholderia cepacia
ttcgcgccgggccgcagccgcgacatcgtctgcctcggccggctcgccgtggatctgtacgcgcagcaggtcggcgcgcggctcgaagacgtgtcgagcttcgcgaagtatctcggcggatcgtcggcgaatatcgcgttcggctgcgcgcggctcggtctcgcgtcgtcgatgctggcgcgcgtcggcaacgatcacatgggccgctttctcaccgagacgctcaccaaagagggctgcgacgtcagccacgtgcgcatcgaccgggaacgcctgaccgccctcgtgctgctcggcctgaaagaccgcgacacgttcccgctgatcttctaccgcgagaactgcgcggacatggcagtcgatgaagcggatttcgacgaggccttcattgcatcgtcgaaagcgctgctgattaccggcacgcacttttccaccgagcaggtgaaccgcacgagccgccgcgcgctcgattacgcacgccgcaaccaggtgcgcaccgtgctcgatatcgactatcgcccggtgctttggggtcttaccggcaaagcggacggtgaaacgcgcttcgtggcgagcgaaggcgtcaccgcgcacttgcagcgcattctgccgctgttcgatctggtgatcggcaccgaggaggaattccgcattgccggcggcaagaccgaactggtcgatgcgctcgcgatggtgcgcgccgtcacgccggccacgctcgtgctcaagcgcgggccgctgggctgccagatcatcgacggccaggtgcccgcctcgctcgacaatgtgccgattcacggcggcgtggaagtggaagtgctgaacgtgctcggtgcgggcgacgcatttgcttccggctttctctccggatggttgcgcgatcaaccgctcgaagcctgcgcgcgcgcggcgaacgcgagcggcgcgctggtcgtctcgcggcacggctgcgcgcccgccatgccgacgcccgccgaactcgactacttcctg

SEQ ID NO: 31224 - DNA, 1146 bp, Burkholderia cepacia; identical to SEQ ID NO: 28464

SEQ ID NO: 31225 - DNA, 1668 bp, Burkholderia cepacia
tccaatttcatccgcaacatcattgacgaagacaaccgcaccggcaagtggggccagcgcgtcgaaacgcgctttccgcccgagccgaacggctatctgcatatcggtcacgccaagagcatctgcctgaacttcggcgtggcgcgcagctacggcggcgtgtgccatctgcgctttgacgacaccaacccggaaaaggaaagcgtcgaatacgtcgactcgatcatcgacgccgtgcgctggctcggcttcgagtgggaaaaagacggcaaggaacagctctactacgcgagcgactactacgacaagctgtacgaattcgccgaactgctgatccagcgcggcaaggcgtacgtggacagccagtcggccgaggaaatgcgcgcgaaccgcggttcggccacggaagtcggcacaccctcgccgtttcgcgaacgttcggtgcaggagaacctcgacctgttccgccgcatgaaagccggcgagttcaaggaaggcgagcacgtgctgcgcgcgaagatcgacatgtcgtcgccgaacttcaacatgcgcgatccggtcatctaccggatccgcttcgcgcatcactaccgtaccggcgacaaatggtgcgtgtaccccatgtacgactacacgcactgcatttcggacgcgctggaaaacatcacgcattcgctgtgcacgctcgagttcgaagatcatcgtccgctgtacgactggatcctgaacgagctcgcggaagccggcattttcacgcgcccgctgccgcagcaaatcgaattctcgcgcctgaacctgacctatgcgatcaccagcaagcgcaagctgctgcaactcgtgaccgaaggccatgtagacggctgggacgatccgcgtatgccgaccatcgtcggcgtgcggcggcgcggcttcacgccggaatcgatccagttgttctgcgagcgtatcggcatcaccaaggtcgattcgtggatcgacatgagcgtgttcgaaggcgcgctgcgcgacgatctggacgagaaagcaccgcgcaccgccgccgtcctcgatccggtcaaactgatcatcgacaacttcccggaaggcgtaacggagccgtgcaatgcgccggtccacccgcatcatccggaaatgggcgtgcgggagtttccgatttcgcgcgagctgtggatcgaacgcgacgactacaacgaaacgccgccgaagggctacttccgcctgttcccgggcaacaaggttcgcctgcgctacggctacgtgatcgaatgcattggcgcggacaaggacgagaacggcaacatcgtcgcggttcactgcaactacttcccggacagcaaatcgggcaccgaaggcgcgaacaactacaaggtcaagggcaacatccactgggtcagcgcggcagccgcatgcccggccgaagtgcgtatctacgaccgtctgttcaaggaaccgcaaccggacgccggcggccgcgacttcctcgaagcgctgaatcccgattcgaagcgcgtggtcaacgcgtacctggaaccgggcgcgcgcgaggcgctgccggagcaacgctatcagttcgagcgccacggctacttcgttgccgatcgcgtcgattcgaaaccgggcaagcccgtattcaatcgcatcgtcagcctgcgcgatagttggggcaag

SEQ ID NO: 31226 - DNA, 1122 bp, Burkholderia cepacia; identical to SEQ ID NO: 28466

SEQ ID NO: 31227 - DNA, 726 bp, Burkholderia cepacia; identical to SEQ ID NO: 28467

SEQ ID NO: 31228 - DNA, 1434 bp, Burkholderia cepacia
atgttcctcggcattgacctcggcacgaccgaattgaaggtccttttgctgtcaagcgatggaagtgtcgtcgggaccgctcgtcattctttggaaatctcacggccgaggcaccgatggtcagagcaagacccagatgattggtggcgagctacgagaattgcgctttcgacgctacgcaatagccatcccgatgcgtttgctcgcgtgcaggccattggcatgtcgggtcagatgcacggcgctgttctgctcggcgcaaatgacgaaccgttgcgctcagcgatactttggaatgacatgcgcagcgccagcgaatgcgccgaactcgaggcccgcgcaccgagactgcgcgagatagcaggcaactgcgcgatgccaggactcactgcgccgaagcttctatggctggcgcgacacgagccggagtgcttccgacgggtgtcatgcgtggtgctaccgaaagattacgttcgtctgcgcttgaccggcatcaagcttacggacgcgtctgatgcgtcgggaacgctttggctagatgttggacgccggcagtggtccgacgagctcctacatgcctgtgacatgacgcagatgcaggttcctcggattgtggaaggttgccaggcaaccggcgttgtgctcgcaagtgtcgccagtgagcttgggttgtccccaaatgtactggttgcagcgggcggaggcgacacggcgacaagcgcgctcggcgtcggcgcgacagaacctggagagggctttctgtcgctcggtacgtcgggtgtcctttccgtcgtcaccgagcgcttccggccaagcccggaactgggactgcacgcactttgccacgcaattccagacaggtggcaccgaaccagcgtcgtgctgtccgcggctagctgcattcgctggctttgcaagctgacttcggctgacgaaactgctttgttagccgaggtcgagggtgtcagcgcgagcggtcgcactaaagcgccattgttcctgccgtatctttccggcgaacggacgcctcacaatgacccatatgctcagggcgtgttctgcggtcttaatcaatcaacggaccgtgcgacgctcgcttattccgttatcgaaggcgtcacgtttgccctgtccgatggcctcgacgccttgcgtacagatggtactcaggaaacgttggtgaaccttataggcggaggcgcacgcagtacgttctgggcacagttgctcgtcgacgtactcgggatagtgttacgccgtccgtttgacacacattacatcgctgcgctcggcgccgctcgtctaggctggcttgcagctggcggggacttccccgttgtcgtccgtacgcagtcgctatcgcaggagttcttccctgacgacgaacggcgtcaaatactctccgagcggttggcgtcatacagattcctgtat

SEQ ID NO: 31229 - DNA, 1815 bp, Burkholderia cepacia; identical to SEQ ID NO: 28469

SEQ ID NO: 31230 - DNA, 1383 bp, Burkholderia cepacia; identical to SEQ ID NO: 28470

SEQ ID NO: 31231 - DNA, 1572 bp, Burkholderia cepacia; identical to SEQ ID NO: 28471

SEQ ID NO: 31232 - DNA, 1380 bp, Burkholderia cepacia
gcgctcgaagcactgctgcgcgatcagcgccatgcttatctgcgcgcgccgtatccgtcatgggagacccgcgccgcgcacctgaaagcgctgcgcaaagtcatgctcgacaatcgcgacgccctcgccgacgcgatgaacgtcgacttcggcaatcgcgcgaaacaggaagtgctgctcgccgaattcctgctggtgaaggaggagatcgacgccgcgcttcggcacggcaagcgctggatgaaatcgcagcgccgcagcaccagcaaatggctgctgccggcgcgcgccaaagtcgtgccgcagccgctcggcgtggtcggcatcatcgtgccgtggaattatccggtgctgctcgccgtcgggcccctgatcagcgcgttgaccgcgggcaatcgggcgatcatcaagatgtccgaactgacgccgcgcacttcggcattgttcgagcagttgatcggccagaccttcgcgcgcgatcacgtcgcggtggtgaacggcgacgccgcgctcgccgccgcgttcagcgcgcagcccttcgaccatctgctgttcaccggctcgaccagggtcggccacgaagtgatgcgcgccgccgccgagcatctgacgccggtcacgctcgaactgggcggcaagtcgccggccatcatcggcgcgcatgcgcgcttcgacaacgcggtggacaacctcgtcgccggcaagacgctcaatgcggggcagacctgcgtcgcgccggactacgtgctggtgccgcgcggcaaggagcaggcgttcgtcgagcgggcgcgcgcacggatggcgaggatgtacccgaacttcgccaacaaccccgattacacgacgatcatctcggcgcgtcacttcgcgcgcctcgaacgtctcgccgacgaagcccaggccgccggcgcgcaactgcacccgctcaccgacagttcgcccgatgcggcaagccgccgctttccgctgatcgccgtcacgaatgcgccggacgcgtgcgcgctgatgcaggaggaaatcttcggcccgctgctgccgatcgtcccctacgacacgctcgacgacgcgatcgcgtggatcaacgctcgtccccgcccgctcgcgctgtatctgtatgccgacgacgccgccaccatcgggcgcgtgacgcacgaaaccatcgccgggggcatggcggtcaacgagacgctgatgcatctggcgtgcgaaagcctgccgttcggcggagtcggggcgagcggaatgggcgcatatcacggctacgaaggcttcgtgacattctcgaagatgaagccggtgctgacgcaggcgcgtctgaacgcgcgcgggtggatatcgccgccgtacggcaaacgggtgaatgcgctgctgaagctgatg

SEQ ID NO: 31233 - DNA, 1317 bp, Burkholderia cepacia
cgcaacgcgatcgccaggccgatgcgcgcgtgcgggcgtctcacccgcgccgccggtctggtgctcgaagcggtcggcctgcgcctctcggtgggcgccgaagtgatgatcgaactgccgcaaggcagttcgctgccgatggccgaggccgaagtggtcggcttctccggcgacaaactgtttctgatgccgaccaccgaagtgatgggcctgctgcccggcgcacgcgtgtttccgctcgaaagcgcgccgatcgccgatccgatggcgggcgccaagcgcctgccggtcggctgggaattgctcggccgcgtgctggatgcgtccggccgtccgctcgacggactcggtcctctcggcgcgcatgccgacgcgccgctgtccgcaccggtcatcaatccgctgaaccgcgaaccgattcacaaggtgctcgacgtcggcgtgcgcgcgatcaacgcgctgctgaccgttggccgcggccagcgcatgggcctgttcgccggttcgggcgtgggtaaatcggtgctgctcggcacgatggcgcgctacaccagcgccgaagtgatcgtgatcggcctgatcggcgagcgcggccgtgaagtgaaggaattcatcgagcagattctcggcgaggaaggtctggcgcgctccgtggtgatcgccgctcccgccgacgtctcgccgcttctgcggatgcaggctgcgtcgtattcgacgtcgcttgccgaatatttccgcgaccagggcaagcacgtgctgttgctaatggattcgctgacccgttacgcgatggcgcagcgcgagattgcgctggccgtgggcgagccgcccgccaccaagggctatccgccttcggtgttcgccaagctgccggcgctcgtcgagcggaccggcaacggcccggcgggcggcggctcgatcaccgcgttctacaccgtgctgaccgagggcgacgaccagcaggacccgatcgccgactccgcgcgggcgattctggacggccacatcgtgctgtcgcgctcgctggccgaagccggccactatccggccatcgacatcgaagcgtcgattagccgcgcaatgaccgcgttgatcgacgataaccatctcgagaagacgcgtatgttcaagcagatgctgtcgcgctatcagcgcaatcgcgatctgatcaacgtcggcgcgtattcgagcgggcgcgatgcgctgctcgaccgtgccatcgcgctgtatccgcggatggaagcatttttgcagcaaggttttcgcgagtgcgcgaactttgaaccgagtctcgaaatgctggacgcgctgtttgcc

SEQ ID NO: 31234 - DNA, 817 bp, Burkholderia cepacia; identical to SEQ ID NO: 28474

SEQ ID NO: 31235 - DNA, 678 bp, Burkholderia cepacia; identical to SEQ ID NO: 28475

SEQ ID NO: 31236 - DNA, 777 bp, Burkholderia cepacia
atggatctgggaatcgacggccgccgggcgattgtctgcgcgtcgtcgcgcggtcttggcaaggcttgtgcgcttgccctcgcgcgcgagggctgcgaggtgttcatcaacggccgtgacgaagcgaggctcggccaggcggcgcgcgagatcgagcaggccagcgggcgccgtccgactcccgtcgtcgccgatctcgactccgatgcgggacgcgccgcgctgctcgccgcgtgtccgcagcctgacatcctcgtgaacaacaatgctggcccagcgcccggcgaactggagcaatgggatcacgcggcgtggctggcggcgctcgaggcgaacctgctcgcgcctatcctgctgatgtccgctgtcgttcccggcatgcggacgcgcaagttcggccgcgtcgtcaatatcacgtcggcggtcgtcaagtcgccgcgcctcggcatgagcctgtccacgaccgcgcgcaccgggctgaccgcattcgccaagggcctgtcacgcgaagcggtcgccgacaacgtcacgatcaacaacctgcttccccagcatatcgacacggaccggcaggaatacatggcccggcggatcatggaggaccgcgggatcaccttcgcacaggcgcgctcgcttcaggtgaaatcggtgcgtgcgcgccggctcggcaggcccgaggaattcggcgacgcctgcgcgtttctctgttcggcacaggcatcgttcatctcgggacagaacctgcaactcgatggcggctcgtatgacgggctgttt

SEQ ID NO: 31237 - DNA, 741 bp, Burkholderia cepacia; identical to SEQ ID NO: 28477

SEQ ID NO: 31238 - DNA, 1524 bp, Burkholderia cepacia
gttattgcggcactcgatcgagccgttgccgcacatccggaccgggtgctgctcgacttctcgggcgatctgtacacctatgcacaggtcgacgggctgtccacccgtcttgccaattcgctcgccgagctcggcgtgacggcgggccagacggtcgtcacgatgctcgacaacaatctcgacgccgtgatcacatggctcgcgatcaacaagctgtgtgcggtcagcgtgccgatcaataccgccctgcgcggcgaattcctgcgtcaccagctcgacgacgcgagtgcacggctcgtcatctgcgagggcgattacgtcgaacgcatcgcggccattgccgatcagctcaaggaagccacacgcgtactgcatcgcggcgcgaccaccgtcaggaaatgcggcgcgctcgcgctcgcgcctctcgaccagcaccgcggcagcgacgacacgccgctcagccgcaagccgaatccgtgggacctcgcgagcctcatctatacctcgggcacgaccgggccgtccaaaggctgcatgatcagctacaacttcatgtgcaatctcgcgcgccagcagttgcgggcgggcccggcaacggcgaacgacatcacgatcacgccgctgccgctctttcacatgaacgcgcttgcggtcggcgtgctctcgaacatactcgtgggcgcgcgcgtcgccatcgtgccgcgcttctcggtatcgaaattctggtccgaggtcgagcgcagcggcgcgaccatcgcatcgattctcggcggcatgggcggtctgctcgccaacgcgcccgacgacgaagctgcgaaacgatgctacggacagattcatacggttcgcggcaacccgtttaccgaagcgaccaagcagatatggcgcgagcgcttcggcgcgaggcaggtcggcggcaacggctacgggctgaccgaggcgtgcgtgatcacgtcgctgccggccggcgagtatgcggcgccgggttcctcgggcaagcgcattcccgagttcgacgtacgcatcgtcgacgaactcgaccgtgagctgcccgcgaaccaggcaggcgaaatcgtctgccgtccactgcaccccgacgtgatgttcatgggctactggcaccggccggaggacacgctcaagctgatgcgaaacttgtggtttcatacaggcgacattggcaagttcgacgacgatggtttcttctacttcgtcgaccggaaaaaagactatctgcgcaggcgcggcgagaacatttccagcttcgagatggaatcggcgttttcacgtcatcccgacatcgccgaagtggccgtgcatgccgtcccgtcggacaagggcgaggacgacgtcaaggtcacagccgttctcaacccggatgccgcgctgacggccgaagcactgtttcactgggcaactgacgccgtgccgtattacgcgctgcctcgctacatcgaattccgcgacacactgcccaagaacccgcaaggccgcattctcaagtaccagttgcgagacgagggc

SEQ ID NO: 31239 - DNA, 834 bp, Burkholderia cepacia; identical to SEQ ID NO: 28479

SEQ ID NO: 31240 - DNA, 1158 bp, Burkholderia cepacia; identical to SEQ ID NO: 28480

SEQ ID NO: 31241 - DNA, 1137 bp, Burkholderia cepacia; identical to SEQ ID NO: 28481

SEQ ID NO: 31242 - DNA, 789 bp, Burkholderia cepacia; identical to SEQ ID NO: 28482

SEQ ID NO: 31243 - DNA, 756 bp, Burkholderia cepacia; identical to SEQ ID NO: 28483

SEQ ID NO: 31244 - DNA, 1044 bp, Burkholderia cepacia; identical to SEQ ID NO: 28485

SEQ ID NO: 31245 - DNA, 759 bp, Burkholderia cepacia; identical to SEQ ID NO: 28486

SEQ ID NO: 31246 - DNA, 789 bp, Burkholderia cepacia
atgaatccgattgaagacaaggttgtcatgatcacgggcgcgagcagcggcatcggcgaagcaacggcgcgccggctcgcgcagcagggcgcgaaactcgtgctggcggcgcgcaggagcgagcgcctcagtcggctggccgcccagctcggcggcgccgaccgcgtgctgtgggacgccaccgacgtgacgaagcccgaagcgctccagcaactcgcggcgacggcgcgcgagcgtttcgggcacctcgacgtgctcgtcaacaacgcgggcatcatgccggtttcgctgatcgcgcaaggccgcgtcgacgactggaaccgcatgatcgacgtgaacatcaagggcgtgctgtacggcattcatgcggtgctgggcgccatgctggagcggggggtggggcacatcatcaatatttcgtcggtggcgggcctgagcgtcgggccgggcggcgcggtctattcggcgacgaagttcgccgtgcgcgcgatcagcgaggggctgcgccaggaatgcgcgggcaaggtgcgcgtcacctcgatctgtccgggactcgtggcgagcgagctgccggacagcatcacggtgcccgcattccgcgagcgcgcgcagaagctgttcgaaggggcgatgcctgccgacgcggtcgccgatgccatcgtctacgcgctcacccagcccgagcaggtcgcggtgaacgaaatcgtcgtgcggccgctgacccagagcttttgagcaccggcccgcgcagcggcgaacgcgtgcaccggacgggtgatcgacactaca

SEQ ID NO: 31247 - DNA, 1536 bp, Burkholderia cepacia; identical to SEQ ID NO: 28488

SEQ ID NO: 31248 - DNA, 753 bp, Burkholderia cepacia; identical to SEQ ID NO: 28489

SEQ ID NO: 31249 - DNA, 756 bp, Burkholderia cepacia; identical to SEQ ID NO: 28490

SEQ ID NO: 31250 - DNA, 1344 bp, Burkholderia cepacia
taccgcacgcgccgtgagcgcgtactcgccgcgctccgggcggcgggcggcggcgtcgccatcgtgcccaccgcgccggaagcgctgcgcaaccgggacgccgattatccctatcggcacgacagctacttctactacctgaccggcttcaccgaacccgaggcgttgctggtgctcgacgccagcgccgcgcccggcgagccggcttcggtgctgttctgccgcgagaagaatgtcgagcgcgaaacgtgggaaggtttccgcttcggcccggacggcgcgcgcgcggctttcggtttcgacgcggctttcgccatcggcgaaatcgatacgcaactgccgcgtctgctcgccgacaagccgtcgctgcactacgcgctgggcacttcgccgcagctggacgaacgggtgcgcggctggctcgacgcagtacgggctcaagcccgcggcggcgtcgccgcaccggccgccgcgcacgatctgattccgttgctcgacgacatgcggctcatcaaggacgaccacgaactcgccatcatgcgccgggccgggcagatttccgccgaggcgcatcgtcgcgcgatggccgcgtgccgtcccggcatgcgcgagtacgaactcgaagccgagctgctctacacgttccgcaagttcggcgcacaggcgccggcttacacgtcgatcgtcgcggcgggcgcaaatgcctgcgtgctgcactacccggcgggcaatgcgattgctcgtgacggcgatctgatcctgatcgacgcggcctgcgagctcgacggctacgcgtccgacatcacccgcacctttcccgcgagcggccgtttcacgccggcgcagcgcgagctgtacgacatcgtgctggccgcgcagcaggccgccatcgacgcgacccgcgccggcgccaccttcgacgacccgcaccaggccgccgtgcgtgtgctgtcgcagggcctgctcgacactggcatcatcgagcgcgcgaagttcgcctcggtcgacgacgtaatcgccgagcgcgcctacgtgcccttctatatgcaccgcaccggccactggctcggcatggacgtgcacgacgtgggcgactaccgcgaacgcggcgcgccgcgcgacgaagcgggcgcgctgccgtggcgcacgctgcaggcctcgatgacgctgaccatcgagcccggcctgtatatccggccgaccgaaggcgtgcccgagcgctactggaacatcggcatccgcatcgaggacgacgcgatcgtcacgccggacggctgtgagctgatcacgcgcggtgtacccgtcgccgccgacgagatcgaggcgctgatgctggaagcccgc

SEQ ID NO: 31251 - DNA, 564 bp, Burkholderia cepacia
atgatcgaccacctcatctgtgactgcgacggcgtgctcgtcgacagcgaaatcatcgctgaccgcgtaatgctcgaaacgctgagcgccacgttccccggcctcgacttcgaacccgtcgtcaaaacggcctttggccagcaaacgtcgcgctttctcgaaagcattgaaaagtcgttcgatatcacgctgccggccaattttttcgacaccatcgaacacaacgtcgagctcgcgctcgcggcttcgctcagcccgatcaacggcgtgcgcgatgccttgcaacgcgttaccttgccggccgccgtcgtctcgaacagccgcatgacgcgcgtgaatgcgtcggtgcggcgcgcgggtttgcagcagattttcggcgaacgcattttcagcgcggaacaggtggcccggccaaagccctatcccgacgtatatctgttcgccgcgaagacgctgggcgtggagccgtcacgatgcgtcgtggtggaagacagcgtggcgggtttgaatgccgcgcgtgcggcgggtatgaaaacgatcgctttcgtcggcgcgagccacatt

SEQ ID NO: 31252 - DNA, 1422 bp, Burkholderia cepacia; identical to SEQ ID NO: 28493

SEQ ID NO: 31253 - DNA, 1431 bp, Burkholderia cepacia
gatttgctcgtcgtgggcggcgggatcaacggcgccggcatcgctcgcgacgcggcgggccgcggcctgtcggttctgctgtgcgaacaggacgatctggcggcgcatacgtcgtcggccagtaccaagctgattcacggcggcctgcgctatctggaataccgcgagttcgggctggtgcgcaaagccctgcaggagcgcgaaacgctgctgcgcgccgccccgcacatcatgtggccgctgcgcttcgtgatgccgcacatgcccgacctgcgcccggcctggctgatccgcgccggcctgttcctgtacgaccatctggccaaacgcgaactgctgcccggctcgcgcggcattgtgatgcgcaaccatccggcgggcgcgccgctggtcgattcgatcaagcgcggctttgtgtattcggacggctgggtcaacgacgcgcggctggtcgtgctgaacgcgctggatgccaaagagcgcggcgcgaaaattctcacccgcacgaaactgctgagcgccgtgcgcgcgggcggcgaatggcgcgcgcaactcaagcgcgaggacggcacgattctggacgtgcgcgccgcatcgattgcgaacgccgccggaccgtgggtcggcgaactgctgcaaggcgcgctcggccgcgcggcgtcgcacagcgtgcggctcgtgaaaggcagccatatcgttacgcggcgactgttcgaacacgatcacgcatatatcttccagaatccggacaagcgcatcatcttcgcgattccgtacgaacacgattacacgctgatcggcacgacggatctcgaatatcgcggcgacccgtcgcaagtggcgatcaacgccgaagaaacgcaatacctgtgcgattcgatcaaccgctatttcaagcagaagatctcgccggccgatgtgcgctggacctattccggcgtacgcccgctgctcgaagaagaaggcgcggacaatccgtccgcggtcacgcgcgattattcgcttgaactcgacgcgcccgccggtgaagcgccgctgctgtccgtgttcggcggcaagatcaccaccttccgcaaactggcggaagaagccgtcgaccaactcgcgcatgcactgcatcacgacacatcgtcatggacagccggtgcgccattgcctggcggcgatattcccggcgccaacttcgagcgctttctcagcgaattcaggcagcagcatgcatggctgccggccggcctcgcgcaccgccttgcccgcgcctacggcacacgcgtcgagcatgtgatcggcaatgcgcgttccgtggccgagctcggccgcgccttcgcgcccggtctttacgaagcggaactgacttatctgcgcgataccgaatgggcgcgcagcgcgcaagacgtgttgtggcgccgatcgaaactcggcctgcacgtc

SEQ ID NO: 31254 - DNA, 1354 bp, Burkholderia cepacia; identical to SEQ ID NO: 28495

SEQ ID NO: 31255 - DNA, 2133 bp, Burkholderia cepacia
atgacctcactggaccgccgtaccttcctgcgcagcgccgcgggcgctgccgcgctcggcctgttcccacccgcgattcgccgcgcgctggcgattcccgcgaacaacacgaccggcaccatcaacgacgtgcagcacgtcgtcatcttcatgcaggagaatcgatcgttcgaccattatttcggcacgctgccaggcgtgcgcggctttagcgaccgcttcacgattccccagcccggcggcacgaccgtgtttcagcagaacgacgggacgcgtaccgtgctgccgttccatctcgacagcacgcaaggcaacgcgctgctcgccggcggcccgcattcgtggagcgacgcgcatcaggcgtgggacagcggacgcatgacgcaatggccgaaggccaagggcgacgtgtcgatgggttatctcaatcaggccgacgtgccgttccatgtcgcgttggcgaatgcgttcacgatctgcgacgcctatcactgctcgctgcatggcggcaccaactccaaccgcattttcctgtggaccggcaccaacggcgcgagcgcgggcgccaatccggtggtcaacaacgacggctgggatggcctcggcgcttccgccacgggcctgacgtggacgacttatcccgagcgcctgcaggccgcgggcgtgagctggaaggtctaccagaacatgccggacaactacacggacaattcgctcgccggcttcgcgacctatcgcaaggtcaacgagacgctgcccggctcgccgctgctgccgtacacgcagtcgctcgaagcggtggcgccgctgtacaagggcatcggtaacacgatgcccgatggcggcttcctgcaggcgttgaaagacgacatcgccgcggggcagatgccgcaagtgagctggatcgtgtcgccgcaggcgtactgcgaacaccccggcgcctcgacgccggggcagggcgcttactatctgcaactgctgctcgacacgttgaccgcgaaccccgacgtgtggagcaagacggtgctgttcgtcaattacgacgagaacgactgcttcttcgatcacatgccgccgcccgacgcgccgagcaaaaatgcggacggcacgtttgccggcaagtcgaccgtggacacgcagtacgaatatttcacgaagaccaacccgccgggcgattcgtcgccgatcgtgccggacggacaatgtttcggcccggggccgcgcgtgccgatgttcgtcgtatcgccgtggagcaccggcggttgggtgaactcgcaggtgttcgatcacacttccgtattgcgtttcctcgagcagcgtttcggtgtgaccgaaaccaatatcagcccgtggcgccgcgcggtgtgcggcgatctcacgtcggcattcaacttccgtaatccgaacgacgtgccgccggcttcgctgccggcggccccgagcaaagctcaggcggacgcacagaacacgcagcagagcgcgctcggcgcggtgccggtgccgtcggcggccagtcagcagatgccgcagcaggtgctgatgtcgcggccgtcgcgcgcgctcccgtatctgctgcacgtgagcgccaacgccgacgtgcaggatggcctgatctggctggtcttcagcaacacaggcacggcgggcgcggttttccatgtgtacgaccagttgcatctcgaccgcgtgccgcgccgctataccgtcgaagccggcaaggaactgtcggactcatggagcgcgctcgccgacgatcagggcaactacagtctgtgggtgctcggaccgaacggatttcatcgttcgtttcagggaaatgtcgcgacggtggcgaccggaccgaacccggaagtgcgcgtttgctacgacgtggtcaacaacgccgtctatctgacgatcatgaatacgggcaatgccgtcgccaacgtcacggtgacttcgaacgcgtatcgcggcgacggtccgtggacgtacgcggtaccggcgggcatgcaggtcgagccgtactggtcgaccggcgccgtgggtggctggtacgacttcacgctgagcgcggccggtgggttttcgcggcgttttgccggccgtatcgaaaccggcaaggatagcgtcagcgacccggcaatgggcgtg

SEQ ID NO: 31256 - DNA, 1149 bp, Burkholderia cepacia; identical to SEQ ID NO: 28497

SEQ ID NO: 31257 - DNA, 906 bp, Burkholderia cepacia; identical to SEQ ID NO: 28498

SEQ ID NO: 31258 - DNA, 1200 bp, Burkholderia cepacia; identical to SEQ ID NO: 28499

SEQ ID NO: 31259 - DNA, 1434 bp, Burkholderia cepacia
acgaggagactcatgcatcgcgccaccaagattgtcgccaccatcggaccggcttccaatacgccggaaatcctgctgcaaatgattcaggcagggttggacgtggtgcggctcaatttttcgcacggcaccgccgacgaccaccgccagcgcgccggattcgtgcgcgaggcggcccgccaggccggccgcgaagtcgccatcatggcggacctgcaaggcccgaagatccgggtcggcaaatttgaaaacggcaagatcatgctggtcgccggcgagccgttcgtgctcgacgccgactgcgaactcggcaacgagcaacgcgccggcctcgactacaaagacctgccgcgcgacctgaaaccgggcgacgtgctgttgcttaacgacggcctgatcgtgctgaacgtctcgcgcgtgatcggcaacgagatccacacggtcgtcaagatcggcggcgaactgtcgaacaacaagggcatcaaccgccagggcggcggcctgtccgcgccggcgctgaccgccaaggacatggaagatattcgcaccgccatgtcgctcggcgtcgattatgtcgcggtatcgtttccgaagaacgcgaccgacatggaaatggcccgccagctggcgaacattgccggcgcgccgttcggcgtcaagccgaagatgatcgccaagatcgagcgcgccgaagcgattccggcgctgcaaggcattctcgacgcgtcggacggcatcatggtcgcgcgcggcgatctggccgtggaagtggggaatgccgcagttccggcgctgcaaaagcgcatgattcgtatggcgcgcgaatcgaacaagttcgtgatcaccgccacgcagatgatggagtcgatgatccacgcgccggtgccgacccgcgccgaagtgtcggacgtcgccaacgccgtgctggacggcacggacgcggtgatgctgtcggcggaatcggcggcgggcaagtatccggtgcagaccatcgagacgatggcggcgatctgtatcgaggcggagaagtcggagcagtcggagctggacaaggatttcctcgaccgcacgttcacgcggatcgaccagtcgatcgcaatgggcgcgctcttcacggcgttccatctcggcgcgaaggcgatcgtggcgttgacggaatccggctcgaccgcgctgtggatgtcgcgtcactggactcacgtgccgatcttcgcgctcacgccgcgcgtcggcagtgaacgggcaatggcgctgtatcgcaacgtgacgtcgctgcatctcgataccaacaccgaccgcgacacggcgttgcagcaggcgttggagaccgtggtgagcaagggctacgcgtcgcgcggcgacatggtggtgctgacggtcggcgagccgatggggcaggccggcggcacgaatacgctgaagatcgtacgggtc

SEQ ID NO: 31260 - DNA, 870 bp, Burkholderia cepacia; identical to SEQ ID NO: 28501

SEQ ID NO: 31261 - DNA, 762 bp, Burkholderia cepacia
ccaacccgcgtgaggctcgacatcacgtcgccggacgcctgccggcgcgcgatcgaaatcgcgcgccccgactatattgtccatctggctgcgatcagtttcgtggggcataacgacccgctcgacttttaccgcgtcaacgtgatcggcacgctgaatctgctggaggcctgtgccgccgtcgggcatacgccgcgcaagctgctgatcgcgagcagcgcgaacgtctacggcaacgtgacgagcgaggctatcgacgagagctttccggtcacgccggtcaatcactacgccgccagcaaggcggcgatggaaacgatggtgcggacctggttcgaccggctgccgatcctgattgtgcggccgttcaactataccgggcgcggccaggcgtcgaacttcctcgtgccgaagatcgtcgggcacttcgcgcgtcgcgaagcgtcgatcgaactcggcaatatcgatgtcgcgcgcgatttctccgacgtacggtatgtggcaagcgcttatgaagcgctgctcgactcggaggccgcggccgaaaccgtcaatgtctgcaccggcacgccttttacgctgcgcgaaattctcgcggcggcaagcgatctgaccggacatgagttggagattcagatcaatcccgccttcgtgcggcaaaccgacgtgaaaatgctggccggttcgcccgccagactgcgcacgctcgtgccgaccgtcgaggcgattccgttcatggatacgctgcgctggatgcttgcg

SEQ ID NO: 31262 - DNA, 951 bp, Burkholderia cepacia; identical to SEQ ID NO: 28503

SEQ ID NO: 31263 - DNA, 2280 bp, Burkholderia cepacia; identical to SEQ ID NO: 28504

SEQ ID NO: 31264 - DNA, 1086 bp, Burkholderia cepacia; identical to SEQ ID NO: 28505

SEQ ID NO: 31265 - DNA, 2845 bp, Burkholderia cepacia
cgagtccggcggcgcgccggcgaaaaaatcgccgggagcaggcgacgccgagcgcggcgcgaaccgccgcgaaccgcagccgccgcagtcgccgcagtcgccgcgtccgccacgcgcgccgcgcgccccgcgtctcgtcgagcccaatccgattccgccgattacctatccggaagcgttgcccgtttcgggccgccgcgaggaaatcgcgagagccatcgtacagaatcaggtggtgatcgtctgcggcgagaccggctccggtaaaaccacccagttgccgaaaatctgcctcgaactgggccgcgggctcggcgcgggcggctccggtctgatcggccacacgcagccgcgccggatcgccgcgtcggcgacgggccgccgcattgccgaagagctcggcacgccgtttggcgaagtggtcggctacaaggtgcgctttaccgacaatctgtcgccgggtgcatcggtcaagctgatgaccgacggtatcctgctcgccgaaacgcaaaccgatccgctgctgaaagcgtatgacacgctgatcatcgacgaggcgcacgagcgcagtctgaacatcgactttctgctcggctatctgaaggaaattctcgtcaagcgtcccgatctgaagttgatcgtgacctccgcgacaatcgacgcggaccgtttcgcgcgtcacttcggcagcgaagacaagcccgcgccggtgatcgaggtgagcggccggctttatccggtcgaggtgcgctaccggcccgtcgcggaagacagccccgccgtgaaagcggcgcaaggtgatgggcctgctgcgcaacgcggcggcgaccggccgaaaacccagcgcgaaaccgatcgcgatctgatggaagccatcgtcgacgccgtcgacgaactgtgccgtgaaggtccgggcgacgtgctcgtgttcctgcccggcgagcgcgaaatccgcgacgccgccgaggcgctgcgcaagcaccatccgccgcacacggaaattctgccgctgttcgcccgtctttccgcggccgaacaggagcgcgtgttccgcacctcgaacgcgcggcgcatcgtgctcgcgactaacgtcgccgaaacctcgctgacggtgccgggcattcgctacgtggtcgataccggacttgcgcgcgtgaagcgctactcgtatcgcaacaaggtcgagcagttgcaggtcgagtcgatttcgcaggccgcagccaaccagcgggccggccgttgcggccgggtcgccgacggcatctgcattcgcctctacgaggagagcgattaccagggccgcgtgcgttttaccgatccggagattctgcgttcgtcgctggcctcggtgattctgcgcatgaagtcgctgcatctgacggcgatcgaaacgttcccgttcatcgagccgccgccgggccgcgcgatcgccgacggctatcagttgctcaacgaactcggcgccgtcgacgacgacaaccagctcacgccgctcggccgcgaactcgcgcgcctgccgctcgatccgcgcgtcggccggatgattctggccgcgcgcgaccagcaggcgctgaaggaagtgttgatcatcgcgagcgcgttgtccgtgcaggatccgcgcgaccggccgatcgaggcgcaggagcaggccgatcaggcgcatcgccggttcgccgacgagcgctcggaattcctgcaatggctgaaaatctggaactggttcgaagaagcgatcacgcacaagaaatcgaacaggcagttgcacgaggaatgccgcaagaacttcctgtcgcaactgcgtctgcgcgaatggcgcgatgtgcattcgcaactgctgacggtggtgcgtgaacatggctggcgtttgaacgaagcggaagcgactttcgagcagatccatctcgcgctgctgacgggtttgctcggcaatatcggcctgaaggccgacgacgaaccgtattacctcggcgcgcgcggcatcaaattttatctgtggccgggctcggcgctggtgaagaaagccggcaagtgggtgatggccgccgaactggtcgagacgagccggctgtacgcgcgctgcatcgcgaagatcgagccggaatggatcgagaagatcggcccgcatctgttgaagaagtcgctttccgagccgcattgggagaagcgcgcggcgcaggtgtcggcattcgagcgcgcggtgctgtacggtctgccgatctatcaccggcggcgcgtgagcttcggcaagcaggatccggcgcgcgcccgcgagctgttcattcgcggtgcgctggtggaaggcgagttcgataccaagctcgcgttcttcgcgcacaaccgcaagctgcttgccgatatcgaacaactcgaacacaagtcgcgccgccaggacgtgctagtcgacgacgagctgatttttgcgtactacgatcaggcgctgccgaagggcatttataccggcgcgtcgttcgagcgctggtatcgcgacgaggtgaaaaagagcggccagccggaagacaggctgcgcctgctgtatctgtcgcgcgacgatctgatgcggcacgaagccgccggcgtgacgaccgacctgttcccgaaacgcatgacgatggcgggcgtcgacatggcgctcacgtatcacttcgagccgggctcgccgcgcgacggcgtgacgctcggcgtgccgctgtatgcgctgaatcaggtcgacgcgcggcgctgcgaatggctcgtgcccggcatgctgaaggagaagacgcaactgctgctgaagtccttgccgcaaaagctgcgccgtcactgcgtgccggtgccggagtatgcggcgggtttcgtcgaccggcat

SEQ ID NO: 31266 - DNA, 1311 bp, Burkholderia cepacia; identical to SEQ ID NO: 28507

SEQ ID NO: 31267 - DNA, 2412 bp, Burkholderia cepacia; identical to SEQ ID NO: 28508

SEQ ID NO: 31268 - DNA, 1377 bp, Burkholderia cepacia; identical to SEQ ID NO: 28509

SEQ ID NO: 31269 - DNA, 747 bp, Burkholderia cepacia; identical to SEQ ID NO: 28510

SEQ ID NO: 31270 - DNA, 1491 bp, Burkholderia cepacia
ctgactctcgtgccgggccaggtaacgctcggtcagttgcgccgcatcattgaagcgcggccgatggtgcagatcgagcgcgcgtcgctcgagcgggtcgaaaaatcgaaggacatcgtgagccggatcgtcgcggacggcaagatcgtctatggcgtgaacacgggcttcggccggctggcaaacacgacgatccccgctgggcggatcgcggagttgcaaaagaatctcgtgctctcgcacagcgtgggcacgggcgaactgatggaagaccgggtcgtcggcctgatcatggcgctcaaggcgatcagtctcgcgcgcggtcactcgggcgtgcgtccgcaagttgtgctcgccatcatctcgatgctcaatgccggcgtctatccgtgcattcccagcaaggggtcggtcggcgcgtcgggcgatctcgcgccgctcgcgcatctggcggccgcgatgttgggcgtgggccacgtgcgcatcgacggcaagcgcgtgccggccgctgaaggcttgagcgtcgccggactcgaagcacttaaactaggtccgaaggaagggctcgcgctgctcaacggaacgcaggcgtcgactgcgctcgcgctctcagggcttttcgccgcggaacgcgtgttcgcttcggcgatggttaccggtgcgttgtcgctcgaagcggtgaaaggctcgaccgtgcctttcgatccgcgtattcatgttgcgcgcggccagcgcgggcaaatcgacgtggcggggcgtctcgcggcactgctcgatggcagcggcatcatcgcgtcgcatggaaacgggactcgcgtgcaggacccgtattcgattcgctgtcagccgcaggtcatgggggcgtgcctcgaccacatccgctacgttgcgggcattctgaccatcgaggccaatgctgcgtcggacaatccgctcgttttcgacaatggcgatgtgctgtctggcggtaatttccatgcggaaccggttgcgctggcagcagacgcgctagcagtggctatctctgagattggcgctatttccgaacgacgtacggcattgttgcttgatagccatatgtcgggcctgccggcgtttctcgtgaaagaaagcggaatcaattccggcttcatgattgcgcaggtaacgagcgccgcgctggcttcggagaacaagtcgcttgcacatcccgcgagcgtggacagtttgccgacgtcggcgaatcaggaggatcacgtttcaatggccacgtttgctgcgagacggctcaaggatatggccgacaacacggccgttatcgtgggcatagaagggatggccgcggcgcagggcatggactttcatcgtccgctgcgttcgagcgaactgctggaggaacagcatgtgcagattcgcgcgcgcgtttccttttatacgaaagaccgctacctcgccgacgacatcgagacaatgaaaaactgggcattggagagttccaggccgggcattgtc

SEQ ID NO: 31271 - DNA, 1014 bp, Burkholderia cepacia; identical to SEQ ID NO: 28512

SEQ ID NO: 31272 - DNA, 2091 bp, Burkholderia cepacia
gcggcgaagaacgcgcaggcgagcggtccgcagtcggatccgaaagcgaaggatctcgaacagtttcgagtcagcccagaaggtgaggcgctgagaaccaatcagggcgtcaagatctctgacaatcagaacacgctgcgcgcgggcccgcgcggcccttcgctgctggaagatttcatcatgcgtgagaagatcacgcacttcgaccatgagcggattcccgagcgcatcgtgcatgcgcgcggctcggcggcgcacggcgtgtttcaggtgtacgaatcgatgcaggaatacaccaaggctgcgtttctgcaggaccccgccgtgcagacgccggtgtatgtgcgcttttccacggtacagggtccgcgcggttccgccgatacggtgcgcgacgtgcgcggctttgcagtgaagttctacacgcaggaaggcaattacgatctggtcggcaacaacatgccggtgttcttcattcaggacgccatcaaatttcccgacttcgtgcacgcggtcaaaccggaagcgccgaacgaaatgccgacgggcggttccgcgcacgacaccttctgggacttcgtctcgctggtgcccgagtccgcgcatatggtgctgtggaccatgtcggaccgcgcgatcccgcgcagcctgcgcacgatggagggcttcggcattcacacgttccgtttcgtgaatgcgcaaggcaagggacgcttcgtcaagtttcactggcgcccggtgctgggctcgtactcgctgctgtgggacgaagcgcagaagctggctggcaaagacccggattttcatcggcgcgatctatgggagtcgatcgaacggggggactttcccgagttcgagctcggcgtgcagatcatcgaggaagcggacgaacacaagttcgacttcgacctgctcgatccgaccaaactgattccggaagaacaggtgccggtgaagatcatcggcaagatgacgctcaatcgcaatccggacaacttcttcgccgagaccgagcaggtcgcgtttcatccgggccatgtggtgccgggtatcgacttctccaacgatccgcttctgcaaggtcgtctgttctcgtacacggatacgcagatcagccgcctgggcggcccgaactttcacgagattccgatcaaccggcccgtgtgcccgttcaacaacaaccagcgcgacgccatgcaccggcagaccatcaacgtcggccaggcctcgtacgagcccaattcgctgagcggcggctggccgaaggaaactgatccggcgccctccgacggcggcttcgagacctatcaggagcgcgtggaaggcaccaagattcgcgtacgcagcgaatcgttcgccgatcatttctcgcaggccgcgctgttttacaacagcatgtccccgccggagaaagaccatattgccgcggcttatcagttcgaactcggtaaggtgacgaagccggaaattcgtgcgcgcgtcgtgaacgagattctcgccaacttcgatgcggggctcgcggcacaggtggctgaagggctgggtttgccggcgccgaagaaaggcacggcgaagctgaccggtcccaaggaatcgccggcgctgagcctgctcaaccgcgtgaagccgggcatcaagacccgcaagatcgcgctgctggccgcgcccggttccgatggcgccgcgatcaaaaagctgcagcaggcgctgcaaggcgagggcgccacgccgatgctgatcgccccgacgcttgccgcgatcgacggcatggcgccggacgccacgattgccggcttgccgtcgatcatgttcgacgcggtgatcgtggtgggcggtgatcagggcgcgaaggcgctggcgcaatcgggcgacgcacggcatttcgtgcttgaggcgttcaagcatctgaaggcgatcgcggcaatcggcgcggggcgtgacgtgctcgccgccgcgcacttgccgcacaatgccgacggcgtcgcaaccggcgacgacaagcaggccgctgaagtgctgaaggcgttcatcgaggcagccgggcagcaccgcgtgtggtcgcgcgcgcagcaggctgagaccgtgccggcg

SEQ ID NO: 31273 - DNA, 1188 bp, Burkholderia cepacia; identical to SEQ ID NO: 28514

SEQ ID NO: 31274 - DNA, 2265 bp, Burkholderia cepacia
atggcccgcacgcacattcccggctttccccgcatcggcgcgcagcgcgaactgaaattcgcgcaggaatcgttctggcgcggcgaatccggcgagccgcatctgcgtggcgtcgcgcgcgaattgcgcgcgcgtcactggcaattgcaacaggacgccggactggatttcgtcaccgtcggcgatttcgcctactacgaccagatgctcaatctgagcgcgctgctcggcgccttgccgcagcgtttcggcttcgaaccgaagacgctgtcgctcgccgagtactacgagcttgcgcgcggcaacgcggcgcagccggccatggaaatgaccaaatggttcgacacgaactatcactacctcgtccccgaactgggaccgcagacgagtttcgacggcggcgtggagtggttgttcgaggagatcgacgaagcgctcgcgctgaatctgccggtcaagccggtgctgatcgggccgatcacttatctgtggctgtccaagagccatgttgccgggttcgaccgtttgtcgctgctgccgaagctcgtgatccgctacgcccgtctgctcgacaagctcaggcagagcggcatcgaatgggtgcagctcgacgagccggccttgtgcgtggatttgcccgcggaatggctcgacgcgttttccgccgcgtatgaggtgctcggcacgtcgggcgtgaaggtgctgctcgccacgtatttcgaaagcgcggcggagcacgcgccgcgtgtagccgcgctgcccgttgccggtgtgcatctcgacctcgtgcgtgccccgcagcagctcgacgcatggcgcgcggcgttgcctgcgcacgcggtgctgtcggccggtgtgatcgacggccgcaatatctggcgcgcggatctcggcgagatcgtcgagtcgctgcagagcttgcaggcggaattcggcgagcgcttgtggatcgcaccgtcgtgctcgctgctgcacgtgccggtctcgctcgacgccgagaaaaaactcgacgccgatctgaaatcctggctcgcgttcgccaccgaaaaactcgctgaagtcgccacgctcgccctcgcgttgcgcgatcccgccgcggccgaaccggcgctcgccgccaccgaccgcgcgctcgaagcacgccgccgctccagcgcggtagtcaacgcgctcgtgcaaaaacgcgtagctgcagtgagcagcgcgatggcggaacggcaaagcccgtttgccgaacgcaaccgtctgcagcgcgaagcgctcggcctgccgctcctgccgaccaccacgatcggctcgttcccgcaaacggcggcgatccgccaggcgcgcgccgcctacaaacgtggtgaactgcgcgcactcgactatctgcagcgcatgcgcaccgagatcgaaatcgccgtgcgcaaacaggaagagctcgggctcgacgtgctggtgcatggcgaagccgagcgcaacgacatggtcgaatatttcggcgaacagttgtggggctatgcgttcacggaaaacggctgggtgcagagttacggctcgcgctgcgtgaaaccgccgatcatctacggcgatgtctaccggcccgaaccgatgacggtcgagaccacgcgttacgcgcaatcgctcacgcagcgcctgatgaaaggcatgctgaccggcccggtgacgatgctgcaatggtcgttcgtgcgcgacgaccagccgcgctcgaccaccgcgctgcaactcgcgctcgcgatccgcgacgaggtcgtggatctggaaaaggccggcattcgcatcatccagatcgacgagccggctttccgcgaaggcttgccgctgcgtcgcgcggactgggccgcgtatctggaatgggccacgcgcgcgttccgcatttcggcagcgggcgtcgccgatcaaacgcagattcatacgcacatgtgttattcggagttcaacgacattctgccgtcgatcgccgcgatggatgccgacgtaatcaccatcgagacctcgcgctcggcgatggaactgctcgacggcttcggcgccttcgcgtatccgaacgaaatcggcccgggcgtctacgatatccactcgccgcgcgtgccgggcgcggacgcgatgcagcgtctgctggaacgcgcgtgcgaagtgattccggccgagcgcctgtgggtcaatccggattgcgggttgaagacgcgcggctggccggaaacggaggcagcgctcgcgaacatggtgcgggctgccaaggcattgcgcgcgaagctggcg

SEQ ID NO: 31275 - DNA, 627 bp, Burkholderia cepacia
gaaacattgaagctgtaccactccgcttcgtcgccgaactcacggcgcgtgcgcatctttctggctgaaaagggcgttccggtgacgctcgtcgcagtcgacctcggcaaaggcgagcaacacggcgatacctatcgcgcgatcaatccacggcgcgtcgtgccgacgctggtgctcgaagacggcacgtcgatcggcgaagtgccggcaatccagcgctacgtcgaagagactcatcccgacgcaccgctattcggcaccacaccgaaagacaaggcgctgatcacgatgtgggaacggcgcgcggaacaggagggctttgcctcggtgatggaagcgatccgcaacatcgcgccgggtttgaagggccgcgcgattgccgggccgcacgactacgaacagattcccgcacttgccgagcgcagccggcaacgcgccgccaattttctggccgatctcgacgatcgcctgaaagactccgcgttcgtggcgggtgaacgctattcggtcgccgacattaccgctctggtcacgatcgatttcgccgcgaaagcaatcgacctgcaagtgccggccgatctggaatcgctcaagcgctggtacgacacggtatcgtcgcggccgagt

SEQ ID NO: 31276 - DNA, 742 bp, Burkholderia cepacia
ttgaaaatgagccatcccgtcattctgatcaccggcgcactcaccggcatcggtcgcgccaccgctatcgcgtttgctgaaatcggcgcccgcctcgtcgtctcgggccgtcgtgaagccgaaggcaaggcgttcgaaaaagaactgcgcgagctcggcgcggacgcccacttcatccaggccgacgtgcgccgcgatgaagaagtcgcgagcctcgtcgatcagacggttgcccgcttcggccgtatcgacgcgcgtgaacaacgccggcaccgaaggtcagcccggcgcgatcaccagccagaccgtcgagagctacagcgcgacgttcgataccaacgtgctcggcacgctgctcagcatgaagcacgaactgcgcgtgatgtcggcgcagaagagcggcagcgtcgtcaacgtttcgtccacttacggccatgaaggcgcggccttcgcttccgtgtacgccggcagcaagcatgcggtggaaggcatgaccaggtcggccgcgctcgaagtggcgtccaccggcgtgcgggtcaacgccgttgcaccgggaccgaccgacaccggcatgctcgaccgctttaccggcacaccggagaacaaggccgcgctcgccgcgcaggtgccgctcggccgtatcggcaagccggacgacgtggcgcgcgccatcgtgttcctggcgtcggatgccgcgtcgttcgtcacggggcagatcgtgactgtcgacggcggcaagacc

SEQ ID NO: 31277 - DNA, 1452 bp, Burkholderia cepacia
ctcaacgttcttctcgtcgcttccgaagccctgccgctcgccaaatccggcggcctcggcgacatggtcagcgcatacgccgccgctctgcgcgatgccggcgtcgatgtctcgatcctgatgcccgcgtatccggccgcgctcgaacgcgccgtcgacgtcacgcccgtcgcgcgcatgaccggcctgcccggcggcgacgcccggctcctgcgcggccacatgcccgacaccggcgtgccggtgctgcttctgcagatggatcacctgttcgcgcgcgaaggcctctaccgcgatccgcaaggacgcgactatctggacaacctcacgcgtttcgcatcgctcgctgcagcggccgcgcgagtggcgcgcggcgtgcgcaacgtgaagcgccccgacatcgtgcacgcgcacgattggcatgcaggactcacgccgctgtatctgcggcttgcgggcgttgccgccagaagcgtcttcacgattcacaacctggcgttccagggcaaccatccgctcgctatgggcggctggatcggcgtgccgcccgaattgctggcgcccgcgctttccgacgaacgcagcatcgagttctatggctcgctcagcatgatgaaagccggcatcgtccatgcggatcgggtcacgaccgtgagccggcgctatgcgcgcgaaatcctgacgccgcgtttcgggcacggcatggaaggcgtgttgcaggcgcaggcggccaagctgtcgggcatcgtgaacggcatcgacagcgcggtatggaatccggctaccgacaaacatatcgcgcgcccctattccgtcgacgatacggccggcaagcaggcctgcaagcgcgatttgcagcaggccttcgggctgacgcgcgatccgttcgcaccgctcgtcgccatcggcagccgtctgaccgaacagaagctcgccgacgtcgtcgtgcatacgctgccggcgctgctcgaacggcatccgcgcctgcagttcgcgattctcggccagggcgagcaaggcatcgaacaggcgctgcagggcatcgcggccgcgtggccgggacgcgtcggcgtacagatcggttatgacgagcggcgggcgcacatgctgcacgcgggtgcggacattctgctgcacggcagccgcttcgaaccctgcggactcacgcagctctacgcaatgcgctacggcacgattccggtggcctcgcgcgtgggcggcctggccgatacgatcgtcgactatctgccgcacgacccgcgcggcgacagaaaggcgaccggctttctgttcgacggcgaaactccggatgacgtgatgcatgcactcggccgcgcgctggacgcgttcgtggagccgtcgtcgtggcatgtgttgcagcgtaatgcgatgagccgcgacttcggctgggcaacgtcgacttcgaactatctctcgctgtatgcggagctg

SEQ ID NO: 31278 - DNA, 1008 bp, Burkholderia cepacia; identical to SEQ ID NO: 28519

SEQ ID NO: 31279 - DNA, 897 bp, Burkholderia cepacia; identical to SEQ ID NO: 28520

SEQ ID NO: 31280 - DNA, 738 bp, Burkholderia cepacia
cgtctctccggaaaacgcatcatcatcacgggcgcaatcggcaacatcggcaaggaagcggcgcgcggcttcatcgcggaaggcgcgcgagtggtcatcggcgatattgccgaagaggctggccgcgccgtcgccgcggaactcggcgcggccgcccacttcgtccaggtcgacgtgaccagcgaggctagcgtcgccaatctgatcgcgcgcggcgtcgaatggctcggcggcctcgacgcgctggcacagaacgccggtttgcagcgctcgggcgcgatcgccggattcgaacaggccaactgggatgcgctcttcgcggtcaacgcgcgcgcccatttcttcggcgccaagcacgccatcccgcatctgcagcgctcgggcaagggctcgatcatcaacatgtcgtcgctggcgggtaagcgcggcgggccgggtctggtcgcttattcggcgtcgaaaggcgcggtgatcgcgttcaccaccgcgctcgcgctcgaactcgcgcccgacaatatccgcgtgaacgcgatctgcccaggctgggtcgataccgcgttcaaccagccggcaatcgacttcatgggcggcgccgacgcccagcaaaagaagatcgcgtcgctcgtgccgctcggccggcaggcgagcgccacggaaatcgcgccgctcttcgtctacctcgcctccgacgaatcggcgtacgtgacggcgcagtcgttcggcatcgacggcggtgtc

SEQ ID NO: 31281 - DNA, 1416 bp, Burkholderia cepacia
atgaaccattacgacgtcgtcgtcattgggtgcggcgcggggggttacaacaccgccattcgggcaagccagctcggactttccgtggcgtgtgtcgaacgggcgtcgaatatcggtggaaccggtatgcggaccggctgcattccgtcccgattgctgcttcatacttctgaaatatacgacctggcgaacaaggggaaaaacgctgctttgggaatcggctgcgcaccaacgctcgacctcacgcagatgatggcctataaagcatcgaccgttgaaaagatgtcgaacagtattcacaaactgctacgcaagcaaggcgtgacactcattcatggcgacgcgctgctggccgcggcgggacaggtcatcgtcaggaaaaccggtggggtgcagcaaaccctgtccggaacagcccttgtaattgccacgggctccgtgccaatcccgcttccgttcgccgctttcgatcacatgcggattctcgattcggctgacgcgttgtcactcggcaaggtaccgcgacatctggcgattatcggcgccggcgccgtgggtgtggagttgggctcgatctggcagcgccttggctcgcgcatcacgctgatcgagcgctgcgatcgcatctgccattggctcgaccgcgatgtgacagcgaccctggagcgatcgctcaggcaacgaggcattgacatcagggtgtcgagcgacgttgtcggactcgataagcactccgacagtgtctctgtccaactccgcgccgcggcatccggtaagatcacccacatcgacgcagacagggttctcgtcgctatcggccgccggccatcgactgccgggatgaacctcgcgagcgtcggcatgcaaaccggctacaagagcacattgtctcagcagggaccggcgacacccgtgacatccatgacgaatggctccggaatatgggtgatcggcgatgcaggccctggtccgatgctgatgtccaaagccgaagaagaagcgatagcgtgcgccgagcggatcgccggcctgcccggattcgtcagctatccgtcaattccctatgttctccataccagcccggaagtggccatgattgggaggaccgaggacgaactccggggaaccggcgcagcgtatagagtcggctactatccgctcgcggccaatccacgcgccgcaatctgcggcacctccgaggggtttgtgaaactgttggtcgacgctgatacgaatctgatcgcgggagctcacctcatagggccgggagcagccgatctgatttcacaagtagccattgcgatggaagcctccatgatctgcgaagactttgcgcgaatctgtcatccctacccggtctggtccgaggcactccgtcaggcggcaatggcggcgggcgggtggatgatgcacgtc

SEQ ID NO: 31282 - DNA, 900 bp, Burkholderia cepacia
ggccgggttctggtagtgggcagcatcaatacggaccttgtggcccgcgcgccgcatttgccgcgcccgggcgagacgattggcggacacgagttctcgcaggttgcagggggcaagggcgcgaaccaggctgtcgcggccgcgcgcatcggtgcgcgggtggccatgatcggatgcgtcgggagcgacgcgaatggtgcgcagcgggtcaaggatctggaggtggaaggcatcgattgcagcggggtcgaggtccatcccacccaaccgaccggcgttgcgatggtcacagtgtcggacgacggccagaatacgatcgtcgtggtcgcaggcagcaacggcgaactcacgccgcagagcgtggctcgccatgaagcggccatcaaggcgtgcgacgtcgtggtgtgccaactcgaaacaccttgggattccgttcacgcgacgctcgcgcttgcccgtcggctgggcaagatcaccgtgctgaacccggcgccggcaaccgggccgctgcccgcggagtggctgccgcttgtcgactacctcgtgccgaatgaagtcgaggccgccattctggccggcctgccggtcgaatcgcaaagcggcgcgcggcgcgcggcgacggagttgcaacaaggcggcgcgcacaatgtgatcgtcacgcttggcgcgcaaggggcttatcttctggtggaaggtggcgagggcaggcattttcccgcgccgcaagtgcacgccgtcgataccacggctgcgggcgatacttttatcggcgtttttgccgcgcaactcgcctcgcggcaaccgctggaaggcgcgatcaatctcgcgcaacgcgcggcggcgatttccgtgacgcgcgccggcgcgcagccttcgataccgactcgcgcggaagtcgat

SEQ ID NO: 31283 - DNA, 1452 bp, Burkholderia cepacia
gacgcaccgcccgtgctgtgtgttcacggcatcggcaagacctatgccgagcccgtgctcgccgacgtgtcgctggaactgcgcgcgggcgaggtgctggcgctgaccggcgaaaacggcgcgggcaagagcaccctgtccaagatcgtcggcggcctcgtcacgccgactaccggttcgatgaccctcggcggcgcggcctacgcgccggccagccgcaaggacgccgaggcgctcggcgtgcgcatggtcatgcaggaactgaaccttctgccgactctctcggtggcggaaaacctctttctgaaccgtttgccgcgcaacctggtcggctggatcgaccgcgccaggctgcgcgagaacgcgcggcacgcgatggcgcaggtcggtctcgacgcaatcgatcccgacacgctggtgggcacgctgggtatcgggcatcaacagatggtcgagatcgcgcggaatctgatcggcgactgccgcgtgctgattctcgacgaacccaccgccatgctgaccgcccgcgaagtcgatctgctgttcgagcaggtcgagcggctcaaagcgcacggtgtggcgctggtgtacatctcgcaccggctggaagaattgaagcgtattgcgcggcgtgcagccgtgttgcgcgacggccggctcgtgcacgtcgacgagatggctaacctttccaccgaccgtctcgtcaccctgatggtggggcgcgatatcggcgacaggatcgatctcggcgagcggcgtatcggcgaggtggcgttcaaggtcagcggcatgacgcgcgagccggtggtgcgcgacgtgtccttcgaggtcagggccggcgagattttcggcatcagcggattgatcggcgcgggccgcacggaactgatgcggctcatttacggcgcggaccacgcggacgccggcagcgtctcgctcggccgtggaggggccgcacctgagccagtgacgattgcctcgccgtcggacgccgtgcagcacggcatcgcgctcatcacggaagatcgcaaaggcgaggggcttctactgacccagcccattgccgccaacatttcgctgggacacttgcgcgcggtgtcgaacaagggcgtggtggacgggcgtcgcgaggcggcgctggcgcgccggcagatcgacgccatgcgtatccgcagcgcgggaccgtcacaacccgtgtcggaactctcgggcgggaaccagcagaaggtggtgatcgggcggtggcttgcgcgcgattgcacggtgctgctgttcgatgaaccgacgcgcggcatcgacgtcggtgcgaagttcgatatctatgcattgatgggcgcgctggctcgcgaaggccgtgctctcgtggtcgtatcgagcgatctgcgcgaattgatggcgatttgcgaccggatcggggtgatgtcggcgggacggatgacgggcctgttcgag

SEQ ID NO: 31284 - DNA, 518 bp, Burkholderia cepacia
atgacgacgcaaaccgaaaccgccctcctggccggcggctgcttctggggcatgcaggacctgttgcggcgctaccccggcgtgctgtccacgcgcgtgggctacaccggcggcgacgtgcccaacgccacataccgcaaccacggcacccacgcggaggcgctcgaggtcgtgttcgacccgcgccagatcagctatcgccagatcctggagtttttcttccagatccacgacccgaccacgaagaaccgccagggcaacgacgtgggaacgagctaccgctccgcaattttctatctcgacgacgaacagaagcgcgtggcagagaacaccgtcgccgacgtcgaagcatccgatctgtggcccggcaaggtcgtcaccgagatcgctcccgcgggtccgttctgggaagccgagccggaacatcaggactatctggaacgcattcccaacggatacacgtgccacttcgtccggcccgactggaagctgccgaagcgcggctgaagatgaaacca

SEQ ID NO: 31285 - DNA, 459 bp, Burkholderia cepacia
tacaagctgatggattcgcccgtcggccagttgaaactcgttgcgaacggcgagcgcctcgccgccattctgtggcaaaacgacaagccgaaccgggtgcgtctgggggaattgatcgaagcaaatgaccggcctgtcctgatcgacaccgaacggcagctgaacgagtattttgccggtacgcggcgcgagttcgaccttccgctcgccttccagggaacggagttccagaaacaggtctgggccgcgctgttgacgataccgttcggccagacgcgcagctacgcggaaatcgccgtgcagatcggcaacgtcaacgcggtgcgggcggccggcgcggcgaacggcaggaatccgatctccatcgtggcgccgtgccaccgggtgatcggcgcatccggcgacttgaccggctttgccggaggcctggcgaacaagatgtttttgctgtcgctggag

SEQ ID NO: 31286 - DNA, 762 bp, Burkholderia cepacia; identical to SEQ ID NO: 28527

SEQ ID NO: 31287 - DNA, 966 bp, Burkholderia cepacia; identical to SEQ ID NO: 28528

SEQ ID NO: 31288 - DNA, 1440 bp, Burkholderia cepacia
ccttgcacgctggtgatcttcggcgcaggcggcgatctgaccaaacggctcctcatgccggcgctgtacaacctggcggtggatagtctgctcgacgacggcatgaaaatcatcggcgtgaatcacggcgcgcgcgagacgagcgagtggcgcgacgatctgcacaaatcgctagaacagttcgccgccgacaaggccagcacctttcacgccggcaagctcgacgaccaggcatgggactgggttgcgcaacggctcgaatacatggccggcgaattcgaaaccgacgataccttcgcgcaaatcaaacagaagctcgagcaaacgccgggcggcaacgtgatcttctatctcgcggtcagctcgcgctttttcgagccgatcgtcgagcgtctcggcaacgcgggtttgctgaaagagggcgatgtcggcggctttcgccggcttgtgatcgagaaaccctttggtagcgatctcgcttcggcacgcgatctgaacgcgcatatcctgtcgttcgcgaaagaaacgcaggtgtatcgcatcgatcactttctcggcaaggacaccgtgcagagcattctcgcggtgcgtttcgccaatgcgctgttcgaaccgatatggcggcgcgaatatatcgacagcgtgcagatcaccgcttcggaaacgatcggcgtggagggacgcggcaagttctacgaacagaccggcgcgttccgcgacatggtgccgaaccatctgttccagttgctcggcatggttgcgatggagccgcccaattcgttcgacgccgaagccgtgcgcgacaggaaagctgaaatcttcgacgcgatcaagccgttgacacccgacgacgtggtgttcggccaatacgaaaaaggcccggccggtgtcggctaccgtgaagagccggacgtcgcgccggacagcacgacggaaacctatgccgcggcgcgggtgttcgtcgagaactggcgctgggccggcgtgccgttttatctgcgcacgggcaaacggttggctggacgtcgcacggaaatctcggtgcaactgaagcccgtgccgttccgcctgttccgcgacacacccgtggacgcgctcacaccgaatgtgctgaccctgcgcatcgatcccgcacacggtacgagcttcgacttcaatgtgaaaacgcctgggccggtcatgcagatcggtgcggtgcagtcgtcgttcgattacggcgacttttttgcggagcgcgccaacgtgggctacgagaccttgctctacgactgcatgctcggcgacgagacgctgttccagcgcgctgacagcatcgaaacgagctggtgcgcggtagacgacgtgttgcaccccgaatccggcggcgcgatgccggtgcatggctatccggcaggcagcgaaggtcccgcggaagcagacgcgctattggcgcgcggcggt

SEQ ID NO: 31289 - DNA, 1548 bp, Burkholderia cepacia
ggcacactgggcggcccgctgctcgacaacaacgatttcgtcgacggcgacggtccgccgaattaccagttgctctcgtggaccacctatccggagcgcctgcaggccgcgggcatctcgtggcaggtgtatcaacaggggttgaccggctccgatccgctgaacggcaactacggcaccaacatcctgcagaacttcaccaacttcatcaacgcgcaacccggttcgccgttgtacgagcgtgcgcaaaccgtgcgcaccatcgacgacctgaaggccgacgtgctggccaacaagctgccgcaagtatcgtggctgtgcccgccggccgcgtactcggaacacccgagctatacgcccgcatacggcgcggaatacacgtcgcagattctggatgcgctgacgtcgaatccggaggtctggagcaagaccgtgctgttcatcatgtacgacgagaacgacggcttcttcgaccacctcgtgccgccgcaaccggccacgacggctgcgcaaggccagtcgacggtcagcaccgaaggcgagattcacaacgtggtcaatccgttgcgcggcggcagctacaccgccgacggcctgccctacggcctcggcccgcgcgtgcccatgacgatcgtgtcgccgtggagcaagggcggctttgtgtgctcgcaggtgtttgaccacacgtcggtgatccgtttcatcgaagcgcgctttggcgtgtatgagccgaacatcacggcatggcgccgcgcggtgtgcggcgacctgaccacggcattcgacttccgcacgccggactcgaaggtgccgccgctgcccgacacgagcaactacaagagcattgccgacaaccagtgcgcgacgcagccgaagccgaccgttcccgcaacgccgggcgcgatcgatccgcaggaaagcggcatccgttttgcgcgcgcgctgccgtatgaactgcatgtgaacggacacgcggacgcgaagaagaacacgttcgaactctcgatcggcaacaccggcgatcagggcgcgcatttctacgtgtattcgacgaaccgcacggatggtccgtggcgctacacggtcgaagcgggcaagtcgctcagcgagacattcgacctgaccgtgacgagcggcgcgtacacgttcgaagtcttcgggccgaatggtttcgtgcgcaaattcgcgggcaacacgcagcagccgaaggcacataacgcgccgttcggcggcggccacggcaacaacaagccggccgaaccggaagtgaaggtgcaatacgatgtcgcgaacggcaacgtgttcctcaagttcagcaacaagggcggcggcattgcgcggttgacggtgacggacaacgcgtacggtgcgcgtccgcgaccggtgctggtgccggctggcgcgcaaatcgaagaagcatgggtgctggcgtcgagccatcactggtacgacttgacggtgacgagcaatgacgacgccagcttctcacgccgtcttgcgggtcacgtcgagaatgggcggccgagcatcagcgatccggcggcggtt

SEQ ID NO: 31290 - DNA, 1647 bp, Burkholderia cepacia; identical to SEQ ID NO: 28531

SEQ ID NO: 31291 - DNA, 1254 bp, Burkholderia cepacia
ggtctcgcaacgttcttcgacggcttcgacgtgatcgcgattgcggccacgttgccgatcctgatcgcgaagtggcatctgacgccgtgggaaatcggctttctgatcggctccggttcggtcggacaactgatcggcgcgttcgtctttccgtggtacgcggagcgcggcgggcgcgtgaaggcgatcgcgttgagttcggggattatcggcatcaccagcattgcgtgcggttttgcgccgacgttcgcagcattcgttgtattacgcgtgattcaggggctcgggctcggcggtgaattgccggtggccgcgacttacatcaacgagatcagccgggcgcatggccgtggacgtttcgtgctgctgtatgaaatcgtctttccggtcggcctgctcgcttcgaacgcattgggtgcgtggatcgtgccgcgtttcggttggcaagccatgtactttatcggcggcatgccgttgatcctgttcttcgtgctgcgcaaactggtgcccgaatcgccgcgctggctcgccgaacgtgaacggatggccgatgcggacacggcggtgcatgcgttcgaacgtgcggtcaaaggtccgcttccgccggtgacgcattcggccgaattcgaggcgatggccaatcgtcacccgaagcgccgcatgagcgacctgttcggtcccgcgtacctgaagcgcacgcttgccgtggcgatgctgtggatcacctgcggcttcattcaatacggcctctcgacgtggctgccgaccatctatcgcacgatctatcacgcgccgctgcaactcgcgctgaatctggcggtggcggcttcggtgctcggcgtggtgggttcgctgacctgtgcgttgctggtcgacaaggtggggcgtaagccgatcatcaacctgtcgttcgtggcatgtgcgctgtcgttgctgctggcgggcgttttccacgattcgtcggtgtatgtggtggcgacgttctgtgcgttctcgctgggctttctcgcgtgcggttttattacggcctatgtgtatacgccggagctgtatccgaccagcatccgtgcgatgggttgcggtgtcggcggcgcgtggttgaaggtcgcggcgatctttgctcccgctatcgtgtccaagacgatgatcggcgggaatttgcaggtagcgttttatattcttgcggctgtgccgttcctcgcggcggtgacagtgcattttcttgggattgaaaccaagggcaaggtgctggag

SEQ ID NO: 31292 - DNA, 1458 bp, Burkholderia cepacia
ttcgataccagcctcgtgcccaccggcgatattttcatcggcggcgaatggcggcaagggcgtggcaacccgtacacaagcctgtatccggcggatcagtcggtcaacatggaaatctcgacggccaatgccgacgacgcccgcgacgccgtggaagccgccgatatcgcgtggcggcgcgcggactggtcgggactgaagccgcatcaacgcgcgctgattctgtaccgcatcgccgatctgatcatggcgcgccatgaagcgctcgcgcaattgcagcgccgcgacaacggcaagccgatcggcgaaacacgcgtgctcgtggcgagcgccgcgaataccttccgttatttcgcggcctgcctcgaaacgctcgacgaagaagtcacgccctcgcgcggcgactatctgaccatgagcatctatgagccgatcggcgtgatcgccgcgattacgccgtggaactcgccgattgcttcggacgcgcagaagctcgcgccggcactcgcgggcggtaacgccgtggtgctgaagccggctgaagtgacgccgttggtctcgctggcattggcgcgcatctgcgaagaggcgggtgtgccgaagggcgttctaagcgtgttgccggggaaaggctcggtgatcggtgacgtgctggtgcgtcatcctctcgtgaagaaggtgtcgttcacgggtggcaccgaagtgggccgcggcattgcgcgcatcgcggcggacaagctgatgccggtgtctctggaactcggcggcaagtcgccgaccatcgtcttcgacgatgccgatctcgatcacgcggtcaacggcgtgctgtacggcattttcagttcgtcgggcgaagcgtgcattgcgggttcacgcctgttcgtgcagcgctccatttacgacacgttcatgaagcgtctcgcggacggcgcgcgcaagctgcgcgtgggcgacccgtcgcgttccgaaacacagatgggtccgctgatcacggcggcgcatcgcgaaactgtcgagcgctatgtcgcgctcggcctggaagaaggcggccgtctgctgtgcggcggcgagcgcccggtcggcgacggccgcgaagcgggcacgtattttcagccgaccattctcgaaggcctgaccaacaacgcccgcatctgccaggaagaaatcttcggcccggtgctggtggccatgcccttcgacgatgaagcctcgttgctgaaagaagcgaacaacagcgtgttcggcctcgccgccggcatctggacgcgcgactacaagcgcgcctaccggattgcccgagcgctcgaagccggcaccatctggatcaacacctacaagctgttctcgatctcgacgccgttcagcggctggaaagagagcggcatgggacgcgagaagggccggctcggcatccgcgaatacatgcaacagaagagcctctactggggcttgaacgac

SEQ ID NO: 31293 - DNA, 789 bp, Burkholderia cepacia
atccaaatcgacttgaccgggcaggtagcggtggtgacgggcggctcgtccggcatcggcctcgccactgccgaactgtttctgcgagccggcgcctcggtcgcgatctgcggccgcgataccgaacgtctcgcgcaagcggaagccgcgctgaaggcgcagttcccgcaggcgcaattgcttgcgcgccgctgcaacgtgctcgacgccgacgacgtaaaagctttcgcggaagccgtgcagagccgcttcggccgcactggcatgctgatcaacaacgcgggccagggccgtgtgtcgactttcgccgacaccaccgacgaagcctggcgcgaagaactcgacctgaagtacttcagcgtgattcgcccgacccgcgcgttcctgccgatgctgcgcgatgcctccgcatcgaacagcaacgccgcgattgtctgcgtgaactcgctgctcgcactgcaacccgagccgcacatggtggcgacttcgtcggcgcgtgccggcgtgcagaacctgctcaagtcgctcgcggtggaactcgcgccgcagcgcatccgcgtcaattcgattctgatcggcatcgtcgaatcgggtcaatggcgtcgccgttatgcgaaagaagcgcagccgggccaaagctgggaagactggacggcagaactggcgcgcaagaaaaacattccgctaggccgcttcggtcgccccgaagaagccgctcaagcgctcttttatctggctacgacgctgtcgtcctatacgacgggcagtcatatcgatgtttctggaggc

SEQ ID NO: 31294 - DNA, 735 bp, Burkholderia cepacia; identical to SEQ ID NO: 28535

SEQ ID NO: 31295 - DNA, 1770 bp, Burkholderia cepacia
attgcattcttgccatgtgttacgcacgcagcaggcattgttgcggacggaggaactgcgactacagttgtgtcagctgcaaacggtgggcaaaccgttaatatagcgccagccgtttcaggcgtttcgcagaatacctacagttctttcaatgttggcgtcgccggcgccacactgaataatgtcggcattaatgcccgaaccattgtcaaccaggtaaccagctctaatccgagtttaatcgaagggcaaatctctgtaacgggttcacgggccaacgtcatactcgccaatccaaatggcataaccgtgaacggtgggtctttcgtcaacacgggtcacgtcgccttgacgacgggacaggtcagttttgacgatctgcagatcgctccgggcattttccagcgcaacgtcgtcctgaatacgaccggcggcgcgatcgtcattgggccgcaggggttgtccagcgcgctggtagacctggatctgatcgcgaagaccatccagatcaacggtccagtggcgaataccttcacttcggcgacggcgatcacgcgtgccgtcgccggcaccagcgccgtcacgctgaacacaggtctgtcgccctcggacaatgccaacgactggctaaccttgcaaacaggccaaccgctggccaccgcgaattccttcgcactcgacatcaccgctgcgggcagcgtgacgagcgggcgggttgaaatcatcgtgaccgacaaggggccgggcgtacgcagcgccggtccgcttgacgcatcgctcggcgatttcacgttgagttccaacggcagcgtccagatatcgaacaccacggtgacggccaacgggaatatcaactttcaggtgcaggacggcatctcgctcaccgataccagggtcaccagcggaacagcaacgcttgatgcttccggggccatcacgctgacgggcagcagcatactcaccaacggcggcgccacgctgtccgcaaacggtattacgctgacccccgacagcgcgcagaccgggtccacgctcgcctctgcaaccgcgggcgtggtgctcgacagcacggcagacatcaccaatctcggctcgctgatccaggggcaggcagcgaccagcggcgatgcgcaatcgctcggcgcggtcacgctcgatgcaagcggcaacatcctgaaccagtcgttgcccggcacccctctgggcatcctgtttggcgtcaagggcgacgttgtggtgagcgccggcggcaacatcgtcaaccagaatgcgcgaatcctgtcgaacgagaacgtgacgatcgccgccgggggggacgtcgacaacatcatcgaccacacgagcggcgtcgacaacggtgttgcatccagctattcgagcgatggctggtcgtttctgtttcttgagcaccacagcagcggcatttcggtgaactatggcgaactatccgatcccactgcgctgtcatatatcacggcggacgccggcaacgtgactatcaccggcaacaacatcaacaacgttggcggctcgatcctctcgaacgacggcgcaatcagcatcaccgcgcgtaactcgctgctcgatcagggtgtgttcaccggtcaggcgcagtttcacgagtcctgcttcatcttctgtcattcgtcggcgtcaagcgacgtgcagctatacggcggcgatatcgaggccggtacgagcatttccctgaaggctggcacgcagattctcaacacgggcggcaccgttctggccgagggcgcactgaca

SEQ ID NO: 31296 - DNA, 1206 bp, Burkholderia cepacia
caggtcgatcgcgtcgcgccgtacctcggctccctgtcccgctggctcgaaaccctgaagcgcccgaagcgcattctgatcgtcgacgtgcctatcgaactcgataacggcacggtcgctcacttcgaaggctatcgcgtgcagcacaacgtatcgcgcggtccgggcaagggcggtgtgcgttatcaccaggacgtgacgttgtcggaagtgatggcgctgtcggcgtggatgtcggtgaagaatgctgcggtgaacgtcccgtacggcggcgcgaagggcggcatccgtgtcgatccgcgcaccttgtcgcgtggtgagttggagcgtgtgacgcgccgctataccagcgaaatcggcatcatcatcggaccgaataccgacattcccgcgccggacgtgaacacgaacgagcagatcatggcgtggatgatggacacctactcgatgaaccagggccaaacggccacgggcgtcgtgacgggcaagccgatcacgctgggcggctcgctcggccgccgcgaggcaaccggccgcggcgtgttcgtggtggcgtcggaagccgcacgccgtatcggcgtggacatcgaaggcgcgcgcatcgcggtgcagggtttcggcaacgtgggcgggatcgcggcgcgtctgttccaggaagcgggttcgaagctggtcgcggtgcaggatcacaccggctcgctgtacaagtccacgggtatcgacgcggttgcattgctcgagcacgtcgcaaaacacggcggcgtgggcggcttcccggaagcggatgccgtgagcaatgaagaattctggacggtcgaatcggacatcctgattccggccgcgctggaaaaccagatcaccgaaaagaacgcggcgaagatcaggacgaagatcgtcgtggaaggcgccaacggcccgaccactacggcggcggacgacatcctgcacgatcgcggcattctcgtgattccggacgtggtggccaacgccggcggcgtgaccgtgtcgtacttcgaatgggtgcaggacttctcgagcttcttctggacggaagacgagatcaaccagcgtctggagcgtgtgatgcgcgaagcgttcgccgcggtgtggcaggtttcgagcgagcagaaggtgtccgtgcggaccgcggcgtttatcgtcgcgtgtaagcggattctggaagcgcgcgaactgcgcggcctgtat

SEQ ID NO: 31297 - DNA, 459 bp, Burkholderia cepacia; identical to SEQ ID NO: 28538

SEQ ID NO: 31298 - DNA, 1278 bp, Burkholderia cepacia
acgagaatttcaatggatatcgaccagtacatgaccgacctcggccgtcgcgcccgccaggcatcgcgggctatggcgcgggcgtcgacggcggcgaagaacgccgcgctcgccgccgtcgccgaggcgatcgagcgcgacgccgcctcgctgaaagaagcgaatgcgcgtgacgtggccaaggctcgcgagaaaggccacgacgccgcgttcatcgaccgtttgacgctgtcggacaaagcgctgaagacgatggtggaaggtctgcggcaagtcgccgcgctggccgatccgatcggcgagatcagcaatctgaagtaccggccgagcggcattcaggtcggtcagatgcgcgtgccgctcggcgtgatcggcatcatctacgaatcgcgtccgaacgtgacgatcgacgccgcggcgctctgcctcaagtcgggcaacgccaccattctgcgcggcggttccgaagcgctcgaatgcaatacggcgctggcgaagctgatcggcgaagggctggaagccgccggtttgccgcaggacgccgtgcaggtggtggccacctcggaccgcgcggcggtcggcaagctgatcaccatgactgaatatgtcgacgtgatcgtgccgcgcggcggcaagagcctgatcgagcgcctgatgaacgaagcgcgcgtgccgatgatcaagcacctcgacggcatctgccacgtgtacgtggacgatcgcgcggatctgaccaaggcgctgacggtctgcgacaacgccaagacgcaccgctacggcacctgcaatacgatggaaacgctgctggttgcgcgcggcattgcagccgaagtgctgccgccgttgggcaagctgtatcgcgacaagcaagttgaactgcgggtggatgcggcggcgcgcgcggtgctggcggatgcgggcgtgggaccgctcggcgatgcgaccgaggaagactggcgcaccgaatatctcgcgccggtgctggcgatcaaggtggtggacgatctcgatgcggcgatcgagcacatcaacgagtacagctcgcagcacaccgacgcgatcgtcacggaagaccacgatcgcgcgatgcgcttcctgcgcgaagtggattcggcgagcgtgatggtcaacgcgtcgacgcgttttgccgatggtttcgaattcggtctgggcgcggagatcggcatctcgaacgacaagctgcatgcgcgcgggccggtgggactcgaagggctgacgtcgttgaaatacgtcgtgctcgggcacggcgaaggccgt

SEQ ID NO: 31299 - DNA, 789 bp, Burkholderia cepacia; identical to SEQ ID NO: 28540

SEQ ID NO: 31300 - DNA, 1254 bp, Burkholderia cepacia; identical to SEQ ID NO: 28541

SEQ ID NO: 31301 - DNA, 1008 bp, Burkholderia cepacia
atgacgattcgcgtcgcaatcaacggctacggccgtattggccgcaacacgctgcgcgccttctatgaaaacggcaagaagcacgatatcgaaatcgtcgccatcaacgacctcggcgatgccaggaccaacgctcacctgacgcaatacgacacggcgcacggcaagttcccgggcgaagtgtcggtggacggcgactacctggtcgtcaacggcgacaagatccgcgtgctggccaaccgcaacccggctgaactgccgtggggcgagctgaacgtggacgtcgtgatggaatgcacgggctttttcacgaccaaggaaaaggccagcgcgcacatcaagggcggcgcaaagaaggtgatcatctcggcgccgggcggtaaagacgtcgacgccacgatcgtctacggcgtgaaccaccatgtgctgaaggcatcggacacggtcatctcgaacgcatcgtgcacgacgaactgcctcgcgccgctcgtcaagccgctgaacgacaagatcggtctggtgaacggtctgatgaccacgatccacgcgtacacgaacgaccaggttctgacggacgtgtaccacgaagacctgcgccgcgcgcgctcggccacgcacagccagatcccgaccaagaccggcgcggcttcggcggtcggcctggtgctgccggaactgaacggcaagctggacggctacgcgattcgcgtgccgacgatcaacgtgtcgatcgtcgatctgtccttcatcgccgcgcgcgacacgacggtcgaagaagtcaacgcgatcatgaaggaagcgtcggaaggctcgctgaagggcattctcggctacaaccaggcaccgctggtgtcgatcgacttcaaccacaacccggcttcgtcgacgttcgacgccacgctgaccaaggtgtcgggccgtctggtgaaggtgtcgagctggtacgacaacgagtggggcttctcgaaccgcatgctggacacggctgtggcgctcgctcacgcgaag

SEQ ID NO: 31302 - DNA, 1983 bp, Burkholderia cepacia
atggccaacgcaatccgcgcgctgtccatggacgccgttcaaaaagcgaactccggccaccccggcatgccaatgggcatggccgaaatcggcgtggcgttgtggtcgcgtcatctgcgccacaacccgaagaacccgcaatgggccgatcgcgaccgtttcgtgctgtcgaacggtcacggctcgatgctgctgtactcgctgctgcacctgaccggctacgatctgccgatcgaagagctgaagaacttccgccagatgcattcgaagacgccgggccacccggaatacggcatcacgccgggcgtcgagacgaccaccggcccgctcggccagggtctggcgaatgcggtcggcatggcgctcgccgagtcgctgctcgccaccgaattcaacaagcctgacgcaacgatcgtcgaccaccacacgtacgtgttcgtcggcgacggctgcctgatggaaggcatctcgcacgaagcctgttcgctcgcgggcgtgctgaagctgaacaagctgattgcgttctacgacgacaacggcatctcgatcgacggcgaagtggtgcactggttccacgacgacacgcccaagcgcttcgaggcgtacggctggaacgtgatcccgaacgtggtcggccacgacgtcgaagcagtggacgcggccatcaagcaggcgaagcaatccgacaaacccacgctgatctgctgcaagacggtgatcggcgaaggctcgccgaacaaggccggcagccacgattcgcacggcgcggcgctcggcgacaaggaagtcgcggccacgcgcgaaaagatcggctggaagtgggagccgttcgtgatcccgcaagaggtctatgcagcttgggacgcaacagaagcgggcgcacgcaacgaatccgagtgggacaaggcattcgccgcgtacgctgccaaatatccgcaggaagccgctgaattcaagcgccgcaacgcgaagcagttgccggcggactggaaggaaaaggccaaggcgatcattgccggcgcgaacgagcgcgcggaaaccgtagcgacgcgcaaggcatcgcaacaggctatcgaggctttgtcggccgtgctgccggaactgctcggcggctccgccgacctgaccggctcgaacctgaccaactggaaggccgccaaaccggtacgcgtgaacgccgaaggcaaggctgccggcaactacgtcaactacggcgtgcgtgaattcggcatgagcgccgcgatcaacggcgttgcgctgcacggtggcttcaaggcgttcggcggcacgttcctgacgttctcggactacagccgcaacgcgctgcgcgtcgccgcgctgatgaaagcgccgtcgatcttcgtgttcacgcacgactcgatcggtctgggcgaagacggcccgacccaccagtcgatcgaacatgttgcgagcctgcgtctgattccgcacctgcaagtgtggcgtccggctgataccgtcgagacggcggtggcctggacccacgcggtcgaacatcatggcccgtcgtgcctgatcttcagccgtcagaacctgccgttctcggagcgcacggacgcgcagatcgccaacatcgagaagggcggttacgtgctgcgcgactggaacgacgagatcgtcgcgcgcaagatcatcctgatcgccaccggttcggaagtcgaactggcgctgaacgcggtcgagccgctggcgcgcgaaggtatcgcggcgcgcgtcgtgtccatgccgtcaaccaccgtgttcgacaagcaggacgccgagtaccgtgaacgcgtgctgccgcaaggcgtgcgccgcgtcgcgatcgaagcgggtgtgacggatttctggcgcaagtacgtgggtctggaaggcggcgtggtcggcatcgacacgttcggcgaatcggccccggctggcgtgctgttcaagcatttcggcttcaccgtcgaacacgtggtagagacggcaaaagccgcactc

SEQ ID NO: 31303 - DNA, 825 bp, Burkholderia cepacia; identical to SEQ ID NO: 28544

SEQ ID NO: 31304 - DNA, 867 bp, Burkholderia cepacia
tttcgcggcatcatttcgtaccccgtaacaccgttcgatctgcacgacggcagcgttgatgtcccgacgctgaaccggttgatcgatcgtctggtcgacagcggctcgcacggcatcgcaccgctcggcagcacgggcgaaagcgcctatctcagcgacgacgaatgggacacggtggccgaggcatcggtcagacgcgtggcgaagcgcctgccggtcattgtcggcatttccgacctgacgacccgcaacgcggtgcgccgtgcgaagttcgccgaatcagtgggcgccgatgcggtgatggtgctgccggtgtcttactggaagctcaacgaagcggaaatcttccgccattacgcgacgatcgccgaggcgatcagcgtgccgatcatggtgtacaacaatccggcgacgagcggcatcgacatgcagcccgaactgatcgtgaagctcgcgagggagatcgacaacgtcacgatgatcaaggaaagcaccggcgacattcagcggatgcaccggattgcgcagctgtcggacgggcgcgtgccgtttttcaacggcagtaatccgctggcgctcggagccttcgcggcaggggcggccgggtggtgcacggcggcgccgaacctcgtgccgcaatggccagtcaagctttatgaggcttgtgagaagggtgatatggagcttgcgcgagcggttttttatcgcttgctgccgttcctgcagtgcatcatgaagggcggcttgccgacgacggtgaaggccgggcttgcgttgcgagggttttcggtgggcgcgccgcgtaggccgcttcagccgcttgcggagccggcggtgcgtgagttggcggcagtgctgggggggctt

SEQ ID NO: 31305 - DNA, 639 bp, Burkholderia cepacia
agtttcggcggctaccttgcgctgcccaaaggcggcaagggaccggccgtcatcatcattcaggaaatcttcggcgtgaacagccatatccgctcggtcgcggatcagtatgcccaggacggctacatcgcgctcgcaccggacgtgttctggcgggtgcagccgcgcgtggaattgacgtatgaaggcgcggatcgcgagaagggcatcgagctgatgcagaagaccaacgtcgatcaggccgtagccgatatcggcgcagccgccgccgcgttgcgtgccatgccggaagtgaccggcaagattgcggcgatcggctactgcttcggcggccggctcgcgtatctggccgcggcgcaaggcacgctcgacgcagcggtggcctactacggcggcggcatccagaaccagctcgacgaagcagcgaagatcaaggtgccgatgcaattccactacggcgagctcgacgcgcatattccggtgtcggctatcggacagattcaggagcgcttcgccggccgcaccgacgccgagttccacatctatccgaatgccgatcacggcttcaactgctcggaccgcgcgtcgtataaccagcgcgccgccgcgctggcgcatggccgcacgttgaccttcctc

SEQ ID NO: 31306 - DNA, 1383 bp, Burkholderia cepacia; identical to SEQ ID NO: 28547

SEQ ID NO: 31307 - DNA, 1278 bp, Burkholderia cepacia
gaagacctcggcgtgctgcgtttcatcactgcgggcagcgtcgacgatggcaagagcacgttgatcggccgcctgctgtacgacagcaaggctgtgctttcagatcaactctcggccctgtcgcgcgcgaagaataagcgtaccgtaggcgacgaaatcgatctgtcgttgctgacggacggcctcgaagcagaacgcgagcagggcatcacgatcgatgtcgcgtaccgttacttcgcgacggcgaagcgcaagttcatcattgccgacacgccgggtcacgagcagtacacgcgcaatatggtgacgggtgcatcgaccgcgcacgcggcgatcattctggtcgacgcgacgcgcgtgacgtttgtggacggcgtcgcgcaactgctgccgcaaaccaagcgtcatagcgcgatcgtcaagctgctgggtttgcagcacgcaatcgtcgcgatcaacaagatggacctggtcgattacagcgagcagcgcttcaacgagattcgcgacgcgtatgtcgaacttgcgcgtcaactgggcttgaacgatgtgcgcttcgtgccggtgtcggcgctcaagggcgacaacatcgtgacggcgagcgaaagcatgccgtggtacgcgggcgaaccgctgctcgacctgctcgaagcgctgccggtcgaagtaccgacgggccaggcgctgcgtttcccggtgcaatgggtggcgcgccaggacggcagccaggccgacgatttccgcggctacatgggccgtgtggaagccggtgaagtgaagctcggcgatacgatcgtcgtgttgccggccaatcgggaagcgacggttgcagagatcatcgcgccggtgccgggcggcacggctgcggtggaccgcgcgtttgccggtcaaacggtgacgattcgtctggcggaagacgtcgacgtgtcgcgcggcgacaccttcgtgctgcgtgaagcggcgccggagccggcgaagaaactggaagccgacctctgctggttcgacgacacgccgctgtcgacgcaacgcaagtatctgttgaagcagaccaccaacacggtgttcgcgcggatcggtgcgatcaaggaagtgctcgacgtgcatacgctgtcgcaggcgaccgatcgaaaggaactgacgatgaacgatattggccgtgtggcgctgacgttgcagaagccgctggtgtgcgacgtgtacgactcgcatcagggcacgggtgcgttcgtgctgatcgatgaggcgacgcatcacaccgttgccgctgggatgatt

SEQ ID NO: 31308 - DNA, 1665 bp, Burkholderia cepacia; identical to SEQ ID NO: 28549

SEQ ID NO: 31309 - DNA, 1356 bp, Burkholderia cepacia; identical to SEQ ID NO: 28550

SEQ ID NO: 31310 - DNA, 924 bp, Burkholderia cepacia
atgcagccaatcgtctcggtcacgaacctgtcgaaaacctatgccagcggttttcatgcactcaagaacatcaatctggcgatcaaccgtggggaaatctttgcgttgctcggcccgaacggcgcgggcaaaacaaccctcatcagcattatctgcggcatcgtcaatgcgagcgaaggcagcgtaacggtggacggccgcgacatcgcgaccgactatcgcgccgcgcgctcgctgatcggcctcgtgccgcaggagttgaccaccgacgccttcgaaaccgtctgggcgaccgtgtcgttcagccggggcctgttcggcaagccgaaaaaccctgcatacgtcgaaaaggtgctgcgggacctgtcgctgtgggaaaagcgcgatagcaagatcatcacgctttcgggcggcatgaagcgccgcgtgctgatcgccaaggccctctcgcacgaaccgcgcgtgctgttcctcgacgaaccgaccgcaggcgtggacgtggagttgcgccgcgacatgtggaagctggtgcgctcgctggcgcagagcggcgtgacgatcatcctcaccacgcactatatcgacgaagccgaagaaatggccgaccgcatcggcgtgatcaacgcgggcgaaatcatgctggtcgaagagaaaacggagctgatgcgcaagctcggcaaaaagcagttgacgctgcaactggagagcccgcttgcgcaagtgccggtctcgcttggcggctacgggctcgccgtcgcgaaaggcggcaacgagttgatctacacatacgagagcgagggcgggcgcaccgacatcatcgcgctgctcaaggcgctcgacgacgccggcatccgcttcaaggacctgcagaccacgcaaagttcgctcgaagacatcttcgtcagtctgctccgaggtgaccaa

SEQ ID NO: 31311 - DNA, 1422 bp, Burkholderia cepacia; identical to SEQ ID NO: 28552

SEQ ID NO: 31312 - DNA, 1233 bp, Burkholderia cepacia; identical to SEQ ID NO: 28553

SEQ ID NO: 31313 - DNA, 771 bp, Burkholderia cepacia
cttcgaatcgcaaccttcaatatcaacgggatccgctcgcgcctgccggcgctcttgcaatggctcgaacgcgaggcgcccgacattgtctgtttgcaggaattgaaggcggcggacagcgcctttcccgtcgagcaactgcgtgacgccggctatggcgcgatctggcaaggtcagagcgcatggaacggcgtggcgatcctgtcgaaaggcgaggcgccgctggagagccgccgcggcctgcccggtttcgaggacgacacgcacagccgctatctcgaagccgctgtcggcggcatcgtggtggcgtgcctctatctgccgaacggcaatccgcaaccggggcccaagttcgactacaagctcgcgtggttcgatcatctgatcaggcacgcggcgaagctgtacaggagcggtcatccggtcgtgctggcgggcgacttcaacgtggttcccaccgacgaagacatctacaacccgcgctcctggctgaaggacgcgttgctgcaacccgagagccgcgagcgctaccggcaactgctcgcgcagggctggaccgacgcgctccgaacgcgtttcggcaacgaacgggtctacaccttctgggactatttccgccggcattgggagaccaattccggtttgcgtatcgaccatctgctgctgagcgccgacctcgcgccgcgcttgcgcgatgcgggcgtggaccgctgggtgcgtggagagccgcacgcgagcgatcatgcgccgacgtgggtcgaactggagatg

SEQ ID NO: 31314 - DNA, 780 bp, Burkholderia cepacia
acaacgaggagacgtgtcgtgacgggaacgggaatcaagaaggtcgcgctggtaacgggcgcgggtagcgggatcggccgggcgtgcgcgctgaagatgctggagcacggctatagcgtcgtgctggccggccgccgccaggcgccgctcgacgccgtggtcgaggaagcgcagcatctcggcggcgacgccctggccgtggcgtgcgacgtcaccgacgcgggcagcgtcgcggccctgttcgacacgatccgcgaacggcgcggccggctcgacgtgctgttcaacaacgcgggccgcagtgggtcgcccgtcgatatcgacgaactcgatatcgacgaatggcgctcggtggtggacaccaatctcaccggcgtattcctgtgcacgcgcgcggccttcggtctgatgaaaacgcagagtccgcgcggcgggcgcatcatcaacaacggttcgatctcggcgcatgcgccgcggccgcacagcattgcctacacggcaaccaagcacgccattaccggcctcaccaaagccgtctcgctcgacggccgcaaatacgacatcgtgtgcgggcagatcgacatcggcaatgcggctacggaaatggccgagcgcatggcgcgcggcgtgccgcaggccaacggcgagatcgcggtcgaaccgctgatggacgttcagcacgtggcggacgccgtgctgcacatggccgaactgccgctcacggcgaacgtgcagttcatgacgatcatggcgagcaagatgccgttcatcggccggggt

SEQ ID NO: 31315 - DNA, 1404 bp, Burkholderia cepacia; identical to SEQ ID NO: 28555

SEQ ID NO: 31316 - DNA, 2409 bp, Burkholderia cepacia; identical to SEQ ID NO: 28556

SEQ ID NO: 31317 - DNA, 639 bp, Burkholderia cepacia
atcgaaaccgcaccgaatcctgaattcgccgtgatcctgctgcatggtctcggcgccgacgccaacgacttcgtgccgctggttccggaattgcgtctcgccaatggacccgccgtgcgtttcgtgtttcccaacgcgccggagatcgccgtgaccgcgaacaacggctacgtgatgcgcgcgtggtacgacatccgttcgttccagtcgatcgaacggcaggtcgacgaggcgggcatcgaggcgtcgtgcgcgaccgtgaggcaactgatcgccgggcagaacgcgcgcggcattccgaccacgagaatattcctcgcggggttttcgcaaggcggggcgatgacctactcagcggggctcacacatccggccacgctcggcgggttgatcgtgatgtccggttacctgccctccagagccttcatcgagagccgcctcgcgcccgcgaaccacggcacgccgatctttgccgcgcacggcgagtacgaccaggtgttgccgatccagctcggcgaggccgcgcgcgacttcgcgctggcgcagggcagcaaggtggagtggcatgcgtatgcgatggagcattccgtatgcggcgaagaagtcgccgcactgcgcgcatggcttggtgcgcgcatc

SEQ ID NO: 31318 - DNA, 936 bp, Burkholderia cepacia
aaagtcaccaaagccgtgtttcccgtagcgggcctcgggacacgattcctgccggctaccaaagcgagtccaaaggaaatgctgccgatcgtggacaagccgctgattcaatacgcggttgaagaagcgattgccgccggcatcaccgagatgatcttcgtgacgggccgcagcaagcgcgccattgaagatcatttcgacaagtcctacgagatcgaagccgaactcgaggcgcgtaacaagcagaagctgctcgatctggtgcgcagcatcaagccggccaatgtcgactgtttctatgtgcgccaggccgaagcgctcggtctcggccatgcggtgctgtgcgccgagaaactggtgggcgacagcccgttcgccgtgattctggccgacgacctgctgcacagctcgaagccggtaatgagccagcttgtcgatacgttcaaccactatcacagctcggtgatcggcgtggaaaccatcgcgcgcgaagacagccgctcgtacggcgtggtggacggccgcgaatgggaagacaacgtgatcaagctgtcgggcatagtcgagaagccggcgccggacaaggcaccgtcgaatctcggcgtggtgggccgctatgtgctgatgccgaccatcttcaagcatatccgcgcgttgaagccgggtgcgggcggcgagttgcaattgaccgacgcggtgcaatcgctgctgaccgaagagcaggtgcttgcgtatcgctatttcggcacgcgtttcgattgcggcagcaagctgggctatctgaaggcgacggtggaattcgcgctgcgtcatccggaagtgaaggcggaattcgaagcgtatttgcaggcgtatatgcagaccaacatgcaggaaggtgtgccggcgcagtatgcggcggaagcggcttgagtcgcgagatacttcgagtcctgg

SEQ ID NO: 31319 - DNA, 1497 bp, Burkholderia cepacia; identical to SEQ ID NO: 28559

SEQ ID NO: 31320 - DNA, 2211 bp, Burkholderia cepacia
tccaccagtgtaaaaaccgtgtgcccctactgcggcgttggctgcggcatggtgctgcacgtcgaggacggccaggtggtgaaaatctccggtgacaaggagcacccggccaatttcggacggctgtgcacgaagggccagtcggcgcacgtcgcgttgcgcaagtcgggacggctggagggggcgttcgtgcgtcatgcgcgcggtcgggacccggcgccgttgcccatgacgcaggcgatcagcgccacggcagcgcgtttgcgcggcctgctcgatgaacatgggccggatgcgctgtcgttctatgtttccgggcagatgtcgatcgaggcgcagtacctcgtcaacaagctcgccaaaggcttcgtgggcaccaacaacatcgaatcgaattcgcgcctgtgcatggcgagcgcgggcagcggctacaagctctcgctcggcgcggatggtccgccgggatcgtacgaagatatcgaccacgccgacctgttcttcgtgatcggcgcgaatatggccgactgtcacccgattctgttcctgcgcatgatggatcgcgtgaaggccggcgccaaattgatcgtggtcgatccgcgccgcaacacgacggcggagaaggccgatcttttcatgcagatcaagccgggcaccgatctcgcgttgctcaatggcctgctgcatctattgcacgaaaacggccatacggatgccgcttttatcgccgaggccaccgaaggctgggaggcgatgcccgcgtttctcgccgactacacgccggagaaagccgcgcagatcaccggccttgccgtcgaggatatccgtgcggccgcgcagatgatcggcagcgccaatgagtggatcagttgctggacgatgggcctgaatcaaagcacgcacggcacatggcacaccaacgcgatctgcaatctgcatctcgcgacgggcaagatctgccggcgcggcagcgggccattttcgttgaccggccagcccaatgcaatgggcggccgcgaaatgggttacatggggccgggtttgccgggccagcgttcggtgctggtggaagaagaccgcgcgtttatcgaagacctgtggcgcattccaaagggcacgctcaagcccgaagccggcaacggtacgatcgacatgttcacgcgcatggcggcgggcgagatcaaggcgtgctggatcatctgcacgaatccggtggcgagcgtagcgaatcgtcagaacgcgatcgacggattgcgcgcggcgcaactcgtgatcgcgcaagacgctttcctcgacaccgagaccaaccgttacgccgacgtgctattgcccggcgcgctctgggccgaagcggaaggcgtgatgatcaactcggagcgcaatctcacgctgatgcaaaagggcgtcgagccgccgggcgccgcgctgccggactggcagatcatcgcgcgtatcgcctgcgaaatgggttacgcagaaggcttcacctacgcgagcgccgaggaagttttcgcggaaatcacccgcgtgtcgaatccgaaaacgggctatgacctgcgcggtgcgagccatcgccggttgaaggaaacgccgttgcagtggccgcttgcatcggacgaatcagcggagcgcaatccggttcgctatctcaacgacggcgtgagccagacactcaaggaactggcggacggcagccgtccgcggcttgtttttcccacggcgagctgcaaggcggtgttcttcgcgcgtgcttatgcagcgccggccgaattgccggatcgtgaatttccgatcgtgctgaatacgggccgcttgcagcatcaatggcacaccatgaccaagaccggcaaggtcgcgatgctcaacaagctgaacccggcgccgttcgtcgagattcatcccgaagatgccaccacgcttggtatcaaggcacaggacccggtggagatccgttcgcgccggggccgcgcggtgttgccggccgtcgtgaccgaacgcgtgagcgcgggcagttgctttgcgccgatgcactggaacgatgtatttggcgacgacctgtgcatcaacgccgtgacgagcgatgccgtcgacccgatctcgcagcagcccgaactcaagttctgcgcggtcgcgttgagtccggtggcggcggacagcaggcagccgcttctgactgacgacgatgcaacgatcaccgatgcatccgtggcggtt

SEQ ID NO: 31321 - DNA, 1780 bp, Burkholderia cepacia; identical to SEQ ID NO: 28561

SEQ ID NO: 31322 - DNA, 924 bp, Burkholderia cepacia
accgtgatgggcttcggcgcggcgccgatcggcaacatcttcaggccggtcagcgaggaggattcggcagcgctcatcaaggcagcgtgggacgcgggcgtgcgctatttcgacaccgcgccgatgtatggccacggcttgagcgaggtgcgctgcgggcagggactgcgctggtatccgcgcgaccagtatgtgctgtcgacaaaggtcggacggctcctgaaaccacgcaggcgcgccgagatcgacttcgcgccgtgggtcgacggactgccgttcgagcctgttttcgattacagctacgacggcacgatgcgctcgatcgaagacagcctgcagcgactggcgctggagcacatcgatatcgcgctgatccatgacatcgacgtctttactcacggtgagcgtcagcctgagatgttcgaggccgcgatggcgggcgcgtcgaaagccctgcttaaactgcgtgacgaaggggtggtgaaagcggtggggctgggtgtcaacgagtggcaggtcgcgcacgaggcgattcggcggcaggatttcgactgcctgctgctggcgggtcgctacaccctgctcgaacaggatgcgctggacgggtttctgccgctttgcgagaagaaacaggtgtcggtgattctcggcggcggctacaacagcggcattctcgcaacgggcgcggtgcccggtgcgaaatataactacgcgcccgcgccggaagccattctggaacgcgtgcgcaagatggagcaggtatgccgcgagttctcggtgccgctgaaggcagcgtcgctgcaattcgtgctcggtcatccggccattccgaccaacattccgggcgtgcgcacggttgctcaactggaagacaatcttcaaaccttccgggctgaaattccggcggagttctgggcggaattg

SEQ ID NO: 31323 - DNA, 534 bp, Burkholderia cepacia; identical to SEQ ID NO: 28564

SEQ ID NO: 31324 - DNA, 2376 bp, Burkholderia cepacia; identical to SEQ ID NO: 28565

SEQ ID NO: 31325 - DNA, 2607 bp, Burkholderia cepacia
gcaccacctgagcagcgcgcctggcatgcggagacggcagagtctacgattgaacgcttcggcaccgacgcgacaaggggactcgataccgccgaggcggcgcgtcggcgcgcggtctacggacgtaacgaaatcatcgaaacggaacggcgtcggatcatcacgatgctgatcgagcaattcaaggatttcatgatcctcgttctgctcgctgccgcaatcgtgtcgggactcgtcggcgaccttgaagacgcgctcgtgatcgtcacgatcgtcgtattgaacggaacgattggcttctttcaggactttcgcgccgagcacgccatggcggaactcaagcggctggccgcgtttcacgcgtcggtagtccgtgacggacacccgttgacgattgccgccgccgaagtcgttcccggagatatcgtccttctcgaagcaggcggcgccgttccagccgacctgagagtgatcgaagcaccccagttaagggtcagtgaagccacgttgacgggcgaggccgcccccgttgacaagcatccgcagccgctaacaggcgatgcgacgctccccatcgccgatcgcaccaacatggtctacaagggcactgtcgtgacctatgggcgggcgcgcggcgtcgcagtcgcaacggggatgaacacggaactcggcaagatcgcggcgctgctggagtcggctcccgcattgcagaccccgctgcagcagcgcctgagtcgattcggcaagcaactcgccattgccattctcgcaatctgcgcgctgatattcgtgttcggcgtatcgagtggagagccgccaatactcatgttgctgaccgcactgagccttgccgtcgccgccattccagaagcattgcccgccgtcgtcacgatgatgctcgccctcggtgcgcgcagcatggcgcagcgcgctgcgctggtccggcgccttcccgcggtggaaacgcttggctccgtaagcttcatctgcacagacaagacgggcacgctgacactcaacgcaatgcgcgtggtcgaagtatgtccggcgggaacgcagcggctgcaaaccgcgaacatgggcgtcgacgatattaccgggcagctgctgcgggccgtttcgctgtgcaacgacgcgacgtacgatgcatccggcaagctagccggcgatcccactgaagtggcactgtgggaggtcgccgcggacgccggcatcgatcgctccgctctcgacagatcgatgccgcgctgcacggaaatgccgtttgattccgtacggaaacgcatgaccaccgtgcatcgcgctgaagactcatttatcgcgtataccaagggcgcgcctgaaaccgtgattgaacggtgtacgtcggttgtcggacaggacggcacgccgttcgacacgacaaccttgacgtcgatggcgggtgcgatggcggcggatggactgcgtgtgcttgccgtggcaatgcgccgctggccgcaaaagccaccggccgacaccgacgaactcgaatgcgacctgacgctactcggctttatcggcatgctcgatccacctcgcccggaggccgcgggtgccgtcgcattgtgcaggcaggccggcatcactgtggtgatgattacgggagaccacccgatcaccgcgttggcgattgccaggtcagtgggcattgccagcgatgaagcacaggtgatgaccgggtacacgctgggcaagctgtcggacgaggcactgctcgaagcgacacagcgcatccgcgtctacgcaagggtggatccctcgcagaagatccgcatcgtaaaggcaatgcagtcgacggggcactacgtggcgatgaccggcgacggcgtcaacgatgcacctgcccttgcggcggcaaacatcggcgtggcgatgggcaaagtcggcactgacgtcgcgcgcgaagcggccagcgtggtcctgctcgacgacaatttcgcaacgatagtcgcggcagtccgtgaaggccgacgggtttatgacaacgttcgcaaattcatccgttacgtattgaccggcaatctggcggaactctgcgccatcgcgctggcaccgctttttggccttccgatccccctgctgccaatccagatcctgtggatcaacctgctgaccgatggcttgccggggcttgcactggccgccgagcctgccgaaccgaccatcatgcaacgcccgccaaggccgcccgacgacagtctgttcgcacatggactatggcagtacatcgtgcggatcggcatcgcgatagcagccgtaacgatgggcacccaatggttcgcgatgggactcgacgacgcacactggcgcaccatgaccttcaccgtgctggccttgtcccagatggggcatgtgctcgcgatccgttccgggcagacctcgatcttcacccagggtttgctgtcgaaccgcccgctcgctgccgcggttgcactgactgtcgtgttgcagctcgccgcgatctacgttcccgtgctcaacaacatcctcgataccgcgccgctgagcgcgccggaactgggtttttgcatcctcgtgtccgcgctgatcttcgttctggtggaaacagaaaagtggatcatccgt

SEQ ID NO: 31326 - DNA, 861 bp, Burkholderia cepacia; identical to SEQ ID NO: 28568

SEQ ID NO: 31327 - DNA, 927 bp, Burkholderia cepacia
cagttgctctcggtggatcaattctcgcgcgactcggtggaggcgctgttccgcgtggccgacatcatgcagccgatcgcccggcgccgcaaaatctcccgcgtgctggaaggcgcggtgctcggcaatctgttcttcgaagccagcacgcgtacccgcgtgagcttcggcgcggcgttctgccggctgggcggctcagtttgcgacactaccggtttcacgttttcgtcaatggccaagggcgaatcgatctacgacaccagccgcgtgatgagcggttatgtggacgccctggtaatccgccatccggagcaaggctcggtggccgaattcgcgcgcgcgaccaatgtgcccgtgatcaacggcggcgacgggccgggcgaacacccgagccaggcgctgctcgatctgtacaccattcagcgtgagttctcgcgcctcggcaagatcgtcgacggcgcccatatcgcgctggtcggcgacctgaagtacgggcgcaccgtgcactcgctggtcaaattgctggcgctttaccgcggcatcaagttcacgctgatctcgccgcccatgctcgaaatgcccggctatatcatcgagcagatttcgcgcaacgaccacgtgatcgagcagactcacgatctgtccaccggcctgcgcggcgccgacgtggtgtacgccacgcgcatccagaaagagcgcttcaccgacgaatcgttcgaaggctatacgccggatttccagatcaatcaggcgctggtggacagcgtgtgcggcgtcgatacgctgatcatgcacccgctgccgcgcgacagccgccccggcgcgaacgatctgagcgtggacctgaaccacgattcacggctggcgatcttccggcagaccgacaacggcattccggtgcgcatggcgattttcgcggtgctgctg

SEQ ID NO: 31328 - DNA, 1389 bp, Burkholderia cepacia
atgtcgaccgactgtctgcaagaactcgaaaacgcgctcggccgcgccgccctcgtgcgcgacgaagaccgcgcactgtacgacgtcgactggcgtggccacctgcatggccgatcactcgccgtggtgtgtccatcgcgagtcgaagacgtaggcgagacgatacgcatcgcgaggcgacatcaaatttccatcgttccacaaggcggcaataccggcctcgctggcggagcgaccccggattcgaccggcaggcaactcgtgctatgcacacgccgcctgaatcgcattcgcggcgtcgacctgctcggcaacttcatcacggtcgacgccggctgcatcctgcagaacgtgcaggatgcggcgcaaagtcatgaccgtctctttccactcagcctcgccgcgcaaggcagttgcacgatcggcggcaatctcgccaccaatgcgggcggcaacgcggtgctgcgctatggcaatatgcgcgaactatgcgttggcatcgaagccgtcgacgcgcaaggccgccttatcggcgacctcaaatgcgtgcgcaaaaacaataccggctacagcctgcgcgatctgctgatcggtagcgagggcacactcggcatcatcaccggcgcggcgctccgtctgttcccgcgcccctttgcttacgcgaccgcgctggtcaaatgcgcggacatcgaccatgcactgcaagtgctcggcatattgcgcgctcactgtgcggactttctgagtggtgtcgaatggatgtcgaacggttcgctctccaatgtatcgaagcagttcctggacacgagaataccgcccggcttcgacgaatcgtgtctgtgcctcgtcgagctatcgggatccacgccgcccggtctgctggacgacatactcgccagtgcgctcgatcaggccatcacgtcgggcttcgccgcggacgccgcactcgcgtcgaaccttgccgagcgcgacgcattctgggccctgcgcgaacgtctcccactggccgaagcacggtgccgctcgttgaaacacgacgtctccctgcccgccggcaatatgagcgaattcgtcgcgcatctcgaaggctatctttcgagcatgacgctgcgctgcgcgtgggccggcttcggacacctcggcgacggcaacctgcacgccaacgtgctgattccggataccatgccggatgcactttgcgactgcattgacgagttcgtgtacagcgaggtgctgcgactcgagggcagcatttcggccgagcacggcattggcagccgaaaaaacgatctgctgcaccgggcgctcgacgtcgccagccttcaggccatgcaagcggtcaggaacgcgctcgatccgcacaatctgttcaaccccggcaagctgctc

SEQ ID NO: 31329 - DNA, 801 bp, Burkholderia cepacia; identical to SEQ ID NO: 28571

SEQ ID NO: 31330 - DNA, 840 bp, Burkholderia cepacia; identical to SEQ ID NO: 28572

SEQ ID NO: 31331 - DNA, 1350 bp, Burkholderia cepacia
atcgacggccgcgatgaacaggccgccgacggcgccaccttcgagacgctggaccccggcaccggcgaacatctcgcgacggttgccgcgatgggacccgcggacgtcgatcgtgcggtcgacgcggcgcggcgcgcgttcgcccggtcgggctgggccacgatgcacccgaacgaccgcgcgatctggctgcaccggctcgcggacgaagtcgaacggcgcaaggcgatcatcggccagatcgaagcgctcgacgccggcaagatcgaacagcaggcgcaaggcgacgtgcagagcttcgtcgatacgctgcgttacttcaacgaactggccctgaacacggagcgccgctcggcattgccggtatccggctacgaggcgtggaccacgcggcagccctggggcgcgtgcggattcatcgttccgtggaacttcccgatggtactgatcggatggaatatctctccggcactcgcggcgggcaatacggtggtcatcaaaccggcggaggacacgccgctgtcggccatttacctggctcggctcgcgcgcgagatcggcttcccagatggcgtcatcaacgtcgtgacgggtctgggtgagatagcgggcgctgcgttgtcgcgccatcctggactcaggcgcatgtcgtttaccggttcgccggaagtcggacgcatggtggcggaagcttgcggcagaaatctcgtgccatgcaaactcgaactgggcggtaagggcgcagccgtgattttcgacgatgtgaatatcgaggagaccgcggacaaacttgcgcgcgcaatcacattccacacgggccaggtctgctgcgatgcgactcgctggctcgtgcacgaatcgatcttcgagcgtttcgtcgatgcgagcgtcgctgcgttgcagcgcacaaagatcggttatcaactcgaccccggcgcggagatgggaccggtcgtgagcgcgaaacagcgcgagcgggtgctgggctatctggagcgtggacaacgcgacggcgcgcgagccgtgctcaagggcggcgcagtcgacgtggccgggcacgacggtttctacgtgagccccgcgttgctcgcgggctcgctcgagaacgtggccgcgcgcgaagagattttcggtccggtcgcctttcttgcgccgttcagggacgaagcgcaagccgtcgaactcgccaacgacaccgactacggccttgccaacagcgtatggagccacgacccgagacgcgcgtcgcgggttgcggaagcgatggtggcgggcaatagctggatcaacgcacacaacctgtttccactcggcgtgccgtatgccggagtgaacaggagcggcatgggt

SEQ ID NO: 31332 - DNA, 738 bp, Burkholderia cepacia
ctcgaacttcgcggacgcacggcgctcgtcacaggcgcgagcacgggcattggaacgggcattgcaagggcgctggcgagcgagggcgtgcggcttgcgatcaccgcgcggcgcgatgcgctgctggaggaggtggcggcgtcgatcgtggcggagggcggcgtgcggccgatcgtgatcgtcggcgatctcaccgcgcccggtcacatcgagcgcattcttgcgcaggcgaccgacgcgctggggcagatcgatattctggtgaacaatgcgggcgcgtcgcggcccgcgccgctcgattcgggcgaagacgtctgggaagaggcgttcgcactcaatttcaccgcggcgcgacgcatgacacatgcggttctgccggcaatgcgctcgcgcaaatgggggcgcgtgatcaatatcagcggttcgatggaaccgcgtggactcaatcccagtggtccggcgaaggcggcgctgcatctatgggccaagagcctctcgcgcgaaattgccgcggacggcatcacgatcaacactatcccgccgggcagaattcatagcgagcaaatcgaaaagcgcctgcatcccaccgaagaatcgaaacaggcattcattgcgcgaaacgtgccgatcggctacttcggcgatccgctcgacatcggttatctggcggcatttcttgcgtcgccgcgcgcgaggtacatcacgggagatgtgattccagtggacggcggcatgcat

SEQ ID NO: 31333 - DNA, 1200 bp, Burkholderia cepacia
atgaccgaagcattcctctgcgacgcgattcgcacccccatcggccgctatgcgggagcgctgtcgtcggtgcgtgccgacgacctcggcgccgtgccgctcaaagcgctgatggagcgcaacaaagaggtcgactggaacgcgatcgacgacgtgatctacggctgcgcgaaccaggctggcgaggacaaccgtaacgtcgcgcgcatgtcgctgctgctggccggcttgccgcaaggcgtgccgggcacgacggtgaatcgcctgtgcggctcgggcatggacgcggtcggcattgccgcgcgcgccatcaaatcgggcgaggccgcgttgatggtggcgggcggcgtggaaagcatgagccgcgcgccgtttgtgacgggtaaggcgaccagcgcgttctcgcgccaggccgagatttacgacacgaccatcggctggcgcttcgtcaatccgttgatgaagaaactgtacggtgtcgattcgatgccggaaaccggcgaaaacgtcgccaccgactacaacatcagccgcgccgatcaggacgctttcgcgttgcgcagccagcagaaggcggcgcgcgcgcaacgcgacggcacgctcgcgcaggagatcgtcggcgtgacgatcgcgcagaagaagggcgatccggtcaccgtgtcgcaagacgagcatccgcgcgagacgagtctggatgcgctcgccaaactcaagggcgtggtgcgtccggacggcacggtcacggcaggcaatgcgtcgggcgtgaacgacggcgcagcggcgctgctgcttgccaacgaggaaaccgccaggcgcttcggcctcacgccgcgtgctcgcgtgctgggtatcgcgacggcgggcgtcgcgccgcgcgtgatgggcatcggcccggcgcccgccacgcagaaactgctggcgcgcctgaacatgagcctcgatcaattcgatgtgatcgaactgaacgaggcgtttgcttcgcaaggtatcgcggtgctgcgcgcactcggcgtggccgacgacgacactcgcgtgaatccgaacggcggcgcgatcgcgctcggccacccgctcggcatgagcggcgcgcgtctggtgaccaccgcgatgtatcagttgcatcgcacgcagggccgttttgcgctgtgtacgatgtgtatcggcgtcggccagggcattgcgatcgcgattgaacgggtg

SEQ ID NO: 31334 - DNA, 906 bp, Burkholderia cepacia; identical to SEQ ID NO: 28576

SEQ ID NO: 31335 - DNA, 765 bp, Burkholderia cepacia; identical to SEQ ID NO: 28577

SEQ ID NO: 31336 - DNA, 927 bp, Burkholderia cepacia
acccgcattccgatcatcgatctcgccggcgttcgcgcgggcgacccgcaggctttacagcgcgtggcgcaggaaattcgtgaagcgtgcacgacgatcggcttcttctacatcgtcaatcacggcgtgccgcaagcgctgatcgacgccgccgcgcaggcggcgcgccgcttcttcgcgtttccggtggagaccaagcggcgcgcggcggtcaatcaccgccatcggggtttcaatgcgctcggcgacgcgaccatgtaccaggccaaacgtcccgactacaaggagttcttcagcatcggcctcgaattgccggaggacgaccccgacgtgctggccggtcaggcgctgcgtggaccgaataactggccggacttcatgccggagttgcgtcccgcgctgtacggttactatgaagcggtaggggcgtgcggcgccgatctgctgcgcgcggtggcggtgagcctcggcgtggaggaacaattcttcgcgccgcgttataccaagcggatgcagcgcacgcagatggtctactatccgccgcagccgccccaatcggacgaagatcagttcggcgtcgcgccgcacaccgactatggctgcatcaccttgttgtggcaggatcaggtgggtggcctgcaggtgcgggaaatcgccaacgatacgtgggtggatgcaccgccggtcgaaggcagcttcgtggtcaacgtcggcgatctgctcgcgcgctggaccaacgaccgctttcgctccaccctgcatcgcgtgatcaatgcgtcggggcgcgagcgctattcgatcgcgacgttttatgatccgacttacggtgcgcgggtcgatccacgcgatctcggtacgaacgaaaccgacctcaagtatcagccggtcgcagcgggcgactatattctcgggcgtatcaacgactcg

SEQ ID NO: 31337 - DNA, 1362 bp, Burkholderia cepacia
gagacactcgatgcgctgcgcgccgcgctcggtgaagacagcgtccgcgtgggcgagcagatcagcgaacgcgcgatgaccgactggacacgccacgagccgacgcggcctgcggcattgctcctgccgcgcaccacggagcaggtctcgcgcgcgctggccatctgtcacgcggcgcatcagccggtggtgccgcaaggcggcatgaccggcctcgcgggcggcgcgattgcgcgtgccacggatattgcgttgtcgctcgaacggctggacggcgtcgaagaagtggacgccgcttccgccaccctgaccgtgcgcgccggcacgaccttgcaagccgcccaggaagccgccgccgaagccggcttcgaactcgcgctcgatctcggcgcgcgcggctcgtgccagatcggcggcaatctcgcgaccaacgcgggcggcaaccgggtgatccagtcgggcaccgcgcgcgaccaggtgctgggtctcgaagtggtactggccaatggcgacgtgctcacgtcgctcggcaagatggtcaagaacaataccggctatgacctcaaacactggttcatcggctcggagggcacgcttggcgtaatcacgcgcgccgtgttgcgcttgcatccgccgcgtgccgcgcgccataccgcgctggttgcgctcgacggctacgatgccgccgtgaacctgctgcgccgcttgtccacgcgattcggcaacgacatcggcgcgttcgaaatcatgtggccggacttctacgacttcggcgtgaagctgaccggcacgcgctcgccatttgccgacgcgcatccgctctatgcattgatcgaacacgccagcttcgattcggacgacgacggcgaacgcttttccgccgcgctgaccgaagcgctggaagccggcgcgatccgcgacgccgtgatcgcgcagtcggtggccgacgtgcgcgcgctatgggcgattcgcgaatgcacggcggagtttccggtgcggctcgacgcgatcaacttcgacgtgagcctgccgatcggcgcgatcggcgccttcgtcgaccgctgccgcgcggcgctcgatcagcgctggccgggcaatgcgtcgtatttcttcgggcatatcggcgattcgaatctgcatgtcaccgtggacggacattcgatccccggcgtcaatcatcatgcggtgtacgcgttcgtctacgacatgctcgggccgctgcacggttcggtgtcggcggaacacgggattggtttgctcaagcgcgagttcctgccgatttcgcgctcgccggcggagttggcggcaatggctgcgatcaaacacgcgctggatccgcacggcattctgaatccgggcaag

SEQ ID NO: 31338 - DNA, 1705 bp, Burkholderia cepacia
attcaatcgcattacgacgtggtcgtggtgggttccggctacggcggcgcgattgccgcgtgccgcatggcgcgcgccgggcgccgcgtatgcgtgctcgaacgcgggcgcgaattcatggccggcgaattcccccgcacgccgtttcagggcgccgcgcaggtgcaatacaacacggcggcggcccatatcggctcgccgctggccttgctcgaagtgcacgtgaacgaagacgtgaacgcggtagtcggctgcggtctgggcggcacctcgctgatcaacgcgaacgtcgcgctcgaagccgacccgcgcctgtgggacgacgcacgctggccggccgcgttgcgtgccgacaaggccgcgcgcgacaaaggctatgcgcttgcccgagcgatgctgcaaccgtcgccggtgccgaaggattatccggtgttgccgaaactgcaggcgctcgaaaaatcggcgcaggcgctcggcatggaagaccgcttcacgcgcccggatatcaccgtcacgttcgaggaccgcgtgaacgccgcaggcgtcgcgcagaaggcttgcgttggctgcggcgactgcaattcgggctgcaattacgatgcgaagaattcgacccacatgaactatctgcccgacgccgtggcccacggcgcgcagattttcaccggcaccgctgtccattcggtgcggcgcgacgcgaccacgcgcaaatggatcgtgggctaccagttggtgagcctcggccgcgaaagctatggcgcgcccgatctgttcgtgagcgccgatatcgtgatcgtctcggctggcacgatcggctcgaccgcgctgctgctgcgctcgcgcaatcaggggttgagcgtctccggcatgctcggcaaacatttcaccggcaatggcgacgtgctcgcctttgcgtacaacaccgagcccgtgatcaacggcgtcggctggggttcgcacgagccgggcgatatcccgccggtcggcccgaccattaccggcctcatcgatcatcgcaatacggccaacgtcagggatggctatgtgatcgaagaaggctcgctggccggtccggtgggcgcggcgctggtcggcctgctcggcgccgccgcgccgctcgaaggcgtggatgtcgcgccgcgttcgctcccggaacagatcgcttacgacgcccgcatgtccgagagctttctgcgcggcccctatcacggcgcgctcaatcacacgcaaagctacctcgtcatggcgcatgacgacgaagacggccagatcgacgtggacgacacaggccagccgcgcatcgtgtgggaaaacgccggcaagcagccgatctttcaggtggtcgaggaggcgctcaagcaggccaccgtgccgctcggcggcaaatacctgcgcaatccgatctccaccgatatcatcggcaaccgcaccgtcaccgtgcatccgctcggcggctgcggcatgggcgaggacgcggagcacggcgtagtcgaccacatgggccgcgtgttcagcggcgccacgggcaacgcggtgcacgacggcctgtacgtgatggacggcgccgtcatgccgatgtcgctcggcgtcaatccgctcctcaccatttccgcgctggccgaacgcaattgcgagctgctgctggccacgcatcccgtgaccgccgccccggccgacggcgcggccgccacgccgagcttgccgc

SEQ ID NO: 31339 - DNA, 1569 bp, Burkholderia cepacia; identical to SEQ ID NO: 28581

SEQ ID NO: 31340 - DNA, 1326 bp, Burkholderia cepacia; identical to SEQ ID NO: 28582

SEQ ID NO: 31341 - DNA, 906 bp, Burkholderia cepacia; identical to SEQ ID NO: 28583

SEQ ID NO: 31342 - DNA, 891 bp, Burkholderia cepacia
cgcgtcgaggtggcggggcaggcgccggcttcggtcggcgaaagtccggtgtggcgcatcgcggaacaggcgctctactgggtggacattccggcgcagaagatcgtgcgtttgcggatcgattcgggcgaacgctccgaatggcggatgccggagaaagtggcgtgcatcgcgttcgatcatcgcggcacggtgctggccggttgcgagacggggctcttcgccgtgacgctcgctggggccacggccaccggcgaagccgtgcaggtgacagggcgcaagctcgccgcgcccgacttcgcatgcgacgacatgcgtttcaacgacggccgttgcgaccggcaagggcgcttctggtccggcacgatggtgcaggacatggcggccgccaggccggccggtgcgctctatcggttcgatgcgcgcggtgttctgtccgcgccggtcgtcgacgggctcatcacgcagaatggcctcgcgtggtcgccggacggcgcgaccatgtatctgtcggactcgcatcctttgcgccggcagatctgggcattcgactacgacggcgagaccggcgagccgcgcaaccgccgcgtgtttgccgatctgaatcatcatgcgggccgccccgacggagccgcggtggacgccgacggctgctactggatttgcgccaacgacgcgggcctgttgctgcgcttcacaccgcttggcaagctggaccggcagatcgccgtgccggccatcaaacctgccatgtgcgcgttcggtggacgcgatctggatacgttgttcgtgacgtcgattcgtcccgcggcgaacgcaagtgagcacgacggccatctgttcgctgtgcgccccggtgtcaccggcttacccgagccggaattcgcgggc

SEQ ID NO: 31343 - DNA, 624 bp, Burkholderia cepacia; identical to SEQ ID NO: 28585

SEQ ID NO: 31344 - DNA, 1449 bp, Burkholderia cepacia
cccgacctgccgctcgacatgatcattttcggcggcaccggcgacctgtcgtttcgcaagctgctgcccgcgctctatatggcgcatctgcactgcaacctgccgccggacacccgcattctcacaatcggccgcaagccctggtcgcgtgaggagtacatcaacgaattcatggagcagaaggcaaagcccttcattgaaaagaaagcgttcgatgccgccgcctgggacaagtttctggcgctgttcgaatacgtgcgcatggacgtggattcagtcgaggactatcaacggctgaaggaggcgtcgcgcgagggcgtgcgccgcgtgttctatctcgcgacgtcgccggacctgttcacgaacatctgcgataacctcgcggcggcgggattggtcgacggcaactcgcgggtggtgctcgaaaagccgctgggccacgatctggcgtccgcgcaggaaatcaacacggcggtcggcaagcatttcagcgaagcgcagatctaccggatcgaccactacctcggcaaggaaaccgtgcagaacctgatggtgctgcgtttcggcaatccgattttcggcccgttgtggcaggcgccgtatatcaagagcgtgcagatcacggtggcggagacggtcggcgtgggcagccgcgcgggcttctatgacaagaccggcgcgctgcgcgacatggtgcagaaccacttgctgcaactgctgtgcattgtcgcgatggagccgcccgtgtcgctcgacccggacgcggttcgcgacgaaaagctcaaggtgctgcgctcattgcggcccatgacgccggaagacatcgcgcgcgacaccgtgcgcggccagtacaccgccggcgcggtggacggcgaggcggtgaagggttatctcgaggaagacaacgtgccggcaggcagccgcgccgaaaccttcgtcgcgttgcgcgcgcatatcaacaactggcgctgggcgcatgtgccgttcttcctgcgcaccggcaagcggatgcagaagaaagtatcggagatcgtcatcgagttttccgaactgcctttctcgatcatcccgaacgggaatagcgggcgcaactacggcaaccggctcgtgatccagttgcagcctgaggagtcgatccagttgcaggtgctcgccaaggaaccgggcagcggcatgcatatgctgccggtgaatctgaatctggatttgcagcaggcttttaccgagcgtcgcgcggaagcgtacgagcgtttgctgatcgacgtgattcgcggacgcctcacgcacttcatgcgtcgcgacgaactcgaagcagcatgggcgtgggccgagccgattctggcaggctggagcaagtcgggcgagaagccgcgtggctatacggcgggcacgttcgggccggctgcatccaccgcgctgatggcgcgggaaaatgcagtgtgggcggaa

SEQ ID NO: 31345 - DNA, 510 bp, Burkholderia cepacia
atcaaaagccacatccgcacggtgcccgactggccggagccgggcgtgcagttccgcgatatcacgccgctgctgcaggagccgaagtcgctgcgcgtgctgatcgatctgttcgtgcagcgctatatcgacgcgaagctcgactacattgccgggctggacgcgcgcgggttcatcatcgggccgattctcgcgtatgagctgaacctcggcttcattccgatccgcaaggcgggcaagctgccctacaaccggctcgcgcaatcttatgaactcgaatacggctgcgcaaccgtcgagattcacgaagacgcctgcaagcccggcgaccgcgtggtcatcatcgacgacctgatcgccacgggcggcacgatgatggccggcaagatcctgctcgaacggctcggcgcggtcgtggtggaaggcgcggcgatcatcgatctgcccgaactcggcggttcgaagctgctgcgcgacagtgggctggcgctctatacggtgaccggattc

SEQ ID NO: 31346 - DNA, 1218 bp, Burkholderia cepacia; identical to SEQ ID NO: 28588

SEQ ID NO: 31347 - DNA, 723 bp, Burkholderia cepacia; identical to SEQ ID NO: 28589

SEQ ID NO: 31348 - DNA, 1344 bp, Burkholderia cepacia
gcaagcgtttcggcgcggctcgaccgcctgcccccgacgcgctatttcagcggcctcgtcgcacgcatcgcgatcggcggctggttcgagttttatgaaatgttcatggcggcctatatctcactgggactcatcagcagcggcctgtatcgcgccaccacggccggcctgttcgacgtcgacggcttcgccagctttctcggctcgtttttcgccggaatgttcgtgggcacggtggcgctcggcggcttcaccgaccgcttcggacgccgcgccgtattcacctgcgcaatgctgatctattcggtcgcgaccttcgccgcggcgttccagcattcgccgcaagcgatggatctctggcgcttcgtcgcgggcctcggcatcggcgtgcagctcattactgtcgacacttatatttccgagctcacgccgcatcacacccgcggccgctacagcgcgttcagcatcctcgtgatcctgacttccgtgccgaccgtcgccgtactgtcgtttctgctcgtgccgcacaccatcctaggtctcgagggttggcgctgggtgatgatcatcggctcggcgggcgccgtgctgatctggttcatgcggcgcggccttccggagtcgccgcgctggctcgaaagcaaaggccggctcgacgaagcgcgcgcgatcgtcgacgcgatcgaggctcgcgtggtcgcggaaaccggccgcgcattgcaggcgccggcacagcgcgcgccgcaaccgttgaccggcgagcacggcggttcctggtcggagatgtggaaaggccgctatctgagccgcaccatcatgctgtcgttcttcaacttcttccagaccttcggcgtgtacggcttcggcgcgtgggtgccggtgctgctgtacacgaaaggcatcacgatcacgcattcgctgctctacacgatggtgatcgcgttcgcgacgccgctaggcgcgctcggtgcgatggcgtgtgcggagcgcatccagcgcaagtggcaactggtcggctgcgcgatcgtcgtggcggtggccggcgtactgttcggcatggtgcgcgagccgttgctgatcctgctgttcggcagcgccgtgaccatcgcgaacaactggctgatcggtatctttcacacctatcaggccgagctgtatccgacccggattcgcgcccgcgccgtcggtttcgtgtttagctggagccgtctgagttcgatcttcgtcggtttctgggtggcggcattgctcaagcattcgggcgtgcccgccgtgttcgtgctgatttcgtcagccatgttcgtgatcgtcgtgatggtcgggctgctagggccgaagaccaac

SEQ ID NO: 31349 - DNA, 1311 bp, Burkholderia cepacia; identical to SEQ ID NO: 28591

SEQ ID NO: 31350 - DNA, 1107 bp, Burkholderia cepacia
attctcgacatgctggaccgctttctcgaaaccgaggtgcgtccttacgtccacaagttcgatcatgacgatatctacccggcggagatcgtcgagaagatgaaggagatgggcctgttcggctgcatcatcgatcccgagtatggcgggctgggtctgtcgacgcggacctacgcgcagatcatcgcgcgcatctcgcgggtctggatgtcggtgagcggcatcatcaactcgcatctgattctcgcaatgctggtgcaacgcaacggcacgccggagcagaaaagcaaatacctgccgaagttcgccaccggcgagtggcgcggcggcatcggcctcaccgagcccgattgcggcaccgatctgcaggcgatccgcaccaccgcgaaacgcgtgggtgacgaatacgtggtgaacggcaacaagacgtggatcaccaacagcaagcatggcaatacgctggcgctgctggtgaagacggatacgacggcgcagccgcggcatcgcggaatgagcctgttgctggtgcagaaagggccgggattcgaggtcagccgtcagttggaaaagctcggctataagggtatcgatacctgcgagttgtcgttcaacggttaccacgtatcgaccgacgcgctgatcggcggtgtggaaggtaagggcttgcagcagatactcggcggcctcgaactcggccggatcaatgtcgcggcacgcggcgtcggcgtcgcgcaagccgcgctcgacgaatccgtcagttattcgcagcagcgcaaaaccttcggcaagccgatctgcgagcaccaggcgattcagttgaagctcggcgagatggcgacgcgtgtcgaagcgggccgcctgctggtcgacgccgccgcgcagaaatacgaccgcggtgagcgctgcgatatggaagcgggcatggcgaaatatttcgcgaccgaagcggcgctggaaaacagcatcgaggccatgcgcattcatggcgcgtacggctattcgaaggagtacaacgtcgagcggctgtatcgcgatgcgccgctcctcaccatcggcgaaggcaccaacgagatgcagcgcatcatcatcgcgaagcagctgatcgaa

SEQ ID NO: 31351 - DNA, 1608 bp, Burkholderia cepacia
tcaccgggcacaactatgcgttttctgcgtttcctcaagatttttttcacggtcatccgcttcggtctcgatgagatgatgctcagccgcgtcaacgaccggcgcgtgcgtctgctgttgcgcatcaccaccatcggccgcaagttcgacgcgccgccgggcgtacgtttgcggctcgcgctggaaagcctcgggccgatcttcgtcaagttcgggcaggtgttgtccacccggcgcgatctgttgccggtggatatcgccaacgaactggcgaaactccaggatcaggtgccgccgttcgattcggcggtggcgatcgggctggtcgagaagtcgctcggcgcgccggtcgacgtgctgttcgacgatttcgagcgggtgccggtggcgagcgcctcgatcgcgcaggtgcacttcgccacggtgaaggcggggcaacacgcgggcaaggccgtcgccgtgaaggtgctgcggccgaacatgctgccggtgatcgattccgaccttgccctgctgcgcgacatcgccgtgtgggcggagcggctgtgggccgacggcaagcgtctgaagccgcgcgaggtggtcgccgaattcgacaaatacctgcacgacgaactcgacctgatgcgtgaggcagccaacggcagccagttgcggcgcaactttgccggactcgatctgctgctggtgccggagatgtactgggagttctgcacacccacggtgctggtgatggagcgcatggtcggcgtgccgatcagccaggtggagacgctgcgcgcggcgggcgtggatattccgaagctggcgcgcgaaggcgtcgagattttctttacccaggtgttccgcgacggctttttccatgccgacatgcatccgggcaacattcaggtgagcctcgatccggcgcatttcggccgctatatcgcactcgacttcggcatcatcggcgcgctgtcggacttcgacaagaactacctcgcgcagaacttccttgcgttcttcaagcgcgactaccatcgggtcgcaacgctgcatctggagtcgggctgggtgccgccgactacccgcgtcgaagaactcgaaagcgcgatccgcgcggtctgcgaaccgtacttcgaccgcgcgctgaaagatatttcgctgggccaggtcctgatgcgcctgttctcgacctcgcgccgcttcaacgtcgagatccagccgcaactggtgctgctgcaaaagaccatgctgaatgtagaaggtctcggccgctcgctcgatcccgaactggatctgtggaagaccgccaagccgtacctcgaacgctggatgaacgaacagatcggcctgcgcggctggtacgagcgcctgaagatcgaggcgccacaatggagcaagacgctgccgcaactgccgcgcctgatccatcacgcgctggccgagcgccacgaccacacgcgcggcgcgaacgacgaaatgattcgccagattctgctcgagcagaaacgcaccaaccggttgttgcaaggcctgctgctgttcggtgtggcggtgggtgtcggcgcggcgctggcgcgggtgtttctggcgctcgcttacggcggctgaatgcaatccccagga

SEQ ID NO: 31352 - DNA, 1179 bp, Burkholderia cepacia; identical to SEQ ID NO: 28594

SEQ ID NO: 31353 - DNA, 1485 bp, Burkholderia cepacia; identical to SEQ ID NO: 28595

SEQ ID NO: 31354 - DNA, 1479 bp, Burkholderia cepacia
atccgttcggtcggcattgtcggctccggtgcgatgggccggggaatcgcgcagattgccgcgctcgcgggactgaacgtacacctgtacgacatcaggcaggacgccgtggaggccgcccgacaccatctccgcgatacgttcgcgacgcttgcgacgaaaggcaagattgcggtcaacgcggcaaccgacgcggtggcacgcatccggtccgcgacttcggtggacgcgttgaagaattgcgacctcgtgatcgaggcgatcgccgagaatctcgacgcgaagcgggatctatttacccggctcgacgcggtggttcgggaggactgcatcctcgcgtcgaatacctcgtcgctgtcgatcaccgcgatctcgaccgcgtgttcgaaaccgtcgcgcgtcgcgggattccacttcttcaatcccgttccgctgatgaaagtcgccgaggtcatcgacggtctgcatggcgtgcgggagaccggtgatcgcctgatggagctggcgcggcggatgggacatacgccggtgcgggtgaaggacatgcccggctttatcgtcaaccacgcggggcgcggaatgaacaccgagggcctgcgtatcgtgagcgaaggggtggcggacttcgtcgatatcgaccgtatcgtgcgcgagcaggccggcttccgcctggggccattcgaactgatggacctcacgtccctcgatgtatcgcatcctgtcatggagtcgatataccaccagttctatgaggagcctcgcttccgtccatcgccggtcaccgcggtccggctcgcgggcggccttgtcgggaggaaggccggcgaaggcttctaccgataccctggcggcaggaaggagatcccggacgaggggctcgttcatgccgcgttgcccgaacgcgtatggatcagttcgcgttcaatcgacgcgcaccggcaggtcaccgatctggtagcgccgaccggtgtaacgatcgagtcgggcgagcgaccgtcggaaagcgcattgatcctcgtgatgccgtatggcaaggacgccaccaccgccgcgctcgaagaagggctggacgcgagccgggttgtggcgatcgattgcctgttcccgcttagcgcatcgcgccgtcgcacgctgatgaccacgccgctgacgaatccgagctttcgcgacggcgcgcgcgcgctctgctcgcacggcggtgccgccgtgaccgttattcgcgactcggcgggattcgttgcacagcggatcgtcgcgatgatcgtcaacatcggttgcgatatcgcgcagcagagaatcgcgtcgcccgacgatatcgatctcgccgtgacgctcggtctcggctatccgaacggaccgctcgcgatgggcgacgctgtcggcgcggcgaggattctggagattctgcgcaacatgaccgcgctgctcggcgatccgcgataccgaccctcgccgtggttggcgcggcgggcgcaactg

SEQ ID NO: 31355 - DNA, 825 bp, Burkholderia cepacia
gtcgcgggcagcggcacgatgggcaccggcattgcgatcgtcgcggcccgcgccggtttccggaccatcgtgttcgacacgcgtcaggacgcactcgatcgcgcacgcgggcagaccgaagccttcctgcggaagtcggtcgcgcgaggcaagctcagcgtcgaggacctcgacgctattctcggacgatggtcgtcgacgacgaagctcgaggatctcgcgtcaggcgacgtggtcatcgaggccgtgttcgaggacctgcgtgtgaagcacgagctgttttccgcactcgacagggtctgcgccgccgacacgatcttcgcgtccaacacgtcgaccatttcgatcaccgaaatcgcaggcggctcggggcgcccggaccgcttcgtcggcatgcacttttgcctgcctgcccagttgatgaaactgatcgagatgtcgccgggtctcgaaacgagcgacgacacgtggcagcgagcgtgggagttcgcgttgcagatgggccagcagccggtcaagacgaaggacacgccggggttcatcctcaactatttcctgattccgtacaacaacgatgcgatccgtctcgtcgaggccggcgttgcggaaccggcggagatcgacagggcgatcaggacggcactgggctatccgatgggtccgctcgaactgctcgacctcgttggcatggacacccagcgcctgttgtgcgaggcgatgcacggcttgacgaacgaagaccgcgccgcgtgcccgccgctcgtgaagcggatgatcgcggcgaaacggctcggcaagaaaaccggccacggtttccatcgatac

SEQ ID NO: 31356 - DNA, 1377 bp, Burkholderia cepacia; identical to SEQ ID NO: 28598

SEQ ID NO: 31357 - DNA, 1086 bp, Burkholderia cepacia
aaagttgccttgattaccggcgttacaggtcaggacggctcgtaccttgcggaattactgttaagcaagggctatgaagttcacggcataaagcgccgttcgtcgctgttcaatacggaacgaatcgatcacctgtaccaggagccgcatgcgtccgatcgccgcttcgtcctgcaccacggcgatctgaccgattcgacgagcctcgtgcggatcatccaacgcgcgcagcccgacgagatttataacctcggggcacaaagccacgtcgcggtctcattcgaggagccggagtatacggcgaacgtcgacggtgtcggcgcactgcgcattctcgaggcgatcaggattctcggcctcgaaaagaagacgcgcttctatcaggcctcgacgtctgaactctatggattggttcaggaaatcccccaaaaggaaaccacgcctttctacccacgtagtccgtatgcggtagccaagctgtacgcgtactggatcacggtcaactaccgcgaggcgtatggcatctacgcgtgcaacggcattctgttcaatcacgagtccccggtgcgcggcgagacctttgtgacgcgcaagatcacgcgggcgatctcccgcattgcaacaggcctgcaggagtgtctgtacctcggcaacatgtccgcgctgcgggactggggccacgcgcgcgactacgtcgagatgcaatggttgatgctgcaacaggaacagcccgaagactttgtgattgccaccggcgtgcagtacagcgtgcgtcagttcgttgagcaggccgctgcggaactggggatccatttgcgctttgagggatcgggcgtcgacgaggtgggcattgtcgagcgtgtcgtagggggagacacgaaagtagtgcggggtgacgtgatcgtgcgtgtggatccgcgctatttccgcccggccgaggtggaaacgttgctgggtgatcccaccagggcgcacgaaaagttgggctggaaaccggctacgtcgttcgaatcactggtcacggaaatggtgcgcgccgactatcaggtcgcgaagcgggatgcgttggtgacgctggcgggtttc

SEQ ID NO: 31358 - DNA, 915 bp, Burkholderia cepacia
aaagttaccaaggctgtgtttcccgtagcgggtcttggcacccgatttcttcctgctacaaaggcgagcccgaaagagatgctgccgatcgtcgacaagccgctgattcagtacgcggtcgaagaggccatggcggccggcatcaccgaaatgattttcgtcactggccgcagcaagcgcgcgatcgaggatcacttcgacaagtcctacgagatcgaggccgaactggaagcgcgcggcaaggacaagctgctcgaactggtgcgcagcatcaagccgagccatgtcgattgcttttacgtgcgtcagtcggaggcgctcggcctcggccacgcggtgctgtgcgcagaaaagctggtcggtgacaacccgttcgcggtcattctcgcggacgatcttctgcacggcacaccgccggtcatgaggcagatgatcgaagcgttcgatcactaccatagctcaatgataggcgttgaggaaatcccgtcgcaggataccggctcgtatggcgttatcgatggatcggaatggggggactcgatcatcaggatggcgggcatcgttgaaaagcctgagccgaatgtggcgccttcgaacctgggtgtagtggggcgatacgtgctgaagccgcgaattttcaagcatctgcgcgccatcaaggccggcgccggtggggaacttcagttgacggatgcgatccagtcgctgcttgccgatgaacaggtgctggcatacaagtaccacggcacacgctttgactgcggtagcaagctgggttatctgaaggccacggtggaatttgcgttacggcatcctgaggtacgttccgaattccgtgcgtaccttgagaaacatctatctctcctgcagatgtgaattgccataatcgcgggtggccgggcgcctttgtcaccg

SEQ ID NO: 31359 - DNA, 1341 bp, Burkholderia cepacia; identical to SEQ ID NO: 28601

SEQ ID NO: 31360 - DNA, 1158 bp, Burkholderia cepacia
ttgcagacgcgggtcctgcgcgcaggctcgccgccgttcgacagcggcgccgcgccggtgaacgtgccggtcgtacgtgccagcacggttcgcttcgagcgcgacgcggagcgcgccacgttgcatcgccggcgcgaggcgggcgaagccgtcagcacttacgggcgacacggcatggcgacgcatcgcgcgctcgaagcggcgctcggcgagctcgaaggcgcgagcgatgtgctgcttgcgccgtcgggactcgcggcgatttcgctggtgttcatcgcattgttgtcgccgggcgatcatgtgctcgtgcaggacagcgtctatggtccagtgcgcgaacgcatcgagccgctgctgacgcggctgggcgtgtcgttcagctacttcggcgcgagcgacggcgtgcctgcggcgctgctgcggccgcaaacgcggctcatctatgtggagtcgccgtcgtcgttcctgtatgaagtggtcgatctgccggcgctggcggctttcgcgcgcgaacacggcgtgttgctcgccgcggacaacacgtggggcgcagggctgctgtatcggccgctcgcgctgggcgcggatatttccgtgcaggcgacgaccaagtatcccggcggtcactccgatctgatgcaaggagcggtctcgacagccgatgcgaagctggcgaggcgtctgcgcgacacgcacgacgcgcttggtctgagcgtcggcgccgacgatgcctatctggcgcttcgcggcctgcgcacgctcgccgtgcgcctcgcgcagcacggccgcaatgcgctcgaagtcgcgcgctttttgcaaaccgggactcgcgtggtcgcgcgggtgtttcatccggcgttgcctgaccattccggccacgcactgtggcagcgtgatttcaccggcgccaacgggctcgtttcatttgcgttccgtcacgcgcaaccggccgacgcgagcgcattcgtcgacgcgctgcggctattcggtatcggtgcttcgtggggcggctatgaaagcctggcgttgatcgcgccgtccgcacggctgcgcgagcacagctattggcgcggcgacgtacccgtcgtgcggctgcatatcggcctcgaagatccggccgatctgatcgacgatcttagccaggcatttcgccgc

SEQ ID NO: 31361 - DNA, 2055 bp, Burkholderia cepacia
atgatgttgcagactcaggccgccgagtgcggactggtttgtgttggcatgatagccaactacttcggccacgatatggatctggcaagcctgcggcgccgtttcacgacgtcgctcaaaggcgccacgctgaatgacatcatgcagatgtccaaccagctcggcttgacgccgcgggcattacggctggatctgaatgatctggcaaagctgaatcgtccgtgcattctccattgggagatgaatcactttgtcgtgctcaaggaggtttcgcgcgacaagatcacggtgcatgatcctgcgcgcggcattcgcgatattccgatggacgaggtatcgcgcggatttaccggcgttgcgctcgagctgatgccatcggcgtcgttccagccggttgcggaaaagcagtcgatctcgatgcttaaacttatcggcggcgtaatcggcatacgttcggcgtttgtacaggttctgcttatttccgccgccctggaggtgtgcggcatcatctcgcctttctatatgcagtgggtgatggaccaggttctggtatccgccgacgtggatctgctgacgctgcttggcatcggtttcctgatgctggtggtgttccagaatgcgattgcggcgctacgttcctgggtcgtaacgtggttctccagcctgttgagcgtgcagtggacagcaagcgtctgttcgcatttgctgaaattgccgatgtcgtatttcgagcagcggcatatgggagatattgtttcgcgcttcggttcggtcggaacgatccagagcatgctcacttcccgttttatcagcacgctgctggacggcgtgatggcgagcattaccctcgtgatgctgttcgtctatagccccatgctcacgtggcttgtgcttgggctgtttgccgtctatgcgctgatccggtggattgcctacagaccgctgcggcgagccaatgaagatcagatcgcgtattcggcacgcgcgcagtcgcaactgctggaatccattcgtggcgttcagacgatcaagctcgggaacaagcaggaagcacgcgtggctacctatacgaactccgtggtcgatatgaccaatcggggcattgccatccagcgcctgtcaatcagcttcagtacgctgcaaggcgtcatttcggggatcggccgcgtggtgctgatctggctggccgcccgtcaggtcctgcagaacgagttctccgccgggatgctggtggcgttcatcagctttgctgaccaatttacgtcgcgcgcgtccggcctgatcgacaccgtcatcgatattcgtatgttgcgtctgcatggggagcgtctggccgacatcgtcctcacggaaccggaaagcaacatggaggggtccgtcactcgcgcgaacctggttgaagaagccaaagaccgtgcgcccggcatcgaagtctccaacctgcgtttccgctatgctgatacggaaccctgggtgatcaaagactgttcgttcacagtcgagccgggggaatcggtcgcactgattggcccgtccggccagggtaaaaccaccatggctaaactgctgctcggtctcctgatgccgcaaaaaggcgaaatcagggtggatggcgtggacatcaaaaagctggggatgcttggctaccgcgacatgattggctcggtcatgcaggacgacattctctttgccggttccattgccgacaacatcagctttttcgatacccatcctgattacgcgcaagtcgagagagtggcgcgaatcgcgcagattcacgacgaaatcacggctatgccgatgggttatcaaagcctggttggcgacatgggatcgtcgctttccggtggtcaggcccaacgcgtcctgcttgcacgggcgttgtaccgcaacccgtcaattctgattctcgacgaagcgacaagccacctggacgtggatcgcgaacggctgatcaacgatgcgatccgcaatatggaggtcacgcggatcatcattgcgcaccggccggagaccatccgcagcgcggatcgcatcattgccatgcagcaaggc

SEQ ID NO: 31362 - DNA, 1434 bp, Burkholderia cepacia
atgtatatcggcggcgagtgggtagagccggcgtcgggcgaatatttcgaaacggtggatccattcacggcgaagccctgggcgctgatcccgcgtggtaatgccgaagacgccgaccgcgcgatacgcgccgccgacaaggcgttccgcgacggcccgtggcgtgccatgcatccgtccgagcgcggtttggtgctgcagcgcttcggccaactcatcgggcaacatgccgacgaactggccgggatcgaggtgcgcgataacggccggctgttggccgagatgcgccatcagatcagaggcatcccgaaatggtattactactacgggggactggcggacaagatcgaaggcgccgtacacccggtcgagcagccggcgctcagcttcacgcggcacgagccgctcggcgtgtgcgtaggcatcgtgccgtggaatgcgccgctgctgctgctctcgctgaaggcggcgccggcgctcgcggccggcaacaccatcgtgctgaagccggccgaatttacgtcagcgtcggcgctcaagctcatggaactggtggagcaagccggttttcctcccggcgtcgtcaacgtggtgaccggcttcggcaaagaggtgggcgagccgctggtcgcgcatccgctgacgcggcatctgggtttcaccggctcaacggccaccggctctcacctctatgcgctcgccgcgaaggacgtgaagcgcgccagcctcgagctgggcggcaaatcggccaatctcgtcttcaacgacgccgatctgaacaatgccgtgcgcggggtggtcggcggaattttcggggcagtcgggcagacctgcattgccggctcgcgcctcctggtgcagcgccgcatccacgacgaattcgtggacaagctcgcggctttcacgaaaacggcgcgcatcggcgacccgcgcaaaccggaaacccagatcggtccgatcgccaaccggatgcagtacaacaagatcctgggctatatcgacatcgcgcgcgaggagggcgccgagctggtgatgggcggggcgcgccccgatatcgccgagtgcggggaaggattcttcatcgagcccaccatctataccggcatccgcaacgacatgcggatcgcgcgcgaggaagtgttcgggccggtgctcgccaccattcccttcgatgatccggaagaagccatcgccatcgccaacgacagcgacttcggattgggtgcgggtgtatggacctccgacatgcgactggcactcaggatgagtgagcggctggaggccggcagtgtctggatcaacacctatcgcgacatttcgtatacgacgcccttcggcggctacaagaaaagcggcatcggccgggagaacggcatcgagggcattcgcgaatatctgcagaccaaggccgtctggatctccacagcggaagaa

SEQ ID NO: 31363 - DNA, 1083 bp, Burkholderia cepacia
gccgcaggctatgaccgcgaaaaccgcttcttcgccggtgacctcgaagatctgcaacgcgtcggcttcctgcgcgcgagcgtacccgtcgaactgggcgggctcggcttgacgctgccgcagctgctgcgcgagcaggtccggctcgcgacgcgcgcacctgccaccgcgctcgcgctgaacatgcatttatactggatcggcgcggcgctgcatttgtatcgacgcggcgacgcgtccgcgcgatggatcctcaccgaagccgccgcgggcaaggtctttgcagccggccacggcgagcccggcaacgatctcggcctcgctcattcgttcgtcaaagccacgccgctgggcgacggcggttatcgtttcgacggccgcaagatcctgacgtcgcttgcgcccgcatgggactggctcggcgtgcacgggctcgacgactccgatcctgccgcgccgaaaatcgtccacgcgttcattcatcgcgacgccgccggacatcgaaccgtggaaacgtgggacgccctcgggctgcgtgcaacccgtagtgacgacacctatctggaaggtgcaatcgcgcagcaccagcatgtgattcgcgttttgcccgcgggcattccggacgacccgttcgtcgacggcattctgggcgccgtgctgcccggccttgccgcggtgtattacggcatcgcaaagcgggcgctcgaactggccatcgcgacggcaaagacgcgcacctcgcaggcgctggccggaaagacgtatgcatacaagccgttgacgcaactcagcgtggcacaggcggccatcgaactggacagcatcgaagcgctcgtcgaacgtgtggcggcgcaatggtggcaaggctatccggacggcgagccgtggatcgccagattgctcgcgtcgaaacagcatgcggttgacggcgcgttgcgcgtcgtcaacctggcgctgaaaatcgcgggcgccggcgcgctctcgaagaacaacgaactggaacgactctatcgcgatgtgcgtgccggcgcgtttcacccgccaaacgccgatgcgacgcatgaagtgatcggccaggcgtgg

SEQ ID NO: 31364 - DNA, 2256 bp, Burkholderia cepacia
tatcagcatgccagcggagggtggggatcgctaaaggcggtcgcgagcgcattgatccaggaaaaagcgccggtcgaaacgagccgtgtgctcgtgcatcaaaacaagccggacggcttcatgtgcgtcagctgttcgtgggcgaagcccgcccatccgcataccttcgagttctgcgagagcggcgccaaagcgaccgcctgggacctcacgtcgcgccgcgtgaatcccgaattctttcagcagcacacgctggctgaactggagcaatggcacgatcaggcgctggaagacgcgggccgcctctgcgcgccgatgcggtgggacgcggcactcgacaaatatgtcgaggtcacatgggaacacgcgttcgcagagatcggccgcgagctgcgcgcgatcaagcccgacgaagcggtgttctacacgtccggccgcgcatcgcttgaaactgcgtatatgtaccagctttttgcacgcatgtacggcacgaacaacctcccggacagctcgaacatgtgtcacgaaagcacgagtgtcgggctcaagcaggcgattggtgtcggggttggcacgatcacgctggaggacttcaagcataccgacctgatgttcttcttcggccagaacgtcggcacgaacagcccgcgcatgctgcacgatctgcaggaagcgagagagcgcggcgtgccgatcatcacgttcaatccgatccgcgagccgggcctcgtgagcttcgtgaatccgcagtctcccacgcaaatgctcaagcccggcgcgacgcagatcagcacgcaataccatcagctcaaagcaggtggcgattcggcggcgatagtcggcatctgcaaggccgtgatcgaagcggacgaccgcgcgcaagccacaggcgcggcacggatcgtcgacgccgggttcatcgcggaacatacgagcggctttgacgatttcgcgcgctatgtaagaaatgcccgctgggacgagctcgagcgcatctgcgggctgacgcgcgccgcgctcacggcggccgccgacgaatacatgcgcgccaaggctgtgatcatccactatgggatgggtctcacccagcaccggatgggcgtgcagaacgtccgcatgatcgtcaatctgctgctcctgcgcggcaatatcggcaagcctggggcggggccgtcgccgattcgcggacattcgaacgtgcaaggacagcgtacggtcggcgtgacggagaagccggaactggcgccgctcgacaagctcgccgagcagtaccacttcacgccgccccgcaaggaaggcatggcgaccgtcgacgcatgcaaaggcgtgatcgacggcaaggtgcgcgccgtcttccagctaggcggcaacctcgtgcgctccgtgcccgatcgctatgcgatcgagcccgcgtggcgcaagctgcgtctgactgtcagcatcgcgaccaaactcaatcgcagccacctcgtgcatggcgaagtgtcttatctgctgccttgcctgagccgtatcgaaatcgacgaacgcatgggcaacgcgcaggcggtcgcaatggaagacagcaccggctgcatgcatggctcgcacggcgtcgcgcagccggcaagcgaccagctgttgtccgagccggcgatcgtcgccgggatagcgaaggcggcgctcgattcgacgtcggtggactgggacgcgtggagcaacgactacgcgctggttcgcgacgccatcgccgagacttatccggaaatcttccacgacttcaacgcgcggatgtggacaccgggcggttttcatcgtccgctgcccgcacgcgagcgcaagtgggagacgaaaagcggcaaggctgagttcatggtgccgcaaacgctcaacgaagatcccgacatgcccgaacgccagcctgacgacttgcgcctcttcacgctgcgcagcgacagtcagttcaatacgacgatctatacattggacgaccggtttcgcggcgtccggggcacgcggatggtgctactgatgaaccggcgcgacatcgagcggcatggcctcgaggctgacgccgaggtgtcgctggaggcggtctcgccggacggcatcccgcgccgggtcgacggctttcgcatcatggagttcgacctgcccgccggctgtgtggccggctactaccccgaatgcaatccgctgattccgctgtcgcaccacgcgaaggaaagcaaggtgcccgccgcgaaggcgattccggtgagaatcgtcgccgcgcaa

SEQ ID NO: 31365 - DNA, 1128 bp, Burkholderia cepacia
atgaaagcattggtatatgaaggtccgcgcaaagtcaccgtgaaggaaatgccggatgcgaaaatcgagcgccccacggacgtgctcgtcaagatcaccaccaccaatatttgcggctcggacctgcacatgtatgaaggccgcacgaacatggaaacaggccggattctcgggcacgaaaatctcggcgtagtcgtggaagtcggcgcaggcgtcgaacggatcaaggtcggcgatcgggtctgtttgcctttcaatatcggctgcggtttttgcaagaattgcgagcgcggcttgaccggcttctgcctgaccacgaaccccggcatggcgggcgcggcttacggattcgccggcatgggcccctatagcggcggacaggccgaatatctgcgtgtgccgttcggcgatttcaattgtctcgtgctgccgcccgacgcggaagaaaaggaaaacgactacgtcatgttgtccgatatttttccgaccggctatcacgcgacggttctcgccggagtcgaacccggcgacagcgtggtgatctacggcgcgggaccggtcggtctgatggcggcgttgtccgcatcgatcaagggtgcgagcaaaatcatggtggtggacagccatccggaccggctcaagctggcggaaaaaatcggcgcgattcccgtggacgatactgacggctcatcggccgagcggatcctcgaaatgaccggcggcgagggcgcggaccgcggctgcgaatgcgtcggctatcagtgcagctgcaagggccatgaagtgccgaacctgaccatgaacaacctcatcaaggcggtgcgcccgacgggcggcatcggcgtggtcggggtattcgtcgccgaggacccgaaggccggggatgagcttgcgaagaagggccagctcgccctcgacttcgggcagctatggatgaaagggcagcacatcgcgaccggccaggccaacgtcaaggcatacaaccgcaagctgcgggatctgatcgcagccggcaaggcgcggccctcgcagatcatctcgcacgaactgccgctcgataaagcgccggacggctacaagcacttcgacgaacgtgacgacggctggacaaaagtggttctcaagccc

SEQ ID NO: 31366 - DNA, 1077 bp, Burkholderia cepacia; identical to SEQ ID NO: 28608

SEQ ID NO: 31367 - DNA, 1275 bp, Burkholderia cepacia; identical to SEQ ID NO: 28609

SEQ ID NO: 31368 - DNA, 1392 bp, Burkholderia cepacia
gtcgatggacgctgggtgcacagcgcgagcgcggcgagcgtcgccgtgcacaatcccgccgatcagcaggtgcttggccatgtgccgatgctcgacgccgcgcagatcaccgaagccgtcggcgccgcgcagcgcgcgttttccacgtggcgctggctgccggtcagccagcgttcggcgctgctgttgcgctggcacgagttgatcctgcgccatcagcatgatctggccgcgattctgtcgctcgaacagggcaagccgctcgccgaagcgcgcggcgagatcgcctacggcgcgagtttcgtcgaatggttcgcgcacgaggtgcgtcgtttgaacggccggacgattccgacgcatatcgacggcgcgcatctcggcacgatgatcgagccggttggcgtcgcggcgctgatcaccccgtggaattttccttgcgcgatgatcacgcgcaaagcggccgccgcgctcgccgccggttgcacggtggtggtgaagcccgcgcacgaaacgccgttttccgcgctcgcgctcgcgcaactggcggaagaggcgggctttcccgccggcgtgttcaacgtcgtgctcggcgagccgcaaatggcgatggaaagactggtcggcgacagccgggtgcgttcggtgagcttcaccggctccacgcgcgtcggcgcgctggtcatgcaggcggcggcgcgcgccggtatcaagaagacggcgctggaactcggcggcaacgcgccattcatcgtgacgggcgacgccgacctcgaccaggccgtgcgcgtggcggtcgcggcgaagtttcagacctcggggcaggattgttgcgcggcgaatcgcattttcgtcgcgcggccgctgtacgaagcgttcgtcgcccaatacagcgacgccgtcaaggcgctgaaagtcggcgctgcgttcgaagcgaacgtggacgtcggcccgttgatgcatcaagccgcgttcgacagcacggcgcaacgcgtcgcggacgcgaaggccaggggcgcgcgcattaccgccggcggcggcgcgcacgaacgcggcggctggttcttcgagccgaccgtggtcgcggacgccgcgcccggcatgcgcatctacgacgaggaaaatttcgcgccgatctccgcggtgtcgcctttcgattcgctcgatgaggtcgtcgaacgcgcgaacgataccgaatatggcctcgccgcttatgtctgcgcgcgggacctcaacacggtgtttcaactgatccgccgtctggacttcgcgatggtgtcggtgaacggcgcgaagttcactggagcgccgattccattcggcggcatcaaatcgtcgggcctcggccgcgaaggcggggccgagggcttcgagccgtttgtcgaaacccgctat

SEQ ID NO: 31369 - DNA, 750 bp, Burkholderia cepacia
ttatccggcaagcgcggactggtcgtcggcatcgccaacgagcacagcatcgccgccggttgcgcgcgcatgttccgcgccatcggcgccgagatcgccgtcacctatctgaacgacaaagccgagccttatgtgcgcgccgtcgccgaaacgctgccggcgagcctcgtgatgccctgcgacgtgaccgtgccgggccagctcgaagccgtcttcgcgcgcatcagccgggagtggggcaagctcgacttcgtgctccactcgatcgccttcgcacccgccgtcgatttgcacgcgagcctcgtcgattgttccgccgagggtttcgcgctcgcgatggacgtgtcgtgccattcgttcatccgcatgacgagactcgcgttgccgctgatggccgaaggcggcagcctgatgaccgtgagtttctacggtgccgagcgggcggtcgaccactacaatctgatgggtccggtcaaggcggcgctcgaatcgagcgtgcgttatctggcggtggatctcgcgcctcgccgggttcatgttcacgccatttccgccggtgccgtcaaaacccgcgcggcgtccgggctcgatcatttcgatgtgctcctcgacgaagtccgcgcgcgcacgccggccagacaccttgtcacgatcgacgaaatcggccgcatcgcggctgtgctcgccagcgacgccggcatgacgctgaccggctcgaccctgtacgccgacgccggctttcacgtggtg

SEQ ID NO: 31370 - DNA, 1395 bp, Burkholderia cepacia
cctatctccagtccgaactgctcgcccatgacacagaccacgcctgattcccgcgaggatgcctggctcgaacgcagccgcgcaacgcttgcaaaagcacagccgggcgcgcgcgccgaagccgtcggccgggtcgagcacgtcgccgacggcatcgcactcgtttccggcctccccgacgtgcgcctgaacgagttgctgcgcttcgagggcgaccggttcggcttcgcgctgacgctcgacgccgacaccatcggcgcggtattgctggacgacgccgacgcgattaccgccggttcgatcgtcaccggcaccgggcaggtcgtccaggtgcccgtcgggccgggcctgaccggccgcgtcgtcgatccgctcggccgcccgctcgacggtcgcggcgctgtgcatgcggacgcgcggatgccgatcgaaaggcccgctccgagcatcatcgagcgcgatctggtggccgagccgctcgccaccgggatcctgttgatcgatgcgttgttcgcaatcgggcgcgggcagcgcgagctgattatcggcgaccgggcgaccggcaagaccgcgatcgcgatcgatgcgatcgtcaatcagaagaacagcgacgtgatctgcgtctacgtggcgatcggccagcgcgcatcggcggtcgaacgcgtgatcgcagcggtgcgcgagcacggcgcgcccgaacgctgcgtcttcgtgttcgcttcgtcggccgcctccgcggggctccagtggatcgcccccttcagcgcgatgacgattgccgagtacttccgcgaccgtggccagcacgcgctcgtcgtgatcgacgatctgacgaggcatgcggccactcatcgcgaactggcgttgctcacccgcgagccgccgggacgcgaggcttatcccggcgatatcttctatctgcatgcgcgccttcttgaacgcgcggcgaagctctcgccggagcgcggcggcggttcgttgacggcgttgccgatcgcggaaaccgatgcgggcaacctgtccgcgtatatcccgaccaacctgatttcgattaccgatgggcagatcgtgctggataccggcctgttcgccgccaaccagcggcccgcaatcgatgttggcttgagcgtgagccgcgtcggcggcaaggcgcagatgccggcgttgcgaaacgtgtcggggcgcttgcgtctggactattctcagtttctggaactggagatgttctcgcgcttcggtggcctgaccgaggcccgtgtgaaggcgcaggtcgtgcgcggcgaacgtatccgcgcgctgattacccaaccgcgcttcacgccgctgcgtcccgtcgacgaggtcgcgcttcttggcgcgctggccgaaggcgtattcgacgcgctcccggtcgac

SEQ ID NO: 31371 - DNA, 822 bp, Burkholderia cepacia
ctcagcgaagttcagggccggatttcgagtgtccatgaactcgaatcggtagtgagcgcaatgcgcggcatcgctgctgcccgttcgcgcgaagcgcaaagccgcatcgaagccattcgcgcgtgcgcccgcacggtcggcaacgccatcggcgacgcgctgatgttcgaacagcatgacgaaccgcaagcgccgccaggacatgccgccggtaacgaggtcgtcattgttctgtgcgctgagcagggtttcgtcggcaccttcaacgaacacgttatcgaagccacggcgcgccgcgttgcatcgcgttcgaccgaattcttcctgatcggtgcgcgcggcatcgcagtcgccgccgaacatggtctgacgatcggctggtccgcgccgatggtcgcacacgccgatgaagtgcccgcgctggccgaccgcatcactgcggcgctgtacgagcggttgaacgcgggacaggcgacgcgcgtgacactgctgcatgcggtaccgaatccgtcggtgacgatcgaggtggtcaaaaccgctttgtggccattcgatttcacccgcttcaaacaggcgcttcgggccaatccgccgctcatcacactgacgccggaaatactgctggcaaagctcgccgaagagtacatcttcgcgcagctttgcgaggcgatcatgctgtcgttcgccgcggagaacgaggcccgcatgcgcgcgatggtcgccgcacgtaccaacgttcacgacaccctcgacgaattgatcggagagtcccgccgcctgcgacaggacgaaatcacgtcggagatcgtcgaattgtcgtcg

SEQ ID NO: 31372 - DNA, 1029 bp, Burkholderia cepacia
ctgcacctgtcgagcaacgactatctcgcgatcgcccggcacccggacattatcggcagcatggccgcgacgctgcttgagaacggcaacgggttgttgatgtcgggcattttcctgcacggcgattgccctcaactccagttcgaaaaccggcttgcgacgttcatgcaggcggaggcgggcgtgctgtgccagtcgggctacgcggccaataccgggctgatccagtccatcgcgtcggagcagacgccggtctatatcgacatgatggcgcacatgtcgttgtgggaaggcgttcgcagtgcgggcgcggtgccggtcgcgttccggcataacgacgccgcgcatctcgagcagcagatcggacgctatgggcaaggcatcgtgctggtggactcggtgtacagcacgactggcagcgtatgccggctcgtctcgctcgcggacgtatgcgaacggcacgcgtgcgtgttcgtcgtcgacgagtcgcattcgctcggcacgcacggtccgcgtggcgcagggctcgtcgtcgaactcggactgcagtcccgtgtcgcgtttcgcaccgccagtctcgcgaaggcgtttgccggcagagctggtttcattagctgtccggtcgatttccaggagtacttcaagttcgaatcgaatccggccattttcagttccacgctattgccgcatgaaatcagcgggctcgatgcgacactgtcggtgatcgaatgcgccgaccggcggcgcacgagactcgcgtcgagcgccgcatggctgaggcagcggttgacggaactcggatacaacctgaacggcagcaggagtcagatcatcgccctcgaagccggtacggagcagcgcacgatcgtgttgcgcgacgcattggagtcgcgcggcattttcggctcggtgttctgtgcgcccgcgacggcacgaaatcgggcgctgatccgcctgtcgatccacgcggcgctgagcgacgcccaggtcgaaaagattgccagcgtctgccgtgacatccgtagcgag

SEQ ID NO: 31373 - DNA, 735 bp, Burkholderia cepacia; identical to SEQ ID NO: 28615

SEQ ID NO: 31374 - DNA, 1596 bp, Burkholderia cepacia
caacccgtgagccaggaacagctcgaccgggcagccaccacgtcgaacgactggctgctttcgaacggttcgtacgcgcagacgcgctactaccgcggtgcacaaatcaacaaaacgaacgtgtcgaaactcaggccggctttcatcttccagacagccgtcaacgagtcgatggaaacggcgccgatcgtatcgaacggcgtgatgttcattaccacctcgtttaatcacgtgtatgcggtcgatgcggtgacgggcaaggaattctggcactacaagcacaagatgggcgcggtcactacgttttgttgcgggcccaacaatcgcggcgtggccatagccggcgaccgtctctacatgggcaccctcgacgcgaagctcgtcgcgctcgacgcaaaaaccggcagcgtgttgtggcaaacgcagatcgccgatcccgatgaaggctattcggaaacgatggcgccgaccgtggtcgacggcaaggtgttgatcggcacgaacggcggcgaatatggcattcgcggtttcctcaaggcgttcgacgcaaactccggtcaattgctgtggaccttctatacgattccggaaaccggccaggaaggtgtgtgggccacgaaggacgctaccggccgcgacgggaagcgcgacatcgacgccgagaaaaagcagcttgccgagaaaggcggcgacttctacaagacgctcggcggcggcgtgtggatggcgcccgcaatcgatcggcagacgcatacggtgttcttcgtcgtcggcaatccctcgcctgacctgtatggcgcaatccggccgggagacaacctctatacggattcgctcgtcgcgatcgatctggacaccggcaaatacaaatggcactaccagtatgtgccgcacgacgtgtgggacctggacgccgtgagcccgccgatgctgatcgacgtacgcgacaacaacggcaggatgattccgggcgtggtgcacggcggcaagaccggtcacgtgtacgttcacgatcgcgcgactggacggctgatccgctattcgcaggcgatgattccgcaggagaacatgtggacgttgccgaccgccgccggcgcgcggatgctgcctggcgcgaacggcggagtcgagtggtcgcctatggcattcgatccgcacacgcgtctcgtgtatgcggccaatctgcatcagccgatgacgtatcaggtcgaggacgccgcctatccgggcggcagcaagctgtggctgggcggcgcgttcaagacgatcgcgtccgaacagcaatggggcaagctgtccgccgtgaacgtcgatacgggtaaggtcgcgtgggactacaaaaccgagcagccgctcatcggcggcgtgctgacgacggcgggcggcctcgtattcaacggcgaaggcaacggcctgttccgcgcattcgattccgccacgggcaagaaactctgggagttccagtgcggcgccggcgtcaatgcgcccgcggtgtcatacatggtgcacggcaagcagtacatcgcggtcgcggcgggcggcaatacgcagctcgacttcaagcgcggcaacaccgtgctcgtctttgcgttgcca

SEQ ID NO: 31375 - DNA, 1776 bp, Burkholderia cepacia
ctcgcgatcctcgcgtcggcagccttgagttcgttcgttgcacaggccgattcgcagctcgacgggctcatgaagaatccgtccaactgggccgcgcaggcgggcgactatgccaaccatcgctacagccctctcaagcagatcaacgaaaacaacgtcgggaaactacaggtcgcgtggaccatgtcgaccggcgtgctgcgcggccacgaaggcgcgccgctcgtgatcggcgacaccatgtatatccactcgccatttcctaacaaggtaatcgctatcaacctgaaggatcagacgttcatctggcagtacctgccgaaacaggacgatcaggtggtgtccgtgatgtgctgcgataccgtcaaccgcgggctcgcgtatggcgacggcaagatcttcctgcagcaggccgacaccaaactcgtcgcgttgaacgccaaaaccggcgacgtggtctggaccgcgcaaaacggtaatcccaaggcaggtgaaaccaacaccaacgcgccgcacgtattcggcgacaaggtgcttaccggcatttccggcggcgagttcggcgtacgcgggcgtctcatcgcgtacgacatcaagaccgggaaaccggcctggacggcctacagcacgggcccggacaaggacatgctgatcgatcccgacaagacgacgacgtatgccgacggcaagatggtgccggtgggcgcggactcgtcgctgaagtcgtggaagggggaccagtggaaactgggcggcggcaccacctggggctggtacgcgtgggatccgaaactcaaccttgtctactacggcaccggcaatccgggtacatggaatccgacgcagcgtccgggcgacaacaaatggtcgatgtccatctttgcgcgcgatctgaataccggtcaagccagatgggtctaccagatgacgccgcacgacgagtgggactatgacggcgtcaacgaaatgatcctgtcggacctgtcgatcgacggcaaaaaggttccggctatcgttcacttcgaccgtaacggtttcggctacacgttgaatcgcgagaccggccagttgctggttgcgcagaagttcgacccggcggtgaactgggccgatcacgtcgacatgaagagcggcaagccgattcgcaacgccgcctattcgacgcaggcagccggttcggaccacaacgtgaagggcatctgtccggcggcgctcggctcgaaggaccagcagcccgcggcgtacgaccccggttccagcctcttcctcgtgccgaccaaccacgtttgcatggactacgaaccgttcgatgtcgactacgtgtcgggccagccgtatgtgggcgccacgctgtctatgtatccgggcccgaacgacaacaactcgatgggtaacttcattgcctgggatgcttcgaagggcaagatcgtctggtccaagccggagcggttctcggtatggtcgggcgtgctggccaccgcaggcggcgtggctttctacggcacgctggaaggctacatcaaggcagtccgcatcaaggacggcaaggaactgtggcgcttcaagacgccgtcgggaatcatcggcaacgtctttacctacgagtatcagggcaagcagttcatcggcgtctactcgggtattggcggctgggccggtatcggcatggcggcgggtctcgagaagtcgacggaaggcctgggcgcggtgggcggttatcgcgagctcgcgaagtacacggcattgggcggcacgctcttcgtgttcgccattccc

SEQ ID NO: 31376 - DNA, 1032 bp, Burkholderia cepacia; identical to SEQ ID NO: 28618

SEQ ID NO: 31377 - DNA, 1980 bp, Burkholderia cepacia; identical to SEQ ID NO: 28619

SEQ ID NO: 31378 - DNA, 1104 bp, Burkholderia cepacia
cgtacgaccctttcgaaatttctgatcgacaccctcgaccgccagccctgttcgacggaaacggcgcgcaacgccggcctttcggcgctgctgatcgacgtcgccgccgctatcaagtcgatctccgcgatgctcaccaaaggcgcgctcggcggcaactacggctccgcgcagagcatcaacacgcacggcgaggaacagaagaagctcgacgtcgcgaccaatgaaatcttcgtgcagcaatgcgagtgggacggactgctcgccgcgatggtgtccgaggaaatggagagcgtctatgcgattccgccgggctatccgcgcggcgattatctgctcgctttcgatccgctcgacggttcgtcgaatatcgacatcaacggcgtggtggggtcgatcttttcggtgctgcgcaatggcgagggaaatggaaatgccaatgaaaaaaacggcagcgatccgcgcggcacggtcggcgagtccgcgtttctgcggccgggctgcgagcaggtggccgcgggctacgccgtctacgggccatcgaccatgctcgtgctctcggtcggcaacggcacgcatggtttcacgctggagcgcgagatcggcaacttcgtgctcacgcattcgaacatccgcattcccgaagacaccgtcgagttcgcgatcaacgcctcgaacgaacggttctgggaaccgccggtgcgccgctatgtgcaggaatgcaaggacgggcgcagcggctgccgtgcgagcgacttcaatatgcgctggatcgcgtcgatggtcgccgaggtgcatcgcatcctgatgcgcggcggcgtgttcatgtacccgcgcgactcgaagacgcctgcgatggaagggcgcctgcggctcctgtatgaagccaacccgatgagctttctcgtcgaacaggcgggcggtctttcgatcaccgggcgcgagcggattctcgacgtcgtgccgcgcgcgctgcatggacgcgtgccggtgatcctcggttcgaagcacgaggtggagcgtattggccgctatcacggcgaatacgaccgcggcgaagatcagcccttcacctcgccgctgttcagccggcgctcgctgttc

SEQ ID NO: 31379 - DNA, 1167 bp, Burkholderia cepacia; identical to SEQ ID NO: 28621

SEQ ID NO: 31380 - DNA, 1338 bp, Burkholderia cepacia
tatcacggcaacgaatatggccggatggccgtggcctccgccgcgcaagtcacccaggctgtcgacggcgcgctggccggcttcagggcgtccaccctgtcgccttacgagcgcttcaggattctgatggaagcggcccggatcgtcgaaagccgcatgccgatgctgatcgacctgatgcgcgatgaggcgggtttcacgcacgccgacggcgagaacgaagtgcgccgctgtgtgcagacattcgaactgtcggcggaagaaggcaagcatctggcaggcgaactggtcccgatggaagccgccgcgggagtcaggaaccggatgggcttcacgattcgtgtgccgcgcggcgtggtctgcgcgatcacgccgttcaactcgccgctcaacacgctcgcacacaaagtggggccggccattgcgggcggcaacgcggtggtgatcaagccgtcgaacgtaacaccgctgtcggccgtcgagttgtgcaaggttctgatcgacgcgggactgcccgcgaatctgctggcgctggtgcatggttcgggcagcgcgatcggccgccagttgctggccgatccgcgcatcgcgttctatgcgttcaccggcagcacgcaggtgggccgcgaaatccagcaggccgcgggcttgcgcggaatgcagctcgaactgggcagcattgccagcaccatcgtttgcgaggacgccgacatcgacctcgcgattcccaagatcgtcaacgcgggttttcgcaaagcagggcaagtctgcacgtcggtgcagcgcctgttcgtcgcccgcggcattgccgacgaattcattcccaggttcgtggcggcggtcaaggcgactccctatggcgacccggccgatccgaaaaccattctgggcccgatgatttccgtccagcatgcgcagcgggcggcggcgtgggtcagggaagcgcttgacggcggggcgcggctgctcaccggaggcaagtgcgaaggcgcgttgttcgagccgaccgtgcttcacggggtcgacgcgacaatgaaggtagtttgccaggaagtcttcgcgcccgtggtgtcgatcattgaattcgacgatatcggcgaagcggtggcgggcgccaacgccagcgatttcggccttgcagcagggctctttacgtcggatctgaagacggcgttccgtacggcgcgcgagctcgcgttcggcggggtgcacatcaacgaggcttcgagcgcgcgcatcgacgtgatgccgttcggcggcgtcaaggacagcgggttcggccgcgaaggcccggcttacgccatccgcgaaatgaccgaagaacgcctgatcaccgtg

SEQ ID NO: 31381 - DNA, 1359 bp, Burkholderia cepacia; identical to SEQ ID NO: 28623

SEQ ID NO: 31382 - DNA, 1422 bp, Burkholderia cepacia
atgacgtatgcgcagatcgacagcatggcttcgcagctggcggattcactcgtcaaacgcggcatccgcaagggttgtcatgtcgcgctgatgttgaagaacgcgcccgaattcgtgatcacgtggatcgcgcttggacggatcggcgccgtgatggtgccggtcaacacgtcctatacgcaggacgagctggtgttcgtgctgaccgacgccgacgcgcaatatctcgtgatcgacgccgaattcctgcctcgtcttgccgccgcgccggcactgcccgggctactcgcgtgggagcgcgtgatcgtctgcggcgagagcgagcatccgttgcgatgggcggcgctgctcgaggccggcagtgccgatttcaccgcgccgagcgcggtgtcgcgccacgatctgctcaacctgcaatacacctcgggcacgacgggttttccgaaaggctgcatgcttagccacgactactggatgattcattgtcacggcgcggcgcggcatcggcgcggccctgaggcgggtatcgaaaacgtgctgatctgggcgccgttcttttatatggacccgatgtggcagttcctcatgacaatgaaactcggcggcaccgcgtacattgcggagcgtatgagcctgacgcgtttcatgtcgtggctgatcgactatcgcattcactactgcatctttcccgagcctgcgttgagccagcatccgcgcggcccgcgtgacgcggaggtgcatctgaagtacatcagcatctacggctggacgaggtcggcgcgggaagaagtgcaggcacgcttcggtgtgatcgcgcgcgagggttttggcatgaccgaagtggggacgggcgcactggtgcccgcctgggcccacgacaaggcgctcgagcgtacctgcggcttgcccgcgccgtttcgcgaactgcagatcaggcgtgaggacggcagcgtggccgaagtcgatgaagtcggcgaactctggattcgcgggcgcggcatcctgtggggttattacaaacgccccgaggcgaacgcggaaagtttcgacggcgactggttccgtaccggcgatctattccggcgcgatgcgcaaggcttttatttcatcgtgggccgcatcaaggagatgatcaagcgcgcgggagagaacgtctcggctaccgaagtggagaccgtgctgcgcggcatggatgcgatcgacgaggccgcagtggtggccgtgcccgatccgctgcgccgcgaggaagtgaaggcctatctgaaactgcgcgaaggactcacgcaaggggacgtgccgcccgcggccgtgttcgagcattgcgcgcgccatctcgcgccgttcaaggtgccgcgctatctgcagtacatagagggcgattttccgcgtacgccttcgcgcaagatcgccaagaagcggttg

SEQ ID NO: 31383 - DNA, 1551 bp, Burkholderia cepacia; identical to SEQ ID NO: 28625

SEQ ID NO: 31384 - DNA, 1520 bp, Burkholderia cepacia
cgcagttcacccaaatttcaaggagctttgttgtgaacattccagacgcatcggtgtggcgcgcccgcgcgcaggagatccggcccgaaggccgcgcgttcatcgacggaaactacgtgggcgcgctgtcgggccgcacctttgccaccgtcaacccggccacggggcaggtgatcgcgcaagtcgcggagtgcggcgaggaagacgtgaacctggcggtcgcaagcgcgcgcaaggcgttcgaatccggtgtctggtcgcgccgtgcgcccgccgaacgcaaggccgtgatgctgcgcttcgcgcaactcatgatggaacaccgcgaggagttggcgctgctcgaatcgctcgatgtcggcaagcctgtcgctaacgcctataacggcgacatcgtcagctcggccacctgcattcaatggtacggcgaggcgatcgacaagctgtacggcgagaccgcgcccgccgcccccgacatgaccacgatgatcgtgcgcgagccgctcggcgtggtcgccgccgtggtgccgtggaactatccgctttcaatggcgagctggaagctcggtcccgcgctcgctgcgggcaattcggtcgtgctcaagccggcggaacagtcgccgctgagtgcgatccgcattgccgcgctcgcaatggaggcggggctgccggccggcgtgctgaacgtgctgcccggctacggcgaaacggcgggtcgcgcgctcggcctgcatatggacgtggacgcggtcggattcaccggttcgacggcggtcggcaagctcttcatgcagtactcgggccaatcgaacatcaagcgcgtggggctcgaatgcggcggcaagagcccgcatatcgtgctcgacgattgcgccgatctcgacgcggccgcgcgcgccgttgcggcgggcatcttcggcaatagcggccaggtatgcaatgccggctcgcgcctgatcgtgcaggcggccgtgcgcgacgaactgctggaaaaggtcgcggccatcgcgcgtgaactcgtgcccggcgatccgctcgatcccgccacgaagatgggcgcgatcgtgagcgacgtgcagcacgcctcgatcatgtcgtacatcgacgcgggccgtgccgacggcgcgcgggttgtcgcgggcggtcgcgcggcgcggcccgaatcgggtggctacttcatcgagccgacggtcttcgacggcgtgaacaacgacatgcgcatcgcgcgcgaagagattttcggacctgtcctttcggccatcacggtcgactcgccggaagaagcggtgcgggtcgccaacgacaccatctacggtctcgccgccgcggtgtggacctcgaacgttacgcgcgcgcagcaggtgtcgcggcaattgaaggcgggcgtcgtgtgggtcaattgtttcgaccgcggcacgatgtcctcgccgttcggcggtttcaagcaatccggcttcggccgcgacaagtcgatgcatgccttcgacaaatacatggactggaaggcgatctggatcgcc

SEQ ID NO: 31385 - DNA, 3057 bp, Burkholderia cepacia; identical to SEQ ID NO: 28627

SEQ ID NO: 31386 - DNA, 1149 bp, Burkholderia cepacia
tcgaatctggtcgagcgcctgcagggccggcgcacgtccgcgtgggaaatccatcgcgtcgcgcaacaggcggcggccaacggtgaagacgtgatcgtgctgagcgtcggcgatcccgatttcgccacgcccgcgccgatcgtcgaacgcgcggtcgaggccttgcgcggcggcgacacgcactacagcgcggtgtccggtcgtgagccggtgcgcgccgcgattgccgaagagcatgcgcgcaccacaggctgtgccgtgagcgccgccaatgtgatcctgaccgcgggcgcgcagaacggcgtattcgcttcgtcgctatgcctgctggaggcgggcgacgaggtgatcgtccccgagcccatgtacctaacctacgaggcctgcgtgcgcgcggcgggcgccacgctcgtggcggtgccggtcgatcgggcgcgggcgtttcacgtcgattgcgaggcgctcgaagcagcggtcacttcgcgcacgaaggccattttcttcgctacgccgtgtaatccgaccggcgtggtcatgccgcgcgccgatctcgaacggatcgcgcggatcgcgtgcgagcatgatctgtgggtgctgtccgacgaggtctacgccgagctcacattcgagcgcggacacctgagcattgcagcattgcccggcatggcggagcgcaccgtgacgctcggcagtctgtcgaaatcccatgctatggccggttggcgcgtgggttgggcgatcgggcccgcggagctgatcgaacatatggggcggctcgcccttgcgatgctgtacggcttgcccggcttcatccagcaggccgcattgaccgctttgcagaacaaggcacagatcgccgccgggatgcgcgagatttaccgccgccggcgcgacgtggtgttcgagcgtttgcagcgcgtgccggggctgcggtgcgtgttgcccgaagccggcatgttcatgatggtcgacgtgagcggcacgggtctcgatacggtcgacttcacctggcagctatttcgcgcgcagggtgtgtcgctgctcgacgcgagcgccttcggcgagacggcgaatggtttcgtgcggctgggtttcgtggtcgaggaagcgcgactgatcgacgcgtgcgagcggattgccgcatttgtc

SEQ ID NO: 31387 - DNA, 1317 bp, Burkholderia cepacia
gtgttccatcgtttaccgaagcaattgctgccggtcgccgtcgcgggcgagggtatcgagatcatcgattccacgggcaagcgctatatcgatgcatccggcggtgccgccgtttcgtgtctcgggcacagcaaccagcgcgtgatcgatgcgatcaaacggcagtcgcagcagctgccgtatgcgcatacgtcgttcttcaccaccgagcccgccgaagcgctcgccgaccgcctggtggcgagcgcgccgcaagggctcgaacatgtgtatttcgtctcgggcggctcggaggcgatcgaggcggcgctgaaactcgcgcgccagtatttcgtggagaagggcgaaccgcggcggcgccatttcatcgcgcgtcgtcagagttatcacggcaacacgctgggggcgctggcaatcggcggcaatgcgtggcgccgtgagccgttcctgccgattctgatcgaagcgcatcacgtgagcccgtgttacgcgtatcgcgagcagcgcgcggacgaaaccgaagaggccttcgcgcagcgtctcgccgacgaactcgagcgcaagattctcgaactcggcgcggacacggtcgccgctttcatcgccgaaacggtggtcggcgcgacggccggcgccgtgccgccggtgcgcgagtacttccgcaagattcgcgcggtgtgcgaccgctacggcgtgctgctgattctcgacgagatcatgtccggcatgggccgcaccggctatctttatgcctgcgaggaagacggcgtggcgcccgatatcctgaccatcgccaaagggcttggcgcgggttatcagccgatcggcgcgacgctcgtgagcgagcggatttatcaggcgatcgtcggcggctcggggttctttcagcatggccatacctatatcggccatgccaccgcctgcgccgcggcgctggaagtgcaacgcgtgatcgaggaagacaatctgctgcccaacgtgctggcgcgtggcgaacagttgcgcgtccggttgcgcgagcactacgcgcagcatccgcatatcggcgacgtgcgcggacgcgggttgttcgtcggtgtggaactggtcagggaccgcgccggcaaaacgccgttcgacgctgccctcaagctgcacgctgcaatccggcgcgaagcgtttgcgcgcggtttgatggtgtatccgatgggcggcacggtcgacggcaagatcggcgatcatgtgctgctggcgccgcctttcatctgtaccgcgcgcgacatcgacgaaattgtcagccggcttaccgatgcaattgacggcgcgctggccgccgtc

SEQ ID NO: 31388 - DNA, 1284 bp, Burkholderia cepacia; identical to SEQ ID NO: 28630

SEQ ID NO: 31389 - DNA, 1305 bp, Burkholderia cepacia
gcagcgcacatcggcgccttcgtgtccgctgctcgcgaagcacaacacgcctgggcgcaaggcggtctcgcgcatcgcacgaaggcgctgctcgcgtgggccgacgaactggaaaagaatggtgcggaggttgtcgcggcgctatcggtcgatacggcacggcaccgcatttcggcggaagaactgggcgcggtgattcacttcatccacggtttctgcgagcatgcgcccactgtgctggccacgccgttccggaagctggaagcgcacccggacgtcgtgttcaaggtcacgtatgcggcctatccggtggtcggcgtgatcagcccgtggaatttcccgctggtgctgtcgttcatcgacgccattcctgcgctcgtcgccggagccgccgtcatcatcaagcccagcgaagtgacgccgcgcttcatcgagccgcttcgccgcaccatcgaagccgtgcccgcgctcgcgaacatcatcacgctggtgacgggcggagcgcagacgggcgccgcgatcgtggcgcaatcggacgccgtggtgtttacaggcagcgtgccgaccggccagaaaatcgcgacagcggcggcgcaggctttcattccggcattcctggaactgggcggcaaggacgcggcggtcgtgctcgcgggtgccgatgtcgtgcgcgcagccaccagcatcttgcgcagcgcgctttataactcggggcaggtctgctatgcgatcgaacgcgtgtatgcgcacgattcgctccatgacgcgcttgtcgaggaactgcgcacccaggcggccgcattgaagcgcagcaacgctgcgggcgacggcggccactacggcccgatgattttcgaaaggcaggcggccatcatagacgcccaactggacgatgcggtgagcaagggggcgtcgatcgtgctcggtggcaagagcgaacgaattaacggggctgtttggatcgacccgactgtcgtaacgaacgtcgaccacacgatgacgctcatgacagaagagacatttggtccgatcgtgcccgtcatgcgctttaatgacgacgctgaagccgaacgcttgatgaacgactccatgttcggattgagcggcgcggtgtttggtcctgacacacacaccgccggcgacttcgcgacgaagatggaggcgggtggcgtcagcatcaacgacacggaattgccacgcgtgatgatgttcgacggtgagaaaaccgcgttcaagaagtcgggcatgggtgggtcgcgttatggcgccaccagcatcatgcggtatgttcgcaagcgtgcattg

SEQ ID NO: 31390 - DNA, 732 bp, Burkholderia cepacia; identical to SEQ ID NO: 28632

SEQ ID NO: 31391 - DNA, 1428 bp, Burkholderia cepacia; identical to SEQ ID NO: 28633

SEQ ID NO: 31392 - DNA, 1596 bp, Burkholderia cepacia; identical to SEQ ID NO: 28634

SEQ ID NO: 31393 - DNA, 1128 bp, Burkholderia cepacia
gacgaacaacgaatgatccgcgacgccgcgcgcgactttgccaccgagcgcctcgcgccgtacgcgggtcagtgggaccgcgacgcgcaactgcccgccgaggtcgtcacgcaaatgggcgaactcggctttctcggcatgatcgtgccggcggaatggggcggctcctatacggactacgtggcctatgcgctcgcgctcgaagagatcgccgcgggctgcgcctcgtgcgccacgctgatgagcgtgcataactcggtcggctgcgggccgatcctcaacttcggcagcgcagcgcaaaaagaccgctatctgcacgacctcgcgaccggccgccgcatcggcgcgttctgcctgactgagccgcaggccggctccgaggcgaacaatctgcgcacccgcgccgtgctgcgcgacggcaagtggattctcaacggcagcaagcagttcgtgaccaacggcgctcgcgcccatgtcgcaatcgtgttcgccgtcaccgatcccgatcgcggcaagcgcggtctgtcggccttcatcgtgcctaccgatacgccgggcttcaacgtcggcaagccggaacacaagctcggcattcgcgcgtccgacacctgcccgatctcgctcgacgactgcgccgtgcccgaagccaatctgctcggcgagccgggcgagggcttgcgcatcgcgctgtcgaatctcgaaggcgggcgcatcggcattgccgcgcaggcgctcggcatcgcgcgggccgcgttcgatgccgcgcgtctctatgcgagcgaacgcatccagttcggcaaggcgttgaaggagcatcagaccatcgccaacatgctcgccgacatggccacgcgtttgaatgctgcgcgcctgctcgtgcatcacgcggcgcggctgcgcacggaaggcaagccgtgtttgtcggaggcttcgcaggcgaagctgttcgcctcggagctggccgaggaaatctgctcgaacgcgattcagattcacggcggctatggttatctggaggactacgcggtggagcgccactaccgcgatgcacgcatcacgcagatttacgaaggaaccagcgaagtgcaacgcatggtgatagcgcgccatgtgtaaatgcaagcgagg

SEQ ID NO: 31394 - DNA, 996 bp, Burkholderia cepacia
atgaaggcagtgcaggtggcgcaggctggcggacccctggaactcgtcgaacgggacgtgccggaaccgggtgccggacaggtgctcatcaagatccaggcgtgcggtatctgccacagcgacgtgctaacaaaagaagggcagtggccgggtctggaatatccgcgggtgcccgggcacgaaattgcaggcgtgatcgatacggtcggcgcaggcgtcgaagaatggcaggcgggacagcgcgtcggcgtcggctggcacggcggccattgcggacactgcgagcattgccgccgcggcgattttgttctgtgccagcgcgcgctcgtgcccggcatcagctacgacggcggctatgccgagttcatgctggcgcccgtcgaggcactggcgcgcattcccgacgatctcgccgatgtcgatgccgctccgcttctatgcgcgggcatcacgacattcaacgcgctgcgcaatagcggcgcgcgcgccggcgatgtggtcgccattctgggcattggcgggctcggccatctcggcgtgcagttcgcgcgaaagatgggcttcgtcaccgtggccatcgcgcgcgggcaggacaaggcaagtcttgcgaaacaactcggcgcccatcactacatcgacagcacggcggcgaatgtggcgcaagcgttgcaggcgctgggcggcgctcgcgtcattctcgccaccgtcacgagcggcaaggcgatgagcgccgtggtgggcggcctcgggctgaacggtaagctgatcatggtaggactctcggacgagcccgtcgaagtgccggtcgcgcagttcatcatgggacgaaattcggtgcagggctggccgtcgggcacgtcggcggattctcaggacacgcttgcgttcagcgcactctcgggaatcaaaccgatgatcgaagaattcccgctaacgaaagcggccgaagcctacgagcggatgatgagcggcgccgcgcggttcagggtcgtgctc

SEQ ID NO: 31395 - DNA, 762 bp, Burkholderia cepacia; identical to SEQ ID NO: 28637

SEQ ID NO: 31396 - DNA, 723 bp, Burkholderia cepacia; identical to SEQ ID NO: 28638

SEQ ID NO: 31397 - DNA, 1287 bp, Burkholderia cepacia; identical to SEQ ID NO: 28639

SEQ ID NO: 31398 - DNA, 1578 bp, Burkholderia cepacia
gtgctgctgctcgaagcgggcggccccgactaccgcttcgacttccgcacgcagatgccggccgcgctcgcctatccgctgcaaggacgccgctacaactgggcgtacgaaacggaccccgagccgcacatgaacaaccggcgcatggaatgcgggcgcggcaaggggctcggtggctcgtcgctgatcaacggcatgtgctatatccgtggcaatgcgctcgattacgacggctgggccgcgcacgcgggcctcgaaaactggacctatctggattgcctgccgtatttccgcaaggccgagacgcgcgatatcggtgcgaacgcgtatcacggcggagacggtccggtgcacgtcaccaccagcaagcccggcaacaacccgctctttgccgcaatggtcgaagccggtgtgcaggcaggctttccgcgtaccgacgatctgaacggctatcagcaggaaggcttcggcccgatggatcgcacggtgacggcaaacggccggcgcgccagcacggcgcgcggctatctggatcgcgcgaaagcgcggccgaatctgaccatcgtcacgcatgccgtgacggatcgcgtgctgttctcgggcaagcgcgcagtcggcgtctcgtatctgcatcatggcaatgtgctgaatgcgcaggctcgccgcgaggtgctggtgtgcagcggcgcgattgcttcgccgcaactgctgcagcgctcgggcgtgggccgctccacgtggctgcgcgaactggacgtgccgctcgttcacgatctgccgggtgtgggcgagaacctgcaagaccatctggagatgtatatccagtacgagtgcaaggagccggtttcgctttatccggctttgcagtggtggaatcaaccggccatcgggctcgaatggatgctgaacggaaccggcatcggcgcgagcaaccagttcgaagcaggcggctttatccgcacgcgcgacgacgatccgtggccgaacatccagtatcacttcctgccggtcgcgatcaattacaacggttcgaacgcgatcaggatgcacggttttcaggcgcacgtcggttcgatgcgctcgccgagccgtggccgcgtgaagctcacctcgcgcgatccgaacgcgcatccgggcatcctgttcaactatatggccgatccgctcgactggcgcgagttccgcgacggcattcgcatcacacgcgagatcatgcggcaaccggcgctcgaccgttatcgcggccgcgaactgaaccccggcgccgaactgactaccgacgaacagctcgatagtttcgtgcgcatgcgagcggagacggcgtttcatccatcctgttcctgcaagatgggctacgacgacatggccgtagtcgacaacgagggccgcgtgcacggcatgcaaggactgcgtgtggtggatgcgtcgatcatgccgcgcatcaccaccggcaatctgaacgcgccgaccatcatgctggcggagaagatcgccgaccgtattcgcggacgcgaggcgctggcgcgggtggatacgccctatttcgtggcgaatggcgtggcttcgcgcaaacgggag

SEQ ID NO: 31399 - DNA, 1467 bp, Burkholderia cepacia; identical to SEQ ID NO: 28641

SEQ ID NO: 31400 - DNA, 813 bp, Burkholderia cepacia
attgccgagatgaagcagcagatccgcgagcacagcgagattctcacggtcgtgcgcaccactgacgacattttccgcgcaaagaaagagaacaagacgggcatcattttcggtttccagaacgcgcatgctttcgaggacaacctcggctatatcgaggcgttcaaggatctcggcgtgaacgtggtgcagctttgctacaacacgcagaacctcgtgggcaccggctgctatgaacgcgacggcggcctgtcgggctatggccgcgaagtgatccaggagatgaaccgcgtcggcatcatggtcgatctgtcgcacgtgggcggcaagacttcttccgaagcgattgcggcttcgaacaagcccgtttgctactcgcattgctgcccgtcggccctgaaagagcacccgcgcaacaagagcgacgagcaactgaaagagatcgcggacgcaggcggattcgtcggtgtgacgatgttcgcgccgttcctcaagcgcggtcccgacgcgactgtcgaagactatatcgaagcgatcgagtacgtggtgaatctgatcggcgaagaccaggttggtatcggcacggacttcacacaaggctacagcacggagttcttcgactggatcacgcatgacaaaggccgctatcgccagttgacgaacttcggcaaggtcgtgaatccggaaggcatccgcacgatcggcgagtttcccaacctgacggccgcgatggagcgcgccggctggagcgaaacgcgcatcaaaaagatcatgggcgaaaactgggtgcgggtattcggcgaagtgtggaag

SEQ ID NO: 31401 - DNA, 1533 bp, Burkholderia cepacia
atgcttgagaccaaaaagaatattcttatcctgatggcagaccagatgacgccgttcgcactagccgcgtacggacaccgtctgacgaaaacccccaatctggatcgcctcgcgaaacaaggcgtggtattcgaatcggcctactgcgccagtccgctgtgtgcgccttcgcggttttcttttctgtcgggcaagttgccttcggcaatcggcgcctatgacaatgcagcggagtttccgtcgcaaacgctgaccttcgcacattatcttcgcgcagaaggatatcgcaccattctgtccggcaagatgcatttctgcggcgccgatcagttgcatggtttcgaggagcggctcaccacggacatctatccggccgacttcggctggacgcccgactgggagcattttgaaacacgccccacgtggtatcacaacatgagttccgtgatcgacgccggcccgtgcgtgcgtaccaaccagctcgacttcgacgacgaagtcacgttcacgactcgccagaaactcttcgatatcgcacgcgaacgtcatgcgggaaaggatgcgcggccgttctgcctggtcgcctcgctgacgcatccgcacgatccctacgcgattccgcaaaagtattgggacatgtatcgcgacgaagagatcgacatgcccgcgtttcgcgattcgttcgaagacgccgacccgcactcgaagcgcctgcgccatgtctgcgaaaccgaccgcacgccgcccaccgatcagcagatccgcaatgcgcgccgcgcgtattacggcgcgatctcctacgtcgacgatcagttcggcgcgatcctcgaagcgctcgaacaatccggcctcgcgaaagacactgtgatcgtggtgacttccgatcacggcgagatgctcggcgagcgcgggctctggtacaagatgaccttcttcgaaggcggttgccgcgttccgctgatcgtgcacgcaccgcagcaattcgacgcgcatcgcgtagaggcgagcgtctcgcatctcgatctgctgcccacgctggtcgagttggcacgcggcgaacaaccggccgtgtggcccgattcgctcgacggacaaagccttgttccgcatcttatgagcgggcaaggcgggcaaggcggccatgacgaagcgatcggcgaatatctggccgaaggggccattgcgccgatcgtgatgttgcggcgcggccgcttcaagttcattcacacaccggccgatccggatcaactctacgatgtcgccgcagacccgctggaacgcgagaaccttgccgcgcgcagcgaatacgcgtcacaggtcacggctttccgtgaggagatcgcgcaacgctgggatctcgccgcgctgcaccacgaagtgctgcaaagccagcggcgccgtcattttcattttgcctccacgacgcagggcgtggtcgcgtcatgggactggcagccgcacgtggatgcgagccagcgttacatgcgcaatcacatcgatctggattcgctcgaagcgatggcgcgctttccc

SEQ ID NO: 31402 - DNA, 1149 bp, Burkholderia cepacia
gcagacgacgcgcaggcgcttctcgccgcacggcgtctcgccgaggcgttcgcaccggacgctgcgctgcgcgatcgcgaacggcggcttccgtgggccgagctcgacgcgttcgtggcgagcggcctgtggggcatcaccgtgccgcgcgaattcggcggcgcgggtgtgagcaacggcacgctcgcggaagtcaccgcgacgatcgcggcggccgacggctcgctcggccagatcccgcaaaaccatttctatgcactggaggtgttgcgcgtcggcggcagcgtcgaacagcagcgctttttctacggacgcgtactcgccggcgagcgtttcggcaacgcgctcgccgaaatcggccacaaggatttcaaacgccgcacacggctcacgcgcgaggcggccggctggcatatcgacggccgcaagttctattgcacgggcgcgctatacgcccactggattcccacgctagtcgtggccgaagagcagggccgcgacgtcacctatctggcgttcgtgccgcgcgacacaccaggcgttaccgtaacggacgactgggatggcttcggccagcgcgtcaccggcagcgggtcggtgcagttcgattacgtgcgcgtcgagcccgaatgggtcgtgccgtttcaggcgtcgttcgagcgccccacaacgatcggaccgcttgcgcagatcattcacgcggcgatcgatctgggtcaggcgcgtggcgcgttcgaagccggcctgaagttcgtgcgggaacgctcgcgcccgtggatcgacgcgaaggtggaacgtgccgccgacgatccgctgacccttgcgcagttcggcgacatctcggtgcggctgcgtgcggcggaagcgttgctgcgccgcgcgggccgcttcgtcgacgcggcgcaggcgcagctcacagagcagtcggtggcgcaggcatcgattgccgtggccgaggcgcgcgcgctcaccaccaccgcatcgctggatgccggctcgcgtctgttcgaactcgccggcaccgccgccacgctcgacggtctcggcctcgaccgcttctggcgcaacgcccgcactcatacgttgcacgacccggtgcgctggaagtatcacgccgtgggcaacttctacctcaacgacaagctgccg

SEQ ID NO: 31403 - DNA, 765 bp, Burkholderia cepacia; identical to SEQ ID NO: 28645

SEQ ID NO: 31404 - DNA, 1146 bp, Burkholderia cepacia; identical to SEQ ID NO: 28646

SEQ ID NO: 31405 - DNA, 1635 bp, Burkholderia cepacia
aatatcagttctcttgccggcaagccgcttccgccggcactgctggtcaacgtgccgcgcctcgtcgcgagctactacaccgggacgcccgacccgtcgctcgccgccgagcgcgtcaaattcggtacttcgggacatcgcggatcttcgttgcagcgcagcttcaacgagtggcatgtgctcgcaatcacgcaggctatctgccgataccggaaattacagggaatcgatggaccgctgtttctcggcatcgacacgcatgcgctgtcggagccggcctcggccagtgcgctcgaagtgctggcggccaatggcgtggaggtcatgatcgcgccggatggcgaatacacgcccaccccggccatatcgcacgccatcctcacctataaccgcggccgttcgtcgggcctcgcggacggcatcgtcatcacgccttcgcacaatccgccgggtgacggcggcttcaaatacaacccgcccagcggcggacccgcggacgaaacggtgacgggctggatcgaagtcgcggcgaacagcctgctcgagaaccggctcgacggtgtcatgcgcatgccgctcgccaacgcgctgcgtgcctcgaccacgcactatcacgacttcctcagaatctacgtcgccgatctcgacagcgtcatcgacatgagcgtgctgcgcggtgcgccgatccgccttggcgtcgatccgctcggcggcgcgggcgtgcactattgggccgcgatcgcggaacgctatcggctgaacctcacggtgacagacgaagacgtcgatccgactttccgcttcatgagcgcggattgggacgggcagatacgcatggacccgtcgtcgccgtatgcgatgcagacgttgatcggcaaggccgaccgcttcgataccgcgtttgcatgcgataccgatcacgaccggcatggcatcgtcacgcccacagccgggctattgccgccgaatcactacctcgccgtcatgatcgactatctgtgcgcgcatcgtccggattggcccgcgcatgccgcgatcggcaagacgatggtcagcagccggctgatcgaccatgtggcggcaaagcatggccgcgcgctctacgaagtgccggtgggcttcaaatggttcgtgggcggcctgctcgacgggtcacttggttttgccggcgaggaaagcgcgggcgcgacctgtctgaggctcgacggccgcgcgtggacgaccgacaaggacggcatggtgcccgcgctgctgtcggcggagatcgcgacgcgcaccggccgcgatgtcgcggagcattaccgcgccctcaccgaacgcctcggcgagccgcgcgagcgtcgcgtgcaggcggcggcgagtgcgtcccaacgcgcgctgctcgggcgactgtcgccggcgcagttcgctcacaccgagcttgccggcgaaaaaatcgattccgtgctcgaccgcgcgccggccaatcaggcgccgctgggcggcatcaaggtgagtacgaagagcggctggttcgccgcgcgaccctcgggtaccgagaatatctacaagatttatgccgagagttttctcggcgacgaccacctggcgcgcattgtcggcgaagcgcagagcatggtcgacaacgcgctggcg

SEQ ID NO: 31406 - DNA, 1671 bp, Burkholderia cepacia
gactatctgattctcggcggcggctcggccggctgcgtgctggccgcgcgcctgtccgaagacgaaggcagcaccgtctgcctcgtcgaggccggccgcaacatctcgcgaacggacatgcccgctgcggtgcgcagccgctatcccggccgcgcctatctcgacaccgcgaacatctggcagcatctgaaggcacgcatgaacacttcggccgcgacacgccgttacgagcaggcgcgcctgcttggcggcggttcggcgatcaatgcgctgatggcgaaccgcggcgcgccggccgactacgacgaatggcacgcgcgcggcgcacacggctggaactgggccgcctgcctgccgtacttccgcaagctcgaaaccgattgcgacttcggcggcgcgctgcatggcgcgagcggaccggtgcgcatccagcgcacgccgtgggcgcgcatctcgccattcgtacgcgcggtgctcgccacgctcgacgcgcgcggccacacgcggcgtgacgaccagaacggcgaatggcaggacggcacgttcatcggctcgatcgcggtgagcgaagcgggcgagcgcatcccgacctcggtctgctatctcgacgacaccgtgcgggcccggccgaatctgaccatccgcacgcaaacgctcgtcgaacacgtgctgttcgacggcgggcgcgcgatcggcgcgcgggttgtcggcgaaaacggtgcgagcgaaacattgcacgccagacaggtgatcgtttgcgcgggcgcgattcacagcccggcgcttctgatgcgaagcggcatcggaccggcgtccgaactggccgcgctcggtatcgaggtggtggccgatcgcggcggcgtgggcggcaatctgatggagcatccgtcgattgccgtgtccgcggttctgccgcgcgcggcccgcgcgttatatcccgacgagcatcacgaacaggcgatcgtgcgtttttcgtcgggcgtgagcggagcggtacctggcgacatgcacggcgcgatcctgtcgcgatcgggttggcattcggtgggctaccggctcggcacgctgtttttctgggtcaacaagtcgtactcgcgcggccgcgtgagtctcacgtcggccagtccgcacgacgaacccgccgtcgacttcaacatgctgtccgacgcgcgcgatctcgaacggctgaaactcgcgctgcgcttcggcgcccgaacgctggccgatccgatgatggcgcagcaccgcaccacgctgctgccttcgagctattcgccgcgcgtcgcgagcgtggccgtgccgggcgtgtggaacgcgttgcagcgcggcctgctgagcgcgctgctcgacattgccgggccgttgcgcgggtggctcgtgcgccgcgtggtcacgcaaggcgtgacgctcgacgaactgctcgccgacgatcacgcgctgacgcgtttcgtgacgcgctcggcgggcggcacctggcatccgtgcggaacctgctgcatgggtgccgccgacgatccgctcgccgtctgcgacgcgcgcggcgcggtctatggcgtcagcggactttatgtaggcgatgcgtcgttgatgccgtcgatcccttgcgcgaacacgaatgtgccgaccatcatgatcgcggagcggattgcggatatgttgcgaggacgggcg

SEQ ID NO: 31407 - DNA, 1449 bp, Burkholderia cepacia
ttcaatccggacgacgtcgcgattcgcagcggccattacatcggcggtgaatacgtggaggcgggcgggcgccgcatcgaggtcgcgcgtccctcggacggcgtggtatatgccacggtgccgcttgccgatgccggcatggtggaccgcgcggtcgaaaacgcatggcaggccttcagacacagtggctgggcgcgcatggcgccgcgtgaacgcgcgaagatcctgcgccgtttcgccgaactggtcgaagccgatgcgcccacgctcggccggctcgaagcgttgggatcgacacgtccgatcgctcaggcgatcggctgggacgtgccgttcaccgccgagggtatccgcttctacgccgagttcgccgacaaactgggcggcgacgtggcggccacggatcacgatcatctcggcatgacgatcgccgagccgtacggcgtgatcggtgcgatcgcgccgtggaatttcccgctggtgatggcttcgtggaagatcgccccggcattggcagcgggcaatgcggtggtgctcaaaccttcggagatgacgccgttctcggtcttgcggcttgccgaactggccgtgcaggcgggcgtgcccgcgggcatcttcaacgtgatccagggcgatggcagggtgaccggcgacgaactggtgcgtcatccgaagatcagcaaggtgaccttcacgggctccacgcgcacgggcgcgtcgatcatggccgcctgcgcgaatagcggcaccaggccggtcacgctcgaactgggcggcaagagcccgcaaatcgtgttcgccgacgcgccgcgtctggatgacgtggcacgccgtatcgccggcgctattacaggtaatgccgggcaggtgtgcgtggcgggctcgcgtctgctggtcgagcgaagcctcgctgaaccgctcgccgagcgcatcggcaagatcttcgcggagttgaagcccggcgcgacgtgggccgccggcacgacactgtcgccgatcatctcggcgccgcaggcggcgcgcatagagggcatcgtggggcgcacgctggaagccggtgcgacgctgcgctacggcggcgtcagggccgatgtcggctccaacggcgcgttctacacgcccaccttgctgacgaacgtcaccgctcattccgaagcagtgcgcgaggaaatcttcgggccggtgctgacgctgcaaaccttcgataccgaagaagaagcgctcgcgctcgcgcagcaccccgaatacggcctcgcggccggtgtgcataccgccgacctcggccgggcgctgcgtttcgtgcgcgggctcgaagcgggcacggtgtgggtgaaccgctatggccgcacctcggacttcatgattcccaccggcggctacaagcgttccggtatcggcaaggaccttgggcggcaggcctatgaggcgaacctgcgtttcaagagcgtg

SEQ ID NO: 31408 - DNA, 1299 bp, Burkholderia cepacia; identical to SEQ ID NO: 28650

SEQ ID NO: 31409 - DNA, 1071 bp, Burkholderia cepacia
aagaaatatcggatcgcggtcattcccggcgacggcatcggtgtcgaagtcatgccggaagccattcgcgtgctcgaagcggtgaaagcgcgcttcggcatcgagctggagtatcagcacatcgaatgggcgagctgcgagtactacgcaaagcacggcaagatgatgcccgacgactggaaagcccaactgctctccgccgacgcgatcctgttcggcgcggtgggctggcccgacaccgtgcccgaccatatttcgctgtgggggtcgctgctgaagttccgccgcgaattcgaccagtacatcaacctgcgccccgcccgcctctttgccggcgtgccttcgccgctcgcgggccgcaaggccggcgacatcgatttctggatcgtgcgcgagaacaccgagggcgaatactcgtcggtgggcggcgtgatgttcgaaggcacggagcgcgaattcgtgctgcaggaatccgttttcacgcggcacggcagcgagcgcgtgctgaagttcgccttcgatctcgcccagcggcgcgcgcgcaagaagatcacggtggccaccaagagcaacggcatcgcgatcagcatgccgtggtgggacaaggtcgcggccggcatcgccgcgcagtatccggacgtgacgtgggacaagcagcacatcgacattctctgcgcgcgcttcgtgctgaacccggatcgcttcgacgtggtggtggccaccaacctgttcggcgacatcctgtccgatctcggccccgcctgcaccggcacgatcggcctcgcgccgtcgggcaatctgaatcccgaccgcaagtttccgtcgctgttcgaaccggtgcacggctcggcgcctgacatcgcgggcaagaacatcgccaatccgatcgcgatgatctggtccgccgcgatgatgctcgacttcctcggcaatcacgccggcaaggagcgcgaggcgcacgacgcgattctcgccgcgatcgaagcaacgctgatcgaaggcccgcataccggcgacctgggcggcaaggcgaacacgaccgaggtcggccaggcaatcgcaaagaaactc

SEQ ID NO: 31410 - DNA, 1440 bp, Burkholderia cepacia
ttgatccgctccgacaatttcatcgacggcgcatggacgcccgcgcaagacaacctgcgctttgccgtcaccaatcccgcgagcggcgagatcatcgctgaagtggcggacagcagccccgccgacgcccgcgccgccaccgacgccgccgcccgcgccctgcccgcttggcgcgcgcgcctgccgaaggaacgcgcggccgtgctgcaccgctggcatgcgctgatcatggcgaatctggatgcgctcggcgcgctgatctcgctcgaacagggcaagccgctcgccgaaggcaaaggcgaggtcgcctacggtgcctcgtatgtcgcgtggttcgcggaagaagccacgcgcatctacggcgatctgattccgcagcagcagcgcggcaagcgcatgacggccgtgaaggaaccggtcggcgtcgtcgccgcgatcacgccgtggaatttcccgctcgccatgatcgcgcgcaagatcgcgccggcgctcgccgccggttgcacggtggtggccaaaccggcggaagatacgccgctcaccgcctcggcgctggtcctgctcgcgcacgaagccggcgtgccgccgggcgtgctgaacctgatcacggcctcgcgcgatcatgcggtcgccgccgtcgccgagtggctgcacgacgcgcgcgtgcgcaagatcaccttcaccggctccacgccggtcggcaaatatctggcgcgcgagtcggcggaaacgctcaagaaactgtcgctggaattgggcggcaacgcgcccttcatcgtattcgacgacgccgacctcgaagccgccgtcgccggtctcatggcagcgaaattccgcaacggcgggcagacctgcgtgtgcccgaaccgcgtatatgtgcaagccggcgtctacgaacggttcggcgcgctgctggccgagcgggtcggcgcgctgaaagtggcgcccgccaccgacccggccgcgcagatcggcccgatgatcaacagccgcgcgctcgacaagatcgcccgccatgtggacgacgccgtggcgcacggcgcgcgcgtgctgaccggcggcaagcgccttgccgaactgggcccgcactattacgcgcccacggttctcgccgacgccaccgccgcgatgcagttgaatagcgaagagaccttcggcccgatcgtgccgctgttccgtttcgaagacgaagccgaagcggtcaacgccgctaacgacacgccattcggcctcgccgcgtatttctacagtgaaggcgtgaaacggatcgaccgggtggcgcgcgcgctggaagcgggcattgtcggcatcaacgaaggcgcggtcgcgagcgaagccgcgcccttcggcggcgtgaaagaatcgggctatggtcgcgaaggctcgaagtacggtctcgacgactatctgtcgatcaaatacctctgccagggcaacctc

SEQ ID NO: 31411 - DNA, 1563 bp, Burkholderia cepacia
catcccatgccccaatccgcagacaggattctcgaccacgaactgctgttccgtgagcccgagtaccaggaaattttccgcacaaaaaaggaaaacttcgaattcaaccatccggacgagcaggtcagtcagatcgtcgaatggaccaaaaccgaggactacaaacagaagaacttcgcgcgcgactcgctgaccgtcaacccggccaaggcttgccagccgctcggcgcggtgtatgtcgccaacggctttcacaagacgctgagtttcgtgcatggctcgcagggctgcgtcgcctattaccgctcgcacttttcgcgccacttcaaggagccgacctcgtgcgtcagttcgtcgatgaccgaggacgcagcggtgttcggcggcatgaacaacatgatcgacggtctcgccaacgcgtacaacctgtacaagcccgagatgatcgcggtctcgacgacctgcatggcggaagtgatcggcgacgacctcgacgcgttcatcaagaacagcaagcagaagggcagcgtgccggaagactacgatgtgccgttcgcgcacacgccggccttcgtgggcagccatgtcaccggctacgacaacgcgcttctcggcatcctcaagcacttctgggacggcaaggccggtacggccgcgccgctcgaacgggtggccgatgagagcgtcaacttcatcggtgggttcgacggctacgtggtcggcaacatgaaggaaatccgccgcatcttcgatctgttcggcgtgcaggtgaacatcctctgcgatccgtccgaaacgtggaatacgccgaccgacggcgagttccgcatgtacgaaggcggcacgaccaaggatgaggtggagcgcgctttgaacgcgaaggcgaccttcgtgttccaggaatactgctgcgagaagaccagcaagttcatcgccgagcatggtcaggaagtcgtggtgctgaacgcgccggtcggcgtggcgggcaccgatcagtttctgatggaaatctcgcgtgtggccggcaagccgattccggcgcaactggagaaggagcgcggccagctcgtcgacgcgatggccgatagccaggcgcatctgcacggcaagcgtttcgcgctctatggcgacccggaccagatgctcggctacacccagttcctgctcgaactcggggccgaaccggcgcacgtgctggcgaccaacggcggcgaaacctgggctgcgaaggtgcaggcgctgttcgacgcgtcgccgtacggcgcgggctgcaaggtgtatccgaaacgcgatctgtggcatatgcgctcgctgctgttcacggagccggtggatttcctgatcggcaacacctacggcaaatacctcgagcgtgatacgaaaacgccgctgatacgcatggtgttcccgatcttcgatcgccaccactatcatcgcttcccgacgtggggctatgaaggcgcgttgcgcgtgctggtcacgctgctggacgaattcttcgaagcgctcgacgccaacacgatcgtcgcggcgaagaccgactacagctacgacatcatccgc

SEQ ID NO: 31412 - DNA, 348 bp, Burkholderia cepacia; identical to SEQ ID NO: 28654

SEQ ID NO: 31413 - DNA, 1863 bp, Burkholderia cepacia
atggccctcctgcagatcgccgaacccggccagagcgccgctccgcaccagcaccggctggcggcgggaatcgacctcggcaccacgaattcactggttgccacggtgcagagcgcagtggcccgggcattacccgacgaggacggtgcctgcctgctgccgtcggtggtgcgctacacgcgcgccgccgaacccgaggtcggccgcccggcccaggcgcgccaggccgaggacccggtcaacacgatcgcgtcggtcaagcgcttcatgggacggcgcctcgccgatctgccggaagccgcctcgctgccctaccgcttcatcgaccagacaggcatggtcggactcgctaccgccgctggcgagcgctcgcccgtgcaggtgtcggccgacattctgcggaccttgcgcgtgcgcgccgaggcatccctcggcggcgaactggcgggggttatcatcacggtgcccgcctatttcgacgacgcgcagcgtcaggcgacgagagacgcggcgcacctcgccgggctgacggtgctgcggctgctcaatgaaccgacggccgccgcgatcgcgtacggcctcgaccgcgctgccgaaggcgtcttcgcgatctacgacctgggcggcggcacttttgatatctcgatcctgcggctgtctaaaggcgtgttcgaagtgctggccaccggcggcgactcggccctgggcggcgacgacttcgatcgcgccattgcgcagtggttctgcaacgggcacggtgtcgaaggcctcgccatgctggcgccctccgcgcagcgcagtctgatgatggcggcccgcgcggcgaaagagacgttatcgcacgccgggtccgcggtgatcgcgcttgcgcacgccgaccgcagcatctggcaggcggcgctgtcgcgtgcgcagttcgcggaattgggcgccgcgctcgtcgcacgaactctcgcggccacgcggcgtgcgttgcgcgacgcgaaactcggcacgggcgatatcgacggcgtggtactggtcggcggttccaccaggatgccgctggtacggcacgccgtgcaggaatttttcggtcgcgaaccgcttgccgatatcgatccggatcaggtggtcgcgctcggcgcggcgatccaggccgatgtgctggccggcaaccgcaatggcgacggctggctgctgctggacgtctgccctttgtcgctcggcatcgaaacgatgggcgggctggtcgagaaaatcatcccgcgcaattccacgctgccgaccgcgcgcgcccaggaattcaccaccttcaaggacggccagacggccatgtcgctgcatgtcgtgcagggcgaacgcgagagcgtggcggactgccgttcgctcgcccgcctggagttgcgcggtatcccgccggcggttgccggcgcggcgcgcgtgcgcgtgagttttcagatcgacacggacggcctgctcgcggtcaccgcgcgcgagcagaccaccggcgtcgaaacgcacgtcgaggtcaagccgtcctacggactgaccgatgtcgagatcgccgcgatgctgcaacaggccatcgacgcgtcgctgcccgatatgcagttgcgcacgttgcgcgaggcgcagatcgacgcacgccgtctgctcgatgcaaccgaagcggcactggacagcgacgccgcgctcctgtccgccgacgagctggcggccgtgcggcgcgcaatgttccaggtcggcgaggcgctggagaccgatgcgtgcgtcgatctgctcaaggctgcggcgacggatctcgcgggcgcgaccgaaaccttcgccgcgcggcgcatgaacgcgtcgatccgcaatgcgctcgccggacgcaacctcgat

SEQ ID NO: 31414 - DNA, 1293 bp, Burkholderia cepacia; identical to SEQ ID NO: 28656

SEQ ID NO: 31415 - DNA, 978 bp, Rhodobacter sphaeroides
cacccgctgcccgtggtgatcgcgcacggcgaaggagcctgggtgacgacgtggcgggcgtcgctatctggactgcctcgccggatactcagcggtaaacttcggacaccgcaaccctgaactcctcgccgccgcccgcgctcagctcgaccggatcaccctcaccagccgcgccttccaccacgaccggttcgcaccgttcgtcgccgcgctcgccgatctcgtcggcaaagaacaggtgcttccggtcaacacgggagctgaagcggtcgaaaccgggatcaagatcgcccgcaaatggggatacgaggtcaaaggcgtccccgacgggcgcgccgtcatcgtcgtggccagcggaaacttccacggacgcaccaccacgatcgtgtccttctccaccgaccctgccgcctaccgcggcttcggaccacccactccaggattccgcatcgtgccctacggggacgccgcggcactcgccgacgctatcgacgccgacaccgtcgcagtcctcgtcgaaccggtgcagggcgaagccggggtgatcgtgccgcctgccgactacctgccacgcgtccgggacctgtgcacccgtgccggcatcctgctgattgcagacgaagtgcagtccgggctgggacgcaccggcaccgtgcgggcctgcgaccacagcggagtcgacgccgatatctacctgttcggcaaagcgctgggcggcggcatcctgcccgtggcggcggcggtaggcgacgcggaagtcttcgacgtgatccgccccggccagcacggcagcaccttcggcggcaacgccctcgcctgcgcggtcggcactgccgtggtgagcctcgtccgcgacggcccttacctggaccatgtccgcgccctcgcccccgtgctgcgcgcccgcctcgaccaactggtcggcaacggcgtggtcgcggcccgcagcatcggcctgtgggctgggatcgacgtcga

SEQ ID NO: 31416 - DNA, 363 bp, Rhodobacter sphaeroides
atccagttgatccagcggatcatcccgcaccgttacccgttcctgctggtggaccgggtgcgcgacatcgtcccgaacaagagcgccgtcggcatcaaatgcgtcacgatgaacgagccgcagttcacggggcacttccccggcctgccgatcttcccgggcgtgcagatcatcgaggccatggcgcagacttcggccgtgctggtcggcgtctcgatggatctcgccgacaagggcgccaaggtctatttcatgggcatcgacggggccaagttccggcgcaaggtcgtgccgggcgacgtgctcgagatgaccgtcaccgtgaagcgcggcggcggcaaggtctggaagttcgagggccgg

SEQ ID NO: 31417 - DNA, 912 bp, Rhodobacter sphaeroides
atgcgaaagggctgagccatgaccgcatcgaaacccggccgcatcgcggtcgtcggctccaacatggtcgatctggtgacctacatcacccggatgcccgcgcccggcgagacgatcgaggcgcccgacttcgagatcggctgcggcggcaagggcgccaatcaggcggtggccgccgcaaagctcggcagcgcggtcagcatggtgacgaaggtcggcgacgacatcttcggcgagaacacccgccgcaacctcgcccagcacggcatcgacatccgccatgtggagacggtggcgggcaagtcctcgggcgtggcgccgatcttcgtcgaggcgtcgggcgagaattcgatcctgatcgtgaagggcgcgaatgccgaccttttgcccgccgatgtggatacggccgaagagacgctgcgcgcggccgacctgatcctgatgcagatggaggtcccgcgcgagacggtgatccataccgtgcggcgggcggcggaatggggcgtgcgcaccatcctgaaccccgccccggccgcggccgacctgaatgtggatgacctgcgcgacctgagcttcctcgtgccgaacgagagcgagcttgcgctgatctcgggcctgcccaccggcagcgaggaggagatcgcggccgccgccctgagcctgatcgagcgcggcatcggcacggtgatcgtgacgctgggcgggcgcggcgcccggctggtgacccgcgcgggcgtggtgcccatcgccccggtccgggtgacgcccgtcgacacgaccggcgcgggcgatgccttcatcggcgccttcgcccatttcctcgccgcgaccggcgaggtggagggcgcgctggcccacgccgcgcgctatgccgcccattccgtgacggggcgcggcacccagaaatcctac

SEQ ID NO: 31418 - DNA, 1317 bp, Rhodobacter sphaeroides
catatcttcggccgctccacccggggcagccttcccgtcgccgctgagggcgagggctgctacatcctcgataccgagggccggcgctatctcgacgggtcgggcggggcggcggtctcctgcctcggccattccaacgcggcggtgcgcgcggcgctccacgaccagctggaccggctggccttcgcccataccggcttcttcacctccgaaccggccgagcgtctggccgaccggctggcggcggcggcgcccgaggggatcgagcgggtctatctcgtctcgggcggatccgaggcggtcgaggcggcgctgaagctcgcgcggcagtatttcatggaagtgggccagcccggccggcaccgggtgatcgcccgccgccagagctaccacggcaacacgctcggcgcgctggccgcaggcggcaacgaatggcgccgggcccagttcgcgccgcttctggtcgagacctcccatgtctcgccctgctacgaatatcgcggccgggccgaggacgagagcctcgaggcctacgggctgcgcgtggccgacgagctggaggccgagatccagcgcctcggtcccgagacggtgatggccttcgtggccgagccggtggtgggggccacggcgggcgccgtgccggccgtgccgggctatctcaagcgcgtccgcgagatctgcgaccggcacggggtgctgctcattctcgatgaggtcatgtgcgggatgggccggacgggccatctcttcgcctgcgccgaagatggcgtggcgcccgacatgatcaccatcgccaagggtctcggcgcgggctaccagcccatcggcgcgcttctggttcagggccgcatctacgacgccatcgccgcgggctcgggcttcttccagcacggccacacctacatgggccatgcgatggccgccgccgcggccaatgcggtgctggacgagatcgagggccgcgatctcctgcaggcggtccggcggcagggcgcgcggctcgaggcgctcctgcaggagcggctgggccagcatccccatgtgggcgacatccgcggccgcggtctcttccgcggcatcgagctggtggccgaccgcgagacgaaggagccgttcgatccggcgcggaagctccatgcccggatcaaggccgaggccttcgcaggcggcctcatctgctatccgatgggcggcaccctcgacggggtgcggggcgaccatatcctgctcgcgccgcccttcatcatctcggacgccgaactcgacgagctggtggacaagctctcgggcgcgctcgaccgcgccctcgcggca

SEQ ID NO: 31419 - DNA, 1038 bp, Rhodobacter sphaeroides
catatgaagcgcatccccctcggccgcaccgatctgaccgtttccgaactctgcctcggcacgatgacctggggcagccagaacagcgaggccgaagcccatgcccagatcgacctcgccctcgaccacggggtgaatttcctcgacacggccgagatgtatccgaccaatcccgtgacggccgagacggtgggcggcaccgaaaccatcatcggccgctggcttgccgcgcggggcgggcgcgaccggatcgtgcttgcgaccaagatcaccggcgagggcagtgcggcggtgcgcggcggcgagcaggtgacgcccgagagcctgcgccgcgcgctcgagggctcgctcgcgcggctcggcaccgatcatgtcgatctctaccagatccactggccgaaccggggctcctatcacttccgcaagatgtgggcctatgtgccgcccacgggggtcgaggcggtgcgcgacaacatggtcgcggtgctcgaagaggcgcagaagctggtggccgagggcaaggtgcgccatttcggcctttcgaacgagacggtctggggcgcggcgcagtggctgtcgctcgccgaccggcacgggctgccgcgcatggccacggtccagaacgaatattccctgctctgccgccagttcgacaccgactgggccgagctgtccgcgctggaggagatgccgcttctggccttctcgcccctcgctgcggggcttctgtcgggcaaatatgccggagacgtgacgcccgacggctcgcgccgcgaacgcaatgccacgctgggcgggcgcgtcacgcccaccgtcttcgaggcggtggcgggctatctcgggatcgcggcgcgccacgggctcgacccctgccagatggcgctcgccttctgccgcaagcgtcctttcccggtgatcccgatcctcggcgcgacctcgctcgaccagctgcgcaccaacctcggcgcctgtgacctcgagctgtcccccaaggtcgaggccgagatcgcggcggcccatcgcacctggcccgcgccc

SEQ ID NO: 31420 - DNA, 1167 bp, Rhodobacter sphaeroides
gttcaataaagggctcgccgcatgtttcacgctccgatgaccttcgacctcggcgaggagatcgccgccctccgcgagaccgtccatgcctgggcgcaggagcgggtgaagcccatggccgcccggatcgaccgcgagaacgtcttcccggccgagctctggcgcgagatgggcgagctcgggcttctgggcatcacggtccccgaggaattcggcggctcggacatgggctatctcgcccatacggtcgccgtggaggaggtggcgcgcgcctcggcctcggtctcgctcagctacggggcgcattccaacctctgcgtgaaccagatccgcctgaacggcagccctgagcagaaggcgcgctatctgccgaagctcgtctcgggcgagcatgtgggggcgctcgccatgtccgaggcgggcgcgggctcggacgtggtgtcgatgaagctcaaggccgagaagcggaacggctactatgtcctcaacggcacgaaatactggatcaccaacgggccggatgcggatgttctggtggtctatgccaagaccgaccctgaggcgggcgcgaagggcatcactgccttcctgatcgaaaagtcgatgacgggcttctcgacctcgccgcacttcgacaaggtggggatgcgcggctcgaacacgggcgagctgatcttcgagaattgcgaggtgccgttcgagaatgtcctcgggcaggacggcaagggggtgcgcgtcctcatgtcggggctcgattacgagcgcgtggtgctgtcggggatcggcacggggatcatggcggcctgcctcgacgaggtggtgccctactgccagagccgccagcagttcggtcagccgatcggaaacttccagctgatgcagggcaagctcgccgacatgtatgtcgcgctgaacacggcgcgggcctatgtctacgagacggcgcgcgcctgcgatgcggggcgggtgacgcgcgcggatgcggcgggctgcgtgctctatgcctcggagcaggcgatggtgcaggcgcatcaggcggtgcaggcgctcggcggcgcgggcttcctgaacgattccgtcgtgagccggctcttccgcgatgcgaagctgatggagatcggggcgggaacttccgagatccgccggatgctcatcggccgcgaactt

SEQ ID NO: 31421 - DNA, 816 bp, Rhodobacter sphaeroides
atggcactcaagtcgtacaaaccgacgacgcctggccagcgtgggctggttctgatcgaccgttcggagctgtggaaaggccgtccggtcaagaccctcgtcgagggcctgatcaagaccggtggccggaacaacaccggacgcgtcacgatgtggcacaagggcggcggagccaagcggctctaccgcatcgtggatttcaagcgtcgcaagttcgacgtgccggccgtggtcgagcgcatcgaatacgacccgaaccgcaccgcgttcatcgcgctcgtgcgctatgaggatggcgagctcgcctacatcctcgcgccgcagcgcctcgccgtgggcgacagcgtcgtcgccggcgtcaagaccgacgtgaagcccggcaacgcgatgcccttctcgggcatgccgatcggcacgatcgtgcacaacgtcgagctgaagcccggcaagggtggccagctggcccgcgccgccggcacctacgcccagttcgtcggccgcgacggcggctatgcccagatccgtctgagctcgggcgagctgcgcatggtgcgtcaggaatgcatggccaccgtgggtgccgtgtcgaacccggacaactcgaaccagaacttcggcaaggccggccggatgcggcacaagggtgtgcgcccgaccgtccgcggcgtggccatgaacccgatcgaccacccgcacggcggcggcgaaggccggacctcgggcggccgtcacccggtcaccccgtggggcaagggcaccaagggcaaccggacccgcaagagcaaggcttcggacaagctgattgtccgctcgcgg

SEQ ID NO: 31422 - DNA, 1563 bp, Rhodobacter sphaeroides
ctcgtcctgctgctcggagcggagttcctgctcgccatcctgtcggatcttctcggacggctcggcggcctcaccgacacgctcctgacggaacggctcaccatgtcctcctcggtgcggctgatgcaccacgcggccagcctcgatctggccgcgttcgaggatgcggggtttcaggatcggctcgagcgggcgcggcggcagtcgggcgggcgcatgacgctgacgggccagatcctctcgctgatgcaggatgcggtcaccgtgacctcgcttgcgggcgggctcctgctctacaacccgtggctcatcctgcttctggtcgcggcgctggtgccggccttcctcggcgaggcgcatttcaacgcgcagaactacaacctcgatttccgccgcacgcccgagcggcgggaactcgattatatccgcgtgaccgcggccggagtggaaacggccaaggagatcaagatcttcggcctcgcgcccttcctgatcgagcgctaccgcaccctctcggagagcttctatgccgcgcggcggcgcatcgcctcggcgcgggcggtctggggcacgctcttcagcgcgctggggacggcgggctattatctggcctacctctggatgatcggcgccacattgtcgggccggctctcgatcggcgatctgacctttcttgcaggctcgttcctccggctgcgcgggctggtcgaaggactgctcacgggcttctccaccaccgccgcgcaggcgctctatctcgaggacctgttcggcttcttccggcagcagcccaccatcctcgcccccgccgagccgcgccccgtgcccaaaccgatccgcgagggcttccgcttcgagaaggtgggcttccgctatccgggggccggcggctgggcggtgcgcgatctcagcttcacgctgaaggcgggcgagacgctggcgctcgtgggcgagaacggcgcgggcaagaccacgctcgtcaagctgctggcccggctctacgatccggacgaggggcggatccttctggacggacaggatctgcgcagcttcgatccggtggcgctgcgcggcgcgatgggcgtcatctttcaggatttcgtgcgctactcgatgagtgcgggcgagaatatcgccgtgggccggatcgaggcgcgttccgaggaagaccgcatcgccgaggccgcccggcgcagcctcgccgaccggatcgtggcgcggatgcccgacggctacggccagatgctgggcaagcgtttccgggagggcgtggatctctcaggcggcgaatggcagaagttcgccatcgcgcgggcctacatgcgcgacgccgaggtgctgatcctcgacgagccgacggcggcgctcgatgcgcggtccgagttcgaggtattccagcggttcaaggagttgtcggcgggccggacggcggtgttgatctcgcaccggttctcgtcggtgcgcatggccgaccggatcctcgtgctggcgggcggtcgggtcgaggccagcggcacccacgaggagcttctggcccagccgggccgctatgcggaactgttc

SEQ ID NO: 31423 - DNA, 1400 bp, Rhodobacter sphaeroides
ttctccgacctcgcgctggatccccgcgtgctgaaggccgtgcaggaagccggctacgaaacgcccaccccgatccaggcgcaggccatcccgcatgcgctggaaggcaaggatgtgctgggcatcgcccagaccggcaccggcaagaccgccagcttcacgctgcccatgatcaccatcctcggcaagggccgcgcgcgcgcccggatgccgcgcagcctcgtgctctgcccgacgcgcgagcttgcagcccaggtggccgagaatttcgacatctatgccaagcactccaagctctcgaaggcgctgctgatcggcggcgtctccttcaccgagcaggacaagctgatcgaccgcggcgtggacgtgctgatcgccaccccgggacgcctcctcgaccatttcgagcgcggcaagcttctgctcaccggcgtgcagatcatggtggtggacgaggccgaccggatgctcgacatgggcttcatcccggatatcgagcgcatcttctcgctgacgcccttcacgcgccagacgctgttctactcggccaccatggcgcccgagatcgagcggatcaccaacaccttcctcaccggcgcggtgaagatcgaggtggcgcggcaggccacgacctccgagacgatcgagcagaagctcatccaggtcacaccgacgcggaaggagcgtagcttcgccgacaagcgcgccgtcctgcgggcgctgatccgggccgaaggcgaggcctgcaccaacgcgatcatcttctgcaaccggaagatggacgtggacgtggtggccaagtcgctgaagcagcacggcttcaacgcgtcgcccatccatggcgatctcgaacagtcgcagcgcatgaagacgctcgacgggttccgcgacgggtcgttgcacctgctcgtagcctccgacgtggccgcgcgcgggctcgacattccggcggtgagccatgtgttcaacttcgacgtgccgacccaccccgaggattacgtccaccgcatcggccggaccggccgcgcgggccggaagggcaaggcctacacgatcgccgtgccgtcggacgagaagcatgtgaccgccatcgagagcctcgtgaaacaggcgatcccgcgcggcgagctgcccgagggcttcagcctcgaggatcgccccgaccggcccgagcgtgacaacgcacgcggcgagcggtccgaacgccctgcgcgcggccgtcgcggccgcgaccgcgaccggcgcgaggagccccgggtcgaggccgtggaagccccggccgcggccgttcccgaagtgcgggaagtgcgcgaggagcgcccgccccgccgcgaagagcggcgcgacgagcgccgcgagggcggcaacaaccggcgcgagcgtgaccgcgaccgccgcga

SEQ ID NO: 31424 - DNA, 1437 bp, Rhodobacter sphaeroides
cgcgaggctctcaccttcgatgacgtccttctcgttcccgccgccagcagtgtgctgccgtcggacgcggacacgtcgaccttcgtcacgaaggcgatccgcatgaacatcccgctcctgtcctcggccatggacacggtgaccgagggacgtatggccattgcgatggcgcaggcgggcgggatcggcgtgatccaccgcaacctcggcatcgaggaacaggcgcgcgaggtgagccgcgtgaagcgcttcgagagcggcatcgtctatgcgccgatcacgctgcgtcccgaccagacgctcgccgatgcgaaggcgctgcaggagcgttacaacgtgacgggcttccccgtggtggacgaaagcggccgcgtggtggggatcgtgaccaaccgcgacatgcgcttcgccaatgacgatcgcacgccggtcaaggtgatgatgacctcggacaatctggcgatcctgcaggagcctgcggaccgcgacacggccatcagcctgatgaaggcgcgccggatcgagaagcttctggtgacggacgggcagggcaagctcacggggcttctcacgctcaaggacaccgagaagtccgtgctgaaccccaacgcctgcaaggacgagctgggccggctccgggtcgccgcggcctcgaccgtgggcgaggcgggcttcgagcgcagccaggcgctgatcgaggcgggcgtcgacatggtggtgatcgacacggcgcacggccattcggaaggcgtgtcgctcgcggtcgagcggatcaaggctttctcgaactcggtgcaggtcgtggcaggcaacgtcgccaccgccgaggccacgcgggccctgatcggcgcgggcgcggatgccgtcaaggtggggatcggccccggctcgatctgcaccacgcggatcgtggcgggcgtgggcgtgccgcagctgaccgcgatcatggatgcggcgggggcggccggcgacgtgccggtgatcgccgatggcgggatcaagttctcgggcgacttcgccaaggccatcgccgccggcgcctcctgcgccatggtgggctcggccatcgcgggcaccgacgagagcccgggcgaggtgatcctctatcagggccgcagcttcaagagctaccgcggcatgggctcgctcggcgccatggcccgcggctcggccgaccgctacttccagaaggacgcggcttccgacaagctggtgcccgaggggatcgaggggcaggtgccctacaaggggcctgccgcggcggtgatccaccagatggtgggcggcctgcgcgccgccatgggctacaccggcaaccgcaccgtggccgagatgcggcagggctgccgcttcgtccgcatcaccggcgccgggctgaaggagagccacgtccacgacgtgcagatcacgcgcgagagcccgaactaccggctgggc

SEQ ID NO: 31425 - DNA, 1203 bp, Rhodobacter sphaeroides
aaacgagtggtcatcacgggcgccggcacgatcaacgcgctggcgcacgatgtggcgggcacgcttgcggccttccgcgaggggcgctgcggcatcaccgagctcgatatccgcgacaaggaccggctgtcgatccagatcggcgggcaggtccacaactgggatcccgaggcgcatttcaaccgccagcagatcgtcctctatgacaagttcacccagttcaccctgctggccgcccgcgaggcggtggcgcaatcggggctgaccttcgcgggcagcctcgggctcgaggccggggtgatcctcggcaccgcgggcgggggcgtgaacacctgggacgagaattaccgggtggtctacgaggagggcaagaaccgcgtccatccgttcgtcgtcccgaagctcatgaacaacgcggccgcctcgcatgtgtcgatggagttccagctgcgcgggccttccttcacggtggccaccgcctgcgccagctccaaccatgcgatgggacaggccttccagatggtgcgctcagggatggcgcgggccatgctgaccggcggatccgaggccatgctctgtttcggcggcatcaaggcctgggagggcctgcgggtgatgtcgaaggacgcctgccggccgttctcgctcaatcgcaacgggatggtgcagggcgagggggcggcgatcttcgtcttcgaggaatatgagcacgcccgtgcccgcggcgccgagatcctcgccgaggtgatcggctttgccatgacgtcggacgcgtccgacatcgtgatgccctcgaagctcggcgcggcgcgcgccatcgagggggcgctgagggatgcgcgggtcacgcccgacgcggtgggctatatcaacgcccacggcaccgggacggcggccaacgacaagaccgaatgcgccgcggtggcggatgtgttccgccatcatgccgaccggctgatgatctcttcgaccaagtcgatgcacgggcatctgatcggcgggacgggggcggtggagcttctggcctgcatcctcgcgctgcgcgagggcgtcattgcgcccaccatcggctatgaggagccggacccggaatgcgcgctcgatgtggtgccgaacgtggcgcggcaggcgcgggtggatgtggtgctgtcgaacgccttcgccttcggcgggctgaacgccgtgctcgccctgcggcgggtc

SEQ ID NO: 31426 - DNA, 1334 bp, Rhodobacter sphaeroides
ctctcgaactcgctcgccgccgcagacatagcccattcgctgcacccctataccaacgcccgcgcacacgaacggaacggacccctcatcatcacgcgcggtcagggcgtgcatgtctatgacagcgaggggcgggaatatatcgagggtctggcagggctctggtcggtggccgtgggcttctccgagccgcgtctggccgaggctgccgcgcggcagatggccgagctgccctattatcacaccttcgccggcaaggcgcacgagccgcagatccggctggccgagaagctggtcgagatgacgcccgaggcgctgacgcgggtgttcttcaccaactcgggctccgaggccaacgacacggtggtcaagctcgtctggttcatgaacaacgccctcggccggccgcagaagaagaagttcctgtcgcggatcaagggctatcacggcatcaccatcgcctcggggtcgctcacggggctgcccgtcaaccacagggcttcgatctgcccgccatcccggtcgtgcatctgggctgcccgcaccactggcgcttcggcgccgagggcgagagcgaggccgagttctgcgcccgcctcctgcgcgaggccgaggagacgatcctcgccgaggggcccgagaccgtcgccgccttcatcggcgagccggtcatgggcgcgggcggggtgatcgtgccgccggacggctactggtcggggatcgaggcgctctgccggaaatacgacatccttctcgtctcggacgaggtcatcaacggcttcggccggaccggcgcgcgctggggatgcgagaagttcggcttcacgcccgacatcctcgtgacctcgaagcagctcacctcctcctatatgccgctcgcggcggtgctgatgaccgacaaggtctatcagaccatcgccgaccatacggagacgctgggcacgctcggccacggcttcaccggttcgggccatccggtcgccacggcggtggggctcgagaacctgaccgtcatcgaggagcgcgacctgatgggcaatgcggcccgtctcgagcgcccgttccaggacgggctgcgcgcgttccgggacaatccgctggtgggcgaggtgcggggcacggggctcatcgccgcgatcgagatggtggccgaccgggccacgaagcgcagcttcgagcccttgggcaaggtgggggcgcgcgccgcggccttcgcggccgaagaaggtctcctctgccgggcgctcggcgacacgctggcgctctgcccgccgctgatcgtgaccgaggccgacgtgggccgcatcctcgaacggatgggccgtgcgctcgac

SEQ ID NO: 31427 - DNA, 888 bp, Rhodobacter sphaeroides
atggacccgcaacagatcaaggcggccctcggctccggcctgctctccttccccgtcacgccgttcgacgccgagaacaggttcgccgccgccccctaccagaagcacgtcgagtggctgtccggcttcgacgcgccggttctcttcgccgcgggcggcaccggagagttcttctcgctgacccccgacgagatccccgccatcgtcaaggccgccaaggagagcgccggcaagaccgccatcgtctcgggctgcggctacgggaccgagattgcccggggcatcgcgcgttcggtcgaggcggcgggcggcgacggcatcctgctgctgccgcattacctgatcgacgcgccgcaggaagggctctacgcccatgtcagggcggtctgccaggccaccggcatgggcgtcatggtctacaaccgcgacaatgccgtgctgcaggccgacacgctggcgcggctctgtgacgactgcccgaacctcgtgggcttcaaggacggcaccggcgacatcggcctcgtgcgccagatcaccgcgaagatgggcgaccggctgacctatctcggcggcatgccgacggcggagctctttgccgaggcctacctcggggcgagcttcaccacctacagttcggcggtgttcaacttcgttccggcgctggccaacaagttctacgccgcgctgcgggccggggatcgcgccacctgcgagagcatcctcaacagtttcttctacccgttcatggagctccgctcgcgccgcaagggctatgcggtcgcagcggtcaaggcgggcgtgcggctggtgggcttcgacgcgggcccggtgcgggcgccgctctcggatctgaccggcgaggaggaagagatcctcaaggccctgatc

SEQ ID NO: 31428 - DNA, 1797 bp, Rhodobacter sphaeroides
atccggcagctcgacgaagctgccatcaaccgcatcgccgcgggcgaggtggtcgagcggccggcctcggcggtgaaggagctggtcgagaatgcgctcgacgcgggcgcccggcgcatcgccgtcgacatcgcctgcgggggcaaggccctgatccgcgtcaccgatgacggctgcggcatgacggccgacgacctgccgctcgcgctctcgcgccatgccacctcgaagatcgacgggtccgaccttctcgacatccgcagcttcggcttccgcggcgaggcgctgccttcgctggcggccgtggggcggctcaccatcacctcgcgggtggccgaggccgagggcgcgcagatcgccgtcagcgcgggccggatcgagccggtgcgtccggcggcgctcggggcgggcacggtggtcgaactgcgcgacctcttcttcgccacgcccgcgcggctcaagttcctgcgcaccgaccgcgccgagacccaggccatcgccgaggtggtgcgccgtctggcgctggccgagcccgaggtgggcttcaccctcaccgaccattctgcgggcgagccgcggcttctgttccgcgccgaggccgaagggggcgatctgttcgacgccctccaccgccgcgtggcgcgggtggtgggggcggagtttgccgagaatgcgctccggatcgatgtggcgcgcgaagggctgcgcctgcagggctatgccgcgctgcccacctattcccgcggctcgggcgtggcgcagttcctgttcgtgaacggtcgcccggtgctcgaccggatgctcctcggcgcgctccgggcgggctacatggatgtgctgagccgcgatcgctatccggccgcggtgctgaacctgatctgcgatccgcagcgggtcgacgtgaacgtgcatccggccaaggccgaggtgcggttccgcgaggcgggcgaggtgcgcgggctgatcgtcaccgcgctgcgtcaggcgctggcgggggcggggcaccgggcctcgaccaccgtcgcgggcgagacgctcgaggccttccggccggagaggcccgcggcggcgggtccgggtccggcgtcgcggatctatcagatggaccggccctcggtcgccgcggtggcgcgcagcttcgcctttcaggcgcccgagcctgcgatgccgggtctggccgaggcgcccgccgcaagggtcgaagcgccggcggccgaggaggcccacgaccgccctctcggcgccgcgcgggcgcagatccacggcaactggatcctcgcccagaccgagagcggcctcgtgatcgtggatcagcatgccgcacacgagcggctggtctacgagaagctcaagcgccagcgcgacgagacggggatcgcgcggcaggcgctgctgatccccgagatcgtcgaactgtcgcccaccgatgccgcccggctgctggaggccgcggacgagctggcctccgcgggcctcgtgatcgagccgttcggcggcggtgccgtcgcggtgcgtgaggtgccggcgatcctcggcaaggtcgaggctgcaccgctcctgcgcgacatcctcgacgatctggccgatctcggcagctcggaccggcttcaggcccggatggatgcggtgctctcgcgcatggcctgtcacggatcggtgcgctcgggccgggcgctcagggccgaagagatgaatccgcttctgcgcgagatggaggccacgcccctctcgggccagtgcaaccacggccggcccacctatgtcgagctgaagctggccgacatcgagcggctcttc

SEQ ID NO: 31429 - DNA, 1014 bp, Rhodobacter sphaeroides
atcgccatcctcggggcttcgggctataccggggccgagctggtccgcctgatcgccacgcatcccgcgatgcggatcgtggcgctttcgggcgaccgcaaggcgggcatggcgatgtccgaggtgtttcccttcctccgccatctcgacctgccgcggctccagaagatcgaagagatcgatttctcgagcgtggacctggccttctgcgcccttcctcatgccacgtctcaggcggtgatcgcggggctgccgcgcgatctgaaggtcgtggacctctcggccgacttccggttgcgcgatccggcggcctacgagacctggtacggcaagccccatgcggcgcccgagctgcagaaggaagcggtctacggactgaccgaattctaccgcgacgagatccgcggcgcgcgcctcgtggcgggcaccggctgcaatgcggcgacggggcaatatgcgatccggcccctgatcgaggcgggcgtgatcgatctcgacgatatcctgatcgatctgaaggcgggggtctccggcgcggggcggagcctgaaggagaacctgctccatgccgagctctccgagggcacgcatgcctattccgccggcggcaggcaccggcatctgggcgagttcgaccaggaattctcgaagatcgccggccggccggtgcaggtccgcttcacgccgcatctcacgccgatgaaccgcggcatcctcgccaatgtctatgtgaagggcgacccgcaggcggtgcaccgggcgctcaccgagcgctatctcacggaaacgttcctcgaggtgctaccttttggcgcgctcccctcgacacgcgacatccgggggtccaactacgtccatatcggcgtgatcggggacagggtgcccggctgcgccatggtggtggcggtgctggacaacctgtgcaagggctcctcggggcaggcgatccagaatgcgaacctgatgctggggctggacgaggcggcaggtctcgggctcgccccggtcttcccc

SEQ ID NO: 31430 - DNA, 1410 bp, Rhodobacter sphaeroides
atgaccacgacggccggcgcgccgatcgccgacaaccagaacacgctgaccgcgggtccccgcggtccggtgctgctggaggattaccagctgatcgagaagctcgcgcaccagaaccgcgagcgcattcccgagcgtgtggtccatgccaagggctggggcgccttcggcaccttcacggtgacgaacgacatcacccgctacagctgcgccaaggtcttttcggaagtgggcaagcagaccgatctcgcggtgcgcttttctacggtggcgggcgagctcggcgcggccgaccatgagcgcgacgtgcgcggcttctcggtgaagatgtataccgaggaaggcaactgggacctcgccggaaacaataccccggtgttcttcgtgcgcgacccgatgaagttccccgacttcatccacacccagaagcgccacccgcgcaccaacctgcgctcggccacggccatgtgggacttttggtcgctgagccccgagtcgctgcatcaggtgacgatcctgatgtccgaccgcggcctgccggtcgatccgatgcatatgaacggctacggctcgcacacctattcgctgtggaacgcgcagggcgagcggttctgggtcaagttccactggaagaccctgcagggccacgcgcactacaccaatgccgaggccgccgagatcgtcggccgcacccgcgagggctatcaggaggcgctgttcggcgccatcgaggagggccgcttcccgaaatggcgcctcatggtgcaggtgatgcccgaggccgaggccgagaccacgccctacaacccgttcgacctgacgaaggtctggccgcattcggactatccgctgatcgaggtcggcgtgatggagctgaaccgcaatgcggacaactacttcgcccagatcgagcagctggccttctcgccgtcgaacaaggtgccgggcatcggctacagccccgacaagatgctgcaggcccgcgtcttctcctatgccgacgcgcaccgctaccggctgggcacgcactacgaggccctgccggtgaacgcgccgcgctgcccggtgcatcactaccacaaggacggccagatgaacttcttcggccatcgcaccggcgcggtcgatgcctattacgagccgaactcggtgccgggcgctgccgtcgaggatccggcggtggccgagccgccgctcaggatctcgggcgatgcggcgcgctacaaccaccgcgagggcaacgacgactacagccagccccgcgccctgcatgacaaggtgatgacggacgagcagcgggcccggctctatgccaacatcgccgaagccatggcgggcatccccgaggagatcgcgaaccgggccatcgcccagttcgaccgggtgagccccgcctacggcgagggcatc

SEQ ID NO: 31431 - DNA, 537 bp, Rhodobacter sphaeroides
atgccgacgagaccttatgtcatagaccagctgatctctccgaaacagatcgccgcgcgggtcgaggtgctggcgcgccagatcaccgaacatttcgccgagaccgagaagctggtggtggtgggcctgctgcgcggctccttcgtcttcatcgccgatctggtccgcgagatccacctgccggtcgaagtggatttcctcgaggcctcctcctacggcgatgccatgacctcgagccgggaggtgcgcatcctcaaagacctgcgcggcgagattgccggccgcgacgtgctcgtcgtcgaagatatcgtggatacgggcttcaccctttcccatgtcgtgcggctcctgcgctcgcgcgagccgaagcggctcgaggtctgcgccctgctcgacaaaccctcgcggcgcgaggtggacatccgcgcgacttggaccggattcgagattcccgacgagttcgtcgtgggttacgggatcgacttcgcgcagcgcaaccggaacctgcccttcatcggcaaggtgcgcttcctcgaa

SEQ ID NO: 31432 - DNA, 933 bp, Rhodobacter sphaeroides
accatgagccgcgcattcgtgttccccgggcagggcgctcagaccatcggcatgggccgcgcgctcgccgaagcctatcctgcggcgcgggcggtattcgacgaggtggacgaggcgctcggcgagaaactctcggcgctgatctgggacggatccatcgaggagctcacgctgacgcagaacgcgcagcccgcgctgatggcgacctcgatggcggccctcgcggcgctcgaggtcgaaggcctgggcatcgccaccgcctccttcgtggcgggtcactcgctcggcgaatattccgccctgtgcgcggcgaagtcgctgaagctctcggatacggcgcggcttctgcgcatccgcgggcaggccatgcaggaggcggtgccggtgggcgtgggcgcgatggccgcgctcctcgggctcgattacgacaccgcggtcgaggtcgcgcacgaggcggcgcagggcgaagtgtgccaggccgccaacgacaacgatccggcgcaggtggtggtctcgggccacaaggcggccgtcgagagggcagtggagatcgccaagggccgcggcgccaagcgggccatcctgctgccggtgagcgcccccttccattgcgcactgatgcagcatgccgcgagcgtcatgtccgaagctctcgccgcggtggtgatcgaggcgccggtctgcccggtcgtcgtgaacgtgcgcgccgaggcggtgtcggagccggaccggatccgtgcgctcctcgtggcacaggtgacgggggccgtccgctggcgcgagagcgtgatgtggatggaaaatgcgggcgtggacgagttctgggaaatcggtgccggcaaggcgctgtcgggcatgatcaagcggatcgccaagggcgcggcgacccgggccatcggcacgcccgaggatgtggcggctgccgccacggcc

SEQ ID NO: 31433 - DNA, 903 bp, Rhodobacter sphaeroides
atgagtgtcaatctatccttacacccccgctccgtgcccgagccgcgcgcgctgctcgagctgatccagcccatcacctggttcccgccgatctgggcctatctctgcggcacggtctcggtggggatctggcccggagagaaatggccgctggtcctcctcgggatggtgctggcaggccccttggtctgcggcatgagccaggccgcgaacaactggtgcgaccggcatgtggatgccgtgaacgagccggaccggccgatcccctcggggcgcatccccgggcgctgggggctctatatcgcactcctcatgaccgtgctctcgctcgccgtgggctggatgctgggcccctggggcttcggcgccaccgtcttcggcgtgctcgcggcctgggcctattcggtcgagccgatccgcctcaagcggtcgggctggtgggggccgggcctcgtcgcgctctgctacgagggcctgccttggttcacgggcgcggccgtcctgtcggcgggcgcgccgagcttcttcatcgtgaccgtggcgctgctctatgccttcggcgcgcatggcatcatgacgctcaacgatttcaaggcgctcgagggcgatcgccagcatggcgtgcgctcgctgccagtaatgctcgggcccgaagtggccgcgaagctcgcctgcaccgtcatggcgatggcgcagatcctcgtcatcacgctcctcgtcatctggggcaagcccatccatgcgggcatcatcaccgcgctgctggtggcccagctgttcgcgatgcgcgtgctgctgcgcgatccggcgggcaagtgcccctggtataacggcaccggcgtcacgctctatgtgctgggcatgatggtcgcggccttcgccatccgcgggctggaggtgctg

SEQ ID NO: 31434 - DNA, 1182 bp, Rhodobacter sphaeroides
atggcctatgatgtcttcgtagtgggtggcggcccgtcgggcgccacggcggccgacgagctggcccgtgccggcaagagcgtggcgcttctcgaccgtgccgggcggatcaagccctgcggcggcgcgatcccgccgcgcctgatcgaggatttcgacatccccgacagccagatcgtggcgcgcatccgcaccgcgcggatgatctcgcccaccggccgcaaggtcgacatcccgatcgagggcggcttcgtcggcatggtggaccgcgagcatttcgacgaatggctccgccgccgcgccgccaaggccggggccgagcggctgacgggcaccttcctgcgcgtcgagcgcgacagcttccacacctatgtcgtctggcgcgagaaggcgacgggcgaggagaaacggtccgagaccaagctcgtgatcggtgccgacggcgcgaaatccgacgtggcacgcgccgaggtgcccgggggcgacaagatcccgatggtgatcgcctaccacgagatcatcaagccgccgaccagctcggtgatcgactacgaccctacccgctgcgacgtgatctacgacggccgggtcagccccgatttctacggctggatcttcccgcatggcgagaccgcctcggtcggcatgggcacgggcatcctcggcttcgacctgaaggaggcgactgcgctcctgcgccggcaggccgggctcgaccagtgcgagacgatccgcaaggagggcgcgccgatcccgctgcagccgctggagaagtgggacaacggcaaggacgtggtgcttgcgggcgatgcggcgggggtcgtcgcaccctcgtcgggcgaggggatctactatgccttcgtcggtggccaggtcgcggccagggcctgcctcgccgcgctgaaatcgggccgggcgaccgacctccaactcgcgcgcaagatgttcatggccgaccacaagaccgtgttcaaggttctccgctcgatgcaggatgcctattatcgcgacgacgagcggcgcgagcggttcgtgagcctgtgccacgacaccgacgttcagcgcctgaccttcgagtcctacatgaacaagaaactgacgagcaaacagccctgggcccatatcaagatcgggttcaagaacgtgatgcacctgacgcggctcgtctcgccgcaatggacc

SEQ ID NO: 31435 - DNA, 531 bp, Rhodobacter sphaeroides
atgacggaaatggttcccgcctgggtcgagggccggctgatgccggtcgagaagctggaggcgcaccagcgcggcctgcgtcacatggcgatctcggtctttgtcatggccggcgaggcggtgctgatccagcgccgcgcggccggcaagtatcacacgcccggcctctgggcgaatacctgctgcacccatccccgctggggcgaggaggcggccgactgcgccgtccggcgcctgcgcgaggaactggggatcaccgggctcgtcaccgtcttcgccgaccgcgtggaatatcgcgccgacgtgggcaacgggctgaccgagcatgaggtggtcgacatcttcgtggccgaggcgccctcggacctgccggtgaacccggacccggaagaggtgtgggagacccgctgggtcgacctcaccgatctcgcgcgcgaggtgaaggagcatcccgagcgcttcacaccctggctccggatctatctggccgagcatatggagcggatcttcggcaagctgcgcgtcgtgcag

SEQ ID NO: 31436 - DNA, 1674 bp, Rhodobacter sphaeroides
gtgccgctcggcccgtgggaacgggtcgaggcggccctcacccttctcgccatcgaccctgcaggcctcaagggcctctggctccgggcgcgggccagcgcgctgcgcgaccggatcaccggggcgctcggcgcgctgccgctgccggtccgccgcattcatccgaccatcggcgacgatgcgctcttcggcgggctggatctggccgcgaccctctcggccggcacgcccgtcgtgcagaagggcatcctcgacgagcccgcggtgctggttctcgccatggccgagcgcaccctgcccggtctcgcggcccggctcggcaccgcgctcgatgcgccgcgccactgtctgatcgcgctcgacgagggcgccgagcgcgacgagctgctgccgctcggcctcgtggaccggctggcgctgttcctcgacctcgacggcctgccctggggcgagacccgcgagatcgcgctcgaccccgagcgcctcgccgcagcccgcgcccggctggccgcggtggcgaccccgcccgaggcggccgcgaccctcgcccgcgtggcggcgcagctcggcatcgcgagcctccgcgcgccgacgctggcgctggccgcggcccgcgcgcaggccgcctgggaaggtcacgccgccgtcacggacgaggacatccgccgcgcggccgatctggtcttcgcccatcgcgccatgcctgcctccgaggaggccccgcccgagcccgaacccgagccgcccgaggatcagcccgacgacagcccgccgccgcccgagcagcagcagggcgaggagatgtttcccgaagagatgctggtcgaggccgtgcgggcggcgctgccggccgatctcctcgagcagctggccgccggtcgcgccgcgcggatggcgcggggcgccaccggcaccggctcggccaaggccggcaaccgccgcggccgccccctgccctcgcgcatgggccgcctcggcaccggcgcgcggatcgacctcgtgggcacgctgcgcgcggccgccccctggcagccgctccgccgccgccagcagaagaccgatgccgtgctgctcgtgcggccctccgacatccgcatcaagcggttccgcgagacctcggaccgcgtgctgatcttcgccgtggatgcctcgggctcttccgccatggcgcgcctctccgaggcgaagggcgcggtcgagcttcttctggggcaggcctatgcccggcgcgaccatgtctcgctgctggccttccggggccgcgacgccgagctgatcctgccgcccacccgcagcctcgtgcagacgaagcggcgccttgcgggcctgcccggcgggggcggcacgccgctcgcccacgggctgcggctggcgctggccgtggggcttcaggcccgcgcgcgcggcatgacacccacggtcgcgcttctgaccgacgggcgcggcaacatcgcgctcgatggctcggccaaccgggcgcaggccgaggaggatgcgctgaagctcgcggcctcgctgcgcggctcgggtctgcccgcggtcgtgatcgacacggcgaaccgcccgcagccctcgctcgcggccctcgcccgcgccctcgacgcgccctacatcgccctgccgcgggccgatgcccacaagctctcgaacgtcctcggcgcagcaatgggagac

SEQ ID NO: 31437 - DNA, 1554 bp, Rhodobacter sphaeroides
atgccctcgatctcgcccgcctccgacgccgaccgcgcccttgtgatcggctccggactggggggccttgcggctgcgatgcgcctcggcgccaagggctggcgcgtgacggtcatcgacaagctcgacgttccgggcggccgcggctcctcgatcacgcaggaggggcaccggttcgatctgggacccaccatcgtgacggtgccgcagagcctgcgcgacctgtggaagacctgcgggcgggacttcgacgccgatgtcgagctgaagccgatcgatccgttctacgaggtgcgctggccggacgggtcgcacttcacggtgcgccagtcgaccgaggcgatgaaggccgaggtcgcgcgcctctcgcccggcgatgtggcgggatacgagaagttcctgaaggacagcgaaaagcgctactggttcggttacgaggatctcggccgccgctcgatgcacaagctgtgggatctcatcaaggtgctgcccaccttcgggatgatgcgggccgaccggtcggtctaccagcacgccgcgcttcgggtgaaggacgagcggctgcgcatggcgctctcgttccacccgctcttcatcggcggcgaccccttcaacgtgacctcgatgtatatccttgtgagccagctcgagaaggagttcggcgtccattatgccatcggcggcgtggcggccatcgccgcggccatggcgaaggtgatcgaggggcagggcggcagcttccgcatgaacaccgaggtggacgagatcctcgtcgagaagggcaccgccaccggtgtgcggctcgcctcgggcgaggtgctgcgggcgggtctcgtggtctcgaatgcggatgcgggccatacctacatgcggcttctgcgtaaccatccgcgccgccgctggaccgacgcccatgtgaagagccggcgctggtcgatggggctgttcgtctggtatttcggaacgaaggggacgaagggcatgtggcccgacgtcggccaccacacgatcgtcaatgcgccgcgctacaaggggctggtcgaggacatcttcctcaagggcaagctcgcgaaggacatgagcctctatatccaccggccctcgatcaccgatccgaccgtggcgcccgagggggatgacacgttctatgcgctctcgcccgtgccgcatctgaaacaggcgcaaccggtggactggcaggctgtggccgagccctaccgcgaaagcgtgctcgaggtgctcgaacagtcgatgccggggatcggggaacggatcgggccctcgctcgtcttcacccccgagaccttccgcgaccgctacctcagcccctggggcgcgggcttctcgatcgagccgcggatcctgcagtcggcctggttccggccgcacaacatttccgaggaggtggcgaacctgttcctcgtgggcgcgggcacccatccgggtgcgggcgtgcccggcgtgatcggttcggccgaagtgatggccaagcttgcccccgatgcgccacgtgcgcgccgcgaggccgaacctgctgaaaggcttgccgcggaa

SEQ ID NO: 31438 - DNA, 354 bp, Rhodobacter sphaeroides
aagatgaaatacaccaaggagcatgaatggctgcgggtcgagggcgacctcgtcgtggtcggcatcaccgaacatgcggcgacgcagctcggcgatgtcgtgttcatcgagctgcccgagatcgagaccgtggtcgcggagggcgacgaggtggcggtgatcgagagcgtgaaggccgcctcggacatttcggcgccgatggacggcgagatcgtcgcggtgaacgagaagctcgtcgacaagcccggcctcgtcaacgacgacccgatggccgcctggttcttcaagatgaaggtcgacgacctctcggtgctcgacgacttcatggacgaggacgaatatcaggatctgatc

SEQ ID NO: 31439 - DNA, 2013 bp, Rhodobacter sphaeroides
gacaaagggacgatgatgttcaagaagatcctgatcgcgaaccggggcgagatcgcctgccgcgtcatcaagaccgcccgcaagatgggcatccagacggtggccgtctattccgacgccgaccgcaatgcgctccacgtcagcatggcggacgaggcgatccacatcgggccgccgcccgccaaccagtcctatatcgtgatcgacaagatcatggaggcgatcaaggcctcgggcgccgaggcggtgcatccgggctacggcttcctgtcggaacggatggatttcgccgcggcgctcgaggcggccggcgtggtcttcatcggcccgccctcgggcgcgatcgaggcgatgggcgacaagatcacctcgaagaagctggcgaaagaggcgggcgtctcgacggttccgggctacatgggcctgatcgccgacgccgacgaggcggtgaagatctcgaacgagatcggctatccggtgatgatcaaggcctccgccggcggcggcggcaagggcatgcgcatcgcctggagcgaggccgaggtcaaggaaggcttcgaatcctcgaagaacgaggccgccaacagcttcggcgacgaccggatcttcatcgagaagttcgtgacccagccgcgccatatcgagatccaggtgctggccgacaaacacggcaactgcgtctatctgcacgagcgggaatgctcgattcagcgccgcaaccagaaggtcatcgaggaggcgccctcgcccttcctcgacgaggccacccgcaaggccatgggcgagcaggcctgcgctctggccaaggccgtgggctatgcttcggccggcacggtggagttcatcgtggacgggcagaagaacttctacttcctcgagatgaacacccgcctgcaggtggagcacccggtcaccgagctcatcaccggcatcgacctcgtcgagcagatgatccgcgtggcggccggcgagaagctgcccttccagcagtcggacctgaagatcaacggctgggcgatggagagccgtctctatgccgaggatccctaccgcaacttcctgccctcgatcggccgcctcacccgctaccgcccgccggtggagagcgtgacgccgacctcggtcgtgcgcaacgataccggcgtctacgagggcggtgagatctcgatgtattatgacccgatgatcgccaagctctgcacctgggcgccgacgcgggaagcggccatcgaggagatgcgcctcgcgctcgacacgttcgaggtggaggggatcggccacaacctgcccttcgtgggcgcggtgatggaccatccgcgcttcgtgaagggcgacatcaccacggccttcatcgccgaggaatatcccgacggcttccagggcgcggtgctcgacgagccgacgctgcgccgggtggccgccgccgccgccgcgatgaaccgcgtggccgagatccggcgcacccgcatctcgggaacgatgaacaaccacgagcggcatgtgggcgtcgactgggtggtggcgctgcagggcgagagctatcacgtcagcatcgccgccgaccgtgagggctcgacggtcagcttctcggacggctcctcgctgcgcgtgacctcggactggacgccgggccagccgctcgcaagcctgatggtcgacggcaggccgctggtcatgaaggtgggcaagatcccgatgggcttccgcctgcggctgcgcggcgcggatctgaaggtcaatgtccgcaccccgcgtcaggccgagcttgcgcttctcatgcccgagaagctgccgccggacacgtcgaaatacctgctctgcccgatgccgggcctcgtggtgaagatcaacgtggccgagggcgacgaggtgcaggagggtcaggcgctggccacggtcgaggcgatgaagatggagaacatcctgcgcgccgaacgccgcggcacggtcaagaagatcgccgccgcgccgggggcgagcctgcgggtcgacgatgtgatcatggagttcgaa

SEQ ID NO: 31440 - DNA, 684 bp, Rhodobacter sphaeroides
accggcgcttcgggcggcatcggcggcggcatcgcgcgcgcgctccatgcgcgggcgacggtgccttccgcaccggacgggaccgctcgaagagctggcggccgagctgggggatcgcgcccatgtgctcgcctgcaacctctcggatgcggcggccgtcgaggcgcgccgacagcgcgaggatgggccgtgacactcgtgacagcgggcatcacccgcgatcagctcgccatgcgcatgtcggacgaggattgggagcaggtgatcgaggtgaacctgacctcgaccttccggctctgccgcggcgtgctgcgcggcatgatgaaggcgcgctgggggcggatcgtcaacatcacctccatcgtgggcgcgacgggcaatccggggcaggccaattatgccgcctcgaaggcgggcgtcgtggccatgtcgaaaagctttgcggccgaggtggcgagccgcggcatcaccgtcaatgcggtggcgccgggcttcatcgcgaccgcgatgaccgacaagctgaacgacgagcagaaggcgcggattctgggtcaggtgccgatgggccggatgggcgcccccgacgatatcgcggcggccgtgctctatctggccagtcccgcggcgggctatgtgacgggggccacgctccatgtgaacggcggcatggcgatgctgtgaaaa

SEQ ID NO: 31441 - DNA, 237 bp, Rhodobacter sphaeroides
atgagcgacatcgctgatcgcgtgaagaagatcgtcgtcgagcatctgggcgtcgaagaggagaaggtgaccgagaatgcctcgttcatcgacgacctcggcgcggacagcctcgacacggtcgagctcgtgatggccttcgaggaagagttcggcatcgagatcccggacgatgcggccgaaaccatccagaccttcggcgatgcggtgaagttcatctcggaagccgcctgagct

SEQ ID NO: 31442 - DNA, 1251 bp, Rhodobacter sphaeroides
cgtcgagtggttgtcacggggctgggcatggtcacgccgctggcgtgcggcgtcgaggagacctggaagcggctgctggccgggcagtccggcgcgggtccgatccagcggttcgacacgtccaacgtgaccacgcaatatgcctgcgagatcccggtgggcgacggcagcgacggcaccttcaacgccgacgactggatggagcccaaggacaggcgcaaggtcgacgatttcatcctctatgccatggccgcggccacgcaggcggtgaaggattccggctgggagccgcaatccgaggaagaccgctgccgcacgggcgtgatgatcggctcgggcatcggcggcctctcggccatcgccgacacggccgtgctcatcaaggaaaaggggccgaagcgcgtctcgcccttcttcatcccctcggcgctcatcaacctggcctcggggcaggtctcgatccgcttcggctacaagggtccgaaccatgccgtcgtgaccgcctgctcgaccggcgcccatgcgatcggcgacgcggcccggctgatccagctcggcgatgccgacgtgatgctcgcgggcggcgccgagagcccgatctccgagatcggcatcgcgggcttcaacgcctgcaaggcgctctcgaccaagcggggcaacgagcccgaggccgcctcgcggccctgggacgccgaccgcgacggattcgtgatgggcgagggcgcgggcgtcgtcgtgctcgaggaatatgaacatgccagggcgcgcggcgccaagatctatgccgaggtgctgggctacggtctttccggcgatgcctaccacatcaccgccccctcggaagacggggacggcggcttccgctcgatgaccatggcgctgaagcgcgcgggcctcgaaccctcggcggtcgactatatcaacgcccacggcacctcgaccatggccgacgtgatcgaactcggcgcggtcgagcggcttctgggcgaggcggcggcggcggccaccatgtcctcgaccaagtcgagcatcgggcacctgctgggcgctgcgggcgcggtcgaggcgatcttctgcgtgctggccatccgcgatcaggtggcgccgcccacgctgaacctcgacaacccggccgtggaggcgaggatcgacctcgcacccaaggcggcgcgcccgcgcaagatcgacgtggcgctatcgaattccttcggcttcggcggcacgaacgcgtcgctggtgctgggacgggtc

SEQ ID NO: 31443 - DNA, 783 bp, Rhodobacter sphaeroides
ctggtgctgctcggctgcgggaagatgggctcggcgatgctcgagggctggctcggacggggccttgcgctctccgccgtctgggtgacggaccccaggccgtcggactggctgaaatcgctcgcggcgcgcgggctgcatctgaacgaggcgctgcccgacgagcccgcggtggtgctggtcgcggtcaagccgcagatgatgtccgaggccctgccggggctcgcggcgctcggcgaagggcgggtgcttttcctgacggtcgcggcgggcacgcccatctcctattacgaacgcacgctgggcgcggccacgccggtgatccgcgccatgccgaacacacccgcggcggtcggccgcggcatcacggcgctggtgggcaatgctgccgcctcggaggcgcagatggcgctggccgaggatctcctctcggcggtgggccaggtggtccggctcgagggcgagcatcagatggatgcggtgaccgcggtctcgggctcggggccggcctatgtcttccacctgatcgaggcgctcgccgcagcgggcgaggccgaggggctgccggccgatctcgccatgaccctcgcccgcgccaccgtcaccggcgcgggcgagcttgcccatcgcgcgccggaaagcgcgagccagctgcgcgtgaacgtgacctcgccggggggcacgacggcggcggcgctcggcgtgctgatggatcccgagagcggcctgccgccgctcctccgccgcgcggtgaaggctgcggccgaccgcggacgggagctc

SEQ ID NO: 31444 - DNA, 696 bp, Rhodobacter sphaeroides
atgaccgccatcgtctccgtccgcgatctggtgaagacctacgacaccggcttccgggcgctgaaatccgtcagcctcgacattcgcgagggcgagatcctcgcgctcctcggcccgaacggcgccggcaagaccacgctcatctcgacgatctgcggcatcgtgcgcccgacttcgggccaggtcacggtgggcggccacgacatcgcctccgactggcgcgcggcgcgggcgatgatcggcctcgtgccgcaggagatcgcgctcgagcccttcgagaaggtgttccgcagcgtgagctacgcccgcgggctctatggcaagccgccggaccccgcccatgtcgagcgggtgctgcgtcagctctcgctctgggacaagaaggacagcgcgatccagccgctctcgggcggaatgaagcggcgggtgctgatcgccaaggcgctggcgcacgagccgcgggtgctctttctcgacgagcccacggcgggcgtcgatgtggagctgcgcaaggacatgtgggccgtggtcgaggatctgcgggcagagggcgtgaccatcatcctgaccacccattacatcgaggaggccgaggccatcgccgaccgcgtggggatcatcacggggggcgagatccttctcgtagaggacaaggcgagcctgatggcgcggatgggccgcaaggagctgaaggtg

SEQ ID NO: 31445 - DNA, 993 bp, Rhodobacter sphaeroides
atggcactcatcacgcttcgccagcttctcgatcacgcggccgaacagggctacggcgttcccgccttcaacatcaacaacatggagcagggtctcgcgatcatggaggcggcgcgggcctgcgatgcgcccgtcatcatccaggccagccgcggcgcgcgcagctacgccaacgacatcatgctggccaagatgatcgaggcgctggccgcgatctatcccgagatcccgctctgcatgcatcaggaccacggcaacaacgaggccacctgcatgaccgcgatccggcacggcttcacctcggtgatgatggacggctcactgaaggccgatgccaagacgcctgccgattatgactacaatgtcgatatcaccgcccgcgtgagccacatggcgcattgggtgggcgcctcggtcgagggtgagctgggcgttctgggcagcctcgagaccggcgagagcgaggccgaggacgggcatggcgcggaaggcaagctcgatcacagccagctgctgaccgaccccgatcaggcggtggatttcgtgaagaagacccaggtcgatgcgctggccatcgcctgcggcacctcgcacggcgcctacaagttcagccgcaagcccgacggcgagatcctcgccatgtcggtgatcgaggcgatccacaagaagctgcccgacacccatctcgtgatgcacggatcctcgtcggtgccgcaggagctgcaggacatcatcaacgcgttcggcggcgccatgccgcagaccttcggcgtgccggtcgaggagatcgtgcgcggcatcaagatgggcgtgcgcaaggtcaatatcgacaccgactgccgcatggcgatgaccgggcagttccgccgcatcgcgcagcagacgccttccgaattcgacccgcgcaagttcctcaagcccgcgatggatgcgatgcgcgacctctgcaagcagcggctcgaagccttcggcaccgcaggccaggccgggaag

SEQ ID NO: 31446 - DNA, 999 bp, Rhodobacter sphaeroides
atgacaatcagggttgccatcaacggcttcggccgtatcggccgcaacgtgctgcgggccatcgtggagtcggggcgcaccgatatcgaggtggtcgcgatcaacgatctgggtcaggtcgagaccaacgcgcatcttctgcgcttcgacagcgtgcacggccgcttcccggccaaggtcaccagcggagacgactggatcgatgtgggccgcggcccgatcaaggtgacggcgatccgcaatccggcggagctgccctgggcgggtgtcgacatggcgatggaatgcacgggcatcttcaccaccaaggagaaggccgcggcccatctgcagaacggggcgaagcgggtgctcgtctcggcgccctgcgacggggccgaccggaccatcgtctatggggtgaaccatgcgacgctcaccgcggacgacctcgtggtctcgaatgcctcctgcaccaccaactgcctctcgccggtggccaaggtgcttcacgatgcgatcggcatcgccaagggcttcatgaccacgatccacagctatacgggcgaccagcccacgctcgacacgatgcacaaggatctctaccgcgcccgcgccgcggcgctgagcatgatccccacctcgacgggagcggcgaaggcggtgggcctcgtgctgcccgagctcaagggccggctcgacggcgtgtcgatccgggtgcccacgcccaatgtctcggtggtggatctggtgttcgaggccgcccgcgacacgacggtggaggaggtgaatgcggccatcgaggccgccgcctgcggaccgttgaagggcgtgctgggcttcacgaccgagcccaacgtctcgtccgacttcaaccacgacccgcattcgtcggtgttccacatggaccagaccaaggtgatggagggccgcatggtccgcatcctcagctggtacgacaacgaatggggcttctcgaaccggatggccgacaccgccgtggcgatgggccggcttctc

SEQ ID NO: 31447 - DNA, 993 bp, Rhodobacter sphaeroides
atggccatcgagctggaggacctggggctgagccccgatgtggcggacgtgatgcagcgtctggcgcgcgtgggggcaggcatcgcccgcatcatctcgcgcaacgggctcgagcgcgatctgggcgcgggcgtcggcaccaatgccggaggagacgggcagaaggcgctcgacgtgatcgcggacgacgcgttccgcgcggcgctcgaaggctctgcggtggcttattacgcctccgaggagcaggacgaagtggtgacgctgggcgagggaagcctcgcgctcgccatcgacccgctggacggctcgtccaacatcgatgtgaacgtgtcgatcgggacgatcttctcgatcttcccggcggcggctggccccgaggccagcttcctgcgcccgggcaccgagcagattgccggcggctacatcatctacgggccgcaatgcgcgctggtctgcagcttcgggcagggcgtgcagcactgggtgctcgacctcgatgcgggcatcttccggcggatgcccgacatccgcccgctgccggccgagacgtccgagtttgcgatcaacgcctcgaactaccgccactggccgcagccgatccgcgccttcgtcgacgatctggtcgccggggccgaggggccgcgcggcaagaacttcaacatgcgctggatcgcctcgctggtggccgagacgcaccgcatcctgatgcggggcggggtgtttctctatcccggcgacgagcgcaagggctacgagcggggccggctgcgccatgtctacgaatgcgcgcccatcgccttcctgatcgcgaatgtcggggggggcgccaccgacggctgcgccgacatcctgaccgcgctgcccgaccggctgcacgcccgcacccccttcgtcttcggctgcgcgagcaaggtcgcccgcgtcgccgcctatcacgatctggcctgcgaagagacgtccgctctcttcggcagccggggcctgttccggagt

SEQ ID NO: 31448 - DNA, 1403 bp, Rhodobacter sphaeroides
gttcgcaccgctgccaccatggagcgcacaggcgccatcggcgccgtgctcgaggctatggatgcgcccgccaatctgcgcgtggtggcgcgggtgctcggctggccgttcaagtggctggggctgcccggcgatccggcgctgccgccggcgacgcgggcgctgacggcgctcgggccggcctacatcaagttcggacagatcctctcgacccggcccgacgtggtgggccccgagatggcgctgcagctccagtatctgcaggacaagctgccgcccttccccacgtccgtcgccaaggccctgatcgaggaggagctgcatctccccgtcgaccgcgtcttctcggaattctccgagccagtcgcggcggcctcgatcgcgcaggtccaccgcgcacggctggccgacaccggggtcgaggtggcggtcaaggtcctgcgcccggggatcgagcgcgccttccgcaccgacatcgacgccttctatctcgccgcgcagatcatcgagcttctgtctccctcctcgcgccgcctgcgtccgaccgaggtcatccgtcatttcgaaggcgtggtgaacggcgaactcgacctgcggctcgagtcggcctcggccggcgaattcgcggtgaataccgaggcggacgcgggctttcaggtgcccaagccggtctggaacctttcggcgcggcaagtcatgaccatcggctgggcagagggcctctcgcttgcggacaatcccgcgctcgacgcggccggccacaaccggaccgagctcggcacgcgcgtgctctcgctcttcctcagtcatgcgctgcgcgacggcttctttcacgccgacatgcatcagggcaacctgaaggtggccgcgaacggcgatattatcgcctatgatttcgggatcatggggcggctcgacgaatatacccgccgcgtctatgccgagatcatcttcggcttcatccagcgcgactatcgccgcgtggccgaagtccatttcgaggcgggctacgttccggccgaccgcgacatcgacgaattcgcccgcgccctgcgcgcggtgggcgaacccatcttcggcatggatgcctcgcggatctcgatggcgcggctgctcgcctacctcttcgaggtgaccgagcggttcggcatggagacgcggaccgaactgatcctccttcagcggacaatggtagtcgtcgaaggggtcgcacgctcgctcgatccccatatcaacatctggcaggtcgcccgcccgatcgtcgaggattacatccgcgacaatgtggggccgaaggctgtcgcccgcgatctcctgcggacagcgcggatcctcgggcggttcgggccgcgcctgccgcgactcgtcgaggcacggctgatccggcagggccatcccgaggt

SEQ ID NO: 31449 - DNA, 1272 bp, Rhodobacter sphaeroides
atgagcacgatcatcgacatccacgcccgcgagatcctcgacagccgcggcaaccccaccgtcgaggtggacgtcacgctggaaagcggcgccttcggccgcgccgccgtgccctcgggcgcctcgaccggcgcgcacgaggccgtcgagaagcgcgacggcgacaagtcgcgctacatgggcaagggcgtgctcgaggcggttgcggctgtcaacggcgagatcgccgagatgctggtgggcttcgatgcgaccgaacaggtcggcatcgaccgcaccatgatcgagatggacggcacgccgaacaagggccgcctcggcgcgaacgcgatcctcggcgtctcgctggcggtggccaaggccgcggccgaattcaccaaccagccgctcttccgctatgtgggcggctcgtccgcgcgcgtcctgccggtgccgatgatgaacatcatcaacggcggcgaacatgccgacaacccgatcgacatccaggaattcatgatcatgccggtggccgcgcagaatgtgcgcgaggcgatccgcatgggctcggaagtgttccacacgctgaagaaggagctcgccgcgggcggcttcaacaccggcatcggcgacgagggcggctttgcgccgaacatctcctcgacccgcgaggcgctggactacatcctgcgctcgatcgagaaggcgggctacaagccgggcgaagacatctacctcgcactcgactgcgcctcgaccgaatatttcaagggcggcaaatacgagatgaagggcgagggcaagtcgctgacctcggccgagaacgtggattatctcgccgccctctgcgccgactatccgatcatctcgatcgaggacggctgcgccgaggacgactgggagggctggaaactgctgaccgacaagctcggcgccaaggtgcagctggtgggcgacgacctcttcgtgaccaaccccaagcgtctcgaacagggcatcaaggcgggcgtcgcgaactcgatgctggtcaaggtgaaccagatcggctcgctgaccgagacgctgatggccgtcgatatggcccaccgcgcgcgctataccaacgtcatgtcgcaccgctcgggcgagaccgaggatgcgaccatcgccgatctcgccgtcgccaccaactgcggccagatcaagaccggctcgctgtcgcgctcggaccgtctggcgaaatacaaccagctgatccgcatcgaggaaatgctgggcgaagtggcggaatatgccggccgctcgatcctgaag

SEQ ID NO: 31450 - DNA, 1809 bp, Rhodobacter sphaeroides
atgtgcgggatcgtcggagtcctcggcaaccacgaggtcgcaccgctgctggtcgaggcgctgaagcgtctcgaatatcgcggctatgactcggccggcatcgccacagtcaatggcggccggctcgaccggcgccgtgccgtgggcaagctcgtcaatctgtccgacctgctcgtccacgatccgctggcgggcaagagcgggatcggccacacccgctgggccacccatggtgcagccaccgtgaccaacgcccacccgcatcgtgcaggccccgtggcggtggttcacaacggcatcatcgagaacttccgcgacctgcgggccgagctcgccgaggccggcttcgccttcgagacccagaccgacaccgagacggtggcgctgctcacgcagatgcacatggcccgcggcctcggaccgcgcgaggcggccgccgagacgcttgcgcggctgacgggcgcctttgcactctgcttcctcttcgagggcgaggacgatctgctgatcgccgcgcgccggggctcaccgctcgccatcgggcacggcgacggcgagatgttcgtgggatctgacgcgatcgccctcgcgccgatgacggatgcgatcacctacctcgaggaaggcgactgggccgtcgtgacccgcgccggtgccgagatcttcgacagccacggccggcgcgtgaaccgcgcgaccacccggatccagatcgatgccgcgcggatcgagaaggcgggctacaagcatttcatggccaaggagatcgccgagcagccggtcgttctggcggatgcgctgcgccactatgtgcaggatggccggatcaacctgccgggcgtggatttcaccggcgtggaccgggtgacgctcgtcgcctgcggcacggcctcctacgcctgccatgtggcgaaatactggttcgagcagattgcgggcctgccggcggacgtggatatcgcctcggagttccgctaccgcgagccggtgctctcgcccacctcctgggcggtgttcgtgagccagtcgggcgagaccgccgacacgctggccgctctccggcatgcgggcgacgccgtggcgcggacgcttgcagtggtgaacgtgcccacctcctcgatcgcgcgcgaggcgaacctcgcgctgccgatcctcgcgggcatcgaggtgggcgtggcctccaccaaggccttcacctgccagctgaccgtgctcgcccttcttgcgctgaaggcggcgcaggatcgcgggcggatcgacgcggccgagctcggccgcaggctcgacgcgctggcgacgctgcccggtctcatgaaccatgctctgcggctggccgacgacatccgcgatctggcgggcgagcttgccgaggcgcaggacattctgttcctcgggcgcgggccaatgtacccgctggcgctcgaaggggcgctgaagctgaaggagatcagctacatccacgccgaaggctatgcctcgggcgagctgaagcacggccccatcgccctgatcgacaaccgggtgccggtgatcgtgatggcgccgcgcgacgcgctgttcgacaagaccgtgtcgaacatgcaggaggtgatggcccgtcacggcaaggtgctcttgatctcggatgcgcgcggcatcgaggaggcgggggccgggtgctggcgcacgctcgccctgccccaggtcgccgattttctggcgccgatcctctatgcggtgccggcacagcttctggcctaccacacggccatcgccaagggcaccgacgtcgaccagccgcgcaacctcgcgaagtcggtgacggtggaa

SEQ ID NO: 31451 - DNA, 1699 bp, Rhodobacter sphaeroides
ctggaaaaatgcgcggcgaattacgcggcgcttacgcccctgtcgcacctcaagcgcgccgcggaggttcataccgaccgcaccgctctcgtgaatggctcgatccggctgacctacggcgaatatcacgcccgcgtcagccgcctcgcctcggcgctggcgggcatgggcatccagtcgggcgacgtggtggcgacgctcctgcccaatatcgccgcccatgccgaggctcatttcggggtgcccgcctgcggcgcgatcctgaacgcgatcaacacgcgcctcgatctggataccgtgtcctatatcctcgagcatggcggggcgaagctcctgctctgcgatacggccttcctgaagctcgcgaaggatgcctgcgcccggctggaaggaaaggcgccgatcctcgtcgaggtctgcgaccgcgaggcgggcttctctccttcgggcgaggtgctggaatatgaggacctcatggaccgcggcaacccgtgggcgcccctgggtgatgcccgaggacgagtgggagagcatcgcgctcaactatacctccggcacgacggggcggccgaagggcgtggtctaccaccaccgcggcgcctatctctcgacctacggcaatgccatcgcctggcggatgcagctctacccggtctacctgaccatcgtgccgctctttcactgcaacggctggtgtcacacctggatggtgccgatgctgggcggtaccgtcgtctgctgccgcgacatcaccgcgacggcgatctatgcggccatcgccgacgagggcgtgacccatttcggcggcgcgcccatcgtgctcaatacgctcatcaatgcagctcccgaagaccggcgcagcttcgatcaggtggtggaggtcttcaccgcgggcgccccgcccccggccgcaacgctggcggccatcgaaccgctcggcttcaacgtgacccaggtctacgggctgaccgaagtctatggcccggccaccgaatgcatctggaagcccgagtgggacgagacggcgggcgaggagcgttcggcgctgaaggcgcgcaccggcgtcgccatggcgaccctcgaaggggccgaggtgcacgacacccacggccagccaatcccgcgcgacacggtccatctgggcgagatcgcgatgcgcggcaacatggtgatgaagggctattacaagaaccccgaggccacggccgaagccttccgcgacggctggttccgctcgggcgacatcgccttccagcatcccgacggctatatcaagatcaccgaccgcgcaaaggacatcatcatctcgggcggcgagaacgtctcgtccgtcgaggtggaaggcgtgatcgcccaccatccggccgtcagcctctgcgccgtggtggccaagcccgacgagcgctggggcgaggtgccctgcgccttcgtcgagctgaagcgcggccggcaggccaccgaggaggagatcatcgccttcgcgcgcgagcgtctggcgggcttcaagacgcccaagcaggtcatcttctgcgaattgcccaagacctcgaccggcaagatccagaagttcgaactgcgcgccgtggccaagctcgccgtgacggagacggaagacgcccgttgaggggcggcggtgattgtgactggcggtgaggcaggctatcgtcgcgcggcaggaactcagggccggggccgaccg

SEQ ID NO: 31452 - DNA, 1884 bp, Rhodobacter sphaeroides
catacgatggcatacgcaagtctctacaaatggtctctggaggatcccaacggcttctggatgaaggcggccgagcagatcgactgggtgagcccgccctcgaaggctctgttcgacgagaaggagcccttctacgaatggttcgccgacggacaggtgaatgcctgctggaacgccgtcgaccgccatgtcgaggccgggcgcggcaagcagatcgccatcgtccacgaaagcccgatcacccattcctcgaagggcatcacctatgccgagctgcaggcccgcgtggcctcgctcgcgggggcgctgcgggccaagggcgtggagaagggcgaccgcgtcatcatctacatgccgatgatccccgaggcgctcgaggcgatgctggcctgtgcccgccttggcgcgatccactcggtcgtcttcggcggtttcgcggcgcacgaacttgccgtccgcatcgacgactgcacgcccaaggccatcatcgccgcctcctgcgggctcgaaccgtcgcgcgtcgtccattacaagccgctgctcgatcaggccatcgaggaggccagccacaagcccgacttctgcgtgatcttccagcgcgagcaggaagtggccaagctgatcgagggccgcgacgtggcctggcacacgttccagtatggcgtggagccggccgaatgcgtgcccgtcgagggcaaccatccggcctatatcctttatacctcgggcacgaccggccagcccaagggggtggtgcgcgccaccggcggccatctcgtcgccctgaactggacgatgaaggccatctacgacatcgacgcgggcgacgtcttctgggccgcctcggacgtgggctgggtcgtgggccacagctatatctgctacgggccgctgatcgcgggtgccaccaccatcgtctacgagggcaagcccgtcggcacgccggatgcgggcgccttctggcgcgtgatgcagaaccacaaggtgaagaccttcttcaccgcccccacggcgctgcgggccatcaaacgcgaggatccgcagggcgcgctcattcaggactacaacctgcgcaacctcaaggcgctcttcctcgccggcgagcgcgcggaccccgacacgatcgtctgggcgcagaagaacgtgggcgtgccggtcatcgaccactggtggcagaccgagagcggctgggccatggctgcgaacccgctcgggatcgaggcgctgccggtcaagatcggcagcccttcgctgccgatgccgggctatgacgtgcgcgttctcgacgagggcggccaccagctggaggcaggtcagctcggcgccatcgcgatcaagctgccgctgcctccgggcacgctgcccacgctctggaacgcgcaggaccggttcgtgaaaagctacctcacgcacttccccggctattacgagacgggcgacgcgggctacatcgacgaggacggctatatctatatcatggcccgcaccgacgatgtcatcaacgtggccggccaccgcctctcgacgggcgcgatggaagaggtgctggcctcgcacgaggacgtggccgaatgcgcggtcatcggcgtcaccgacgcgctgaagggccagtcgccgctgggcttcctctgcctcaacaagggctcgaaccgggcggccgaggatgtggtgaaggaatgcgtcaagctcgtgcgcgagaagatcggcccggtcgccgatttcaagcgcgcctgtgtcgtggaccggctgcccaagacccgctcgggcaagatcctgcgcggcacgatggtcaagatcgccgacgggcaggagttcaagatgcccgcgacgatcgacgatccggccatcctcgacgagatccgcgttgcgctcgaggcggtgggc

SEQ ID NO: 31453 - DNA, 3432 bp, Rhodobacter sphaeroides
aagatcctcatcgccaaccgtggtgagatcgccatccgggtgatgcgggcggcaaacgagatgggcaagaagacggtcgccgtctatgccgaggaagacaagctctcgctccaccgcttcaaggcggacgaggcctaccggatcggcgagggcctctcgcccgtgggcgcctatctctcgatccccgagatcatccgcgtggcgcagatgtcgggcgccgatgcgatccacccgggctacgggcttctgtcggagaaccccgatttcgtcgaggcctgcgacgcagcgggcatcgccttcatcggcccgaaggccgagacgatgcgcgcgctcggcgacaaggcttcggcccgccgcgtggccatggccgcgggcgtgccggtgatcccggcgaccgaggtgctgggcgacgatatggaggagatcaagcggcaggcggccgagatcggctatccgctgatgctcaaggcctcgtggggcggcggtgggcgcggcatgcggcccatcacttccgaggccgagctggccgacaaggtgcgcgagggccgacgcgaggccgaggccgccttcggcaacggcgagggctatctcgagaagatgatccagcgcgcgcgccacgtcgaggtgcagatcctcggcgacaaatacggcgcgatctaccatctctacgagcgcgactgcaccgtgcagcggcgcaaccagaaggtcgtcgagcgcgcgcccgcgccttatctcaccgaggagcagcggacagagatctgcgagctcggccgccggatctgcgcccatgtgaattacgaatgcgcgggcacggtcgagttcctgatggatatggactcggagaaattctatttcatcgaggtcaatccgcgggttcaggtcgaacataccgtcaccgaggaagtgacgggcatcgacatcgtgcaatcccagatccgcatcgcggaaggggcgacgctggccgaggcaaccggatgcccgagccaggacgacatcaagctctcgggccatgcgctgcagtgccgcgtcacgaccgaggatccgcagaacaatttcattcccgactacggccggctcaccgcctatcgctcggccacgggcatgggcatccggctggacggcggcacggcctatgccgggggcgtcatcacccgctattacgattcactcctcgtgaaggtgacggcctgggcccccacgcccgaaaaggccatcgcgcggatggaccgggcgctgcgcgagttccgcatccggggcgtggccaccaacatcgccttcgtcgagaacctgctgaagcacccgagtttcctcgactattcctacacgacgaaattcatcgacacgacgcccgacctcttcaacttcaagccgcgtcgtgaccgggcgacgaagatcctgacctacatcgccgacatcaccgtgaacgggcaccccgagacggccggccgggtccgcccctcggccgagctgaaggatccgaaggcacccgagcccaagggcgcaccgcagcccggcacgcggaccctcctcgaggagaagggcccgcaggcggtggccgactggatggccgcgcagacccgcgtgctgatgaccgacacgacgatgcgcgacggccaccagagcctgctcgccacccggatgcgctcgatcgacatgatcaaggtcacgcccgcctatgcggcgaacctcggcggcctcttctcggtggaatgctggggcggcgccaccttcgatgtggcctatcgcttcctgcaggaatgtccctggcagcggctgcgcgacatccgcgcccggctgcccaacgtcatgacgcagatgctgctgcgcgcctcgaacggggtcggctatacgaactaccccgacaatgtggtgcaggaattcgtccgtcaggcggccgaaaccggcgtcgacgtgttccgcgtgttcgactcgctcaactgggtcgagaacatgcgcgtggcaatggatgcggtgatcgaggccaacaaggtctgcgagggcacgatctgctacacgggcgacctgctcgatcccgaccgctccaaatacgatctgaactactatgtcggcatgggccgcgcgctgcgcgacgcgggcgcgcatgtgctgggtctgaaggacatggccgggcttctgaagcctgccgccgcccgcgtgctggtgaaggcgctgaaggaggaggtgggcctgccgatccacttccacacccacgacacgagcggaattgcgggcgcgaccgtgctcgccgcctgcgatgccggggtggatgcggtcgatgcggcgatggacgccttctcgggcggcacctcgcagccctgcctcggctcgatcgtcgaggcgctgaagcacaccgaccgcgacacgggcctcgacatcgcggcgatccgcgagatctcggactactggggccatgtgcgccagcagtattcggccttcgaatcgggcctgccctcgcccgcctccgaggtctatctgcacgagatgcccggcggccagttcaccaacctcaaggcgcaggcgcgctccatggggctcgaggaacgctggtccgaggtggcgcaggcctatgccgacgcgaaccggatgttcggcgacatcgtgaaggtcacgccctcgtcgaaggtggtgggcgacatggcgctgatgatggtggcgcaggggctgacgcgggaagaggtcgaggatcccgaggtcgaggtgagcttcccggactcggtcgtggacatgctcaagggcaatctcggccagccccacggcggctggcccgagccgatcctgaagaaggtgctgaagggcgaggcaccctcgaccgagcgaccgggcgcgcatctgccgcccgtcgacatcgcagccgcgcgcgagaagctcctgtcggagatcaagcagggcgacgacgatccgctcgacacggccgtcgatgccgaggatctgaacggctacctcatgtatcccaaggtcttcaccgactaccgcgcccgccacaggatctacgggccggtgcggacgctgccgacccggaccttcttctacgggatggagccgggcgaggagatctcggccgaaatcgaccccggcaagacgctcgagatccggctgtccgccgtgggcgagacgtcggacgacggcgatgccaaggtgttcttcgagctgaacggccagccgcgggtgatccgcgtggccaaccgggcggtgaaggccaagaccgcgacccggcccaaggcgcaggacggcaatccggcccatgtcggcgccccgatgccgggttcggtcgcctcggtcgcggtctcggcgggccagaaggtgaagccgggcgatctcctcgtcaccatcgaggcgatgaagatggagaccgggctccatgccgaccgtgcggccaccgtgaaggctgtccatgtcgggcccggcgcgcagatcgaggcgaaggacctgctg

SEQ ID NO: 31454 - DNA, 1896 bp, Rhodobacter sphaeroides
tatatcgacgagctgaatccggcgcagcgtgcggcggttctggcgctggatggaccggtgctgatgctggccggggcgggcaccggcaagacgaaggcgctgacggcgcgaatcgtgcatctgctcgattcgggaaaggcgcggccgaacgagatcctcgccgtgaccttcaccaacaaggccgcgcgcgagatgaaggaccgggtggcccgccttctggggcaggtcgagggcatgccctggatgggcaccttccacgccatcagcgtcaagatcctgcgccggcacgccgaactggtggggctgaagtcgaacttcaccatcctcgacaccgacgaccagctccggctgctgaagcagctgatcgtcgccgccaacatcgacgagaagcgctggcccgcccggatgctggccggcctcatcgaccactggaagaaccgcgcctggacgccggccaaagtgcccgcctcggaggcgtcggcctacaacaaccgcggcaccgaactctacgaccagtatcagcagcgcctgcgcgagctgaatgccaccgatttcggcgacctgctgctccatgtgctgacgatcttccagtcgcaccccgacgtgctcgagcaatatcgccgctggctgcgctacatcctcgtggacgaatatcaggacacgaacgtcgcgcaatatatgtggctcaggcttctggcgcagacgcaccgcaacatctgctgcgtgggcgacgacgaccagtcgatctacggctggcgcggggccgaggtgggcaacatcctgcggttcgagaaggattttcccggcgcgcaggtgatccggctcgaacagaactaccgctcgaccccgcatatcctcgccgccgcctcgggcatcatcgcggccaatgcgggccggctcggcaagacgctctggaccgagcggcaggagggcgagaaggtccggctgatcggccactgggacggcgaggaagaggcccgctggatcggcgacgaggtcgagagcttccagcgcggccgcggcggcctcggccccttccgtctcgatgacatggcgatcctcgtgcgcgccagccaccagatgcgcgccttcgaggaccggttcctgaccatcgggctgccctatcgcgtcatcggcggcccgcgcttctacgagcggctcgagatccgggatgcgatggcctatttccgcctcgccgtcagcccggacgacgatctggccttcgagcgggtggtgaaccagccgaagcgcggactgggcgacaaggcccagcaggagatccagcgtgaggcccgcgcccatggcacctcgcttctcgaaggcgcgcgcagccttctggcccgcggcggcatcggcgggaagggggcggggcagctccgcgccttcgtcgacggcatggaccgctggcacggcaccacgctcgaccgcgaccatgaccatatccgcctcgccgagcagatcctcgacgagtcgggctacaccgccatgtggcaggccgacaagacgcccgaggcgccgggccggctcgagaacctcaaggagctggtgaaggcgctcgagcagttcgagaacctgcagggattcctcgagcacgtcgccctcatcatggagaacgagaccgaggaatcggtcgacaaagtcacgatcatgacgctccacgcggccaaggggctggagtttcccgtcgtcttcctgccgggctgggaggacgggctgttcccgtcacagcgcgcgatggacgagaccggcctcaaggggctcgaggaggagcggcggctggcctatgtcggcatcacccgtgccgagcagctctgcaccatctcctttgcggccaaccgccgggtctatggccagtggcagagccagctgccgtcgcgcttcatcgacgagctgccg

SEQ ID NO: 31455 - DNA, 1992 bp, Rhodobacter sphaeroides
agctttgcgctgcgcgaggggaggccctttccgctcggggcgacctgggacgggtcgggcaccaacttcgccatcttctcggcccatgcgcgcaaggtcgagctctgcctcttcgatgcccgcgggcggcgcgagatcgcccgcgtggccctgccggaatatacccacgaggtttggcacggctatctgcccgaggtgcgccccgggcagctctacggctaccgtgtccacggaccctacgagccgcaggcggggctccgcttcaatccgaacaagctcctgatcgacccctatgcgctgatgctgcagggcgaggtcgtctggcacgatgcggtcttcggctaccggatgggcaatgcccgcgccgacctctcgttcgaccgccgggactcggccttcgtgatgccgaaatgcgtggtcgtcgatcccgcggtgacctgggggcccgactatccgccgaacatcccctggcccgagacgatcatctacgaggcccatgtcaagggcatgaccgcccagaatgccgccatccccgaccgggtgcgcggctccttcgcggcgctggccgacccgcgggccatcgagcatctggtgacgctcggcgtgaccgccatcgagctcatgcccacgcaggccttcttcgacgaccgctacctgatcgagaaggggctcacgaactactggggctacaatacgatcggcttcttcgcgccggccacccgctacatctcgcccggcggcggggtgcatgaattcaagctgatggtgcgccggctgcacgaggccgggatcgaggtcatcctcgacgtggtctacaaccacacggcggagggcaaccacctcggtcccacgctctcgttcaaggggatcgacaatgccagctactacatgctgggcgacgatccgcgttactactacgacacgacgggttgcggaaacacggtgaacctcgggcaccagcgggtgctgcagatggtcatggacagtttgcgctactgggtcgaggcctgccatgtcgacggcttccgcttcgatctggcaacctcgctcgggcgcgaccggcaggggttcaacgcgaatgcggtctttctcgacgcggtgcggcaggatccggtcctgagccgggtgaagctgatcgccgagccctgggacacgggccacgaaggctatcagctcggcaatttccctcccggatgggccgagtggaacgatcagtaccgcgacacggtgcgctcctactggaagggcgatgcgggcgagctgccggggctcgcctcgcagcttctgggatcggccggccacttcgaccgccggggccggcgtccatgggccagcgtgaatttcatcaccgctcacgacgggttcaccctcgccgacaccgtgtcctacaacgacaagcacaatgcggcgaacgaggaaggaaaccgcgacggccattccgacaaccgcagctggaactgcggcgaggaggggcccaccgaggatgcggaggtgctcgacctccgcgaccggatgcggcgggcgatgatgggcacgctcctgatctcgcagggcacgccgatgcttctgatgggagacgaggtgggccgcagtcagggcggcaacaacaacgcctactgtcaggacaatgcgatgaactggctgaagctcgaggggctcgagccgcgggacgcggccttcctcgacttcacccggcggctgatcgcgctgcgcaggtcgcgcccgctgctgcggcatccctcgttcctgcacaaggcggcggtgggagaagagccggtcgaagtgcgctggctgcgccccgacggggaagagatggagcccgacgactggcacaatccggcggcgcgaactttgggcctgctgatccggaacaagccggccctgctggcacttttcaatagccatttcgaggaggtgcccttctccctgccggtgcgcggccggggatgggggctgcttctggacacggctgcggggcgggtgccggagcgg

SEQ ID NO: 31456 - DNA, 2151 bp, Rhodobacter sphaeroides
gtccccgaaagcgacgtggccgccatcatgcgcggaacgcacggagatcccttccgcgtgctgggcatgcacggaggcggcggcgcgccgctctccgtccgggtcttcgccccgcaggccgcggaggttgcggtgctggggcaggggggcgaggtgctcgcccctctcgaacgcatcggcgccgagggcttcttcgcgggcacggtgccgggcgaggagaaattcccctaccgcctccgcttcgtctcgggaccgcacgagtgggaggcggacgatccctaccgcttccccgaggtgctgggcgagctcgacgaatatcttctcggcgaggggcggcactatcagctctacacccggctcggcgcgcatccggccgagatcgagggcgtgcagggggtgagcttcgctgtctgggcgccgaatgcccgccgcgtctcggtggtgggcgcctttaacgcctgggacgggcgccgccatccgatgcgcaagcgcatcggcgtgggtgtgtgggagctgttcgttcccggcctccataccggagatctctacaaatacgagctgctcgggccttcgggcgagcggttgccgctcaagtccgatccgctctccttcgcgcaggaggcgccgccggccacggcttcggtggtccatgggctgcccgaggccgagtggcacgatgcgggctggatgcaggagcgcgagagccgccagcgccgcgatgcgccgatctcgatctacgaggtccatgcgggctcgtggcggcaggggctcgattacgacgcgctggccgaggaactgtcggcctatgtgcgcgagatgggcttcacccatgtggaattcctgccgatcagcgaacatcccttcaccggctcttggggctatcagcccatcgggctcttcgcccccaccgcgcgcttcggcccgcccgagggcttcgcgcggctggtggaccggctccaccgcgacgggatcggcgtcatcctcgactgggtaccggcgcacttcccgtcggacgcccatgggctggccaacttcgacgggacccatctctatgaccatgccgacccgcggcagggcttccaccgcgactggaacacccagatctacaacttcggccgacaggaagtggcgaacttcctgcaggcttcggcgctcttctggctcgaccgctaccatgtcgatgcgctgcgcgtggatgcggttgcctcgatgctctacctcgactattcgcggaatgccggcgaatgggtgccgaaccgccacggcgggcgcgagaacctcgaggcgatcgatttcctgcgcggcgtgaacgagcgcgtccggctcgaccatccgggctgcatcaccatcgccgaggaatcgacggccttcccgcaggtgagccgcccggtcgaggacggcgggctcggcttcggcttcaagtggaacatgggctggatgcacgacacgctgggctacttccggcgcgacccgatccaccgcaagcaccaccagaacgacctgaccttcggcatggtctatgcctattccgaggatttcgtcctgcccctcagccatgacgaggtggtgcacggcaagggctcgctcatcgggcagatggcgggcgaccgctggcagaagttcgcgaaccttagggcctatttcggcttcatgtgggcgcatccgggcaagaagcttctcttcatgggcggcgagttcgcgcaggagcgcgagtggaaccacgatgcctctctcgactggcacctgctcgacgatccgtcccacgccgggatgaagcgcctcgtggccgacctgaaccgcgaatatcgcaagcgccccgcgctgcaccggatggattgcgatcccgaagggttcgagtggatcgacgccggcgacagcgagaacagcgtgctgagcttcctgcgcaaggcgcccggcgaaaagccggtgctggcggtctgcaacctcacgccggtggtgcggtcggattaccggatcggggtgcccgagggcggcgagtggcgcgagatcctcaactccgacgccgcgatctacggcggctcggacgtgggcaatcccggcgggcttcaggccgaggagttctcctggcacggacggccggcctcgctgcgcctgacgctgccgccgcttgcgacgatcttcgtgacgcct

SEQ ID NO: 31457 - DNA, 2163 bp, Rhodobacter sphaeroides
cgggcgggccgggcgcgggcctcacggcctcggccgagggcgagcctccaagtggcgcgccggtctcggtcaccgtgcagccgggcttctcgctgtggcgcatcgccgaggagaccttcggcgagggcatcctctatgtgaaggtctacgaggcgaaccgcaccgcgatccgcgaccccgacctgatctatccggggcaggtcttcacccttccgacgccgacggactgatcgcaggcgagccgggcgggacgggcttcggctctggcaatccgggtgagggcggcttaggtagggctctccgaggagatccccgatgagcgaagcgagacagaggccgggcccgacgcccgttgatccgccggaaatgagcggctgggcgaccatgaagcgcatggcgccctacctttggccgaagggccagacctgggtgaagcggcgcgtcgtcatcgccatggcgatgctggtgctggccaaggtgatctctgtctcgacccccttcttctacaaggccgcggtggatgcgctcgcgggcgatgcgcccacgcccgccttcatgctgggcctcggcgcggtcgggatgacggtggcctacgggctggcgcggctcggcgccgtggccttcggggaactgcgcgacgcgatcttcgtgcgcgtgggccagcgtgccctgcgccagctcgcgctcgagaccttcacccacatccaccggctctcgctgcgctaccacatcagccgcaagaccggcggtctcagccgcatcatcgagcgcggcgtgaagggcgtcgatttcctgctgcgcttcatgctcttctcgatcgggcccctcttcatcgagctgacgctggtcgcgatcatcttcgcggttgtgttcggctggcaatatatggtcgtggtggtggccaccgtcgcgctctatgtggccttcaccttcaaggtcaccgagtggcgggtgcagatccgccgccagatgaacgagcaggacaccgacgcgaaccagaaggccatcgactcgctcctgaatttcgagacggtgaaatatttcggcgccgagctgcgcgaggccgaacgctacgatgcggccatggcgggctacgagaaggcggcggtcaagaccggccagtcgctcgccgtcctgaacgcggggcagagccttctcatcaccgcggggctcgtggcggtcatggtcatggcggcctacggcgtgcaggcgggtcggctcacggtcggggatttcgtgatggtcaatgcctacatgatccagatcaccctgccgctcggcttcctcggcaccgtctaccgcgagatccggcaggcgctcgtggacatggggcagatgttcggtctgctcgcccagccggccgaagtcagcgacgcgcccggggcgcggccgctcgcggtggcgggcggcacggttgagctcgagaatgtccgcttcggctatgacgcgggccgcacgatcctcaagggcatctcgctccgggtcgaggcgggcgagacggtggcgctggtcggtccctcggggtcgggcaagtccacgatcggccggctcctcttccggttctacgacgtgaacgagggcgccatccgcatcgacgggcaggatctgcgcgcggtcacgcaggactcgctccatgcgcagatcggcgtggtgccgcaggacacggtgctcttcaacgacacgatcttctacaacatcgcctacggccgccccggtgccacgcccgaacaggtcgaggccgcggcgcgggccgcgaagatccacgacttcattctgcgcctgcccgagggctaccgcacgatggtgggcgaacgcggcctgaagctctcggggggcgagaagcagcgggtgggcatcgcgcgcaccctgctcaagaacccgccgatcctgcttctcgacgaggcgacctcggcgctcgacacccagaccgagcgcgacatccaggattccctgcgcgagatgggcgaggggcgaaccgtcatcaccatcgcgcaccggctttccaccatcgccgatgccgaccggatcgtggtgctggaagaggggcggatcgtcgaggaggggcggcacgaacagcttctcgcccgcagcgggcgctatgcctcgatgtgggcgcggcaatcggccgaggaagaggacgaggcggcggcctgaggcggcgcc

SEQ ID NO: 31458 - DNA, 1170 bp, Rhodobacter sphaeroides
gggcgcgtgaccgggatcggccggggaaccttgtccgtcggaggcctcgagcagggcaccgcgctgggcgaccgggtggaaatctgcggcgcgggcggcatcctcggcggcgaggttctgcggctttcgtcgcacgaggtgacgatcctgcccgacggcagcccggaaggcctcgcgatcggcgatgcggttgctctcgtcggccccgcagagatcgcgccggacgacagctggatcggccggatcgtcgatccgctcggccgcccgctcgacgggcgcccgctgtttcgcggcccgcgcgcgcgtcccttgcgcgcggccgcgccgcaagctgcggcgcgccgcagcctcgggccgcggcttcccaccggagttgcggtcttcgacacgctgctgcctcttgtccaggggcagcggatcgggctcttcgcggggtcaggggtggggaagtcctcgcttctcgccaagttcgcgcggagcgtcgtggccgatgtggtggtgatcgggctcgtgggcgagcggggtcgcgagctgcgcgagttcaccgagcgggtgctcgggcctgcgggcatggcgcgtgcggtggtggtgacggccacctccgaccagtcgccgctggttcgccgtcgctgcggctgggcggccatggcggtggccgagcatttccgcgaccaggggcttcacgtgttgctcctcgtcgattcgatcacccgttttgccgaagctcatcgcgaggtcgcgctcgcgggcggcgaggcggcgagcatgagaggctttcccccgtcgacagcccacacgatcatggccctggccgaacgcgcgggaccgggcgctgagggcaccggcgacatcacggcggtcttctcagttctcgtggccgggtccgacatggaggagccggtggcagatattctccgcggagtgctcgacggccatgtggtgatggatcgcaagatcgccgagcgcggacgctttccggcgatcgacctgctgcgatccgtgtcgcgggccctgcctgaggccgcgagcacggccgaaaatgcgctgatcgccgaggcgcgtcggctgctcggggcctgggaccgtgccgagatgatgatccaggcggggctctatgccagaggatccgatccgctcgtggatgcggcgatccgggtctggcccgcgctc

SEQ ID NO: 31459 - DNA, 648 bp, Rhodobacter sphaeroides
ttcctgctcaaccgtaagaagtccgagatggtctctgccgccgaggcgctgcccggccggcctgatccgattcccacggccgagacacatttcctgtcgggcctgccgctgaaatcgccggtgcctgcgggcatggccgaggcggtgttcggcatgggttgcttctggggggtcgagcgcaagttctggcaggtgccggaaggggtctggctcaccatggtgggctatgccggcggctacacgccgaacccgacctacgaggaagtctgctcgggccgcaccggccataccgaggccgtccgcgtgatctacgacccgtccgtcgtctcctatgccatgctgctcaagctcttctgggagaaccacgatcccacgcaggggatgcggcagggcaacgacagcggcacgcagtaccgctcggccatctacacctacgggcccgaacaggccgaggccgcccgggcctccgccaccgcctatcagggcgcgctgagcgcggccggccggggccggatcacaaccgagatccttcccgcgccgcccttctacttcgccgaagcctatcaccagcaatatctggccaaaaacccggccggctactgcggcgtgggcggcaccggggtgtcctgcccgatcggaaccggggtc

SEQ ID NO: 31460 - DNA, 883 bp, Rhodobacter sphaeroides
ctcgcgcctctgtccgcgggtctgttgccgagtgtctggtggagtccggccgcgcagggggcgtggtcaacatcgtccatggcggggccgagaccggcgcgcttctcgtccgccatccgggcgtggcgaagttgccttcaccggctcgaccgccgtcggccgcgagatccggcgcgcgacggccggcagcggcaagagcctgacgctcgaactcggcggcaagtcgcccttcgtggtctgcgccgatgccgatctcgatgcggccgtcgaaggggtggtggagggcgtctggttcaaccagggcgaggtctgctgcgcgggctcgcggcttctgctgcaggaggggatcgccgagcgattcctcgccaagctccgggcgcggatggagaagatccgcgtgggcgacccgctcgacaaatccaccgacatgggcgccatcgtctcggcgcgccagaaggcccggatcgaggagctgatcgcgggcgcggcgcgcgagggctaccggctcgagcaggcggcctgcccgctgcccgcggcgggccatttcgtggcgcccggcttcttcgccgacaccgagcccgcggccaccgtcgcgcaggtcgagatcttcggcccgatcgcggtcacgaccaccttccgcaccgtcgacgaggcggtggcgctggccaacaacacgccctacgggcttgcggcctcggtctggtccgagaatatcaatgccgcgaccgagcttgccgcgcggatccgcgcgggcgtggtctggatcaacgcctcgaacctcttcgatgcgggcgcgcccttcggcggcatgaaggagagcggcttcgggcgcgagggcgcgcgcgagggtctcggcgcctatctgcgcccgcgcacgccgcgc

SEQ ID NO: 31461 - DNA, 921 bp, Rhodobacter sphaeroides
gattcgctctccaccccccgcttcgtcggcctgccgagcttcatgcgcctgcccatggccacggagcttcaggggctcgacgccgccatcgtcggcctgccctcggattcgggcgcgcccttccgcaccggcgcgcgcttcgcgccgaacgcgctgcgcgccatgtcggtgatgctgcgcccgatcaacccctaccgcggccacatcaacatcttcgaggtcctgcgcgtggccgatgcgggcgacgcgacctgcgtgccgggctacgagatcgagagcctcgccgcgctcgaacgggcgctcgacgcggtggtcgaggccggcgccgtgcccttcggcatcgggggcgaccactcggtctcgctcgccggtctccgggcggtggccaagcgtcacgggccgctcggcctcgtgcatttcgacagccacaccgacacctgggacagctacttcgacggcaagcgctacagcgccggcaccatgttccgccgggccatcgaggagggcatcgtcgatcccgcccgctcgatccaggtggggatgcgcggctcgctgttccagccggccgatgtcagccagtcggtcgatctcggcctcgaggtcatcacctgcgacgagatgttcgcgctgggactgcccgagaccgcccgccggatcgccgcgcgcagcgcaggtcacccggccttcctgagcttcgatctcgatttcgtggatcccgcctatgcgcccggcgtcgagacgcccgagtgcggcggccccaccgcgcgcgagacgctctcgctgctgcgcagcctccagggcctcaacctcgtcggctgcgacgtggtcgagctcaatccttcctatgacggtccgggccagatcaccgccctgctcggggccaccgtcatggccgagcttctggcgatcctcgccgaggcg

SEQ ID NO: 31462 - DNA, 783 bp, Rhodobacter sphaeroides
atggatctgggcatcagaggcaagacggcgctggttctgggcgcgggcgggggcctcggcggcgccatcgcccgctcgctcgcccgcgagggcgcgcgggtggcgctcggcgacatcgacctcgccgcggccgaagccaccgccgaggcgatccgggccgagggcggcacggcgctgccgctcgcctgggatctggccgacctcggcgccatcgagacgaacgtgagcctgatcgaggccgagctgggcccggtcgacatcctcgtgaacaacacgggcgggccgaagccctcgccgatcgccgggcaggaggccgcgctctggcgcgcgagcttcgagtccatggtgctctcggtcatctccatcaccgaccgcgtgctgccgggcatgaaggcccgcaaatggggccgcatcatcacctcgacctcgtcgggcgtggtggcgccgatcccgaacctcggcctgtcgaacgcgctgcgcatctcgctcgtgggctggtcgaagacgctcgcgcgcgaggtgggccgcgacggcatcacggccaacgtcgtgctgcccggccgcgtcgccaccaagcgcatcaccttcctcgacgagcagaaggccgcgcgcgaaggccgggccgtggccgaagtggccgccgagagcgtggcctcgatcccgctcggccgctatggtcagcccgaggaatatggcgatgccgtggccttcctcgcctcggcccgcgcctcctacatcaccggcagcaccatccgcatcgacggcggcctgatcgccagcgtc

SEQ ID NO: 31463 - DNA, 1626 bp, Rhodobacter sphaeroides
atgtccgctaaagaagttcgattcggtaccgacgcccgcggccgtatgctgaaaggcatcaacacgctggccgatacggtcaagatcaccctcggcccgaagggcagaaatgtcattctcgacacgtcctatggcgcgccccgtatcaccaaggacggcgtgaccgtcgccagggagatcgagttgtcggaccgtttcgagaacgtgggcgcccagatggtgaaggaagtggccagccgcaccaacgaggaggccggcgacggcacgaccacggcaacggttctggcacaggccattgccaaggaaggcatgaaggcggtcgcggccggcatgaatccgatggatctgaagcgggggatcgaccgcgcggtggccatcgtcatagccgagatcaggtccatgtcccgaccggtcggagacagcgccgaaattgcgaaggtcggggccctatcggccaatggcgaggcggcgatcggccgtcagatcgccgatgcaatggcgaaggtcggcactgcgggggtgatcaaggtagaggagaataagggcctcgagaccgaaaccgaggtggtggaaggcatgcagttcgaccgcggttacctgagcccctatttcatcactcatgcgcagaagatggtcgtggaattggacgactgcgccatcctgctccacgaaggcaagctgacctcgcttgcttcgatggtgccgttgctggaagcggtcgttcaggcagaaaagcaacttctcgtcgtggccgaggacgtcgagggcgaggctctgacgaccctggtggtcaacaagctgcgcggcggtctcaaggttgcggcagcaaaggcacccggcttcggggatgggcgtgcggcgatgctggaggatcttgcagtcctgacgggcgcgcacctcatctcggccgagctcgggacgaagctggaaaccgtcacgctggacatgctcggttttgcgaagaaggttgtcctgacgaaggacagcaccatcctcatcgacagtgccggcgacaaggcggcgatcgcttcacgcatcggccagatccgcaaccagatcgaggatacgacgtcggcctacaacaaggagaagttgcaggaacgtctggcgagactcgcgggcggagttgctgtcattcgggtcgggggtgccaccgaaatcgaagtgaaggagcgcagggacagggtggaggacaccctcaacgccacccgcgccgcggtacaggagggcgtcgtgcccggcggcggggccgcactgattcatgcgggcaaggctctggcgggcttgaagggcgacaatcccgatcaggatgcaggcatcaagatcatccgccgcgcaatccaggcgccgctgcgccagatcgccgacaacgccgggatcgacggatcggtcgtcgccggcaaggtcatcgagaacgacagcgcaacctttggcttcgatgcgcagttggagacgtacggcgatatgctgcaggccggcatcatcgatccgaccaaggtcgtgcggatagcattggaggacgccgcatcgatcgcaggcctgctgatcacgacggaggtgatcatcgcgcataagccggaaaggggcgaacgaatgtcccagatggatgagatgggcggcatgatg

SEQ ID NO: 31464 - DNA, 4184 bp, Rhodobacter sphaeroides
ttcgacgagatcaagatctcgctcgcttcgccggaacggatcctctcgtggtcctacggcgagatcaagaagcccgagaccatcaactaccggaccttcaagcccgagcgcgacggcctgttctgcgcgcggatcttcgggccgatcaaggactacgagtgcctctgcggcaaatacaagcgcatgaagtatcgcggcgtcgtctgcgagaaatgcggcgttgaagtcacgctccagaaggtgcgtcgcgagcggatgggccatatcgagctcgccgccccggtcgcgcacatctggttcctgaagtcgctgccgagccgcatcggcctcatgctcgacatgacgctgcgggatctggaacgcatcctctacttcgagaactacgtcgtcatcgagccgggcctgacggacctcacctacggtcagctgatgaccgaggaagagttcctcgatgcgcaggaccagtatggcgccgatgccttcaccgccaacatcggcgcggaagcgatccgcgagatgctgtcggccatcgacctcgaacagaccgccgagacgctccgcgaggagttgaaggaggccacgggcgaactgaagccgaagaagatcatcaagcggctgaagatcgtggaatcgttcctcgagtcgggcaaccggccggagtggatgatcctgaccgtgctgccggtgatcccgccggaactgcgcccgctggtgccgctcgacggtggccggttcgccacgtcggacctgaacgacctctaccgccgcgtcatcaaccggaacaaccgcctcaagcggctgatcgagctgcgcgcgccggacatcatcgtccgcaacgaaaagcggatgctgcaggaagccgtcgacgcgctcttcgacaacggccgccgcggccgcgtcatcacgggcaccaacaagcgcccgctgaagtcgctgtcggacatgctcaagggcaagcagggccggttccgtcagaacctgctcggcaagcgcgtggacttctcgggccgttcggtcatcgtgaccgggccggagctgaagctgcaccagtgcggcctgccgaagaagatggcgctcgagctgttcaagcccttcatctactcgcggctggaggccaagggcctgtcctcgaccgtgaagcaggcgaagaagctggtggagaaggaacgccccgaggtctgggacatcctggatgaagtgatccgcgagcacccggtcctcttgaaccgggcgccgacgctgcaccgtctgggcatccaggctttcgagccgatcctgatcgaaggcaaggcgatccagctgcacccgctggtctgctcggccttcaacgccgacttcgacggcgaccagatggccgtccacgtccccctctcgctggaagcccagcttgaggcgcgcgtgctgatgatgtcgaccaacaacgtgctgtcgcccgccaacggcgcgccgatcatcgtgccgtcgcaggacatggttctggggctctattacaccacgatggagcgccgcggcatgaagggcgagggcatggccttctcgtccgtcgaagaggtcgaacatgcccttgccgccggcgaggtgcatctgcacgcgaccatcaccgcccggatcaagcagatcgacgaggaaggcaacgaggtcgtcaagcgctaccagaccacgccgggccgcctgcggctgggcaacctgctgccgctgaacgccaaggctccgttcgagctcgtgaaccgtcttctgcggaagaaggacgtgcagaacgtcatcgacaccgtctaccgctactgcggccagaaggagtcggtgatcttctgcgaccagatcatgggcatgggcttccgcgaagccttcaaggccggcatctcgttcggcaaggacgacatgctgatcccggacaccaaatggccgatcgtgaacgaggttcgcgatcaggtgaaggagttcgagcagcagtacatggacggcctgatcactcagggcgaaaagtacaacaaggtcgtcgacgcctggtcgaaatgctcggacaaggtggcgggcgagatgatggccgagatctcggcggtccggtacgacgatgccggcgccgagaaggagccgaactcggtctacatgatgtcccactccggggcgcggggttcgccggctcagatgaagcagctgggcgggatgcgcggcctgatggccaagccgaacggcgagatcatcgagacgccgatcatctcgaacttcaaggaaggcctgaccgtgctcgagtacttcaactcgacccacggcgcccggaagggtctggccgataccgcgctgaagacggcgaactcgggctacctgacccgtcgtctcgtggacgtggcgcaggactgcatcgtgcgcacgcacgattgcggcaccgagaatgcgatcacggcctcggccgcggtgaacgagggcgaagtcgtgagcccgctggccgagcgggtcctgggccgtgtcgcggccgaggacatcctcgtgccgggctcggacgaggtgatcgtggcgcgcggcgagctgatcgacgagcgtcgggcggatctggtcgatcaggcgaacgtggcttcggtgcgcatccgcagcccgctcacctgtgaagcggaagagggcgtctgcgccatgtgctacgggcgcgaccttgcccgcggcacgctcgtcaacatcggcgaggcggtgggcatcatcgccgcccagtcgatcggcgaaccgggtacgcagctcacgatgcggaccttccacatcggcggcatcgcgcagggcggccagcagtcgttcctcgaggcgtcgcaggagggccggatcgagttccgcaacccgaacctgctggagaacgccaacggcgagcagatcgtcatgggccgcaacatgcagctcgcgatcatcgacgaggcggggcaggagcgggcgacgcacaagctgacctacggcgccaaggtccatgtcaaggacggccagacggtcaagcgggccacgcgcctgttcgaatgggacccctacaccctgccgatcatcgccgagaaggccggcgtggcgcggttcgtggatctcgtctcgggcatctcggtgcgcgaggacaccgacgaagccaccggcatgacccagaagatcgtgtccgactggcgctcgacgccgaagggcggcgacctgaaaccggaaatcatcatcatgaatccggagacgggcgatccgatgcggaacgaggcgggcaacccgatctcgtatccgatgtcggtcgaggcgatcctgtcggtcgaggacggccagaccgtccgggccggcgacgtggtggcgcggatcccgcgcgagggtgcccggaccaaggacatcaccgggggtcttccccgcgtggcggaactgttcgaggcccgtcgtccgaaggatcacgcgatcatcgccgagaacgacggctatgtgcgcttcggcaaggactacaagaacaagcgccgcatcacgatcgagccggtggacgatacgctgaactcggtcgaatacatggtgccgaaaggcaagcacatcccggtgcaggaaggcgacttcgtgcagaagggtgactacatcatggacggcaacccggctccgcacgacatcctgcggatcctgggcgtcgaggcgctggccaactacatgatcgacgaagtgcaggaggtctaccgactgcagggcgtgaagatcaacgacaagcatatcgaggtgatcgtgcggcagatgctgcagaaatacgagatcctcgactcgggcgagaccacgctgctcaagggcgagcatgtggacaaggccgagcttgacgaggtcaaccagaaggccatggaccacgggatgcggccggctcatgccgaaccgatcctgctcgggatcaccaaggcgtcgctgcagacccgcagcttcatctcggcggcctcgttccaggagacgacgcgcgtgctgaccgaagcctcggtgcagggcaagcgcgacaagctcgttggcctgaaggagaacgtgatcgtcggccggctgatcccggccgggacgggcggggccacctcgcgcgtcaagaagatcgcgcacgaccgcgaccagaaggtgatcgacacccgccgggccgaggccgaatccgcggcggcgctggcggcgccgacggacggggtgatcgatctcggctccgaggactcggggctggtggaaacggtggagaaccg

SEQ ID NO: 31465 - DNA, 1788 bp, Rhodobacter sphaeroides
ctgcacaggaacgccaccgcgttcccgcgccagcccgcctatcgggagaaggaattcggcatctggcaggtctggagctgggcggaggcggcgtccgagatccgcgccatcgcgctgggcttcctcgcgctcggcatgcagcgcggcgaccatgtggcggtggtggggcgcaatcgcccggcgctctactggtcgatggtggcggcgcagatgtgcggcgcggtgcccgtgccgctctatcaggacgcggtcgccgaggagatggtctatgttctcgaccattgcggcgcgcgcttcgtcatctgcggcgatcaggagcaggtcgacaaggtcatcgaggtgcaggaccggatccaccatatcgagcaggtggtctatgtcgacaagcggggcatgcggaaatacgaccattcccgcatgaactggctcgaggatgtcgtggccgagggccgggccgcccatcgccgcttcgacgaagagctcgaccgccggatcgccgagctcgactacggctcgacctgcgtgatgctctatacctcggggacgaccggcaagcccaagggcgtggtcctgtcgaaccgcaacatcatcgagacctcgaagaattcggtcgcgttcgatggcttgcgccccggcgacgaggtgctggcctatctgccgatggcctgggtcggcgatttcatcttctcggtcggtcaggcgatgtggacgggcttctgcgtgaactgccccgagagcgcgaccaccatgatgaacgatctgcgggagatcgggcccacctatttcttcgccccgccgcgcgtcttcgagggccagctcaccaatgtgatgatccgcatggaggatgcgggccggatcaagaaggcgctcttccggcactatatggaggtggcccgccgggtgggccccgcgatcctcgacggcagacctgtgagcaccgcagaccggatcgcctactggatcggcgacaagctgatctacgggccgctgaagaacacgctcggcttctcgcgcgtgcgggtgggctatacggcgggcgaggccatcgggccggagatcttcgacttctaccgctcgctcggcatcaacctgaagcagctctacggccagaccgaggcctcggtcttcatcacccagcagcccgatggacaggtgcgctcggacacggtgggcgtgccctcgcccggcgtcgaggtgcggatcgccgagaccggcgaggtgttctaccgctcgcccggcaccttcgtggcctattacaagaaccccgaaagcaccgcctcgaccaaggatgccgagggctgggtcgccaccggcgacgcgggcttcttcgaggaggccaccggccacctgcggatcatcgaccgcgccaaggacgtgggcaagatggccgacgggcggctcttcgcgccgaaatatgtcgagaacaagctgaagttctatccctcgatcctcgaggccgtggtcttcggcaacgggcgcgagcgctgcaccgccttcctcaacatcgacctcgccgccgtgggcaactgggccgagcgcaacaacatcgcctattcctcctatcaggagctggcgggccacccgaaggtctacgagatgatgaagggccatgtggaggaggtgaaccgctccgtggccgaggatccgatgctgtcgggctgccagatccaccgcttcctgatcctgcacaaggagctggacgccgacgacggcgagatgacccgcacccgcaaggtgcgccgcaaggtcatcgaggagaaataccacgacctgatcgccgcgctctac

SEQ ID NO: 31466 - DNA, 1102 bp, Rhodobacter sphaeroides
atacgcccccagcccgggattctcgacattgccctctacgagggcggcaagagccatgtggcgggcatccagaacgcgctgaagctgtcgtcgaacgagaacccgttcggcccctcgcccaaggcgaaggaggcattcctgcgctcggtccatacgctgcaccgctatccctcgaccgaccatgcgggcctgcgccatgccatcgccgaggtgcacgggctcgatcccgcccgcgtgatctgcggcgtgggctcggacgagatcatcaccttcctgtgccaggcctatgccgggccgcacacggatgtggtcttcaccgagcacggcttcctcatgtaccggatctcggccctggcggtcggggccaatccggtcgaggtgcccgagcgcgagcgcacgaccgacgtggatgcgatcctcgccgcctgcacgccgcacacgcggctggtgttcctcgccaaccccaacaacccgacgggcaccatgatcgggcaggccgatctcgcgcggttggccgcggggctgccggcgcaggcgatcctcgtgctcgacggggcctatgccgaatatgtgccgggctatgacgcgggcctcgccctgatcgaggagcgcggcaacgtcgtcatgacgcggaccttctcgaagatctacgggctgggcgggctgcgcgtgggctggggttacgggccgaaagccatcatcgacgtgctgaaccggatccgggggcccttcaacctctcgaccacacagctcgagaccgccgaggccgcggtgcgcgatcaggaccatgtcgcccgctgccgcgccgacaatgcgcgctggcgcatctggctggccgaggcgctggcggaaatcggcgtgccgtccgatacatcgatggcgaacttcatcctcgcccgtttctcggataccgaggaggccgaggcctgcgacctccatctgcagacgcagggggctgatcgtgcgccgcgttgcgggctacaagctgccgcactgcctgcgcatcaccatcggcgacgaggcctcgtgccgccgcgtcgcccatgcgatcggccagttcaagaggatgcgctgatggccctctacgaacgcgttgcgctga

SEQ ID NO: 31467 - DNA, 774 bp, Rhodobacter sphaeroides
ctcgccacctggaacatcaactcggtccgcctgcgcgaggcgctggtctcgcggctgctgacggaggagatgcccgacatcctctgcctgcaggaatgcaagagcccggtcgagaagatgccgctcgaggcgttccgggcgctcggctaccactggtgcgtggcgcgcggacagaagagctacaacggcgtggcgatcctgtcgaagctgccgctggtggatgcgggcgaccatgatttcgccgatctcggccatgcgcggcatgtgtcggcggcgctcgagaacggcgtgacgatccacaattgctatgtccccgccggcggcgacattcccgaccgcgagcagaatgtgaagttcggccagaagctcgattacctgacgcggatgcgcgactggtgccgggccgacacgccgaagaaggcgatcctcgtgggcgatctcaacatcgccccgcgcgaggacgatgtctggaaccacaagtccctgctgaagatcgtgagccacacgccgatcgaggtggaccatctgaacgcgctgatggaggcgggcgcctggatcgacgtgacccgcaaggacctgcccgaggggcggctctattcctggtggtcctaccgctcgcccgactgggaggcggccgacaaggggcgccggctcgaccatatctgggccacgcccgacatcgtcaatgccgcgcacggcagccgcatcctcaaggcggcgcggggttggctgcagccgtcggaccatgcaccggtcttcgccaccttcgatctc

SEQ ID NO: 31468 - DNA, 708 bp, Rhodobacter sphaeroides
ccgaacccgctcctgcccgagaaccggcccgccaccgcggcgcgcgtgcgcgagaccggcgccgatttcggcgtggcctgggacggcgacttcgaccgctgcttcttcttcgaccacgagggccgcttcatcgacggcgaatatgtggtgggcctgcttgccgaggcctttctggcgcggcatccgggagcgaccgtcatccacgatccccggatcatctggaacacgcaggatgtggtggcccgtgccggagggcgcgccgtccagacccggaccggccacgccttcatcaagcaggcgatgcgcgacgaggcggccctttatggcggcgagatgtcggcgcaccattatttccgcgacttctaccattgcgacagcgggatgatcccctggctgctcgtggccgggctggtgagccgccacggccgcctcgcggatctggtggcggaccgcagggcggcctttccctcgtcgggcgagctcaatttcgtgctggaggatccggcggccgcgatggcgcgggtgcggcaggccttcgcgcccgaggcgcgggcggtggacgagatggacgggctcggcttcgacctcggctcatggcgcttcaacctgcggagttcgaacaccgagcccgtggtgcggctgaatgtcgaggcgaagggcaagccggagctggtggcgcagggggtcacggcggtgaaggcgctgctt

SEQ ID NO: 31469 - DNA, 1972 bp, Rhodobacter sphaeroides
agcaacctcaagaagatcatcatcgacggcatcgaagtcgaggtcgatggcgccatgacgctgctgcaggcggccgaagaggtggggatcgagatcccgcgcttctgctaccacgagcgcctgtcgatcgccggcaactgccgcatgtgcctcgtcgaggtggtgggcggcccgccgaagcccacggcctcctgcgccatgcaggtgcgcgacctgcgccccggcccgaacggcgaggcgccggtggtcaagaccaactcgcccatggtcaagaaggcccgcgagggggtgatggagttcctgctcatcaaccacccgctcgactgcccgatctgcgaccagggcggcgaatgcgacctgcaggaccaggcgatggcctatggcgtcgatttcagccgctaccgcgagccgaagcgcgcctccgagaacctgaacctcggcccgctcgtcgccacgcaaatgacgcgctgcatctcctgcacccgctgcgtgcgcttcacgaccgaggtcgcgggcatcacccagatgggccagacggggcgcggcgaggacagcgagatcaccagctacctcaaccagacgctcgattcgaacctgcagggcaatatcatcgacctctgcccggtcggcgcgctgacctcgaaaccctatgccttcaccgcccgtccttgggagctcggcaagaccgaaagcatcgacgtgatggatgctctcggctccaacatccgcgtggacacgaagggtcgcgaggtcatgcgcatcctgccgcgcaaccatgacggcgtgaacgaggaatggatctcggacaagacccgcttcgtctgggacggcctgcgccgccagcggctcgacacgccctacatccgcgaggccggcaagcttcggaaagcctcgtggggtgaggcgctgaaggcggtggccgcggcgatgaagggccgcaaggtcgcgggcctcgtgggcgatctggccccggtggaagcggccttctcgctcaagatgctgatcgagggcatgggcggccgggtggaatgccgcaccgatggcgcgcgcctgcccgcgggcaaccgcagcgcctatgtgggcaatgccgccatcgaggatatcgacaacgcgaaatcgatcctgctcgtgggctgcaacccgcgcgacgaggcgccggtgctgaacgcccgcatccgcaaggcctggctgcagggcgcgcaggtctcggtgatcggcccggcggtcgatctgacgttcgactacaatcatgccggcaccgaccgggcggcgctgatgtcgctcgtgtccgaggccgaacggtccggcgccgacggcaagccgggtctggtgatcgtggggcaggggcgctctggccgaggccgacggcgaggccgtgctggcgcaggcgatgaagctcgcccagacgatgggcgcgaagcttctcgtgctgcataccgccgccgcccgcgtgggcgcgatggatgtgggcgccgtgaccgagggcgggctctccgccgccatcgagggcgcggaggtgatctacaacctcggcgccgacgaggtcgagatcggcgcgggcccgttcgtcatctatcagggcagccacggcgaccgcggcgcgcaccgcgccgacgtgatcctgcccgccgccgcctataccgaggagaacggccttttcgtgaacaccgagggccgtccgcagcttgccttccgcgcgggcttcccgccgggcgaagccaaggagaactgggcgatcctgcgcgcgctctcggccgaactgggccagacgctgccctgggacacgatggcgggcctgcgccgcaagctggtcgagaccgtgccgcatctcggccgcatcgaccagctgaccgagagcgagtggcaaccgctgccgctgcgcgatccggcgaccgccgacttccgccttgcggtgcgggacttctatcttacgaatccgatcgcgcgggcctcgcagctcatggccgagctc

SEQ ID NO: 31470 - DNA, 1917 bp, Rhodobacter sphaeroides
aagatcctgatcgccaaccgcggcgagatcgccgtccgcatcgcggccaccgcccggcgcctgggcgtggcgaccgtcgccgtccattccgatgccgatgccgaggcgctccatgtggccgtggccgacgaggcggtgccgatcggcggcccgcagccggccgacagctacctgcgcggcgagcggctgatcgaggcggccctcgccaccggggcggaagccatccatccgggctacggcttcctctccgagaaccccgagttcgtcgaggcggtcgaggccgcgggcctcgtcttcatcggcccctcggccgcggcgatccgcgccatgggcctgaaggatgccgccaaggcgctgatggccgaggcgggcgtgcccgtcgtgccgggctatcacggcgcggatcaggagcccgaacatctggccctgatggcccaggacatcggctatccggtcctcatcaaggcggtggcgggcgggggcggcaaggggatgcgccgcgtcgagcgggcggaggagttcgccgcagccctcgcctccgcccgggccgaggcccgcaccgccttcggcaacgaggcggtgctgatcgagaaatggatcgactgtccgcgtcatatcgagctgcaggtgttcggcgacggcaccgatgcggtccatctctacgagcgcgactgctcgctgcagcgccggcaccagaaggtgatcgaggaggcgccggcccccggcatgacgcccgcgatgcgcgccgcgatgggcgaggccgcggtgcgggccgcccgcgccatcggctaccgcggggcgggcacggtcgaattcatcgtggacggctcggccggcctcagcccggaccggttctggttcatggagatgaacacgcggcttcaggtcgagcatccggtgaccgaggccgtgacgggcatcgatctcgtggaatggcagctgcgcgtggccgcgggcgaacccctgccgctcgcgcaggaggacatccccctccgcggccatgccttcgaggcaaggctctatgccgaggacgtccccgcgggcttcctgcccgcgatcggccggctcgaccatctgcgcttcgccgacggcatccgcgccgatacgggcgtgcggacgggcgaccggatcagcccctggtacgatccgatgatcgccaagatcgtcgcccatggcccgtcgcgggcctccgcgctgaaccggctcgcgcgcgcgctcgaagagaccgaggtggcgggcacggtcacgaacctcgccttcctgcgccgcctcgcgcagcacccgggtttcgctgcgggagaggtggacacgggcctcatcggccgcgatctggccgccctgatcgcgcccgcgacgctggccccggaaacggtcgcggcggcgctcctcgtggccgagctcggcgagacgcccgccccccttcagggcttcagcctctggacgccccttcgaaggcacgtccgcctgcgccatggctcggaggagatcgcggcggcgctcaccgtcgaggcgccgggcagggccaccgtcgagctgggcgaggcgcgcctcgccgcgcggctgcgccccgagggctgggcggtggcggggcgccctccggcgcgcgtcctgcggatcgggacgcaggttcatgtcttcgcccgcaccggcaccgtcagcttcgagatccccgatccgctcgaccgcggcacggaggaggcggggcagggcggcctcaccctctcgcccatgccgggcctcgtccgggaggtctcggtgcgggcgggcgaccgggtggagaagggcgaccgtctcgcggtgatcgaggcgatgaagatggagcatgtgctgaccgccgcccgggacggcacggtggccgaggtgctggtcgaggccggcgcgcaggtcgaggccggggcggcgctcgtgcggctggag

SEQ ID NO: 31471 - DNA, 1518 bp, Rhodobacter sphaeroides
tatttcctcgccatcgacgccggaaccggcagcggccgcgccgtcctcttcgacgagaccggcgccgagatcgcggcctcgggtcaggaatggtggcatgtggccgacccgcgctaccccggctctatggatttcgacaccgaaggcaactgggccattctcgcccgctgctgtcgcgaggtgatcgcgcggagcggcgtcgatcccgcagagatccgcgcggtcagcgcgaccgccatgcgcgaggccttcgtgctgcatgacgcgacaggccgcgagatctgggcctgcgccaatgtcgatgcccgcgcgggcgccgaggtgcgcgagctgaaggaagaccatccggggcttgaggctcagatctatgcgcgctcgggccagacctacgcgctcggcgcgctgccgcggctggcctggctccgccgccacgcacccgagacgctggcgcgggcgcgcagcctcaccatgctgtccgactggatcctctaccggctctcgggcgagctgacgctggagccgtcgaacggcggcaccaccggccttctcgatctgcgcacccgcgcgcccctgaccgacgcgctggccaccgtggggctgcccacagacctcttcccgcgtggcgtcaccaccggcgaggtggtgggcgaggtgcagacggcggccgccgccgagaccggcctcgcccccggcacgctggtcgtggcgggcggcggcgattgccagacgggcgcgcttggcttgggcatcgtgcgcgagggcgactgcgccgtgctcggcggcaccttctggcagcaggtggtcaatgttccgctgacgctcaccgatccgaccatgaacctgcggatcaacccgcacatggtggcgggcctgaatcaggccgaggccatcagcttcttcgtgggcgccgtgatgcgctggttccgcgacagcttcggacagggccgcgactataccgccctcgaggcggattcgatgcaggtccctccgggggcgcacgggatcattccgatcttctccgacgtgatgcgctacggcgactggttccacgccgcgccgtcgctgctgaacctctcgctcgatccggcggcctcggggcctgccgcgatcttccgcgccctgcaggagaatgcggccatcgtcgcgcggcgcaacctcgagagcgtcttcgccctcaccggccaccggcccgagcggctggtcttcgcgggcggcgccgcaaaatcggcgcactggtcgcagatcctggccgacgtcaccgggctcaccgtcgtcacgccggaggtcaaggaggccaccgcgcagggctgcgcctcggccgcggccaccggtgcgggccatttcgcctcgctcgccgaggcgggcggtgcctggatgcggatcgaccgcaccttcacgccggatcccgcgctccgcccgctctacgacgaggccggcgaccgctgggcccgcgcctatgccgcgcagcgcggcctcgtgcaggacggcaccgccaccgccatgtggcgcgcccccggc

SEQ ID NO: 31472 - DNA, 1569 bp, Rhodobacter sphaeroides
gattacatcatcgtgggggcgggcagcgcgggctgcgtactggcgaaccgcctgtccaaggatccctcgaaccgcgtgctgctgatcgaggcgggcaagcgcgacaattaccactgggtgcatatcccggtgggctatctctactgcatcaacaatccccgcaccgactggtgcttcaccaccgagcccgaggaagggctggaaggtcgcagcctgatctacccccgcggcaaggtgctcggcggctgttcctcgatcaacggcatgatctacatgcgcggtcaggccgaggattacgacggctggcgccagatgggctgcaccggctggggctgggacgatgtgctgcccctcttccgccgccagcaggaccatcaccgcggcgaaagcgaacatcacggcgcgggcggcgaatggcgggtggaacgggcgcgggtccgctgggcggtactcgatgctttcctcgatgcggccgagcaggcgggcatcccgcggaccgaggattttaaccgcggctcgaacgagggcggcggctatttcgacgtgaaccagaggtccggcatccgctggaacacggccaaggccttcctgaagcccgccctctcccgcccgaacctgcgcgtcgtgaccgaggcgcaggttgagcggctgatcgtcgaggcgggcgaggtgcggggcgtgctctaccggcagggcggcaccctgcacgaggcccgggcgcggcgcgagacggtgcttgcggcgggtgccatcggctcgccgcacattctggagctttcgggcatcggcgatcccgaggtgctgcgcgcggcgggcgtcgagccgcaggtcgccgtgccgggcgtaggtgcgaacctgcaggatcacctgcagctccgcctcgtcttcaaggtgcggggcgtgcccacgctgaacgagaaggccaccagcctcttcggtcgcgccgcgatcggggcggaatatctcctgcgccgctcggggccgatgtcgatggcaccgagtcaggtcgggatcttcacccgctccggctccgagaaggccacgcccgatctcgagttccatgtccagccggtctcgctcgacaagttcggcgacaaggtccaccccttccccggcatgacggcgagcgtctgcaacctgcgccccgaaagccgcggcagcgtccatctgaaaagccccgatcccgcgcgccagcccgccatcgcgccgcattatctttcgaccgagggcgaccgcgaggtggcggtgcgctcgatccagattgcgcgccatatcgcctcgcagcccgccttcgcgcggtttcaccccgaggaataccgtccgggagccgagcacgacacgcgcgaggcgctggtcgccgccgcgggccgcatcggcaccacgatcttccacccggtcggcacctgccgcatggggtcggatccggcgagcgtcgtcgatccgcggctgaagttccgggcgctcggcggcctcaggatcgcggatgcgtcgatcatgccggccatcacctcgggaaacaccaactcgcccaccctcatgattgccgagaaggcggccgagatgatcctc

SEQ ID NO: 31473 - DNA, 435 bp, Rhodobacter sphaeroides
atctacatcctgaacgggccgaacctgaacctgctgggccagcgccagcccgagatctacgggcacgagacgctggccgatgtcgagcggcgctgtgcggcggtcgcggccgagaagggcttctcggtgcgcctcttccagtcgaaccacgaaggcgccatcgtcgaccagatccacgaggcccggcaggcggcctgcggcatcgtcatcaacccggccgcctatacgcacacctcggtggcgatcctcgacgcgctcaatgccttcgaggggccggtgatcgagtgccacatctcgaacgtccacaagcgcgagagcttccgccatcactcctatgtgagcctgcgcgccgacggggtgctggcgggcttcggcatcgagggctacgaactggcggtgcggcggatctgttcgctctgcgcaggcggctgagcc

SEQ ID NO: 31474 - DNA, 1071 bp, Rhodobacter sphaeroides
atacgcacccacaggatcgccgccattcccggcgacgggatcgggatcgaggtggtcgcggcggggctcgaggtgctcgaggcgctggccgaccgcgacggcggcttccgcttcgacgtggagagcttcgactggggaaccgaccgctaccggcgcaccggcgccttcatgcccgaggacggggccgaccggctgcgcggcttcgacgcgatcctgttcggcgcggtgggcgcgcccgacgtggccgaccatctgacgctctgggggctgcgcctcgccatctgccagccgctcgaccaatatgccaatgtgcggccgacccggatgctgcccggcatccgcagcccgctccgccatgtcggggagagcgagctcgactgggtgatcgtgcgcgagaattccgagggcgaatatgccgggcaaggcgggcgctcgcaccccggcctgccgctggaggtggccacggatgtgtcgatcttcacccgcgccggggtcgagcgaatcatgcgcttcgccttccgccttgcgcagtcgcggccgcgcaagctcctgaccgtggtgaccaaatccaacgcgcagcggcacggcatggtgctctgggaccagatcgcgggcgaggtcgcgcgcgagttcccggacgtgcgctgggacaagatgctggtcgatgccatgacggtgcgcatggtgcagaagcccgcatcgctcgacacgatcgtcgccacgaaccttcatgcggacatcctgtcggatctcgccgcggcactggcgggctccatcggcgtggcgcccaccgccaacctcaaccccgagcgcgacacgccctcgatgttcgagccgatccacggctcggccttcgacatcaccgggcggggcatcgcgaacccggtggccaccttctggaccgccgccatgatgctcgagcatctgggggaggccgaggccgcggggcggctgatgaccgccgtgggccgggtgacggcggacgaggatctccatacgcccgacctcggcggtcgggccaccacgcggcaggtgacggatgccctgatcgcggccctgcgcggccgcaac

SEQ ID NO: 31475 - DNA, 1068 bp, Rhodobacter sphaeroides
atggcagacaatcacctgaagatcgcggtcatcgccggcgacggcatcggcaaggaagtggtgccggaagggctgcgggtgctcgaagcggtggccgggcgccaccggatcgacctgcgcttcgaggagttcgacttcgcctcctgcgactactacgcgcggcacggccagatgatgcccgaggactggcaggagcgtatcggagggcacgacgccctgttcttcggcgcggtgggctggcctgcgacggtgcccgatcacgtctcgctctggggctcgctgatccagttccgccggcagttcgaccagtatgtgaacctgcgcccggcccggctgatgccgggcgtgccctcgccgctggccgggcgcgggccgggcgacatcgacatgtggatcgtgcgcgagaatacggagggcgaatattccgcgatcggcggcaggatgtatcccggcaccgagcgcgagatcgtgctgcaggagacggtgatgagccgtcacggcatcgaccgtgtgctgcgctatgccttcgagctggcgaaccggcgcgagcggcgcaggctgacctcggccaccaagtcgaacggaatctcgatcaccatgccctactgggacgagcgggtggaggcgatggcgcaggactacccggatgtcgcctgggacaagtatcacatcgacattctggccgcgcatttcgtgctgaacccggaccggttcgacgtggtcgtggcctcgaacctcttcggcgacatcctgtccgacctcgggcccgcctgcaccggcaccatcggcatcgcgccctcgggcaacatcaaccccgagcgcgcctttccctcgctgttcgagccggtccacggctcggcgcccgacatcgcgggacagggcatcgccaatccggtggggcagatctgggccggggcgatgatgcttgaccacctcggccatggcgaggccgcggccgagatcatggcggccatcgagcgcgtcctcgccgatccgcggttgcggacgcgggacctcgccggcgcggccgacaccgtcacctgcggcaaggccatcgtcgaggcgctg

SEQ ID NO: 31476 - DNA, 1518 bp, Rhodobacter sphaeroides
cccagccgtcgccggaggcagccgctctgatcgcgcctctggtgacccccggcccgcggccgagcggcaccgagattgccgaccgcctcatcgccgccatggccgaggaaggccaacggatctgcgacgagggcctcgcgcagagcccctcggacatcgatctggtcgaggtgcatggctacggcttcccccgtcacaaggggggaccgatgtttcacgccgcgcgcaagacccgaagccgcacgggcggagcatgaccggcgcgctagaggccggccggagcacatccacgcaaggaggggccgattcggccgcaccgacatgacccaggtcttcatctgcgactatatccgcacgcccatcggccgctacggcggggcgctctccccggtccgggccgacgatctgggcgccgtgcccctcaaggccctgatggcccgcaatggcggggtggactgggaggccgtggacgatgtgatcttcggctgcgccaatcaggcgggcgaagacaaccgcaacgtggcccgcatgtcggcgctgctggcggggctgccggtgggtgtcacgggcacgacgatcaaccggctgtgcggctcgggcatggatgccgtgctgaccgccgcccgccagatcgccgcgggtgaggcggatctcgtgatcgcgggcggggtggagagcatgtcgcgcgcgccgttcgtgctgccgaaggcgggaacggccttcacgcgctcggccgagatccatgacacgacgatcggctggcgcttcgtcaatccggcgatggaggcggcctacggggtggatcccatgccgcagaccggtcagaacgtcgcctgcgacttcggcatcagccgtgaagcgcaggatgccatggccctcgcctcgcagacgaaggcggcggcggcgcaggcgaacgggcggctcgcacaggagatcacgccggtcctcgttccgcagcgccggggcgagccggtccgggtggagcaggacgagcatccgcgggcgacgacgccggaggcgcttgccaagctgaagccgctcttcgccggcggatccgtcacggcgggcaattccagcggcgtcaacgacggcgcggcggccctgatcctcgccagcgaggcggcggtccggcgccacgggcttacccccatggcgcgggtgctgggcggcgccaccgcgggcgtgcctccgcgcatcatgggcataggcccggtgcccgccacccgcaagctgatggcccggctcggactgaccacggaggctttcgacgtgatcgagctgaacgaggccttcgccgcgcagggggtggccacgctccggcagctcggcatcgccgaggaggatgcgcgggtgaaccccaacggcggcgccatcgccctcggccacccgctgggcatgtcgggcgcccgcatcaccggcacggcggcgctccagctgcagcgcacgggcgggcggcgggcactctcgaccatgtgcatcggtgtgggtcagggcatcgccatcgcgctggaacgggtc

SEQ ID NO: 31477 - DNA, 1245 bp, Rhodobacter sphaeroides
gtgctgactcatgccgagggcatctatgtccataccgaggacggccgccgcctgatcgacgggccggcgggcatgtggtgcgcgcaggtgggctacggccgccgcgagatcgtcgatgccatggcgcatcaggcgatggtgctgccctatgcctcgccctggtatatggccacgagccccgcggcgcggctggcggagaagatcgccacgctgacgccgggcgatctcaaccggatctttttcaccacgggcgggtcgaccgcggtggacagcgcgctgcgcttctcggaattctacaacaacgtgctgggccggccgcagaagaagcgcatcatcgtgcgctacgacggctatcacggctcgacggcgctcaccgccgcctgcaccggccgcaccggcaactggccgaacttcgacatcgcgcaggaccggatctcgttcctctcgagccccaatccgcgccacgccggcaaccgcagccaggaggcgttcctcgacgatctggtgcaggaattcgaggaccggatcgagagcctcggccccgacacgatcgcggccttcctggccgagccgatcctcgcctcgggcggcgtcattattccgcccgcaggctatcatgcgcgcttcaaggcgatctgcgagaagcacgacatcctctatatctcggacgaggtggtgacgggcttcggccgttgcggcgagtggttcgcctcggagaaggtgttcggggtggtgccggacatcatcaccttcgccaagggcgtgacctcgggctatgtgccgctcggcggccttgcgatctccgaggcggtgctggcgcggatctcgggcgagaatgccaagggaagctggttcaccaacggctatacctacagcaatcagccggtggcctgcgccgcggcgcttgccaacatcgagctgatggagcgcgagggcatcgtcgatcaggcgcgcgagatggcggactatttcgccgcggcgctggcttcgctgcgcgatctgccgggcgtggcggaaacccggtcggtgggcctcgtgggttgcgtgcaatgcctgctcgacccgacccgggcggacggcacggccgaggacaaggccttcaccctgaagatcgacgagcgctgcttcgagctcgggctgatcgtgcgcccgctgggcgatctctgcgtgatctcgccgccgctcatcatctcgcgcgcgcagatcgacgagatggtcgcgatcatgcggcaggccatcaccgaa

SEQ ID NO: 31478 - DNA, 1464 bp, Rhodobacter sphaeroides
tggcacgcccgcgccaaagccgtggcccttccgaaccgtcccttcatcgacggccagtatgtcgacagcctgtcgggcgagaccttcgcctgcatctatcccggcgacgggcggccgctgaccgatgtggcctcgtgcaatgcggcggatgtggatgtcgcggtgcggtcggcccgcaaggcgttcgaggcgggggtctggtcgcggatggccccggccgaccggcgccgcatcctgctgcgcttctccgagctgatcctcgccaaccgggaggagctggcgctcctcgagacgctgaacgtgggcaagcccatcgccaatgcctacaacggcgacgtggtgagcgctgccgcctgcatcgcctggtatgccgaggcgatcgacaaggtctatggcgaggtggcggccacggcttacgacatgacgacgctcgtcatgcgcgagcccttggggatcgtggcggccgtggtgccgtggaactatccgatgtcgatggccgcctggaagctcgggcctgcgcttgccaccggcaattcggtgatcctgaagcccgccgaacaatcgcccttcaccgcgctgaagttcggcgagctcgccatcgaggcggggatgcctccgggggtgctgaacgtggtgccgggcctcggccatatcgcgggcaaggcgctcgggctgcatatggatgtcgattgcgtgggcttcaccggctcgaccgaggtcggcaagtatttcatgcagtattccggccagtcgaacatcaagcggatcgggctcgaactcggcggcaagtcacctcaggtcgtgctggcggattgcgatgatctcgatgcggcggcggccgggattgcggccggcatcttcgccaacaccgggcaggtctgcaacgcgggctcgcgcctgatcgtggacgagaagatccacgaccagctcctcgagaagatcgcggctcaggccaaggtcttcgcgcccggcgatccgctcgacaccgccacccgcatgggctcgatggtgagcgaagagcagatggaccgcgtgctgggctacatcgacgccggccgcgcggacggtgcacgtccggtcatcggcggcggccgggtgaagaccgaaaccggcggcttctacatcgaacccacgatcttcgagggcgtgcgcaacgacatgaagatcgcgcaggaagagatcttcgggccggtgctgtcggccatcccggtgaagggcttcgacgaggcgatggcgacggccaatgacacggtctacgggctcgcgggcgcggtctggaccgggtcggtgaagaacgcgcaccgggcggccaagtcgctccgcgcgggcgtggtctgggtcaactgcttcgaccgcggctcgctcgccgtgccgttcggcggcttcaagcaatcgggcttcggccgggacaagtcgctgcatgcgatggataaatacaccgacctgaaggccgtctggttcgcc

SEQ ID NO: 31479 - DNA, 1542 bp, Rhodobacter sphaeroides
gaggaccgccgccgccggatcgaggccgagccgttgccggagaatatcggggcgctgatcgacgcggccgccgcggaggccggcgaccgggtggtgtggaacttcttcgagagcggcgagacccttacctacggcgagatgcgccgcaaggtgaacgggctggccgcgcgcctcgtggccctcgggatcggcaagggcacccatgtgggcgtgatgctgccgaacgtcgaggctttcccgctgacctggctggcgctcggccggatcggggcagtgatgctgccgatcaaccccggctacaccccgcgcgagatcgcccatgtgatgaaggtcgccgaggcagactgggtggtgacccacgacagcacgcgggccgtgctcgacgaggcccatgcggcgggcctgatcgcgctgcccgccgagcggctgatcgtggtgggcggcgccctaggcggggcgcatgactgggccgagcttgcctcggagccgcaggaccatttcaccccgcccgagccggtggggcacgacgatctcctgaacatccagttcacatccggcacctcgggctttcccaagggctgcatgctcggccagcgctactggatctcggcgggcaaggtgaacgccttccgcgacggccggatctaccggcgcatcctcgcctccacgcccttcttctacatggatccgcaatggctcctgctgatgacgctctaccagcgcggcaccctgttcgtggcggcccggcaatcgacgagccgcttctcgggctggctcgaagagcatgagatcgacttctgtctgctgccctgggtgctgcacggcatggcgccgcagcagcatgacgcgcagaatcgggttgtgcgcgccaatatctacggctgcccgcgcgacctgcaccgcgggctcgaggagcggttcgacctgaacgcccgcgaggccttcggcatgaccgagatcggcccggcgatgttcgcgcccatcgagcgcgcggacaaggtgggctcgggctcctgcggcgtgccgtgcccgttccgcgagtgccgcatcgtgggcgaggacggccagcccgtggcgcggggcgagatcggcgaattgcagatccgcggaccgggcatcatgctcggctactacaacaaccccgaggctacggccgaggtgttgaaggacggctggttctcctcgggcgacctcttccgtcaggatgaggacgggttcttctacatcgtgggccgcaagaaggacatgatccggcgttcggccgagaacatcgccgcgcgcgaggtcgagacggtgctggccgcggcgcccggcgtggccgaggtggcggtggtgggcgtgcccgacccgctgcgcggcgaggaggtcaaggcctgcatccgcctgaaggagggcgtggtcgccgatgccgcgatcctcgagggcatcgtggccaccgcgcaggccgggctcgcgcccttcaaggtgccgcgcttctacgccttcgtcgaggatttcccgcgcaccgcctcgctgaagatcgccaagccccggatcaccgaa

SEQ ID NO: 31480 - DNA, 1316 bp, Rhodobacter sphaeroides
gcgcgcagcaattcaacggggggtgaccgatgagctcagaccgcaaactcggcttcgacacgctgcagatccacgccggggccaagccggatccggcgacgggcgcccggcaggtgccgatctaccagacgaccgcctatgtgttccgcgacgccgagcacgcggcacgtctcttcaatctggaagaggtgggctatatctactcgcgccttaccaacccgacggtcatggctctggccgagagggtggccgcgctggagggaggcgcgggcgccgtctgctgctcctcggggcatgccgcgcagatcatggcgctcttcccgctgatggcacccggccgcaacatcgtggcctcgacacgtctctacggcggcacgatcacacaattctcgcagacgatcaggcggttcggctggtcggccaagttcgtggacttcgacgatcccgccgccatcgaggccgcgatcgactcggatacgcgcgccctcttctgcgagaccattgccaaccccggcggcgtcatcacggatctcgatgcggtctcggccatcgcggacaggatgggcctgccgctcatcgtggacaacaccactgccacgccctggctctgccgccccatcgagcatggcgcgacgctcgtcgttcattccgcaacgaaatacctgaccggcaatggcacagtgaccggcggcgtgatcgtggactcgggcaagttcgactggtcggcgtcggacaagttcccgagcctgtcgcagcccgagccggcctaccatggcctcgtcttccacaaggcgctggggccaatggcctacacgttccactccatcgctgtgggcctgcgcgatctcggcatgaccatgaacccgcagggggcgcattacacgctgatggggatcgagaccctcagcctgcgcatggcccggcatgtcgagaacgcgcagaaggtggccgcctggctggagcaggacccgcgggtggaattcgtgagctacgcaggattgccctcctcgccctggcacggccgcgtcgcgcggatctgcccgaagggggccggagcgctctttaccttcgcggtcaagggcggctacgacgcgtgcgtggcgctcgtcgatgcgctgcagctgttcagccatgtcgccaacctcggcgatacacggtcgcttgtgatccactcggcctccaccacccatcgccagctcacgcccgagcagcaggtggcggccggcgcagcgccgaatgtcgtgcgcatctcgatcggaatcgaggatgccgacgatctgatcgcggacctggatcaggccctcgccaaggcgacg

SEQ ID NO: 31481 - DNA, 1655 bp, Rhodobacter sphaeroides
tccgccgcacggacggcatcgatcgcagccaaaccgactggtacaaggacgcgatcatctatcagctgcacatcaaggcgtttcaggacgccaatggcgacgggatcggtgacttcgcgggcctgatgcagcggctggattatgtgcaggcgctgggcgtgaccgcgatctggctgctgcctttctatccctcgccgctccgcgacgacggctacgacatctcggactatcgctcgatcaacccgtcctacggcgcgatgcgcgacttcaagctgttcgtgcaggaagcgcacaagcgcgggctgcgcgtcatcaccgagctggtcatcaaccacacctccgaccagcatccctggttccagcgggcccggcgggcgaagaagggatcggccgcgcgcgactggtacgtctggagcgataccgaccagaaattccccgaaacgcggatcatcttcctcgatacggaaaagtcgaactggacctgggatccggtggcaggcgcctattactggcaccgcttctattcgcaccagcccgacctgaacttcgacaatccccgtgtgctcgaggaagtgctcaagatcatgcgcatgtggctcgagatgggcgtcgacgggctccggctcgacgcgatcccctatctggtcgagcgcgagggcaccaacaacgagaacctccccgagacgcacgatgttctcaagaagatccgggccaacctcgaccagcatttccccgacaggatgctgctcgccgaggcgaaccagtggccggaggacacgcgcccctatttcggcgagggcgacgaatgccacatgggcttccatttcccgctgatgccgcggatgtacatggcgctggcgcaggccgaccggcatccgatcaccgacatcatccgccagacgcccgagatcccggaaggctgccaatggggcatcttcctccggaaccacgacgagctgacgctcgagatggtgacggccgaagagcgcgactacatgtggcgcttctacgccgaagattcgcgggcgcggatcaatctcggcatccggcgcaggctggcgccgctgatgaagaacgaccggcgcaagatcgagcttctgaaccagatgctgatgtcgatgcccggcacgcccatcgtttattacggcgacgagatcggcatgggcgacaactactatctcggcgaccgggatggcgtgcggacgcccatgcaatggtcggccgaccgcaacggcggcttctcgcgctgcaatccgcagcagctctacctgccgacgatcctcgatccggtctacggccatcaggcgatcaacgtcgaggcgcaggcggcggacccgtcgtcgctcctgaactggacgcgccgcctgatcgcggtgcgcaagcagcatccggccttcgggcgcggctcgatgagcctgctctatccgcgcaaccgcaaggtgctggcctatgtccgcagccacgagggcacggacatcctctgcgtggcgaacctctcggacacggcgcaggcggtcgagctggatctcgggcggttccgcggcgcggtgccggtcgagctcacgggccggtcggagtttccgccggtgggcgatctgccctacatgctgacgctgccgccctacggcttctactggttcatcctctccgaccag

SEQ ID NO: 31482 - DNA, 624 bp, Rhodobacter sphaeroides
gtgatcttcgactgcgacggcgtgctggtggacagcgaacccacggccttcgcgcttctgggcgaggatctcgcccgccacggccttgcgctcgaccatgcgacgctcgaggcgcatttcctcggcggcaccattcccggcgcggccgtgacggcccgccgtctgggggccgacctgcctgcggactgggtggaggatttctacgagcggctctatgcgcgactggccgagggcacgccgctcatcccccatgtcgaggaggtggtggccgcgctcgatcaggcgggcatcccctatgcggtgggctcgaacgggtccgaccgcaagatgcaggtgacgctcggccagcatccggccctgatggcgcggctcgacgggcggctgttctcgggccagtcgatggatgcgccgaagcccgcgcccgacctttatctccatgccgcccgcgcgctgggggtggagcccgaccgctgcgcggtgatcgaggacagcccgaccggcgcccgcgccgcccgcgctgccggcatgacctgcttcggctatgtgcccgacggcagtccggaggcgctcgtggccgagggcgcgcggcccttctcggacatgcgcgagctgcctgccctcctc

SEQ ID NO: 31483 - DNA, 628 bp, Rhodobacter sphaeroides
atgcaaggatcggctaacacgtttgtcagaaggccagggaaggagcagcgcaatgggcaacatgcagggcaaggtcgtggcaatcaccggggccagccgcgggatcggagcggccgcggtgcgcgtcttcgcggcggcgggcgcgcgcgtcgcgctcctctcccgcagcggggccgagatcgaggcgctggcggccgaggcggggcagggcgccttcgccctgacctgcgatgtggccgaccgggcctcggtgcagacggcgatcgaccgggtggtcgagacggcgggccggatcgacgtgctcatcaacaatgcgggcgtgatcgagcccatcgcgcggctggcggatgccgatcccgacgcctgggaccgcgccatcgacgtcaacctcaagggcgtcttccacgggatgcgggcggcggtgccgtacatgcgcgccaggggcggcaccatcatcaccgtgagttccggcgcggcgcagaatgcgctcgagggctggagcgcctattgcagctcgaaggcgggcgcggccatgctgacccgctgcgcccatctcgaggaggcggtccaccgcatccgcatcctgggcctgtcgcccgggacggtcgcgaccgagatgcaggacaag

SEQ ID NO: 31484 - DNA, 984 bp, Rhodobacter sphaeroides
atgagcctgatgaaagccctcgtctgcgtcgaacccggccggttcgagcagcaggatcgcccccgccccgaagccaagccgggccacatccggatcaggatcctgcaggtggggatctgcggcaccgattatcacatctacggcggccatcagccctttctcgcctatccgcgcatcatgggccacgagctgtcgggccgcgcgatggaagcctcggccgacgggcgcatcgccgagggcgatctcgtcgtcatcaatccctatctcacctgcggcacctgccgtgcctgccgggcgggcaagcccaactgctgcgagaacatcgccgtcctcggcgtccatacggacgggggcatgtgcgaggagatcgtggtgcccgagggcaatgtctacggcgccgaggggctgaccgagcagtcggcggcgatggtcgagttcctcgccatcggtgctcatggcgtgcgccgcggcggcgtgcgcgcgggcagcgcggccctcgtcgtgggggcggggccgatcggtatcggtgcagccctcttcgcggcgatcgagggggccgcggtcacgctgcgcgacacctccgcctcgcggcttgctctggcgcagaaggtgctgcttgaggcccggatcgagcttgtgggcgaagaggcggccgaggtctatgacaccgtcttcgacgcgaccggcaacatccgggcgatgaacgcgggcctgcaatatgtcggccacggcggcgcctatgtgctcctgtcggtggtcaagggcgatctgtcctttgccgatcccgagttccacaagcgcgaggccacgctctttgccagccgcaacgcgctgaagaaggatttcgagcatgtgatcgcgcagatccgcaacggccgcgtgccggtcgaggcgctggcgacccatgccacgagcttcgaggacgccgtcaccaacctgccgctctgggccgaggaccggggcaccctcatcaaggcgatcatc

SEQ ID NO: 31485 - DNA, 879 bp, Rhodobacter sphaeroides
ggcgtctatatcatcgccgcgacccccttcacggatcggggcgagatcgaccacgacagcctcctcagcctcgtcgatttctacatcggccacggcgtgacgggcctcaccatcctcggcatgatgggcgaggcgaacaagatgaccggcgacgaacgccgcgcggtgatcgacacggtcctttcgcgctcgggcgacctgccggtggtggtgggcgtctcggacgcgggcctcgccaacctcaccgatctggcctcctacgcgatggacaagggcgcggccggggtcatggtggccccttcggccggcccggcccgcgaggaccggatcgagggctatttccatgccgtctgcgaggcgctcgggcctgaggtgccggtctgcttccaggacttcccgctggccacgggcctgccggtctcgcccgccctcatccgtcgcctctcgcaggagcgcgaccagatcgtcatgctcaagcacgaggactggccggggctcaccaagatcacccagctgcgcaagcaggaggaggcggccggcgtcgcccggctctcgatcctctgcggcaacggcgggctctacctgccgcaggagctgcagcgaggcgccgacggcgccatgaccggcttcgcctatcccgaggcgctggtccagacggtcgcgctgcatcacgcgggccgcgtggacgaggccgaggatctcttcgaccgctacatcccgatcctgcgtcatgaacaacagccgggcttcggccttgcggtgcgcaaatatgtgctgatgaagcgcggcgcgatcgcctcggccgccacccgcgcgccgggaccgaagatgtcggccgtcgacgccgccgagaccgaccgtctgatggcccgtctcgag

SEQ ID NO: 31486 - DNA, 2535 bp, Rhodobacter sphaeroides
gccttctcggcggcggctcaggcggcgaaggcacgcggcaacccctatgtcgagctggtccatctgatcgaggcgctgctcgccgcggatcggtccgacatggcgctgctgatgcgcgcggcaggctgcgatgccggccggctctcggccgatgtggcccgcgcggtggatgcgctgccgcgcggggcgagcgcggtggaagaattttccgaccatctcttccacgccatccgcgagggctggaccttcggcagcctgcggttcggcgacgaccgcgtgcgctcgggatacctcctgctcggcgcgctgcgggtgcccgtgctcgaggcgctgctcatgcggatcagcggcgccttcgggcaggtggatgcggagtctctttccgagacgttccgcgatctgacgcagggctcggccgagggcgatgccgcgccgccccccgcgcggccgggcgcggccgacggctccgcgctcgcccgctatgcgaccgatctgacggcgcgggcgcgggaggggcggctcgatccggtcgtggggcgcgatcccgagatccggcagatcatcgacatcctgatgcggcggaggcagaacaatccgatcctcaccggcgaggccggggtgggcaagaccgccgtcgtcgagggccttgcgctgcggcttgcccgaggggacgtgccgccgccgctgcgcccggtgaccctgtggatgctcgatctcgggctgatgcaggcgggtgccagcatgaagggcgagttcgagaagcggctgaagagcgtgatcgacgaggttcacgcctcggacgccccggtgatcctcttcatcgacgaggcccatacgctgatcggcgcgggcggcgcggcggggacgggggacgcggccaatcttctcaaaccggcactggcacggggagagctgcgcaccatcgccgccaccacctgggccgaatacaagcagcatatcgagcccgacccggcgctgacccgccgctttcaggttgtgcggatcgaggagccctcggaagaggccgcgatccgcatgtgccgcggcgtggccgccgtgctggagcgccatcaccgggtcgagatcctcgacgaggcggtgggggcggcggtgcggttgtcgcagcgctacctgccggccaggcaattgccggacaaggcgatttccctgctcgacaccgcctgcgcgcgcgtcgccgtctctcagcatgcgacgccggcggaggtcgaggacatcgaccgccgcgcgcaggcgctcgcgctcgaggcgggcatcctcgagcgcgaggaggccgtgggcatggatgtgacggcgcgccgcggcgaggtcgaggcggcgcggaccgccgtcgcggccgaccgtgccgcggcggaggcgcggtgggaggccgagaaggcgctggtggccgaaattcttgaactgcgcgcccggctgcgggcagagggcgatgcgctggacggcaccgcggcgcaggccgccgaggaggccgagccgcccaaggacgaccgtgcggcgcttctcgaccggctgcggcgttgcagccgggatctcgccgaggcgcagggggagcggccgctgatcctgccgacggtcgaccgacaggcggtcgcctcggtggtgcaggactggaccggcatcccgatggggcggatgctggccagccgcaacgaacgcgcgctcggccttgcggacctgctggcccggcgcgtcgtgggacaggatcatgcgatggaggccatcgcgagccggatccagaccgcgcaggcggggctcggcccgccggagaagccgctcggcgtgtttctgctctgcgggccctcgggcgtgggcaagaccgagacggcgctggccttggccgaacagctgcacggtggcgagcaggctctcatcacgatcaacatgagcgaatttcaggaggcgcatacggtctcgacgctgaagggatcgcccccgggctatgtgggctatggcaagggcggcatcctgaccgaggcggtgcggcgaaaaccctattcggtgatcctgctcgacgaggtcgagaaggcgcatcccgatgtccatgaaatattctttcaggtgttcgacaagggaaggatggacgacagcgaagggcggcagatcgatttccgcaatacggtgatcctgctgacctcgaacgtcggcaccgacgagatcgtggaggcggcggggcaggatctggcccgggtctcggccacgctccgcgcgccgcttctgcaggtctttccggccgcgctgctggggcggatgatcgtgctgccgttcctgccgctctcggaccggatgatcgcggccatcgcggggcagaagctcgaggccattgcccggcggctgaaggcggggcacggcgccgagctggttctgggcgagggcgtgctcgagacgatccgcgcccgctgcaccgaggtcgagtcgggggggcggatgatcgacgcgatcctgagcggcaccctgctgccggagctgagccgcaagcttctcgagcgccagctcgcgggggcggccttcagccgggtg

SEQ ID NO: 31487 - DNA, 810 bp, Rhodobacter sphaeroides
atcctgaaccacacctacgagatcgagggcgtgctgggccgcggcggcaccggcgagatctaccgcgcgcgcaacctgatctcggggcggatcgtcgcggtcaaggcgctgaaccggcgcttttcgggcaacgacgattacatcggcctcatgcgccgcgaggagcagctacgcgacgtgatcgacgatgccgtcgtgcgctacaccgaatgttcgcgcagcgacggcgggcatgtcttcctcgtgatggaccatatcgagggcccgtcgctcgcgcaggcgatggaggccgggcggatcgaggcgcgcgaccttctgatcgtggcgcaccgggtggccgagggcctgcgggccgcgcaccggcacgggatcgtccaccgcgacctgtcgcccgacaatatcatcctgcgcggcggagcccccgagcgggcgacgatcatcgacttcggcatcgccaaggatctctcggccggggcgcagaccatcgtcggcaacgacttcgccgggaaatacgaatatgcggcgcccgagcagatcgacgggcgtgccgagccgcgctcggatctctatgcgctcggcgccacgctgctcgcggcctttcggggcgaggcgccgttcgccggagcgacgccgggcgagatcgtccggcgcaaggggcgtccgctcgacacggagggggtgcccgagcccctgcgcggcctgatcgatcgcctcgccgcgcccgaggcagagcgccggcccgccagtgccgcggcggtggtggaggagctcgaccggctgctccggccgcaggcggagccggaccggcgg

SEQ ID NO: 31488 - DNA, 3579 bp, Rhodobacter sphaeroides
atgcacggtgaagtctcaggtccagccggcacccccggctacagcatcgccatcgtcacgctcgacgcccatgcggccgggcccgcggcgcgcatcgcgccgcgcctgcagcaggacttcccgggcctgacgctctcgatccatgccgctgccgaatgggccgagaagcccgaggcgctcgccgccgcgcgcgaggccatcggccgggccgacatcgtcatcgcgaacctcctcttcatcgaggagcatatcaacgccgtcctgcccgagctgcaggccgcgcgcgagcgggtcgacgccttcgtcggcatgatcgccgatccctccatcgtgaagctcacgaagatgggcgatctcgacatgcagaagcccgcctcggggccgatggcgctgctgaagaagctgcgcggcgcctcgaaggagcagggcaacagcggcgaaagccagatgcggatgctccgcaccatcccgaagatgctgaagttcgtgcccggcaaggcgcaggatctgcgcgcctggttcctgtccatgcaatactggctgggcggctcggacgacaacctcgagcagatggtccgctatctcgtctcgcgctattcggcgaaccgggcctggcacaggatccatgccaaggcgccgatcgaatatcccgaggtgggcctctatcatccgagcctgcccgaccgcatcaccaccgacccgaacgacctgccccgccccgcgggcgccaaggtcacggtgggcctcctgatgctgcgctcctacatcctcgcctccgacaccgcccattacgacgcggtgatcgaggctttcgagcggaagggcatcgccgtccttccggccttcgcgggcgggctcgacgggcgcccggcgatcgacgcctatttccacgacaagctgggcacgaccatcgatgcgatggtctcgctcaccggcttcagcctcgtgggcggccccgcctacaacgacagccatgcggccatcgaggcgctgaagggcctcgacgtgccctatatcgcggcccatccgctggaattccagacgctcggccagtgggcgcaggcgggcggcgggctcggcccggtcgagacgacgatgctcgtggccctgcccgagatcgacggcgccaccaaccccaccgtcttcgccggccggcacgacctctcgggctgcaccggctgccccggcggctgcaaggccaccgcgcaggcggccgaatgccgcgccatgtcgccctgccacgagcgcatccaaaccctggccgagaagacgctccgccttgcgctgctgcgccgctcgaaaatcgccgagcgccgggtgggggtcgtgctctacggcttcccgccgaacgcgggcgccgtcggcaccgcggcctatctcgccgtcttcgagagcctcttcaacgtgctgaacgccatgaagcgcgagggctaccagctcgaggtgcccgagagcgtgcaggcgctgcgcgacgcggtgctcggcggcacggccagccagtatggccagcccgccaatatcgcggcccatgtttcggccgagaagatcgtctcgggcacgccctggcttgccgacatcgagaaggcctggggcgccgcccccggccgcatccagtcggacgggcgcggcgtctatatcctcggccagcagttcggcaatgtcttcgtgggcgtccagccggtcttcggctacgagggcgacccgatgcggctcctgttcgagaagggcttcgcgccgacccatgccttcagcgtcttctaccgctggctgcgcgaggatttcggcgccgacgtgctgctgcatttcggcatgcacggcgcgctcgaattcatgcccggcaagcaggccggcatgtccggcgcctgctggcccgaccggctgatcggcgccctgccgaacgtctatctctatgcggcgaacaacccgtccgaggcctcgctcgccaagcgccgctcgaacgcgatcacggtaacgcacctgaccccgccgctggccaaggccggcctctaccgcgggctgcaggatctcaaggacagcctcacccgctaccggcagctcgcccccgacgcgcccgaacgcgaggagctctcgctcctgatcggagagcaggcccgggccgtgaacctcgacatggtcgatgtggacacgatgtggctgaagctcctcgagaccgagggctcgctcatcaccgacgggctgcatgtcgtgggccggcccatgaccgaggagcagatcgccgacaacatcgctctcatgcccgagatgtcgtccgagcggcgggccgaggtcgaggggatgctgcggcaggagaccgagatcgcgggcctgctgcgcgcgctcggcggccattacatggagccggtgccgggcggcgacctgatccgcgcgcccgagatcctgcccacgggccgcaacatccatgccttcgacccgttccgcatgcccaccgcctatgcgattcaggacggggcggcgcaggcgcagcggctgctcgacgcgcacccgaaactgcccgagacggtggccctggtgctctgggggtcggacaacatcaagtccgacggcgggcccatcgcgcaggctctggcgctgatgggggcccggccgcggttcgaccattacggccgtctcgcgggcgccgacctcatcccgctgtcggaactcggccgcccgcggatcgacgtcatcatgacgctctcgggcatcttccgcgacctcctgccgctccagacccggatgctggccgaagccgcctggaaggccgccaatgccgaaggcgagccgctggcgcagaacttcattcgcgcccatgccctgtcctacgcgcaggagatgggcgtggacatggagaccgcctcgctgcgggtcttctcgaatgccgaaggcgcctatggctcgaacgtgaacgtgctcgttggctcctcggccttcggcgaggaagacgagctggccgacgcctacgaggcccgcaagagcttcgcctacggccgctcgggcaagcccgtgcagaatgcggcgcttctccagaagtcgctgaagacggtggatgtggcctatcagaacctcgaatcggtcgagctgggcgtgaccacggtcgaccattacttcgacacgctgggcggcatcgcgcgcgcggtgaagcgggcgcggggcgaggaagcgtccgtctatatcggcgaccagacccgcggtggcggcaccgtccgcacgctgaaggaccagatcgcgctcgagacccgcgcgcgcagcctgaacccgaaatattacgaggggctgctgaagcacggggccgagggcgtgcgccagatcgaggcgcaggtgaccaacacgctcggctggtcggccacgacccagcaggtcgagccctgggtctaccagcgcctgagcgaaaccttcgtgctggacgaggccatgcgccgccgtctggccgaactgaacccggaagcgagcgtccgcatggccgagcgtcttctggaagcgagtgcccgtaactattggcagcccgacgcggagactttggccgcgttgcagggggctgcggacgagttggaagaccgtctcgaggggattgccgccgag

SEQ ID NO: 31489 - DNA, 1593 bp, Rhodobacter sphaeroides
atgaaactgacgctgtggacatatgaaggcccgccccatgtgggtgcgatgcgcgtggcgaccggcatgaccgggatgcattatgtgctccacgcgccgcagggcgacacctatgccgacctgctcttcaccatgatcgagcgccgcggcaaacggcctccggtgagctacacgacctttcaggcccgcgatctgggctcggacactgccgagctgttccagtccgcctgccgcgacgcctacgagcgctttcagccgcaggcgatcatggtcggctcctcttgcacggccgagctgatccaggacgacacggggggcctcgccgacgcgctgtccctgcccgttccggtcgtccatctcgagctgccctcctaccagcgcaaggagaatttcggcgcggacgagagcttcctgcagatctgccgcaagcttgccaggcccatggagcgcacggagaaggtctcctgcaacctcctcgggccgacggctctgggcttccgccaccgcgacgacatcctcgaggtgacgcggcttctcgagggcatggggattgcggtgaatgcggtggcgccgatgggcgcaagcccggccgacatcgcccggctgggggccgcgcatttcaacgtgctgctctaccccgagaccggcgaatccgccgcccgctgggccgagaagacgctgaagcagccctatacgaaaacggttcccatcggggtcggcgccacgcgcgacttcgtggccgaagtggcggcgctcgcaggcgtcgcgcccgtcgcggatgacagccgcctgcgccagccctggtggtcggcctcggtcgattccacctacctcaccggcaagcgcgtgttcctgttcggcgacgcaacccatgtgatcgcggcggcccgcgtcgcgcgcgacgagatgggcttcgaggtggtgggcatgggctgctacaaccgcgaattcgcccgccccatgcgcgcggccgccaagggctacgggctcgaggcgctcgtgaccgacgattacctcgaagtcgaggaggccattcaggcgctcgcgcccgagctgatcctcggcacgcagatggagcgccacatcgccaagcggctcggcatcccctgcgcggtgatctcggctccggtccatgtgcaggacttcccggcccgttactcgccgcagatgggcttcgagggggcgaacgtcctcttcgacacctggatccatccgctgaccatgggtctcgaggagcatctcctgaccatgttccgcgaggatttcgagttccacgacgaggccggcccctcgcaccacggcggcaaggcggtccccgcctcggcgccccgcgccgacgaggccgccgaggcgctgccgctgacgggcgccgagacggccgagggggggtcgatcccccccgaggccgtgcccccggccgaggccgccgcagtccccgcgggcgagatcgtctggctgacggatgccgagcgcgagctgaagaagatccccttcttcgtgcgcggcaaggcacgccggaacaccgagaagtttgcggctgagaagggcctcacccggatcagcctcgagaccctgtacgaggcgaaagctcat

SEQ ID NO: 31490 - DNA, 1284 bp, Rhodobacter sphaeroides
atgagccttgaccttccgcccccgcccgcccgcggctgccgttcgaccgaggtcctgaaggagcgcggccagcgcgaggtcttctgcggactgaccggcatcatctggctgcaccgcaagatgcaggacgccttcttcctcgtcgtgggctcgcgcacctgcgcccatctgctgcaatcggcggccggggtgatgatcttcgccgagccgcgcttcggcacggccgtgctcgaggagaaggatctcgcgggcctcgccgacgccaatgcagagctcgaccgcgaggtggaccgcctgctcgcgcggcgtcccgacatccggcagctcttcctcgtgggctcctgcccctccgaagtcatcaagctcgacctgcaccgggcggccgagcggctctcggcgcatcacgggcccgcggtccgggtctacaacttctccggctcggggatcgagacgaccttcacgcaaggcgaggatgcctgcctcgcctccatcgtgccgacgctgcccgccaccgaggcgcgcgagcttctgctcgtgggtgccctgcccgacgtggtcgaggatcaggcggtctcgcttctgacccagctcgggatcgggccggtgcgctgcctgcccgcccatcacgcggccgaggcgcccggcgtgggaccgaacacggtcttcgccctcgtccagccgtttctcggcgacacgcatggcgcgctgacccgccgcggcgcgcggcacatcgccgcgcccttccccttcggcgaggagggcacgaccctctggctcaaggccatcgcggacgagttcggcgtgtcggccgacacgttcgaggccgtcaccgccgccccccgcgcccgggcgcgcaaggccgtggccgcggcctccgaggggctgcgcggcaagtcggtcttcttcctgcccgacagccagctcgaaccctcgctcgcccggttcctcacccgcgaatgcggcatgagcgccgtcgaggtgggcacgcccttcctccaccgcggcatcctcgggccggatctggacctcatcgccgaggggccggtcctgtcggaaggtcaggacgtcgagcgccagctcgaccgggtgcgcgcggcgcgacccgatctcacggtctgcgggctgggccttgccaacccgctcgaggccgaggggttcaccaccaaatgggccatcgagctcgtcttcacgccggtgcatttctacgaacaggcgggcgatctcgccggcctcttctcgcggccggtgcggcgccgggcgatcctgcggcgcgaggctgcggaa

SEQ ID NO: 31491 - DNA, 1575 bp, Rhodobacter sphaeroides
gacatctccgagcggctcgagcgtgaggagagcctgaagaaggcgcgcaatgacgcgctgaagggcgaagaggccaagtcgcgcttcctcgcggtcatgagccacgagatgcggacgccgctcaacgggctgatggctgcctccgacctgctgcagacctcgacggatctcaccgacagacagcgctggctcaccgacatcgtgatcggctgcggctcggcggcactcgatcaggtgaacaacgtgctcgagctgacgcggctgtcggacaaggacggcgcgagctacgcccgcacggtcttctcgccggtggatctcatcgaggggctgatccggcagaaccagccgcaggccgacaagcgcggcaacaagctgtggttcgcgcagcccaagaacccggtgccgcccgtgctcgggcagcgccacctgttcctgcgggtgatgtacaacctgatcggcaatgccatcaagttcaccgacaatggcaaggtctcggtcgagctgctctggcacccgggccgcacgtccggcaccgtcgacctctgcatccatgtgggcgatacgggcatcggcattgcggaggagcatctcgacacgatcttccgcaatttcgagacgctcgacgcctcctacgggcgcatccgcgaagggacgggcctcggcctcggcatcgccaagctcgccgccgagaccatgggcgggcagatcgacgtccagagcaagctggggctcggatccgtcttcacgcttcgcctgcagctgcccgtggcgcagggggccgaggcggcccaggaggagttcgcggaggatgcgccatcggccggggacggcgcccgcgcgatcctcgtggtcgatgacaatgcgatcaaccgtcagctcctcgccgagatcctgcggatggcggggcacgaggtggcgacggccgaggatggcgccgaggcggccgaggcggctggcgcccgccgcttcgacctgatcctgatggatgtctcgatgccgcgcgtggacgggctcgaggccacgcgacggatccggcgggccggcgcctcgaccgacacgcccatcctcggtgccacggcccatgccgacccggaccgtgtccccgacttcctcgcagccggcatgaatgacgtgctggtgaagcccatcacgcgctcggcgctgtttcgcgccatccgccagttcacggaaaccagcgccgcggtcgaggaggtgctccccgctggcgacccgccacccgacgatctgccgctgatcgacgccgagctgcgggccgacctcgagggcaatctcgggcccgattatatcgcgggcatgatcggcagggtgctgagcgagacgggcgacgcgctccccgagatgcggcgcctgcacgaggcgggcgatcatctggcggccgccaagctcgcgcaccggacggcgggggcggcggcggccgtgggcctcatggcgctgcaccgcagccttgcgagctacgaaacggcagccgacgcgtcgaacacggctgaggccgcgcgcgcgctcgagagcctgcccgcgacgctggaacgcaccgctgccgcctgtcaggccacc

SEQ ID NO: 31492 - DNA, 642 bp, Rhodobacter sphaeroides
cttgtcattttcgattgcgacggggttctggtcgattcggaagttctggccgtggccgtcctcatcgcagagctggaccgggcgggcgcgcgggtcgacgaggccttcgtgcatcggcattttcttggccgcagcttcccggtcgttcaggaggtcgttcagcgccagttcggcgtgaccctgcccgaaacttttcaggccggggaacgcgcccggctgctggcggccttcgagaccggcctccgggccatgcccggcgcggcggagaccgtccgcgcgctggcggtgcccttctgcctcgccacgtcgagcacgccggcccggctcacgcgctcgctcgagatcacgggccttgccgccctcttcgaggggcgctgcttcaccgcgagtcaggtggcgcggggcaagcccgcgcccgatctgttcctgctcgccgcggccgagatgggcgtcgcgcccgcacgctgcctcgtgatcgaggataccgagcccggcgtgcgcgcaggcctcgcggccgggatgcaggtctggcgcttcaccggcggcagccatttcgcgaaccgatcccccgaggatgcgcccgatgcccggccgcaccggcggttcgacagcttcgaccgtttctacgagaccctgcccggc

SEQ ID NO: 31493 - DNA, 768 bp, Rhodobacter sphaeroides
atgcggctcgacggcaagaccgccctcatcaccggctcggcgcgcggcataggccgcgccttcgccgaggcctatgtgcgcgaaggcgcgcgcgtggccatcgccgacatcaatctcgaggcggcccgcaccaccgccgccgagatcggccccgcggcctgcgccatcggcctcgacgtgaccgatcaggccagcatcgaccgctgcgtggccgagcttctcgaccgctggggccgcatcgacatcctcgtgaacaatgccgccctcttcgatctggcgcccatcgtcgagatcacccgcgagagctacgaccggctgttcgccatcaacgtctcgggcacgctcttcatgatgcaggcggtggcgcgggcgatgatcgcgggcggccggggcggcaagatcatcaacatggcaagccaggccggccgccgcggcgaggcgctggtgggcgtctattgcgcgaccaaggccgccgtcatctcgctcacccagagcgcggggctgaacctcatccgccacgggatcaacgtcaatgccatcgcgccgggcgtggtggacggcgagcactgggacggagtggatgccaagttcgccgactacgagaacctgccgcgcggcgagaagaagcgtcaggtcggcgcggcggtgcccttcggccgcatgggccgcgccgaggacctgaccggcatggcgatcttcctcgccacgcccgaggccgactacatcgtggcccagacctacaacgtggacggcggcaactggatgagc

SEQ ID NO: 31494 - DNA, 1824 bp, Rhodobacter sphaeroides
atcaccgtcaacggccgcccgctcgaggtcgagggctcgaaggacctgctcaccacctgtctttcggcgggcatcgagatcccgcatttctgctggcacggcgatctgggctcggtcggcgcctgccggctctgcgcggtgcgggtgcatgacgggccggaggataccgagggccggatcgagatggcctgcatgacgcccgtgcgcgagggccagcggatcgaggtcatggacccggaggccgagcggttccgcgcccggatcgtcgaatggctgatggtgaaccacccccacgattgcgcggtctgcgaggaaggcggcgcctgccacctgcaggacatggtggtggcttcgggccaccatcgccggcgcgccgaggtggcgaagcgcacccaccgcaatcgggatcacgggccgttcctcacgcaggagatgaaccgctgcatcggctgctaccgctgcctccgcttctaccgcgactatgcgggcgggcgcgatttcgaggtgctgggcgcccatgaccgggtctggttcggccgcacagagcccggcgcgctcgacagccccttcgccggcaacctcgccgaggtctgccccaccggcgtcttcgacgaccgctggtggtcgcgccactacgcgcggccctgggacatggccgagacgccctcgatctgcgcgaactgcgcggttggctgcaacatcaccctcttcgagcgcggcggaacgctccgcaaggtgcagaaccgcacgcatggcgcgatcaacggctcgttcctctgcgaccggggccggttcggggcgctcgcggccgaggcggcccgtccgacccatcccacccgcaagggcgccgggatcctctggaccgaggccattgaggccgcccgcgccctcgtcgcgcggggggccatcggcatcggctcaccccgcgcctgtctcgagaccaatttcgcgctgcgcaggctcgtgggcgaagaccggttcttcgccggatgcagcgcgtccgaggcggcgctggtggcccggatggccgcgatcctgcggcagggaccggcggggatcgcggccatccgcgacatcgaacgggccgatgcggtgctcgtgctgggcgaggatctgaccggcaccgcgccgcgcgccgcacttgccctgcggcaggccgcccgcggcgccgagcgccgtctcgccgccgaaaagggcgtgccggactggatggatgccgcggtgcgggtggcgggcgaaggccgccgctcgccggtcgcagtggtcacgcccctgcccgacgcgctcgacgaggtggcgctctggccgctccgtcgcacgccggccgaggtgggcgccttcgggcatgccgtggccgcggcgctgcgcggcgaggaggctgcacccgacgcgcgtgcggtggccgaggcgctggtcgcggccgaggtgccggtggtgatcgcgggggcgggcctcggcctcgccgctccggccgaggctgcggccgccgtcgccgcggcgctgggtgcgcgcgcgcggatcgcgctcttcccgcccgaggcgggcagcctcggtctggccctgctgggcggcactgggctcgaacgggcggtggccgagctcgaggccgagccgcgccccgtgatcctgctcgatgcctccctgcccgaccgtgcgccggccgaactcgtcgagcggctgatggccgccgcgaccgaggtgatgctgctcgactggctcgacgggccgctcgcgccgcaggcggatctcctgctgccggtcacggcgccggccgagacctccggcacctacatcaaccacgagggccgtgcgcagcggttcttc

SEQ ID NO: 31495 - DNA, 2245 bp, Rhodobacter sphaeroides
gccgagcagatctgggatatgaagtatcgcctgaaggatggcgcgggccatccggtcgacggatcggtcgaagatacctggcggcggatcgcgcgggcgctggccgaagtcgaggccgagcctgcgctttgggaggatcggttctacagcgcgctcgaggatttccgcttcctgccggccggccggatcaccgctggggcgggcaccgggcgcacggtcacgctcttcaactgcttcgtcatgggcaccgtcccggacagcatggcgggtatcttcgacgcgctgaaggaagcggcgctgacgatgcagcagggcggcgggatcggctatgacttctcgaccatccgcccgcgcggcgccgaggtgaagggcgtcgccgccgacgcctcggggcccctttccttcatggatgtctgggatgcgatgtgccggacgatcatgtcggcaggctcgcggcgcggcgccatgatggccacgatgcgctgcgaccatcccgacatcgagagtttcatcgaagccaagaaagacccggcccggctgcggatgttcaacctctcggttctcgtgaccgacgccttcatggaggccgtgaaggcggacggcccgtgggagctcaccttcggcggcaaggtctacaggacgctgcaggcgcgcgacctctggaaccgcatcatgcgttccacctacgatttcgccgagccgggcgtgattttcatcgaccgcatcaaccagatgaacaatctcgcctactgcgagacgatctctgccaccaacccctgcggcgagcagccgctgccgccctatggcgcctgccttctcggctcggtgaacctcgcccggctggtcgcgaaaccgttttccgacggggcggagctcgatctagccgagctggacgagctggtgcgccttgccgtccggatgatggacaatgtggtggatgcctcgcgcttcccgctgcccgaacaggcgcgcgaggcgcagatgaagcgccggatcggcctcggcgtgacgggccttgcggatgccctgctgatggtggggctgcgctacggctcggaagaagccgccgcccggaccgaggcctggatgaaggccatcgcgcgctcggcctatctcgcctctgcggatctcgcgcgcgagaagggcgccttcccgctgttcgaggccgacaagtatctcgggtcgggctcgctcacccatatggacgaggatgtgcgcgcggcgatccgcacccacggcatccgcaacgcgctgctgacctcgatcgcccccaccggcacgatcagcctctacgccggcaacgtctcgtcggggatcgagccggtcttcgcctatgcctacaagcgcaaggtgctgcagaaggacggaagccgcaccgaggaggaggtcgtcgattacgccgtccgcctctggcgcgaacagatgggcgacgccccgctgccggactatttcgtgaatgcccagacgctggcgccgctcgaacatgtgcggatgcaggcggcggcgcagaaatggatcgacagttcgatttccaagacgatcaactgcccggaagatatcggtttcgaggaattcgccgacgtctacctcgcggcctgggatcagggctgcaagggctgcacgacctatcggccgaacgaggtgacgggctcggtgctctcggtctccgaggcggggcaggcggctccggccgaggcgcccgagcccaagggcggcgaggtggtctatctcaccgatccgctcgaccgccccgcagcccttgagggcgcgacctacaaggtgaaatggccgggctcggaacatgcgctctacatcacggtgaacgacatcgtcatctccggccaccgccggccgttcgaagtgttcatcaactcgaagaacatggagcatttcgcctggacggtggcgctcacgcggatgatctcggccgtcttccggcgcggcggcgacatttccttcgtggtcgaggagctgaaggcgggtcttcgacccccgcggcggcgcctggatggaggggcgctacattccctcgatcctagcagccatcggcggcgtgatcgagcgccacctgatcgcgatcggcttcatcgagggcgagggcatgggtctgaagaccgaccctcatgccgatgtgcaggtcttgggggtgaaggccaaggcctgctcctcctgcggcagctacgacctccgcatggtggaaggctgcatgacctgcgccagctgcggcttctccaagtgcggatga

SEQ ID NO: 31496 - DNA, 630 bp, Rhodobacter sphaeroides
ttccaaggcttcgaggtgccgcggcagggcagccagaccgtgctcgacgtggtgtcctggatccagcagaacctcgatccgacgctgacctaccgctatgcctgccgggtcggcatgtgcggctcctgcgccatgatggtgaacggggtgccgcgctggacctgccggacccatgtgaacaaggtcgatcagggcggtgcgctcaccatcgggccgctgcgcaacctgccggtcatcaaggatctcgcggccgacatggacccgttcttcgagaaatgggtcaaggccgaagggctcttccaccccgcccgcacgcgccacgaggaagtggcgcgggtcgatcccgcttccgaggcgcggcgcaccgccgaccgggccatcgaatgcatcaactgctcggtctgctatgccgcctgcgacaccgtggcgggcaacccggattatctcgggcccgccgccctcaaccgcgcctggagcgtggtgaacgacgagcgcgacgcgggccgggccgaggtgctggcggccgtctcggtctcgggcggctgccacaactgccacagccagggaagctgcacgcgccactgcccgaacgagctttcgccgctcgattccatcgcgggcctcaagcgc

SEQ ID NO: 31497 - DNA, 1581 bp, Rhodobacter sphaeroides
gagaccgacatcctgatcctgggctcgggcggcgcggggctctttgccgccctccacgcccagcagagcgcgcccacgggcacccggatcaccattgcggtgaaggggcttctcgggaaatgcggctgcacgcgcatggtgcagggcggctataatgtggcgctcggcgcgggcgacacggtcgagcggcacttcatggacacgatccacggcggcaagtggctgcccgatcaggacatggcctggcggctctgccaggaggcggtgacgcgggtgcgcgaactggagaacgaggtcggctgtttcttcgaccgcaacccggacggcacgctgcaccacaaggccttcgcgggccagaccgccgaccggactgtccacaagggcgatctgaccggcatcgagatcatcaaccggctgatggagcaggtgctcgcgcgtccgatcgagcggctgcaggagcatcgcgccgtgggcctcatcccggccgagggcggcggggcgatctcgggcgtgctcttcatcgacatgcgcacgggccgcttccgcttcgtgcgggcgaagaaggtgctgatggccacgggcggcgggcccaccatgtacaagtatcacacgccatcgggcgacaagacgatggacgggctgtcgatggcgctgcgtctgggcctgccgctccgcgacatggagatggtgcagttccacccgaccgggctactcgcggggccgggcacgcgcatgacgggcaccgtcctcgaggaaggtctgcgcggcgcgggcgggcatctgctgaacgggcacggccaccgcttcatgtatgaccatgatgcggcgggcgagcgggccacgcgcgacgtggtcagccgcggcatctatgccgagatgcgcaagagcaacacctccgagaacggcggcgtctatatctcgatggcccatctcggccccgacgatgtccgccgccgcttcaagggcatggtcaagcgctgcgccgactgcggcttcgatctggccggcgggctggtcgaggtggtgcccaccgcgcattacttcatgggcggcgtcgtggtggatcccgacacccgcaccgagatcgacgggctgcatgtcgcgggcgaggatgcgggcggcgcgcatggcgcgaaccggctgggcggcaacggtgtcgccaactccaccgtcttcggcggcatcgcgggcgacgtgatgggcgccgaggtggcctcgatccgccatctgcgccccgcggacgaggcagtgctcgcggccgagatcgaccgtgccatggcgccgctctcgaagcggccgggccaggtgcaagtgctgcgcgaggcgctgcaggaggccatgtgggaggatgtgggggtcctgcgcaccggcgcgggcctcgagcgcggcctcacgcgggtggcggccatcggcgcggaactggccgagaccggcgtcgatggcgcgaacctcgccttcaacctcacctggcacgactggctgaacatgcgctcgctcgtggacatatccgaggccatcgccacggcgggccttgcgcgcgagaattcgcgcggggcgcattaccgcgaggatcaccccgag

SEQ ID NO: 31498 - DNA, 1326 bp, Rhodobacter sphaeroides
atgaaagactggctgagaaagcatccccaggtccgcacgatccgtgtcgcggccgcggatctcaacgggcaggcgcggggcaagcgcatccccgcccgcttcgccgacaaggtcgtgaaggacggcacgcgctttccgttctcggtgctcaacctcgacatctggggcgaggatatcgacgacagcccgctcgtcttcgagcagggcgatgccgacgggatcctgcgcccgaccgagcgcggcttcatgccgatgccctggctcgaggcgccgaccgcgctcctgccgatctggatgttccgcgaggacggccgcccctacgagggcgacccgcgccatgcgctgcgcgccgtgctcgaccgctacaaggcgcgcggcctgacgcccgtcgtggccgtcgagctcgagttcttcctgatcgacgacagcggcaagaccctgcaggtgccgccgtcgccgcggtcgggcaagcgcaggaaggccgccgaggcgctctcgatccgcgcgctcgacgccttcgacatcttcttcaccgacctctacgacgcctgtgaggagatggacattcccgccgacaccgccacgtcggaaaccgggctcggccagttcgaggtgaacctgatgcattgcgacgatgccctgcgcgccgccgacgatgcctggttcttcaagcttctggtcaagggcctcgcccgaaggcacggcttcgccgcgagcttcatggccaagccctacccggaatattcgggctcgggcctgcacatgcatttctcggtgctcgacgcgcaggggcggaatgtcttcgacaacggcggccccaccggcacggcgatgatgcggcacgcggtggcgggctgcctgaatgcgatgcacgacagcacgctcgtcttcgcgccgcacgccaacagctacgaccggctggtgcccgggatgcatgcccccaccgccatctcctggggctacgagaaccgcaccaccgccgtgcggatccccgcgggcaacccggccgcgcggcggatcgagcatcgcgtggcgggcggcgacgtgaacccctatctccttgtcgccaccatcctcggcgcggccctgaccggcatcgaggatcaggaggagccgccgcaggccatcatgggcaacgcctatgccctcgaagacctgccgcagatccccccgagctgggaggccgcgattcagtccttcgaaaattcggcaatcatgccgcgaatccttccgcgcgagctcatccgcaactatgtcctgacgaagcggcaggaactgcactatctggccgagctctcgcccgaggaacaggtcgagctctacctc

SEQ ID NO: 31499 - DNA, 1213 bp, Rhodobacter sphaeroides
atggccaacgtcgtcgtcgtgggcgcccagtggggcgacgaggggaagggcaagatcgtggactggctctcggagcgggccgacgtgatcgcgcgtttccagggcgggcacaatgcgggccatacgctggtgatcgacggcaaggtctacaagctctcgctgctgccctcggggatcgtgcggccgggcaagctgtcggtgatcggcaacggggtcgtgctcgatccgtggcatctggttcaggagatcgccaagctgcgcgccgacggcgtcgagatctcgccccagagcctgatgatcgccgagaatgcggtgctgatcctgccgctgcacggcgagctcgaccgcgcgcgcgagtcgcagaattcggtggccaagatcggcaccacgggccgcggcatcggcccggcctatgaagacaaggtgggtcgccgcgcgatccgcgtggccgacctcgccgacgaagcgacgctcgcgctccgcgtcgaccggctgatggtccatcacgatgcgctgcgccgcggcctcgggatcgagcccgtcgaccgcgaggcgctgctggcccagctgcgcgagatcgcgccgcaggtgctgccctacgccaagcccgtctggaaggtgatgaacgagatgcgcaaggccgggaagcgcatcctgttcgaaggggcgcagggggcgctcctcgacatcgacttcggcacctatccctatgtgacctcctcgaacgtcattgcggggcaggccgccaccggcaccggcatcgggccgggcgccatcggcttcgtgctgggcatcgtcaaggcctacaccacccgtgtgggcgagggaccgttcccggccgagcttcaggatgccgacggcgagcgtctgggcgagcgcggccgcgagttcggcaccgtgacggggcgcaagcgccgctgcggctggttcgacgcggtcctcgtgcggcagacctgcgccacctcgggcgtttcgggcatcgcgctcaccaagctcgacgtgctcgacgggttcgagacgctgaagatctgcgtgggctacgagctcgacggcgagcggctggatcacctgccgatcgcggccgaccagcaggcgcgctgcacgcccatcttcgaagagctcgagggctggtccgagagcaccgccggcgcgcggagctgggccgatctgcccggcgccgcggtgaaatacgtccgccgcatcgaggagctga

SEQ ID NO: 31500 - DNA, 1140 bp, Rhodobacter sphaeroides
aactacgtcttcacttccgagtccgtctcggaaggtcaccccgacaagctgtgcgatcgcgtgtcggatgccgtcctcgataccttcctggccgaggaacccaccgcccgggtcgcctgcgaaaccttcgccacgaccggccgcgtcgttgtcggaggcgaagtcggcctctccgatccccagaagctggacgagttcatggagcgcgtggacggcatcgtccgcgattgcgtgaaggacatcggctacgagcagcaggaattccactggcgcaccatcgaggtgcagaacttcctgcaccgccagtcggcccatatcgcgcagggcgtcgacaaggacggcgcgggcgaccaaggcatcatgttcggctatgcctgccgcgagacgcccgagctgatgccggcgccgatccagtattcgcatgcgatcctgcgccggctggccgaggtgcgcaaatcgggtcaggagcccgacctgcgtcccgacgccaagtcgcagctctcgctgcgctacgagaacggcaagcccgtcgaggtgcgctcgatcgtgctctcgacccagcacgcccatgaggagcagacctccgacgacatccgcgccatcgtcgagccctacatccgcgaagtgctgcccgagggctggatcaccgaggcgaccgaatggtgggtgaacccaaccgggaccttcgtcatcggcgggccggacggggatgcgggcctgacgggccgcaagatcatcgtggacacctacggcggggccgcgccccacggcggcggcgccttctcgggcaaggatccgaccaaggtcgaccgctcggccgcctatgccgcgcgctacctcgccaagaacgtcgtggccgcgggcctcgccgagcgctgcacgctgcaggtctcctatgccatcggcgtggcgaagccgctctcgatctatgtcgacacccatggcacgggccaggtggatgcggcgcagatcgagaaggccgtggcggactgcatggacctcacgccgcgcggcatccgcgagcatctgaacctctgccggccgatctatgcccgcacctcggcctacggtcacttcggccgggcgccggaagcggacggcggcttctcgtgggaacggacggacctgaccgacgccctg

SEQ ID NO: 31501 - DNA, 1254 bp, Rhodobacter sphaeroides
ctgaaggggcgtgccgagatccccggcgacaagtcgatcagccaccgcgcgctgatcctcggcgccatggcggtgggcgagacgcggatcacgggtcttctcgaggggcaggacgtgctcgacaccgcgaaggccatgcgcgccttcggcgccgaggtgatccagcacgggccgggcgcctggtcggtgcatggggtgggcgtggggggcttcaccgagcccgccgaggtgatcgactgcggcaattccggcaccggcgtgcggctggtgatgggggcgatggctacctcgccgctgaccgcgaccttcaccggcgatgcctcgctccgcaagcggcccatggggcgggtgaccgatccgctggctctgttcggcacgcgcgcctacgggcgcaagggcgggcggctgccgatgacgctcgtgggcgccgccgatccggtgccggtgcgctatacggtgccggtgccctcggcgcaggtgaaatcggcggttcttctggccgggctgaacgcgcccgggcagacggtcgtgatcgagcgcgaggcgacgcgggaccattccgagcggatgctgcgcggcttcggcgccgaactcagcgtcgagacggggcccgaggggcaggtcatcaccctgaccgggcagccggagcttcggccgcagacggtggcggttccgcgcgatccgtcctcggcggcctttccggtctgcgcggcgctgatcgtcgagggatccgagatcctggtgccgggggtgagccgcaatcccacccgggacgggctctatgtgacgctgctcgagatgggcgcagacatcgccttcgagaacgagcgcgaggagggcggcgagccggtggccgacctgcgcgtgcgggcctcggccctcaagggcgtggaggtgccgcccgagcgcgcgccctcgatgatcgacgaatatccgatcctgtcggtggtggcggcctttgccgagggcttgacgatcatgcgcggcgtgaaggagctgcgcgtgaaggagagcgaccggatcgacgcgatggcgcgggggcttgaggcctgcggcgtgcggatcgaggaggacgaggatacgctgatcgtccatggcatgggccgggtgccgggcggggccacctgcgccacccatctcgatcaccggatcgccatgagcttcctcgtgctcggcatggcggcggaggcgccggtgaccgtcgacgacggctcgcctatcgcgacctccttccctgccttcatcgatctgatg

SEQ ID NO: 31502 - DNA, 636 bp, Rhodobacter sphaeroides
atggcaggagtccgcgtcaagatctgcggactgcggacggagtcggatgtgaaggcggccgcgtcctcgggcgcggcctatgtcggtctggtgttcttcccgaaatcgccgcgccatctggagcttgcgcaggcgcagcggctcgcgctcgccgcgccgccgggggtggccaaggtggcgctgacggtcgacgccagtgacgagacgctcgacgccatcgtcgaggcggtgccgctcgacatgctgcagcttcacggcggcgagagccccgagcgggtggccgaggtgcgggcgcgctacgggctgccggtcatgaaggccgtgggggtggcggacgaaggcgacctgccgcagattctcgaacagtcgctggccgccgaccagatcctgatcgatgcaaaaccgccgaagggcgcggcgctgcccggcggcaatggcctctccttcgactggcggctgatctcggggcggcactggatcaggccctggatgctggcgggggggctgacggtcgaaaatctggccgaggccgtccggcgcacgggggcgtcgcaggtcgatgtctcctcgggcgtcgaatcggcgccgggcgtcaaggatccggcccggatcgcggccttcctgcaggccgcccgg

SEQ ID NO: 31503 - DNA, 1446 bp, Rhodobacter sphaeroides
gaccggtgccgtgcgtccgaagcgcggctcggcgctgtcatccgcgaggcgcgccatgtctacggactgacaaccggcttcggtccccttgcgaaccgcctgatctcaggtgagaatgtccgaacgctgcaggccaatcttgtccatcatctggccagcggcgtgggaccggtgcttgactggacgacggcgcgcgccatggttctggcgcgtctggtgtcgatcgctcagggagcctccggtgccagcgaggggaccatcgctcgcctgatcgacctgctcaattccgagctcgctccggccgttcccagccgcggcacggtgggcgcgtcgggtgacctgacaccgcttgcgcatatggtgctctgcctccagggccggggagacttcctggaccgggacgggacgcggcttgacggcgcagaagggctccggcgcggacggctgcaaccgctcgatctctcccatcgcgatgcactggcgctggtcaacgggacctccgccatgaccgggatcgcgctggtgaatgctcacgcctgccgccatctcggcaactgggcggtggcgttgacggccctgcttgcggaatgtctgagaggccggaccgaggcatgggccgcggcactgtccgacctgcggccgcatcccggacagaaggacgccgcagcgaggctgcgcgcccgcgtggacggcagcgcgcgggtggtccggcacgtcattgccgagcggaggctcgacgccggcgatatcgggacggagccggaggcggggcaggatgcctacagcctgcgctgcgctccgcaggttctcggggcgggcttcgacacgctcgcatggcatgaccgggtgctgacgatcgagctgaacgcggtgaccgacaatccggtgtttccgcccgatggcagcgtgcccgccctgcacgggggcaatttcatgggccagcatgtggcgctgacgtccgatgcgctcgccacggccgtcaccgttctggcgggccttgcggagcgccagattgcacgtctgacagatgaaaggctgaaccgtgggctgccccccttcctccaccggggccccgccgggttgaattccggcttcatgggcgcacaggtgacggcgaccgcgctcctggccgagatgcgagccacgggacctgcctcgatccattcgatctccacgaacgccgccaatcaggatgtggtctcgcttgggaccatcgccgcgcgcctctgccgcgagaagatcgaccgttgggcggagatccttgcgatcctcgctctctgtcttgcacaagctgcggagctgcgctgcggcagcggcctagacggggtgtctcccgcggggaagaagctggtgcaggccctgcgcgagcagttcccgccgcttgagacggaccggcccctgggacaggaaattgccgcgcttgctacgcacctcttgcagcaatct

SEQ ID NO: 31504 - DNA, 1443 bp, Rhodobacter sphaeroides
atggtttcgagagtcattccggtggacacgttcgatctggtcatcttcggcggcacgggcgatctggcacgccggaagatcctgcccggcctctatcggcgcttcaccggcgggcagatgccgcccgacagccgcatcatcgctgccgcccgctcggagatggacgacgcggcctatcgcgcccaagtgcgggccgcgctcgaggaattcgtgcccgcgggcaagcgcgacgagggcgggatctcggcgttcctcgagcggatccactatgtcgccatcgacgcgaccggaacctcgggatgggcggacctcaagaagatgatgcgccccgacgtggtccgggccttctatttctccgtggccccctcgctcttcggggcgctggccgagcggctgcacgagaacggcatcgccgggccgcagagccgcatcgtggtcgagaagcccttcgggcgcgatctggaatccgcgcgggccttgaaccgcgtgctggcgctccatttcgccgaggagcagatctaccggatcgatcactatctcggcaaggagacggtccagaacctgatggcggtgcgcttcgccaacatcctcttcgagccgctctggaaggctcagtatatcgaccatgtgcagatcaccgtagccgagaccgtgggcgtaggcgggcgcggcgcctattacgacacgtcgggcgcgatgcgggacatggtgcagaaccacctgatgcagcttctctgcctgatcgcgatggagccgccctatcacttcgatccgaacgcggtgcgcgacgagaagctgaaggtgatccgtgcgctcgatccggtcccgcccgaggatatcgtgcgcggccagtatctcgcgggcggcgggcaggagagctatgtcgatcacgccggcaacccccgcagccgcaccgagagctacatcgcgctgaaggtccatatcgccaactggcgctggaagggcacgcccttctatctgcgcaccggcaagcggctgcgcgcccgcgcctccgagatcgccatcaccttccgcgagccgccgcattcgatcttcgacgatgccgaggactggcgcgagaacgtgctcgtgatccggctgcagcccgacgaggggatcaatctcaaggtgatgatcaaggagccgggcccgggcggcatgcgcctcacgcaggtgccgctcgacatgtccttcgccgaggcgctggggccggacggcgaggacattcccgacgcgtatgagcggctcatcatggatgtgatccgcggcaaccagacgctcttcatgcgcggcgacgaggtcgaggccgcctgggcctgggccgatccgatcatcgccgcctgggagcggcgcggcgacaggcccaagacctacgagccgggaacttccggccccgaggatgcgctgatgctcatgcaccgtgacggccgccgctggcgcgag

SEQ ID NO: 31505 - DNA, 1596 bp, Rhodobacter sphaeroides
aaacagatctggcaggcgctgaaagcgcatcagcaggcggtggagcaccgcgcaattctcgatctctttaccgacccccgccgagccgagaccttctcgacccggctgggcgacatgctcttcgactggtccaagaccaacatcgaccatacggcacgcgatctgctcatcgatctggcgggcgcggccggcgtcgccgagaagcgcgaggccatgttctcgggcgcgaagatcaacgagaccgagggccgggcggtgctgcatacggcgctccgcaacatggaccggccggtgcgggtggacggtgtcgacgtgacgcccgcgctgcgcgagacgcacgcccggatgcaggccttcgtccgcgatctgcgctcggggcgcttcacggggcagggcggcccgatcaccgatgtggtgaacatcggcatcggcggctccgacctcggccccgcgatggcctgcctcgcgctcgccccctatgccgacgggccgcgctgccatttcgtctccaacgtcgatggcgcgcatatccacgacacgctgcaggatctcgatcccgccaccacgctcgtgatcgtggcctcgaagaccttcaccaccatcgagacgatgaccaatgccgagacggcgaagcgctggatggccaagcgcgtctccgatcccgccgcgcagttcgccgccgtctcgaccgcggcggacaagacggcagccttcggcatcgacgcttcgcgcgtcttcggcttcgaggactgggtcggcgggcgctattccatgtgggggccgatcggcctcgccctgatgatcgccatcggccccgaagcattcgacgccttcctggccggcggcgccgagatggaccgccacttccgcgaggcccccttcgccgagaacctgcccgtgctgctggcgctcgtcggcctctggcacaaccagatctgcggccatgccacccgggccgtgctgccctacgaccagcggctcgcgcggcttccggcctatctccagcagctcgagatggaatcgaacggcaagcgcgtggcgatggacgggcacgagctcacccatcactccggtcccatcgtctggggcgagcccggcaccaacggccagcacgccttctaccagctcatccatcagggcagccgcatcgtgccctgcgaattcctcgtcgcgcgtgagggccacgagcccgatctcgcgcaccagcatctcctgctggtctcgaactgcctcgcccagtccgaggcgctgctgcgcgggcgctcggtcgaggaggcgcgggcgatcctcggcaagaagggcctgaccggctccgagctcgagcggcaggcccgccaccgcgtcttcccgggcaaccgcccctcgacggtgctggcctatgaaaagctcacccccgccacgctcggccggatcgtcgccctctacgagcaccgggtcttcgtcgagggcgtgatcctcggcatcaattcctacgaccagtggggcgtcgagctcggcaaggaactggcgctggcgctgcagcccatgctcgagggccgcgcgggcaccgagggcaaggacggctcgacggcacagctcgtggcctacctgcgccgc

SEQ ID NO: 31506 - DNA, 3524 bp, Rhodobacter sphaeroides
ctgcctgagcctccatcttcagccgtatcggctgcttcttgacgataatcgggacgaacggcttccgattgcacggtaatctaggcgaaacaggagtgtccgtccatgctcgccgccgctgtccatcccacctcttccgacactctcgacgaggcgggcctcgtggcgcgcctgatcgccgaggccgatctcgacccgtccgcccgtgcgcgcatcgtggaccgcggggcggatctcgtccgccgcatccgtcagggatcgcggcccgggctgatggagggcttccttgcggaatacggcctctcgaccgacgaggggatcgcgctcatgtgcctggccgaggcgctgctgcgggtgccggatgccgagacgatggatgcgctgatcgaggacaagatcgcgccctcggactggaaccggcatctggggcggtcggcctcgagccttgtcaatgcctcgacctgggcgctgatgctgacgggcaaggtgctcgacgaccgcgagccgggcgtggcgggccatctgcgcggcctcgtgcggcggctgggcgagccggtgatccgcaaggccgtggcccgcgccatgaaggagatggggcgccagttcgtgctgggcgagaccatcgagggcgcgatggcgcgcgcggccgagctggaggccaagggctacagctacagctacgacatgctgggcgaggctgcccggaccgaagccgatgcgcggcgctatcatctggcctattcgcgcgccatcaccgccatcgcggcggcggcgaagagccgtgacatccgcgacaatccggggatctcggtcaagctctcggcgctgcatccgcgctacgaggtggccaagcgcacccgcgtgctggccgagctcgtgccgcgcgtgacggcgctggcggggctggcgcgggcggcgggcctcggcttcaacatcgacgccgaggaggccgaccggctcgatctctcgctcgaggtgatcgcggccgcactggccgagccgtcgcttgcgggctgggacgggttcggcgtggtggtgcaggcctacggtcgccgcgcgggcgaggtgctggaccggctttatggcatggccgtgcggctcgaccgcaagctgatggtgcggctcgtgaagggcgcctactgggacggcgaggtgaagcgggcgcaggtgctgggtctggacgacttcccggtcttcacccgcaagatggcgacggatgtgagctacatcgcgcaggcccgcaagctcttctccatgtccgaccggatctatccgcagttcgccacccacaatgcccatacggtggccgcgatcctcgagctggccgaggggcgcccgttcgagttccagcgcctgcacggcatgggcgagcggctgcatgacctcgtgctgaccgaagagaagacgcgctgccggatctatgcgccggtgggcgcgcaccgcgatcttctggcctatctggtgcgccgcctgctcgagaacggggccaattcgagcttcgtgaaccagatcgtcgatgagagcgtgagccctgaggcggtggcggcctgcccgctcaccgcgatggagcggacggagcccgtgcgcaacccggtgctgcgcgccggcaccgacctctttcccgggcgcaggaactcgcgcggcttcgatctcgcctcggccgaggatctggcgctgatcgagagcgcgcgcagcccccaccggacggcgctgttcgatgcgcggccgatcctcgcggaatcgctcgcgggcgggcagcgggccgaggtgacggatccttccaccggggcgcgggtgggcaatgtgctgcccgcgagcctgcccgatgtggagaccgcgctccatcatgccgtgccgtgggaggcgcgccccgaggaccgggcagaggtgctgcgccgcgcggccgacctctacgaggcgagcttcggcccgatcttcgcccttctggcgcgcgaggcgggcaagacgctgcccgatgcggtgggcgagctgcgcgaggcggtggatttcctgcgctactatgcggccgagggcgaggcgctgactgcgccgcctctgggcaccgtggtctgcatcagcccctggaacttcccgcttgcgatcttcaccggccagatcgcggccgcgctgatggcgggcaatgcggtgctggccaagcccgccgaacagacgccgctgatcgcggctctcgcggtcgagcttctgcaccgggcgggcgtgcccgtcaccgcgctccagcttctgccgggcgagggcgggacggtgggtgcggccctcacgcgcgatccgcgggtggggggcgtggtcttcaccggctcgaccgagacggcgcgggcgatccggcagagcatggcggcccatctcgatcccgcggccccgctcatcgccgagaccggcggcctcaatgcgatgatcgtcgattcgaccgcgctgcccgagcaggcggtgcgcgacatcctcgcctcggccttccagtcggcgggccagcgctgctcggcgctccgttgcctctatctgcaggaggatgtggccgagggcgtgctcgagatgctcttcggcgcgatggacgagctgcaggcgggcgagccctgggatctggcaaccgacctgagcccggtgatcgatgccgaggcgcaggcgggcatccgcgactggatcgccgccgcccgcgccgaggggcgggtgctgaagcagctggcggtgcccgcgcgcggcaccttcgtcggcccgacggtgatccgcgtgggctcgatccgcgagatggaccgcgagatcttcgggccggtcctgcatgtcgcgaccttccgcgccaccgagatcgaccgggtgatcgccgagatcgacgccacgggctacgggctgaccttcggcctgcacagccggatcgacgaccgggtgcaggcgctggtgggccggctgcgggtgggcaacatctacgtcaaccgcaaccagatcggcgccgtggtgggcagccagcccttcggcggcgaggggctctcgggcaccgggccgaaggcgggcggcccggcctatctggcgcggctggtgagccggcccgcgccggattgcgccgggagcgaggcgcccgcgcagcccgcggccgaggtgcaggcggcgctcgaccgcctcgcgcccaaggccggagagctcatcggcacccacgcactgccggggcccacgggcgagtcgaaccgcctctcgctcctccgccgtccgccgctcctctgcctcgggccgggcgcggccgccgcccgggcgcaggccgaggcggtgcgcacgctcggcgggctcgcggtcgaggcgccgggcctcgcgcccgaggcgctggccacgcttcgcggcttcgcgggcgcgctcttctggggcggggccggggacgcgcgaccccgggcgcaggcgctggcgtcgcgcgagggggcgatcctgccgctgatcggcggcctgcccgacgaggcccatgtcgcggtggagcggcatctctgcatcgacaccaccgcctcgggggcaatgccgaacttctcgcc

SEQ ID NO: 31507 - DNA, 1265 bp, Rhodobacter sphaeroides
atgctgaatgccgacgtaagccgccgccgcaccgaagccgtgtcgcgcggcgtggggatgcagacccagatctatgccgaccgcgcggtcaatgccgagatctgggacatcgaggggcgccgctacatcgatttcgcggccggcatcgcggtggtgaacaccggccactgccacccgaaggtcatggctgcggtcgccgagcagatgggccgcttcacccacacctgccatcaggtgctgccctatgagaattacatccgcctcgccgagcggctgaatgccgcggcgccgggcgacttccccaagaagacggtcttcgtcaccaccggcgccgaatcggtcgagaatgcgatcaagatcgcgcgcatccacaccgggcgctcggccgtcgtggccttcggcggcggcttccacggccgcaccttcatgaccatgtcgctcaccggcaaggtcgagccctacaagaagggcttcggcacgatgatgcccgaggtctaccacgtccccttcccgcaggcgctgcacggcatctcgaccgaggggccatggcggccctcgcccggctcttcaaggccgacctcgacccgggccgcgtggccgcgatcatcttcgagccggtgcagggcgagggcggcttctatcccgcgccgccggatctggtgcgggcgatccggcagctctgcgatgcgcacgggatcgtcatgatcgccgacgaggtgcagacgggcttcgcgcgcaccggcacgctctttgccatgcacggctatgacgtggcgcccgacctcgtcaccatggccaaggggctgggcgggggcctgcccatcgccgcggtgacggggcgggccgagatcatggacgcggcccatccgggcggcctcggcggcacctacggcggcaacccgctgggcatcgccgcggcccatgcggtgctcgacgtgatcgaggaggagaacctctgcgcccgcgcgaccgaactcggcagccggctgaagcagaagctggccgagatccgggccacggcgcccgagatcgccgacatccgcggcccgggcttcatggtgggcgcggaatttgccgatcccggctcgaaggcgcccgacgcgggcttcaccaaccgggtgcgcgaggaggcgctgaagcgcgggctgatcctgctcacctgcggcgtccatggcaacgtgatccgcttcctcgcgccgatcaccatccccgagccgcatttcgccgaggcgctggagatcctcgaagcctcggtcgcagcggcc

SEQ ID NO: 31508 - DNA, 2592 bp, Rhodobacter sphaeroides
gcttatccgcaggtcgcagggcaagaagagggttccatggctgtcgtcgtcgtcgaaagcccggccaaggccaagacaatcaacaaatacctgggctccgactatacggttctggcctcctatggccatgtccgcgacctgcctcccaaggacggatcggtcgatcccgagcatgaattcgccatgacctgggaggtcgcggcggattcgaagaagcatgtccgcgccatcgccgacgcgctgaagaccgacgacacgctcattctcgcaaccgacccagaccgcgagggcgaggcgatctcgtggcacctgcaggaggcgctggcctcctcgctgaagaagggcaagaccgtccgccgcgtgaccttcaacgcgatcaccaaatcggcggtgaccgaggcgatgaaggctccgcgcgaggtcgataccgcgctggtcgaggcctatctggcccgccgggcgctcgactatctggtgggcttcaccctctcgccggtgctctggcggaagctgccgggggcgaaatcggcgggccgggtgcagtccgtgtgcctgcggctcatcgtcgagcgcgagatggagatcgaggccttccgcgcccgcgaattctggaccgtctcggccgttctcgccaccccgcgcgggcaggaattcgaggcccgtctgaccgtgctcggcggaaagaagctcgagaagttcgacctggccacctccgaggcggcggaactcgccgtgcaggccgtgacctcgcggccgctgaaggtggcctcggtcgaggccaagcccgcgagccggaacccctcggccccgttcatgacctcgaccctccagcaggaggcgtcgcgcaagttcggcatgggcgcgaaacagtgcatgtcggcggcgcaaaggctctatgaggcgggccacatcacctacatgcggaccgacggcatcgacatggcgcccgaggccgtgatggccgcgcgcgacgagatcaagcggcgcttcggggcgaactacgtgcccgacagcccgcgcatgtacaagaacaaggccaagaacgcgcaggaagcccacgagtgcatccggcccaccgacatgtcggcctcgcccgagaagctggggctgaccgacaccgaccagcgcaagctctacgagctgatctggaagcggacgctggccagccagatggccgcggcgcggctcgagcggaccacggtcgagatcgcctcgcccgacgggcaggtgggcctgcgcgccacgggtcaggtcgtgctcttcgacggcttcctcaaggtctacgaggaggggcgcgatgaccgcagcgacggcgacgaggacgatgagggccgcctgccgcagatcatggcgaacgaggcggtggaaaagaaatccatcacgcccgagcagcaccacacccagccgccgccgcgctataccgaggcgacgctggtcaagcggatggaggagctgggcatcggccggccctcgacctatgccagcatcgtctcgacgatccaggaccgggaatatgtccgcaaggacaagaatcggctgatccccgaggacaaggggcggctggtcacggccttcctcgcgaacttcttccgcaaatatgtggaatacgatttcaccgccgatctcgagggcgaactcgacgacgtctcggcgggcgagcggaactacaaggaagtgctcgcgcgcttctggcgcgacttctcggccgccgtggccgagacggccgatctgcgcatcggcgaggtgctcgacaagctcgacgagttcctcgccccccatctctatccgccgcggcccgacgggtcggatccgcggatctgcccgacctgcggctcggggcgtctgcatctgaagacggcgcggggcggcggggccttcatcggctgcggcaactatcccgactgccgctacacgcggccgatctcggtcacgggcgacgaggagaatgcgatctcgcccgacggcaagcttctgggccatgacgaggacggcgcgccgatctcgctgcgctcgggccggttcgggccctacgtccagaagggcgaggtcacggccgaggtgccgaaaccgccgcgggcgagcctgcccaagggctgggcgcccgacacggtcgatctcgaccgcgcgctgatgctgctgaacctgccgcgcctcgtgggcagccaccccgaggacggccagccggtcgaggcggccatcggccgctatgggccttacgtcaagcatggctcgacctatgcgaacctgccggatgtggaggaggtcttcaccatcggcatgaaccgcgcggtcgaggtgctggcgcagaaggcggccggccgccggggcgcctcggcgccggcgcagccgatcaaggagctgggcgagcatcccgacggcggcctccttgccgtgatgccgggccgctacgggccctacgtcaagtggggcaaggtcaatgccacgatcccgaaagggatcgagcccgaggcgatcacccttgaggaagctctggcgctggtggccgagaaggccggcaaggcgccgaagaagaaggcgcccgcccggaaggccaaggccgaggagggagcgccgaagaaggctgcgcccaag

SEQ ID NO: 31509 - DNA, 1401 bp, Rhodobacter sphaeroides
ttcgtcgacggtcgtccgctcgaggatgagaccggcgcgccgatccccgtgatctatcccgccaccggcgaggagatcgcccgccttcacgaggccacgcccgccgtgatcgaggcggctttggcctcgggcgcccgcgcgcaggcggcctgggccgcgatgcggcccgtcgagcgggcgcggatcctgcgccgggcctcggacctgatccgggcgcacaacgaggagctgagccttctcgagacgctcgacaccggcaagccgctgcaggagacgctggtggccgactgggcctcgggggcggatgcgctggaattcttcgccggtctggcgcccgtcgtcaccggcgagaccgtgccgctggggcaggatttcgtctatacgatccgcgagccgctgggcctctgcgtgggcatcggcgcctggaactacccgagccagatcgcctgctggaaggccgcgcccgcgctcgcgctcggcaatgcgatggtgttcaaaccctcggaagtgacgccgctcggcgcgctgaagctggccgagatcctgatcgaggcgggcctgccgcccgggctcttcaacgtggtgcagggccgcggcgcggtgggggcgtcgctcgtcaccgacagccgggtggccaaggtctcgctcacgggctcggtgccgacggggcggcgcgtctatgcggctgcggccgagggcgtgcgccatgtcacgatggagctcggcggcaagtcgcccctgatcgtcttcgacgatgccgatctggagagcgccatcggcgcggcgatgctcggcaacttctattccgcgggccagatctgctcgaacgggacgcgggtcttcgtgcagaaggggatcaaggaagcgttcctcgcccggctggccgagcgggccgatgccatccgcatgggcgatccgctcgaccccgaggtccagatggggccgctcgtctcgcaggcgcagctcgagaaggtgctggcctatatcgagaaggcccgcgccgagggcggccgcctcgtctgcggcggcgaggcctcggtcagccccggctgctatgtccagcccacggtcttcgccgatgtgacggacgccatgaccctcgcccgcgaggaggtgttcggtccggtgatggcggtgctcgatttcgagaccgaggaggaggcgatcgcgcgggcgaatgccaccgacttcggcctcgccgcgggggtcttcaccgcggatctcacgcgggcgcaccgggtggtggcgcagctgcaggccgggacctgctggatcaacgcctacaaccttacgccggtcgaggcgcccttcggcggggtgaagctgtcgggcgtgggccgcgagaacggccgggccgccgtccagcactatacgcaggtgaagtcggtctatgtcggcatg

SEQ ID NO: 31510 - DNA, 1575 bp, Rhodobacter sphaeroides
gattacatcatcgtcggcgccggctcggccggctgtgccatggcctatcgcctcggcgaggcgggccgctcggtgctggtcatcgagcatggcggcacggatgccgggcccttcatccagatgcccgcggcgctctcctatccgatgaacatggggatctacgactggggcctgaagaccgagcccgagccgcatctggacgggcgcgtgctcgccacgccgcgcggcaaggtgatcggcggctcgtcctcgatcaacggcatggtctatgtccgcggccacgcgcgcgacttcgaccattgggccgagagcggggccaccggctggggctttgccgatgtgctgccctatttcaagcggatggagaactggcacgtccccggcgatgtcgagtggcgcggccatgacgggccgctgcatgtgacgcgcggcccgcgctccaatcccctgttcaacgccttcatcgaggcggggcggcaggcgggctatccggtgaccgacgattacaacggcgcggcgcaggagggcttcggcccgatggaggccacgatctggcagggccggcgctggtcggccgccaatgcctatctcaggcccgcgatgaagcggttcggggtccagctcacccgcgccctcgcgctgaaggtggtgatcgaggaaggccgtgccgtcggcgtcgaggtgcagcgccgcggcggccgcgaggtgatccgggccggccgcgaggtgatcctcgccgcctcctcgctcaacacgccgaagcttctgatgctgtcgggcatcgggtccgccgcgcatctggccgagcacgggatcccggtcgtggccgaccggccgggcgtgggccaaaacctccaggatcatctggaggtctacatgcagttcgcgagcctccagccggtcacgctcttcaagcactggaacctgcgcggcaaggtcagcatcggcgcgcagtggctgtttaccgggcgcgggctcggggcctcgaaccagttcgaggcctgcgccttcatccgctcgaagccgggcgtggagtatcccgacatccagtatcacttcctgcccattgccgtgcgctacgacggcaaggccgccgccgagggccacggcttccaggtgcatgtggggccgatgcgctcgccctcgcgcgggtcggtgacgctgcgctcggccgatcccgaggcgccgccggtgatccgcttcaactacatgtcgaccgaagaggattggcaggacttccgccgctgcgtccgcctcacgcgcgaaatcttcgggcaggaggctttcaagcccttcgtccggcacgagatccagccgggggcggcctgcgcttcggacgcggagatcgacgccttcatccgcgagcatgtcgagagcgcctatcacccctgcgggacggcgcggatcgggcgggcggacgatccgatggcggtcgtcgatcccgagtgccgggtgatcggggtcgaggggctgcgcgtggccgacagttcgatcttcccgcgggtgacgaacggcaacctcaacgcgccctcgatcatggtgggcgagaaggcgtccgaccatatcctcggccgg

SEQ ID NO: 31511 - DNA, 1941 bp, Rhodobacter sphaeroides
gcgaatgcggtctataccgcgtcggcagatttcattgcgcaagcccatgtcgacgcggccggctacgagcggatgtatgctgcatccgtggccgacccggaggcgttctggggcgaacagggcaagcggctcgactggatcaagccctacaccaaggtcaagaacacgaacttccggccgggcgaggtctcgatcaagtggttcgaggacggcacgctgaacatcgcctggaactgcatcgaccggcatctggcgacgcgggccaagcagaccgcgatcatctgggagccggacgatccgaacgtgccggcccagcacatcagctatcaggagctgcacgacaacgtctgccgcatggccaacgtgctggtgagccagggcgtgcgcaagggcgaccgggtggtgatgtatctgccgatgatccccgaggccgcctatgcgatgctggcgtgcgcccggatcggcgccatccattccgtcgtcttcgcgggcttctcgcccgacgcgctggcgaaccggatcaacgactgtcaggccaaggtggtcatcaccgccgacacggctccgcgtggcggccggcgcacgcccttgaagtcgaacaccgacgcagcccttctccattgctcggaccgggtgcgctgcctcgtcgtcaagcacacgggcgaccagatccactggatggacggccgcgacgtggacgtgaaggagctgatgcgccacgcctcgcccgactgcccgatcgaggaggtgaatgccgaggatccgctcttcatcctctatacctcgggctcgaccggcaagccgaagggggtcgtgcacacctcgggcggctatctgacctatgccgccatgacccatcagatgaccttcgactaccatgacggcgacgtcttctggtgcaccgcggacgtgggctgggtcacgggccacagctacatcgtctacggcccgctggcgaacggcgcgaccacgctcatgttcgagggcgtgccgacctatcccgatgcgggccgcttctgggccgtctgcgagaagcacaaggtgaaccagttctacaccgcgcccacggcgatccgctcgctgatgggcctcgggccggaatgggtcgacaagtacgacctgtcgtcgctgaagctcttgggctcggtgggcgagccgatcaaccccgaggcctggagctggtacaacacccatgtcggcaagggccgctgcccgatcgtcgacaccttctggcagaccgagaccggcggccacatgatcacgccgctgccgggcgcgatcccggtgaagccgggcgcggcctcgaagcccttcttcggggtgaagccggtgatcctcgacccgaccgacgggcacgagctgcacgaaaccgcgaccgagggggtgctctgcatcgccgacagctggccggggcagatgcgcacgctctggggcgaccacgagcggttcgaagaggcctatttctcgcaatacaagggctattacttcaccggcgacggctgccgccgcgatgcggacggctattactgggtcacgggccgggtcgatgacgtcatcaacgtctcgggccaccggatgggcaccgccgaggtggaatccgcgctcgtcgcccatgcgcaggtcgccgaagccgcggtggtgggctatccgcacgacatcaaggggcagggcatctatgcctatgtcacgctgatgaacggggtccagccgaccgaggagctgcgcaaggatctggtgaaatgggtccgcaccgagatcggccccatcgcctcgccggacgtgatccagtgggcgccgggcctgcccaagacccgctcgggcaagatcatgcgccgcatcctgcgcaagatcgccgagaacgacttcggctcgctcggcgacaccacgacgctggccgatccgtcggtggtcgacgacctgatcgccaaccgcaagaaccgg

SEQ ID NO: 31512 - DNA, 660 bp, Rhodobacter sphaeroides
gccctcgtgacaggcggcgccggcctcatcggcgcagggatctgccggacgctgcgcgcgcacggctggaaggtggcctccttcgatctcgaggaggcgccggaagccacgcgctcggtccgctgcgacgtgacggacgaaggatcggtggcgaccgccatggccacgctcggctagtccgagttggatctcctcgtgaacaatgcgggacgggccgatccggtcacgggccccatcgccgagctcacgctcgccgactggcggcggatgaccgacagtcacctcacagcagccttcctcatggtgcgggcggcggtgccgctcctgcggcccggcggatccatcgtgaacatggcttcgacccgcgccttcatgtccgagcccgacacggaggcctatgcggcctccaagggcggtctcgtcgcactgacccaggcgctcgcggtgagcctcgggccgcgcctgcgggtgaatgccatcgcgcccggctggatctctgacggcgacgggctccgggacatcgaccatgcccagcatccggcgggccgtgtcggccgcccggaggatgtggccgacacggtgctctggctcaccgacgcgggcttcgtgaccggtcaggtcatcgtcgtggatggcggcatgatgcggaagatgatctac

SEQ ID NO: 31513 - DNA, 1212 bp, Rhodobacter sphaeroides
cgcgcgcgcgctgccgcggcggagctcgcctttgccgaaccgtcgcgcaaggaagaggccctgaatgccgcggccgaggcgatgctcgcccgctccgacgagatcctcgaagcgaacggccgcgatctggctttcggcgccgagaagggcctgacccccgccatgatggaccggctgaagctcgacgccgcgcggatcgacggcatcgtcgaggggctgcgggcggtcgcgggtcagcccgatccggtggggcaggtgatcgccgaatgggaccgaccgagcggcctgcacatccgccgggtccgcacccccctgggcgtggtgggcgtgatctacgagagccggcccaacgtcacggcggatgcgggcgcgctctgcctcaagtccggcaatgcggtcatcctgcgcggcggctccgagagcttccattcctcgggcgcgatccacgccgcgctgcaggacgggctgcggcaggcgggcctgccggtggatgcgatccagcgcgtgccgacgcgcgaccgcgccgccgtggccgagatgctgcgcatggtcgagcatatcgacgtgatcgtgccgcgcggcggcaaggggctcgtgggcctcgtgcaggccgaggcgcgggtgccggtcttcgcccatctcgagggcatctgtcacgtctatgccgacggcgaggccgatctcgagaaggcgcgtcgcgtggtgctgaacgccaagacccgccgcaccggcatctgcggctcggcggaatgcctgctgatcgaccgggccttcctcgccaagcacgggccggtgctgatcgaggatctgctgaaggcgggcgtcgaagtccgcgccgagggcgagctggcccaggtgccgggcaccgtgcccgcgcagcccgaggatttcgggcgcgagtttctcgacatgatcatcgcggccaaagtggtggacggggtggacgaagcgatcgcccatatccgccgctacggctcgagccacaccgaatcgatcctgaccgagaacgacgccacggccgagcgattcttccgccggctcgacagcgcgatcctgatgcgcaacgcctcgacgcagttcgccgatggcggcgagttcggcatgggggccgagatcggcatcgccaccggcaagatgcatgcccgcggcccggtgggcgccgagcagctcacgagcttcaaatatctcgtgacgggagacggcacgatccgg

SEQ ID NO: 31514 - DNA, 795 bp, Rhodobacter sphaeroides
cgcaccgtggtctggcccgagggggcggcgggaaccgtcctcatcttctcgggccgcaccgaatatgccgagaaatacggccccgcggccgaggcgctgcgccggcgcggctttgcctcagccaccctcgactggcgcggacaggggctgtcggaccggtcgctccgcgatccgctcgtgggccatgtcgacgatttcgcctcctatcagcaggatgtgacggccttcgtcgcggcgctgcgcgcgcaggggctgcccgagcccttccatcttctggcccattccatgggcggctgcatcgggctccgcgcgctgcacgaggggctgcccgtgcgcgccgcctgcttctcggcgccgatgtggggcatccgcgtccatgccgcgctgcggatcgtagcggcggcactcggggcgctcgcccgcgcgacggggctcgggcaccgctatgtccccggcaccggcacgcgcagctatgtcgccaccgccgccttcgacacgaacgtcctcacccgcgacccggagatgttcgcctggatgcaggagcagctggtgcaggcgccggaactgggtcttgccggcccgagcctcgactggctgcgcgcggccttcgaggagacggcgcggctgaagcggctgcccgcgccggatctgcccgcgctctgcatcgtgggctcggccgagaaggtggtcgatctcgaggagatccagcgccggatggagggctggggccggggcgaactgcagatcgtgcccggggccgagcacgaggtgatgatggaccgccccgaggtgcgc

SEQ ID NO: 31515 - DNA, 1170 bp, Rhodobacter sphaeroides
cgggccgaggcgctcgcggccaatgcgacgaaggaccggttcctcgcgcagatgagccacgagctgcgcacgcccctcaatgcgatcctcggcatcggccatgccgaactgcggggcgcgtccgatccggtcagccgcgaccgtctgggcgtgctgatccgctcggccgaggggctttcgacgatgctcgacgacatcctcgacatgtcggcggtccagcagggccggatgccggtgcggccgcagaccgtctcgccgcgcgaggagatcgtggccagcgtcgagctgttccgccctctggtcgaggagacgggcgtggcgctcgagctcgtgctgggcgatctgccgaagcgcgcgcggctcgatccgcagcgcctgcgccagtgcctgtcgaacctcctgtcgaacgcgctgaagcacacgcaggagggccgcatccgggtcgaggcccggatcgagggcgcggggccgcgcccgcttctccgcatcgaggtgagcgacacgggcgacgggatccttcgggaagaggcggaagccatcttcgatccgttcatgcccacgggcaacgggcgccttgcgggcaacgggctcggcctctcgatcagccgggcgctcgcgcggcagatgggcggcgatctgcggcttctggcgcagccggggccgggcgcgcggttcgcgctgaccatcgcgctccagaccgtcgaggcgcccgcctccgcgcccgccgcaccgcgggccgaacaccggctcggcggacggcgcgtcctcgtggtcgatgacatatccacgaaccggctggtcgcggccgcctatctccagctcttcggcgtccgcacgatcgaggcccagagcgggcccgaggcgctggccctcctcgaacgcgagccggtggatctggtgctgctcgacatgaacatgcccggcatggacgggctcgagaccctgcggcggatccgggcgatgcccggccccgcggcgagcctgccggtcgtggccatgaccgccgatgcgaccgaggaacagcgcgacatgtatctcggcgcgggcctcaccggctatgtggccaagcccgtcacccccgaccggatgtcggccgaactcagccgcgtgctgggactcgcgcatcccgacgagagctgagagccgagagccgagagccgagagccgaga

SEQ ID NO: 31516 - DNA, 996 bp, Rhodobacter sphaeroides
atgggctacagggtcgtcgtcgcgggtgccacgggcaacgtgggccgtgaaatgctgaacatcctcgccgagcgcgagtttccggtggaggagattgccgctctggcgagccgcaaatctctcggcaccgaagtgagcttcggcgacaagaccctgaccaccaaggaccttgacacattcgacttcaccggctgggatatcgcgctgttcgcggtgggctcggacgcgaccaagatctatgcgccgaaggccgcggccgcgggctgcgtcgtgatcgacaactcgtcgctctaccgctacgacccgcaggtgccgctgatcgtgccggaagtgaacgccgatgcgatcgagggctacaaggcgaagaacatcatcgccaacccgaactgctcgaccgcgcagatggtcgtggcgctgaagccgctgcacgaccgggccaggatcaagcgcgtcgtcgtctcgacctaccagtccgtttcgggcgcgggcaaggccggcatcgacgagctctggaaccagaccaagggcatctacgtcccgggtcaggaggtcgagccctcgaagttcaccaagcagatcgccttcaacgtgatcccgcacatcgacagcttcatggaagacggctccaccaaggaagagtggaagatggtggccgagaccaagaagatcctcgatccgaaggtgaaggtcacggcgacctgcgtgcgggtgccggtgttcgtgggccactccgaggcgatcaacatcgagttcgaggatttcctcgacgaagaggaagcgcgcgacatcctgcgcgaggctccgggcgtgctcgtcgtcgacaagcgcgaggccggcggctacatcaccccggtcgaatgcgtgggcgattatgccacctacatcagccgcatccggcaggattcgaccctcgacaacgggctgaacctctggtgcgtgtccgacaacctgcgcaagggcgccgcgctgaacgcggtgcagatcgccgaggttctg

SEQ ID NO: 31517 - DNA, 1074 bp, Rhodobacter sphaeroides
gtcatgagctacaacactttcggccacatcttccgcgtcaccacctggggcgagagccatgggcccgcgctcggcgcgacggtggatggctgcccgcccggcgtcgcgatcgaggccgaggcgatccagcactggctcgaccgccggaagcccggccagaaccgcttcaccacccagcggcaggagccggatgcggtcaggatactgtcgggcaccttcgagggccgctcgaccggcacgccgatccagctcatgatcgagaacaccgaccagcggtcgaaggactatggcgagatcgcccggagcttccggccgggtcatgccgacatcgcctatcactggaaatacgggctgcgcgactatcgcgggggcgggcgctcctcggcgcgcgagacggcggcgcgggtcgcggcgggcggtgtcgcccgggcggcgctggcggccttggttcccggcctgcggatcgagggctacatggtccagatcgggccgcatgctatcgaccgcgcccggttcgacgcggacgagatcgagcgcaaccccttctggtgccccgatcccgatacggccgcgctctgggccgactatctcgacggactgcgcaaggcgcacgattcggtgggcgccatcgtcgaggtgcgggcctcgggcgtgccggcagggctcggcgcgccgatctacggcaagctcgacagcgacctcgccgcggccatgatgacgatcaacgcggtgaagggtgtcgagatcggcgaggggatggccgcggcctgcctcaccggcagcgccaatgccgacgaaatccgcatgggccccgagggccccgagttcctgaccaaccatgcgggcggcatcctcggcggcatctcgaccgggcaggatgtggtggtgcgctttgcggtgaagcccacctcctcgatcctgaccccgcgccgctcggtcacgaccgacgggcgcgaggtggaggtggtgacgaagggccgccacgatccctgcgtgggcatccgcgcggtgccggtgggcgaggcgatgatggcctgcgtgctgctcgaccatctgctgctcgaccgcggccag

SEQ ID NO: 31518 - DNA, 2529 bp, Rhodobacter sphaeroides
atgaacctcgagaagttcacggagcggtcgcgcgggttccttcaggccgcgcagacgatcgcgatgcgggaaagccaccagcggctggcgtccgaacatctgctgaaggccctgatggacgacgatcaggggctggcctcgaacctgatccgccgatcgggcggcgagcctgcgcgcgtggccgagacggtcgagctgaccatcgccaagctgcccaaggtgtcgggcgatgcgcagcccttcatggacccgggcctcgtccgcgtgctggacgaggcggagaagctcgcgaagaaggcgggcgacagtttcgtgccggtggagcgcatcctgatggcgctggccatggtcgcgtcgaaggccaaggacgcgctggatgcgggtgcggtgacggcgcagaagctgaatgccgcgatcaacgacatccgcaaggggcgcaccgccgacacggcctcggccgaggaaggctatgacgccctgaagaaatatgcccgcgacctgacgcaggccgcgcgggacggcaagatcgacccgatcatcggccgcgacgacgagatccggcgcgccatgcaggtgctgagccggcgcaccaagaacaacccggtgttgatcggcgagcccggcgtcggcaagaccgccatcgccgagggcctcgccctgcgcatcgtgaatggcgacgtgcccgagagcctgaagaacaagcgcctgctgtcgctcgacatgggggcgctgatcgcgggcgcgaaataccgcggcgagttcgaggagcggctgaaggccgtgctgaacgaggtgacctcggctgcgggcgagatcatcctctttatcgacgagatgcacacgctggtaggcgcgggcaaatccgaaggcgcgatggatgcggccaacctcatcaagccggcgctggcgcggggcgagctgcactgcatcggcgctacgacgctggatgagtatcgcaagcatgtggagaaggacgcggcgctggcgcggcgcttccagcccttgatggtcgaggagccgacggtcgaggatacgatctcgatcctgcgcggcatcaaggagaagtacgagctgcaccacggggtgaagatcgcagacgccgctctcgtggccgcggcgacgctctcgcaccgctacatcaccgaccgcttcctgcccgacaaggccatcgacctcgtggacgaggcggcgagccgcctgcggatggaggtcgattcgaagcccgaggaactcgacgcgctggatcggcagatcctgcaagcgcagatcgaggcggaggcgctgaagaaggaggacgacgcggcgtcgaaggaccggctggcgaagctcgagaaggaactctcgggcatgaccgaacgcgccgccgagatgacggcgcagtggcaggccgagcgcgacaagctcgaggccgcacgcgatctgaaggagcagctggaccgggcccgggccgagctcgagcaggtcaagcgcgagggcaacctcgcccgcgcaggcgagctgtcctacggggtcattcctcagatcgagaagaagctcgaggaagccgaagcgcgcgagggcgatctcctcgtctcggaagccgtgcggccggagcagatcgccgaggtcgtggagcgctggaccggcatcccgacctcgaagatgctcgagggcgagcgcgagaaacttctcaagatggaggaggagctcggccgccgggtgatcgggcagcgcgccgcgctgcgggcggtggccaatgccgtgcggcgggcgcgcgcggggctgaacgacgagcggcggcctctgggcagcttcctcttccttggcccgacgggcgtcggcaagaccgagctgacgaaggcggtggccgaatatctcttcgacgacgaccaggcgatggtccgcatcgacatgtcggagttcatggagaagcactcggtcgcccggctgatcggcgcgcctccgggctatgtgggctacgatgagggcggggtgctgaccgaggccgtgcggcgccgtccctatcaggtcgtgctgttcgacgaggtcgagaaggctcacccggaggtgttcaacgtgctcctgcaggtgctcgacgacggggtcctgaccgacgggcagggccggacggtggacttcaagcagacgctcatcatcctgacctcgaacctcggggcctacgccttgagccagctgccggaaggggccgatcccgcgcctgcccgcgcggcggtgatggaggcggtgcgcggacatttccggcccgagttcctgaaccggctcgacgagatggtgatcttcgaccgcctgtcgcgagacgacatgggccagatcgtcgagatccagctcgggctcctcggcaagcggctggccacccgcaagatcgggctcgagctcgatgcggcggcgaaacagtggctcgccgacgagggctacgatccggtctatggcgcgcgtccgctgaagcgcgtgatccagcgccatctgcaggatccgctggccgagatgatcctcgcgggcgacgtgctcgacgggtcggtcgtgcaggtc

SEQ ID NO: 31519 - DNA, 1158 bp, Rhodobacter sphaeroides
ggcctcgacgaggagctcgagatgatccgcgaccagttccgccgtttcgcggacgagcgggtggccccgcacgcccatggctggcacatgcgcgacgagctgatcccgatggagatcgtggaggctctggccgagatgggcgtcttcggcctgacgatcccggaggagttcggcggcttcggcctgtcgaaggcctcgatggtcgtggtctcggaggagctgtcgcgcggctatatcggcgtgggctcgctcgggacccggtccgagatcgcggcggagctgatcctctgcggcggcaccgatgcgcagaaggcggcctggctgccgaagcttgcgagcggggagatcctgccgaccgccgtcttcaccgagccgaacaccggatcggatctgggcagcctgcggacgcgcgcggtgaaggacggcgacgaatgggtggtccatggcaacaagacctggatcacccatgccgcgcgcacccatgtgatgacgctccttgcccgcaccgacctcgagacgaccgattaccggggcctgtcgatgttcctcgccgagaaggtgccggggaccgacgcggatccgttcccgacgcccggcatgaccggcggcgagatcgaggtgctgggctaccgcggcatgaaggaatatgagatcggcttcgacggcttccgcgtgaaggccgagaaccttctgggcggcgtcgaggggcagggcttcaagcagctcatgcagaccttcgagagcgcgcggatccagaccgccgcccgcgccatcggcgtggcgcagaatgcgctcgaggtggggatgcaatatgccgaggagcgcaagcagttcggcaaggcgctgatcgaatttccgcgcgtggcgggcaagcttgccatgatggcggtcgagatcatggtggcgcggcagctgacctaccattccgcctgggagaaggatcacggccagcgctgcgacctcgaggccgggatggcgaagctcctgggtgcccgggtggcctgggccgcggccgacaatgcgctgcagatccatggcggaaacggcttcgcgctggaatatcagatcagccggatcctctgcgatgcgcgcatcctcaacatcttcgagggggcggccgagatccaggcgcaggtgatcgcgcggcggctgctggac

SEQ ID NO: 31520 - DNA, 1581 bp, Rhodobacter sphaeroides
ggacgcgtgaacccagcgcagacgctggacgcacaaggcatcactggacttggcgaggtgcattacaacctcatcgagcccgcgctggtcgaagcggccgtgacgcgcggcgaaggccggctgggccgcggaggcgcgttcctctgctcgaccggtgccttcacgggccgctcgcccaaggacaagttcgtcgtgcgcacgccgtcggtggaagacacgatctggtgggaaaacaacgctcccatggatccggccgccttcgaccggctccatgccgacatgctcgagcacatgaagggccgcacctacttcgtgcaggacctgttcgccggcgccgaccccgagctgcgcctcgacgtgcggatggtgaccgagctcgcctggcacggcctcttcatccgccacatgctgcgccgccccgagcgcgccgagctcgacagcttcgtgcccgactggacggtcatcaactgcccgtccttcaaggccgaccccgagcgccacggctgccgcaccgacacggtgatcgtgctcaacttcgagcgcaagctgatcctgatcgccaacaccgaatatgccggcgagaacaagaagtcggtcttcacgctgctgaactacatcctgcccggcaagggcgtcatggcgatgcactgctcggccaaccacgcgctcggcgacacggacgatgcggcagtgttcttcgggctctccggcaccggcaagaccacgctctcggccgatccctcccgcacgctgatcggcgacgacgagcacggctggtcggaccgggggacgttcaacttcgagggcggctgctacgccaagacgatcaatctctcggccgaagccgaacccgagatctatgccacgacctcgaaattcgcgaccgtggtcgagaacatggtctatgacgaagagacgctcgagctcgacttcaacgacgacagcctgacggcgaacacgcgctgcgcctatccgctcgactatatctcgaacgcgtccgagagcgggctcggcgggcatccgaagaacgtcatcatgctgacctgcgacgccttcggcgtgctgccgcccatcgcgcggctgacgcccgcgcaggccatgtatcacttcctgtcgggcttcacctcgaaggtggccggcaccgaacgcggcgtgaccgagccgcagccgaccttctcgacctgcttcggcgcgcccttcatgccccgtcgtcccgaggtctacggcaagctcctgcaggagaagatcgccaagcacggcgcgacctgctggctcgtgaacaccggctggaccggcggcgcctacggcaccggcaagcggatgccgatcaaggccacccgcgcgctgctgaccgcggcgctcgacggctcgctctcgggcgttcagttccgccgcgatccgaacttcggcttcgaggtgccggtggacctgcatggggtagatgcgaagctgctcgatccgcgctcgacctgggccgatccggcggcctacgatcagcaggcgaagaagctggtggagatgttcgccaacaacttcgcgcaatatgtccccttcatcgatgcggatgtgaaggcggccgcg

SEQ ID NO: 31521 - DNA, 867 bp, Rhodobacter sphaeroides
atccgcaaggtcggcgtcgtgggcgcgggacagatgggcagcggtatcgcgcatgtcttctcgctcgcgggctacgaggtgctgctgaacgacatcagcgccgaagggctgaacaaggcgctctcgaccatcgagcgcaacatggagcggcaggtctcgcgcgggaaggtctcggccgaggacaaggccgcggcgctcgggcggatccgcaccacccagaccctcaccgacatcgccaggagcgacctcgtgatcgaggccgccaccgagcgcgagacggtgaaacaggcgatcttcgaggatctggtgccgcatcttctgccgcacacgatcctgacctcgaacacctcctcgatctcgatcacacggcttgcctcgcgcacggaccggcccgagaaattcatgggctttcacttcatgaacccggtgccggtgatgcagctcgtcgagctgatccgcggcatcgcgaccgacgacccgacctatcaggcgctgctcaaggtggtgcagagcctcggcaagaccgcggccagcgccgaggatttcccggccttcatcgtcaaccgcatcctcgtgccgatgatcaacgaagcggtctacacgctctatgaaggcgtgggctcggtgcgctcgatcgacgagtcgatgaagctcggggcgaatcatccgatggggccgctggagctcgcggatttcatcgggctcgacacctgccttgcgatcatgaacgtgctgcacgacgggctggccgatacgaaataccggccctgcccgcttctggtgaaatatgtcgaggcaggatggctcggccggaagaccgcccgcggcttctacgattatcgcggcgagacgccggtgccgacacgg

SEQ ID NO: 31522 - DNA, 804 bp, Rhodobacter sphaeroides
aaaagcgttctgatcacgggctgctcgtcgggcatcgggctcgacgcggcacggggacttgcggcccgcggctggcgggtcttcgccacctgccggcaggaagccgactgcgaccgcctccgcagcgaggggctcgagagcttccggctcgattacgacgatcccgaaagcctcgccgccgccgtcgaggaggccacgcgccgcaccggcggcacgctcgacgcgctctacaacaacggcgccttcgcttgcccgggcgcggtggaggatctgccgcgcgaggcgctgcgggccgtgctcgagaccaatatcgtgggcgtccacgacctgacgcggcgggtcatcccgatcatgcgccgtcaggggcacgggcggatcgtcaattgctcctcggtgttgggcttcgtggcctatccctggcgcggcgcctatgtcgcctcgaaattcgcgatggaggggctgaccgatgtgctgcggatcgagatggcagacacgccgatccgggtgatcctgctggaaccgggccccatcgcctcgcggatccgcgagaattccatcccgcatttcgagcgctggatcgactggagagcctcggcccgcgccgaccagtatcgcacgcttctgggccggctctacgagggcggcgaggatcgctggcagctgcccccatccgccgtcacggaaaagctggtgcaggcgctggaaagcccccgcccccgcgcgcgctaccggatcaccgtgccgagccgcaccgcctgggtgctgcggcggctcctgccgaccgcggcgctcgaccgggtgctc

SEQ ID NO: 31523 - DNA, 1182 bp, Rhodobacter sphaeroides
gtcctgatctcgggctgcatcgtcctgatgctgggctttgcgatccgcgccagcttcggcgtgttccagatccccatcgccgaggagttcgactggccgcggtccgacttctcgatggccatcgccatccagaacctcgcctggggcatcggccagccgatcttcgggatgctggccgagaagttcggcgaccgccgggccatcgtcgcgggcgcgctgacctatgcggcgggtctcgtgctctcgagcttcgccgtgacgccgctccagcatcagttcctcgaggtgctggtggggttcgggatcgcgggcacgggcttcggcgtgatccttgcggtggtgggacgggccacggcgccggagcatcgctcgctggcgctcggcatcgccacggctgcggggtcggcggggcaggtcttcggggcgcccgcggccgagatcctgctgggcttctacagctggcagacagtgttcgtgatcttcgcgggcgtcatccttgccgcgctctttgcgctgcccttcatgcgtgcgccggtcaccgcgacgaaggccgagctcgaggagtcgctcggcacggtgctcagacgggccttccgcgatccgtcctatacgctgatcttcgtgggcttcttctcctgcggctatcagctggccttcatcaccgcgcacttccccgccttcgtgacggagatgtgcggggcgatcgatccgcgcggcccgctggcggcgctggggatcaccaccacctcggcgctgggcgcactggcgatctcgctgatcgggctggccaacatcgtgggcacgatcaccgcaggctggctcggcaagcgctactcgaagaaatatctgctggccgcgatctacaccgggcgcacgctggcggccgcgctcttcatcctcgtgccgatgacgcccaccacggtccttctcttctccctcagcatgggcgcgctctggctcgcgaccgtgccgctcacgagcgggctcgtggcccatctctacggtctgcgctacatgggcacgctctacgggttcgtcttcctcagccaccagctcggcagcttcatgggtgtctggctgggcgggcggatgtatgacatgaccggcgactatacgatggtctggtggatcggcgtgggtgtcggcgccttctcagccatcgttcacctgcccatccgcgag

SEQ ID NO: 31524 - DNA, 1497 bp, Rhodobacter sphaeroides
gactggtggcgcgggtcggtgacctatcagatctatccccgctcgtttcaggattccgacggcgacggcgtgggcgacctgcgcggcatcatcgagcggctcgaccatgtggcctggctcggggccgatgcgatctggctctcgccgatctttccctcgcccatggaggacatgggctacgacgtgtcggactacaccgccatccacccgctcttcggctcgatggaggatttcgacgcgctcctcgctcgcgcgcacgagcttgggctgaaggtcatcatcgaccaggtgctcagccattcctcctcggcccatccgttcttccgcgagagccggcggagccgcgacaatcccaaggccgactggtatgtctgggccgacgcgcagcccgacggcagcccgccgaacaactggctgtcggtcttcggcggctcggcctgggaatgggatgcgcagcggcggcagtattacctgcacaacttcctgatctcgcagcccgacttcaacttccacaatcccgaggtgcaggactggctgctcgaccagatgcgcttctggcttgatcggggcgtggacggcttccgtctcgacacggtgaacttctacttccatgacgccgagctcaggtcgaaccggccgaacccgcagaacgggccgatcccgccggtcaatgcctacgacatgcaggaccatgccttctcgaagtcgcggatcgagaatatcgccttcctcctcaggatgcggaagctgctcgacgactacccggacagggcgatggtcggcgaggtggccgacgggctgcgcggccttgcgatcatggccgaatataccagcgggaccgaccggctgcacatggcctacacgttcgagatgctctcgcgcaccttcaccgccgggcatttccgcagccggatcgaggagttcttcgccaccgcaccgcagggctggccctgctgggccttttccaaccacgatgtggtgcgccatgcgacgcgctgggccggccacggggccgaggacgatgtggcgcggctcgcggcggccatgctcctgtccttcgagggctcggtcagtctctatcagggcgaggagctgggccagacagagaccgagctgctctatgaggagctgaccgatccgccgggcctccggttctggcccgaggagaaagggcgcgacggctgccgcacgccgatggtctgggacgacgggcccgcgggcggcttcaccaccggcacgccgtggcttccggtgaagccgccgcagctggcgcgcaacgtggcgtcgcagaagggcatccccggctcgctgctggagacctaccgggcgctcctgcagttccgccggagccagcccgcgctgatccgcggccgcagccggttcttcgacctgccggagccgatgctgggcttcacccggacgctcgacggccagtcgctcgcctgcttcttcaacctcggcatcgagccggtctcggcgaccctgccgggccatggc

SEQ ID NO: 31525 - DNA, 729 bp, Rhodobacter sphaeroides
gacctgaagggggcgtcggtcttcctcagcggcggcggttcgggcatcggggctgcgctgaccgagggcttcctgcggcagggcgcgcaggtggccttcgtccagcgctccgacgccaccgccttctgcgaccggatggaggccgagaccggcgcgcgaccgctgttcctgccctgcgacgtgaccgacattccggcgctgcggcaggcgctcgccgaggtggccgagcggcaggggccgatccaggttctcgtgaatgctgccgcccacgacgaccgtcacaccacggccgaggtgacggaggactactgggaccgcgcacaggcggtgaacctcaagcattacttcttcgccgcgcaggccgtcattcccgggatgaaggctgcgggcggcggctcgatcatcaacttctcctcgatctcctacatgatgggcaatgcgggctatccggcctacacgaccgccaattcgggcatcaacggcctgacccgcagcctcgcgcgcgagttcgggcccgaccggatccgggtcaatgcgctggcgccgggctgggtgctgaccgagcggcagaaggatctctgggtgaccgaggacgggctgcaggcccatctcgaccgccagtgcctgaaggaggcgctggtgcccgccgatatcgtggggggcgtgctgttcctcgcgtcggaggcctcgcggatgatgacggggcaggcgctggtgatcgacggcggc

SEQ ID NO: 31526 - DNA, 1161 bp, Rhodobacter sphaeroides
gacatcctcgtcctctccgccgtccgcaccgccatcggcggcttcggcggcgcgctcgccgcggtcccgccgggcgatctcgccaccaccgtcacccgtgccgcgctggagcgcgcaggcgtggagcccggccgcgtggggcatgtggtcttcggccatgtcatcaacaccgaaccgcgcgacatgtatctctcgcgcgtggcggcgatgcaggcgggtatcccgtcggaggtgccggcgatgaacgtgaaccggctctgcggctcgggcgtgcaggccgtcgtctcggccatgcaggcgctgatgctgggcgatgccgaggtggcgctggcgggcggcgcggaatcgatgagccgcgcgccctatgcgctgacgacggcgcggtggggccagaagatgggcgacacgcgcgcgctcgacatgatgacgggggcgctcaactgccccttcggcaccggccacatgggcatcaccgccgagatcgtggccgagcgccacggcatcagccgcgaggatcaggacgcgttcgcgctggaaagccagacccgcaccgcccgcgcgcaggaggagggccgcttcgacggccagatcgttccggtcgagatcgcctcgcggaaggggccggtctccttctcccgcgacgaacatcccaaggccaccaccctcgaggcgctcgcggggctgcgtcccgccttccagaaaggcggcacggtgaccgcaggcaatgcgagcgggatcaacgacggggccggggcgctgatcctcgcgcgcgagggggccgtgcccgacgcgcgtccgctcggccggctgatcggctatgcccatgcgggcgtcgatcccgaggtgatggggctggggccgatcccggcggtaaaggcgctctgcgcgcgcaccggcctctcggtcgcggatttcgacgtgatcgagtcgaacgaggccttcgcggcacaggcgctggccgtggcgcgcgcgctcgatttcgatccggccagggtgaacccgaacggcggcgccatcgcgctcggccatccggtcggcgccaccggggcgatcatcacggtgaaggcgctccacgagctgcaccggacgggcgggcgccgggccctcgtcaccatgtgcatcggcggcgggcaggggatcgcgctggcgctcgagcgggtc

SEQ ID NO: 31527 - DNA, 1104 bp, Rhodobacter sphaeroides
ccggccgcgcggccggccaatccgcgcttctcttccggcccctgtgccaagattcccgcctattcgctggaccttctgtcggacgcgccgctgggccgctcgcaccgtgccgccgtcggcaaggccaagctgaaagaggcgatcgacctcacccgcgagatcctcggcgtgccggaaggctaccgcatcggcatcgtccccggttcggataccggcgcggtcgagatggcgatgtggtcgctgctgggcgcgcgccccgtcgagatgctggcctgggaaagcttcggcgaaggctgggtcaccgacgcggtgaagcagctgaagctggatgcgaccgtgcgcaaggcggcctatggcgagatcgtcgatctggcgcaggtcgatttcacccgcgacgtggtcttcacctggaacggcaccaccagcggagtgcgcctgcccaacggcgatgcgatcccggccgaccgcgaaggtctcaccatctgcgacgcgacctcggcggccttcgccatggacctgccctgggacaagctcgatgtcgtgaccttctcctggcagaaggtgctgggcggcgagggcggccacgggatgctgatcctcagcccccgcgcggtcgagcggctggaaagctatacgcccgcctggccgatgccgaagatcttccgcatgaccaagggcggcaagctgatcgagggcatcttccagggcgagacgatcaacacgccctcgatgctcgcggtcgaggattacctcgtctcgcttaagtgggcgcaacggatcggcgggctcaaggcgctggtcgcccgcgcggaagcgaactcgaaggtcgtggccgatttcgtcgcggcgcatgactggatcgcgaacctcgccgtcgatcccgcgaccgcctcgaccacctcggtctgcctgaagttcaccgatccgcgcatcgcggacggtgcggccttcgccaaggcggtggccaagcggctcgagaaggagggcgtggccctcgacgtcggcgcctatcgcgatgcgcccgcgggcctcaggatctggtgcggctcgaccgtcgagacggccgatgttgcggcgctgatgccctggatcgaatgggccttc

SEQ ID NO: 31528 - DNA, 795 bp, Rhodobacter sphaeroides
ccgccgcggggcgatgcgcccgacgccacccccgccatcgaggcgcgccacctcaccaagcggttcgacgacttcaccgcggtggacgatgtgagcttcaccattcccgagggcgagatcttcggcttcctcggctcgaacggctgcggcaatccaccacgatgaagatgctgaccggccttcaggacgcgaccgaaggcgagacgcggctcttcggcgagcggctgggcgccgccgacatgcagagccggatgcgcatcggctacatgtcgcagggcttctcgctctatggcgagctcaccgtgcggcagaacctgacgctccatgcccagctctatgccctgcccgccgcgcggcgcgcgccccgggtggccgaggtcatggccgagttcgatctggccgaggtcgccgatcagaaacccgagagcctgccgctcggcatccgccagcgcctccagctcgcggtggccaccatccacgagccgcggatcctgatcctcgacgagcccacctcgggcgtggatccgctcgcgcgcgacgacttctggcgcaagctcatcgtgctctcgcgcgagcgcggcgtgaccatcttcatcaccacccatttcatgaacgaagccgagcgctgcgaccgcatctcgctcatgcatgcgggccgcgtgctcgagatggggacgccggccgagatcgtgtcccgccgcggggcagccacgctcgaggaggccttcatcgcctgcctcgaggagcagaccggctcggccggcggcgaggcggcggccatggtgccgcccgatc

SEQ ID NO: 31529 - DNA, 813 bp, Rhodobacter sphaeroides
gcaccgagcccggccgcgactggcccgccgatctggccgtgaagctgccggactgagggcatggagagcgtagccgagatcgcgggcgtctcgcaccgctacggcaccgtgaccgccctcgatgcggtcagcctcgccattcccgcgggccggatggcggggctgatcgggccggacggggtgggcaagtccacccttctcgcgctggtcgcgggcgtgcggcggctgcagggcggcgggctcaccgtgctcggccacgacatgacccgccgcgccgagcggcaggcggtggcgccgcgggtggcctacatgccgcaggggctcgggcggaacctctatcccaccctcacggtgcgcgagaacctcgagttcttcggccggctcttcggccagaaggcgccggagcgcgcgcagcggatcgagatgctgctccgcgccacgggcctcgaccccttccccgaccgccccgccggcaagctctcgggcggcatgaagcagaaactttcgctctgctcggcgctgatccacgacccggacctgctgatcctcgacgagcccacgaccggggtcgatccgctctcgcgccgtcagttctgggagctgatcgcggccatccgcacccacctgccggggatgagcgtcctcgtcgccaccgcctacatggaggaggccgaccggttcgactggctggccgcgatggacgggggccgcgtgatcgccaccggcagcccggccgagctgcgcgcccgcaccggggccgccacgctcgaggcggccttcatccgtctcctgcccggcggggccgatgccgcc

SEQ ID NO: 31530 - DNA, 756 bp, Rhodobacter sphaeroides
ctgatgaagggtaaacgcggtctggtgatgggggtcgcgaacgaccgctcgatcgcctggggcattgcacgcgccctggccgccgaaggggccgaactcgccttctcctatcagggcgaggcgttcggcaagcgggtcgagccgctggcggcctcggtcggctcggacttcctcgtcgatgtcgatgtgatggacgatgcctcgctcgacgcctgcttcggcgcgctgaaggatcgctggggcacgctcgacttcgtggtccatgcaatcgcctattcggacaagaccgaactcgccggacgcttcatcaacacctcgcgcgagaacttccgcaattcgctgacgatctcgtgctattccttcatcgacatcgcgcggcgcgcctcggagctcatgcccgacggcggcgcgctgctgacgctgacctatcaggggtcgaaccgggtgacgccctattacaacgtgatgggcgtggcgaaatcggcgctggaatcggcggtgcggtatctcgccaatgacctcgggccgcagaagatccgggtgaatgcgatttcgcccggcccgatgaagacgctcgcgggcgcggccatcgcgggcgcgcgcgccaccttccgccacaccgaggccaacgcgcccctgcgggcgaacgcgacgctcgaagcggtgggcggcacggcggcatggctcgcctcggactatggcgcctgcaccacgggcgagatcgtccgggtggacggcggctatcatgtgctgggg

SEQ ID NO: 31531 - DNA, 1224 bp, Rhodobacter sphaeroides
atgcgccgcgtcgtcatcaccgggatcggcatcgtctcgccgatcgggaacaatgccgccgaagtggaagcgagcctgcgcgccggccgctcgggcatctccttctcggaggactatgcccaccacggcttccgcagccagatccacgggatgcccgatctcgtgctcgaggaccatgtcgacaagcgcgacctgcgcttcatgggcgccggagccgcctacaacttcatcgcgatggagcaggcgatcaaggattcgggcctcgaggccaccgaggtctcgaacccgcgcaccggtctcgtgatgggctcgggcgggccgtcgacctcgaacttcttccaggcccacaagatcgtcatcgagaagggctcgcccaagcggatgggtcccttcatggtgacgcgctgcatgagctcgaccaactcggcctgccttgccacgcccttcaagatcaagggcgtgaactattcgatcacctcggcctgctccacctcggcccattgcatcggcaacggcaccgagctgatccagatgggcaagcaggacatcgtcttcgccggcggcggggaagagctcgactggacgctctcctgcctcttcgacgcgatgggggccatgtcgtcgaaatacaacgatgcgcccgagaccgcctcgcggccgttcgacgccacgcgcgacgggttcgtgatcgcgggcggcggcggcgtggtcgtgctggaagagctcgagcatgcgctggcgcgcggcgcgaagatctatgccgaagtgaccggctacggggccacctcggacggggccgacatggtggcgccgtcgggcgaaggcggcgagcggtcgatgcggctggcgctcggcacgctgcccgaggggcgccgggtcgattacatcaacgcacacggcacctcgacgcccgcgggcgacgtgaccgaggtgcgcgcgatccggcggatcttcggcgagggcaaggttccgccgatctcctccaccaagtcgctcaccggccattcgctgggggccaccggcgtgcacgaggcgatctattcgatcctgatgatgcagggcgacttcatcgcggcctcggccaacgtgacccagctcgaccccgagatccagccggacgagatcgccaccaccctgcgcgagggggtcgagatcgactcggtcctgtccaacagcttcggcttcggcggcaccaacgccagtctgctcctgagcaagttcaac

SEQ ID NO: 31532 - DNA, 1107 bp, Rhodobacter sphaeroides
ctgaccgacgagcagcgcctcgtgcaggagatggcgcgcaccttcgcccgcgaggtgctggcacccggcgccgcggcccgcgcgaaggccaaggcgatcgagccggccgtgctcgcgcagatgggcgagctcgggttcttcggcatgacggtgcccgaggagatgggcggcgtcggcgccgactatatgagctatgcgctggcgctgatcgagatcgcggcgggcgacggcgcggtctcgacggtgatgagcgtgcataacgcccccttcaacgcgatcctccagcggttcgcgagccccgcgcagcgcgagagggtgctgcggccggcggcacagggcgccttcatcggcgccttcgccctgaccgaggcccatgcgggttcggacgcctcggcgctgcgcagccgggcgcggcgcgcgggcggagactatgtgatcgacggcgagaaggtcttcatcacctcggggcggctcgcgggctgggcaatcctgttcgcgcggatggagggaagcacgggcaaggagggcatcacctgcttcctcacccccaccgacacgccgggctacgaggtggtcaaggtcgaggacaagctcgggcaggaggcgtccgacacctgcgcgctgcgcttcgacagcctgcgggtgcccgaggcgctgcggatcggggccgagggcgagggctaccggatcgcgctctccagcctcgagaccgggcgcatcggcatcgcggcccagtcggtcggcatggcgcaggcggcgctcgaggcggcggtggcctatgcgcgcgagcggacctcgttcgggcggccgctgatcgagcatcaggcggtgggcttccggcttgccgaggcgaagacgcggctcgaggcggcgcggcagatggtgcttcatgcggcgcggatgaaggatgcgggccagccctgcctgaccgaggccgcgatggccaagctcttcgcctcggaggcggccgagcggatcgtgtcggacgcgatccagaccttcggcggctacggctacagccgcgactttcccgtggagcggatctaccgcgatgtccgggtgtgccagatctacgagggcacctcggacatccagaagatgctgatc

SEQ ID NO: 31533 - DNA, 1143 bp, Rhodobacter sphaeroides
atcgtgatcgcgggggcggcgcggacgccgatgggcgcctttcagggtgcgctcaagggccggacgggggtcgagctcggcgcggcggcgatctcggccgcgctcgcgcgggcgggcctcgcccccgaggcggtcgaggaggtcgtgatgggctgcgtgctgcccgcgggcctcgggcaggcgccggcgcggcaggcggctctgggcgcggggctgccgctctcggtgccctgcgctacgctgaacaaggtctgcggctcggggatgaaggccgccatggccgcgcatgacatgatccgggcgggcagcgcgggcatcgtcgtcgcgggcggtatggagagcatgtcgaacgcgccctatctgctcgacaaggcgcgcggcggctaccggatcgggcatgggcgcgtgctggaccacatgttcctcgacgggctcgaggatgcctacgaccgcggccgcgccatgggcaccttcgccgaggattgcgccgaggcctaccagttcacccgcgacgcgcaggatgcctatgcgctggcctcgctggcccgggcgcaggcggccattgccgaggggcgcttcgcggccgaggtggtggcagtggacggggtggcggttgacgaggccccgggccgcgcccgccccgagaagatcccccagctcaggcccgccttccgcgagggcggcacggtgacggcggccaacagctcctcgatctcggacggggcggcggcgctcgtgatcgcctcggccggcgcggccgaggcgcaggggctgaccccgctcgccacgatccgcggccatgcaagccatgcgcaggcgccgaacctttttaccacggcgccgatcttcgccatcgggaagcttctcgagcggttgggctggagcgcggccgaggtcgatctcttcgagatcaacgaggctttcgcagtggtggccatggccgcgatgcgcgacctagacctgccccacgacaaggtcaatgtgaacggcggcgcctgcgcgctcggccatccgatcggctgctcgggggcgcggatcgtggtgactttgatcgaggcgctgcgggcgcggggattgagacgcggcgtggcctcgctctgcatcggcggcggcgaggcgacggcgctggcggtggaggtgatc

SEQ ID NO: 31534 - DNA, 837 bp, Rhodobacter sphaeroides
gccctcgtgacctgctttcacgaggacgagaccgtcaactatgcagccacccgcgcccaggtgcgccgccagctggccgccggcaacgatctcatggtctgcggcacgaacggcgatttctcggctctgacccatgacgagaagatccgtctggtgggagaggtgatggaggaagtggcgggccgcgcgaaggtcatcgccaacgtcggctgccccgccaccttcgagacgctccagctcgcccgcgcggtggatgggatgggcctgcacggcatcgcggtcattgcgccctacttcatctcctgcacgcaggacgggctgatccggcacttctcgaccgtcgccgatgccgtgacgacgccggtctatctctacgacatcccggcccgcacccagaaccatatcgagcctgccacggtgggcacgctcgcccgtcatggcaacatcgcggggatcaaggattccggcggctcgaccgacacggtgcgcgcctatctcgacgtggcgcgcgatgtggaggggttcgaagtctactgcgcgcccgaccatctggtgctctggggcctcgaggaaggctgcgcgggcgtcgtctcggggctcggcaacgtggctccgggcctgctggcgcagatcatcgcgggcttcaacgcgggcgacatggaggccgcgcgcgcggcgcaggaaaactttgcgggcctgcggaaggacctctatgccctgggcttcccgccggcgctcgtcaagcgcgcgctctatctgaacgatccttcggtcggcctctcccggcagcccgcgctgctgccagacgccgcgcaggacgcgcagatcctcgccatc

SEQ ID NO: 31535 - DNA, 1077 bp, Rhodobacter sphaeroides
cctgccgccgtgcatttcggcgaaggcagccttgcccgcctgccagagtgggtggccgcgcgcggcttccgcgcgcccttcgtcatcgccgatgcggtgaatgcgcagcggctggaccggctggggctcggatcggtcggctgcttcgggaccgtcgtgcccgagcccgacaccgccaatctgcaggccgccgtcgccgcggccgaaggggccgacctgatcgtgggattcggcggcggctcggccatggacctggccaagctcgtggcggtgctcgtgggaaccggcctcgcgctttcggacatctccggtcccggccgggcgccggcccggcgcgtgggcctcgtgcaggtgccgaccaccgccgggaccggctcggaagtgggcacgcgcgccctcgtgacggatcccgcgagccttgccaagatcgcgaccgaaagcgccgagatgcttgccgacatggcgatcgtggaccctgcgctcacgctcagcgtgccgcccgcggtcacggccgcaaccggggtcgacgccatggcccattgcgccgaggccctgacctcgaaacgggcgcatccgctggtcgatgcctatgcgctggaggggatcgcgctcgtcggccgcttcctgcgtcgcgcggtcgaggacgggcaggatgtcgaagcccgggcaggcctgtcgctcgcggccttctacggcggcatctgcctcggccccgtgaacacgacggcgggccatgcgctctcctatccgctcggcacgcgccacaagctgccgcacgggatcgcgaatgcgctgatcttcccgcatgtgctggcggccaacgcctcggccgcgccggagaagacggcccggatctgcgaggctctgggctttgccgcgggcgccgaggagacggtgcgggccggtgcgctcgccttctgcgccgggctcgggctcgacatgcggctgcgggcacatggcgtgccgtccgaggatctgccggtcatggcaacggaggcgcatggcatccgccgcctgctcgactggaacccgcgcgatctgagcgtggccgagatcgaggcgatctaccgccgcgcc

SEQ ID NO: 31536 - DNA, 765 bp, Rhodobacter sphaeroides
atgaggatcgcgaccttcaacgtgaacggggtgaacggccggcttccggtgctgctgcgctggctcgaggaggcgcgccccgacgtcgtctgcctgcaggagttgaaggcggcctccgcgcgctttccggccgccgcgctggaagctgcgggttacggagcggtgtggcacgggcagaagagctggaacggcgtggcgatcctcgcgcgcggcgccgagccggtgcagacgcggcaggatctgccgggcgtgcaggacggtgaaagccgctatatcgaggcggcggtggagggcgttctcgtgggctgcctctatctgccgaacggcaatccggccccgggcccgaagtttgccgccaagctcgcgtggttcgaccatcttctcaatcatgccgaggaggttctgcgccacgacgtgccggtcgttctcgccggagacttcaacgtgatgccgaccgatctcgacgtccatcgtcccgagcgctggcgcgaggacgcgctgtgccgccctgaggtgcgggcagcctttgcccggcttctcgcgcagggttggacagatagcatccggcatctgtatcccgaggatcggatctatacgttctgggactatctccgaaatgcgtgggagcgggacgccggtctgcggctcgaccatctgctgctgagcccgtcccttctgacccgtctgaagggggcgggggtcgaccggcatgtccgcggctgggagaaggcgagcgatcacgctccggtctggatcgcgattgac

SEQ ID NO: 31537 - DNA, 2463 bp, Rhodobacter sphaeroides
gaactgatccaactggacgcgcgcgcgtcgtccaaggaagaggccatcgctcaggcggcggcggcgctcgtggcggcgggctgcgtgcggcccggcttcgaggccagcatgctgcggcgcgaagcggtgtcgaacacctatctcggcaaggggatcgcgattccgcacggcacggtcgaggaccgcgacctgatccagaaggatgccatcgctgtgcttcaggtgcgcgacggcgtggaatggaacgcgggcgagcgggcgcggctcgtggtggccatcgccgcccggtcggacggccatatcgagatcctccgccggctgacccggcttctgcaggacgaggaccggctggccgtcctcgccgcgacggacgaccggcaggcgctgtccgacgcgctgaacggagtggccgcgggcgctgcggccactgccgagcctgcgggcgatttcgcgcagtccttcgactgggtgctggattacccgaccgggctccatgcccggcccgccaccgaatgggccgaggcggcgcgccgcttcccctgccgcatccgcatccggcacggcgccgagacggcggatgcgcgcaacatgatttcgcttctgagccttgggctgaagtcgggcgatgcgatcaccgtttcggccgaagggcagggcgcggccgaggcgctcgccacgctgaaggtcacgatgaccgggctcagcgcccgggagaaggccgacgcggcccgcgccgaggagaagcgccgcgcgaccgccgcggccggcggctgggtgccgccctcgtctccgcgcgccatcgagggcgtgccggccgcgccgggtctggccatcgggcgcatcacccggatcgccaccgacgggatggagatccccgacgagccggtggagctggcccgggcggccgatctgcttcatgcggccttgggccagacggcggaacagctccacagcctcgccgacgataccgcgcggcggctgggagaatcggatgcggccatcttccgggcgcaggcggggctgctggccgatcccgatctcatcacgctcgcctcgcaatggctggtggacgggcacggcctcgcctggtcctggcatcgcgcctatgaggacatggcggcgcggctctcggccctgcgcaacccggtgctggctgcccgcgcggccgacctgcgcgacgtgggccagcgggtgcttgcccatatcgacccgcgctttgcccggtcgcggctggccgacctgcccgaggacacgatcctcgtggccgaggatatctcgccctcggatgcggcgggactggaccccgcgaaagttgcgggcctcgtgacggcgctgggcggtcccacctcgcacacggcgatcctcgcccggacgctgggcctgcccgcggtcgtgggcacgggagcggtggtcgagcggctggaagatggcgcgtgcgccatcgtcgatggccatggcgggcggctctatctcgatccgtcggaagccgacctcgcctcggcccgcgactggatcgcggcggaagaggcacgccgcgcccgggcggccgagacgcgggcgctgcccgccaccacgcgcgacgggcaccggatcgacatcggcgccaacatcaacctcgccgagcaggcagccttcgcgctggggcagggtgccgagggcgtgggtctgatgcggaccgagttcctgttcctcgaacgcagcgagagcccgaccgaggacgagcaggccgaagcctatgcggcgatggcgcgcgcgctcgaggggcggccgctggtgatccgcgcgctcgacatcggcggcgacaagcaggtggcccatctcgacctcccgcgcgaggagaacccgttcctcggcgtgcgcggcgcgcggctcctgctgcgccggcccgacctgctggtgccgcagctgcgcgcgctctatcgcgcggcggccggcggggcgcagatctcggtcatgttcccgatggtcacctcgctcggcgagcttctggagctgcgcgccacctgcgagcggatccggcaggagctggacgcgccggtcgtgccgctgggcatcatggtcgaggtgccctccgcggcgcttcttgcggcggaattcgccgcccacgcggacttcttctcgatcgggaccaacgatcttacccaatatgcgctggccatcgaccggcagaacccggagctcgcccccgaggcggacagcctgcatccggccgtcctgcggctcatcgatctgacggtgaagggcgcggcggtccatggccgctgggtgggggtctgcggcggcatcgcgggcgatccgttcggcgcggcgctgcttgcgggcctcggggtggacgagctttcgatgaccccgcgcgacattcccgcggtgaaggagcgtctgcgccagtccgaccgggcggggctcagggctctggccgaacacgcgctggcctgttccgacgccgaagccgtgcgggccctc

SEQ ID NO: 31538 - DNA, 807 bp, Rhodobacter sphaeroides
atgactgaagcctttgcccgcgcgaagatcaacctgaccctgcatgtcaccggccagcggccggacggctatcaccttctcgactcgctcgtggtcttcgccgatgtgggcgaccgggtgcgggccgaaccggccgaagcgctgagcctcgccatcaccgggccgcaggcggcgaacctgccggtggcggacgacaatctggtgctgcgcgccgcccggacgctgggcggtcagggggcgcggctcacgctcgagaagcatctgcccgtggcctcgggtatcggcggcggctccgccgatgcggcggcggccctcgtggcgctggcccggctctggcaggtgccgctgccggaacccgccgctgtcctgaagctcggggccgacgtgccggtctgcctcgaaggccgcgcggtgcggatggccggggtgggcgagatcctgacgccgcttgcagcgcccttgcccgaaggctggctggtgctggcgaaccccggcgtgtcggtgccgacgcccccggttttcaaggcgctcgcccggcgggacaacccgccgatgcccgacgatctgcccggctggcccaccgtcgaggccctggccgcgttcctggccacgcagcgcaacgatctggagccgccggccatcgcgcttgcgcccgagatcgcccggacccgcgccgcccttgccgcgcaacgggggtgcctgctggcccgcatgtcgggatcgggcgcgacctgcttcggcctctttgccgccgaagaggccgcgcgggctgcggccgaggccatcggggcagagcaccccggctgg

SEQ ID NO: 31539 - DNA, 1407 bp, Rhodobacter sphaeroides
ggcaggatgagacgccttcgcaatgtaaagatcgtggccaccctggggccggcctccaacgactatgccaccatccgcgcgctgttcgaagcgggtgcggacgtgttccggctcaacatgagccacggatcgcatgacgacatccgggcgcgccaccagatgctgcgccagatcgaggccgacaccgggactccggtctgcatcctcgccgacctgcaggggccgaagctccgcgtcggcaccttcgccaacggctccgaagagctggtcgagcgcggccgcttccggctcgacctcgaccccgcgccgggcaccgccgagcgcgtgaacctgccccaccccgagatcttcgcggcgctcgagccgggatcgtcgctcctcgtcaacgacggcaagatccgcctcgaggtggccgactgcggcccggacttcgccgactgcatcgtgacggtgggcggcacgatctcgaaccgcaagggcgtgaacgtgcccgacgtggttctgcccctcgccgccctctccgagaaggaccgccgcgacctcgaattcgtctgcgaactcggcgtggactggctcgccctctccttcgtgcagcgccccgaggatgtggaagaggcgcgcagcctcgcccgcggccgggcggcgatcctgtcgaagatcgagaagcccgcggccgtgaaggcctatgacgcgatcctcgccgtctccgacgggatcatggtggcgcgcggcgacctcggggtcgaactgcccgttcaggcggtgccgccgatccagaagcgcctcgtgcgcggcgcccgtgcggcggcgaagcccgtgatcgtggccacccagatgctcgagtcgatgatcgactcgcccatgcccacccgcgccgaggtctcggacgtggcgaccgccatctacgagggcgccgacgcggtcatgctctcggccgaatctgccgcgggctcctacccgatcgaagccgtgatgacgatgaacaacacggccatctcggtcgagagcgatcccgtctaccgcgacatcatcgaggcctcgcgcgcagccaagcgcgcctcggtcgccgatgccatcgtggcggccgcgcgcgagatcgccgagacgacgccgatcaaggccatctgctgcttcacccagaccggcaagaccgtgtcgctggtggcgcgcgagcggccgcgcgtgccgatcctcgcgctgacaccgctggtcgagaccgcgcggcgtctgtcgctcacctgggggacgcactgcgtcgtcaccgcgccgcaggagcggttcaagggcgcagtcatctgcgccgcgcgggcggcactgtccgacgggttcgcgcaggagcacgagcagatcgccgtggtcgcgggcgtgcccttcaacgtgcgcggcaccacgaacatcctgcgcgtc

SEQ ID NO: 31540 - DNA, 1080 bp, Rhodobacter sphaeroides
atgaccgcgctcgacacgctcagaggcaaatatatcgaggccatctccagcgccgccgacgaggccgcgctcgaggaagtccggctggcagccctgggcaagaagggcgagatcagcctgaagatgcgcgaactgggccagatgtcgcccgaggagcgccagaccaccggcgccgcgctgaaccggctgcgcgacgagatcgacgcgagcctgcgcgcccgcaagcaggggctggccgatgcggcgctcgatgcgcggctgaagaccgaatggctcgacgtgaccctgcccggccggccgcggcgggcgggcaccatccatccggtgagccaggtcatggccgaactgaccgcgatcttcgccgacatgggcttcgccgtggcggaaggcccgcaggtcgagagcgactggttcaacttcgatgccctgaacatcccgcccgagcacccggcccggcaggagcacgacaccttcttcatggcgcgcgccgagggcgacgaccgcccgccgcacgtcctgcgcacccatacgtcgccggtgcagatccgggccatgcaggcgcagggcgcgccgatccgggtgatcgcgcccggccgcgtctatcgcatggacatggaccagacccacacgccgatgttccatcaggtcgaaggcctcgccatcgaccgcgatatctcgatggccaatctcaaatgggtgctcgaggaattctgccgcgccttcttcgaggtgccttcggtcgagctgcgcttccgcgcctcgcacttccccttcaccgagccctcggccgaggtcgatatccgctgctcgtgggagggcggccagctcaggatcggcgagggcgacggctggctcgagattctcggctcgggcatggtgcatccgaaggtgctggccgcggccggtgtgaaccccgacgagtggcagggcttcgccttcggcatggggatcgaccggatcgccatgctgaaatacggcatcccggacctgcgcgccttcttcgaaagcgacctgcgctggctgcgtcactatggctttgccgctctggacatgcccgatctggccgggggcctctcgcgc

SEQ ID NO: 31541 - DNA, 2493 bp, Rhodobacter sphaeroides
atgaccctcacacggcgcgatctcatcaaggctcaggccgccgccaccgcagcggccgcggcaggtctgccggtctcagcactggcccagcctgtcacgggcggggcggaggccttgcggatccgctggtcgaaggcgccctgccgcttctgcgggaccggctgcggcgtcatggtgggcacgcgcgacgggcaggtggttgcgacccacggtgacacccaggccgaagtgaatcgcggcctcaactgcgtgaagggctatttcctgtccaagatcatgtatggcgaggaccggctgaccacgccgcttttgcgcatgaaggacggggtctaccacaaggagggcgagttcgcgcccgtctcgtgggacgaggccttcgatgtcatggcagcccaggccaagcgcgtgctgaaggagaagggcccgaaggccgtcggcatgttcggctcggggcaatggaccatctgggaagggtacgcggcctccaagctcatgcgggcgggcttccgatcgaacaatctcgaccccaacgcgcgccactgcatggcgtcggccgccaccgccttcatgcgcacctttggcatggacgagccgatgggctgctacgatgatttcgaggccgccgatgccttcgtgctctggggctcgaacatggccgagatgcacccgatcctctggagccggttgaccgaccggcggctgagccacgagcatgtgcgcgtggcggtcctgtcgaccttcacccaccgcagcatggatctggccgatacgcccatcatcttccggccgggcaccgacctcgcgatcctgaactacatcgcccaccacatcatctccaccggccgggtcaaccgggacttcgtcgaccggcacaccaacttcgcgctgggggccaccgacatcggctacgggctgcgccccgagcaccagcttcagctggccgccaagggcgcggcggacgcgggtgcgatgacgccgaccgatttcgagaccttcgccgccctcgtttccgaatacacgctcgaaaaagcggcagagatttcgggagtggagccggcgctgctcgaggagctggccgaactctacgccgatccggaccgcaaggtgatgtctctctggaccatgggcttcaaccagcatgtccgcggggtctgggccaatcacatggtctacaacctgcacctgctgaccgggaagatctccgagcccggcaactcgcctttctcgctcaccggccagccctcggcctgcggcaccgcgcgcgaagtgggcaccttcgcccaccgcctgcctgccgacatggtggtgaccaatcccgagcaccgcgcgcacgccgaggagatctggaagctgcccgcgggacttctccccgactgggtgggcgcccatgcggtcgagcaggaccgcaagctccacgacggcgagatcaatttctactgggtgcaggtcaacaacaacatgcaggccgcccccaacatcgaccaggagacctatccgggataccgcaatcccgagaatttcatcgtggtctcggatgcctatccgaccgtcaccggccgctgcgccgatctcgtgcttccggcggccatgtgggtcgagaaggagggtgcctatggcaatgccgagcggcgcacccacttctggcaccagctcgtcgaggcgccgggcgaggcgcgctcggatctctggcagctcatggaattctccaagcgcttcacgaccgacgaggtctggcccgaggagatcctctcggcagcgcccgcctatcgcggcaagacattgttcgaggtgctcttcgccaacggctcggtggaccggttcccggccagcgacgtgaaccccgaccatgccaaccacgaggccgcgctcttcggcttctatccgcagaagggcctcttcgaggaatatgccgccttcggacgcggccatggccacgatctcgctcccttcgacacctatcacgaggtgcgcggtctgcgctggcccgtggtcgagggcgaggagacccgctggcgctatcgcgagggctttgatccctatgtgaagccgggcgaggggctgcgcttctacggcaagcccgacggacgcgcggtcatcctcggtgtgccctacgagcctcccgccgagagcccagacgaggagttcggcttctggctcgtgacggggcgcgtactcgagcactggcactccggctccatgacgctgcgcgtgcccgagctctacaaggccttcccgggagccgtctgcttcatgcatcccgaggatgcgcgctcccgcgggctcaatcgcggatccgaggtgcgggtgatctcgcggcggggcgagatccgcacgcggctcgagacccgaggccgcaaccggatgccgcgcggcgtggtgttcgtgccctggttcgacgcgagccagctcatcaacaaggtgacgctcgacgcgaacgatccgatctcgcggcagacggacttcaagaaatgtgccgtgaaaatcgaggcggtg

SEQ ID NO: 31542 - DNA, 789 bp, Rhodobacter sphaeroides
atcgtcgtcaccggggcctcgggccggatggggcagatgctgatgaagacggtgctcgcctccggcaaggcgcggctcgtgggggcggtcgaaaggccgggcagcgactgggtcgggcgcgacgcgggcgcggccatgggaggcgccgccgtcggcgtcaccgtgaccgacgatccgctcgcggccttcgcgcaggcgcaggcggtcatcgacttcaccgcgcccgaggccacggtgcagttcgccgagctggccgctcaggcgcgggcggtgcatgtgatcggcaccaccgggctcgagccggcccatctggaaaggctcgcctgggccgcgcatcacgccgtcatcgtgcgggcgggcaacatgagcctcggggtcaatctgctcacgcggctcacgcagaaggtggccgaggcgctcgacgaagactgggacatcgaggtggtcgaggcccaccaccgcatgaaggtggatgcgccctccggcaccgcgctcatgctgggcgaggctgccgcgcgcggacgcggcgtcgatctcgcgcaggcccgcgtgtcgggacgcgacggcatcaccggcccgcgcgctccgggcagcatcggcttctcggccatccggggcggcgacatcgtgggcgagcacgacgtgatctttgccgcggcgggcgagcgcatcaccctgcgccatgtcgccaccgaccgcgcgatcttcgcccgcggcgcgctgaaggccgcgctctggggccaggacaggcgacccggccagtatgacatgatggacgtgctcgggctc

SEQ ID NO: 31543 - DNA, 1605 bp, Rhodobacter sphaeroides
gcagcctttgtgggcttcttcgtgaatctcctccacctcgccttgccgctctataatgcgcaggtttacgaccgggtgatcggcagcgccaatctcgacacgctggtggccctcacagggctggtcgcgatcctgctcgtcttcggcgcggtcctcgacgtgctgcgggcccggatcttcgcgatcctcgcggcgcggctggccggacagctcggccagcccgtcttcgtggcagccgtcgagaccgcgctccgtggcggccccaccgctgcggccgaggggatgcgcgccgtggccgacctccgcagcttcctcgcgggcggggccatcgcgctgccgatcgacctgaccttcactccggtcctcctcttggttctcttcgccctcgatccggcctacggcctgatcggtctcggcggggccgccgctctggccgggacgggcatcgtgacggagatcctcgcccgccgccccgtggccagcgcgctcgcggcgggcggcagcgtgcaggccgagaccgcgaccgccctgcgcagcgccgaagtcattgcggccatgggaatgctgccagacatcgcccggcgctggcgaagggctcaggcgcggtcgctcgcggccgccgatcgcgggcaggcgcgggccaaggccctgtcctcgctggcgcgcttcctccgcaccgccatccagatcgccgtgatctgcaccggcacgacccttgtcgtcgatcaggccgccaccatcggcaccatcgtggcggcgatggcgatcatgtcccgcctgctcctgccgttcgagcatctgatcgacggctggcggcaatggatggatgcggccgaggcgcacggtcatctgcggcgcctcctgcgagaaggcggcagcccccgctcgtccctgcccgcgccggtcgggcgcgcgctgctggtggccgaccgcgtcacctatatccctgcgggccaagacctgccccttctgcgcaacgtctcgttccgcatcgaacccggcgagctcctcggcgtcatcggcccgtcgggcgcaggcaaatcgacgctcgcgcggctgacggtcggtctctggccgcccagcgccggcggtcttttcctcgacggacaaagcacctttctccacgaacggacgagcttcggacgggcggtgggctatctgccgcaggagccgcttctgctcgacggcagcgtgcgcgacaacatcgcgcgcttccgggacgcgccgatggacgaggtgatcgccgccgcccggcaggccggcgtgcacgagctgatcggccgccttccgaggggctacggcacgcggctcgccgatgccggcgcgcggctgagcgggggacagcgccagcggatcgcgctcgcccgggccatcttcggcgacccgcagcttctcgtgctcgatgaaccgaatgccagcctcgatgcggaaggcgaggccgcgctggtctcggccgtcgagcaggcgcgggcgcgcggcgcggcggtgctcgtggtggcgcagcggatgtcggtgctggccaaggccgaccggctgctcgtgctacgcgaaggggccgtgacccattacgggcctcgggcagaggtgatggccgccatcggaccg

SEQ ID NO: 31544 - DNA, 2024 bp, Rhodobacter sphaeroides
tcgacggcgccaaggcgcgggcgcgggctctggtggaggatgccgaggcggcgcttgcgccctatgggccagaggcaggaacattgatcgaggcggcgcgcttcgtcatctcgcgtgaaagctgaaggaagagcatgaccgacagaccctgcacgccgacgctcgaccgggtgacgctcccggtggacataaagggcctcacggaccgtgagttgcgctcgctggccgacgagctgcgggccgaaacgatctcggccgtgtcggtgacgggcgggcatctgggcgcaggcctcggcgtggtggagttgacggttgcgctgcatgcgatcttcgatgcgccccgcgacaagatcatctgggacgtgggccaccagtgctacccccacaagatcctgaccgggcggcgcgaccgcatccgcaccctgcggcagggcgggggtctctcgggcttcaccaagcgctccgagagcccctatgactgtttcggcgcgggccattcctcgacctcgatctcggccgcggtgggctttgccgcggcacgcgagatgggcggcgacacgggcgacgcggtggcggtgatcggcgacggctcgatgtcggccggcatggccttcgaggcgctgaaccacggcgggcacctgaagaaccgggtgatcgtgatcctgaacgacaacgagatgagcatcgcgccgccggtgggggcgctgtcgtcctatctctcgcggctctatgcgggcgcgccgttccaggacttcaaggcggccgccaagggagcgctcgggcttctgcccgaaccgttccaggagggcgcgcgccgcgccaaggagatgctgaagagcgtcaccgtcggcggcacgctcttcgaggagctgggtttctcctatgtcggcccgatcgacgggcacgatctcgaccagcttctgccggtgctgcggaccgtcaagcagcgggcgcatgcgccggtgctgatccatgtcatcaccaagaagggcaggggctatgctccggccgaggccgcgcgcgaccgtggccatgccacgaacaagttcaacgtcctgaccggcgcgcaggtgaagccggtctcgaacgccccctcctataccaaggtcttcgcccagagcctcatcaaggaggccgaggtcgacgagcggatctgcgcggtgacggccgccatgccggacgggacggggctcaacctcttcggcgagcggtttccgaagcgcaccttcgatgtgggcatcgcggaacagcatgcggtgaccttctcggcggcgcttgcggcaggcggcatgcggcccttctgcgccatctattccaccttcctccagcgcggctacgaccagatcgtgcatgacgtggcgatccagcgcctgccggtgcgctttgccatcgaccgcgccggcctcgtgggggcggacggcgccacccatgcgggctcgttcgatgtggccttcctgtcgaacctgcccggcatcgtggtgatggccgccgccgacgaggccgagctcgtccatatggtagccaccgccgccgcccatgacgaagggcccatcgccttccgctatccgcgcggcgacggcgtgggggtcgagatgccggtgaagggcgtgccgctccagatcggccgtggccgggtggtgagcgagggcacgcgaatcgcgctcctgtccttcggcacccgtctggccgaggtgcaggtggccgccgaggcgctggctgcgcgcgggatctctcccacggttgcggatgcgcgctttgcaaagccgctcgaccgggatctgatcctgcagctcgcggcccatcacgaggcgctcattaccatcgaggagggcgccatcggcggcttcggcagccatgtggcgcagcttctggccgaggccggggtcttcgaccgcggcttccggtatcgctcgatggtgctgcccgacacgttcatcgaccacaacagcgccgaagtgatgtatgccaccgccgggctgaatgcggccgacatagagcggaaggcgctggagacgctgggggtg

SEQ ID NO: 31545 - DNA, 657 bp, Rhodobacter sphaeroides
gtcgtccatgccatgcgctatgcggtgcagggcggcaagcggctgcggggtttcctcgtgctcgaatccgcccggctgcacgggatcgcgcccgaggcggcggtgagtgctgcggcctctatcgaggcgctgcatgcctacagcctcgtgcatgacgacatgccctgcatggacgatgacgacctgcgccgcggcctgccgaccgtgcatcgcaagtgggacgaatgcaccgccgtgctggcgggcgacgcgctgcagactctcgccttcgagctcttggccgatccggcgctcggacccgccgcggtgcggatcgaactggtggcgagccttgcgaaagcctcgggcgccgagggcatggtgctgggccaggcactcgacatcgcggccgagacggctgccgtgcccctcacgctcgatcagatcacccaccttcaggccggcaagactggcgcgctgatccgctggtccgccgaagcgggggcgatcctcgggcaggcggaccgggtgccgctgcgccgatacgccacggccctcgggcttgcgttccagatcgcggacgacattctcgatgtcgagggcgatgcggagaaggcgggcaagcggctccagaaagatgccgaagccgggaaggccaccttcgtctcgcttctcggg

SEQ ID NO: 31546 - DNA, 1200 bp, Rhodobacter sphaeroides
aagatcaaggtagcgaaccccgtcgtcgagctcgacggcgacgagatgacccgcatcatctgggacttcatcaagcagaagctgatcctgccctacctcgacatcgacctgcattactacgacctcggcatcgaggagcgcgaccgcaccgaggaccggatcacggtcgatgcggcccatgcgatcaagcagtatggcgtgggcgtgaaatgcgccaccatcacgccggacgaggcgcgggtcgacgaattcggcctgaaatccatgtggaagagcccgaacggcacgatccgcaacatcctcggcggcgtgatcttccgccagccgatcatctgccgcaacgtcccgcgcctcgtgccgggctggacgaagcccatcgtcgtcggccgccatgccttcggcgaccagtatcgcgcgacggacttccgcttcccgggcaagggcaagctcacgctgaaattcgtgggcgaggacggcgcggtgatcgagcgcgaggtgttcgacgcgccgggctcgggcgtgaccatggcgatgtacaacctcgaccagtcgatcatcgacttcgcgcgggcctcgatgaactacgggctgaacctcggctggccggtgtacctctcgaccaagaacacgatcctcaaggcctacgacgggcgcttcaaggacctcttccagcaggtctacgaggaggaattcgccgagaagttcaaggcggcgggcatcacctacgagcaccggctgatcgacgacatggtggcctcggcgctgaaatggtcgggcggctatgtctgggcctgcaagaactacgacggcgacgtgcagtcggatacggtggcgcagggcttcggctcgctcgggctgatgacgagcgtgctgatgacgccggacgggcagacggtggaggccgaggccgcgcatggcacggtcacgcggcacttccgccagcatcaggcgggcaaggagacctcgaccaactcgatcgcctcgatctacgcctggacggggggcctcaagcaccgcgccaagctcgacggcaatgccgatctcgcccgcttcgccgagacgctcgagcgggtcacggtgcagacggtcgaggacggcttcatgacgaaggacctcgcactcctcgtgggcccggatcagaagtggctgaccacgatgggctatctcgagagggtcgacgaatatctcgaccgcgcgctc

SEQ ID NO: 31547 - DNA, 1473 bp, Rhodobacter sphaeroides
gacggcctcgccgtcggcgcccccgaccggccctggctgacctatgcgggcctgcgcgagcttgtgggccatacggtcacggcgctccatgccgcgggcgtgggaaagggcgaccgggtggccatcgttctgccgaacggacccgagatggccacggccttcgtggcccttgccgagggcgccgtcaccgcgcccctcaatccggcctaccggctcgaagagttcgaattctacctctcggacctcggcgccaaggccatcgtgctggccgaaggctatgacggcccggctctggtggccgcgaaccatctgggccttgcggtcctgcgcctcggacatgacgcggccgatcccgcaggcagcttcaccctgcgcgccgagagcgtggccccgggcgagcccgagcgcgccaccgcgcggccgcgcgacctggccctgatcctgcatacgtcgggcacgacctcgcggcccaagatcgtgccgcttcgccatggcaacctctcggcatccgcgcaccatatcgccggcagcctcgcgctcacgccgcacgaccgttgcctcaacatgatgccgcttttccacatccacgggctggtggcggcggtatcggcgagccttgccgccggcgcttcggtctggtgcgcgccggggttcgacgcgctgaaggtcttcggctggatcgaggcggcccggcccacctggtacacggcggtgccgacgatgcatcaggccatcctcgcccgcgcgccccgcaatgccgaggtgatcgagcgcgtgccgctgcgcttcatccgctcctcctcggcctcgctgcccgcccaggtgatggaggcgctgtcggccaccttccgcgccccggtgatcgaggcctacggcatgaccgaagccgcccaccagatgacctcgaacccgcttccgccccgcccgcagaagccgggatcggtgggcgtcgcggccgggccgcaggtccggatcgccgacgaggcctccgaccggctgatcgagggcacgggcgaggtggtgatctcgggcccgaacgtgacggcgggctacgaagcgaacaaggccgccaacgcgaagagcttcttcgaggccgagggcgagcgctggttccgcaccggcgatcagggccgcttcgacgccgagggctatctgacgatcaccgggcggctcaaggagatcatcaaccgcggcggcgagaagatctcgccgctcgaggtcgacggggtgctgatggaccatccggccgtcctgcaggtcgtgaccttcgccctgccgcatccgaagctcggagaggaggtcgcggcggcggtcgtgctgcgcgaggggatggccgcggacgaggcggcgatccgcgccttctgtgccgaccggcttgcggagttcaaggtgccgcgccgcgtggtgctgctcgacgagatcccgaagggggccaccggcaagctgcagcggatcgggctggccgagaagctg

SEQ ID NO: 31548 - DNA, 1047 bp, Rhodobacter sphaeroides
cccttcccgctggtcgcggccgaagcgcagggcgcacgcctgaccgacctcgacgggcaccggctcgacgatttctgcctgggcgacacgggctcgatgttcggccactcgccggccccggtggcgcgggcgatccggcggcaggcgcggcaggggctgacctacatgctgccgaccgaggccaccttcgaggcggggcagcttctcaatcggaccttcggcgacttccgctggcaggtggcgctgaccgcgaccgacgccaaccgcttcgcgctgcgcgtggcgcgggccgtcaccgggcggcgcaaggtgctggtgttcaacggctgctaccacgggacggtcgacgacacgatggtcatgctcgagaacggccgcacgcgggcgcggccgggcctcgtgggcatggtcgccgatctcgcctcgaaggcggtcgcggtcgagttcaacgatgtcgcgggcgtcgaggcggcgctggccactggcgagatcgccgcgatcctcaccgagccggtgatgaccaactcctgcatggtgctgcccgaggcgggcttccacgatgcgctgcgcaccctctcgcgccgctacggggcggtgctgatcctcgacgagacccatacgctttcctcgggcctcggcggctacggacgggtgcacagcctgtcgcccgacattctcgtggtgggcaaatgcgtggcgggcggcacgcccaccgccgtctggggcctgacgcccgatctcggcgcgcgcttcgcggcctacaatgcgacgcgccccgcgggccacagcggcatgggcacgactctctcggccaatccgatgcagttcgcctgcctctgcgccaccctgtccgaggtgatgacgcccgaggcctatgcccatatggagcgcggcgcaaagcggctggccaagggtctggccgcggccatcgcccgtgtgggtgcgccgtggcatgtcgtccgcgtgggtgcgcgcgtcgagttcatctgcgcgcccgggccgctccgcaacgggacagaggccgcggccgcccatcagccgcgcctt

SEQ ID NO: 31549 - DNA, 1617 bp, Rhodobacter sphaeroides
ctgccctcctgggacctgacgcagcgccagatctgcgacctcgaactgctgatgaacggcggcttccatccgctcaagggcttcctgaccgaggccgattacgatggcgtggtcgagaacatgcgcctcgccgacggacggctctggccgatgccggtgacgctggacgtgagcgagaagtttgccgagggcgtcgagcccggtcaggacatcgcgctgcgcgacgccgagggcgtgatcctcgcgatcctgtcggtcaccgacaaatgggtgccgaacaaggaccgcgaggccgagaaggtgttcggcgcgaacgatctcgcccatccggcggtgaactacctgcaccacacggccgggaaggtctatctcggcggcccgatcaccggcatccagccgccggtgcactacgatttcaagatgcgccgcgacacgcccaacgagctgcgcgccttcttccgcaagatgggctggacccgcgtggtggccttccagacccgcaatccgctgcaccgcgcgcatcaggaactgaccttccgcgccgcccgcgaagcgcaggcgaacctgctgatccatccggtcgtgggcatgacgaagcccggcgacatcgaccatttcacccgcgtgcgctgctacgaggcggtgctcgaccagtatccctcctccaccacgaccctgtcgctcctgaacctcgccatgcgcatgggcggcccgcgcgaggcggtctggcacgggctgatccggcgcaaccacggctgcacccacatgatcgtgggccgcgaccatgccggcccgggcaagaactccgagggcaaggacttctacggcccctatgatgcgcaggagctgttcaaggcccatgcagacgagatcggcgtcgagatggtcgatttcaaacagatggtctatgtgcaggagaaggcccagtatttccccgtggacgaggtgccggaaggctccaccgtcctcgacatctcgggcaccgagctgcgccgccgcctgcgcgaggggctcgagatcccggaatggttctccttccccgacgtggtgagcgagctgcgccgcacctcgcccgcccgctcgaagcagggcttcaccgtcttcttcacggggctctccggctcgggcaagtccaccatcgcgaacgccctcatggtcaagctgatggagatgggcggccgcccggtgactctcctcgacggcgacgtggtgcgcaagcatctctcctcggagctcggcttctcgaaggagcaccgcgacatcaacatcaagcggatcggctatgtggcctccgagatcaccaagaacggcggcatcgcgatctgcgcgccgatcgcgccctataccgcgacgcggcgcgccgtgcgcgagatgatcgaggccttcggcgccttcatcgaggtgcatgtggccacgccgatcgaggaatgcgagcggcgggaccgcaaggggctctacaagctcgcgcgggaaggcaagatcaaggagttcaccgggatctccgacccctacgaggtgccggccaaggccgagctggtggtggacacggccaatgtgagcgtcgaccattgcgcccatcaggtgatcctgaagctcgagcagatgggcctgatccgg

SEQ ID NO: 31550 - DNA, 1089 bp, Rhodobacter sphaeroides
tccctcctcatcctcgccggcgacggcatcggccccgaagtcatggccgaggtgaaacgcatcatcggctggttcggcgagaagcgcggcgtgagtttcgacgtctccgaggatctcgtcggcggcgcggcctatgacgcgcacggaacgccgctggccgatgagacgatggccagggcgcaggaggtggatgcggttctgctcggcgccgtgggcggaccgaaatacgacgtgctcgatttctcggtgaagcccgagcgcgggctgctgcgcctgcgcaaggagatggacctctatgccaacctgcgtccggcgcagtgcttcgacgcgctggccgacttctccagcctgaagcgcgacatcgtcgccgggctcgacatcatgatcgtgcgcgagctgacctcgggcgtctatttcggcgagccgcgcgggatcttccccgacaacgagggcggccgtttcggcgtcaacacccagcgctacacgaccgaggagatccgccgcgtcgcgcgctcggccttcgagctggcccgccgccgcaacaaccgggtctgctcgatggagaaggccaacgtgatggaatccggcatcctctggcgcgaggaagtgcagtgggtccatgacaacgaatatcccgatgtcgagctcagccacatgtatgccgacaacggggccatgcagctcgtgcgctggccgcgccagttcgacgtgatcgtgaccgacaacctcttcggcgacatcctgtcggactgcgcggcgatgctgacgggctcgctcgggatgctgccctcggcctcgctgggcgcgccgatggcgaacggccggccgaaggcgctctacgagcccgtccatggctcggcgcccgacatcgcggggcagggcaaggccaacccgatcgcctgcatcctgagctttgccatggcgctgcgctattccttcgacatgggcgaggaagccacccgcctcgagaaagccgtcgagacggtgctggccgacggcgtgcgcaccgccgatctcatgggccccgagggcggcacgccggtctcgacctcgggcatgggcgacgcggtcctcgcggcgctggatgcg

SEQ ID NO: 31551 - DNA, 2625 bp, Rhodobacter sphaeroides
gccatgaccgctccgagaacgctctatgacaagatctgggacgaccatgtcgtccaccagtccgaagacggcacctgcctgctctacatcgaccgccatctcgtccacgaggtgacgagcccgcaggccttcgaaggcctgcgcatgacgggccgcaaggtgcgcgcccccgagaagaccatcgccgtgccggaccacaacgtccccacgacggaaggccgcgacacgaagatcgacaacgaggagtcgcgcatccaggtcgaggcgctcgacaagaatgcccgcgacttcgggatcaactactatcccgtgtcggacatccggcaggggatcgtccatatcgtcgggcccgagcagggctggacgctgccgggcatgacggtggtctgcggcgacagccacacggccacccacggcgccttcggcgcgctggcccacggcatcggcacctccgaggtcgagcatgtgctggccacgcagacgctgatccagaagaaatcgaagaacatgaaggtggagatcaccgggagcctgcgccccggtgtcaccgccaaggacatcacgctgtcggtcatcggcctcaccggcaccgcgggcggcaccggctatgtcatcgaatattgcgggcaggcgatccgcgaactgtcgatggaaggccggatgaccgtctgcaacatggcgatcgagggcggcgcgcgcgcgggcctgatcgcgccggacgagaagaccttcgcctatgtgatgggccgtccacatgcgccgaagggcgcagcctgggaggcggcgctcgcctactggaagacgctcttcaccgatgagggcgcgcagttcgacaaggtcgtgacgatccgcggcgaggacatcgccccggtcgtgacctggggcacctcgcccgaggatgtgctgccgatcaccgcgaccgtccccgccccggaggatttcaccggcggcaaggtcgaggccgcacgccgcagcctcgaatacatgggcctgaccccgggccagaagctgaccgacatcaagatcgacacggtcttcatcggctcctgcaccaatggccggatcgaggatctgcgggccgcggccgagatcctgaagggcaagaaggtggcgccgggaatgcgggccatggtcgtgccgggctcgggcctcgtgcgcgcgcaggccgaggaagaggggctggcgcagatcttcatcgacgcgggcttcgaatggcgcctcgcgggctgctcgatgtgcctcgcgatgaaccccgaccagctctccccgggggaacgctgcgcctcgacctcgaaccggaacttcgagggccgtcagggccgcaacggccgcacccatctcgtcagccccggaatggccgccgctgcggcgatcaccggtcacctgaccgacgtgcgcgacctgatgatggcgccggccgagccggcgtgacgacggccgggcgcgcagcacagcgcgcccgcgcaggtttgcagcaagtcaggacagaacggaatgaaaggcacgagctcgctcatcgtctccggcatcctcgcccttctgggcgggatcgccgcactggccttcccgctgcccgtctcgctcgcggtcacggtccttgcgggctgtgtcttcgtggcgagcggggcgttcgggctctgggcggccttctccgacaggggaatgccctcgcggggggccgcggccttcttcagcctcgtcagcctcgtcgcgggggtctggatgctggccaacccgctggcgggaatggtgtcgctcacgctgatgctgggcgcgctcttcctcgtctcgggggtggtgcggctcgggctgagcctcgccacctggcgcggcaccgtcatgttctggctgatggcgctttccggcctgatctcggccggcctcggtctcttcatcctgctgcgactgccggaagcgagcctcgtgctgctcggcacgctcgtcgcggtcgagctgatcgtcatgggcgccaccctcgtcgccatgggctttgccctcagaaaatctggaaatccctgagccatgcaagaattcaccaaagtgaccggtgtcgcggcccccatgccgctcgtcaatatcgacaccgacatgatcatcccgaagcagttcctgaagacgatccagcgctcgggtctcggcaagaacctgttcgacgagatgcgctataatcccgacggcagcgagatcccggagttcgtgctgaaccagccggcttatcgcgatgcgcagatcatcgtcgcgggcgacaatttcggctgcggctcgtcgcgcgaacatgcgccctgggcgctgctcgacttcggcatccgctgcgtgatctcgacgagcttcgccgacatcttctacaacaactgcttcaagaacggcatcctgcccatcgtcatgccgcccgaggtggtcgaggtgctgatggaggatgcccgccggggcgccaacgcgcgcatgactgtcgatctcgaggcgcagacggtgacgacctcggacgggcagtccttcccgttccaggtcgattcgttccgccgtcactgcctgatgaacggcctcgacgacatcggcctgacgctggagaaggccgcctcgatcgacgggttcgaacgcgaccttgcaaccctgagaccctgggtc

SEQ ID NO: 31552 - DNA, 3459 bp, Rhodobacter sphaeroides
ttgcggttcacccgcctcagactgaacggcttcaagagcttcgtggaccccaccgatctggtgatccacgaggggctgacgggtgtcgtggggccgaacggctgcggcaagtcgaacctgctcgaggcgctgcgctgggtgatgggcgagaaccggcccaccgccatgcgcggggcggggatggaggatgtgatcttcgccggggcggccacgcggcccgcgcgcaacttcgccgaggtggcgctcgtcctcgacaatgccgaccggctggcgcccgcgggcttcaacgatgccgacacgatcgagatcgtgcgccggatcacccgggacgcgggctcggcctacaaggccaacaccagggatgtgcgggcgcgcgacatccagatgctgttcgccgatgcctcgacgggggcccattcgcccgcgctggtgcggcaggggcagatttccgagctcatcaacgccaagcccaaggcgcggcggcggatcctcgaagaggccgcgggcatctcgggcctctaccagcgccggcacgaggccgagctgcggctggcggccaccgagcagaacctcgcgcgggtcgaggatgtgctcgaccagctggcgcagcagctttccacgctggcgcggcaggccaaacaggcggcccgctaccgcgagatcggcgaggagctgcggcgggccgaggggtcgctcctctatcgccgctggcgcgaggcggatgtcgcgcggaccgaggcgctcgcgctcctgcgcgagcggatgacggcggcggggcaggccgaggccgtggcgcgcaaggccgccgctgcccgtgccgaggccgaggcgacgctgccgccgaagcgcgaggaggaggccatcgccggcgccgtgctgcaacggctgacggtcgagcgcgacgcgctggccgccgaggaggatcgcgcgcgggccaccatcgccacgctcgtgtcgcgggtggaccagctcggccgcgacatcgagcgcgaggcagggctcaaccgcgatgcggccgagaccatcgggcggctggaatgggagcgcgaggcgctcgagaccgcgcacgagggccacgaggagcggctggccgaggcggccgaggcggcgcgcgaggcgggggcggcgctcggcgagcgcgaggagatcctgtccgagcgcaccgaggatgccgcgcggctctcggcgcgccaccagtcggcgcagcggatgctggttgacagccgtacaacgctggccagatccgaggccgaggcggcgcgggcgcgcgaaacggtcgaggccgcggccgaggcgcaggagcgggcggccgagacctgggaagaggcggcggcggcgcaggaagaggcgcaggagcgcgccgaggccgccgaggaggcgctggtgcaggccgacgaggcgcgggccgaggcgcagtcgcgcgaggcggaggcgcgggcgcagcggtcggccgccgagggcgaggccaatgcgctgcgggccgaggtggcggcgctggcgcggctcgtcgaccgcgaggcgcaggcgggtagccagcttctcgaccgcattcaggtcgagccgggcttcgaggcggccctcggcgccgcgctgtccgacgatctgcgcgcgcccgaggtggcggcggacgcgccctccggctgggccgcgctgcccgattatgacgagacggccccgctgccggcgggcgccgagccgctggcgccgcatgtgggcgtgcccgaggtgctgcgccgccggatcggccagatcggcctcgtcggccgcgaggcgggggccgcgcttcagccgctgctgcaaccggggcagcggctggtgagccttgcgggcgatctgtggcgctgggacgggttccgcgcgggtgccgaggatgcgccctcggccgcggcgctgcggctgaagcagctgaaccggctggtggcgctgaagcgcgatctcgaggaggtggcggcccgcgccgagggggcaaggcaggcgcacgaggcgctgcaggcccggctcgcgcagctcacccgcgccgatcaggaggcccgcgaggcccgccgcgccgccgatgcgcgcgtgaccgaggcgagccgtgcggcggcccgcgccgaggcggaccgttcgatctcgggcggcaagctcgaatcggcgcggctcgcggtgaagcgctacgaggacgaggcgatggaggcccgcgcgcggctgcgcgaggcggaaggcgtggcctcggcgctgccggatctcgaggcggcgcgcgcggggctcgaggatctgaagatggcggtcgaggccgcgcgcatcgcgatgatgtcgcgccgctcgctgcatgacgagctgcgccgcgagggcgaggcgcgggtcaagcggcggcaggaggtgacgaaggacctttcgggctggaagcaccggctggagaccgccgagaagcgcagcgccgaactggccgagcgcaaggccgagaccgaggaggcgctgcgcgaggccgccgaggcgcccgaggagatcgccgcccgccgggaggagctggcagaagcgatcgaggccgccgaggagcgccgcgcccgcgcctccgatgcgctggcctcggccgaggcggcgctccgcgccgcgcaggaggccgagcgcgaggccgagcgtcaggcgggcgagagccgcgaggcgcgcgcccgggccgaggcccgcgccgatgccgcgaccgaggcgctgcagctggcggccgagcggatccgcgaggagacggagcggacaccgcagcagttgctcgaggcgctggcggtcgatcccgagcggatccccacggtcgaggcgctcgagaccgatgtcgggcggctcaagcggcagcgcgaggcgctgggggcggtgaacctgcgcgccgaggaggatgcgcaggcggtccagaccgagcatgacacgctgaaggccgagaagaccgacctcgaagaggcggtcaagaagctgcgcgcgggcatccagggcctgaaccgcgaggggcgcgagcggcttctgaccgccttcgagcaggtgaatgcgagcttcggcacgctcttcactcatctcttcggcggcggcgaggcgcggctcgtgatggtcgagagcgacgatccgctggaagcggggctcgagatcatgtgccagccgccgggcaagaagctctcgacgctctcgctgctctcggggggcgagcagacgctgacggcgctggcgctgatcttcgcggtcttcctcgcgaaccccgcgccgatctgcgtgctcgacgaggtggatgcgccgctcgacgatgcgaacgtcacccgcttctgcgacctgctggacgagatgacccggcgcaccgagacgcgctttctcatcatcacccaccatgcggtgacgatggcgcggatggaccggctgttcggcgtgaccatggccgagcagggggtgagccagctcgtttcggtcgatctcaagcgggccgaggcgctggtggcctgagtc

SEQ ID NO: 31553 - DNA, 885 bp, Rhodobacter sphaeroides
atggagatgcgtgtcatgatcagagggtccattcctgcccttgtgacgccgttcaagaacggcgagctggatctggacacgctgaagaagctggtcgactggcagatcgccgaaggctcgaccggcctcgtcccggtgggcaccacgggcgagagcccgacgctcagccacgaagagcacgagacggtgatcgaggcggtggtgaaggccgccgcaggccgggtgccggtgatcgcgggcgcgggctcgaactcgaccgccgaggggatccggctgatccgcttcgccgagacggtgggcgccgatgcggcgctcgtggtgacgccctactacaacaagcccacgcaggccgggatgattgcgcatttcaccgcgctccacgactgctgcagcctgcccatcgtgatctacaacatccccggccggtcggtcgtcgacatgtcgcccgagacgatgggcacgctggcgcggctgccgcggatcgtgggcgtgaaggatgccaccggcaagatcgagcgggtgagccagcagcgcgcctcctgcgggcctgacttcatccagctctcgggcgaggatgcgacggcgctcggcttcaacgcccacggcggcgtgggctgcatctcggtcacggccaacgtggcgccgcggctctgcgccgagttccagcaggcaaccctcgcgggcgacttcgccaaggcgctggagtatcaggaccggctgatgccgctgcacgaggcgatcttcctcgagccggggctggtgggggcgaaatatgcgctctcgaagctcgggctctgctccgacgaggtgcgcctgccgctcgtgggcctcaccgacgcgaccaaggcccgcatcgaggcggccatgcgtcacgccggcctgatc

SEQ ID NO: 31554 - DNA, 834 bp, Rhodobacter sphaeroides
accgacgatcccagaacgctcgtctccaccgactggctggccgcccatctgcgcgatcccgacctgaggctcctcgatgcctcctggtatctgccgcaggaaaaccgcaacccgcgggccgaatacgaggccgagcatattcccggcgcgcgcttcttcgacatcgacgagatcgccgacctgcgctcggccctgccccacatggcgccgccgcccgagaaattcatcagccggatgcgcgccatgggcgtgggcgacggccatcaggtcgtggtctacgacggctcgggcctgcgctcggcggcgcgggtctggtggaccttccgcctgatgggcaagacggatgtggcggtgctcgacggcggcctgccgaaatggaaggccgagggccatccggtcgaggacatgccgcccgtcgtccgcgaccggcacatgacggtgcagcgtcaggcgggcctcgtgaaggacgtgacccaggtggcccatgcctcgaagctcggcgaggccgagatcatcgacgcgcgctcggccggccggttcaagggcacggatgccgagccgcggccgggcctgcgcgcgggccatattcccggctcgaagaacgtgcccttcacgacgctcctcgcgccggacggcacgatgaagccgccggcagagctgcgcgcgatcttcgaggcggcgggcgtggatctctccaaacccgcgatcaccacctgcggctcgggcgtgaccgcggccgtgctcagcctcgcgctcgagatcctcgggcaccgcaaccatgcgctctacgacggctcctggtccgagtggggcatgtatgacgatctcaaggtc

SEQ ID NO: 31555 - DNA, 1173 bp, Rhodobacter sphaeroides
atgctgaccgccctgaagccgcagcccgcggacaagatcctgcaactgatccagatgttccgcgaggatgcgcgcgcggacaagatcgatctgggcgtgggcgtctacaaggacccgaccgggctcaccccggtcatgcgggccgtgaaggcggccgagaagcggctctgggaggtcgagaccaccaagacctacaccggccttgccgacgagccggcctacaatgccgcgatggcgaagctgatcctcgcgggcgcggtcccggccgaccgggtggcctcggtcgccacccccggcggcacgggcgcggtgcgtcaggcgctcgagctgatccgcatggcctcgcccgaggccaccgtctggatctcgaacccgacctggccgaaccatctgtcgatcgtgaaatatctcggcatcccgatgcgggaataccgctatttcgacgccgagaccggcgccgtcgatgccgagggcatgatggaggatctggcccaggtgaaggcgggcgacgtggtgctgctgcacggctgctgccacaacccgaccggcgccaacccgaacccggtgcagtggctggccatctgcgagagcctggcccggacaggcgcggtgccgctgatcgacctcgcctatcagggcttcggcgacgggctcgagatggatgcggcggcgacgcggcttctggccaccagactgcccgaggtgctgatcgcggcctcctgctcgaagaacttcggcatctaccgcgagcgcacgggcatcctgatcgccatcggcgaggcggcgggccggggcacggtgcaggccaacctcaacttcctgaaccggcagaactactccttcccgccggaccatggcgcgcggctcgtgaccatgatcctcgaggacgagacgctgagcgccgactggaaggcggaactcgaggaggtgcggctcaacatgctgacactgcgccgccagcttgccgatgcgctgcaggccgagaccggctcgaaccgcttcggcttcgtggccgagcatcgcggcatgttctcgcgcctcgggatcacgcccgccgaggtggagcggctgcggaccgagcacggggtctacatggtgggcgattcgcggctgaacatcgcggggctgaaccggacgaccgtgccggtgctggcgcgcgcggtggccaaggtg

SEQ ID NO: 31556 - DNA, 1584 bp, Rhodobacter sphaeroides
cttctcggcatcgacgtcggcaccggcagtgcgcgcgcgggcctgttcgaccgcgcgggcaggatgctcgcctcggccaaatgcgacatcgcgatctggcgcgcgccgggcgcgatggtcgagcagtcgagccgcgacatctggcaggcggtctgccgcgcgacccgcacggcgctggccgaggcggggctgccgcccgaggcggtgggcggcgtgggcttcgacgccacctgctcgctcgtcgtggtgggcgagggcggcgcgcccctgccggtcgggccttccgaggatcccgagcgcaacatcatcgtctggatggatcaccgcgccgtggcgcaggccgagcggatcaacgcgcagggccacgaggtgctgcgctatgtgggcggccgcatctcgcccgagatggagacgccgaagctcctgtggctggccgagcaccggcccgacatcttcgcccgcgcctggcagttcttcgatctcgcggattatctcggctggcgggcgacgggggatctggcgcgctcgacctgcaccgtcacctgcaaatggacctatctcgcgcatgagcaccgctgggacgcgggctatttccggcaggtggggctcggggtgctggcggacgagggcttcgcgcggatcggcgcccgggtggtggagcccggcacgccgttgggccaagggctgacgggcgaggctgcagcggagctcggccttcgtcccggcacgccggtgggcgcggggctgatcgacgcccatgccggcgggatcggcaccgtgggcgccgagggcacgcccgagcgcgatctggcctatgtgttcggcacctcctcctgcaccatgaccaccacgcgcgagccggtcttcgtgccgggcgtgtggggcccctaccgctcggccatggtgcccggcatgtggctgaacgagggcggccagtcggccgcgggcgcggcgatcgagcagcttgtgtccttccaccccgccgcggccgaggccgcccgcgccacggaggccctgggcgaggcgctgcccgtccatctggcccggctggccgccgaggggctcgcggatctgtcggaggtggccacccgcgccgagggcctgcatgtggtgcccgaattcctcggcaaccgcgcgcccttcgccgatccccatgcgcgggcggtgatcgcgggcctcgggatggagcgcgacctgccgagcctcgtgtcgctctatgtggcggggatctgcggcatcgcctacgggctgcgccagatcctcgaggcgcaggagcgcgcgggcgccccggtcgagcggatcgccatctcgggcggtgcgggccagctcgacatggtgcgccagctgctggccgatgcgacgggcaagcccgtgctggcgagcgccgtggcggagccggtgctgctgggctcggccatcctcggcgcggtggcggccgggcacgagcccgacatgacggccgccatgcagcgcatgtcgcgcacggccgcgcactacgagcccgccgggggtgccatcgcggcgctgcacgaccgccgctatgcggccttcctcgccctgcaggaggcggcccgggccgcgcgc

SEQ ID NO: 31557 - DNA, 726 bp, Rhodobacter sphaeroides
atggcagagctcatgcaaggaaaggtggccgccatcaccggcgcggcctcgggaatcgggctggaatgcgcgcgcaccctcgtggccgaaggcgccacggtggtgctgatcgaccgcgccgaggaccggctcaaggcgctctgcgccgagatcgggccgcgcgccctgccgctcgtcgtcgatctgctcgacgggccgcaggtctcggggatgctgccgcgcattctcgagctggcgggctcgctcgacatctttcacgccaatgcgggcgcctatatcggcgggcaggtggccgagggcgatcccgacgcctgggaccggatgctgaacctcaacatcaacgcggccttccgctcggtccatgccgtcctgccctacatgatagagcggaagagcggtgacatcctcttcacgagctcggtcgcgggcgtggtgccggtggtctgggagccgatctacaccgcctcgaaattcgcggtgcaggccttcgtccattccacccgccgtcaggtcgcgccgcacggcgtgcgcgtgggcgcggtgctgcccggcccggtggtgacggcgctcctcgacgactggcccaaggccaagatggaggaggcgctggccaacggctcgctcatgcagccgaaggaagtggccgaggccgtgctcttcatgctctcgcgcccgaagggcgtcgtgatccgcgacctcgtgatcctgccgcacagcgtcgacatc

SEQ ID NO: 31558 - DNA, 1326 bp, Rhodobacter sphaeroides
atgaacgcgctgatcgaggggctcggccaccatctcgcccagctgccgcaccggcaggccccgcaggtcacgggccgcgtggtgcgctacgacgggcttctgctggaatgcgcaggtttccccgtgagccccggggcgctctgccgtgtggccaccgaggatggccgcgaggtgcagggcgaagtgatcggcttcgcgcagggccgcaacctgctcttcctcgaccagatgcgggcgccggtgatcgcgggcgcgcgggtgcgcctcgtgcccggcgggcagatggccgcggtggggcccgcgctcctcggccgggtgatcgatgccgagggcgcgccgctcgacggcctgccagcccccgactgcatgggcgaatggccgctcgcgggtcgggtgatgaacccgctcgcccgcaccgccgtgagccgcccgctcgacgtgggggtgcgcgcgatcaacgcggcgctgacggtgggacagggccagcgcatcggcatcgtcgcgggctcgggcgtgggcaagtcggtgctcatcgagatgatgacgcgctacaccgcggccgacgtgatcgtcgtggggctgatcggcgagcgcgcgcgcgaggtgggcgcctttgcggcctcggtcatgcagggcgaggccgcgcggaagctctgcatggtggcggtgcccgccgaccgttcgccgctcctgcggctgcgggccgcgcgaagggccaccgccatcgccgaacatttccgcagcgagggcaagcaggttctcctcatcatggacagcctcacccgcgtggcccatgcgcagcgcgaggtggggctcgccctcggcgagcagccgacggccaagggctatccgccctcggtcgtctcgatgatcccgggcctgatcgagcgcacgggcccgggccttccgggcgagggcgccatcaccgcgatctataccgtgctggccgacggcgacgacacgacgaacgatccggtggtcgatacggcgcgcgccatcctcgatggccatttcgtgctgtcgcggcggcagacccagatggggctctatccggcgatcgacattcctcattcggtcagccggaccatgaacgacgtggtggacgaccgccaccggcgcgccgcggcccgtctgcgccagctcatcgcgctctattccgacaaccgggatctgatgctgatgggaggctatgcggccgggcaggatgccgatctcgatcaggcggtgcagctgtggccgaggatccgggcgctgatcggtcaggggccgcacgagcccgcggatttcgaggcgagccgcgcggcccttctcgagctgacggggctc

SEQ ID NO: 31559 - DNA, 1311 bp, Rhodobacter sphaeroides
ttctacggcttcaccgatctgccctcggtgcaccagcgcgggacggtcgtgctgacccacggcaaggggccctacatctacgacgtgcacgggcgcgcctatctcgacgcgaactcgggcctctggaacatggtcgcgggcttcgatcatccggggctgatcgaggctgccaaggcgcagtacgagcgcttccccggctatcatgcctttttcgggcggatgtcggaccagacggtcatgctgagcgagaagctggtcgaggtctcgcccttcgcgcggggccgggtcttctacaccaactccggctccgaggcgaacgacacgatggtcaagatgctctggttcctcggcgcggccgagggccacccggagcggcgcaagatcatcacccgcgtgaacagctatcacggcgtgaccgccgtctcggcctcgatgaccggcaagccctacaacagtctcttcgggctgccgctgccgggcttcatccatgtgggctgcccgcattactggcgcttcgggcaggcgggcgagaccgaggccgagttcacccagcggcttgcgcgcgagctcgaggccaccatcatcaaggaaggcccggacacgatcgcgggcttcttcgccgagccggtgatgggtgccggtggggtgatcccgccctccgagggctatttccaggcggtccagccggtgctgaagcgctacggcatcccgctcatcgccgacgaggtgatctgcggcttcgggcgcacgggcaacacctggggctgccagacctacgatttcatgcccgacgggatcatcagctcgaagaacatcaccgcgggcttcttcccgatgggcgcggtgatcctcgggccggagctggccgaccggctgcaggccgcttcggaagcggtcgaggaattcccgcatgggttcaccgcgagcggccatccggtcggctgcgccatcgcgctgaaggccatcgatgtggtgatgaacgaggggctggccgagaatgtccgcgccctcacgccgaaattcgaggcggggctcgcctatctggccgagaacccgaacatcggcgaatggcgcggcaaggggctgatgggggcgctggaagcggtgaaggacaaggccaccaagacccccttcccgggcgacctctcggtgtcggagcggattgccaacagctgcaccgaccatgggctgatctgccggccgctcggccagtcgatcgtgctctgcccgcccttcatcatgacggaggcgcagatggacgagatgttcgagaagctgggcgccgcgctgaagaaggtcttcgccgaagtc

SEQ ID NO: 31560 - DNA, 1344 bp, Rhodobacter sphaeroides
gtggcgctgatggacctctcgccgggcctcgaggagaagatccgggtctgcaactccacctataccgtgcgcttcggggtgcggctgcggggcaagatcttcaccttcaccggctaccgctcggtccattccgaacatatggagccggtgaagggcgggatccgctatgccctgtcggtgagccaggacgaggtcgaggcgctggctgcgctcatgacctacaaatgcgcgctggtcgagacgcccttcggcggttcgaagggcgggctctgcatcgatccgcgcgaatgggacgagcatgagctggagcagatcacccggcgcttcgcctacgagctggccaagcgcgacctgatccatccggcgcagaacgtgcccgcccccgacatgggcacgggcgagcgcgagatggcctggatcgccgaccaatatgcgcgaatgaacacggccgacatcaacgcgcgcgcctgcgtgaccggcaagccgatcaatgcgggcggcatccacggccgggtcgaggccacggggcgcggcgtgcagtttgcgctgcgcgaattcttccgccatgccgaggacaaggcgcgcgcggggctctcgggcgatctcgacggcaagcggatcatcgtgcagggcctgggcaatgtgggctatcacgcggcgaagttcctgaccgaggaggatggcgccaaggtcacgggcgtgatcgagcgcgacggggcgctggtcaatccggccgggatcccggtcgaggagctgcgccactggatgatgaagaccggctcgatccgcggcttctcgcaggccgacttcgtcgaggacgggcgcaagctgctcgaagaggagtgcgacattctcatccccgccgcgatggagggtgtcatcacccgggagaatgcggcgcggatcaaggcgccgctcatcatcgaggcggcgaacggcccgatcaccttcggcgcggacgagatcctgcgccagaaggggacggtcatcgtgcccgatctctatgccaatgcgggcggcgtcacggtctcctatttcgaatgggtgaagaacctcagccacatccgcttcggccggatgcagcggcgggccgaggaggcgcgctcgcgcgcgctggtcgaggagctcgagcggctttcggcggatcaggggctgggctggcagctcgcgcccgacttcaagcagaagttcatgcaggggtcggacgagctggcgctggtgcgctcgggcctcgatgacacgatgcgcatcgcctatcagtcgatgcgcgaggtctggcacggggcggaaggcgcgcaggatctgcgcgtggcggcctatatcgtggcgatccgccgggtggcg

SEQ ID NO: 31561 - DNA, 1266 bp, Rhodobacter sphaeroides
ctgcgtcttggtattgccggtctcggcaccgtcggtatcggggtggtcaagatcatccagcgtcacgccgacctgatcgccgcccgcgcaggacgcccggtcaccatcaccgccgtctgcgcccgcgaccggtcgaagaaccgcgatgccgatctttcgggctacgcctgggagacggatgcggtggcgctggcacagcgcgcggatatcgacgtgttcgtcgaggtcatgggcggctcggaaggggcggcgcgcgcctcgaccgaggccgcgctggccgccggcaaggatgtggtgaccgcgaacaaggcgctcctcgctcatcacgggcaggccttggccgagatggccgaggccgcgggcctcgccatccggttcgaggctgccgtcgcgggcggcatcccggtcatcaaggcgctgaccgaggggctcgccggcaaccagatgcgccgggtgatgggcgtcatgaacggcacctgcaactacatcctgacccggatggagaccgcgggcctgccctacgaccatgtcttcgaggaggcccgccagctcggctatctcgaggccgacccgaacctcgatgtcggagggatcgacgcgggccacaagctctcgcttctggcctcgatcgccttcggcacccgcgtcagcttcgacgacgtgcagctcgaggggatcggccagatctcgatcgacgacatccgccatgcgggcgatctcggcttccgcatcaagcttctgggcgtggcgcaggtgtcgggccgcgggctcgagcagcggatgaccccctgcctcgtgcccgccgacagcccgctcggccagcttcagggcggcaccaatatggtggtgctcgaaggagacgcggtgggccagatcgtgctgcgcggccccggcgcgggcgaaggccccaccgccagcgccgtgatgggcgacgtgatcgacctcgcgcgcggactgcgcctgcccaccttcggccgccccgccacgagcctcgtcgaggcggtgcccgccaaggtcgcggcgcccgcgccctggtatctgcgcatgacgctcctcgacaagccgggggcgctggccaagatcgcgacggcgctcggcgaggccggcatctccatcgaccggatgcgccagtatggccacgagggcggccacgccccggtgctgatcgtcacccacaaggcctctcgcgacgacatttcccatgcgatcagccggttcggggccacgggcgtcctcgtcggcgaacctgtggcgatccgcatcgaa

SEQ ID NO: 31562 - DNA, 744 bp, Rhodobacter sphaeroides
ttccttcagggcctcttcagcctcacgggccggcgcgccatggtgacgggcgcgagccgcgggctcgggcaggccatcgctctgggcctcgccgaggcgggggccgatctcgtgctgaccgcccgcgcggcaggcgcgctcgaggagacggcggcccgcatccgggcgctggggcgcgaggcgctctgcctcgcgctcgaccagtccgacccggcctcggtcgcagccccgatggaggccgccgggcggatcgacatcctcgtgaacaatgctggcaccgaggaggtctgcccgtccgaggcggtcacgcccgagctctgggaccggatcctcgacacgaacctccgcggcgccttcttcgtcacgcaagcggcggcgcgtgggatgctggcccgcggacaggggtcgatcgtcaacctctgctcgctcacctccttcgtaggcgtgcccacggccgtgccctacggctcgtcgaagagcgggcttctgggcatgacgcgggcgctggcggccgaatgggccccgcgcggggtgcgggtcaatgccatcgcgcccggctacttccgcaccgccctgaccgaggttttctatcagaatgaggattgggcgcaggcgatgcaggccaggatcccgcagggccgcttcggggagggccgcgatctggtgggcgctgccgtctttctggcctcggatgcctcggcttacgtcaccggccagtgtctcggcgtcgatggcggctatctc

SEQ ID NO: 31563 - DNA, 1269 bp, Rhodobacter sphaeroides
ctcgccgagctcgacgccgccgggcgcgcggcgctgctgcgccggtccgagacggacctgtcgatgttcctcgagaaggtgggcccgatcctcgaggcggtgcgcaccgagggcgacgcggcgctcgtccgcttcgggcgcgaactggaccgcgccgaggggctgacgcgcgagggtctgaaggtgaccgaggccgagttcgacgaggccttcgggctggtcgagcccgagatcgtcgcggcgatccgcttcgccatcggcaacatccgcaccttccacgaggagcaggcgcccgagcccatgtggctgaaggagctgcgccccggcgccttcgcgggcgaccggttcacgccgatccggtcggtggcgctctatgtgccgcgcggcaagggctcgttcccgtcggtgaccatgatgacctcggtgccggcggtggtggcgaaggtgccgcagatcgcgatcttcacgccgcctgcgccggacggcagggtggatgcggcgacgctggtcgcggcgcgcctcgcgggcgtcgagaccgtctacaaggtgggcggcgcgcaggcggtggcggccgcggcctacggcaccgagaccgtgacgcccgcgctgaagatcgtgggtcccggcagcccctgggtggtggcggccaagcggcttctggcgggcgtgatcgatccgggccttccggcgggcccgtcggaatcgatcatcctcgccgacgagacggtgcatggcgggctcgccgcgctcgacctgctgatcgaggccgagcatggccccgacagctcggcctggctcgtgacccactcgcggcaggtggccgaggaggcgctggcggcgctgccgggccactggtcggcgatgacgccgcagcgggtggacttctcgcaggccgtgctctgcgggcgggcgggcggcatcgtgctgaccggctcggccgaagaaagccacgccttcgtcaacgattacgcgcccgagcatctgcagatcctgtccgagaaacccttcgagcatctggggcggatcaccgaggcggcggaggtgctgatggggccgcacacgcccatcaccatcgcgaacttctgcctcgggccgaatgcggtgctgcccacctcgcggggcgcgcgcacctgggggccgctctcggtccatgacttcctgcgccggagttcggtcggctatgtcaccgcccccgcctatcccgaactggccgaggtggcgaagcggcttgcggaatacgagggcttctcgtcccacgccaacgccgtg

SEQ ID NO: 31564 - DNA, 1479 bp, Rhodobacter sphaeroides
ccccgcgacggtgcggtatgcgacggcatgccgattgattttcctgcccgtcttgcctaagagcttgcgggaaaatcaaggagcttgcgcatgactgcaacccgcaccgagaccgacagctttggcccgctcgaggttcctgccgacaaatactggggcgcccagacgcagcggtcgatccagaacttcccgatcggctgggagaagcagccggtggccatcgtccgggccctgggcgtgatcaagaaggcctgcgcgctcgtcaatgtggcccagggcgacatgcccgaggagctgggtcaggccatcgccgctgccgcgaccgaagtgatcgagggccgcttcgacgacaatttcccgctcgtcgtctggcagaccggctcgggcacccagtcgaacatgaacgcgaacgaggtgatctcgaaccgcgccatcgagatgctgggcggcacgatgggctcgaagaagcccgtccatccgaacgaccatgtgaacatgggccagtcctcgaacgacactttccccaccgccatgcatgtggccatcggcatgatggcgcgcgacgtgctgctgccggggctcgagaagctccatgcagcccttgtcgccaagtcggaagagttcaaggacatcatcaagatcggccgcacccacacccaggatgcgacgccgctgacgctcgggcaggaattctcgggctatgccaagcaggtcgagaagggcatcgcccgcgtgaaggcctgcctccccgacatctacgagctcgcgcagggcggcacggcggttggcacgggcctgaacacccggcagggctgggacagccgcgtggccgcgaagatcgccgagatcacgggcctccccttcgtcaccgccgaaaacaagttcgaggcgctggccgcgcacgatgcgatggtcatgttctcgggcgcgctgaagacggtcgcggcctcgctcttcaagatcgccaacgacatgcggcttctgggctcgggtccgcgctcgggtctgggcgagctgatcctgcccgagaacgagcccggctcctcgatcatgccgggcaaggtgaacccgacgcaggccgaggcgctgaccatggtctgtacccatgtgatgggcaatgacgcggcgatcggcttcgcgggcagccagggccacttcgagctgaacgtctacaatccgatgatgtcctacaacgtgctgcaatcgatgcagcttctgggcgatgctgcgggcagcttcaccgacaacatggtggtcggcacgcaggccaacgtggcgcggatcgacaagctgatgaaggagagcctgatgctggtgacggcgctggcccccaccatcggctatgacaatgccaccaaggtcgccaagaccgcgcacaagaacggcacgacgctgcgcgaggaggccatcgccctcggcctcgtcgatgccgagaccttcgaccgcgtcgtccgccccgaggacatgatcgggccgaag

SEQ ID NO: 31565 - DNA, 876 bp, Rhodobacter sphaeroides
ctttcccgactgctccggacccgcgactggctcatggccgacggcgcgacggggacgaacctcttcaacatgggcctgtcgtcgggcgagccgccggaactgtggaccgtcgaccgccccgacaatatccgcagcctctaccgcgcggcggtggaggcgggatcggacatcttcctgaccaacagcttcgggggcaatgcggcccggctgaagctgcacgaggcgcagggccgggtgggcgagctgaaccgcatcgcggccgaactcgggcgcgaggtggccgatgccgcgggccgtccggtggtcgtggcgggatcgatgggccccaccggcgaaatcttcgagccgatgggcaccctcacccaccggatggcggtcgagatcttccacgagcaggccgaggcgctgaaggccgggggcgcggatgtgctctgggtcgagaccatctcggcggccgaggaattcaaggcggcggccgaggcggcccggctggcggggatgccctggtgcggcacgatgagcttcgacaccgcgggccggaccatgatggggatcacggccgcggccctcgtcgatctggtcacgaagctgccgaacccgccgctcgccttcggcgcgaactgcggcgtgggcgcctcggacctcttgcgcacggtgctgggcttcgccgcacagggcatcgaggtgccgatcatcgccaagggcaatgcggggatcccgaaatatcacgacggccacatccattacgacgggacgcccgagctgatggcggaatatgcggtgctggcccgcgacgcgggcgcgcggatcatcggcggctgctgcgggacgatgccggagcatctgaaggcgatgcgggcggcgctcgagggccgt

SEQ ID NO: 31566 - DNA, 1356 bp, Rhodobacter sphaeroides
atcgacgcggcactcggcgacatcgaagcggttctgggcgagcggctctcgcgctcgcgtccggtgcgcgagcagcatgcccagagcgagacgcatcttcatgcaggtccgcccgatgcggtggcctttccgcgctcgacggccgaggtggcgcggatcgccgagatctgcaccgctcaccgcgtgccgatggtgggctggggcgcgggcacctcgctcgaagggcacgcgctggcgctgaaaggcggggtcaccatcgacttcgcccagatggaccggatcctcgagctgcgacccgaggacatgatcgtgcgcgtccagcccggcctcacccgcgaggggctgaacgcggcgctgcgcgacacgggcctgttcttcccggtcgatcccggcgccgatgccagcctcggcggcatggccgcgacccgcgcctcggggacgacggcggtgcgctacggcacgatgcgcgacaatgtgctggggctcgaggtggtgctgtccgacgggcgggtgatccgcaccggcaccgcggcgccgaagagctcctcgggctacgatctgaccgcgctgatggtggggtcggaaggcacgctcggcctcatcaccgagctcacgctgcggcttcacggccagcccgaggcggtgtcggccgccgtctgcgccttccccgacatgggcgcggcggtgggctgcgtgatcgaaacgatccagcacggcatcccgatggcgcggatcgaatttctcgatgcggcttcggtcaccgcctgcaacgcctatgcgcagatggagatgccggcggtgccgcatctgctgatcgagttccacggcaccgaggcgggcgtggccgagcaggcggagcgcttcggcgagatcgcggccgagcacgggtctgcggacttccagtgggccacgcggaccgaggaccgggcgcggctctggaagatgcgccacgcggcctaccgcgcctgcctcgcgctgcgccccggcgccgagggctgggtcacggatgtctgcgtgccgatctcgcggctggccgaggcggtcgaggagacgcaggccgatctcgcggcgagcccggtgccgggaccgattctcggccatgtgggcgacggcaacttccatgcgatcctgctggtcgatccccagagcgcggaggagctggccgaggcgaagcgcctgtcgggccggatggccgagcgggcgctgcggctcggcgggacggtcacgggcgagcacgggatcggcttcggcaaactcggctacatggaggccgaacatggcgcgggctgggcggtgatgggcgcgatcaagcaggcgctcgatccgctggggctgctgaatcccggcaagatggtg

SEQ ID NO: 31567 - DNA, 1635 bp, Rhodobacter sphaeroides
atgctgcgctcgcttgacatccgcgacatgctcatcatcgaccggctctcgctggccttccagccggggctgaacgtgctcaccggcgagacgggggcgggcaagtcgatcctgctcgactcgctgggcttcgtgctgggctggcgcggccgggccgaactcgtgcgcgcgggcgcggacaagggcgaggtgacggccgtcttcgacctgccgcccggccatgccgcccgcgccgtgctcgacgaggcggggatcgaggccgaggacgagctgatcctgcgccgcgtgaatttcgccgacggccgcaagaccgcctgggtcaatgaccgccgggtgtcgggcgaggtgctgcggggcctgtcggaccggctggtggagctgcatggtcagcacgatgaccgcggccttctgaacccgcgcggccatcggcagatgctcgacacattcgcggggctcgacctctcggcctgccgccgcgcctggacggcgctcggcaccgcgcggcgtacgctgctggccgccgaggaagcgctggccgccgtgcgcgccgaagaggatttcctgcggcacgccgtggccgagctcgacaagctcgatccgcagccgggcgaagaggcgctgctcgacacccgccgccgcgagatgcagggcgccgagaagatccgcgacgacatcgcccgcgcccatcgcgcgctctccgccgagggggccgagacgctgctggtcgatgcgctgcgctggctcgagaccgcctccgaccgggccggcaaccggctggaggcgccgctcgccgcgctgtcgcgcgcgctgctggagctgggcgaggcgcaggacggggtagaagcctgcctcgccgatctcgacttcgacccgcgcgatctcgaggcgctggaagagcggctcttcgcgatccgggcgctggcgcggaaacattcagtgctgcccgacgaactcggcaccttcgccgaggagctgcgcggccgtctggcagcgctcgacggcggcacgaagcagatcgacgcgctgcgccgggcgctggccgaggcggaagccgcgtgggaggccgaggccgcgatcctctccgaggcgcgccgcggggccgcgggccggctcgatgccgccatggccgccgaactcgcgccgctcaagatggagcgcgcggtgttcgagacgcaggtgacggaggccgatcccggccccgaggggcgcgacgctgtggccttcacggtggccaccaaccccggcgcgcccgcggggcccctgaaccgcatcgcctcgggcggcgagctctcgcgcttcctgctggcgctcaaggtctgtctgacgggcgacagcccgggcctcacgctgatcttcgacgagatcgaccgcggggtagggggcgccaccgccgacgccgtggggcggcgcctgaaggcgctggccgagggtgcgcaggtgctggtcgtgacccactcgccgcaggtggccgccctcggggcgcatcactggcgagtcgagaagcgggtggcgcatggcatgaccacctcgaccgtgagcccgctcggcgcgggcgaccggatcgaggagatcgcccggatgctcgcaggcgacacgatcaccgatgccgcgcgcgaggcggcccgcgcgctgctc

SEQ ID NO: 31568 - DNA, 792 bp, Rhodobacter sphaeroides
ggactgctggctggcaagcgtgggctcatcatggggctggcgaacgacaagtccatcgcctggggcatcgcgaaatgctgcgccgaccagggagccgagctggccttctcctatcagggcgatgcgctgaagaagcgcgtcgaaccgctggccgcctcgatcggggcgaccgagatggtggaatgcgacgtgtccgacgaggcctcgctcgaccggctcttcgcgcatctgaaggaggtctggggcacgctcgacttcgtcgtccatgccatcggcttctcggacaagtccgagctgcgcggccgctatgtcgacacgacgcccgcgaacttccgcatgacgatggacatttcggtctattccttcaccgccgtctgccagcgcgcctgcgccatgatgcccgcgggcggcagccttctcacgctgacctactacggcgccgagaaggtgatgccgcactacaatgtgatgggaatcgccaaggccgcgctcgagacctcggtgcagtatatcgccgaggatctgggcaaggacggcatccgcgtgaatgcgatctcggccggcccgatcaagacgctggccgccagcggcatcggcgacttccgctacatcatgaagtggaacgagctgaattcgccgctgcgccgcaacgtcacgcaggaagaggtgggcaaggccgcgctctatctgctgtcggatctgggttcgggcacgacgggcgaggtgctgcatgtggatgcgggctatcacgtcgtcggcatgaaggccgtggacgcgcccgacatcgacgcc

SEQ ID NO: 31569 - DNA, 735 bp, Rhodobacter sphaeroides
tttcgtctcgatggcgcctgcgcggccgtcaccggagcgggcagcggcatcggcctcgaaatctgccgggccttcgcagcctcgggcgcgcggctcatcctgatcgaccgcgagggcgcggccctcgaccgggcagctgaagagctcggcgcggcggtggcttcgcggatcgtggccgatgtgacggatgcggaggcgatgaccgccgcggccgccgcggcggaagccgtggcgccggtgtcgatcctcgtcaattccgcgggcattgcccgcctccacgatgcgctcgagaccgacgacgccacctggcggcaggtgatggcggtcaatgtggacggcatgttctgggccagccgcgccttcgggcgcgccatggtcgcgcgcggggcaggggccatcgtgaacctcggctccatgtcgggcaccatcgtcaaccgcccgcagttcgcctcgagctacatggcctcgaagggcgcggtccatcagctgacgcgggcgctcgccgccgaatgggcgggccggggcgtgcgggtgaatgcgctggcgccgggctatgtggcgaccgagatgacgctgaagatgcgcgagcggcccgagctcttcggaacatggctcgacatgacgccgatgggccgctgcggcgagccgtcggagattgcggcggcggcgctgttccttgcctcgccggcggcgagctatgtcacgggcgcgatcctcgcggtcgatggcggttac

SEQ ID NO: 31570 - DNA, 897 bp, Rhodobacter sphaeroides
cggaaaacagagatcatgccgacctatgacgtgagttccatcgggttctatgtctgcgacatcctcggtcgccccgtgacccgcatccccgacggcggccgcgccgactacatccaggagatccggatgacggtcgcgggcaccgccggagccaccgccgccgactgcgccatcctcggcctgaagaccctcgccgtcaccacggtgggcgaggacgagatgggcgacttcatggtggccaagctcacccgcttcggcgtcgattgcgccatggtggcgcgcgacggctcggtccagacgtcggccaccatcctgccggtgcgcccgaacggcgagcggcccgcgctccatgtgccgggcaccgccgccaccttccgcatccccgagggccggctcgacgccgcactcgatgcgcgcatcgtccatgtcggtggcaccggccttctgaagagcttcgacggcgcccctacggtcgaggcgctgcgccgcgcgaaggagctcgggcgcatcaccactttcgatctgatccaggccacgcccgagacctttgagctggtccgcccctgcctgccctacatcgactatttcgtgccttcgatcgaggaggcctccgagatggcgggcacgaccgatccggccgaggtggcgcgcttcttcaagggcctcggcgtgaagaacgcgatcctgaccatgggcggggagggggtctacgtctcgcccgaggcgggcgaggatttccgcttgcccgcccatgccatcgaggtggtcgataccacgggctgcggcgacagcttcaccgccggcgtgatcgtgggcctcgcccgcggctgggacctgcgcgactgctgccgcttcgcctcggcggtggcggcgcgggtcgcgatggggctcggctcc

SEQ ID NO: 31571 - DNA, 762 bp, Rhodobacter sphaeroides
ccctgcgggcgaactgaggacggacggatgacgaagacggcggttgtgacgggggcggcgcgcgggatcgggcgcgcgctcgcggtggggctcgcagaggcgggctacgatgtggcggtgacggatctggccgcgcaggccgacgggctggccgagacgcgcgcgctgatcgaggccgcgggccggcgcgccttcgtcgagacggtggatgtctcggaccgggccgcggtcgtcgccgcgatggcgcggatcgaggacgccgcgggcgggatcgacgtgctggtgaacaatgcgggcatcctgaagcccgcgcggctcgaggatctctcggaggccgactgggacgcgcatatggacgtgaacgtgaagggcgtcctctcctgctgtcaggcggtgctgccgggaatgcgcgcgcgcaaggcggggcggatcgtcaacatcgcctccatcgcgggccgtcagggcgtgccgacccaaggccattatgcggcgaccaaggccgccgtcattaccctgacgcgggtgctggcgcaggaggccggcatggacgggatcaccgtcaatgccatctgcccgggcatcatcctgaccgagatgggcaagaacaacctcggctcggacgaggccatccgccactgggaagaggtggccgcgctgaagcgtctcggcgcgcccgaagatatcgtggggccggtcctgttcttcgcgggcgagcagtcggccttcgtcaccgggcaggcgctgaacgtctgcggcgggatc

SEQ ID NO: 31572 - DNA, 1404 bp, Rhodobacter sphaeroides
gaccgtttcttcattggcggcgcctggacggcccccctcggcaccgaccggcaccggctggtgaacccggcgacggaggaggagatcgccgcgatcccgatggcctcgaccgaggatgtcgaccgcgccgtcaccgcggcgcgcgccgccttcgagggctggcaggccagctcgaaggaggagcgtctcctcctcctccgccgtctcctcgatctctacaacgaggcctacgacgagctggccgagctcatgacccgcgagatgggcaccgtcgcccgcttcagtcgcgaggcgcaggcctgggtcgggcgcgcccatttggaggccgccatcgaggctctcgaggccgagagcttcgaggagatgcgcggctcgaccctgatctcgaaggagcccatcggcgtctgcgccctcatcacgccgtggaactggccgatgaaccagctggtcgtgaaggtggcccccgccctcgccgcgggctgcacggtggtggcgaaaccctcggaattctcgccgctctcctcgatccgcttcgccgaactggtcgaggccgcgggctttccgccgggcgtctacaaccacatcaccggcgcaggccccgtcgcgggcgaggcgctggcgcggcacccggacgtggacatgatctcgatcaccggctcgacccgcgcagggatcgcggtggcgcgcgcggccgccgacacggtcaagcgcgtgacgcaggagctcggcggcaagtcggccaacatcatcctgcccgatgcggatctggccaccgccgtccggcagggggtgctcgactgtttcggcaatgcgggacaggcctgcaaggcgcccgcgcggatgctggtgccggccgagcggatggaggaggccgcggccctcgcaggcgcggcggccgaggcgctgacggtgggggcgcccgagggcgaggtcgatctcggccccgtcgtgaacgaaagccagtggcgccgcatccagtcgctgatcgaggcgggcatcgccgagggcgcgcgcctcgttaccgggggaccgggccggcccgaccatctgccgcgtggctggtatgtgcgcccgaccgtctttgccgacgtggcccatggctcgaccatcgccaccgaggagatcttcggccccgtcgtggccctcattccctaccgggacgaggaagaggcggtccgcatcgccaatgactcgatctacgggcttgcgggctatatccagaccggcgaccccgagacggcgcggcgcatcgcgcggaagctgcgcgtgggcatggtctatatcaacggcgcgggctgggacgcgcgcgcgcccttcggtggctacaagcaatcgggcaacgggcgcgaacacggcgcctggggcctcgccgactacctcgagacgaaagccacggccggattg

SEQ ID NO: 31573 - DNA, 1179 bp, Rhodobacter sphaeroides
cgggacgcctttctcgcggggatgcgcgagctgctggaggggatcgaggccgagggtctcacgaagcgcgaacggcccatcctctcggcgcaggggacgcatgtgcgggtgggggatcgcgacctcctgaacctctgcgcgaacaattatctgggccttgccaaccatccggcgctgatcgaggccgcccgccgcgggatggacgagcacggctacggcatggcctcggtgcgcttcatctgcggcacgcaggacattcaccgtgcgctcgaaggccggatcgcccgcttcctcgggatggaggatgcgatcctctttgcggcctgcttcgatgccaacggcggtctcttcgagccgctgctcggccccgaggatgcggtgatctcggatgcgctcaaccatgcgagcatcatcgacggcatccgcctctgcaaggcgcgccgctaccgctacgccaattccgacatggaggatctgcgccggcagctggcagaggcccgggccgagggcgcgcgccatatcctgatcgcgaccgacggcgtcttctcgatggatggctatctcgcccggctgcccgagatcgtggcgctggccgaggaattcggcgcgcttgtcatggtggacgattgccacgcgacgggcttcatggggccgaaggggcaggggacgcccgcccatcacggcgtgacggtggacattctgaccggcacgctcggcaaggctctgggcggcgcactcggcggctatgtggcgggcccgcagccggtgatcgatctcctgcggcagagggcgcggccctatctcttctcgaacgcgctgccgccggcggtggtggcggccggtctcgccgcgctcgatctggtcgaggccgccgacgatctgcgcgccgcgctcttcgagaacaccgcctactggcgcgcgggcctgaccgaggcgggcttccgcctgctgcccggcgcgcatccgatcgtgccggtgatgctcggcgaggcgcggctcgcacaggagatggcggcggcgctctatgaccgcggggtctatgtctcgggcttcttcttcccggtggtcccgcgcgggcaggcgcgcatccgcacccagatgaatgcggctctgacgcgggacgatctcgatctggccctcgcggcgttccgcgaggcaggcagggcggtgggggcgatc

SEQ ID NO: 31574 - DNA, 1020 bp, Rhodobacter sphaeroides
atgcgggcactggtgaaggccaaggcggaaccgggcctctggatggaagagcggcccgtgcccgagatcggccccgacgaggtgctcatccgggtccgcaagacggggatctgcggcaccgatgtccatatctggaactgggacgactgggcggcgaagacggtgccggtgccgctcgtcaccgggcacgagtttgcgggcgagatcgtcgaggtgggccgcgacgtgcgcgacctcagcccgggccagcgctgctcgggcgagggccatctgatcggccaccattcgcggcaggtgcgggccgggcgcttccacctcgatcccgagacgcgcggcatcggcgtcaatgttccgggcgccttcgccgactatctgcggcttcccgccttcaacgtggtgccgctgcccgatgccatcgacgacgaggtgggggcgatcctcgatcccctgggcaatgccgtgcacacggcgctcagcttcgatctggtgggagaggatgtgctcgtgaccggcgcaggccccatcgggatcatggccgcggctgtggcgcggcatgtgggcgcgcgccatgtcgtcatcaccgacgtcaatgccgaccggttgcggctgtcaaccgaggtggccgatgtggtgccggtcaatgtggccaccgaggatctgcgctcggtgatgggccgactgaagatcgtgcagggcttcgacgtagggatggagatgtcgggcgcacccgcgggcttcgaccagatggtcgaagcgatggtgatgggcggtcgcatcgcgatgctggggatcccgcccggccgcagccccgtggactggagccggatcgtcttcaaggcgctgaccatcaagggcgtctacggccgcgagatcttcgagacatggtacaagatgatcgcgatgctggagaacggcctcgatatccggcgcgtcatcacccaccgctttcctgtggcggatttcgccgagggttttgccgccatgcgcagcggcgcgtcgggcaaggtggtgctggactgg

SEQ ID NO: 31575 - DNA, 1923 bp, Rhodobacter sphaeroides
gtgtcggactacggcgcgggcggcgagttccaccagcacgccggcgaaggggacgagcgtctgacgacggcccagggcgtcaccatcgccgacaaccagaattcgctcaggagcggcgcgccgggaccgaccgcgctcgaggatttcatcctccgcgaaaagattttccacttcgaccatgagcggatcccggagcgcgtggtccatgcccgcggcttcggcgcgcacgggctcttcgaatgcaccaaggccattcccgaaatcacccgcgccgcccccttccagaaggaaggcaagatcaccgagaccttcgtccgcttctcgacggtggcgggctccaaggggtcggtggaccttgcccgcgacgtgcgcggcttcgcggtgaaattctataccgatgaaggcaactgggacctcgtcggcaacaacatcccggtcttcttcattcaggatgcgatcaagttcccggacctcatccattccgtgaagcccgagcccgaccgcggcttccctcaggcccagtcggcgcacgacaatttctgggatttcatctcgctcacgcccgagtcgatgcacatggtcatgtggcagatgtcggatcgtgccatcccccgcagcttccgcttcatggagggcttcggcgtccacaccttccgcttcatcaatgccgaaggccagtcgagcttcgtcaagttccactggaagcccaagctcggcatgcagtcggtgctgtgggacgaggcgctgaagatcaacggcgccgaccccgaccggcaccgccgcgacctctgggaagcgatcaccgccggcgatttcccagaatgggagctgggcctgcagatcttcgacgaagagttcgcgaaccgcttcgacttcgatgtgctcgatcccaccaagatcatcccggaagagctcgtacccctcaccatcgtcggcacgctgacgctggaccgcgtcgtggataactttttcgccgagactgagcaggtggccttctgcacccagaacgtggtgcccggcatcgacttcaccgacgatccgctgctgcagggacggaacttctcctacctcgacacccagctcaagcgtctgggcagccccaacttcaccaagctgccgatcaacgccccgcgtggctgccccgtccacaatttccagcaggatgggcacatgcagacctcgaaccgcaagggtcgggtgaactacgagccgaacggctggggcaagggcccgcgggcccatccgctcgagggctatgtcagctacgccgtgcgcaacgagggcgagaagcggaggctccggcccgagagcttcgccgaccattacagccaggcgcggcagttcttcctgagccagaccccggtcgagcagggtcacatccgcgatgcgctggtcttcgaactgtcgaagtgtcaggagatcgagatccgcgcccggatcgtcgcgcatctcctcaacatcgacggcgctctggcgcaggcggtggccgacgggctgggcctgaccgagatgcccgagcccgctcccgcggcacggccgacgcgcaccgacctgccgccgtccgatgcgctcagcatgctgaagaacccgccgccgaactttgcgggccgcaccgtcggggttctggcgggcaacggcgtcgaggccgagctgctgaccgagctgcgctcgatcctgcaggccgagggggcgatgatgaagctcgtggccccgcgcgtaggcggcgtcaccgacagcgcgggcacgcttcatccggcggacgagaagctgggcggcggcccgtcggtgatcttcgacgcggtggcggtgctgccgggctcggatgcggcgatgctagccgccaacccggcggcgcaggacttcctcaccgatgcgcatgcgcattgcaagttcatcgcccaccatggggcggggccgctgatc

SEQ ID NO: 31576 - DNA, 1068 bp, Rhodobacter sphaeroides
atcggctccgagatctatcgccggtcgagctacggtggcaggcatccgctgcgcgtgccgcgggtctcgaccgtgacggatctcggccgcgcgctcggctggctgccggctgccagcttccgcaccgcgccgcgggccaagcccgccgccctcaccctctggcacgatccggcctatgtggcggcgttggccgcggccgaggcggggcttgccgcgcccgaactgctggccgcccacgggctcggcacgctctcgaacccggtctttcccgagatgttccgccggcccgcgaccggcgcggggggcgtcatgctcgcggccgaactgctgcgcggcggcggcgcgatccatgtgccgggcggaggcacgcaccacgggatgcgcgaccgggcgaacggcttctgctatctgaacgacccggtgctggggatgctggtcctgcgccggatggggctccggcgcatcgcctatgtcgatatcgacgcccatcatcccgacggggtggaggcggccttcgcgggcgatcccgaggtgctcctgatctcggtgcacgaggaggggcgctggcccttcaccggtgcgctcgaggacgagggcggcggcacctgcttcaacctgccggtgccgcgcgggttcaacgacaccgagatgcgggcggtgctcgaggagctgatcctgccgcggctcgccgccttccgccccgaggctgtggtgctgcaatgcggggccgatgcgctggaggaggatccgctgtcgcggctctccctctcgaacaacgctcatttcgaggtggtggcggcgctgcgtccggtggcgccgcgctttctcgtgctgggcggcggcggctacaacccctggtcggtcggtcgctgctgggcgggcgtctgggccacgctggcgggccacgagatccccgaccgtctgccggaggcggcgcgcgcggtgctggcgggcctcgactggggcgggggcgggcgtcctccgccggcgcccccgctgatcgagacgctgcgcgacgcgccgcgggaggggccggtgcggccggagatccgggagaggctcgcccgc

SEQ ID NO: 31577 - DNA, 1038 bp, Rhodobacter sphaeroides
atgccgcgaccagtcagcctcgcctccctcgcaaccgccgtgcctccccatcgcgtcacccaacgcgaggcggcggaggccgcccatggcggcttcgcggcccgctacgacgatttcgcccgccttgcggccgtgttcgagacctcggggatccgcacccgtcatctggtgcgcccggtcgaatggtatctgcaaccgctcggctgggaggcccgcaacgccgcctatctcgaagcagcagaggccctgttcatcgaggccgccaccgccgcactcgaacgggcctcgctgagcgcggccgaggtggacacggtggtgacgatctcctcgaccggaatcgccacgcccagtctcgaggcgcgcgtggccgacaggatggggttccggagcgacctcgaacgcgtcccggtcttcggcctcggctgcgcgggcggcgtctccgggctcggcctcggggcacgcctcgccgccgcgcggccgggcagcaccgtcctcgtcgtggcggtcgagctctgctcgctgtcattccggctcgaccggctgacgaaggagaacatcgtcgcgacggcgctgttcgccgacggggcggcagccgcggtgctgcgggccgtcgacgggccgctgacggtcgagatggcgggccagcactcctggccgcagacgctcgacatcatgggctggcatgtcgacgacggcgggctcggcgtgatcttcgaccgggcgatcccgcccttcgccgaggcccatgtggcaggggccatcgaggcgatcctcggccgcgcggggctgacgcgggcggaggtcgaccgctttgcctgccatcccggcggagccaaggtcatcacggcgctcgaacgctccctgtcgctcgagcagggcacgctcgatcacgagcgcgaggtgctggcccagaatggcaacatgtccgcgccgaccgctctcttcgtgctcgcgcgcgtgctgaacgccgagccgccaccccgcaccctcctcaccgcgatggggccgggcttcaccgccagctgcgtctcgcttcag

SEQ ID NO: 31578 - DNA, 1605 bp, Rhodobacter sphaeroides
tggctgatccagccgctcttcgaccgcgtcttcgccccgggcggcaacaacctgctgccgtgggtgggcctggcgatcctcggcctcttcgtgctgcgcgcgatcacctcggtggcctccaaggccattctcacgcgggtctcgcagatcagctcgaccgcgatgcaggtcgatctgctccgccacatcctgaccctcgatcagggcttcttccagaagaacccgcccggcgcgctgatggagcgggtgcagggcgacacgaacgccgtgcagggcgtctggtcgagcgtgatcctcggcatggggcgcgacgtggtctcgctgatcggcctctttgccgtggcggtttccatcgatccgatctggacactggccgcgctggtgggggcgccgctcctgatcctgcctgcgctggtcgtgcagcgctatatccgcaagaagacgcgccagatgcgggtgcaggccggggcgcgctccacccggctcgacgagatcttccatggcatccagccgatcaagctgaaccggatggagacctaccagctcgaccggttccggcggatcgtcgatgtgatcgtgcggggccagctcaagatggcggtggggcgcgccaccatgcccgcgctgatcgacgtcatcaccgggatcggcttcttcgccgtcctcgtcctcggcgggcgcgagatcgcctcgggcgagcggacgacgggcgagttcatgtccttcttcaccgccatggccctcaccttccagccgctccggcgtctgggcgacctgtcgggcttctggcagatcgcggccgccagcctcgagcggatctaccggctcttcgacaccgaaccccaggtgctgcgccgcccggtcacggccacgcctaaggcaggcgttcccgagatcctgatcgaggacgtgcatttcgcctacgacgaccatcccgtgctgaacggcctcagcttccgggccgcgccgggcaggatgaccgccctcgtggggccgtcgggcgcaggcaagagcacggtcttccatctgctcacgggcctcatcgagccaaggtcggggcgcgtgctcctcaacggggtcgacgcggcagacatggccctgtcggacctgcgggcgcagtttgccgtcgtttcgcaggaggcgggcctcttcgacgagacgatccgcgaaaacgtgaccctcggccgcgacgtgccgcaggaccggctccgggcggcgctcgaggccgcgcatgtgacggagttcgtcgacggcctgcccgagggcgatctgacgcccgcggggccgcgcggctcgcgtctgtcgggcggccagcgccaaagggtggccatcgcgcgagcgctcgtctcggaggcgccggtactgcttctcgacgaggccacctcggcgctcgacgcggcctccgaggcgctggtggccgaggcgctgagccggcttggcgagggccgcacgacgctggtcatcgcccaccggctctcgaccgtgcggcaggccgaccggatcgtggtcatggaagagggccgcgtcgtcgatcagggcacgcacgaggaattgctggcgcggggcggtctctatgccgaactgcaccggctgcagttcaggaac

SEQ ID NO: 31579 - DNA, 549 bp, Rhodobacter sphaeroides
gatgcgatgctgaccgtgccgcgcgaggtctatgtgccgcgccccctgcgggaagtcgcctacatgagcgagaacgtggcggtggcgccgaaccgcgtcctgctcgagccgcggacgtttgcgaagctgctcgacacgctgaacatccagccggtggaatcggtgctcgatgtggcctgcgggctcggctattcctgcgccgtgatcgcccggctggcagaggcggtcgtgggcctcgaggaggacgaacagcttgccgccgaggcgcagcgcaccctctcggccgagggcgtggacaatgcggccgtgatcgtgggcccgctcaccagcggtgccgccaagcacgggccctatgatgtcatcacggtcgaaggcgcggtcgagacggtgccgcaggcgctgctcgaccagctgaaggaaggcggccggatcggctgcatcttcatggaaggcccgctcggcgtagcccgcatcggatacaaggtggacggggcgatcacttggcgcccggttttcaacgccagtgccccggtcctgccggggttcgag

SEQ ID NO: 31580 - DNA, 1966 bp, Rhodobacter sphaeroides
gacctggtgccgtgtggaagaccgcacggcacccttttgacattcacgggaggctctgatgaccaatcccaccccgcgacccgaaaccccgcttttggatcgcgtctgctgcccggccgacatgaaggcgctgagtgacgccgaactggagcggctggccgacgaagtgcgttccgaggtgatttcggtcgttgccgagacgggaggacatctggggtcctcgctgggggtggttgagctgactgtcgcgctgcatgcggtcttcaacacgcccaccgacaagctcgtctgggacgtgggccaccagtgctacccccacaagatcctcaccggccggcgcgagcagatgcgcaccctgcgccagaagggcggcctctcgggcttcaccaagcgctcggaatccgcctacgacccgttcggcgcggctcattcctcgacctcgatctcggccgcgctcggctttgccatgggtcgcgagctgggccagcccgtgggcgacacgatcgccgtgatcggcgacggctccatcaccgcgggcatggcctacgaggcactgaaccacgcgggccatctgaacaagcgcctgttcgtgatcctgaacgacaatgacatgagcatcgcgccgcccgtgggggcgcttgcgcgctatctcgtgaatctctcctcgaaggcgcccttcgccacgctgcgcgcggccgccgacgggctcgaggcctcgctgccggggccgctccgcgacggggcgcgccgggcgcgccagctcgtgaccgggatgccgggcgggggcacgctcttcgaggagctgggcttcacctatgtcggccccatcgacggccacgacatggaggcgctcctccagacgctgcgcgcggcgcgggcccggaccacggggccggtgctcatccatgtggtcacgaagaagggcaagggttacgcccccgccgagaatgcccccgacaagtatcacggggtgaacaagttcgaccccgtcacgggcgagcagaagaagtcggtggccaacgcgccgaactacaccaaggtcttcggctccaccctgaccgaggaggccgcgcgcgatccgcgcatcgtggcgatcaccgccgctatgccctcgggcaccggcgtcgacatcatgcagaagcgtttcccgaaccgcgtcttcgacgtgggcatcgccgagcagcatgccgtgaccttcgcggccggcctcgccggggccgggatgaagcccttctgcgcgatctattcctcgttcctgcaacggggttacgaccagatcgcccatgacgtggcgctgcagaaccttcccgtccgcttcgtgatcgaccgggcggggctcgtgggggccgatggcgcgacccatgcgggggccttcgacgttggcttcatcacttcgctgcccaacatgaccgtgatggccgcggccgacgaggccgagctcatccacatgatcgccaccgccgtggccttcgacgagggccccatcgccttccgcttcccgcggggcgagggggtgggcgtcgagatgcccgagcgcgggacggtgctggagcccggccggggccgcgtggtgcgcgaagggacggatgtcgcgatcctctccttcggcgcgcatctgcacgaggccttgcaggcggcgaaacttctcgaggccgagggggtgagcgtgaccgtggccgacgcccgcttctcgcgcccgctcgacacggggctcatcgaccagctcgtgcgccatcacgcggcgctggtaacggtggagcagggggccatgggcggcttcggcgcccatgtcatgcactatctcgccaattccggcggcttcgacgggggcctcgcgctccgggtcatgacgctgcccgaccgcttcatcgagcaggcgagccccgaggacatgtatgccgatgcggggctgcgggccgaggatatcgcggccaccgcgcggggcgcgctcgcccgggggcgcgtg

SEQ ID NO: 31581 - DNA, 864 bp, Rhodobacter sphaeroides
atggcgtttgaacagcggattgaagcggcaatggcagcggcgatcgcgcggggccagggctccgaggcgccctcgaagctggcgacggcgctcgactatgcggtgacgcccggcggcgcgcgcatccggcccacgcttctgctcagcgtggccacggcctgcggcgacgaccgcccggctctgtcggacgcggcggcggtggcgcttgagctgatccattgcgcgagcctcgtgcatgacgatctgccctgcttcgacgatgccgagatccggcgcggcaagcccacggtgcatcgcgcctattccgagccgctggcgatcctcaccggcgacagcctgatcgtgatgggcttcgaggtgctggcccgcgccgcggccgaccagccgcagcgggcgctgcagctggtgacggcgctggcggtgcggacggggatgccgatgggcatctgcgcggggcagggctgggagagcgagagccagatcaatctctcggcctatcatcgggccaagaccggcgcgctcttcatcgccgcgacccagatgggcgccattgccgcgggctacgaggccgagccctgggaagagctgggagcccgcatcggcgaggccttccaggtggccgacgacctgcgcgacgcgctctgcgatgccgagacgctgggcaagcccgcggggcaggacgagatccacgcccgcccgaacgcggtgcgcgaatatggcgtcgagggcgcggcgaagcggctgaaggacatcctcggcggcgccatcgcctcgatcccctcctgcccgggcgaggcgatgctggccgagatggtccgccgctatgccgagaagatcgtgccggcgcaggtcgcggcccgcgtc

SEQ ID NO: 31582 - DNA, 1485 bp, Rhodobacter sphaeroides
atgagacagattgtgccgaaggtggttgtggtcggggccgggatgggcgggctggcctctgcgatccggctggcgcgggccgggtgcgaggtgacgctcctcgaggcgcgagaggcgccgggggggcggatgcgtaccctcccgagcgtggcgggaccggtggacgcaggcccgaccgtgctcacgcttcgcgaagttttcgacgatatcttcgaggtttgcggccaaaagctcgatcatcacctcactctcctgccccagccgcttctggcccggcactggtggctcgacggcagcacgctcgacctcaccaccgacctcgaggccaatgtcgaggcggtggcggccttcgccggcgcgcgcgaggcccgcgccttccgccgcttccacgatctctcggcgcggctttatgacgctttcgaccggccgatgatgcgcgcggcccggcccgacctgcgggccatcgcgaccggggccctgaaggcgccccggacatggcccgcgctcctgcccggcatgacgctcgaccggctcctgcggctcttcttccgcgaccggcggctgcgtcagctcttcgggcgctacgccacctatgtgggcggcacgccctacggtgcgccgggcgtgctcgcgctcatatgggcggccgaggcgcgcggggtctgggcaatcgagggcgggatgcaccggctcgcgctggcgctggcccgcctggccgacgatcagggcgtgcggctgcgctacggggcgccggtcgcgcgcatcctgcgccagggcggccgcgccaccggcgtgcagctggccgacgggcggacgcttccggccgatcacatcgtcttcaacggcgatccggcggcgctccttgcggggtgtctgggcgacgggccgcaggacgccgtgcccgaggaccggatccacccgcgcagcctctcggcctgggtctggtcctatgccgcccgcgcctcgggcccgccgctcgtccatcacaacgtcttcttcgccgacgacccccggcgcgagttcggaccgatcgccgcaggacagatgccggaggatgcgacactctacatctgcgccgaggaccgctccggcgggcagctccccgacgggcccgagcgattcgagatcatcatgaacggaccgcccggccggcccgcgaaacccgaggattttgcgcaatgtcgcagccgaaccttcgaccgcctgagacagttcgggctgaccttcgacccggtgccgggcgagacgagcctgacggccccctcgggcttcgcgagcctgttcccggcgtcgcagggctcgatctacgggctgagcccgcacggggcgctggcctcgctgaagcgtccgctggcgcggacggcgctgccgggcctgtggctggcggggggcggggcccatccgggggcgggcgtgccgatggcggccctctccggacggcacgcggccgaggcgatactggcggaccttgcttctcggtcgagg

SEQ ID NO: 31583 - DNA, 1691 bp, Rhodobacter sphaeroides
gagcaggggtcaagcgcgcttcgcgttgcgaagcgggaagggatcgtctagagggaccgcaggcagcggcaggggtgaaagatggccgaacagcagaagggtctgacctacgcggacgcaggggtggacatcgacgccggcaacgcgctcgtcgagcggatcaagcccgccgccaagcgcacggcgcgcccgggcacggtctcgggtctcggcgggttcggcgcgctcttcgacctcaaggccgcgggatatcaggacccggtgctggtcgctgccaccgacggggtcggcaccaagctgcgcatcgccatcgacacgggcgaagtggacacgatcggcatcgacctcgtggccatgtgcgtgaacgatctcgtctgccagggcgcagagccgctgtttttcctagattatttcgcgacgggcaagctcgaggtcgcgcaggctgcgcggatcatcgagggaatcgcggaaggctgcgccgcctcgggctgcgcgctgatcggcggcgagaccgccgagatgcccggcatgtatcacaagggcgacttcgatctcgcgggcttcgccgtgggcgcgatggaacgcggtgccgacctgccgcagggcgtcgcagagggcgacttgctgctgggcctcgggtcgaacggggtccattcgaacggctattccttcgtgcgcaaggtggtcgagctctcggggctcggctgggatgcgcccgcgcccttcggcggcgacagcctcgggcgggcgcttctcgcgccgacgcgcctctatgtgaagcaggcgctggcggcggtgcgggcggggggcgtgcatgcgctggcccatatcaccggcggcggcctcaccgagaacctgccgcgcgttctccccaagggtctgggcgcgcgcatcgacctttccgcctgggagctgccgccggtgttccgctggctggccgagaccgcctcgatggccgagcccgagctcttgaagaccttcaactgcggcatcggtatgatcgtcgtggtcgcggccgatcgcgccgacgagattgcggccctgctcgcggccgagggcgagacagtcacgcggatcggcgaagtgatcgcaggcgagggcgtgagctacgacggccgccttctgtgaaacgggttgccgtcctgatctcgggcggaggctcgaacatgctggcgctgctgcgcagcatggagggcgcgcacccggcgcggccggtgctcgtggcctcgaacgatcccgcggcggcggggctcaaacgcgcggccgagctgggcgtgccggtcgctgcggtggatcaccggcccttccggggcgaccgcgcggccttcgaggcggcgctgctcgagccgatcctcgcggccgagccggacatcctgtgccttgccggcttcatgcgggtgctgacgcccgccttcgtcgcgcgcttcgaggggcggatgctgaacatccatccctcgctcctgccgaaatatcaggggctgcacacgcatcagcgggcactcgaggcgggcgacgccgaggccggctgcaccgtccacgaggtgacggccgcgctcgacgacgggccgatcctcggtcaggcgcgggtgccgatcctgccgggcgataaggcggagacgctcgcggcgcgtgtgctgacgcgggaacatgcgctctatccggcggtgcttcggcgttttgccgcgggcgat

SEQ ID NO: 31584 - DNA, 738 bp, Rhodobacter sphaeroides
atggggaagaagatgcgcaaacttgcggccggaaactggaagatgaacggaaccgaggcggatctgggcgagatcgacgccctgctcgccgcgcatccgtcgccccgctgcgagatgctgatctgtccgcccgcaacgcttgttgcgcgcatggcgggacgcgcggcgcagggcctgatggtcggcgggcaggactgccaccccaagacctccggcgcccataccggcgacgtctcggccgccatgctcgccgatgccggggcgagccacgtcattctcggccattccgaacgccgcgccgatcatggcgagacggactcgctcgtgcggctgaaggccgaagcggcctggggcgcgggccttgtcgccatcgtctgcgtgggcgaaaccgaggcccagcgcgacgcgggccagacgctcgacgtgatcggggcacagcttgcgggctcggtgccggaagccgccaccgcggccaacaccgtgatcgcctacgagccggtctgggccatcggcaccggccgcacgcccacgaccgccgagatcgccgaggttcacgccttcctccgcgcgcggctcgccgagcggttttcggatgcggagggcttccggctgctctacggcggctcggtgaagccgtcgaatgcggccgagatcttcgccgtgccgaatgtcgatggcgcgctggtcggcggcgcgagcctcaaggccgcggatttcggcgggatcgtggcggccctt

SEQ ID NO: 31585 - DNA, 1647 bp, Rhodobacter sphaeroides
atgtacagctacaccgacttcgacgaagccttcgtccgcacccgcgtcgcccagttcagcgagcaggtccgccgccgcatcgacggctcgctcaccgaggacgagttcaagccgctccggctgatgaacggactctacctgcagctccatgcctacatgctgcgcgtggcgatcccctacggcaccctcgacagccgcaagatgcgccagctcgccatgatcgccgagcggtgggacaagggctacggccatttcaccacgcgccagaacatccagttcaactggcccaagctcggcgacgtgcccgagatcctctcggccctggccgacgtcgggatgcatgccattcagacctcgggcaactgcgtgcgcaacgtgacggcggaccatttcgccggcgccgccgccgacgagatcgaggatccgcgcccggtggccgagcttctgcgccaatggtcgaccgaccatcccgagttccagttcctgccgcgcaagttcaagatcgccatcaccggctcgcccaacgaccgcgcggtcacgaagtcgcacgacatcggcctgcgcatggtgcgcaacgccgacggagagccgggcttcgaggtgatcgtgggcggcggcctcggccggacgccgatgatcggccgcgtggtccgcgacttcctgcccaaggcggacctgctgccctatgtcgaggccatcctcggcgtctacaacgagctcggccggcgcgacaacaaatacaaggcgcgggtgaagatcctagtccacgagaccgggctcgagccgctgcgcgagatcatcgaggagcggttcctcgagacccgcgccgagttcggcgggcaggacatggcgcttctggccgagatcgaacgggccttcgcgccgcccgccttccggcaggcgccgaccgccgcctatgacgatttctaccgggcggatccgatcttccgggcctgggcggacaccaaccttgcccgccaccgcaacgccgattacgccatcgtcacgatcagcctgaaggcgcacggggccacgcccggcgacgccacggccgagcagatgcgggtcatggccgatctggccgaacgctacggccatgacgagctgcgcatcagccacgagcagaacgtgatcctgccgcatgtccacaaggccgatcttccggcggtccatgcggcgctggcgcaggcggggctcgccacggccaacgtggggctcatctcggacatcatcgcctgccccggcatggattactgcgcgctggccaccgcccgctcgatcccggtcgcgcaggagatcgccacgcgcttcgatacgctcgatctcgagcatgaggtgggcccgctgaagatcaagatctcgggctgcatcaatgcctgcggtcaccaccatgtcggccatatcggcatcctcggcctcgaccgcgccggcgtcgagaactaccagatcacgctcggcggcgacggcaccgagacggcggccatcggcgagaagaccggcccgggcttcgcctacgacgagatcgtgcccgccgtcgaacggatcgtgcgcgcctatctcgagatccgcagcgagccctccgagacgttcctcgacacgctgcggcgcgtgggccatgcgcccttcaaggcggcgctctatgaggcg

SEQ ID NO: 31586 - DNA, 564 bp, Rhodobacter sphaeroides
tccttcggggccgagtcggtcgtgcttttgcatctcgtctcggtcatcgcgcccgagacgccggtgatcttcatcgacacgcggatgctgtttcaggagacgctcgactatcagcgcgagctggccgacacgctgcacctctgcgacatccgcacgatccgggcgacccagccgcggatcgccttcgaggatccggacgggacgctgaaccgctacaacaccgacgcctgctgcgcggtgcgcaaggtcgagccgctcgaacgggcgctcaagcatttcgatggctggatcaccggccgcaagcgctaccagagcggcacgcgggcggcggtcgagttcttcgaggccgaggacgaccggcgcatcaaggtcaatccgctcgcccactgggggcgcgaggatctggaagactatatcgtcaacaacaacctgccgcgtcatccgctggtcgccaggggctatccctcgatcggctgcgagccctgcacctcgccggtggccgagggagaggatccccgcgcgggccgctggcgcggcagcgccaagaccgaatgcggcatccat

SEQ ID NO: 31587 - DNA, 1500 bp, Rhodobacter sphaeroides
agccagccggtcgtcctgcgcctctccgggatcaccaagcggttcggggcgcttctggccaatgccggcatcagcctctccctctgccggggagaggtcgtggcgcttctgggtgagaacggcgcgggcaagaccacgctgatgaacatcctcttcggccattatgtggccgacgagggcacggtcgaggtcttcggtcagccgctgccgcccggccatccgcgcgcggcgctggccgcgggcgtgggcatggtgcatcagcatttcacgctggccgacaatctgaccgtgctcgagaacatcctgctgggcacggcgccgctctggcggccgagcctcggccgccgcgcggcgcgtgcgcggatcgaggcgctctcgcgcgacttcggccttgcggtccatcccgatgcgcgggtgggcacgctctcggtgggcgagcggcagcgggtcgagatcctgaaggcgctctaccgcgacgcgcggatcctgatcctcgacgagccgaccgcggtcctgactccgcaggagaccgaggcgctgttccgcacgctgaagctcgccgtggcgaaggggctctcgatcatcttcatctcgcataagctgcatgaggtgatgggcgtggccgaccgctgcgtggtgctgcggcacgggcgcgtggtgggcgaggtcgccaccgccgagacggaccggcaccggctggccgcgctgatggtgggcgaggaggtggtgccgcccgcggtcgccccgccgcagccgggccccgtgctgttgcggctcgaccgggtgacgacgccggcccaaggctcggccacgggcctgcgcggcgtgagcctcgatctgcgggcgggcaccatcaccggccttgcgggcgtgtccgggaacgggcaggcggcgctctccgacctcgtttcgggcctcgtgcgcccctccgaggggcgactggaactcgccggcgccgatgtcgcgcactggacgccgcggacggccgttgcctcgggcatcgcgcgcatccccgaggaccggcattccaccggcaccattgccgacttcaccctgaccgagaacgccattctcgagggctaccggtcgcgcttcgcgaaaggcggctggatggactggcgcgcggcccgcggcttcgcccagagcatcatcgccacctatgacgtacgctgccccggccccgagacgcgcatccggcttctgtcgggcggcaacatgcagaagctgatcctcggccgcgtgctcgagcccggcccccggatcatcctcgccaaccagccggtgcggggcctcgacatcggggccatcacctatgtgcattcccgcctgctgaaggcgcgggacgagggggccgcggtcatcctcatctcggaagatctggatgaaatcatggctctgtccgacactgttcatgtcatgtccgaagggcggctctcgcccggcttcgcgcgcggcacgatgagccagaccgagctcggcctctggatggccggccacggg

SEQ ID NO: 31588 - DNA, 909 bp, Rhodobacter sphaeroides
ctggcccctgcaggacgcctcctcgcgcagtcgggcagagaggctttgcctgcggaccacccgctccaggcggcctggcgcagctggaaggatgcgttcctgctgcccgccggccgcatcgtcgacgggccgcagcagaatgcgagccattccgaagggcagggctacggagccacgctcgccgcgatcttcggcgacgaggaggccctgcggcgcatcgtcgactggaccgaggcgaaccttgcgcggcgcgaggacaagcttctgagctggcgctggctgcccggtgtggcgctggccgtgcccgacgagaacaacgccaccgacggcgatctcttctacgcctggggtctcgccatggccgcgcagcggttcggcaaggccgattacgccgggcgggcgaccgaactggcgcgcgccatcgcgctgcattgcgtgcgtccgcatccggacggctccgagcagctcgtgctgctgccgggggccagcggcttcgagacgccggacggggtggtgctcaacccctcctactacatgccccgcgccctgaccgagctcgccgccttcagcggccaggaccggctggcgcgctgtgcccgcgacggggcggactggatcgcgtcgctcgggcttccgccggactgggcgctggtcacgcccttcggcacacagccggcgccgggcctgtcccacaacagcggctacgatgcgctgcgggtgcccctgttcctgctctggtccgggctgaccgccaatcccgcgctgcgccgcgcggtggaggcggccggggacgccgcagccggcgacacgccggtgaggttcgaccgcgacacgggggcggtgctggaacggtccgccgatccgggcttccgcgccgtgctcgcgcttggcgattgcgccctttcgggt

SEQ ID NO: 31589 - DNA, 1392 bp, Rhodobacter sphaeroides
ttgcgcccggcgcggcggcggcggcgctcctgcgcgcgacggaggccgcgtgagcgcaagatccctgcccccacgaggagcccgcccatgaaccgcgatgccatgccgaacgccttccgccccggcgcggtggacctgcccccgcgtgaggcggacctggtcgcccggcggcaggcgcttctggggccggcctaccggctcttttacgagcggcccctccatatcgtgcgcggcgagggcgtctggctctacgacgcggacggcaccgcctatctcgatgcctacaacaacgtggcctcgctcggccattgccatccccgggtggtcgatgcggtggcgcggcaggcggggcaactggcgacccacacgcgctatctgcatgagggcgtgctggagctggccgagcggctgctggcgaccctgcccaccgagctcgggcacgcgatgttcacctgcaccgggtcggaggcgaacgacctggccctgcggctcgccttcgccgccaccggcggcacgggtgtgatcgtgaccgagaacgcctatcacggggtgacgatgggcgtggcggccctctcgccctcgctgggtccgggcgtgccgctcggcgtccatgtccgcaccgtgcctgcccccgaccaggacaagggcgccgatgtgaccttcggcgcggccgtggcggcggcggccgccgatctggcccgccacggcatccggcccgcggcgctgatcctcgacacggtcttctcctccgacggggtcttcacccacccgacggacacgctcgccccggcggcggcggcgatccgcgcggcgggcgggctcttcatcgccgacgaggtgcagcccggattcggccgcaccggcgaggcgatgtggggcttcctgcggcacggggtggtgccggacatggtctcgatgggcaagcccatgggcaatggctatccggtggcggccctcgccctccgcccggagctggccgagcggttcggggccggggcgcgctacttcaacaccttcggcggcaatgccgtggcggcggctgcggcgctcgcggtgctcgacacgctggaggcggaagggctgcaggcccacgccctgaatgtgggcgggcagttccgggcggatctgagcgccctgtccgcccgggatccgcggctgggggccgtgcgcggcgcgggcctctttctcggcgtcgaggtgctcgagcccgagtcgcgcgcgcccgatgcccggatggccgcgcgtatcgtgaacgggctgcgcgaggcccgcgtgctgatctcggccaccggaccgcacggccatgtgctgaagatccgcccgccgctcgtcttctcggacgcgaacgcggccttctttctcgagcggttcgagtcggtgctcgcggccctg

SEQ ID NO: 31590 - DNA, 1221 bp, Rhodobacter sphaeroides
atggactacaatctggcactcgataccgctctgaaccggctccataccgagggccggtaccggaccttcatcgacatcgagcggcgcaagggtgccttcccgaaagccatgtggcgcaagcccgacgggagcgagaaggaaatcaccgtctggtgcggcaacgactatctcggcatgggccagcatccggtggtgctgggggccatgcacgaggcgctggattcgaccggcgccgggtcgggcggcacgcgcaacatctcgggcaccacgctctatcacaagcgcctcgaggccgagctcgccgacctgcacggcaaggaagcggcgctggtcttctcgtcggcctatatcgccaacgacgcgaccctctcgacgctgccgcagctgatcccgggcctcgtcatcgtctcggacaagttgaaccacgcttcgatgatcgagggcatccgccgctcgggcaccgagaagcacatcttcaagcacaatgacctcgacgacctgcgccggatcctgacctcgatcggcaaggaccgtccgatcctcgtggccttcgaatccgtctattcgatggatggcgacttcggccgcatcgaggagatctgcgacatcgccgacgagttcggcgcgctgaaatacatcgacgaggtccatgccgtcggcatgtacggcccccgcggcggcggcgtggccgagcgggacgggctgatggaccggatcgacatcatcaacgggacgctgggcaaggcctatggcgtgttcggcggctatatcgcggcctcgtcaaagatgtgcgacgcggtgcgctcctacgcgccgggcttcatcttctcgacctcgctgccgcccgtcgtggcggccggtgcggcggcctcggtgcgccacctcaagggcgatgtggagctgcgcgagaagcaccagacccaggcccgcatcctgaagatgcgcctcaaggggctcggcctgccgatcatcgaccacggctcgcacatcgtgccggtccatgtgggcgaccccgtgcactgcaagatgatctcggacatgctgctcgagcatttcggcatctatgtccagccgatcaacttcccgaccgtgccgcgcgggaccgagcggctgcgcttcaccccgtcgcccgtgcatgattccggcatgatcgatcacctcgtgaaggccatggacgtgctctggcagcactgtgcgctgaatcgcgccgaggtcgttgcc

SEQ ID NO: 31591 - DNA, 1386 bp, Rhodobacter sphaeroides
gcgaagagcttcgacatgatcgtgatcggcgccggtcccggcggctatgtctgcgcgatccggggggctcagctgggcctgaacgtcgccatcgtcgagcgcgagaacttgggcgggatctgcctgaactggggctgcatccccaccaaggcgatgctgcgctcggccgaggtctaccacctgatgcaccgcgcgaaggagttcggcctgaaggccgagggcatcggctacgatctcggcgcggtggtgaaacggtcgcgcggggtggccaagcagctctcctcgggcgtggcgcatctgatgaagaagaacaggatcacggtcgtcatgggcgatgccacgctggccgggaagggccgcgtctcggtcaggaccgacaagggcacggaagagctcgaggcgaagtccatcgtcctcgccaccggcgcgcgggcgcgcgagctgcccgggctcgaggcggatggcgatctggtctggacctatcgacatgcgctggaaccgaagcggatgccgaagaagctgctcgtgatcggctcgggcgccatcggcatcgaattcgcgagcttcttcaacacgctcggcgccgacacgacggtggtcgaggtgatggagcgcatcctgcccgtggaggatgccgaggtctcggccttcgccaagaagcagttcgtgaagcaggggatgaagatcctcgagaaggcgacggtcaagaagctcgaccgggcgggcggcaaggttacggcccatgtcgagaccggcggcaagaccgagacgatggagttcgacacggtgatctcggccgtggggatcgtgggcaatgtcgaggggctgggcctcgaggccgcgggcgtgaccgtcgaccggagccatgtggtgaccgacgaatattgccggaccggcgtcgaggggctctatgccatcggcgacatcgcgggcgcgccatggctcgcgcacaaggccagccacgagggcgtcatggtggccgagctgatcgcgggcgggcatccgcatccgatcaagccgggctcgatcgcgggctgcacctactgccagccgcaggtggcgagcgtcggcctgaccgaggccaaggcgaaggagaagggctacgagatccgggtcggccgcttccccttcatcggcaacggcaaggccatcgcgctcggcgaggccgagggcttcgtgaagacggtgttcgatgcgaagaccggcgagctgctgggggcgcatatggtgggcgcggaagtgaccgagctgatccagggctatgtcgtgggccgcgcgctggagacgaccgaggcggagctcatggagaccgtcttcccgcatccgacgctctccgagatgatgcatgagtcggtgctcgacgcctacggccgcgcgatccacttc

SEQ ID NO: 31592 - DNA, 1488 bp, Rhodobacter sphaeroides
gaactcagccactggatcgacggcaagcgcgtgaagggcacctccggccgcttcgccgatgtcttcaacccggccaccggcgaggtgcaggcgcgcgtgccgctcgcctcgaaggccgaactcgacgccgccgtggcctcggccgccgccgcccagccgaaatgggccgccaccaacccgcagcgccgcgcccgcgtgatgatggaggtcgtgcgcctcctcaaccgcgacatggacaagctggccgaggcgctctcgcgcgagcacggcaagaccatccccgacgccaagggcgacgtgcagcgcggcctcgaggtgatcgaattctgcatcggcgcgccgcatctgctgaagggcgagttcaccgacagtgcgggccccggcatcgacatgtattcgatgcgccagccgctcggcgtggccgcgggcatcacgcccttcaacttcccggcgatgatcccgctgtggaagatgggccccgcgcttgccgccggcaacgccttcatcctgaagccctccgagcgcgatccgtccgtgccgctgatgctggccgagatcttccaggaggcgggcctgcccgacggcgtcctgcaggtggtgaacggcgacaaggagtcggtcgacgcgatcctcgacaacccgaccattgcggcggtgggcttcgtgggctcgaccccgatcgcggaatatatctattcccgcggctgcgcgaacggcaagcgcgtgcagtgcttcggcggtgccaagaaccacatgatcatcatgccggacgccgacctcgatcaagcggccgatgcgctggtgggcgcgggctacggcgctgccggcgagcgctgcatggcgatctcggtcgccgtcccggtgggcgacgagacggccgatgcgctcatcgagcggctgatcccgcgcatcgagaagctgaaggtcggcccctacaccgcgggcaacgacgtggattacggcccggtcgtgaccgccgccgcgcgcgagaacatcctgcgcctcgtacagtcgggcgtggatcagggcgccaagctggtggtcgacggccgcaacttctcgctccagggctacgagaagggcttcttcgtcggcccgcacctcttcgaccatgtcaggcccgacatggacatctaccgcaaggagatcttcggcccggtcctctcgaccgtccgcgcggcctcctacgaagaggcgctgagccttgccatggatcatgaatacggcaacggcaccgcgatctacacccgcgacggcgacgccgcccgcgacttcgcggcgcgcgtgaatgtggggatgatcgggatcaacgtgccgatcccggtgccgctggcctaccacaccttcggcggctggaagaaatcggccttcggcgacctgaaccagcacggccccgactccttccgcttctacacccggacgaagacgatcacctcgcgctggccctcgggcatcaaggagggctccgccttcaacttcaaggccatg

SEQ ID NO: 31593 - DNA, 987 bp, Rhodobacter sphaeroides
atgaccgtgaaagtggcaatcaacggcttcggccgcatcgggcggaacgtgctccgcgccatcatcgaatcgggccggaccgatatcgaggtggtggcgatcaacgatctcggtccggtcgagaccaacgcgcacctgctgcgcttcgactcggtccacggccgcttccccgccaccgtcaccaccaccgagaagaccatcgacgtgggccgcggcccgatggatgtgaccgcgatccgcaacccggccgaactgccctggggccatgtcgacatcgtgctggaatgcaccggcatcttcaccgacaaggagaaagcgaaggtccacctcgagagcggcgccaagcgcgtgctggtctcggccccctcgacgggcgccgacaagaccatcgtctatggcgtgaaccacgagaccctgaccaaggacgacctcatcgtctcgaacgcctcctgcacgacgaactgcctctcgccggtcgccaaggtgctgaacgacacgatcggcatcaccaagggcttcatgacgacgatccacagctacacgggcgaccagccgacgctcgacacgatgcacaaggatctctaccgcgcccgcgccgcggcgctcagcatgatcccgacctcgaccggcgccgccaaggccgtgggcctcgtgctgccggaactgaagggcaagctcgacggcgtggcgatccgggtgccgacgccgaacgtctcggtggtggacctcgtgttcgaagcctcgcgcgcgaccagcgtcgaggaagtgaacgcggccatccgcgaggctgccgacggcaagctgaagggcatcctcggctataccgaccagcccaacgtctcgatggacttcaaccacgatccgcacagctcgatcttccacctcgaccagaccaaggtcatggaaggcaacatggtgcggatcctcacctggtacgacaacgagtggggcttctcgaaccgcatggccgatacggccgtggccatg

SEQ ID NO: 31594 - DNA, 2013 bp, Rhodobacter sphaeroides
gtggacatacagagcctgcgcgagcagcatcccgatcactggaagaaggcctgcgccatccgcgcgctgacgctcgacgccgtggcagccgccaattccggtcactccggcatgcccatgggcatggccgacgtggccaccgtgctctacgagaagcacatggtgttcgacgcccggtcccccgactggccgaaccgcgaccggttcgtactgtcggccggccacggctccatgctggtctatgcgctcctgcatctcacgggcgatcccgaattcccgatcgagcagatccgcaacttccgccagtggggctcgaagaccgcgggccaccccgagaacttccttgccaagggcatcgagaccaccaccggcccgctcggccaggggcttgcgatgtccgtgggcctcgccatggccgaagagtcgctccgcgcccgctggggcgcgaagatcatcgaccattacacctactgcatcgccggtgacggctgcctgatggagggcgtgagccaggaggcgatcggcctcgccggccgccacgagctctcgcatctcatcgtgatgtgggacaacaacggcatcaccatcgacggcaaggtctcactctcggaccgcaccgaccagaaggcgcgcttcgccgccgcgggctgggacgtgttcgaatgcgacgggcacgatccggccgacatcgaccgcgccctgaccgcggccaaggcgtcgaagggcccggccttcatcgcctgcaccacccatatcgcgctcggatcctcggcgcaggacacgtcgaagggccatggtgcgctgaccgatgccaagctcatcgccgacaccaaggccgcctacggctggacctccgccgccttcgagatcccggccgacgtcaagaaagcctgggaagccatcggcgcccgcggcgccgaggcccgcaaggcctgggacgagcgtctggcagccctctcggatggcaagcgcgccctcttccagcagcagttctcctgcgagccgccgaagaagctcgcctccgccatccgcgcggtgaagaaggatgcggtcgagaagatgccgaaggtcgcgacccgccgcgcctcggaaatggtgctcgaggccgtgaacccggtcatgcccgagaccatcggcggctcggccgaccttaccggctcgaacaacaccaagaccgccgatctcggcgtcttcgatccgatcaaccgcaagggccgctacgtctattacggcatccgcgagcacgggatggccgcggccatgaacggcatggcactgcacggcggcctccggccctacggcggcaccttcatgtgcttcgccgattactgccgtccggcgatccgcctctcggcgctgatgcacatgcccgtggtctatgtcttcacccacgattccatcggtctgggcgaggacggcccgacgcaccagccggtcgagcatctggccatgctgcgcgccacgcccaacatgatggtgttccgcccggccgacctcgtcgagaccgccgaggcctgggagatcgcgctcggcgccaaggccacgccctcggtgctggccctctcgcggcagaacctgcccgcggtgcgcaagaaccacaccaacaagaacctcgtggcgcagggcggctacgtcctcgaagaggccacgggcaagcgtcaggtcatcctgatcgcctcgggctcggaggtcgaggtcgcgctgaaggcccgcgaggcgctcgaggccgacggcatcggcacccgcgtcgtctccatgccctgcatggagctcttcgcgcagcaggacgaggcctaccgccgcaaggtcctgcccgcgggcgcggtccgcatcgccatcgaggcgggtgtgcgcatgggctgggaccgctggcttctgggcgagcgcggccgcgaaggcaaggacggcttcgtcggcatgaccggcttcggcgcctcggccccggccgagcggctgttccaggagttcggcatcacctacgaggcgaccgtggcgaaggccaaagcccttctg

SEQ ID NO: 31595 - DNA, 2232 bp, Rhodobacter sphaeroides
ctcgagcaagccatccacggcgctctggcgcttgcgaatgcccgccgtcatgaactcgccacgctcgagcacctgttgcttgcgctgatcgacgagcccgacgcctcgcgcgtcatgaaggcctgctcggtcgacctcgacgagttgcgcaagacgctcgtcgacttcatcgacgatgatctgtccaccctcgtgacctctgtcgagggctccgaggccgtgccgacggccgccttccagcgcgtgatccagcgcgccgccatccatgtgcaatcctccggccggaccgaggtcacgggcgccaacgtgctcgtcgccatcttcgccgaacgggagtcgaatgccgcctatttcctgcaggagcaggacatgacccgctacgacgcggtcaacttcatcgcgcatggcgtggcgaaggacccgtcctatggcgagccgcgcccggtcaccggcgcggaagagcatcatgagaccccgaaggctgaagctggtgaggcgaaggagtctgcgttgtcgaaatattgcgttgacctgaacgtcaaggcccgcaagggcgacgtcgacccgctcatcggccgcgagcacgaggtcgaacgctgcattcaggttctctgccgccggcggaagaacaacccgctcctggtgggcgacccgggcgtgggcaagacggccatcgccgaagggctcgcgcgcaagatcgtcaacggcgagacgcccgacatcctcgcccgcgccacgatcttctcgctcgacatgggcgcgctgctcgccggcacccgctaccgcggcgatttcgaggagcggctgaaggccgtggtcaaggagatggaggatcaccccgacgcgatcctcttcatcgacgagatccacaccgtgatcggcgccggcgccacctcgggcggcgcgatggatgcctcgaacctgctcaagcccgcgctgcagggcggcaagctgcgctgcatgggctcgaccacctacaaggaatatcgtcagcatttcgagaaggaccgcgcgctcagccgccggttccagaagatcgacgtgaacgagccctcggtcgaggatacggtcaagatcctgatgggcctcaagccctatttcgaggagcatcacgacctgcgctacacgcaggacgcgatccggaccgcggtggaactgtccgcgcgctacatccatgaccgcaagctgccggacaaggcgatcgacgtgatcgacgaggccggcgcggcccagcacctgctggccgacagcaagcggcgcaagactatcggtccgcgtgagatcgaggcggtggtggccaagatcgcccgcatccccccgaagagcgtctcgaaggacgatgccgaagtgctgcgcgacctcgagaagaccctcaagcgggtggtgttcggtcaggaccgggccatcgaggccctgtcctcggccatcaagctggcgcgcgccggcctgcgcgagcccgagaagccgatcggcaactatctcttcgcgggcccgaccggcgtcggcaagaccgaggtggcgaagcagctggcaagcatcctcggcgtggaactgctgcgcttcgacatgtcggaatatatggagaagcacgccgtctcccgactgatcggcgcgcctccgggttacgtcggcttcgatcagggtgggatgctgaccgatggcgtggaccagcatccgcattgcgtgctgctgctcgacgagatcgagaaggcccacccggatgtctacaacatcctgctgcaggtgatggaccacgggaaactcaccgaccacaacggccggtcggtcgatttccgcaacgtgatcctgatcatgacctcgaacgcaggcgcggccgagctggccaagtccgcgatcggcttcggacgcgaccggcgcgagggcgaggatacggccgccatcgagcggaccttcacgcccgagttccgcaaccgtctcgatgcagtcatctccttcgcgcccctcggcaaggagatcatcctgcaggtggtcgagaagttcgtcctccagctcgaggcccagctcatggaccgtggcgtgcatatcgagctctcgccggaagcggcggcctggctcggcgacaagggctacgacgacaagatgggagcgcgcccgctgggccgcgtgatccaggagaacatcaagaagccgctggccgaggaactcctgttcggccggctggtgaagggcggcgtcgtgaaggtcggcgtgaaggacgatacgatcgacctg

SEQ ID NO: 31596 - DNA, 765 bp, Rhodobacter sphaeroides
atgccgctcgaactggtcacggtgccctgtctcagcgacaattacgccttcctcgtccatgatgcggggacgggcgagacgtcggtggtcgacgtgcccgaggcagggccgatcctcaaggcgctcgaggagcgcggctggcacctctcgcagatcctcctcacccaccaccattccgatcatgtggcgggcgtggaggagctgcgggcggccaccggggcacgcgtggcgggcgccgccgccgacgcccatcgcctgcccccgctcgacctcgaactggcggagggcgacctcgtgcgggtgggcgcctccgagggccgggtgatcgaggtgccggggcatacggtgggtcatatcgccttccatttcccagactcgtccctggccttcaccggcgacagcctgatggccatgggctgcgggcgcctcttcgagggcacggcagaggcgatgtggcagagcctgcgcaaactttccgcgctgccgcccgagacgatgatctgttcgggccacgaatatgccgcgtcgaatgcgcggttcgcggccactcttgaacccgacagtccgatgcttatcttccgcgtcggatccattgccgcggcccgaaaagagggccgtcccacagtcccttcacatctttccgacgaaatcgcgacaaatcccttcctccgggccggggaggccagcctgaaggccgccgttggcatggtcgatgcagaggatgccgaggttttcgccgagatccgaaggcggaaggacaaattc

SEQ ID NO: 31597 - DNA, 558 bp, Rhodobacter sphaeroides
gtgtccgaaccggcttcgatttcctctggcattgccgcgcgctacgccgccgctgtcttcgaactggcgaaggacgaaggtgcccttcccgccctcgagaaggacatggatgcgctcggcgcagcctggtccgagagcgccgatctgcgcgatctcgcgacctcgccggtctatgcgcgcgaggagcagcagaaggccatcgccgcggtcgccgcgaagatgggcctctcgacggtgaccgcgaacacgctggccctcatgggctcgaagcgccgtctcttcgtgctgccgcagatggtggccgacgtccagaaccgcatcgcgaccgagaagggcgagatcaccgccgaggtgaccgccgccgcgccgctgagccccgagcaggccgcgcggctcgccgccacgctcaaggcgcgcgcgggcaaggatgtcaaactgaaaaccaccgtcgatgaaagcctcatcggcggtctcgtcgtcaagctgggctcctccatgatcgacacctcggtcaaggcacggctcgcagcactccagaatgcaatgaaagaggtcgga

SEQ ID NO: 31598 - DNA, 1482 bp, Rhodobacter sphaeroides
atccaagctgctgagatctctgcgatcctcaaggagcagatcaagaacttcggccagcaggctgaagtcgccgaagtggggcgcgttctctcggtgggcgacgggattgcccgcgttcatggtctcgacaatgtccaggccggcgagatggtcgagttccccggcggcatccgcggcatggcgctcaacctcgaggtcgacaacgtcggcgtcgtgatcttcggcgacgaccgttcgatcaaggaaggcgacaccgtcaagcgcaccaagtccatcgtggacgtgccggccggtgacgcgctcctcggccgcgtggtcgacggcctcggcaacccgatcgacggcaagggtccgatcgcggcgaccgagcgtcgcgtggccgacgtgaaggccccgggcatcatcccgcgcaagggcgtgcacgagccgatggccaccggcctcaagtcggtcgacgccatgatcccgatcggccgcggccagcgcgagctcatcatcggcgaccgtcagaccggcaagaccgccatcgcgctcgacacgatcctgaaccagaagagctacaacgaagccgccggcgacgacgagagcaagaagctctactgcatctatgtcgccatcggccagaagcgctcgaccgtggcgcagctggtgaagaagctcgaggaaaccggcgccatcgactacacgctcgtcgtggccgccaccgcctcggacccggcgccgatgcagttcctcgccccttatgccgcgaccgcgatggcggaatatttccgcgacaacggccgccacgccctcatcatctacgacgacctctccaagcaggccgtggcctaccgccagatgtcgctgctgctccgccgtccgccggggcgtgaagcctacccgggcgacgtgttctacctccactcgcgcctgctcgagcggtcggcgaagctgaacaaggaccacggcgcgggctcgctgacggctctgccgatcatcgagacgcagggcggcgacgtgtcggccttcatcccgaccaacgtgatctcgatcaccgacggccagatcttcctcgagaccgaactgttctaccagggcatccgcccggccgtgaacaccggcctctcggtgtcgcgcgtgggctcctcggcccagaccgacgcgatgaagtcggtcgcaggcccggtgaagctggaactggcgcagtatcgcgagatggcggccttcgcccagttcggctccgacctcgacgccgccacccagcagctgctgaaccggggcgcccgtctgaccgagctgatgaaacagccgcaatatgcgcccctgaccaacgccgagatcgtctgcgtgatcttcgccggcaccaagggctacctcgacaaggttccggtgaaggacgtcggccgctgggagcagggcctgctcaagcatctgcgcaccaatgccaaggacctgctggcggacatcaccaacaacgaccgcaaggtcaagggtgagctg

SEQ ID NO: 31599 - DNA, 867 bp, Rhodobacter sphaeroides
atgcccagcctcaaggacctgaagaacaggatcggaagcgtcaagaacacgcggaagatcaccaaggccatgcagatggtcgcggcggccaagctccgccgcgcccaggaggctgccgaggccgcccgtccctttgccgagcggatgaccgccgtcatgacgggcctcgcgggctccgtcggctcttccgaaagcgcgccgcgtctccttgcggggaccggcagcgacaaggtgcatctcctcgtggtgatgaccgccgagcgcggcctctgcggcggcttcaactcgtccatcgtccggctggcccgggcgcatgcggcgaagctgctgacgcagggcaagacggtgaagatcctcaccgtcggcaagaaggggcgcgagcagctgcgtcgtgacctcggccagcatttcatcggccatgtggacctctccgaggtcaagcgcatgggctatccggtggcgcaaggcatcgcgcgcgacctgctcgaccgcttcgacaagggcgagttcgacgtggcgacgatcttcttcgcccgcttccagtcggtcatcaaccaggtgccgaccgcgcagcaggtgatccccgccgtgttcgagggcgagggcgaggtcagctcgctctacgactacgaaccgtccgaggaaggcgttctcgccgacctcctgccgcggggcgtggccacgcagatcttcaccgctctgctcgagaacggcgcctccgaacagggtgcccggatgagcgccatggacaatgccacccgcaacgcgggcgacatgatcaaccggctcaccatcgagtataaccggtcgcgccaggccgccatcaccaaagagctcattgaaatcatctcgggcgccgaggcgctc

SEQ ID NO: 31600 - DNA, 1422 bp, Rhodobacter sphaeroides
gcaacagcatcccaaggcaaggtgacgcaggtcatcggcgccgtggtggacgtgcagttcgacggtggcctgccgcccatcctgaacgcgctcgaaaccgagaacaacggcaagcgtctggtcctcgaagtggcccagcacctcggcgagagcaccgtccgcacgatcgccatggacgcgacggaaggtctggtgcgcggcgcccgggtgacggacaccggcagcccgatctcggtgccggtgggtgacgccaccctcggccgcatcctgaacgtgatcggcgagccgatcgacgagaagggcgacctcggcgaggcctcgacccgcgcgatccaccagccggccccgaccttcgccgagcagtcgaccacctcggagatcctcgtcaccggcatcaaggtgatcgaccttctcgcgccctactcgaagggcggcaagatcggcctcttcggcggcgccggcgtgggcaagaccgttctcatcatggagctcatcaacaacatcgccaaggtgcactcgggctactccgtgttcgccggcgtgggtgagcggacccgtgaagggaacgacctctaccacgagatgatcgaatccggggttatcaagatcgacaacctctcggagtcgaaagtggcgctggtctacggccagatgaacgagcctccgggggcgcgtgcccgcgtggcgctgaccggcctcacgctcgccgagcagttccgcgaccagtcggggacggacgtgctgttcttcgtggacaacatcttccgcttcacccaagcgggttcggaagtgtcggcgcttctcggccgtattccttcggccgtgggctaccagccgacgctcgccaccgacatgggcgccctgcaggagcgcatcacctcgacgaaagccggctcgatcacctcggtgcaggcgatctacgttccggccgacgaccttaccgacccggcgccggccacctccttcgcccacctcgacgccacgaccgtgctctcgcgcgcgatctcggaactcgggatctacccggccgtggacccgctcgactccacctcgcggatcctcgatccgcagatcgtcggcgaagagcactacaacgtggcccgtgcggtgcaggggatccttcagcgctacaagtcgctgcaggacatcatcgccatcctcggcatggacgaactgtcggaagaggacaagctgtccgtggcccgcgcccggaagatccagcgcttcctgagccagccgttcgacgtggcgaaggtcttcaccgggtcggacggggtgcaggtcccgctcgagaaaaccattgcctccttcaaggcggtggtgaacggcgagtatgaccacctgccggaagccgccttctacatggtcggcgacatcgaggatgtgatcgccaaggcccagcgtctcgcggcgcaggcggcg

SEQ ID NO: 31601 - DNA, 963 bp, Rhodobacter sphaeroides
atgaacgagccgaagctgatctccggcaatgcgaacctcacgcttgcgaaatccatcgcgcggcgcatgtcggttcatcgcggcatggcggtctcgctggtggatgcgcgcgtcgagcggttcaacgatcaggagatcttcgtcgaggtctacgagaatgtccgcggcgaggacatgtatgtgatccagcccacctcgaacccggccaacgacaatctgatggagctgctcatcatcgccgatgcgctgcgccggtcgtcggcggaccggatcacggccgtgatcccctatttcggctatgcccgtcaggaccgccgcgccaaggcccgcacgccgatctcggccaagctggtggcgaacctgatcgtcgaggcaggcatcgaccgggtgctgaccctcgatctgcacgcggcccagatccagggcttcttcgacattccggtggacaacctctattccgccccggtcttcgcgctcgacatcgagcatcatttcaagggccagttgcaggatctgatggtggtctcgcccgacgtgggcggcgtggcccgcgcccgcgagatcgccaagcggatcaatgctccgctcgccatcgtcgacaagcgccgcgagaagccgggcgaaatcgccgagatgacggtgatcggcaacgtggccggcaagaaatgcatcatcgtcgacgacatctgcgacacggccggcacgctctgcaaggcggccgaagtactgatcgagaatggcgcggtcgaggtccattcctacatcacccacggcgtcctgtcgggtccggcggtggagcgcgtgaccaagtcggtcatgaagagccttgtcatcaccgactcgatcgagccctcggcggctgtgcgcggcgcgccgaacatccgcatcgtgcccaccgcaccgatgttcgcccaggcgatcctcaacatctggagcggcacctccgtctcgtcgctgttcgag

SEQ ID NO: 31602 - DNA, 933 bp, Rhodobacter sphaeroides
atgatcaaggtattcggccacaagtcccccgacaccgactcgaccggctcgcccatcatctgggcctggtatctgaccgaggtgaagggcacccccgccaaggcggtcctcctcggcgagccgaacaccgaagcggccttcgtgctgaagcactgggatctcgagaagcccgagatcatctcggacgtgacggccgacgacagctgcgtgatcgtcgacaccaacaacccggccgagctgccgccctcgatcaacgaggcgaaggtggtgggcatcatcgaccaccacctgctcgtgggcgggatcaagaccaagtcccccatcgagatcaccgtgcgtccgctggcctgcaccgccacgatcatgcacgacctgatgggagaagacctcgcccgcgcgccgcgcggcatcaagggcgccatgctctcctgcatcctctccgacacgctggagttccgctcgcccaccacgacggcgcatgaccgggcagtggccgagaagctggcggccgatctgggcgtcgacatcccggcctttgcggccgagcttttcgccgcgaagtcggatgtctccgccttctccgatgccgagcttctgcgcatggattcgaaggaatacgagatcgagggcaagcagttccgcatctcggtgctcgagaccaccgcgccgcaggtgctgctcgaccgcaaggcgagcctgatggcctcgatgcccggcgtggcgcaggaggatggcgcggatcaggtggtgctcttcatcgtcgacatcctgcgcgaggaagcgacgctgctcgtgccgaacgacctcgtgaagacgctggcggaaaagagcttcggcgcgaccgtcaccggcgataccgtcgtgctgccgggcgtcatgagccggaagaagcagatcattccggtcctcaagctctgaccctgaccggccgcc

SEQ ID NO: 31603 - DNA, 285 bp, Rhodobacter sphaeroides
atggctttcaaaccgctgcatgaccgtgtgctggtccgccgcgtccagagcgacgaaaagaccaagggcggtctgatcatccccgataccgccaaggaaaaaccggctgaaggcgaagtcgtgtcctgcggcgaaggcgcccgcaaggattcgggcgagctcatcgccatgtcggtgaaggcgggcgaccgcgtgctgttcggcaaatggtcgggcaccgaagtcaccatcgacggtgccgagctgctcatcatgaaggaaagcgacatcctggggatcctcagc

SEQ ID NO: 31604 - DNA, 1641 bp, Rhodobacter sphaeroides
atggctgccaaggacgtcaagttcgacaccgatgcccgcgaccgcatgctgcgtggcgtgaacatcctcgccgatgcggtgaaggtcacgctgggcccgaaaggccgcaacgtcgtgatcgacaagtcgttcggcgcgccgcgcatcaccaaggacggtgtgtcggtcgccaaggagatcgaactctccgacaagttcgagaacatgggcgcccagatggtgaaggaagtcgcttcccgcaccaacgacgaggcgggtgacggcaccaccaccgccaccgtgctcgcccaggcgatcatcaaggaaggcctcaaggccgtcgccgccggcatgaacccgatggacctcaagcgcggcatcgacctcgcgacctcgaaagtcgtcgaggcgatcaaggccgccgcccgtccggtgaacgactcgcacgaagtcgctcaggtcggcacgatctcggccaacggcgaagcgcagatcggccgcttcatcgctgacgcgatgcagaaggtcggcaacgagggtgtcatcaccgtcgaagagaacaagggcctcgagaccgaagtcgaagtcgtcgaaggcatgcagttcgaccgcggctacctctcgccctacttcgtcaccaacgccgacaagatgacggccgagctcgacgacgtctacatcctgctccacgagaaaaaactctcgtcgctgcagccgatggtcccgctgctcgaggccgtgatccagtcgcagaagccgctgctgatcatcgccgaggacgtggaaggcgaagccctcgccacgctcgtggtcaacaagctgcgcggtggcctgaagatcgctgccgtcaaggctccgggcttcggtgaccgtcgcaaggccatgctgcaggacatcgcgatcctgaccggcggccaggtgatctcggaagacctcggcatgaagctcgagaatgtcaccatcgacatgctcggccgcgccaagaagatctcgatcaacaaggacaacaccacgatcgtggacggcaacggcgacaaggccgagatcgacgcgcgcgtggcccagatccgcaaccagatcgaggaaacctcgtccgactacgaccgcgagaagctgcaggagcgggtcgcgaaactggcgggcggcgtggccgtcatccgcgtcggcggcatgaccgaagtcgaagtgaaagagcgcaaggaccgcgtcgatgacgccctgaacgcgacccgtgcggccgtgcaggaaggcatcgtcgtcggcggcggcgtggccctgatccagggcggcaaggcgctcgacggcctgaccggcgagaaccccgaccagaacgcgggcatcaccatcgtgcgtcgcgcgctggaagctccgctgcgccagatcgcccagaacgcgggcgtggacggttcggtcgtggccggcaaggtgcgcgagtcgaacgagaagtccttcggcttcaacgcccagaccgaagaatatggcgacatgttcaagttcggcgtgatcgacccggccaaggtggttcgcaccgctctggaagacgcggcctcggtcgcttcgctgctcatcaccaccgaagccatgatcgccgacaagccggagccgaaatctccggccggcggcccgggcatgggcggcatgggcggcatggacggcatgatg

SEQ ID NO: 31605 - DNA, 816 bp, Rhodobacter sphaeroides
gccatgaccgccacgctcgagttccatgacgggagccggatcccgcaactcggcttcggcctctggcaggtgccggaggatcggacggccgaggtggtgcgcgaggcgctggagctgggctaccggctggccgacggcgccgcgatctacggcaacgaggagggtctgggccacggcctcaggacctcgggcctgccccgcgacaaggtcttcgtcaccacgaaggtctggaacgatgcgcagggcttcgagtccgccctgcgggcggtggaggagagcctcaagcggcttgggctcgaccggctcgacctctgcctgatccactggcccgcgccgaagcggaacctctatgtcgagacatggcgcgcgctcatccggctgcgcgacgagggacggatcacctcgatcggtgtctcgaacttcgatctggaccagatcgaccggctgaccgccgagaccggcgtgacgccggtgctgaaccagatcgagctgcatccgatgctgcagcaggccgagctgcgcgcgggccatgccgagcgcggcatcgtcacccagagctggagcccgctcggccgcggcatggccttcgagacgccggccatccgcgagatcgccgagcggacgggccgcagcccggcgcaggtggtattgcgctggcacatcgagctcggctgcgcggtgatcccgcgctcgacccggcgcgcggggctggccgagaacctcgccctcttcgatttcgaactgaccgaggccgatcacgcggcgatctccgccctcgatgcgggcacgcgcaccggtcccgatccgcagagcttc

SEQ ID NO: 31606 - DNA, 1131 bp, Rhodobacter sphaeroides
gcgaactggtcctatccgactgccgtgaagttcggcgcgggccgcatcgcggaactggccgagcagtgcaaggctgtcgggctgaagaagccgctcctcgtgacggacaaggctctggccgcgctgccgatcacggcggcggcgctcgaccagctggaggcggcgggtctcgggcgcgcctgcttctccgacgtcgatccgaacccgaacgagaagaacatggaagcgggcatcgcggtctacaaggcgggcggccatgacggggtgatctgcttcggcggcggctcggcgctggacctcggcaagatgatcgcgctgatgcacgatcagaccgtctcggtctgggatctcgaggatatcggcgactggtggacccgggccgacgccgcgaagatcgcgccgatcctcgcggtgccgaccacggccggcaccggctcggaagtgggccgagcgggtgtgctgaccaactccgagacgcacaagaagaagatcatcttccatccgaaacttctgcccgcggtcacgatctgcgaccccgagctgacggtggggatgccgaaattcatcaccgcgggcaccggcatggatgcgctggcccactgtctcgaggcctattgctcgcccttctaccatccgatgagccagggcatcgcgctggaagggatgcggcttgtgttcgagaacctgccgaaggtctatgccacgccgggcgacctcgaagcgcgcgcccacatgatgagcgcggccgcgatgggggcggtggccttccagaagggcctcggcgccatccattcgctgagccatccggtgggcgcggtctacaacacccaccacggcacgacgaacgccgtggtcatgcccatggtgctcgacttcaaccggcccgccatcgaggagaagatcgaacgggcggcagcctatcttggaatcgagggcggcttcgacggcttccgggcgaagatcatggcgctccgggccgagcttgcgatccccgagaccctctcggccatgggcgtcgaggcctcgcggctcgacgagctgaccgagatggcgctggaagatccgtcctgcggcggcaacccggtcgagatgacgcgcgagaacacccgcgcgctcttcgaggcctgcctc

SEQ ID NO: 31607 - DNA, 1380 bp, Rhodobacter sphaeroides
gggaacatcatgacgaaaccgatccagctgatctcgcccgtcgacgggcgggtctatgccgagcggatgccgctctcgatggccgatgccaaggcgatggcccgccgggcgcgggccgcacagcccgcatgggccgcacgccctctggaagagcgcatcgcgctggtcaaggccggtgtggcgaagctgaacgagatgaaggacctcgtggtcgaggaactggcctggcagatgggccgtcccacccgcttcggcggcgagttcggcggcgtgaacgaccgcacctcctacatggcggagatcgccgccgagacgctggcgccgaccgtggtcgaggcctcggaccggttcgagcgccgcatcgtgcgggaagccgtgggcgtggtgctgatcgtggcgccctggaactacccttacctcaccaccatcaacacgctggtgccggcgctgatcgcgggcaacagcgtggttctgaaacatgcgagccagacgcttctcgtgggcgaacggctggcggacgccttccatgcggcgggcgtgccggaggatgtgttccagaatgtcgtgctggatcacggcaccaccgaggcgctgatcggcgcgcgggccttcaacttcgtgaacttcaccggctccgtctcgggcggctatgccatcgagcgcgcggcggcgggcaccttcaccgcgaccgggctcgagcttggcggcaaggacccggggtatgtccgggcggatgcggatctcgatgcggcggtcgacagcctgatggacggcgcgatgttcaacgcgggccagtgctgctgcgggatcgagcggatctatgtccacgagagcctctacgatgccttcgtcgagaaggcggtcgcctgggtcaaggcgctgaagctcggcaatccgttcgagcccgagacgacgctcgggccgatggcgaatgtccgcttcgcgcgcgtcgtgcgcgagcaggtggccgaggcggtggccgccggcgccaagccgctgatcgaccccgccctcttcccggccgatgacggcggcgcctatctcgcgccgcagatcctcgtgaacgtcacccacgacatgcgggtgatgaaggaagagagcttcggccccgtggtgggcatcatgaaggtctcgggcgacgaggaggcgatcggcctcatgaacgacagcccctatggcctgacctgctcgctctggaccgaggacgccgaagccgcggccgagatcggcgcgcggctcgagaccggcaccgtctacatgaaccgctgcgactatctcgatcccgccctctgctggacgggctgcaaggacaccggacggggcgccgcgctctccgctctgggctacatgtcggtcacgcggccgaaatcctaccatctc

SEQ ID NO: 31608 - DNA, 1347 bp, Rhodobacter sphaeroides
ctgaaggcgcgggtggcggaggttccgctcggccccgagatcgaggagaccggccgcatcgccacgctggccgacgggctcgtagaggtcgagggcctgcccggcgcgcggctgggcgaggtggtgcgtttcgcgggcggcgccgaggggctggtgctgaccctcgatcccgagacggtgcaggtggcgctgctcgatcccggcgcggccctgggctcgggcaccgaggtgcgccgcaccgggcagctcctgtcggtgccggtgggccaggggcttctgggccgcgtcgtcgatccgctcggccgcccgctcgacggactgcccgcgatcctgcccgaggccaggctcgagatcgagcgcccggcccccggcatcgtcgaccgcgacatggtggccgagccggtggagacgggccttctggtggtggatgcgctctttgccgtgggccgcgggcagcgcgagctcatcatcggcgagcgtgcgacgggcaagacctccctcgcggtcgatgccatcgtgaaccaggccgcgagcgacatcgtctgcttctatgtggccatcggccagcgcacgacggccgtccgccgggtgatcgagaccgtgcgcgagaagggggccttcgcgcgcacggtcttcgtggtggcgcccgcgacggcttcgcccggcctgcgctggatcgcccccttcgccgcgacctccatggccgaatgggtgcgtgaccggggcgggcatgcgctgatcgtctatgacgatctgaccaaacatgcggccgtccaccgcgagctggcgctgctcgcgcgccagccgccggggcgcgaggcctatccgggcgacatcttctacctccatgcgcggcttctggagcgctcggcaaagttgtcggctgtcaacgggggcggctcgctcaccgcgctgcccatcgccgagatcgaggcgggcaacctctcggcctatatccccaccaacctgatctcgatcgccgatggccagatcgtgacctcggctgcgctctttgccgccaaccagcgccccgcggtggatatcggcctgtcggtcagccgcgtgggcggcaaggcgcagcggggcgcgctgaaggcggtggcggggcgggtgcggctcgattatgcgcaatatctcgagatgaagatgttctcgcgcttcggcggcttcggcgatgcggccctgcgcgcgcgtctggcgcgcggagagcggatcggcgcgcttctcgcccagccgcgcacgaccccgctctcgaccccggtgcaggtggcgctgctggctgcgctggccgagggcgcgctcgacgatgtgccgctcgaggatctggcccggctcaaggccgcgctc

SEQ ID NO: 31609 - DNA, 1389 bp, Rhodobacter sphaeroides
atggccgatttcatcgtcaaggatctatcgctcgccgacttcgggcgcaaggaactggacatcgccgaaaccgagatgccgggcctgatggctctgcgcgaggagttcggcgcctccaaacccctcaagggggcgcgcatcgcgggctcgctgcacatgaccgtccagaccgcggtgctgatcgagacgctggtggcgctcggcgccgatgtccgctgggcctcgtgcaacatcttctcgacccaggaccatgcggcggccgccatcgccgcctcgggcgttccggtcttcgcgatcaagggcgagacgctcgaggactactgggcctataccgacaagatcttccagttcgccgacggcacctgcaacatgatcctcgacgacggcggggacgccacgctctacatcctgctcggcgcgcgggtcgaggcgggcgagaccgacctcatcgccgtgccgcagtcggatgaggaggtctgcctcttcaaccagatccgcaagcgaatggccgagacgcccggctggttcacgaagcagcgcgacgcgatcaagggcgtctcggaagagaccaccacgggcgtccaccgcctctacgacctgcacaagaagggcctgctgcccttcccggcgatcaacgtgaacgacagcgtcaccaagtcgaagttcgacaacaagtacggctgcaaggaatcgctcgtggacggcatccgccgcgcgaccgacgtgatgatggcgggcaaggtcgccgtggtctgcggctatggcgacgtgggcaagggctcggccgccagcctgcggggcgccggcgcccgcgtgaaggtgaccgaagtcgatccgatctgcgcgctgcaggcggccatggacgggttcgaggtcgtggtgctcgaggatgtggtgcaggacgccgacatcttcatcaccaccaccggcaaccgcgacgtgatccgcatcgagcacatgcgcgagatgaaggacatggcgatcgtcggcaacatcggccatttcgacaatgagatccaggtcgccgcgctgaagaaccacaaatggaccaacatcaaggaccaggtggacatgatcgagatgccctcgggcagccggatcatcctgctgtccgaggggcggctcctgaatctcggcaatgcaaccggccacccgtccttcgtgatgtcggcctccttcaccaaccaggtgctggcgcagatcgagctctggaccaagggcgcggactaccagccgggcgtctatatcctgcccaaggcgctcgacgagaaggtggcgcggctgcatctgaagaagatcggcgtgaaactgaccgagctgcgccccgagcaggccgactatatcggcgtgaaggtcgaggggccgttcaaggccgagcattaccgctac

SEQ ID NO: 31610 - DNA, 1398 bp, Rhodobacter sphaeroides
tacatcaacgggggctggaccgctccggccgaggcgcgggactgcgaggtcatcgacccgtcgacggaagaggcctgcgcggtgatctcgctcggcgatcaggcggatacggatgcggcggtggccgcggcgaaagccgccttcgagggctgggccgccacgccgcccgccgagcggctgcgcctcgtgaagggcatcctcgcgcaatatgaggcgcgcaaggaagagatggcgcaggcgatcagcctcgagatgggggcgcccatcgaccttgcgcggaacagtcaggcgccctgcctgccgtggcacctgacgaacttcctcaaggccttcgaggagatcgaatgggtgcgcccgctcggcccgcatgcgccgaacgaccggatcgcgctcgagccgatcggcgtggtgggcctcatcacgccctggaactggccgatgaatcaggtgacgctgaaggtcatcccggcgctgctcgcgggctgcacctgcgtgctgaaaccctcggaggaggcgccgctctcctcgctcctcttcgccgaattcgtccatgatgcaggcctgcccgcgggcgtcttcaacctcgtgaacggcgacggcgctggcgtgggcacgcagctctcctcgcacccggatgtcgagatgatctccttcaccggctcgacccgcgcgggccgcgcgatctcgaaggctgcggccgagtcgctcaagcgcgtgacgctggagctcggcggcaagggcgcgaacctgatcttcgccgatgccgacgagcgcgcggtcgagcggggcgtgaagcactgtttcaacaactcgggccagagctgcaacgccccgacccggatgctggtcgagcggccactctatgatcgcgccgtcgagatcgcggccgaggtggcggcgaagacccgcgtggcctcggcgcatgaggaagggccccatatcgggccggtggtgaacaagcgccagttcgagcagatccagtcctacatccagaagggcatcgacgagggcgcccggctggtggcgggcggccttggccgacccgacgggctcaatcgcggcttcttcgtgcggcccaccgtctttgccgacgtgacccccggcatgaccatcgagcgagaggagatcttcgggccggtcctgtcgatcctgccgttcgagaccgaggaagaggcggtgcggatcgccaacgacacgccctacggcctgacgaactatgtccagagcgaggacggggcgcggcgcaaccgccttgcccgccgcctccgctcgggcatggtcgagatgaacggcaagtcgcgcggcgcgggcgccccgttcggcggcgtcaaggcctcgggccgggcgcgcgagggcggcgtctggggcatcgaggaattcctcgaggtcaaggccatc

SEQ ID NO: 31611 - DNA, 1266 bp, Rhodobacter sphaeroides
ggcagatacatgacccaaactgatattgccgcgccgctggccgcggcgcttgccgccaagggctacgagtccctcactccggttcaggaggcggtgctcgccgaaggcgtggccgggcgcgatgcgctcgtctcggcccagaccggctcgggcaagaccgtggccttcggcatcgccatcgccgaccagatcctgcagggggccgaccggctcctgttcgcggacacgccgatcgcgctcgccatcgcgcccacccgcgagctggcgcttcaagtcgcccgcgagctgggctggctctatggcgaggccggcgcccatatcgccacctgcgtgggcggcatggactaccgcaccgagcggcgcgcgctcgaccgcggcgcccatatcgtcgtgggcacccccggccgcctgcgcgaccatatcgagcgcggctcgctcgacctctccggcctgcgcgccgtggtgctggacgaggccgacgagatgctcgacctcggcttccgcgaggatctggagttcatcctgggctcggccccggaagagcggcgcacgctgatgttctcggccaccgtgccgaaggagatcgaggcgctcgccaaggaattccagcaggacgccgtccgcatccagaccgcgggcgagcgcaagcagcatgccgacatcgaatatcgcgccctgaccgtcagcgcgcgcgacaaggaacatgcgatcttcaacgtgctgcgcttctacgaggcgccctcggccatcgtcttctgcaagacgcggctagcggtgaaccatctgctcgcgcggatgggcaaccgcggctttcaggtcgtggcgctctcgggcgaactctcgcagcaggagcggacccatgcgctgcaggcgctgcgcgacgggcgcgcccgggtctgtatcgcgaccgacgtggccgcgcgcggcatcgaccttccggggctcgagctcgtgatccacgccgatctgcccaccaactccgagacgctgctccaccgctcgggccggaccggccgtgctggctccaagggcgtgtcggtgctgatcgcggcgccgtccgaagtgcgcaaggcgcagcggcttctgaccggcgcgaagctcgtggccgactggggcaagccgccatcggccgacgaggtgcaggagcgcgacgacgcgcggctgctcgagcatccggtgctggggcaggatctgtccgacgagatgccgctggccgagaagctgctcgaacggttcggcccggcgcagatgtcggcggccttcgtc

SEQ ID NO: 31612 - DNA, 756 bp, Rhodobacter sphaeroides
accctgatcgccgtgggcgacaattgtctcgatgtctatctgtcgaaggaccgcatggcggtggggggcaatgccctcaacgtggcggtgcaatggatgcgcgcgggcctgaagacgcgctacttcggccttgtcggccccgaccccgagggcgatgtggtccgcaccgccctctgccgcgcggggctcgatcccgacgattgcgaggtgcgcccgggcagcaccgccgtcacgcttctcctcgaacgcgacggcgaccggcgcttcctgctcgaggatctgggcgtggggctgggctatgtgcccgagggcgcgcgttacgcggcgctgcgggccgccgactgggtgcatctgggcacccacagcgcacccgaactggtgcgcgccctcgtccgcgacggcgcgcgcttttcggtcgatgtctcgacgcatcacgatctcctcgatctcgagggcgtgccgctcgtcttcgcctcggggcccgaggatccgtccgagcgggtcgagccgctgctcgcccgcttccgcgagcgcggcgcgcaggccaccgtcgtgacctgcggcagccgcggtgccttcctcgaggcgggcggcaccgtcacgcccgttcgcgcgcggcgggtcgaggtggtggacacctgcggcgcgggcgacagcttcatcgcgcgcttcatcgcgctctgggccatcgagcgccgcgccgatgccgaggccctgcgcggggcggcggatgcggccaccaacacctgcctgcac

SEQ ID NO: 31613 - DNA, 1323 bp, Rhodobacter sphaeroides
ttcgacgccccggcgctggagcggatgtgcgcgctgaacgaggcccatgccgcgatgctggccgcccgcgggctgatcccggccgattgcgcgcgcgacatcctgcgcggcatcgcgcagatccgcgccgagggccccgccgccatcgacctcgatccgcagttcgaggacagctatttcgccttcgagaaccggctcgggcaggtggcgggcaaggcggtggcgggctggctccatgtcgggcgcagccgcaacgacatcggctcgaccctcgaccggatggccgcgcgcgagacctgccttgcgcttctggccgcgatggaagaggcccgccgcgcctgtctcgcggcggccgggcgccatgtgctgaccgtgatgccgggctacacccacctccagcccgcgcagcccatcaccttcggctattatctcgccaacgtcgcccgcgggatggagcgcgagcatgagcggctcgcggcggtgctcgaccggctcgacgcctgcccgctcgggtcggcggcgctggccggcacctcctttgccatcaaccgcgacgagacggcggaccttctgggctttgccggaccggccgcaccggggctcgatgccgtggcctcgcgcgatttcgtgaccgagcttctctgggccgtcaccagcgcgcaggtgctgttctcgcgcgtggcgcaggatctctatgtcttcaccacctgggagttcggcgcgctgaccttccccgaccgggtggcgggcacgtcctcgatcatgccgcagaagaagaacatgctgccgctcgaatattttcgggccgaggccgggcgcagcatcggggcgctggcgggcgctctcgcggcggtgaaggggtcgaactattccatcgggctcgacagcgtgcgcgagggggtggccgacgcctggcccgccttcgcccggttcgaggcgggcctctcgctgctgcggctgatcttcgagacggccacgccggatgccgaaaagctgctggcgcgctgcaaggccaatttctcgaccgcgacggatctcgccgacgggctcgtgcgcgatttcggcatctcgttccgcgacgcccatcatgtggtggggcgcgcggtgcagatggtgctggccgcgggcggcggcgccgaggagctgacggtcgcggtgctgaacgaggcggccgaagccgagatcggccgcagcttcgatctgcccgaagagcggctcaggcgctggatggatccggtcgaggcggtgcgggcgcgcaccgtgccgggcggcaccgcgcccgaggtggtctcggcccttctcgccgagatggaggcccgcctt

SEQ ID NO: 31614 - DNA, 735 bp, Rhodobacter sphaeroides
ttcgacctgacgggtcgggtcgccgtcgtcaccggggccggtcgcggcctcggcgcggcgatggccgaggcgctggccgccgcgggcgccacggtcgtgctctcggggcgcgatccgggcccgctcgaacgcaccgccgcggccatccgcgcggcgggcggcgcggcctcggtcacgctctgcgacataacgaagcgcgccgaggtcgaggctctggtggcggagaccgaagcgcgtcacggccgcctcgacgtgctcgtgaacaatgcgggcatcaccgggcgctcggcgctgaccgaggtcgaggatgccgactgggatctgatgctccgcacccacatgaccggccccttcatggcctgccgcgcggcgctgcccggcatgatgcggcgcggcgcgggcaagatcgtcaacaccgtctcggtgctgggagagctcggccggccctgggtggtgccctatgcggcggccaagggcgggctgcggatgctgacgcgggcccttgccaccgaggtggcgggcgccaacattcaggtcaacggcatcggcccgggctatttcgagaccgagatgaatgcggccatcgtccagaacgaggcgctccatgccgagcgcgtggcccgcgtgcccgcccggcgctggggccgccctgtcgaactcggcggaaccgcggtctatctcgcctcggcggcgtccgattacgtcaacgggcagatcatctatgtcgacggcggc

SEQ ID NO: 31615 - DNA, 717 bp, Rhodobacter sphaeroides
ctggcaggccgcaagatcgtcatcaccggagcaggctcgggcatcggccgcgagtccgcgcgccagttcgcgcgcgagggggcgacgctggcgctgatcgaccgcgacgaggcggcggcgcaggtgacggcggacgagacggggggccatgtcttcgcgctcgacgtgaccgacgaggcggcggtcgaaaccgtcgtgggccgcgcggcggaggcgctcggcggcatcgacgggctgctcaattcggcgggcatcctgaccatgaagaccgtggacgatatcggcgtcgaggagttccgccgggtggtggatgtgaacctgacggggaccttcctcgtctgtcaggcggcgctgccgtggctgcgcaaggagccgaaggccgccatcgtcaacatcgcctcggcgcaggcgctgctgccctcgctgaccggctcggcctatgccgcctcgaaggccgcggtgatgatgttctcgaagagcatcgccaaggaacttgccccggcggtgcgggtgaacatcatctgcccgggggccaccgagacgccgatgaccgatcagggcgtggcgcccgacgatgtggcgggccgcaaggcgctggccgcggtctatgcgatgaaccgtctggcccagcccgaggagatcgcggcgggcatcctgttcctgatgtcggacgaggccgcggccatcacgggcgtcgcgctggcgatcgacaacggc

SEQ ID NO: 31616 - DNA, 801 bp, Rhodobacter sphaeroides
atgtcggtgggagtgattggaaccggcttcgtcggccggggctgggcgatctgccttgcccgggccggccacgaggtccggctgtgggatccggcgcccgacgccgccgaggccgcccgcacctatatcgccgagatgctgccggatctggcggccgcggacctgctgggcggccgcgccccggacgcggtgctggagcggatccgcgtcgccccggacatggccaccgccgtccgcggcgcccgccacattcaggaaagcgcccccgaggatctgcttctgaagaccgcgctcttcgccgagctcgacgctctggccgatcccggcgcggtgatcgcaagctcctcctcggcgcttctgccttcggccttcaccgaggggctggcaggggcgggccgctgcctcgtcgcccatccggtcaatccgccgcacctcattccgctggtcgagctggtgccggcgccgtggaccgacgaggagacgctggcccggaccgagacgctcatgcgcgagatcggccagagcccggtgcggctcgagcgcgaggtggacggcttcctgctgaaccggatccaggccgcggtgctcgacgaggccttccggctggtcgatgcgggcctcgcctcggccgatgcggtggatgcctgcctccgcgacggtctggcgctgcgctgggtcttcatggggccgttcgagaccatcgacctcaacgcgcccgagggcgtgcgcgactatgtcgcccgctaccagccgatgttccgcaggctcaccgacacgatgcgggaaagcgccgactggtcc

SEQ ID NO: 31617 - DNA, 762 bp, Rhodobacter sphaeroides
gacctgaccggaaagaccgccctcatcaccgcgggcgcaggaggcatcggcctcgccatcgcccgccgcttcgcggatctgggcgcgcagctctgcctctgcgacatctccgagacggccatcgccgaggcgcaggcgctgttgcccgaggcgctgatcctgcgggccgacgtcgcgcgctcggccgatgtgcaggaggtggtggaccgtctggtcgagcggttcggcgggctcgacatcctcgtcaacaatgccggcgtctcggggcccacccggcccgtggacgagatcaccgacgccgaatggaacgacacgctcgccgtcaacatcacggcgatgttctacatggtgcgggccgccgtgccgctcttccgtgcggcgggcgggggcgcggtcatcaacatgggctcggtcgcgggccgcgtggggatgccgctgcgcctgccctattcggtgtcgaaatatgccgtgcgcggcctgaccgagacgctcgccatcgagctgggcgagatcggcgtgcgggtcaatgcgatcctgccggggctggtcgacggcccgcgcggccggcgcatcatcgccgagcaggcgcgggagcgcggcctctcgcccgaggactacacccgtctcttcctgcacaatatctcgatgcattcgatggtgcagatggaagaggtggccgacatggcggccttcctcgcttcggatctcgcgccgcatgtctcgggccagatgatcggcgtctgcggcaatttcgagagctac

SEQ ID NO: 31618 - DNA, 1182 bp, Rhodobacter sphaeroides
atgcgcgcactcacctggcacggaaagcacgatgtccgcgtcgagacccatcccgaccccgagatcgtcaatccgcgcgacgcgatcatcgaggtgacggccacggcgatctgcggctcggatctgcatctctacgacggggtgatcccggggctgatgtcgggcgacatcctcgggcacgagttcatgggccgcgtcgtcgagaccgggccgaaaagcacgctgaagaagggccagcgggtcgtggtgcccttcacgatctcctgcgggcagtgcttcttctgcgagcatcagctcttttccgcctgcgacaattccaaccccgcggagaagcaggacctgtccgagccgctctatggccatgcggtgtcggggctgttcggctattcgcatctgacgggcggctatccgggcgggcaggcggaatatgtgcgtgtgccctattcggacgtgggaccgatcgtgatcccggacgggctcgaggacgagcaggtgctgttcctgtctgacattctcccgacgggctggatggccgccgagaatgccgggatcgaggagggcgacacggtcgccgtctggggctgcggcccggtcggcctcttcgcgatccagtcggccctgctgatgggggcgggcaaggtcattgccatcgacgaatatcccaagcggctggcgctggcgcgcaggctcggggccgaggtgatcgacttccggcgcacgaaggtgctcgaggcgctgatggagatgtcggggggcctcggccccgatgcggtgatcgatgccgtggggatggaggcgcatggcttcatgcccgacacgctgatggacaacatgaagcagcgcgtggggatcggcgcggacagcggccacgcgctgcgcgaggcgatccttgcggtgcgcaagggcggccgcgtctcggtgcccggcgtctacggcggcttcctcgacaagtttccgctcggcgcgctgatggagaagggcctgaccgtgaagaccggccagacccatgtgcagcgatacaccgaggagcttctgcgccggatcggcgagggcgagatcgacacgaccttcctgatctcgcaccgcctgccgctcgaggaggcggcgcggggctacgagaacttccgcttcaaccagaacgagtggaccaaggtggtgctgaagccgggcctgaccggcgcc

SEQ ID NO: 31619 - DNA, 846 bp, Rhodobacter sphaeroides
ttcgagggaatctacacgcccgtcatcacgccgcaccgcgaggatggcgccatcgaccgcgacgccttcgccgcggcgatcgagcaactgatcgccgcaggcgtccacggcctcatcaatggcggatcgacgggcgaatattacgcccagtcgatggaggagcgcgccggaatggccagcctcgcccgcgaggtgatcggcgaccgcgtgccgctgatcgtgggcacggtggcgatccggctcgaggattccctgcgcatggccgaacatgcggcaaagatcggcgcggcggcgatcctcgtgggctcgcccccctatgcggtgccgaccgagcgcgagaatgcgctgaacgcgctggccatcgaccgcgcggccgatctgccggtgatgctctacaactaccccgggcgcatgggcgtgacgatgggtgcggaattcctcgaccgcgtcggccggtcgcgcaacttctgcgccatcaaggagagctcgggagacatcaaccgcgtccatcttctggcgcgcgattatccccacatccagatgtcctgcggcatggacgatcaggcgctcgaattcttcgcctggggcgcgcgctcgtgggtctgcggcggctcgaacttcctgcccgccgagcatctggcgctctggcaggcctgcgccgtcgagggcgatttcgccaagggccgccggatcatgtcggcgctgctgccgctgatgcgggtgctcgagcagggcggcaagttcgtgcagtgcatcaagcacggctgcgagatggcgggcctgcgcgcaggccccccgcgcccgccgctgaagcccctgaccaaggaggacaagcgcgagctggag

SEQ ID NO: 31620 - DNA, 1482 bp, Rhodobacter sphaeroides
agatcgccgcggaggcctgagatgacccttctgaccaccgaggattacaaggccatcgcggcgggcctcacgctgcccaccggcgccttcatcgacggccgcttccggcccgcgcagtcgggcgccaccttcgagacgcgcaaccccgccaccgggcagctgctggccgaggtcgcggcctgcggcccggccgacgtcgatctggccgtgcagaaggcccgcgacgccttcgaggacggccgctggtcgcggctgccgccccgcgcgcgcaaggaggtgctgatccgcctggccaagctcctcaagcgccatgcccgcgagcttgcggtgatggagagcctcgacagcggcaagaccatctacgactgcgagacggtggacctgcccgagacgatccactgtctcacctggcatgccgagctgatcgacaagatctacgaccagaccgcacccgcctcggacgaccatctggccctcgtgctgcgcgagccggtgggggtggtgggcctcgtgctgccgtggaacttcccgctgctgatgctcgcctggaagatcggcccggcgctggccgcgggctgctcggtgatcgtgaagccggccgaggagacgccgctcaccgcgctccgggtggccgagctggcgacggaggcgggcgtgccgccgggcgtcttcaacgtcctgcccggccacggccccgaagtgggcgagcccatcggccggcacatggacatcgacgccgtctccttcaccggctcgaccgaaacgggccggcgcttcctgcgctatgccgccgagtcgaacctcaaggaggtcacgctcgagatgggcggcaagaatccggcggtggtgctcgacgatgccgagaacctcgaccgggtggccgcgcatgtcgtgaccggcgccttctggaacatgggcgagaactgctcggccgcctcgcggctgatcgtgcagagcggggtgaaggaggcgctgatcgcgcggatcctcgcccatgcccgcgaatggccgatgggcgatccgctcgaccccgcgaaccgggtgggggcgctggtctcgcccgcgcatctggacaaggtccgctcctatctcgccgaggggccgacggtgctgctggggggcaaggcccatggcgccttcgtcgagcccacgatcctcgagatcaccgaccgcgaggccgcgcccgcgcgcgaggagatcttcggcccggtgctctcggtcctgacggtcgagagcttcgacgaggccatcgcgctggccaacgacacgccctacgggctcgcggcctcgatcttcaccgcgaacgtgaagaaggccctgcgcggcgcgcgggcgctccgggcgggcacggtgacggtgaacagcttcggcgagggcgacatcaccacccccttcggcggcttccgccagtcgggcttcggcgggcgcgacaacggcatccacgcccacgatcaatatacccagctgaagaccatctggatc

SEQ ID NO: 31621 - DNA, 690 bp, Rhodobacter sphaeroides
cgggtcgcgctcgtcaccggcgggggccgcggcatcgggcaggccatcgcccggcgcctcgcctcggacggggcgcgggtcttcacggcgcagcgcggcgcggacgccgggttcgaggccatcgcggccgacttcgccgatgcggacgcgcccgcccgcgctgtggccgaggcggtggatcgggcggggcggctcgacgtcttggtgaacaatgcgggcgtgatgcaggaggcgcgggtcgaggagatggcgctggccgactgggagcgcacgatccgcgtgaacctgaccgcgccgttccttgcgatccgggcggcgctgccgcatctgcgggccgtgcggggcgccatcgtcaatgtgggctccatcgaggggctgggggcgaacccgcgccatgccgcctattgcgcctcgaaggcggggctgcacgggctgacgcgggcggtggccgtcgatcatggcgcggagggcatccgctgcaacgcggtcgcgccgggctggatcgagacggagctgaacgaggccttcgtggaagcgatgcccgaccccgaggccttccggcgcgggatcggccgcatccatcccgtgggccgcacgggccagcccgaggaggtcgcggcgctggtggcctggctcgcctcggacgaggcggccttcgtgaccgggcaggtctggaccgtcgacggaggg

SEQ ID NO: 31622 - DNA, 702 bp, Rhodobacter sphaeroides
aaggtggcgctggtgaccggtgccgcgggtggtatcggcggcgcggtggtgacggcgctccgtgccgcgggtgcgcgcgtggcggtggccgaccgcgcggtggcggggatcgcggccgatctgcatctgccgggcgacctgcgcgaggcggcttacgcggacgggctgccgggcgcggtggcggcggggctgggccggctcgacatcgtggtgaacaatgcgggcgtcatctcccgcggcaggatcaccgagacgacggatgccgactggtcgctctcgctcggcgtcaatgtcgaggccccgttccgcatctgccgcgcggcgatcccgctgatggcggcggcgggcggcggcgccatcgtcaatgtggcctcctgctgggggctgcggccggggccgggccatgcgctctactgcctgacgaaggccgcgctcgcctcgctcacgcaatgcatggggatggaccatgcgcctcagggcatccgcatcaacgcggtctgcccgaacgaggtgaacacgccgatgctgcgcacgggcttcgcgaagcgcggcttcgacccggatcgggcggtggcggagctgggccgcaccgtgcctctgggccgcatcgccgagcccgaggacattgccgatgtggtgctgttcctcgcctcggatgccgcgcgctacctctgcggctctctcgtcgaggtcaatggcggg

SEQ ID NO: 31623 - DNA, 855 bp, Rhodobacter sphaeroides
gttcgggtggcctgcgtcggcggggcggtgctggatcgggtctacgaggtcgcggcgctgcccggcaccgacggcaagtcccgcgcctcctcctaccgcgagttcggcggcgggatggcgggcaatgccgcggtggcgatcgcccgtctgggcgggcaggcccgctggtggggccgcgtgggcgacgatgccatcggcgcgggcgtgctggcggggctcgcggccgagggcgtggccaccgccgaggcgcgcgtggtggagggggcggtctcgtcccactcgctcgtcctctcggatgccgaggggcggcgcgccatcgtactctaccgctcggacgggctcgaccccgatgcctcgtggctgccgctcgcggcggtgggcgggctcgatgcggtcctggccgacaaccgctggatcgacggggcggtggccgccctcaccgccgcgcgcgcggcgggcctgccggcggtgctcgatgccgatgcgggcgccgacccccgcagccgcgaggcggtgcaggcggcctcgcatgcgatcttctccgagccggggctggccgagatctacggcacctccgaccccgacgagggcctccgccacgccgcggccgacgcgcccttcgtggcggtgacgctgggcgaggcgggcctgcgctggcgcgacgcccgaggcggcctcgcctcgctgcccgccttccccgtccgggcggtcgagacggtgggcgcaggcgacgtcttccacggcgccttcgccctcgcgctggccgagggccagccgcccgaggacgcgctccgcttcgccgccgccactgccgcgctgaaatgccggggctcgggcggccgcgcgagctatccc

SEQ ID NO: 31624 - DNA, 1047 bp, Rhodobacter sphaeroides
cgccgccacgccgtagccctcatccccggcgacgggatcggccccgaggtgatcgacgcgagcctcgaggtgctggagaaggtggcgcgcctccacggcttcgcgctcgacatgacccgcttcgactggtcctgcgaccgctacctcgccaccggccgcatgatgcccgaggacgggatcgaccagctccgcccccatgcggcgatccttctcggcgccgtgggctggcccgcgcgcgtgccggatgcggtctcgctgcacgggcttctgctgccgatccgcaaatccttcgaccagttcgccaacatgcgcccgcacaggcttttgcccggcgccaccgggccgctgaagtccgaggccttcgacatcctctgcatccgcgagaacaccgagggcgaatattccggcgcgggcgggcggatccatgtcggcaccccggccgaggtggcggtcgagacctcgatcttcacccgccgcggcgtcgagcgcatcctgcgcttcggtttcgaacaggcgcggcggcgctcggggcggctcgcctcggtcaccaagtcgaacgcgcagaaatattccatggtcttctgggacgaggtgacggaagaggtcgcggccgattatcccgacgtgaccgtctcccgctaccatatcgacgccatcgcggcgcggatggtgatggcgcccgagacgctcgacgtggtggtggcctcgaaccttttcggcgacatcctgaccgacctcggcgcggccattcagggcggcctcggcttcgcgccctcggccaacatcaaccccgaccgcagccagccctcgatgttcgagccggtccacggctcggcccccgacatcgcggggcgcggcatcgcgaacccggtggccacgctctggtccgcggccctcatgctcgaccatctgggcgaggaggcggccggccggtcgcttctcgccgcgctctcggccgtcaccgccgagggccgcctccgcacacccgatcagggcggccgggcctgcacgaccgatgtcgcgcgcgccgtggccgaccgcctgtcc

SEQ ID NO: 31625 - DNA, 1395 bp, Rhodobacter sphaeroides
atcctcgtcggcggcgactggatccaggccgacgcgggcggccggatcgaggtgacgaacccggccaccggcgccgtgatcggcaccgtccccgatgcgggcgcggccgagacggcgcgcgcggtggccgccgccgaagcggccttcgggccgtggcgcgcccttaccgcggccgagcgcgcgacccatctgcggaggctcgctcaggcgatcctcgatcaccgcgaggcgctggccgagcttctgaccgaggaacagggcaagcccctggccgaagcccgcggcgaggtcggcatgagcgcagcctacatccagtggttcgccgaagaggcccgccgcgtctatggcgaggtgatcccctcgccctggcccgaccggcggctcctcgtcacccggcagccggtgggcgtggtggcggcgatcacgccctggaacttcccctcctcgatgctcgcccgcaagatcggccccgcgctggccgcgggctgcaccgtcgtggccaagcccgccagccagacgcccttctcgggcctggcctggggggtgctgggcgagatggcgggcctgcccgcgggcgtgctgaacatcgtcacgggctcggcccgcgccatcgggggcgagctcaccgccaacccatcggtgcgcaagatcaccttcaccggctccacccccgtgggcaaggtgctgctcgcgcaggccgcgggcacggtgaagaagatgtcgatggagctcggcggcaacgcgccgttcctcgtcttcgacgatgccgatctcgaccgcgccgtcgagggcgccatcgcggccaagttccgcaacgcgggccagacctgcgtctgcaccaaccgcttctacgcgcaggccggcatccacgatgagttcgtgaagcggctggccgcggccaccgccgcgctgaaggtgggcccgggcgcacaggacggatccgagatcggcccgctgatcgacgcggccgcggtggccaagaccgaggagatggtggccgacgccaccgccaaaggcgggcgcatcgtcaccggcgggcggcggcacacggccggcgcgggcttctacgagcccaccgtcatcgccgacgcgaccgacgccatgaccttcgcccgcgaggagatcttcggccccgtggccccggtcttccgcttcgagaccgaggaggaagcgatccggcgcgccaacgccaccgagtacggcctcgcctgctacttctacacaagcgatctcggccgcgccttccgcgtctccgaggcgctcgattacggcatcgtcggcgtgaacgaggggctggtcaccaccgaggtcgcccccttcggcggggtgaaggagtcgggcttcggctccgaaggctcgcaccacgggatgcaggattacctgacgctgaaatat

SEQ ID NO: 31626 - DNA, 2883 bp, Rhodobacter sphaeroides
gacttcggcaccccgcgctcgcgcgcgaccgagacggtgacgctcgagatcgacggcttcccggtgaccgtgcctgcgggcacgtcggtgatgcgcgccgccgccgaggcggggatctcggtgccgaagctctgcgcgagcgacactctcgacgccttcggctcctgccggctgtgccttgtcgagatcgagggccgcgcgggcacgcccgcctcctgcaccacgccggtggcgcccggcatgaaggtgcgcacccagacgccgaagctgaagcaactgcgccgcggggtgatggagctctatatctcggatcacccgctcgactgcctgacctgcgccgccaacggcgattgcgagctgcaggacatggcgggcgcggtgggcctgcgcgatgtgcgctacgaggccgtggaaaatcatttcacgccccgcagtgccgccggcgacctcaatccgcaatggatggccaaggacgagtcgaacccctatttcacctacgatccatcgaaatgcatcgtctgctcgcgctgcgtgcgggcctgcgaggaggtgcagggcaccttcgcgctgaccatcgatggccgcggcttcgacagccgcgtctcggccgggatggccagcgacagtttcctcacctccgactgcgtgagctgcggcgcctgcgtgcaggcctgcccgaccgccacgctgcaggagaagtcggtgatcgagatcggcacgcccgagcgtgcggtcgtgaccacctgcgcctattgcggcgtcggttgttccttcaaggccgagatgcgcggcgacgagctggtgcggatggtcccctacaagggcggcaaggccaaccacggccattcctgcgtcaaggggcgcttcgcctatggctatgcggcccacaaggaccggatcctgaagcccatggtgcgcgagtcgatccacgatccctggcaggaggtgagctgggacgaggccttgggcttcgccgcgcgccgcctgacagcgatccaggagaagcacggccgccaatccgtgggcgtcatcacctcgtcgcgctgcacgaacgaggagacctacctcgtccagaagctgacccgcgccgtcttccgcaacaacaacaccgacacctgcgcccgggtctgccactcgcccaccggctacggcctgggccagaccttcggcacctcggccgggacgcaggatttcgattcggtcgaggctgcggacgtggtgatggtgatcggcgcgaacccgaccgacggccatccggtcttcgcgagccggctgaagaagcggctgcgcaagggggcgaaactgatcgtggtcgatccgcggcgcatcgatctggtgaagagcccccatatcgcggcggcccaccatctggcgctcaggcccggaaccaacgtggccgtggtgacggccatggcccatgtcatcgtgaccgaggggctagcggatgaaaaattcatccgcgaacgctgcgactgggacgagttccaggacttcgccgaattcgccgccgatccccgtcacgcgcccgaggcgatcgagagcctgaccggcgtgcccgcggccgagctgcgtgcggcggcccgcctctatgccaccggcgggaatgccgcgatctattacgggctgggcgtgaccgagcacagccagggctcgaccaccgtcatcggcatcgcgaacctcgccatgctcaccggcaacatcggccggcccggcgtgggcgtgaacccgctgcggggccagaacaatgtgcagggctcctgcgacatgggctcgttcccgcacgagctgccgggctaccggcatgtgaagagcgatgcggcgcgcgcggtgttcgagcggctctggggcgtcgagatcgatcccgagccgggcctgcggatcccgaacatgctcgatgcggcggtggagggcaccttcaagggcctctattgccagggcgaggacatcctgcaatcggatcccgacacgcgtcatgtcgcggcgggccttgcggcgatggaatgcgtgatcgtccacgacctcttcctgaacgagaccgccaactatgcccatgtcttccttccgggctcctccttcctcgagaaggacggcacattcaccaacgccgagcgccgcatcaaccgcgtgcgcaaggtcatggcgccgaaaaacggcttcgccgactgggaagtgacgcagatgctggccaatgcgctgggcgcgggctggggctacacccatccgagccagatcatggacgagatcgcggccaccacgccctccttcgccggcgtctcctacgagcggctggaagaggcgggctcgatccagtggccctgcaacgaggagcatccgctgggcacgccgctcatgcatgtcgagggcttcgtgcgcggacgcggaaaactcatccgcacggaatatgtggcgacggacgagaagacgggcccgcgtttcccgctgctcctcaccaccgggcggatcctttcgcagtacaacgtcggcgcgcagacgcggcggacggcgaacagcgtctggcaccccgaggacgtgctcgagatccatccgcacgatgccgaggtgcgcggcgtggccgaaggcgactgggtgcgcctcgcctcgcgggcgggcgagacgacgctccgggcgcggctgacggatcgcgtctcgccgggcgtggtctacacgaccttccaccatcccacgacgcaggccaatgtcatcaccaccgacttctcggactgggcgacgaactgcccggaatacaaggtgacggcggtgcaggttgcgccgtcgaacgggccgtcggactggcaggaggattaccgcgcccaggcgaacctcgcgcggcgcattctgccggctgccgaatgaaagagacccgccatctcctgccgcgtctcg

SEQ ID NO: 31627 - DNA, 735 bp, Rhodobacter sphaeroides
gccctcgtcacgggagccggccggcggctcgggcgcgagatggccctctggctcgggcggcgcggcacggatgtggcggtgcattacgcgggctcggccgacgaggccgaggcggtggcgcaagaaatcgcggccctcggacggcgcgccgtggcgctccgggccgatctcctggtcgaggccgagacgcaggccctcgtggcgcgggcggccgaggctctgggcggcccgctcgatcttctcgtgaacaacgcctcgatcttcgagagggacacgatctccggggccacccgcgaaagctgggaccggcacatggaatcgaacctccgggcgccgttcgtgctgatccagagtttcgcggctcaggcacctgcgccggtgcgggatgctcaaaatgaaccggtggcgcaggcgcttgtcgtcaacatgatcgaccagcgggtgctgcatccgacgccggattttgcaacctatacgctcgcgaaagtcggcctctggaccctgacgcgccttgcggcgcaggagctggggccgcgcgtgcgcgtcaacggcatcggcccgggacccaccctgcagggcgcgcaccagtcgcccggggatttcgcggacgagcgcgccggcacggttctcggacgcggcgccaatccttcggacatcacggcggcgctcggctacctcctcgaggcgccggcggtgaccgggcagatgatctgcgtggacggaggccagcatctg

SEQ ID NO: 31628 - DNA, 827 bp, Rhodobacter sphaeroides
atcgccaccgcccgcaccctgtcggaggccctaccctatcttcagcgctacgcgggcgccgtggtggtggtcaaattcggcggcaacgccatgggcgacgaggccgcgatggccgaattcgcgcgcgacatcgtgctgatgcggcaggtgggggtgaacccggtcgtggtgcacggcggcgggcccatgatcaacgagcttctgggcaagctcggcatcaagtcggaattcgtgcgcggcaagcgcgtgaccgacaaggccacggtcgaggtggtcgagatggtgctctcgggcctcgtgaacaagcggatcgtgcaggcgatcaacgatcaggtggccgcgcggtgggcatctcgggcaaggacgacgacctgatggtctgcgtggccgacgacccggatctcggcttcgtgggcaagcctgtcgagatgaacgtgcaggtgctgcgcgatctctacaatgcggggatcatcccggtcgtcgccccggtcgcgaccggcatggccgacaacgagaccttcaacgtgaacggcgacacggcggcgggcgccatcgccggcgcgcttcaggccgaccgcctgctccttttgaccgatgtggccggcgtgaaggatgccagcggcgaggtgctgagccagctcaccccgagccaggtgcgcgagatggtggcctccggcacgatctcgggcggcatgatccccaagaccgagacggcgctcgccgccctcgacgagggcgtgcgcgcggtggtgatcctcgacggccgcacccccaacgcctgcctgatcgagatcttcaccgacgagggcgcgggcaccatcatccgc

SEQ ID NO: 31629 - DNA, 726 bp, Rhodobacter sphaeroides
ggcgaacagaagacgatggtgctgaccggcgccagccgcggcatcggccacgcaacggtcaagagattctcgcgcgagggctggcgggtgctgacctgctcgcgtcagccgttcgatccgcgctgcccctggcccggcggcgaggagaaccatatccaggtcgatctcgccaatcccgacatgaccatccgggccatcgaggcgatcaaggacaagatcgacggccggctccatgcgctggtcaacaatgcgggcgtctcgccgaaggggccgaagggcgagcggctgagcacgatcaccaccgacctgcgcacctggggacaggtgttccacgtcaatttcttcgcctgtgtcgtgctggcccgcggcctgcaggaagagttgacagccggcaagggctcgatcgtcaacgtgacctcgatcgcgggcagccgggtgcatccgttcgcgggcgcggcctatgccacctcgaaggcggcgctggcggcgctcacgcgcgagatggcgcacgatttcgggccgctcggcgtgcgggtgaatgcgcttgcgcccggcgaggtcgagaccgcgatcctctcgcccggcaccgacaagatcgtcgagaagctgccgctgcagcggctgggtcagccgagcgaggtcgcggatgcgatctggttcctccgctccgaccagtcgagctacatctcgggcgccgagatcgaggtcaacggcgcccagcacgtc

SEQ ID NO: 31630 - DNA, 1374 bp, Rhodobacter sphaeroides
ccgcttctcggccttgccgcgctctcggcgctgcctatcgtcctgaaacttgcacggaagggacggtgaatggagcggatcgagacggatctctgcgtgatcggcgcgggctcgggcgggctgtcggtcgcggccggggcggtgcagatgggcgcgcgggtggtgctggtcgaggcgggcgagatgggtggcgactgcctgaacgcgggctgcgtgccctcgaaggcgctgctcgccgcaggcaaggccgcgcaggcgatgcggacggccggggccttcgggatccgtccggtcgagcccgagatcgacttcgccgcggtcaaggaccatgtggcgcgcaccatcgccgccatcgctccgcatgacagtcaggagcggttcgaggggctgggcgtgcgcgtcctgcgcgactggggccgcttcgtctcgccgaccgaactgcgcgtgggcgcgcggacggtggtggcgcgccgcttcgtgatcgccaccggttcgcggcccctcctgccgccgatccctgggctcgaccgggtcaaggccctgacgaacgagacgattttcgcgcttcgcgaacggccggagcatctgatcgtgatcggcggcgggccggtcggcatcgagatggcgcaggcgcaccggcgtctgggctctcgcgtgacggtgatcgcgggggaaaaggcgctgcccaaggacgatcccgaactggcggccgtcctgctcgaccggctgcgggccgagggggtggagatcgtcgagggcgcccgggccgaggcggtgcagcctctggcccatggcctcgaggtgacggccggagaccggcgcatcgcgggctcgcatcttctggtagccgcgggccgaaagcctgcgctggacgcgctcgatccggcggccgccggggtggaggtgaccgagaagggtgtgaaggtcgggcccgatctgcgctcctcgaaccggcggatctatgcggtgggcgatgccgcaggcgggccgcagttcacccatctcgcaggctatcacgcctcggtcgtgatccgctcgatcctgttcgggctgccctcgaaggccacggcgctcattccgcatgtcacctatacggagccggaactggcgcagatcggcctgaccgaggcgcaggcgcgcgagatccacggcgaccggctggaagtgctgcgcgtgccggttgcgggcagcgaccgggcgcaggcggaagccgcgacggaggggctcgtgaagctcatggtggcgcgcggccggccggtgggcgtctccatcgtggccccccacgcaggcgagatgatcggcctctgggccatggcgctggcctcgggcgccaagctctcgacggtggcgggtctggtgctgccctatcccacg

SEQ ID NO: 31631 - DNA, 1500 bp, Rhodobacter sphaeroides
atggccaatccgttgttcgatgcgctgttcgccccgctggaagggcgggcgagcgacctcataatcctgaaggacggcacgcggctgagcggcgacgccttcttccgtctcctcgcccggacggcccatgcgctgcgggcggaggggctgcgccccggcgaccggatcgccgtgcaggtcgccaagagccccgaggcgctggccgtctatggggcggcggtggcgctgggagcggtcttcctgccgctgaacaccgcctatacgccggccgaagtggactatttcctgggcgatgccacgccgcggatcttcctctgcgacagcgcgcaggccccggcgcttacgccggtggccgagcggcacggggcgcggctcctgacgctcgacgcggacggaacgggcgatctcgcgcagaggacgagggaccggcccgaagagatcggcgccgaaccccgggacgccgaggatctggcggcgcttctctatacctcggggaccacgggccgctcgaagggcgcgatgctgagccagcgcaacctcctgtcgaacgcggaggcgctggccgacctctggcgcttcaccgagcgcgacgtgctgatccatgcgctgccgatctttcacacccacggcctcttcgtcgcctcgaacgtgacgctcctgacccgcggctccatgatcttcctgcccggcttcgatctcgaggcgatccttcgctggatgcccgcggccacggcgctgatgggcgtgcccaccttctacacgcggctcttgagcgacccgcgcctgacgcgcgcgcttgcggctggcatgaggctcttcgtctccggctcggccccgcttctggccgacacccatgccgagttcgaggcccgcaccggccaccgcatcctcgaacgctacggcatgactgaaaccaacatgtccacctcgaacccctacgagggcgagcggcgggcgggcacggtgggcttcccgctgccgggagtcgagctgcggatcctcgaccagggccgcgaggtcgcgcccggcgagatcggcgtgatcgaggtgcgggggcccaacgtcttccagggctactggcagatgcccgagaagaccgccgaggagctgcgcccggacggcttcttcgtcacgggcgatctcggctgccgcgatgccgagggctatgtgcagatcgtcggccgccagaaggacctcatcatctcgggcggctacaacatctaccccaaggaggtggagcttttgctcgacgaacagccgggcgtgctggaaagcgcggtggtggggctgccccttcccgatctgggcgaggcggcgctggcggtgctggtgccgcggccgggcgtgacgctggacccgcaggcggttctgggggcgatcgcggaccggctcgcgcggttcaagcagccccgcgcggccgtgctggtcgaggagctgccgcggaacacgatgggcaaggtgcagaagaccctcctgcgtgcgcgctatgcgggtctcttt

SEQ ID NO: 31632 - DNA, 954 bp, Rhodobacter sphaeroides
cagttccagatcgtcggcatcggcaatgcgctggtcgacgtgctttcccattgcgacgatgccttcctggccgagaacggcatcgccaaggggatcatgcagctcatcgacatgggccgcgcggtggatctctacggccggatcgggccggcgcaggagatttcgggcgggtcggccgccaacaccatcgcgggcattgcccagctcggcgggcggacggcttatgtgggcaaggtctgcgacgaccagctcggcgcgatcttcgcccacgacctgcgggcgcagggcgcggtctacgagacgccgatggcgccgaagggcggcgcgcaggagaccggacgctgcatcatattggtctcgcccgatggcgagcggtcgatgaacacctgtcttggctggtccgagttcctgacacccgacgacatcgacgaggcgcagatggcctcgaccgaatggatctacctcgagggctaccgcttcgacgggccggagagccatgcggccttcgccaaggccatcgccgcctgcaggggcgcgggcgggcgcgtctcgctgacgctgtcggatccgttctgcgtcgaacggcaccgcgacgccttccgccggatgatccgggaggatgtggatcttctgttcgccaaccgcgccgagatcctgtcgatgtatcggaccgaggatttcggtgcggcgctgaaggccgcggccgcggaggtggcgatcgtggcctgcaccgagagcgagaagggggcccacatcctcgcggacgggcagcactggcatgtgccggccctgcccacgcagatcgtggatgcgaccggggcgggcgacctcttcgccggcgccttcctctgggggctgacccacgggcacggctacgagacggcggggcgcatgggctgcatcgcggcttcggaagtgatttcccacctcggcgcccggcccgaggcggatctg

SEQ ID NO: 31633 - DNA, 1329 bp, Rhodobacter sphaeroides
atgttcgaaaagatcctgatcgccaaccgcggcgagatcgccttgcgcgtgatccgcgcctgccaggagatggggatcaagtcggtcgccgtccattcgaccgcggacgccgatgccatgcatgtccgcatggccgatgagagcgtctgcatcggcccggcctcctcgaccgacagctatctcaacaaggcctcgatcatctcggcctgcgagatcaccggggccgaggccgtccatccgggttacggcttcctctccgagaacgcggccttcgcccaggcgctgcaggaccacgggatcgagttcatcggcccgaccgcggaccatatccgcatcatgggcgacaagatcaccgccaaggacacgatgaaggctctgggcgtgccctgcgtgcccggctccgacggcggcgtgcccgactacgagacggccatcgccacggccagagacatcggcttcccggtcatcatcaaggccacggcgggcggcggcgggcgcggcatgaaggtcgcgcggaacgagcaggaactcgagatcgccttccgcaccgcgcgttcggaagccaaggccgccttcggcaacgacgaagtctatatggagaaatatctccagaagccgcggcacatcgagatccaggtgttcggcgacggcaagggccgcgcggtccatctgggcgagcgtgactgctcgctgcagcggcggcaccagaaggtgttcgaggaagccccgggtccggtcatcacccccgagatgcgtgcggagatcggcaggatctgcgccgacgcggtggcgcggatcaactacatcggcgcgggcacgatcgaattcctctacgaggacggccagttctacttcatcgagatgaacacccgcctgcaggtggagcatccggtgaccgaggcgatcttcggcgtcgatctcgtgcgcgagcagatccgggtcgcggcgggcctgccgatgagcttcaatcaggatgcgctggagatcaacggccacgccatcgaggtgcggatcaacgccgagaagctgccgaacttttcgccctgccccggcaaggtgcgggtcttccacgcgccgggcggcctcggggtgcggatggattcggccctctatggcggctattccatcccgccctattacgacagcctgatcggcaagctgatcgtgcacggccgcgaccggcccgaggcgctggcgcgcctgcaccgcgccctgggcgagctgatcgtggacgggatcgacacgacggtgccgctgttccacgcgcttctggccgagcccgacatccagaatggcgactacaatatccactggctggaaaaatggctc

SEQ ID NO: 31634 - DNA, 1245 bp, Rhodobacter sphaeroides
cccgatgccgtggcgcgccccgcctcgaccgaggaggtctcgcgactcctcgcgctctgccatgccgcgggcatgccggtggtggcgcagggcgcgcgttcctcgctcgaggggcaccatctggcgatccgcggcggcatcgcgctcgacctgaccggcatggaccgggtgctggccgtccatgccgaggatctcgacgcggtggtgcagcccggcgtcacgcgcgagacgctgaacgcccatctgcgcgacacgggccttttcttcccgatcgatccgggcgccaatgccacgctgggcggcatggccgcgacccgcgcctcgggcacgaccgccgtgcgctacggcacgatgcgcgaggcggtgctggcgctcgaggtggtgcaggccgacggcaccgtgatccgcaccggcagccgggcgcgcaaatccgccacgggctacgatctcacccacctcttcgtgggctcggagggcacgctcggcatcatcaccgaactcacgctgcgcctcttcggccagcccgaggcgcagtcggccgcgatctgccgctttccctcggtggccgaagcggtcgccaccgtcatcgccacgatccagatgggcctgcccatagcccggatcgagctggtcgatgcgatgatggtacgcggcttcaacctccatgccgatgcagggctgcccgaggagccgcatctcttcgtcgaattccacggcagcgaaagaggcgtggccgagacggccgccctcttcggcgagatcgccgccgatcacggcgggcagtcgttccgctggtcgcagaagcccgaggagcgccgcgcgctctggtcgatgcgccacaatgcgcaccatgccacgcggcggctgcggccgggggcgcgcacggtctcgaccgatgtctgcgtgccgatctcggcgctggccgaggcggtcgcggtcgcgcaggaagagggccgcgcccgcggcctcatgcaggccatcgtgggccatgtgggcgacggcaatttccactgcggcatcctcgtcgaccccgaggatgcaggagagatgaagcgggtgaaggagttcaccgacctcctgtcggatctggccctgcggctgggcggggtcgtgtcgggcgaacacgggatcggcatgggcaagatcggcaagatggaggcccagcacggcccggctctggccaccatgcgggcgatgaaagaggcgctcgatccgaagggcatcctcaatcccggcaagctcctg

SEQ ID NO: 31635 - DNA, 726 bp, Rhodobacter sphaeroides
ctggagggcaagcgcgcgctggtgacggcggcagggcaggggatcgggcgcgcctctgcgctggccatggcgcgcgagggcgcgcgtgtgctggcgaccgacctgaatgcggcagcgctcgaagggcttgcggccgaagggctcgaggtgcagccgctcgatgtgcgcgatccggcctcgatcgcggccgctgtcgcggcggcagggccgctcgacgtgctcttcaactgcgcgggcttcgtggcctcgggcacgatcctcgactgcgacgaggaggactgggccttctccgtcgggctgaacctcaccggcatgtatcggatgtgccgcgccttcctgccgggcatgatcgcgggcggcggcgggtcgatcatcaacatggcctcggtcgtgtccgcggccatcgcggcgcccaaccgcttcgtctacggcaccaccaaggcgggggtcgtggggctcaccaaatccatcgccgccgatttcatcgggcagggcatccgctgcaacgcgatctgccccggcaccgtcgaaagcccctcgctcgaggaccggctccgcgccaccggcgattacgaggccgcgcggcgcgccttcgtggcccgccagcccatcggccgcatcggccgcccggaggagatcgcggcgcttgtcgtctatctcgcttcggacgaatccgcctacaccaccggggtcgcccatgtcatcgacgggggctggtccaatatc

SEQ ID NO: 31636 - DNA, 1116 bp, Rhodobacter sphaeroides
ctgagcgaggagcaacaggcgatcttcgacatggcacgcgcgttcggggccgaggagatcgccccccatgcgcgggcctgggaagaggcggggacgatcccccgcacgctctggcccaaggtggcggaactgggtctgggcggggtctatgtctcggaagatcatggaggatccgggctcgggcggctcgatgcgacgctcgtcttcgaggcgctggccatggcctgtccgtcggttgcggcgttcctctcgatccacaacatgtgcgcgggcatgatcgaccgctatggctcggaggagctgaaggcgcgctggctgccgggcatctgcgcgctcaccacgctcgtctcctactgcctgaccgagcccggagcgggatcggacgcggcggcgctccgcacccgcgccgacgccaccccagaaggctaccggctgagcgggaccaaggccttcatctccggaggcggctattcggacgcctatctcaccatgtgccgcaccggcggcgcggggccgaagggcatctcgacgctcctcgtgccggcgggaacccccggcctcagtttcggcgggctcgaggacaagatgggctggcgggcgcaggagacgcggcaggtgcagttcgacgagtgcctcgtgtcgacggatcttctggtcggcgaggaggggcagggctttgcctatgcgatggcggggctcgacggcggacggctcaatatcgcggccaccgctctcggcggcgcgcaggcagccttcgacgcgacccgcgcctacatggcggaacggaaggctttcgggcagcggctcgacgggtttcaggcgctgcagttccgactggccgagatggaggtgaagctccagcaggcgcggatcttcctgcggcaggcggcctggaagctcgatcagggcgcccccgacgccaccaagttctgcgccatggccaaactcgcggtgacggattcggccttcgaggtggccaaccagtgccttcagctgcacgggggctacggctaccttgccgattacggcattgagaagatcgtgcgcgacctgcgcgtgcaccaaattctcgaaggcaccaacgagatcatgcgggtgatcgtggcccgggccttg

SEQ ID NO: 31637 - DNA, 948 bp, Rhodobacter sphaeroides
cgcttgggcgcgaacgagagcctcttcggcccctcgccgcacgccgtggcagccatggccgcggccgccgccgaggtctcgctgtatggcgatccagagatccatgcgctgcgcactgccatcgcggcccatcacggcgtggcgccggatcaggtgacggtgggcgagggcgtcgacgggcttctgggcaacctcgtccggctgcttgtcgacgagggcgcgccggtcgtgacctcggagggcgcctatccgaccttcgccttccatgtggcggggttcggcggccgcctgcacaaggtgccctaccagggcgatcacgaggatcccgaggcgctggcggccgaggcccggagggtcggggcccggatcgtctatttcgccaatccggacaatccgatggggtcgcaccatcctgccgcctccgtccgcgccctgatcgaggcgctgcccgagggcacgctgctcgcgctcgacgaggcctatgtggaactggcccccgagggcacggcgcccgagatcgcccccgaggatccgcgggtgatccgcttccgcaccttctcgaaagcctacgggatggcgggtctgcgcgtgggctatgccatcggcgcccgcgacctcatccgcgccttcgacaaggtccgcaatcatttcggggtggggcggatcgcgcaggcgggcgcgctggccgcgctcgaggatcgcgcatggctcgcgcatgtgcaggcggaggtgcaggcggcgcgggccgagatcggccggatcgccgaaggctgcgggctgacgccgctgccgtcggccaccaacttcgtgaccatcgactgcggccgggacggcgccttcgcgcgcgccgtgctgaccgaacttgtcgcccgcgacatcttcgtgcggatgccgttcgtggccccgcacgaccgctgcatccgggtgagctgcggccgcgccgaagag

SEQ ID NO: 31638 - DNA, 990 bp, Rhodobacter sphaeroides
tatgcggtcaagtccaacccggaagaggtggtgatcgagaacctcgccgccgcggggatccgcggctacgacgtggcctcgccccacgagatccgcatgatccgccgcatcgcgccggatgcggcgctgcactacaacaaccccgtgcgctcgcgctccgagatcggcgtgggcgtcgagatgggcgtgaagagctggtcggtcgactcggcctcggaactggccaagctcatcgagctcgtgcccgccgagggctgcgagatcgcggtgcgcttcaagctggcggtctcgggcgcggcctataacttcggggccaagttcggcgcgacggtcgagctcgcggtcgagctgctgcgccgggtggccgaggcgggcttcatcccgtcgatgaccttccacccgggtacgcaatgcaccgaccccgccgcgtgggaaacctacatccgcactgccgccgagattgcgcgcgacgccggcgtgaccatcgcgcggctgaacgtgggcgggggcttcccctcgcaccggctgaacggggtcgaacccgagctcgaggccatcttccacctgatcgaccgcgtgacggatgaggccttcggggccgaccggccgctcctcgtctgcgaaccgggccggggcatctgcgccgacgccttcacgcttgccgcgcgcatcaaggcggtgcgcgacgacgcccatgtgttcctcaacgacggcgtctacggctcgctgaccgagctgccgatgatcggcgtgatcgaccgcgtggcggtgctgacccccgagggccgtcggcgcgacggagagacccgcgaccgcatcatcttcgggccgacctgcgactcggtggaccgccttccgggcgagctgccgcttgccgcggatgtggaggagggcgactttctggtgttccagggcatgggcgcctactccgccgccaccaatacccgcttcaacggcttcggcgaactgagtatggccaccgtcctctcg

SEQ ID NO: 31639 - DNA, 1278 bp, Rhodobacter sphaeroides
aaatccgcaaagctcacgatcggcgagaaggtcatcgacctgccgatccactcgcccaccctggggccggacgtggtcgacatccgcaagctctacgcggaagccgatgttttcacctacgacccgggcttcacctcgaccgccgcctgcgaaagcaccatcacctacatcgacggcgacaagggcgagctcttctaccgcggctacccgatcgagcagctggccgaccggtcgcactatctcgaggtctgctacctcctgctctacggtgaactgccgaacgcggcgcagcaggccgatttcgaataccggatcacgcggcacacgatgctgcacgagcagatccactacttcttccggggcttccgccgcgacagccatccgatggcgacgatggtgggtgtggtcggcgccatgtcggccttctaccacgactcgctcgacatcaacgatccgtggcagcgtgaggtcgcggcgatccggatgatcgccaagctgccgacgatcgcggcgatggcctacaaatattccatcggccagcccttcaactacccgcagaaccatctcgattacgcgggcaacttcctgcacatgtgcttcgccgtgccggccgagccctacacggtgaaccccgtcctcgccaaggcgatggaccggatcatgatgctgcacgccgaccacgagcagaatgcctcgacctcgaccgtgcgtctggcgggctcgtcgggggccaaccccttcgcctgcatcgcggccgggatcgcctgcctctggggccccgcccatggcggcgccaaccgggcctgtctcgagatgctgcgcgagatcggcaccgtggaccggatcccggaatatatccggcgcgccaaggacaaggacgatcccttccgcctgatgggcttcggccaccgcgtctacaagaacttcgacccgcgggcgaaggtcatgaaggaaagcgccgacgaggtgttgggcctgctcggcatcgagaacaacccgacgctccaggtcgccaaggagctggagcggatcgcgctcgaggacgattacttcgtcgcgaagaagctctatccgaacgtggacttctactcgggcatcatcctcgatgcgatgggcttccccacctcgatgttcaccccgatcttcgcgatctctcggaccgtgggctggatctcgcagtggaaggaaatgatcggcgatcccacgcagaagatcggccgcccgcggcagctctacaagggcgagacccgtcgcgactacgtcgacctgcgccaccgc

SEQ ID NO: 31640 - DNA, 1374 bp, Rhodobacter sphaeroides
gtcgtcacccgtttcgccccctcgccgaccggctatctgcatatcggcggcgggcggaccgctctcttcaactggctctatgcccgcggacgcaagggcacgttcctcctgcgcatcgaggacaccgaccgcgagcggtcgacgcccgaggccaccgacgcgatcctgcgcgggctgacctggctcggcctcgactgggatggcgaggtggtgagccagttcgcccgcaaggaccgccatgccgaggtggcgcgcgagatgctggaacgcggcgcggcctacaaatgcttctcgacgcaggaggagatcgaggctttccgcgagtccgcccgcgccgagggccgctcgaccctgttccgcagcccctggcgggatgccgatcccacaagccaccccgatgcgcccttcgtgatccgcatgaaggcgccgaggagcggcgagaccgtgatcgaggacgaggtgcagggcacggtgcgcttccagaacgagacgctcgacgacatggtagtgctgcgctcggacggcacgcccacctacatgctggccgtggtggtggacgatcacgacatgggcgtgacccatgtgatccggggcgacgatcacctgaacaacgccgcgcgccagacgatggtctatgaggcgatgggctgggaggtgccggtctgggcccatatcccgctgatccacgggccggacggcaagaagctctcgaagcggcacggggcgctcggggtcgaggaatatcaggcgatgggctatcccgccgcgggcatgcgcaactatctcgcgcggctcggctggtcgcacggggacgacgagttcttcacctccgagcaggcgatggactggttcgatctgggtggaatcggccgctcgcccgcgcgactcgacttcaagaagctggaaagcgtctgcggtcagcacatcgccgtcatggaggatgccgagctgatgcgcgaaattgcggcatatctcgctgcagcgcggaaacccgccctcaccgatctgcaggccgcgcggctggagaaagggctctacgctctgaaggaccgggccaagaccttcccggaactgcttgaaaaggcgcgctttgcactcgagtcgcggccgattgtggcagatgacgctgcggcaaaagcgcttgatccggtatcccgtggtatactgcgcgaattgacgccgatgctgcaagctgctagctggtcgaagcaggatctcgaggccatcctcaccgcctttgcgagcgagaagggaatgggcttcgggaaactggccgcccccttgcgcacagcccttgccgggcgcacggtgacgcccagcgtctacgacatgatgcttgtcatcggtcgggacgagacgattgcgcggctggag

SEQ ID NO: 31641 - DNA, 1152 bp, Rhodobacter sphaeroides
gtcctgccgacctataaccgcgcgcccctcgccttcgttgcgggcgagggctcctggctcaccgccgaggacggcagccgatacctcgacctgggcgccggcatcgcggtgaatgcgctgggccacgccaatcccgcgctcgtcgaggtgatctcggcgcaggccgcgaagctctggcatgtctcgaacctctaccgcatccccgagcaggagcggctggccgagaagctggtcgaagcgaccttcgccgacacggtgttcttcaccaactcgggcaccgaggccgcggaactctcgatcaagatggtgcggaaatactggtccgagaagggccagcccgaccggatcgagatcctctgcttcgagggcgccttccacggccgttcgaccggcgccatcgcggcggcgggctcggaaaagatgaccaagggctacgggccgctgatgccgggcttccggcagctgcccttcggcgatcacgaggcgctgcgggcggccatctcggagaagaccgcggccgtgatgctcgagcccgtgcagggcgagggcgggatccgcgtcctgcccgacgtctgcctcaaggggctgcgcgacgcctgcgacgccgtgggcgcgcttctcgtcttcgacgaggtgcagtgcggcatggggcgcacgggcaggctcttcgcccatgaatgggcggggatcgagcccgacatcatgatggtggccaagggcatcggcgggggctttccgctgggcgcggtgctggcgaagaaagccgcggccgcggccatgaccgcaggcacccacggctcgacctacggcggcaaccccctgggctgcgcagtgggcgcgaaggtcatggagatcgtggccgatcccgccttcctcgccgaggtgaaccgcaaggccgcgctcttccgccagaagctcgaggggctggtcgcggcccatccgcaggtcttcgaggaggtgcgtggcgcgggcctgatgctcggcctcaagtgccgggcgccgaatgccgatctggtgaaggcggcctacggccagcatctgctgaccgtgcccgcggccgacaatgtggtgcgcctgctgcccgcgctcaacattcccgacgaggacatcgccgaggcggtggcgcggctcgaccgggcggcggggacgctc

SEQ ID NO: 31642 - DNA, 912 bp, Rhodobacter sphaeroides
ctttccgtgaaccacttcctcgatatccacaagaccgacaccgccgaactgcggcagatgatggacagcgcccatgcgatgaaggccgcgcgcaaggggcggcccaagggccagctcgacgaggaccagccgctcgccggtcgcatggtcgcgctgatcttcgagaagccctcgacccgcacccgcgtctccttcgacgtgggcgtgcgccagatgggcggccagaccatggtgctttcgggcaaggagatgcagctcggccacggcgagaccatcgccgacacggcccgcgtgctctcgcgctatgtcgatctcatcatgatccggaccttcgaggaggcgacgctgctcgagatggccgagcacgccacggtgccggtcatcaacgggctcacgaaccgcacccatccctgccagatcatggccgatgtcatgacctacgaggaacatcgcggcccgatcgcggggcgtaaggtggtctgggcgggcgacggcaacaatgtctgcgcctcgttcctgcatgcggcggggcagttcggcttcgacttcaccttcaccggcccctccacgctggatcccgaggccgagttcgtgggctatgcccgcgagaagggccggcgcgtctcgatcgagcgcgatccggcgaaggcggtggcgggcgccgatctcgtcgtcaccgacacctgggtctcgatgcacgatccgcaatccgcgcgcgagcggcggcacaaccagctcaggccctatcaggtgaacgagacgctgatggcgcaggccaagcccgatgcgctgttcatgcactgcctgcccgcgcatcgcgacgacgaggccacgagcgcggtgatggacggcccccattcggtgatcttcgacgaggccgagaaccggctccatgcgcagaaggccatcatg

SEQ ID NO: 31643 - DNA, 759 bp, Rhodobacter sphaeroides
ctgcagggcaagcgcgccctcatcaccggcggcacgcagggcgcgggcgcggccacgctcgcgctcttccgcgagctcggggccgaggtcctgacctcggcgcgccaccgccccggcgacctgcccgaggaaatgttcgtggccgccgacctgacgacccctgcgggctgcggggcgctggccgcggcggtgcgcgaccgactgggcggggtggacattctggtccatatgctcggcggatcttcggcacctggcgggggcttcgccgcgctgggcgaggcggagtggcaggcggagctgaacctgaacctgatgcccgccgtccgcctcgaccgcgcgctgctgcccggcatggtggcgcgcgggtcgggcgtcgtcgtccatgtcacctcgatccagcgcctcctgcctctgcccgaggcgacgacgggttatgccgcggccaaggccgcgctgtcggcctacagcaagagcctgtcgaaggaggtggcgccgaagggcgtgcgcgtggtgcgcgtgacgccgggctggatcgcgaccgaggcctcgctccggctggccgagcgtctggccgcagaggcgggcaccgatctcgaggacggcaagcgccggatcatggcctcgctcggcggcatccccctcggccgcccctcgacgcctgccgaggttgcgagcctgatcgccttcctcgtctctgaccgggcggcgagcatcaccgggacggaacatgtgatcgacggaggcacggtgccgacggtg

SEQ ID NO: 31644 - DNA, 726 bp, Rhodobacter sphaeroides
ctgaacggaaagacgatcatcatttctggcgcaagcagcggcatcggggccgcagcggcgaggctttttgcggcggagggggcgcgcctgatcctcggcgcgcgtcgtgccgcgctgctggaggagatcacgaacgagatcctggccggaggtggcgaagcggatttcgtcgtcggagacgtcgaggacagcggtttcgcggcagagctggttcaaagagccgaagaccgcttcggcggacttgacggtgccttcaacaatgccggggtgaccggggagatgtgtcccatccccgacatgcccgaaagcaactggcacaaggtgatcgcggtgaatctcagcagcggattttacgcggcaaagcatcagatacctgccatgcgcaaacgcggcggtggctcgattgttttcacctcctccttcgtgggacacacgatcgggctccccggcatgggcgcctatgccgcagcgaaggcgggcctgatcggcatgactcaggttctggccgcggaacatggacccgagaagatccgcgtcaacgcgctcctcccgggcgggaccatgacgccgatggccggagaggacgccggctttcatgaggtcgtgcggggtttccacgcgctgaaacgcatggcggatccatccgagatcgcgcaggcggcgcttttcctgctctccgatcaggcgtcattcgtgaccgggaccgcactgatcgcggacggggga

SEQ ID NO: 31645 - DNA, 1317 bp, Rhodobacter sphaeroides
atgaccaccgttacccgtttcgctccgtcgcccactggctacatccatgtgggcaatctccgcaccgcgctgatgaactgggccatcgcccgcaagtccggcggcaccttcatcctgcgtctggacgataccgaccgcgagcggtcgaagcaggaatattccgacgggatcatggaggatctcgagtggctgggcctgacctgggaccggctcgagcggcagtccgaccggctggaccgttacgcggaggccgccgacgagctgcgccgggcgggccgcttctacgaatgtttcgagagcccgaccgagcttgacctcaagcgcaagaagctgctcaacatgggcaagccgccggtctacgaccgcgccgcgctgaagctctcggacgaggagcgtgcgcgtctgcgcgaggagcgcggcggctactggcgcttcctgctcgatcaggagcggatcgaatggacggacggcatcctcggcccgatctcgatcgatgcggcctcggtgtcggatccggtgctgatccgggccgacgggcaggtgctctataccttcgcctcctcggtcgatgacatcgacatgggcgtgaccttcatcgtccgcggcggcgaccatgtgacgaacacggccacgcagatccagatcatgcaggcgctgggcggcacgccgccctccttcgcgcaccattcgctgctgaccggggcgcagggcgaggcgctctcgaagcggctgggcacgctcagcctacgcgacctgcgcgcgcggggggtggagccgatggcgctcctgtcgctgatggcgcgtctcggctcgtcgcagccggtcgagcttttccgcacgcatgaggagcttctggcgggcttcgacgtgggcaccttcggcgcggcgccgaccaagttcgatgccgaagacctgttcccgctgacccgccactatgtgcagggcctgccgttcgaggccgtccgcggccgcatcgccgcgctgggcgtgccggacgatctggccgaacccttctggcgggtggccaaggacaatatcggcgtgctggaggatctgggcggctggtggacgctcttctcggaaggggccgagccgcagatcgaccccgaggatgaggatttcatccgtcaggccatgacccttctgcctccgccgccctacgggcccgagagctgggcgcagttcactgccgcggtgaaggaagccacgggccgcaagggcaagggtctcttcatgccgctgcggaaggcgctgaccgggcaggcccacgggccggacatgtccgaggtcatgccgcttctgcagaaggtgcgcgcg

SEQ ID NO: 31646 - DNA, 1050 bp, Rhodobacter sphaeroides
atccccgtcttcgacggacacaacgacttcctcctgcgcctcctgcgcaatcccgccaaccgcgagacgatctggctgaagggcgacggcaccggccatctcgacctgccgcggatgaaggagggcggctttgcgggcggcttcttcgccatctacgtcccctcgccgcaggcccacgatgccgcgcatttcgaggcgatgatggacgctccgcccttcgaactgccgctgcccccgatgatccgggccgagcaggcgcagcccgtggccctcgccatggcggggcacctgctctggatggaacgcgcggcccgcggccgcttcaaggtctgccgcacggcggccgaggtccggtcctgccatgccgacggcatcgtctcgggcatcatgcatatggagggcgccgaggcgatcggggcggatctcgatgcgctccacctcttccattcgctgggcctgcgctcgctcggcccggtctggagccgccccacggtgttcggccacggcgtgcccttccgcttccccggctcgcccgataccggcgaggggctgaccgaggcggggcgtcgcctcgtggccgaatgcaaccggctgaagatcatgctcgacctctcgcacctgaacgaaaagggcttcgacgatgtcgcgcgcctgagcgacgcgccgctggtcgcgacccattccaacgcccatgcggtcacgccctcgacccgcaacctgaccgaccgccagctcgcgatgatccgcgagagccggggcatggtggggctgaatttcgccacctccttcctgcgcgaggacggccgacgctcggccgagatgggctgggagccggtgctgcgccatctcgatcatctgatcgaccggctgggcgaggatcatgtggggatgggctcggacttcgacggggccacgatcccgcagggcatcgccgacgtgaccggcctgcccgcgctgcaggccgcgatgcgcgcccatggctacgacgagccgctgatgcgcaagctctgccacgagaactggtacgggcttctggagcgcagctggggg

SEQ ID NO: 31647 - DNA, 3495 bp, Rhodobacter sphaeroides
tctcgcacaggaacacgctcttctcccttctcgtcgggagcatctagcacggcaggccggcccgcggacagcccggctgcgacgtgacgcaagagggttgcgccgcgcggcggcaagtctataaccgcgccaatttgcgcagagcgtagaatccggacaatcctgcagcccgaccggcgcgggaccatagatgtggggccacaaatgccgaagagaaccgatatcagctcgatcatgatcatcggggcgggtcccatcatcatcggccaggcctgcgagttcgactattccggcgcccaggcctgcaaggcgctgcgcgaagagggctaccgggtcatcctcgtgaactcgaacccggccacgatcatgaccgatccgggtctcgcggatgccacctacatcgagccgatcacccccgaggtcgtggccaagatcatcgagaaggagcgccccgatgcgctcctgcccacgatgggcgggcagaccggcctcaacaccgcgctcgcgctggccgacatgggtgtcctcgagaagttcggcgtccagctcatcggcgcgaaccgcgaggccatcgagatggccgaggaccgcaagctgttccgcgaggcgatggaccggatcgggctcgagaaccccaaggccaccatcatcgccgcgccgaagctcgaaaacgggcgctacgacatcaatgcgggcgtggccgaggcgatggccgccatcgaatatgtgggcctgcccgcgatcatccgccccgccttcacgctgggcggcaccggcggcggcgtggcctacaaccgcgacgattacgaggccatctgccgctcggggctcgatgcctcgccggtggcgcagatcctcgtcgatgaaagcctgctcggctggaaggaatatgagatggaggtggtccgcgaccgcgcggacaatgccatcatcgtctgttccatcgagaacgtggacccgatgggcgtccataccggcgactcgatcaccgtggcgccggcgctgacgctgaccgacaaggaatatcagatcatgcgcaacggcagcatcgccgtgctgcgcgagatcggcgtcgagaccggcgggtcgaacgtgcaatgggcgatcaaccccgcggacggccgcatggtcgtgatcgagatgaacccgcgcgtctcgcgctcgtccgcgctggcctccaaggccacgggcttccctatcgcgaagatcgcggcgaagctggccgtgggctatacgctcgacgagctcgacaacgacatcaccaaggtcacgcccgcctcgttcgagccgtccatcgactatgtcgtgaccaagatcccgcgcttcgccttcgagaagttcccggggagcaagccggagctcaccaccgcgatgaaatcggtgggcgaggtcatggccatcggccgcaccttccacgaatcgatgcagaaggcgctggcctcgctcgagaccggcctgtcgggcttcgacgagatcgagatccccggcgcccccgacaaggccgcggtcatcaaggccatctcggcccagaccccggaccggctgcggctgatcgcgcaggcgatgcggcacgggctgaccgaggacgagatccaggccgcgacggccttcgatccgtggttcctcgcccgcatccgcgagatcgtcgaggccgaggccgagatccgcgccaagggcctgcccgtgaccgaggccgcgctgcgcaggctgaagatgatgggcttcaccgacgcgcgtctggccaaactcaccggccgcgacgagggtcaggtgcgccgcgcgcgccggaacctcggggtgaaggcggtcttcaagcgcatcgacacctgcgcggccgagttcgaggcccagaccccctacatgtattccacctacgaggcccccgcgatgggcgacgtggaatgcgaggcccggccctcgggcgcgaagaaggtggtgatcctcggcggcggcccgaaccggatcggtcagggcatcgagttcgactattgctgctgccatgcctgcttcgcgctgaccgcggcgggctatgaaaccatcatgatcaactgcaaccccgagaccgtgtcgaccgactacgacacctcggaccggctctatttcgagccgctgacgctcgaacatgtgctggaaatcctgcgcgtcgagcaggacaacggcacccttcacggcgtgatcgtgcagttcggcggccagacgccgctgaagctcgcgcaggcgctggcggccgaggggatcccgatcctcggcaccacgcccgacgccatcgacctcgccgaggaccgcgagcggttccagcagctcctgcacaagctggacctgaagcagccgcacaacggcatggcgcggagccgcgacgaggccttccgcatcgcgggcgagatcggctatccgctggtgatccggccctcctatgtgctcggcggccgcgcgatggagatcgtgcgcgacgacgcccagctcgaacgctacatccgcgaggcggtgcaggtctcgggcacctcgcccgtgctgctcgacagctatctctcgggcgccatcgaggtggatgtggatgcgctctgcgacggcgagaacgtgcatgtcgcggggatcatggaacatatcgaggaggcgggggtccattcgggcgactccgcctgctgcctgccgccccattcgctctcggccgagaccatcgccgaactgaagcgccagacggtcgagatggcccgcgcgctgcatgtggtgggcctgatgaacgtgcagttcgcgatcaaggacggggtgatcttcgtgctcgaggtgaacccgcgcgcctcgcggacggtgcccttcgtggccaaggccaccgacagcgccattgcgtccatcgcggcgcggctgatggcgggcgagccgctctcggccttcccggtgcgcgcgccctatccggcgggcgtgggtcccgacaccgacctgccgctggccgatccgctgacgctcgccgatccgatcacgccctggttctcggtcaaggaatcggtgctgcccttcgcccgcttccccggcgtggacccgctcctcggccccgagatgcgctcgacgggcgaggtgatgggctgggaccgcagcttcgcgctggccttcctcaaggcgcagatgggggcaggcacgcatctgcccgagagcgggcgcgtgttcctgtccgtcaaggatgccgacaagaccgcggcgctggccaaggccgcggccgggctcaccgcgatgggcttcgagatcgtggcgacgaagggcaccgccgcgtggctcaccgggcagggcatcgcctcgacctcggtcaacaaggtctacgagggacggccgaacatcgtcgaccggctgaagaacggcgacatcacgctggtgatgaacacgaccgagggcgcgcaggcgatctcggacagccgcgacatccgccgcgtggcgctgatggacaagatcccctacttcaccaccgccgccgcctccatcgccgccgtcgaggcgatgcaggcc

SEQ ID NO: 31648 - DNA, 1352 bp, Rhodobacter sphaeroides
ttcagcaccctcgggctgtccgagcgactcatgcagggcctggccaaggcccagttcacccaaccgacgccgatccaggtcgaggcgatcccctacgtcatgcagggccgcgacctgatgggcctcgcccagaccggcaccggcaagacgctggccttcgggctgccgctcctgcaccggctgctcggcgtgggccatccgccgccgccgcgcaccatccgcgccctgatcctcgcccccacgcgcgagctcgtgacccagatcgcgaccaacctcgagctcttcactaagggcacgccggtcaaggtcgtcaccatcaccggcggcgcctcgatcaaccgccagaccgagcggctcgcccgcggcgccgacatcatggtggccacccccggccgcctgatcgacctgctcgaccgcaatgcggtggtgctcgaccacaccggctatctggtgctggacgaggccgaccagatgctcgacatgggcttcatccacagcctgcggaagatcgcccgcttcctgccgctgaagcggcagacgctgctcttctcggccacgatgccgaagctgatcgaggagctggcccacacctacctgcgcgagccggtgaaggtgcaggtggccccgcccggcaagccggtcgagaagattgcgcagggggtgcatttcaccccgcagggcgacaaggcgaagctgctcgagagctatctccagaagcatccgggcgagcaggcgctggtcttcggccgcaccaagcacgggtcggaaaagctgatgaagctgctggtcagctggggcttcaaggcgggctcgatccacggcaacaagagccagaaccagcgcgaccgcacgctgaccgagttccgcgacggctcgctcgacgtactggtggccaccgacgtggccgcccgcggcatcgacattcccggcgtgagacatgtctacaactacgacatgcccaacgtgcccgagaactacgtccaccgcatcggccgcaccgcgcgcgccggcgccgagggcagcgccgtggccttcgtggccccggccgagatggaggagttccgcgcggtcgagaaacttctcaagcagcccattccggtgatcggcggcgcaccctgggccgcggacatcgtggcggcggcgccccgtcccggccagaagccgcggcagggcggacggccgaagaccggcgccaagccgcagggcaagccccaggccaaggcgcagccgaagccgcagggcgccgccaaggcccatccgcgggccgggcgcccggcgggcgcccccggcggccatgcggccccgaagcgcgcggcccgcggcccgcggcgcggagatgccgcccgcggctg

SEQ ID NO: 31649 - DNA, 761 bp, Rhodobacter sphaeroides
atgagcgcgctcggctgcttcaaggcctacgacatccgggggcggctgggcgtcgatctcgacgaggggatcgcctaccggatcgggcgggccttcgcccgggcgctcgacgcgcggacggtggtgctcggccgcgacatccgcgcctcgtccgaggcgctggccgcgcgggtggcggagggcctcggggacgagggctgccgggtgctggatctgggtctctcgggcaccgaggagatgtatgcggccacaagccacttcggggccgacggcgggatctgtgtgaccgcctcgcacaatcccatggattacaacgggatgaagatggtgcggcagggctcggcaccgctcgatgcggcgagcgggcttgcgcggatccgggagctggccgaggcggaggatttcggcgcggcccgtccgggcggggcggtcatgccggtggcagaggaggcgcggcgggcctatgtggagcgcgtgctgtccttcgtcgaggtggaggcgctgaagcccctgaagatcctcgtcaatgccggccacggcgcggcggggcccaccttcgacgccatcgcggcccgtctcgaggcgctgggggcgccgctcagcttcgagcggatgcaccatgcgcccgacggcaccttccccgccggcatcccgaacccgctcctgccgagaaccggccgcaccgcgggcgcgtgcgcgaacggcgccgatttcggcgtggctgggacgggattcgaccgtgtctcttcgacacgaggcgt

SEQ ID NO: 31650 - DNA, 917 bp, Rhodobacter sphaeroides
atgatcctctgctgtggcgaggccctgatcgacatgctcccccgcgagacgacggcaggagaggcggccttcgcgccctatgcgggcggggccgtcttcaacacggccatcgcgctcgggcggctcggcgcgcccgcgggcttcttctcgggcctctcgaccgatctcttcggggtgcagctcgccgagacgctggccgcaagccaggtcgagaccgatctctgcgcccgctcggaccggccgaccacgctcgccttcgtgcggctcacgaacgggcaggcgagctacgccttctacgacgagaacaccgccggccggcttctggccccggccgacctgcccgccctgcccgaccgggtgagcacgctcttcttcggcggcatctcgctggtgaacgagcctgcggccgccacctacgaggcgctgatggcgcgcgaggcgccgcgccgcgtgaccatgctcgatccgaacatccgcccgggcttcatcgccgatgcggcggcctaccgcgcccggatcggccggatgatcgcgctggccgacatcctgaagctctcggacgaggatctgcactggctcgaggggccgggacagatcctgtccctcgcccgcggcctcctggcccgcggcccgaagctcgtcctcgtgacggagggcgcggtgggcgcgcgcgccgtcaccgccacggaagaccggttctgcgccgcaacgccggtgcaggtggccgacacggtgggcgcgggcgacacgttcaacgcaggcgttctggccgcgctgcacgaggcgggtgcgctgtccaggtcggcagtggcgtccctctcccctgaaaccctcgccgcggccctcgcgctcggcacgcgggccgcggcggtcaccgtttcgcggccgggcgccaacccgccctgggtggacgagct

SEQ ID NO: 31651 - DNA, 1680 bp, Rhodobacter sphaeroides
gaaggggcgtgggcggatctcgggacgccgcgcaccatgcaccggtttctgggccgggccgcggccgaacatggcgaccggccggcggtgagcttccagctcctgtccgcgccgaagagccgggccgagacgctgagctggagccagctgcaccgccgcgtgacgcaggccgccaaccttttccgcagcctcggcgtgggcgagcgcgacgtggtggcctttgtgctgccgaactgcaccgagacggcggtgacgcttctcggcggcgcggtggcggggatcgtcaatcctatcaatccgctgctcgaggccgaccagatcgcggccatcctgcgcgagacgaaggcgcgggtcgtggtgaccttgcgcgcctttccgaagaccgacgtcgcccagaaggtggccgaggcggtgcgccatgcgcccgaggtgcgcacggtgctcgaggtcgatctcttgcgctacctcgggccgccgaagagcctgatcgtgccgctgatccggccgaagctgaagcccgcgcatcacgcccgggtgctttcgttcaacgcggagcttgaccgacagcccgcgacgctggccttccccgatcccgagatcgaccgggtggcggcctatttccacaccggcggcaccaccggcatgccgaaggtggcccagcacaaggtatcgggcatgatctacaacggctggtgcgggcagcgtctgctgttccagccgaccgacaccgtgatgtgtccgctgccgctgttccatgtcttcgcggcctatccgattctgatgtcgatgatcgcgagcggggcgcatgtggtctttccgacgcccgcgggctaccgaggcgagggggtcttcgacaatctgtggaagctgattgagcgctggcgctgcacctatctggtgacggtgcccacggcgctcgccgcgctgatgcagcgccccatcgatgccgacgtgagctcgctccgcggggccttctcgggctctgcgccgctgccggtcgagcttttcaaccggttcgagaaggccacgggcgtgcagattgtcgagggctacgggctgaccgaatgcacctgtctcgtctcggtcaatccgccggagggggcgaagaagatcggctcggtcgggctgccgttcccgcacacccatgtccgcatcctccattccaacggcagcggtcatgtgctgaaggaatgcggcgtggacgaggtgggcgagatctgcgtggccaatccgggagtctacgagggttcgacctacacggagctcgacaagaaccacgggcttttcgccgaggaccggttcctgcgcacgggcgatctcgggcgcctcgatgccgagggctatctcttcatcaccggtcgcgccaaggacctcatcatccggggcgggcacaatatcgacccggccgggatcgaggcggcgctgatgagccatccggcggtgagtttcgtcggcgccatcggccagcccgacgccttcgcgggcgagctgccctgcgcctatgtggagctggtgcaaggggccgaggtcgagacggcggcgctcttcgatcatgcccgggcccatatccacgaacgggcggccgtgccgaaacatatcgagatcctgcccgaactgcccaagacggcggtgggcaaggtgttcaagcccgacctgcgccgcctcgccatcgcgcgggtc

SEQ ID NO: 31652 - DNA, 1476 bp, Rhodobacter sphaeroides
gagcgggtcgtggccgacatgcgccgcgcgctcttcgaccggatgatgggcatgagccccgccttcttcgagcggatcatgacgggcgaggtgctgtcgcggctcacgaccgacacgacgctgcttctgtcggtgatcggctcctcgatctcggtggcgctgcgcaacctcctgatcctgatcggcgggctggtgcttctcctgttcacctcgaccaagctcactggcctcgtgatgctgctcgtgccgctcgtggtggtgccgatcgtcatcctcggccgcaagctccgccgcctctcgcgcgagaatcaggactggatcgcccagagttcgggcaatgcgtccgaggcgctcctgtcggtgcagacggtgcaggccttcacccacgagcgccagtcgcgcgccttcttcggcgatgtgacggagaagtcctttctgtcggccaaggaccggatcgggacgcgggcgctgatgacggtgatcgtgatcttcctcgtcttcaccgggatcgtgggcgtgctctgggtgggcgcgcgcgatgtgcgcgcgggcaccatgacgccgggcgagatggtgcagttcctcatctatgcggtgatggtggcgggctcggtcggcgcgctctccgagatctggagcgagctgcagcgggcggcgggcgcgaccgagcggctgaacgagctgctgacggccgaggatccggtgcaggatccggccacgccggtggcgctgccgcggccggtgaagggcgagatcagcttcgagggcgtgcgtttccgctatccggcgcggcccgaggtctcggcgctcgacgggatcgatctcgtcgtgcggccgggcgagacggtggcgcttgtggggccgtcgggggcgggcaagaccacgatcctccagctgctcctgcgcttctacgatccccagcagggggccgtgcgcatcgacggggtggatctgcgcgacatgacgcgcgacgatttccgccgtgccatcgccctcgtgccgcaggatccggtgatcttcgccacctccgcgcgcgagaacatccgcttcggccgtcccgaggccacggatgccgaggtggaggctgcggcccacgccgccgccgcgcacgatttcctgagcctcctgccgcagggctacgacacctatgtgggcgagcgcggcgtgatgctctcgggcgggcagaagcagcgcgtggcgctggcgcgggcgatcctgcgcgacgcgaagatcctgctcctcgatgaggcgacctcggcactcgatgccgagagcgaacgcgccgtgcagaccgcggtcgaggcgctggcgcagaaccgcacgacgctggtggtggcccacaggctcgccaccgtgaagcgcgcggaccggatcgtcgtcttcgacaagggccgcatcgtggccaccggcacccacgatgcgctggtggccgagggggggctctatgcccgtctcgcgcggctccagttcaccgac

SEQ ID NO: 31653 - DNA, 587 bp, Rhodobacter sphaeroides
atgcgcaaggccgagatcagccgcaagaccgccgagaccgacatctccgtgacggtcgatctcgacggcacggggcgctacgacatccgcaccggcgtgggcttcttcgaccacatgatggaccagctcgcccggcacgcgctgatcgacatcacgctgcgctgcgagggcgacctgcatatcgacgaccaccacacggtcgaggattgcggcatcgcgctggggcaggccctgacgcgcgcgttgggcgacaagcgcggcatccgccgctacggcagcttccacctcgcgatggacgatgcgctggtgcgcgcggcgctcgacctctcggggcgtcccttcctcgtctggaacctgcccttcccgaccgagaagatcggcagcttcgacaccgagctcgtgcgcgagttcttccaggcgctcgcgacccacggcgggattacactgcatgtcgacctgatccacggggtgaacagccaccatatcgccgaagcggctttcaaggcggtggcgcgcagcctgcgcgaggcggtcgagcccgacccgcgccgggcggatgccattccctcgaccaaggggatgctgtg

SEQ ID NO: 31654 - DNA, 768 bp, Rhodobacter sphaeroides
atgctcaagacccgcatcatcccctgcctcgacgtggccgacggccgcgtggtcaagggtgtcaatttcgtcgatctgcgcgacgcgggcgatccggtcgaggccgcccgcgcctacgatgccgcaggggcggacgagctctgcttcctcgatatccacgccacgcatgagaaccgcggcacgatgtatgacctcgtgacccgcaccgccgagcagtgcttcatgccgctgaccgtgggcggcggcgtgcggacccatcaggacgtgcgggcgctccttctggccggagccgacaaggtcagcttcaactcggccgccgtggccgatccgggcgtggtggccgaggccgccgaccgcttcggcagccagtgcatcgtggtggcgatcgacgccaagacggtggctccgggccggtgggagatcttcacccacggcgggcgccgcgccacgggcatcgatgcggtggcgttcgcctgcgaaatggcaagccgcggcgcgggcgagatcctgctgacctcgatggaccgcgacggcacacgggcgggcttcaacctccccctcacccgcgccatctcggacgccgtgccgatcccggtcatcgcgagcggcggagtgggcacgctcgatcatctcgtcgagggcgtgaccgaaggcggtgcgtccgctgtgctcgcggcctcgatcttccatttcggcgaattcaccatcggcgaggccaaggcccacatggccgccgccggcatccccgtgaggctcgcatgaccgtcc

SEQ ID NO: 31655 - DNA, 297 bp, Rhodobacter sphaeroides
gaacggctcgccgccaccgtcgaggcgcgcaagggcgccgatcccgacagttcctggaccgcgaagctctttgccaagggcccggagaaatgcgccgagaagttcggcgaggaagccgtcgaggccatcatcgaggcggtgcgcggcgaccgcgcgaagctcgcctcggaagcggccgatgtgctctatcacctcctcgtcatgctcgcggcccgggacgtgacgctggccgaggtgatggccgtgctcgaggcgcgcgagggcacctcgggcatcgcggagaaggccgggcggggc

SEQ ID NO: 31656 - DNA, 1125 bp, Rhodobacter sphaeroides
ctcctcgcgggaggtcgcggctcccgcctgcatgagttgacgtcccgcgaatgcaagcccgccctgcccttcgccgggccgcggcggatcgtcgacttcaccctcgccaatgcggcgcgctcgggcctgacccggatgatcgtggccacgcaataccgcccggagacgctggcccaccacctcgagagccgctgggccagccgcttcgccgggggcagcctgcgtctgcgcgagggcaccgcggtgacgggcagtcctcagggctatggcgggacggccgcggcggtggccgcgaacctcgccgagcttcagtccgaaggggtgcgcgagctcgtggtgctcgcggccgaccatgtctatgagatggattacgcggacatggtggcggcccaccgtgcgtctggcgcctccgccacggtggccgtggatacggtgcccaccgaccgcgcctcggaattcggcgtggtgcgcacgagcgaaggcggccgcatcgagagcttcctcgaaaagcccgcggtggtgcccgccgatccggccattcccggacgggcgcaggtcagcatggggatctatgtcttcgacctcgactggcttgcctcggtgctgcggatcatccccggcgcaacgcaggacttcggccatgacatcctgccgctcgcggtggccctgggcgaggcccatgcctaccgcgtgccgggcgacaacttctactggcgcgacgtgggcacgctcgatgcctaccgcctggcacagctcgagttccagacgggcgaggcaccctgcgcgctgccgccgcgcatcgcggcgagcgagcacgagatgaaggccgcgaccggcgagctgatccagttcgccttccgcatgcagaccggcggcatcgcgcttcattccccgcggctcggcggggacctgcccggccgctggaccatgctcgacgagagcgtgctgctgcccggcgcgcgcgtggcgcccggcgtgcgcctcacccgcaccatcgtggcccccggcacctcggtgcccgcaggtctcgtcatcggcgaggatcccgacgaggacgcccgctggttccgccgcaccgaggagggcacggttctcgtgacgacccccatgctcgcccgccgcgcc

SEQ ID NO: 31657 - DNA, 1965 bp, Rhodobacter sphaeroides
ccgccgctcaagttcgacatgtcctcggcccatcccaaccggctcggggcggatttcgacggcgagggcaccaatttcccccttttctccgagaatgccacgcgggtcgagctctgcctcttcgacgagaccggccagacccagacccactgcctcgatctgccctcctacgagggcgggatctggtacggctacctgcccggcatccgcgaaggacagacctacggctaccgtgtccacggcccccatgcgcccgaagagggccatcgcttcaacccgaacaagctgctgatcgacccctatgcccgcgaactgcgcggggacctgatctgggacgatgcgctcttcggctatccgatcggcggcgacgatctcgaactcgatccgcgcgacagcgcacccttcatgccgaaggcggtggtggtcgatccggccttcgactgggaggcggacaaggcgctccggcaccgctggcaggacaccgtgatctacgaggcccatgtgaagggtctgaccatgcgccatccgggcgtgccggaagaggatcgcggcaccttcaagggcctcgcctcgccggcggtgatcgaccatctgaaggccatcggggtcacggcgatcgagcttctgcccatccacggcttcctcaacgaccgccacctgatcgagaagggcctgtcgaactactggggctacaacacgctctccttcttcgcgccctatcggccctacacgaagtcgggctccatgcgcgaggtgaagcgggcgatcaagcggttccacgatgccggcatcgaggtgatcctcgatgtggtctacaaccacacctgcgagggcaacgagaagggcccgacgctctcgttccgcggcatcgacaatgcctcctactacctgctctcgcccgaggcgaagcgccattccttcgacacgactggcaccggcaacacgctcaacgtggcccatccgatggtgctgcgcatggtgatggactccttgcgctactgggtcgaagtcatgcatgtcgacggcttccgcttcgacctcgcctcgacactcggccgcgagcccgaggggttcgaacgcggcggcacgttcttcgcggcgatccggcaggatccggtgctctcgatggtcaagctgatcgccgaaccctgggacatcggcgagggcggctatcaggtcggcggcttcccctggccgttccgcgaatggaacgacaaggcgcgcgacgacctccgcgccttctggcggcgcgaccccgggctgatcggcgacgtgtcgcagcgtcttctgggctcgccggtgcagttctcccattcgcaccggcctgcgacctcgtcggtcaacttcatcgcggcccatgacggcttcaccgcctgggacctcgtctcctacgacgagaagcacaatgaggcgaacggcgaggacaaccgcgacggccattcgcacaacctgtcgcacaatctgggcgccgaggggccgaccgacgatcccggcatcctcgaggcgcggctgcggcgggtgaaggccatgctcgccacgctgttcctgtcgcagggcgtgcccatgatcctcgcgggcgacgagttcggccagagccagcagggcaacaacaacgcctactgccaggacaatgagatcgcctggctcgactgggaggaggcgcgcgacgagttgatccgcgccgtggcggacctcgccgagttccgcaaggccgacggcggcatatcgcgtgcccgcttcgccgtgggcccggacgcggtgcagcacgacacgccggtggctacgtggctccatcctgccgggcgcgagatggaggagggcgactggaacgagggcgagctcaggctcttcgcgctccggctcgacctcccgcgcgggcgcgacctcctcgtggtgctgaacgcgggcgacgacggcgacttcgcgctgcccgagggcgagtggcggctgaagatcgacacgtcg

SEQ ID NO: 31658 - DNA, 1203 bp, Rhodobacter sphaeroides
atggagttctctcagcacttccagaagctcattgacgacatgcgactggacgggcggtacaggacgttcgcggaactcgagcgcatcgccggggagtttccgaccgcgctctggcatggtccggacgggcaggccagacgcgtgacggtctggtgcagcaacgactatctgggcatgggccagaacgccgaagtgctggccgcgatgcaccggtcgatcgatctgtcgggcgccggcaccggaggcacccgcaacatctcggggaccaaccggcagcacgtcgccctcgaggcggaacttgcggacctgcacggcaaggaatccgcgctcatcttcacctccgggtggatctccaacctcgcggctctgggcacgctgggcaagattctgcccgaatgcgcgatcttctcggatgcgctgaaccacaattcgatgatcgagggcatccgccggtccggcgccgagcgcttcatcttccaccacaacgatcccgtccatctggaccggttgctttcgtccgtcgatccggcgcgcccgaagatcgtggccttcgaaagcgtctacagcatggacggcgacatcgcccccatcgccgaaatctgcgacgtggccgagcggcatggtgcgctgacctatctcgacgaggttcatgcggtcggactttacggcccgcgcggcggcggcatcagcgaccgcgacgggttggcggatcgggtgacgatcatcgagggcacgctcgccaaggctttcggcgtgatgggcggctatgtcagcggcccgtccctgctgatggatgtgatccgcagcatgtccgacagtttcatcttcaccacctcgatctgcccgcacctcgcggcgggggccctcgcggcggtccggcatgtgaaggctcatcccgacgagcgccgccggcaggcggagaatgcggtgcgcctcaaggtcctgctgcagaaggccggtctcccggttctcgacacgcccagtcacatccttcccgtgatggtgggcgaggcgcatctctgccgcagcatcagcgaggcgttgctcgcccgccacgccatctacgtccagccgatcaactatccgaccgtggctcgggggcaggagcggtttcggctgacgccgacgcccttccatacgacgtctcacatggaggcactggtcgaggcgctcctcgccgttggccgggatctcggatgggcc

SEQ ID NO: 31659 - DNA, 684 bp, Rhodobacter sphaeroides
cgcgtcatcgccatcaccggcacgcgcaagggcatcggccgcgcgctggccgagacctatctcgcgcgcggctggaccgtcgtcggctgctcgcgcgatgcgagcgacctcacgcacccggcctatcgccactacacgctcgacgtggccgacgagcgggcggtcgcgggcatgatgcaggatgtgcgccggacgcatggacggctcgacgcgcttctgaacaatgccggcatcgcctcgatgaaccatgcgctgctgacccccggcagcacggtcgagcgggtgttcgcgaccaatgtcttcggcaccttcctgttctgccgcgaggccgccaagctgatgggccgccgccgcaccggccggatcgtgaacttcgccaccgtggccacgccgctcaagctcgagggcgaggcggtctatgccgcctccaaggccgcggtcgtgtcgctgaccgaggtgctggcgcgcgagctggcgcccatgggcatcaccgtcaatgccgtggggccgaccccggtgcccaccgacctcgtcggcgccgtgcccgaggagaagatgcgcgcgctgatcgcccggcaggccattccgcgctacggcaagatggaggatgtgctcaacgtctgcgacttcttcctgcgcgacgaatccgatttcgtgaccggccagacgatctatctcggaggg

SEQ ID NO: 31660 - DNA, 1632 bp, Rhodobacter sphaeroides
atgaccgtcaagaccgtttccaccacgcccttttccgatcagaagcccggaacctccgggctgcgcaagaagacgccggtcttcatgcggccgcattatctcgagaatttcgtccagtcgatcttcgacgccatcggcggagcccgcggcaagaccttcgttctgggcggcgacgggcgctatttcaacgaccgcgcggcccaggtgatcctgcggatggccgccgccaacggcgcggcgcgggtcatcgtggggcagggcgccatcctctccaccccggccgcctcgcatctgatccgcctgcgcaagaccgacggcggcatcatcttgtcggccagccacaatcccggcggccccgaggaggatttcggcgtgaagttcaacacgccgaacggcgggcccgcgcccgagagcgtgaccgaggcgatcttcgaggccacgaagaccctctcggaataccgcatcttcgaggcgcaggatgtggatctgtcggtcgtgggccggacggtgctcggcgacatgcagatcgaggtggtggatccggtggccgactacgcggcgctgatggaaagcctgttcgatttcccggcgatccgcgcgatgttctcggacggcttcaccatgcgcttcgacgcgatgtgcgcggtgacgggcccctatgcgaccgagattctcgagaaccggctcggtgcggcgaaggggacggtcgtcaacggcacgcccttgcccgatttcggcgggatgcaccccgacccgaacccgacctgggccaaggcgctgatggacgagatgttctcggcggaggcccccgatttcggcgcggcctcggacggagacggcgaccgcaacatggtggtggggcgcgggatctatgtctcgccctccgacagtctcgcggtgctggcggccaatgcccatctcgcgcccggctacaaggcggggctcaagggcgtcgcccgctcaatgcccacctcggccgcggccgaccgcgtggccgaggccctcggtgtcgaggagttcgagacgccgaccggctggaaattcttcggcaacctgctcgatgcgggccgcgccaccatctgcggcgaagagagcttcggcaccggctccgaccatgtgcgcgagaaggacgggctctgggcggtgctcctgtggctgaacatcctcgctgtgcgcaaggaaagcgtgcgcgagatcctcgaggcgcactggcagcagttcggccgcaactactattcgcgccacgacttcgaggcgatcgagacggcgcgggcggacgccatgatggaggagctgcgcggcaagctcgtgggcctaacgggcgccgccttcaacggccatttgaaggtcgccgaggcggacgattttgcctataccgacccggtggatggctcggtcagccgcaagcagggcgtgcggatcctgttccaggatggcagccggatcgtgatgcggctgtcgggcaccggaaccgagggggcgacgctccggctctatctcgagcgctatgcgcccgggccggagggtctggatctcgacccgcaggaggcgcttggcccgatcatcgccgccgcgcacgagattgcggggatcgaacgccataccggccgccgcgagcccgacgtcatcacc

SEQ ID NO: 31661 - DNA, 2037 bp, Rhodobacter sphaeroides
cccggccgcccctggcccctgggggcgagcttcgatggcgagggggtgaatttcgcgctcttctcggcccatgccgagaaggtggagctctgcctctttgcgcccgacgggcggcgcgaggcgctgcggctgccgctgaccgagcgggacggggacatctggcacctgaaggtcaacggcctgctgcccgggcagctctacggctaccgggtgcacggcccctatcagcccgagcagggccacaggttcaacccgaacaagctgctgatcgacccctatgcccgcaagctcgaggggcggttgcgctggtcggatgcggtgatgggctacagggtcgggagcgcgcgcgccgatctgtcgttcgacggccgcgacagcgccttcgccgtgccgaagtcggtcgtggtggggcacaatttcaactgggggccggatgcgccgcccgagcgggcgctcaccgagacgctgatctacgaggcccatgtgaagggtctgaccgcgcttcatcccggggtggaggacggcctgcgcggcaccttcctcgggctcgcctcggacccgatcctcgagcatctgacgcggctcggcgtgaccgccgtcgagcttctgccggtgcaggcctttctcgacgaccgattcctcgtgaaccgggggctctcgaactactggggctatcagacggtgggcttcttcgcgcccgacccgcgctatctggccaagggggcgctctgggaattcgcggccatggtgcgccgctttcatgccgccgggatcgaggtgatcctcgacgtggtctacaaccacaccggcgaaagcgacgagctgggtcccacactctcgttccgtgggatcgacaaccggagctactaccggctgaccgagggcgggcggcgttatgccaacatgaccggcaccggcaacacgctcgatctgtcgcatccgatggtgctgcgcatggtgatggattccttgcgctactgggtcgaggtcatgcatgtcgacggcttccgcttcgatctcgcctcgacgctcgggcgcgaggaggatgcgttcgacgaacagggcgccttcttcgatgcgatccggcaggatccggtgctgacgcgggtgaagctcatcgccgagccgtgggatctggggccgggcggctaccggctgggcggctttccgcatccgtttctcgaatggaacgacaagttccgcgacgacgtgcgccggttctggcgcggcgagggcggcatgacgggcgatctcgcccgcaggcttctgggctcggccgaacggttcgaccaccacagccgcgcggccaccagctcggtcaatttcgtgacggcgcatgacggtttcacgctcctcgatctcgtgagccatgcgcgcaagcacaacgaggccaacggcgaggacaaccgcgacggccacgacgacaatcattccgacaatatgggcctcgagggcccgacgacggatgcgggaattctcgccgcccgggcgctgcggcggcggaacctccttgccaccctgttcctttcccaaggcacgccgatgctgctcgggggcgacgagatcggcaacggccagggaggcaacaataacgcctatgcgcaggacaatccgatcggctggatcgactgggaccggcccgacgagaccatgctggctttcgtcgcccggatctcggagctgcgccggagccttccggtgctgcggcagaagggcttcctgcacggtcggatccgggaggcggacgggctgcgcgatgtggtctggcggctgcccgacgggcgcgagccgggcccgcaggactggcattcgcctgcgatgagctgcctctgcgtcgagatccgcatggatgccgaccggccggatgcgggcgaaagcccggtgttcgccgtcttcaatgcaggcgaggccgtgccactggcactcccgcccgtccccgagagctggagcctcgtgctcgatacgacacggcccgaggccggccccgaacccgcggcgccggggcttgaagccccggcccgttccgtgctggtcttc

SEQ ID NO: 31662 - DNA, 1462 bp, Rhodobacter sphaeroides
atgaaggacagggacaggatggagacggcgcgcggacgggtgttgtcggtggcttccgaatgcgtgccgctgctgaagaccggggggctcgccgatgtggtgggcgcgcttccgggggcgctggcggcggaaggctgggagatgcgggtgctgatgcccctgctaccggccgctgaaatggcggctcgaggagatggaggaggtcttcgccgaagaggatctcttcggggggccggggcgggtgatggcgggcgaggtggccgggcggaagatgctgctccttgatgcgccgcatctctacgaccgcgagggcggcccctatgcgggtccggacggcgactggggcgacaatgcgcagcggtttgcggcgctttcctggatcggggcgcggatcgcgcgcgaggggctcggggacggctggcggccggatgtggttcatgcccacgactggcaggcgggcttcacgccggcctatatgaactattggggcagcggcggagcgagttcggtgctgacggtgcacaacatcgccttccagggctgggcgccggcgagccttctgtcggcgctgcgcctgccgccgcaggagttccatccggccgcgctcgaatattacggcgggctctcgtcgctgaaggcggggctggtctcggccgatcatatcaccaccgtctcgcccacctatgcctgcgagctgatgcggcccgagttcggcatgggcctgcagggcgtgattgcccagcgggctgggcaggtgaccggcatcctgaacggggtcgacaccgacatctggtcgcccgaggtcgaggagcggccctatgacgccgagagcctgaaggccaaggcggagaaccgcgccgtgctgtcgggcgccttcaaactgtcggtgccggggccgcttgcgatcctcgtgagccgcctgacctatcagaagggcatcgacctcatccccgaggtgctgccggacttcatcgccgcgggcgggggccttgcagttctgggcacgggtgacgcgccgctcgaggcggcgatgcgcgagctcgaggtgcgctttccgggtcgggtcggggtgcggatcggctatgacgaagggctgtcgcatctgatgttcgcgggcggcgatgcggttttggtgccctcgcggttcgagccctgcgggctcacgcagatgtacgggctgcgctacggggccattccggtggtggccctgacagggggccttgccgacacgatcatcaacgccaatccggccgccatggccgcgggctgtgcgaccggcctcaccttccatccgaccgagccgcccgccttcgccgaggcgctgaggcggctgatccatctttatgccgatcccgcggcctgggagacggtgcaacggaatgcgatgcgccatccggtgggctgggagacctcggccgcggcctatgcggcgctctaccgggagctcgtcgcgtgacagcgg

SEQ ID NO: 31663 - DNA, 1269 bp, Rhodobacter sphaeroides
atgaaggcgcaacccccactcaggctgaccgcgcaggcgatggccttcgtgctggccggcggccgcggcagccggctcaaggagctgacggaccggcgcgcgaaacccgccgtctatttcggcggcaaggcgcggatcatcgacttcgccctgtcgaacgcgatgaactcgggcatccgcaagatggccatcgccacccagtacaaggcccacagcctgatccggcacatccagcgcggctggaacttcttccgcgaggagcggaacgaatatctcgacatcctgccggcaagccagcgggtcgacgagaaccgctggtatctgggcacggccgatgcggtgacccagaatatcgacatcgtggacagctacgacatcaagtatgtgatcatcctcgcgggcgatcacgtctacaagatggattacgagatcatgctgcgccagcattgcgagaccggcgcggatgtgaccatcggctgcctgaccgtgccgcgggccgaggccacggccttcggcgtgatgcatgtggatgcgaacctgcgtatcaccgactttctcgaaaagcccgccgacccgccgggcatccccggcgacgaggccaatgcgctggcctcgatggggatctatgtcttcgactgggcattcctgcgcgacctgctgatccgcgacgccgaggatccgaactcgagccacgacttcggccacgacctgatccccgccatcgtgaagaacggcaaggccatggcgcaccgtttctcggacagctgcgtgatgaccggcctcgagaccgagccctactggcgcgacgtgggcacgatcgatgccttctggcaggccaacatcgacctcaccgacttcacgcccaagctcgatctctacgaccgcgaatggccgatctggacctattcgcagatcgtgccgccggccaagttcatccatgacagcgagaaccggcgcggcacggccatctcgtcgctggtttcgggggactgcatcgtttcgggcagcgagatccgcagctcgctgctgttcaccggctgccggacgcacagctattcctcgatgagccatgtggtggcactgccgcatgtgacggtgaaccggaaggcggatctgacgaattgcgtgctcgaccgcggcgtggtcgtgccggaagggctggtgatcgggcaggatgcggaggaagatgcgcgctggttccgccgctcggagggcggcatcgtgctggtgacgcaggacatgctcgacgcccgggcgcgggcgctgaac

SEQ ID NO: 31664 - DNA, 1557 bp, Rhodobacter sphaeroides
ttcttcctgacgtcggccgcgctgcaggacatcctgcgccgcttcaagagcgggcacggcgacctgcgggcgctgtcgcggcatgtcgcgatccagatgaacgacacgcatccggccatcgcgggcccggaactcatccggctcctcgtcgatgagcatgggctgtccttcgacgaggcgctgcccgtcgcgcaggagtgcctcggctacaccaaccacaccctcctgcccgaggcgctggaacggtgggccaccttcaccttcgggaacgtgctgccgcgccacatgcagatcgtcgagcggatcgacggatggcaccgccggaccttcccggcgcggccgcattatgtgggcatcgtcaagcaccacgaggtgcggatgggcgagctggccttcatcatgtcgcacaaggtgaacggcgtctcggcgctccataccgatctcgtgaaggccaacctcttccccgaactggaccggttgcatcccgagaagatcgtgaaccagaccaacggcgtcacgccgcggcgctggctgaagatggcgaacgcgccgcttgcccggctgatcggcgagacgatcggcgagggctgggaggacgatctcgaccggctgaaggggctcgagccgcatgtgaaggaccagggtttcctcggcgccttcgatgcggccaagcggcagaacaaggtgacgctgtcgaactggctcggggcggagtgcggggtgaaggtgagccccgatgcgctcttcgacgtgcaggtcaagcggatccacgaatacaagcgccagcttctgaacatcctcgagacggtcgcgcgctggcaggcgatccgggccaatcccgatgcgggctgggtgccgcgggtgaagatcttcggcggcaagtccgcgccgggctatgccgtggccaaggagatcatccatctcatcaacgatgtggccgcggtcatcaatgcggatccgctggtgggcgatctgctgaaggtgatctatcccgccaactacaatgtctcgatggccgagcggctggtgccggcggcggatctgtccgagcagatctcgacggcgggcaaggaagcctcgggaaccggcaacatgaagttcatgatgaacggcgcgccgaccatcggcacgctcgacggcgccaatgtcgagatcctgcaggaggtcggccgcgagaacttcttcctgttcggcctgacggccgaggaggtgatgaagcgccgcgaggatcccgatcacgcgcgcaaggccatcgaggccagccagatcatgcagaacgtgctgcaggccatcgccgagggccagttcagcccggggcaggccgatcgctaccacgggctcgtgcaccgggtctggcaccatgactatttcctcgtcgcctccgacttcgatgcctatctcgcggcccaggccgaggtggatgcggcctacaaggaccgtgcgcgctggctgaccatggccgcgctcaacacggcgcggtcgggcttcttctcgtcggaccgcacgatccgcgggtacatgaaggagatctggggggtggagtcggccctgcaggac

SEQ ID NO: 31665 - DNA, 2385 bp, Rhodobacter sphaeroides
ctgcgcctgcacccggacggaatgagctgcgcctcctgcgtggcgcgcaccgagcgcgtgcttgccgcggtgccgggcgtggccgaggcgcgggtgagcctcgcggacgagagcgcggacatccgctattccgatccggccacgccggaggctctggccgaggcgcttgcgcgcgcgggctacccggcccggcaggagcggctcaccctctcggtcgaggggatgagctgcgcctcctgcaccggccgggtcgagcgggtgctgaaggcgcagccgggggtgatcgaagccacggcgaacctcgcgagccgccgcgcgcaggtgacgctctgggagggcgcggccacggccgccgccctcgcgcaggccgtcaccaaggccgggtttgcggcctcgcccctcacggccgatgccccggatcgccgcgccgaggagatggcgatgctccgccgcgatgcctggctcgcggcgctgctgacgatcccggtgttcctcgtcgagatgggcggccatctcgtgcccgccttccaccactggatcgcgggcaccatcggcacgcagacctcgtggatcgcgcagttcctgctcacgagcctcgtgctggcggggcccgggcgacgcttctatgccaagggcgtgccggcgctcctgcgcggggcgcccgacatgaacagcctcgtggccgtcggcactttcgcggcctgggcttactcgacggtcgcgaccttcgcgccgggcctcctgcccgcagccgcccgctcggtctatttcgaggccgcggcggtgatcgtcgtgctgatcctgctcggccggctgatggaggcgcgcgcgcgggggcaggcgggcgcggccatcgcggggctcctgcgcctccagccgaagacggcgcgggtgagccgcgacggcacggagaccgaggtgccgatcgagagcatcgggcccggcgcgatcctcctcatccgtccgggcgagcgcattcccctcgacggggtggtggtggcaggcgagagcgcggtcgacgagagcatgttgaccggcgaggcgctgccggtcgccaaggccgagggggccgatgtcaccggaggcacggtgaacggcaccggcgcgctcaccatgcgggcgacgcgggtcggcgccgacacggtgctcgcgcggatcgtggccatggtcggagaggcgcagggcgccaagctgccggtgcaggcgctggtcgaccggatcacgctgcgcttcgtgccggtggtgatgggcgtggcggcgctcacggtgctcgtctggctcctgttcgggccgggccttggcgaggcgctggtggcgggcgtgtcggtcctcatcatcgcctgcccctgcgcgatggggctggcgacgccggtctcgatcatggtcggcaccggccgggccgccgagctgggcgtgctcttccgcaagggcgaggcgttgcagcggctgtccgaaatcgagcgggtggggttcgacaagaccggcacgctcaccgaaggccggccgcaggtgacggacgtcctgcccggcgaggggttgggccgcgaggagcttctggcgctggccgcggccgtcgaggcccggtcggaacatccgctggcgggcgcgatccggcgcgcggccgaggaccttccgccgctcgaggctgagggcttctcctcccggcccggccacggtgccgaggcgcgcgtcgcgggccggcgcgtgcgggtgggcagcctccggatgatggaggggctggatccgggcccgctcgggcccgaggcggcgcggctcgaggccgaagggcgcacgccggtctggctcgctctggacgaccggatcgccgggctgatcgccgtggccgaccgggtgaagcccacggcgcgggcggcggtcgaggcgctcgggcggctgggcctgcccgccgcgatggtcacgggagatgccccgggcgtcgcgcgcgccatcggacgggagctcgggatctcggacatccacgcgggtgtcctgcccggcggaaaggtcgaggaggtgacggccatgggccgggcggccttcgtgggcgacgggatcaacgatgcgccggcgctcgccgcagccgaggtgggcatcgccatcggcacgggcaccgatgtggccatcgaggccgcggatgtcgtgctcatgtcgggagatccggtgggcgtggccacggcggtggcactcagccgccggaccatgcgcaacatccgccagaacctcgcctgggccttcggctacaatgtggcgctgatcccggtggccgccggggtgctggtgccgttcggcgggccgcagctctcgccgatgctcgcggcgggcgcgatggccttctcgtcggtcttcgtgctgacgaacgcgctgcgcctgcgtcgcgcgcccgcg

SEQ ID NO: 31666 - DNA, 420 bp, Rhodobacter sphaeroides
atggccatcgaacgcaccctgtcgatcatcaagcccgacgccacccgccgcaacctgaccggcaagatcaacgccaagttcgaggaagccggcctgcgcatcgtggcgcagaagcgcatccacctgtcgctcgctcaggcgcagaagttctacggcgtccacaaggaccgccccttcttcggcgaactgaccgaattcatggcgtccgagccggtggtcgtgcaggtgctggaaggcgaaggcgccatcgcgaagaaccgcgaagtgatgggcgcgaccaacccggccaatgccgatgcgggcacgatccgcaaggaattcgcgctgtcggtcggcgagaactcggtccacggctcggatgcgccggaaaccgcggccgaagagatcgccttcttcttctcgggcctcgaactcgtcggc

SEQ ID NO: 31667 - DNA, 894 bp, Rhodobacter sphaeroides
ggctacgcctacgagaacgcctttgccggggccacgagcttcctgcgccgccgctacacgaaggacctgacgggggtcgatctggcgatcaccggcgtggccttcgatcaggcggtgacgaatcgcaccggcacccgcttcggaccccgcgcgatccgcgaagcctcgacgcttcagccctacgaccggccgttcggctggggcttcgatccgctggaagagctgacggtggtcgattacggcgacctcgccttcgactatgcccgcacggccgagtttcccgcccgcctcaccgcccatgtcgcgggcatcctcgcggcgggcgcgggcgcgctcacgctcggcggcgatcattcgatcaccctgccgatcctgcgcgcccatgcggcggtgttcgggccgctttcggtggtgcagttcgatgcccattccgatctctgggtcgatgacgatccgggccggatcgaccatggcaccttcatgtacaaggcggtgaaggagggcctcgtcgatccggcccggtccgtgcaggtgggcatccgcaccgacacgcccgactggctgggcatgaacgtgatcgacgcgcggacggcgcacgaacagggcccggccgcggtcgcggcgcgggtgcatgcgatcgtgggccaccatcccacctacctcaccttcgacgtcgacgcgctcgacccggccttcgcgccgggcaccggcacgccggtctggggcggcctcgcctcctggcaggccgcggcgatcctccgcgatctcgcgggcctgaacctcgtggggggcgatgtggtcgaggtctcgcctccctacgatccctccggcattacggccgtcgcgggcgcccatgtggcttacgagttgatctgtctctacggttggagaagg

SEQ ID NO: 31668 - DNA, 1089 bp, Rhodobacter sphaeroides
ctgcagccctcggtggtctatgcctcgctcgaccccgaccagctcgacgcgcaatatgcggggcaggtcaagggtttcacctatgcccgcgagggccatcccaatgccgaggtgctggcgcgcaagatcgatgcgctggaaggggccgagggcgggatcgtcgtgggctcggggatggcggcggtggcggcggtgctactgggccttctgcgtgcgggcgatcatgtggtgggcggcgaccagctctatggccggtcgctgcggatgatggccgaggatctgccgcggctcgggatcgccacctcgctcgccgatgccaccgatgcggcggcggtcgaggcggcgctccggcccgagacgaaactcgtgctgatcgaggtggtctcgaacccgacgcttcgggtagccgatctcgatggcatcgccgcgctctgccgcgcgcgggggatccttcttgccgtcgacagcaccttctcgaccccgcgggggatccggcccttcgaccatggcgcggatatcgtgatccattcggtgacgaagcttctggccggccattcggacgtgacgctcggctatgtcgcctgccgcacggccgagctgcgccgggcggtcgagctgttcgcggtgacgacgggccttacgcccagcccgttcgactgctggctggccgagcgcgggcttctctccttccacctccgctacgaccgggccgaggagactgccgcccggctggccgatcatctggcgggtctgccgggggtgcggcgcgtgatctatccgctgcgggccgatcatcccgatcaggcacgagcagtggcgctgctcggacggcgcggcggcaacatgctgtccttcgagctcgagggcgggcgcgcggcggccaatgcgctgacccgcgccatgccggccgtggccttcgcgcccacgctgggcgacgtcggcaccacgctctcgcacccggcctcctcctcgcaccgggcggtcgcgcctgaggtgcgggcgcggctcggcatttcggagggcttcttccgcatctcggtgggcgtcgaggaggcggatctcctgatccgcgacttcaccgcgggtgtg

SEQ ID NO: 31669 - DNA, 1377 bp, Rhodobacter sphaeroides
gccggaggacccgtgatgaccaggggctggaccaagaccgactggcgcgccaaaccgcgcatccagatgcccgattacccggacgccgctgccgtcaaggcggtggaggggcagcttgcgaaatatcccccgctcgtctttgctggcgaagcccgcaagctgaaggcggcgctggcggaagcggccgagggacgtgcgttcctgctgcagggcggcgactgcgccgagagcttctcggaattctccgccgacaacatccgcgacacgttccgtgtgctgttgcagatggccatcgtgctgacctacggcgcgaaagtgccggtggtgaaggtgggccgcatggccggccagttcgccaagccgcggtcggcgccgaccgaggtcatcaacgggatggagctgccctcctaccggggcgacatcatcaacggcttcgacccgagccccgaggcgcgcatccccgatccgcagcggatgctgcaggcctatacccaggcagcggcctcgctcaacctgctgcgcgccttctcgaccggcggcttcgcggatatccaccgcgtgcattcctggacgctgggcttctgcgagcaggacaaggcagagcgctaccgcgacatctcgaaccggatctcggacgcgctcgacttcatgtcggccgcgggcgtgaacggctcgacctcgcacaatctctcgacggtggatttctacacctcgcacgaggcgcttctgctcgaatatgaggaggcgctctgccgcatcgactcgatcaccggccagcccgtcgcgggctcgggccacatgatctggatcggcgaccgcacccgtcagatcgacggcgcgcatgtcgaattctgccgcggcgtgctgaacccgatcgggctgaaatgcggcccctcgaccacggtcgaggatctcaaggtgctgatggccaagctcaacccgcagaacgaggccgggcggctcacgctgatcgcgcgcttcggcgcgggcaaggtgggagagcacctgccgcgtctgatccgggccgtccgcgaggaaggggccaaggtgacctggtgctgcgacccgatgcacggcaacacgatcaaggcggcttcgggctacaagacccgcccgttcgattccgtgctgcgcgaggtgcgcgagttcttctcgatccacaaggccgagggctcgatccccggcggcgtgcatttcgagatgacggggcaggatgtgacggaatgcaccggcggcctgcgcgcggtgacggacgaggatctgtccaaccgctaccacaccgcctgcgatccgcgcctcaacgcctcgcagtcgctggagctggccttcctcgtggccgaggagctgacgacgatgcgggaagcggcgcggcgcgtg

SEQ ID NO: 31670 - DNA, 1497 bp, Rhodobacter sphaeroides
atcctcgtcccgggccaagccacgctcgcgcagctcgaagcgatctggcgcgaggggcggcgcgcgcgtctggcccccgaggcgcgccccgccgtcgaggcggccgccgcccgcgtggccgaggccgcggccggcacggcgccggtctatggcgtgaacacgggcttcggcaagctcgcgagcctcaagatcgctccggccgatacggcgcaactgcaacgcaacctgatcctgtcgcactgctgcggcgtgggcgagcctatgcccccgtccacggcgcggctgatgattgcgctgaagctcctgtcgctcggccgcggcgcctcgggcgtgcgctgggagatcgtggcgctgctcgaaggcatgctggccgcgggcgtcacgccggtgatcccggcgcaggggtcggtcggcgcgagcggcgatctggcacccctcgcccatatggccgcggtcatgatcggcgagggcgaggccgaggtcggcggcaggcgcctgcccggtgccgcggcgctggccgaggccggtcttgccccggtggccctcggacccaaggaagggctcgccctcatcaacggcacgcaattctcgaccgcctatgccctcgccggcctcttcgagggctggcgcgccgctcaggcggccctggtgatctcggccctctccaccgatgcgatcatgggctcgactgcgccgctccgccccgagatccacgcgctgcgcggccatgcgggccagatcgaggcggccgccaccatgcgcgccctgctcgaaggctcggccatccgcgagagccaccgtgagggcgaccagcgggtgcaggacccctactgcatccgctgccagccgcaggtgacgggcgccgcgatggatgtgctgcgcatggcggcgggcacgctggccaccgaggccaatgccgccaccgacaatccgctcgtgctctcggacgggcgcatcgtctcgggaggcaacttccatgccgagcccgtgggcttcgccgccgacatgatcgcgctggcgctctccgagatcggcgccatcgcgcagcgccgcgtggcgctgatggtggatccgacgctctccttcgaccttccgcccttcctcacccccgagccggggctgaattccgggctgatgatcgccgaagtgacgacggccgcgctcatgagcgagaacaagcacatggccgcccccaccgtcaccgacagcacgcccacctccgccaatcaggaagatcatgtcagcatggcggcccatggcgcgcgcaggctcggccggatggtcgagaacctcgcggtgatcctcgggaccgaggcgatctgcgccgcgcaaggggtggagttccgcgcgcccctcgccacctccgccccgctcggcgccgtgctggcgcggttgcgcgccgaggtgccgcggatcgcggccgaccgcatcctcgcccccgacctcgccgcggccgcccgcctcgtgcgcacaggcgcgctggcccgggccgcgggc

SEQ ID NO: 31671 - DNA, 1326 bp, Rhodobacter sphaeroides
aggaagctcttcggcaccgatggggtgcgcggcacggccaacacccatccgatgaccgccgagatggcgctgcggctcggcgccgcggcggggcgctatttccgcccggtgggcgcaggctcgccccgggtggtgatcggcaaggacacgcggctctcgggctacatgctcgagaatgcgctgaccgcgggcctcacctcgaccgggatgaacgtgctgcttctggggccggtgcccacgcccgcggtgggctttctcacccgctcgatgcgggcggcgctgggcgtgatgatctcggccagccacaatccgcacgaggacaacgggatcaagttcttcggtcccgacgggttcaagctgtcggacgaggccgaggccgagatcgaggcgatcctcgcgggcgagatccagcccgcgcagcccggcaacatcggccgcgccaagcggatcgaggacgggcgcgggcgctatcaggaatattgcaagacgaccttcccctcgggactgcggctcgacgggctgaaggtcgtgatcgactgcgccaacggcgcggcctaccgcgcggcgcccgaggtgctgtgggagctcggcgccgaggtgatcccggtgggggtcgaacccaacggcaagaacatcaacctgcgctgcggctcgacccatccccaggccgcgggcgaagcggtgcgcgcccatggcgccgatgtggggatctgcctcgacggggatgccgatcgcgtcatcatcctcgacgagaccggcaaggaggccgacggcgaccagatcatggcgctgttcgcggcccgctgggcggacgaggggcgcctccgcgacggaacgctggtggccaccgtcatgtcgaacctcgggctcgagcggttcctcggcgcgcgggggctccggctcgagcggacgccggtgggcgaccgctatgtggtggaagcgatgcggcgcggcggctggaacctcggcggcgagcagtcgggccatatcgtcatgaccgatttcgcgaccaccggcgacgggctgctggcggggctccagttcctcgcggccatggcccagaccgggcggcgcgcctcggaccttgcgcgcagtttcgagaccgtgccgcagcttctgcagaacgtgcgctacgcggccgggcaggagccgctcaaggcgccgggcgtgcaggcggtgatccgcgacgccgaggtgcggctgaacggggcggggcggcttctgatccgcaagtcgggcaccgagccgctgatccgggtcatggccgagtgcgaggacgaggcgctgctccgcgacgtggtcgaggagatcgtggctgccgtccgg

SEQ ID NO: 31672 - DNA, 2295 bp, Rhodobacter sphaeroides
ctcgtctcggtgcggcccagccccgagaatcccgactggggcggacccgccaccgtcctcaacatcggcatgaacgcggcccgccacgcggcgctcgcgcgcatccatggcgaggaggcggccgacgcgatctatctcggcttcatccagagctatgcgatccatgtggcccgcctcgatcccgagatgttcgagaccggcggctcctcctccgaggcgctccgcgcggcgctccatgcctgggccgaggagatggacgagcccttcccgcaggatcccgcacagcagctctccgaagtgctgcgctcgatggcgcgggcctgggagggaacgaccgcccggctcctccggcaggcgaagggcgcccccgccgaggcgcggctcggcctcgtcgtgcaggagatggcgcaggatctggggcaggggatctcgggctcgggcgtgatccagttcgtcgatcccgccaccggcgtcccgcaggtgacggggcgcttcttcaaccgctcgcgcgcctggcacggcaaggccgagacgctctatctcacgcaggatccgcgcggtccctcgctcgaggagcgcgcgcccgagatcttcgcggccctctgccgccacggctcggtctgccgcgcccgcctgcgcgaggagatgcagatcgaattcaccatcgaggacagccacctgtcggtgctcgacgcggtgaaggtgcagcgctcctcgcgggcggggctccgcatcgcggtggcgctggccgacgatcaggtcatcacccgctccgaggcgctcctccgggtcgagccgcgcgcgctctccgagcttctgcatccgcaggtcgatccgcgcgggcggcgcgaccgcttcgcccgcggcattgcggccagccccggggcggcggtgggccggatcgtcttctcctcgcaggcggcgcaggcctcggccgcgcgcggcgagccctgcatcctcgtccggcgcgagacctcgcccgaggatatccgcggcatgaactgcgcggcgggcgtgctgaccgagcgcggcggcgtcacgagccatgccgccgtgatcgcgcggggcctcggcctgccgtgcgtcgtgggcgcctccgagatccggctcgatgcgcgcgagcgccgtctcgtggcgcccgacgggcgcgtcttccgcgagggcgacctcatcaccgtggacggcacggcgggcgaggcgctcgcgggcgaggcggccatgctcgcgcccgcgctcgacagctgcttccgcaagctcctctcctgggccgacgagatgcgcgacatcggcgtgcgcgccaatgccgacacgcccgccgatgcgctcgtcgcgcggcagttcgaggcgcagggcatcggcctctgccggaccgagcacatgttcttcaccgacgaccggctcgtggtgatgcgcgagatgatctttgccgacagcgcgaccgaccgggcggcggctctggcgcggctgctgccgatgcagcgcgccgatttcgtgcagctcttcgagatcatgcagggtcatccggtctgcatcaggctgctcgatccgccgctgcacgagttcctaccccattcgcgcgaggggctgctggagctggccgaggcgctcgaccggcccctgtccgaggtcacgcggcgcgtcgaggcgatggccgagttcaatcccatgctggggatgcggggcgtgcggctgggtgtggccatccccgagatctacgacatgcaggcgcaggcgatcttcgaggcgacgctggaggtggcgggccgcggcgatccggtggtgcccgagatcatgatcccgctcgtctcggcgcggcgcgaggtcgagctggtcaagacccggatcgatgcggtggctgcggcggtccataccaaatacggccgcgagttcgcctaccggctgggggtgatggtcgagacgccgcgggcggcgctgcgggcgggcgagatcgcgcagcacgcggccttcctctccttcggcaccaacgacctgacgcagatgacctacggcctctcgcgcgacgacgcggggcgtttcatgaacacctacgtccagagcggggtcttccccgaggatccgttccacattctcgacgtggacggggtgggggaactgctgctgatcggggcggaacgggggcgggccacgcggcccgatctggtggtctcgatctgcggcgaacatggcggcgaccccgaatcaatcgagttctgccgccgcgccggcttcgactatgtgtcctgttcgccctatcgcgttccgctggctcggctggcggccgctcatctggcgatc

SEQ ID NO: 31673 - DNA, 1140 bp, Rhodobacter sphaeroides
gtccacgggggcagccgccggagccagtatggcgaaatggccgaggcgatcttcctgacccagggcttcgtctacgactcggccgaacaggccgaagcgcgcttcatcgagaccggcgccgacgaattcatctatgcccgctacggcaaccccacgacgcgcatgttcgaagagcgcatcgcggccgtcgagggcaccgaggatgcgttcgccaccgcctcgggcatggccgcgatccacggcgtgctcacctcgatcgtgcgggcgggcgatcatctggtggcggcgcgcgctctgttcggctcctgcatctacatcctcgaggaggtgctgggccgattcggcgtcgaggtgaccttcgtcgacggcaccgatctcgatcagtggcgcgcggcggtgcggcccggcacgaaggccgtgttcttcgagtcggtctcgaatccgacgctcgaggtggccgatatcggcgccatcgccgagatcgcccatgccgtgggcgcgctcgtcatcgtggacaatgtcttcgcgacgcccgtcttctcgacggcggtgcggcagggcgcggatgtggtgatctattcggccaccaagcacatcgacgggcaagggcgcgcgctcggcggcgtggtctgcgcctcgcaggccttcatccgcaaggtgctcgaacccttcatgaagcacaccggcggctcgatgagccccttcaacgcctggctcatgctgaacgggatggcgacgctcgacctgcgctgccgcgcgatggccgacacggccgagaagatcgcccgcgcgctcgagggccatccgcagctcggccgcgtgatccatcccgcgctggaaagccacccgcagcacgagatggccaaggcgcagatggagcgtcccggcacgatgatcgcgctcgacctcgccgggggcaaggaggcggccttccgcttcctcgacgccctgaggatcgtgaagatctccaacaatctgggcgatgcccgctcgatcgcgacccacccggcaacgaccacccaccagcgtctttccgacgcgcagaaggcccatctcggcatcacgcccgggctcgtgcggctgtcggtggggctcgaggatgcggacgacctgatcgccgatctgaaacaggcgctcgcg

SEQ ID NO: 31674 - DNA, 2133 bp, Rhodobacter sphaeroides
ctcaggcggttgcgggacagtctggccctgtccggaaagggccaggaccggctggaccgcatcacgtccctgattgcggactcgatgcggaccgaggtctgctcgatctatctcttccgcgaccccgacacgctcgagctctgcgcgacccagggtctcaatcccgaagccgtccaccagacgcggctgaagatgggcgagggccttgtcggccgcgtggcgcggatggcgagcccgatcaacaccggcaacgcgccgtccgagcgcggcttccggttcatgcccgagaccggcgaggagatctattccgccttccttggggtgccgatccagcgcgtgggcgagaagctcggcgtgctggtggtgcagtcgcgcgaggcgcgggaatattccgaagacgaggtctatgccctcgaggtggtggccatggtgctggcggaaatggccgaactgggcgtcttcgtgggcgagggcgaggcgctgtcggccaaacatacgcagcccgtgctgatgcgcgggtcgaccgggcaggagggcgcggccgagggccatgtctggctgcacgaggcgcgcgtcgtggtcacgaacccggtgggcgacgatccggtgcacgagaccgaacgcatccgcgccgccgtggcgcagctgcgcgtctcggtcgacgatcttctctcggcctcgacgctcgacaaggatcagcggcaggtgctcgaggcctataggctcttcgcccattcccgcggctggctgcggcggatggaagaggacatcatggccggcctctcggccgaggccgcggtgcagaaagagcagtcagccgcccgcgcgcggctcgagcaggtgcccgacgcctatctgcgcgaccggctccacgatctcgacgacctgtcgcaccggctgctcaggatcctgaccgggcaggggcgcgacaccggcgccgagatgccggagaacccggtgctcgtggcgcgcaacatcgggcccgccgagcttctggaatacggccgcaagctgcgcggcatcgtgctcgaggagggttcggtcggctctcatgccgcggtcgtggcgcgggcgctggccattccgctggtcattcatgccgagcggatcaccaccgaggcgctgaacggcgatcatatcatggtggacggcgacaacggcctcgtgcatctgcgccccgaggcctcgatcgccgcggccttccgcgacaagatggcgatgcaggccaaggcgcaggagcgctacgcctcgctccgcaacctgcccgcccagtcgaaatgcggcacggtcacgggcctcatgatgaatgcggggctcatggccgatctgccctcgctcgattcctcgggggccgagggcgtgggcctcttccgcaccgagcttcagttcctgatccgcaaccagatgcccaagcgcgacgagctggcgcggctctatgcccgggtgatggatgccgcacgcggacaccgggtggtgttccgcacgctcgacatcggctcggacaaggtgctgccctatctcaagccgcaggatgagccgaaccccgcgatgggctggcgcgcgatccgcgtcgggctcgacaagcccggcgtgctgaggatgcagcttcaggcgctgatccgggcctcggcggggcgcgatctgtcgatcatgttccccttcgtgtccgaacaccacgaattcatgatggcccgcagccatctgctgcgcgagctgcaccgcgagcgcagcctcggccatccggtgccggtgaacatccgcgtgggcaccatgctcgagacgccgagcctcgcctacgcgccgcgcgccttcttcgagaccaccgatttcatctcgatcggcggcaacgacctgcgccagttcttcttcgcggccgaccgcgagaacgagcgcgtgcgccggcgctacgacgtgctgaacgtgagcttcctgaccttcctcgagcatatcgtgaaccgctgcgccgagacggcgacgcccctgtccttctgcggcgaggatgccggccgcccggtcgaggccctgtgcttcgcggccatgggcatccagacgctctcgatgcgccccgcctcgatcggcccggtgaaggcgctgctgcgccgcgtggatctgatcgaggcccgcaaggtgatc

SEQ ID NO: 31675 - DNA, 1248 bp, Rhodobacter sphaeroides
atgccgcttctagtgatgaaattcggcggcacctccgttgccgatctggcgcgcatcaagaacgccgcgcagaaggtcaagcgcgaggtggagcgcggctatgacgtgatcgtcatcgtctcggccatgtcgggcaagaccaacgagcttgtgggctgggtcgagcagacctcgcccctgttcgacgcgcgcgaatatgatgcggtggtctcgtcgggcgagaatgtgacggcgggcctgatggcgctgacccttcaggagatggaggtacccgcgcgcagctggcagggctggcaggtgccgatcaggaccacctcgcagcattcggccgcgcgcttcctcgagatcccgcgcgaaaatctcgacgcgaaattcgccgaaggcttcaaggtcgcggtggtcgcgggcttccagggcgtgagccccgaggggcggatcacgacgctgggccgcggcggctcggacacgacggccgtggcctttgccgccgctttcgccgccgagcgctgcgacatctataccgacgtggacggggtctatacgaccgatccgcggatcgcgtccaaggcgcgcaagctggaaaagatcgcctacgaggagatgctggagctcgcctcgctcggcgcgaaggtgctgcagacccgctcggtcgagctggcgatgcgctacaaggtgaagctacgggtgctgtcctcgttcgaggacacggacgagacctcgggaaccctggtctgcgacgaggaggatatcatggaatcgaaagtcgtctctggcgtcgcctattcgcgcgacgaagcgaaaatgaccctcgtcaccgtcgaggaccgccccggcgtcgccgcggcgatcttcgggccgctggccgaggccggggtgaacgtggacatgatcgtccagaacatctcggaaaaggactacggcagccatcccgggtcggtcaccgacatgaccttctcctgcccgatcaatcaggtggcccgcgcgcgcaaggcgctcgaggatgccaaggccgagggcaccatcgtctatgacgatctggtggtcgacaccgaggtggccaaggtctcggtcgtgggcatcgggatgcgcagccatgcgggcgtcgcggcgaccatgttcaaggcgctggccgccgacggtgtgaacataaaggtcatcgcaacctccgagatcaagatttcggtgctgatcgaccggaaatatatggaactcgcggtgcaggcactccatgatgccttcgcattggag

SEQ ID NO: 31676 - DNA, 1023 bp, Rhodobacter sphaeroides
acgcgcatcctcgtgaccctgccctccgaggcggcgtcggatcccgccatcgtgcgcgagctggtggcggcgggggcggatgccttccgcatcaactgcgcccatgacggccccgaggcctgggcggcgatgatcggccacatccgcaagtccgagcggatgacgggacgcaagctgccgatctcgatggatctcggcgggccgaagttccgcgtgacgaagaccggcgggccgctgcccaagcgcctgcaggccggcgaccgcttcgccttcgtcgagaaaccctcgttggcgcccgaaggccggggctgggccatgctcggccatcccgcgctgcttgccgcccttgcaccgggcgtgcaggtctcggtggacgatggcaagctctgggccacggtgatccagaccggccgggggcacgcgctcctcgaggtggaccgcgtgggcgagcgcgggctgaagctgaagcccggccgcggggtgaacctgcccggctcgcatctcgatgtggccgcgctgaccgaggaagaccttgcggcgctcgatgtggtggtggccgaggccgacctcgtggccttctccttcgtccagacaccgggcgacgtgcgcgccctgatcgcggcgatggaggcgcgggcctgccatccgcgcccgctcccggcgatccttctgaagatcgagaccccgatggggctgcatctcctgcccgagctgatcgtcgaggccggcggctcgctgcccgtgggggtgatgatcgcgcgcggcgatctcgccgtcgagatcggcttcgaccggctctccgagatccaggaagagatcctctggctctgcgaggcggcaaaggtgccggtggtctgggccacgcaggtgctggaagggatggtgaaggagggtcaggccagccgcgccgaggtgaccgacgccgcgatgagccagcgggcggactgcgtgatgctgaacaaggggccgcatgtggcggccgccatcgagttcctccgcgacatcctgatccgcatggaccgc

SEQ ID NO: 31677 - DNA, 516 bp, Rhodobacter sphaeroides
gtccgcgactatatccgcaccatcgtggacttcccgcacgaggggatcctgttccgcgacgtgaccacgctgtttgccgacccgcgcggcttccgcatcgccatcgaccagcttctggcgccctacgccgggatgcggttcgacaaggtggcggggctcgaggcccgcggcttcatcctcggcggcgcggtggcgcaccggctctcgacgggcttcgtgccgatccggaagaagggcaagctgcccggccgcaccatctcggtcagctaccagctcgaatatggcgaggcggtggtcgaggtgcatgacgacgcgatccaggcaggcgagaaggtgcttctggtcgacgatcttctggcgaccggcgggacggccgaggctgggatcaagctcatcgagcagctgggcggacaggtggtgggctgcgccttcgtggtcgatctgcccgacctcggcggccgcaagcggctcgaggcgatggggatggaggtccatgccctctgcgccttcgagggc

SEQ ID NO: 31678 - DNA, 1451 bp, Rhodobacter sphaeroides
ggactgagcccgggggcgcgcgtagagaggcacccggaggtgcccatgctgaaccccgccgacgatgccttcctcgcccggctggccgggcgcctgccgccgggctcgctgaccgcgcccgagccgcgccatctgaccgagccgcgcggccgcaggcaggggcaggcgggcgcgctggcgctgccgcgcgacacggccgaggtggccgcgatcgtcgcggcctgcgccgcggcgcgggtggggatcgtgccgctcggcggcggcaccggcctcgtgggcgggcaggtgatggagacgggcccgctgccgctcctcctctcgctcgagcggatgaaccgcgtgcgggggatctttccggaggagaatgtgattctcgtggaagcgggggccatcctcgccgaggtgcaggcggcggccgaagcggcggggcggatgttcccgctctggctcgcctcggaaggctcctgccggatcggcggcaatcttgcctcgaatgcgggcgggacggcggtcctgcgctacggcaatgcgcgcgacctctgcctcgggctcgaagcggttctgccggacgggtcggtgttccacgggttgaagcggctgcgcaaggacaataccggctacgacctgcgcaacctgttgatcggcgccgagggcacgctcgggatcatcacggcggcgagcctgaagctcgtgcggccgcccgcggcggaaggggccgcgcttctggcggtgcgcgaccccgccgcggcactggagctgctggggcgcgcgcagcggcggctcgggccgctggtgacggggttcgagctcatgcaccggcagggcttcgcctttctggccgagaccatgcccgagcggcggttgcccttcgccgacctgccggactggacggtgctcgtcgatctgggcctgaccgagggcatggatcctgcggccgagctcgaggctttgttcgccgaagcggccgaggcggggctcgtctcggacggggccctcgcgcagtcgctggcccagcggcggatttctgggcgctgcgcgagagcatccccgaggccaaccgccggatcggcgccatcgcgagccacgacatctcattgcccctgtcggagatcgcgcgcttcgtgacggaggccggtgcggcgatcggacggctcggcgatctgcgggtgaactgcttcggccatctgggcgacggcaacctgcattacaacgtcttcccggcggcggggcggcggcgcgaggcgtacgacgacctgcggggcgagatcacgcgcaccgtgcacgatctcgtggcggcggccggaggctcgatcagcgccgagcacgggatcgggcggctgaaggtggaggatctcgaacgctacggcgatcccgcgaagctgcgggcgatgcgcgccctcaaggcggcgctcgaccccttcgggatcatgaacccgggcgccgtgctgcgg

SEQ ID NO: 31679 - DNA, 1194 bp, Rhodobacter sphaeroides
ctgccgaacggcttccgcatcgtcaccgagcacatgcccgggctgcattcggcctcgatcgggatctggatcgcggcgggcggtcgccacgagcggcccgaacagaacgggatcgcccatttcctcgagcacatggccttcaagggcacgaagacccgcagcgcgctgcgcatcgccgaggagatcgaggatgtgggcggctacatcaacgcctacacctcgcgcgagatgacggcctattacgcccgggtgctcgaggccgacaccgggctcgcgctggacgtgatcgccgacatcgttctgaacccggtcttcgacccgaaggagatcgagatcgagcggcacgtcatcctgcaggagatcggccaggcgctcgacacgcccgacgacatcatcttcgactggctgcaggaggcctcctaccccggtcaggccttcggccgcaccatcctcggccccgaggagcgggtctcgaccttcgggcgcgccgatctcacgcgcttcgtgggcgagcattacggcccggaccacatgatcctcgccgctgcggggggcgtcgatcacggcaggatcgtcgcgcaggcgcaggcgctgttcggtcatctgaagccggtgggccagcgcccgatgcagcccgcggacttcctcggcggcgagcggcgcgagctgaagtcgctggagcaggtccatttcgccatggcattcgaggcgccgaactaccgggcgcccgacgtctatgcggcgcaggtctatgccatggcgctcgggggcggcatgtcctcgcggctcttccagaaggtgcgcgaggagcgcggcctctgctattcgatcttcgcccagtcgggcgcctacgaggataccgggcagatcacgatctatgccggcacctcgggcgaggaggtggccgatctcgcggggcttacggtggacgagctgaagcgcgccaccgaggacatgtccgaggccgaggtcgctcgcgcccgcgcgcagctcaaggccgggctcctgatggggctcgaaagcccctcgaaccgggccgagcggctggcgcggcttctggccatctggggcagggtgccgggcgtggacgaggcggtggagaagatcgacgcggtgacggtcggggcggtgcgcgactatgcagagcgcatggcgcaggcccgctcggcgctcgcgctctacggcccggccgag

SEQ ID NO: 31680 - DNA, 1113 bp, Rhodobacter sphaeroides
atcacggcggcggtgctcgaacgcgacgggatcgcggggaattatgccgaggagcggccgctcgcgatccgcgagctcgatctcgcggagccggggccgggcgaggtcctgatccgggtggccgccgcgggcatctgccattccgacctgtcggtcatcaacggcacgcggcggcggccgctgccgatggtgctcggccacgaggcctcgggccatgtcgaggctctgggcgagggggtcgaggatctcgagcacggcgaccatgtcgtctgcatcttcgcacccggctgcggccgctgcacgccctgcgccgaggggcggcctgcgctctgcgagaaggcggcgcgccatcatgcggtgggcgaactgatgaccgggcaccggcggctgtcgctcggcgggcggtccgtgcaccatcacctcggcatctcgggcttcgccacccatgccgtggtggcgcggccgtcgctggtccgcgtcccgcgcgaggtcccgccccatgtctcggcgcttttctcctgcgccatgctgacgggggcgggggccgtcttcaacacggcgcagatccggcccggctcgaaggtcgccgtggtggggctgggcggcgtcggcctgtccgccatcctcggcgcggcggcggccggagcggccgagatcgtggcgatcgacccgtttcccgccaagatggaggccgcgcgcgccatgggcgcgacgctctcggtgcccgcggacggagatacggtggcggcggtgcgcgacctgacggcgggcggcgtcgattacgccttcgagctggcgggctcggtccgggcgctcgaaaccgccttcgccgtcacccgccgcggcggcatgacggtgaccgcgggcctgccccacccggacgaccggatgtcgctcgaggcactgaagctcgtggccgaggagcgcaccctgaagggcagttacatcgggtcctgcgtgccccagcgcgacctgccgcggatgctggcgctgcaccgccgcggcctgctgccggtcgagaagatgctgacccaccggctgaagctcgacgagatcaacctcgcgatggaccggctggccaagggcagcgcgatccggcaggtggtggacctc

SEQ ID NO: 31681 - DNA, 2646 bp, Rhodobacter sphaeroides
cagaagacccgcaagaccctcagcgtcggcggctctagctatgcctactactcgattccggcagcggaggaagccggtctcggccagttcgcccgcctgcccgccgcgctgaaggtggtgctggagaacatgctgcgcttcgaggacggcaagacggtgtcggtcgacgacatccgcgccttctcggaatggggcgcgaacggcggccggaacccgcgcgagatcgcctatcgcccggcccgcgtgctgatgcaggacttcaccggcgttccggcggtggtggaccttgccgcgatgcgcgacggcatcctcgggctcggcggcgacgcgcaaaagatcaacccgctgaacccggtcgatctcgtcatcgaccactcggtcatgatcgacgaattcggcaatccgcgcgccttccagatgaatgtggaccgcgaatacgagcggaacatggaacgctacaccttcctcaaatgggggcagaaggcgttcaacaacttccgcgtggtgccgccgggcaccggcatctgccaccaggtgaacctcgaatatctcgcgcagacggtctggaccgaccgtgaccaggacgggatggaagtggcctatccggacacgctggtgggcaccgattcgcacaccacgatggtcaatggtctggccgtcctcggctggggcgtgggcgggatcgaggccgaggccgcgatgctgggccagccggtctcgatgctgatccccgaggtcgtgggcttcaagctgaccggccaaatgatcgaaggcacgacggccaccgacctcgtgctgaaggtcgtgcagatgctgcgcaagaagggcgtggtgggcaagttcgtcgaattctacggcgagggtctcgaccatctgccgctcgcggaccgcgcgaccatcgccaacatggccccggaatatggcgcgacctgcggcttcttcccgatcgacggcgagacgctgcgctacctgcgccagacgggccgggacgagtcgcgcatcgcgctggtcgaagcctatgccaaggccaacggcctgtggcgcgacgcctcctacgagccgatctacaccgacacgctgcatctcgacatgggcgagatcgtgcccgccatctcgggcccgaaacgcccgcaggactacctgccgctgaccgacgccaaggcttcgttcgcgcgggagatggagacgagcttcaagcgcccggtgggcaaggaagtgcccgtcgcgggcgaagactacaccatgtcctcgggcaaggtggtgatcgcctcgatcacctcctgcaccaacacctcgaacccctatgtcctgatcggcgccggcctcgtcgcccgcaaggcgcgcgcgctggggctgaaccgcaagccgtgggtcaagacctcgctcgcgcccggatcgcaggtcgtgtccgaatatctggaggccgcgggcctgcaggaggatctggacgcggtgggcttcaacctcgtgggctacggctgcaccacctgcatcggcaactcgggcccgctgcagccggagatctcggccgccatcaacgagggtgacctcgtggccgccgccgtgctctcgggcaaccggaacttcgagggccggatcagccccgacgtgcgggcgaactacctcgcctcgccgccgctggtggtggcctatgcgctggccggcgacatgaacatcgacctgacctcggagcccatcggcatgggcacgaacgggccggtctatctcaaggacatctggcccaccaacgccgagatcgccgagctggtcgagaagaccgtgacccgcgaggccttccagaagaaatatgccgatgtcttcaagggcgatgccaagtggcagtcggtctcgaccacggacagccagacctacgactggccggcgagctcgacctacatccagaacccgccctacttccagaacatgtcgaaggagccgggcgtcatcaccgacatcaccggcgcgcgcgtccttgcgctcctcggcgacatgatcaccaccgaccatatctcgcccgcgggctcgttcaaggagagcacgccggccgggaaatatctggtcgagcggcaggtctcgccgcgcgagttcaactcctacggctcgcggcgcggcaaccacgaagtgatgatgcgcggcaccttcgccaacatccgcatcaagaacgagatgctggacggggtcgagggcggctacacgctcgggccggacgggcagcagacctcgatcttcgacgcctcgatggcctatcaggcggcgggcaccccgctcgtcctcttcggcggcatcgaatatggtgcgggctccagccgtgactgggcggccaagggcacggcgcttctgggcgtcaaggcggtcatcgccgagagcttcgagcgcatccaccgctcgaacctcgtcggcatgggcgtgatcccgttcgagttcaccgaaggccagaaccgcaagtcgctgggcctgaagggtgacgagacggtctcgatccagggcctctccggcgatctgaagccgctgtcgctggtgccctgcaccatcacctacggcgacggcacggtgaagacgatccagctcaagtgccggatcgataccgagatcgagatcgaatatgtcgagcacggcggcgtgctgcattacgtgctgcgcgacctc

SEQ ID NO: 31682 - DNA, 753 bp, Rhodobacter sphaeroides
aagcgggcaatcgtcaccggctcgaactcgggcatcgggctgggctgcgccgaagagctggcgcgcgccggcgccgaggttgtcatcaactccttcaccgaccgcgacgaggatcacgcgctggccgagaagatcggccgcgaacatggcgtgagctgccgctacatcgcggccgacatgtcggacggcgaagcgtgccgggcgctgatcgagacggcgggcggctgcgacatcctcgtgaacaacgcgggcatccagcatgtctcgtcgatcgaggagttcccggtcgggaagtggaacgcgatcctcgcgatcaacctctcgtcggccttccacaccacggcggcggcgctgccggggatgcgggcgaagggctgggggcggatcgtcaacatcgcctcggcgcacgggctgacggcgagcccctacaagtcggcctatgtcgcggccaagcacggggtggtgggcttcaccaaggtcaccgcgctcgagaccgcgggcaagggcatcacctgcaacgcgatctgcccgggctatgtgctgacgccgctggtcgaggcgcagatccccgaccagatgaaggcgcacgacatggaccgcgagacggtgatccgcgaggtgatgctcgaccgccagccctcgcgccagttcgcaacgaccggtcagatcggcggcacggtggtgttcctctgctcgggtgcggccgatcagatcaccgggacgacgatctcggtggatgggggctggaccgcc

SEQ ID NO: 31683 - DNA, 996 bp, Rhodobacter sphaeroides
atgcgcccgatccaagccgcctatccccatgcccgcttccgccgcacccgccgcaccgacgcgctgcgccggctcacgcaggaatatacgctgaccacgggcgatctgatctggccgctgttcgtgcgtgacggggagaatatcgaagagccgatccactccatgccgggcgtcgtgcgccgctcggtcgaccggatcgtggccgcggccgaagaagccgcaagcctaggcatcccggcggtctgcctctttccctacaccgatccgtccttgaagaccgagctctgcgaggaggcctggaacccctgcaacctcgccaaccgggcgatccgcgccatcaaggccgcggtgcccgagctggccgtcatgaccgatgtggcgctcgatccctacaatgccaacggccatgacgggctggtgcgcgacgggatcatcctgaacgacgagacggtcgaggcgctggtccggatggcgctggcgcaggccgaggcgggcgcggacatcctcgggccgtcggacatgatggacggccgcatcggcgcaatgcggaccgcgctcgaggcggcgggccacaaggatgtggcgatcctctcctattcggcgaaatatgcctcggccttctacggcccgttccgcgatgcagtgggcgcctcgggcgcgctcaagggcgacaagaagacctaccagatggatcccggcaactcggacgaggcgctgcggctgatcgagcgcgacctgcgcgagggcgctgacatggtgatggtgaagcccgggatgccctatctcgacatctgccggcgggtgaaggacgctttcggcgtgccgacctacgcctatcaggtctcgggcgaatatgcgatgatccggggcgcggccgaccgcggctggatcaagggcgaggccgcgatgatggagagcctgctctgcttcaagcgcgcgggctgcgacggcatcctcacctatttcgcccccgaggcggcacggcttctgaacggc

SEQ ID NO: 31684 - DNA, 3214 bp, Rhodobacter sphaeroides
atgcatgtcgtcttccgcgaaagccacgggctcgaggagagtgcgaccccgttcgatcccgggcagacgcctgcggatctggtggtcctgtccttctccgacagcgatctcggggccttcgcggcgggctggcaccgggctgagggcgggcttccctccacccggctcctgaacctcgtggcgctgcgccatccgctctccatcgacacctatgccgagacggtgctggcccatgcgaaggcgatcctgatccggctgatcggcggcgagagctactggagctacgggctggccgaggtgcaggacctctgccggcgccgcgggatcgcgctcgcggtcctgcccgcggacgggcgcgaggatccggcgctcgatgcgctttccacgctgccggtctcgacgctgcggcggctgtccgcgctctgcgatgcgggtggagcggtggcggcgcaggccgcgctcgcgcagctggcgctggcggcggggctttatgccggcccggtgccgggcgagaaacggatgcccgacatgggctggtacgaccccgcccgcggcgtgatccccgaaccggaggcggagggcggacccgccatcgtcgtgaccttctaccgcagttacctgaccgccgccgacacggggcccgtggacgcgctgattttcgcgcttcgcgaacggggcttccgcgccttcggcctcttcgcgccctcgctgaaggcgccgggcgcgcccgactggatcgccgccggtctcggccgcctgaggcccgcggccatcgtcaatgccaccgccttctcggccaggggccccgagggctcgcccctcgacggccccggctgtccggtgtttcaggtcgcgctctcgaccgcgcggcggcgcgactgggccgtggccgagcgcggcctctcgcccgccgatctcgccatgcatgtggtgctgcccgaggtggacggtcggatcttcgcaggcgccgtcagtttcaagtcgcccggcaaacgctgcccggacctgcaatattcccgtttcgcccaccgcgccgatcccgcccgcgtggcggccgtggccgaccgggtggcggcctggcaccggctggcccggacgcccgcacccgagcggcggctggccctcgtcctctcgacctatcccggccgtcccgaccagatcgcccatgccgtgggcctcgatgcgctggcctcggccgaggcgctggcggccacgctggccgcggcgggctatgccacagcctccggcgcggacctcgccgaggcgctgctgaccgagcggcagagctggccgctcgccgcctacgaggccgcgctcgcaaccctgccggcccccctgcaattcgcgcttcgtgaagcctggggcgcgcccgaggccgatcccgattgccgcgacggcgccttccgcttcgcggccctgcggcgcggccaccttctcctcgcgctgcagcccgaacggggcgagacggcggcacgggatgccgattaccacgatctcgcccgcgtgccgcgccatgcctatgtggccttctacctctggctccgcgcgcactccctgcatgcgatgatccatatgggcgcgcatggcacgctcgaatggctgccgggcaaggcggtggcgctgtcggatgcctgctggcccgaggcgctgaccggcgcgctgccggtgatctatccgttcatcgtgaacgatccgggtgaggcggcgcaggcgcggcgcaggctcggcgcgctgacgctgggccatatgccgccgccgctgcgcgagagcgccctgcccgaaaatctcgaacgtctggaacggcttctcgatgagtattccaccgccgacgggctcgatccggcccggcgcgggcgcctgatcggcgccatccgagacgaggcgcgcgccgcgggcgtcgaggaggatctgggcctgccccccgacgccaccccggccgaggccatcacccggatcgaccgtttcgtctgcgatttgaaggaaagccgctacggcgaggggctgcatctctacggtgcggccccgggcgagaccgaggggcttctggccgccctcgacggccgccgggtggccgccggcccatccggctcgccgcatcggggccggacggatgtgctgcccacgggccgcaacctctattccgtcgatccgcgcgccgtgccctcgcgcgcggcccatgcgcagggggtgaagctcgccgaggaactgctccgccgccacctgcaggatcagggcgactggccgaaggggctggtgatcgacctctggggctcggcctcgatgcggacggcgggcgaggaattcgccatggcgctgcatctggcgggcctctccccccgctgggacgaggggtccgagcgggtctcgggtgtcgagatcctgccgctcgcgctgctggggcggccccgcatcgacgtgacgctgcgggtctcgggcctcttccgcgacatcttccccggcctcgcccagctcttcgagaccggcgccgaggcgcttgccgcccgcgaggaggcacccgaggacaatccctatctccgccgcagcccgcgggtcttcgggcctaagccggggctctacggcgtgggcgtgcggtcggatgactacagccccgaggggcggctcagcgcgggcgaggcctggatcgagggctcgtcctgggcgatcggggcggatggcgccggccacgcccgcgcgcggtgcgctcgaagggcggctccgcgccgccgacgccttcgcccatgtgcaggatctggccgagaccgaccttctgatggcgcaggaccatgccgcccacgagggtggttttgccgcggcgctggcccggctcgggcgcgaggcggcgctctatcacctcgacgccacccgccccgaccggccccgcgcccgcagcctcaccgaggagctgagccgcatcgtgcgtgcgcgcatcgccgatcccgcctgggccgatggcatgatgcgccacggcttccggggcgcggccgagatcgcggcctcggtcgatcatctgggaagcttcgccaatctcacccgcgcagtgcccgacgggctcttcgacctctgcttcgaggcgacgctgatgcgcgaggatctcgtggccttcatggcccgcgaaaaccccgcggcccttgccgccctccgcgaccgcttccgcgctcttgccgaggccgggctctggcagccgcgccgcaattccatcgcagccctcctcgcc

SEQ ID NO: 31685 - DNA, 1080 bp, Rhodobacter sphaeroides
gtagagctgggcgcgcgcgcctacgaggtgcggatcgggccggggctcatcgcgcgggcgggggccgagatcgcgccgctcctgcggcggccgaaggtggcgatcctcaccgacgagacggtggcggggctgcatctcgatcccttccggcaggcgctggccgaggcgggcatcgcctcctcggcgctggcgctgcccgcgggcgaggccaccaagggctggccgcagttcgcccgcgccgtcgaatggctgctcgaggagaaggtcgagcggcgcgacgtggtggtggcgctgggcggcggggtgatcggcgatctggcgggcttcgcggccgccgtcctgcgccgcggcgtgcgcttcgtgcaggtgccgacgacgcttctggcgcaggtcgacagctcggtcggcggcaagaccgggatcaacacggcccaaggcaagaacctcgtcggcgccttccaccagccctcgctggtgctggccgacatcggcgtcctcgagacgctgccgccgcgcgacttccgcgcgggttacggcgaggtggtgaaatacggcctgctcggcgacgccgatttctacgaatggctggaggaggcgggcccgcggctggccgctgacgccgaggcccgccagcgtgccgtgcgccgctcggtcgagatgaaggccgagatcgtggcccgcgacgagaccgaggagggcgaccgcgcgctgctgaacctcggccataccttctgccacgcgctggaaaaggccaccggctattccggccggctcctccatggggaaggcgtggccatcggctgcgcgctggccttcgagctgagccagcgtctcggcctctgcgcccaggaagcgccgagccgcctgcgcgcccatctgcgggccatgggcatgaaggtcgacctccgcgacatcccgggcgatctgccctccgccgaggcgctgctcgccctgatggcgcaggacaagaaggtggtggacggcaagctgcgcttcatcctcgcccgcggcatcggacaggccttcgtcgccgatgacgtgccgggagacgtggttcgcacgctgcttgaggatgccctg

SEQ ID NO: 31686 - DNA, 504 bp, Rhodobacter sphaeroides
atggtgggcatgatgggggcgggaaagacggccgtgggcagcgcgctggcccggggtctgaacgtgccctttctcgattcggacgaggagatcgagcgggccgccaaccggaccatcgccgaaatcttcgcccgcgacggcgagcccttcttccgcgagaaggagagccaggtcctcgcgcggctcctgcgcggcagcccctgcgtgctctccaccggcggcggcgccttcatggccgagggcaaccgccgcatgatccgcgagcagggcgtgtcggtctggctcaaggccgacctcgacgtgctctggcaccgggtgcggcacaaggcgacgcggccgctcctgcgcacgcccaacccgcgcgagacgctgcgcgcgcttctcgaggcgcgcgatccggtctatgcgcaggcggatctcgcggtggaaagcggcgagggaacggtggaacagatggcggtgcgggtgcgcgaggcgctggccacccgccccgatgtgctggag

SEQ ID NO: 31687 - DNA, 2337 bp, Rhodobacter sphaeroides
tatcccgtgctgccgctgcgcgacatcgtggtgtttccccacatgatcgtgccgctgttcgtcgggcgcgagaagtcggtccgtgctctcgaggaggtgatggccgacgaccggcagatcctgctgtcttctcagatcgatccgtccgtggatgatccggccaccgacgggatctaccgttccggcgtgctggcgaatgtgctccagctgctcaagctgcccgacggtaccgtgaaggtgctggtcgagggcaagagccgcgtgcgcatcaccgacttcctgagcaacgactcgttcttcgaggcgcgcgccgagcggctcgacgaggagccgggcgatcaggcgacggtcgacgcgctgctgcgcgccgtggccgaggaattcgagcggtacgcgaagatcaagaagaacatcccagaggaggcgctggccgccgtgtcggagacccgcgatgccgcgcgcctcgccgacctcgtggcgggccatctcggtatcgatgtggcgcagaagcaggcgctgctcgagacgctcgacgtggcagagcggctggagaaggtctatggccacatgcagggcgagatgtcggtcctgcaggtcgagaagaagatcaagacccgcgtcaagtcgcagatggagcgcacccagcgcgaatattatctgaatgagcagatgaaggccattcagaaggagctcggcgacggcgaggacggccagaacgagatcgccgagctggaagagcggatcgccaagaccgagctgtccaaggaggcccgcgacaaggccgaggccgaggtcaagaagctgaagtcgatgtcgcccatgtcggccgaggccacggtggtgcgcaactatctcgattggctcctcggcgtgccgtggggcgtgaagtcgcgcaccaagaaggacctgaccaaggcgcagggcgtgctcgatgccgaccatcacgggctcgagaaggtcaaggagcggatcgtcgaatatctcgccgtgcaggcgcggtcggccaagctcaagggcccgatcctctgcctcgtgggccctccgggcgtgggcaagacctcgctcggccggtcggtcgccaaggccacggggcgcgagttcatccgcatctcgctcggcggtgtgcgcgacgaatccgagatccgcggccatcggcggacctatatcggctcgatgcccggcaagatcatccaggcgctgaagaaggccaagaccaccaacccgctcatcctgctcgacgagatcgacaagatggggcaggacttccgcggcgatccggcctcggccatgctcgaggtgctcgatccggaacagaactcgaccttcgtcgaccactatctcgaagtggaatacgacctgtcgaacgtgatgttcctgaccacggcgaacagctacaacatgccgtcgccgcttctggaccggatggagatcatcccgctctcgggctacaccgaggatgagaagcgcgagatcgccaagcagcacctgatcccgaagcagatcgagaaccacggtctgaagaagggcgagttcaaggtcaccgatgaggcgcttaccgagacgatccggacctacacccgcgaggcgggggtgcggaacctcgagcgtgagatcgcgaagatggcgcggaaggccgtgaccgagatcgtcaagggtcacaccaagtcggtcgaggtgacgcccgagaagctggaaggcttcctcggcgtgaagcgccaccgctacggtctggccgagaaggaggatcaggtgggcgtcgtcacgggcctcgcctggacctcggtcggcggcgaactcctctcgatcgaggcgctgcggctgccgggcaagggccggatgaagaccacgggcaagctcggcgacgtgatgaaggaatcgatcgacgcggcctcgagcttcgtccgctcgatctcgcccgagctcggggtgaagccgccgaagttcgagacggtcgacatccacgtccatgttcccgagggggcgacgcccaaggacgggccttcggccggtgtggcgatggtgacctccatcgtctcggtcctgacgggcgttcccgtccgcaaggacgtggccatgacgggcgaggtgacgctgcgcggcaacgtgctgcccatcggcggtctgaaggagaagctcctcgcggcgctgcggggcggcatcaagacggtgctgatcccggaggagaatgccaaggatctcgccgagatcccggacaatgtgaaggaggggctgcggatcatcccggtctcccatgtccgcgaagtgctgcgtgaggctctggtgcggatgccggagccggtcgagtgggacgaggaggccgaggaggccgccgccgcc

SEQ ID NO: 31688 - DNA, 1185 bp, Rhodobacter sphaeroides
atgggctggaagacactcgacgacatggatcttgccggcaaggtcgtgctggtgcgcgtggatgtgaacgtgccgatggaaaatggcgaagtcaccgacgccacccggatcgagaagatcgtccccaccgtcgaggatatcctgaagaagggcggcaagcccgtcctgctcgcccatttcggccgtccgaagggcaaggtcgtggacgagatgagcctccgcctcgtgctgcccgcgctgcagaacgcgctgcctggcaccaaggtgagctttgccgccgactgcgtgggccccgagcccgagcaggcggtggccgccatgctcgagggcgaggtgctcctcctcgagaacacccgcttccatgccggcgaggagaagaacgaccccgagctggccgccgcgatggcgaagctggggcaggtctatgtcaacgatgccttctcggccgcgcaccgcgcccatgcctcgaccgagggcctcgcccgtcttctgccctcggccgccggccggctgatggaggccgagctgaaggcgctcgaagccgctctcggccatcccgagcgccccgttgtggccgtggtgggcggggccaaggtctcgaccaagctcgaccttctgggcaatctcgtgggccgggtcgatcatctggtgatcggcggcggcatggccaacaccttcctcgtggcgcaggggatcgaggtcggcaagtcgctggccgagcgcgacatggccgatacggcgcgcgagatcctctccaaggcgaaggccgcgggctgcacgatccatcttccgctcgatgtggtggtggcgcgcgagttcaaggcgggggccgcgaacgagacggtcgagacggcggcctgcccggccgacgcgatgatcctcgatgccggtccgaagaccgtggccgccctctccgaagtgttcgcctcggctaagacgctgatctggaacggcccgctcggcgccttcgagatcgagcccttcgacgccgcgacgaatgcggcggcgcttcaggtggcgcagctcaccaaggcgggccagctcatttcggtcgcgggcggcggcgatacggtggccgccctcaacaaggcgggcgcggccgaaggcttctcctacatctcgacggcgggcggtgccttcctcgaatggatggagggcaaggagctgcccggagtggccgcgctc

SEQ ID NO: 31689 - DNA, 949 bp, Rhodobacter sphaeroides
tcgaaggaggagcttgtccgttactaccgcgagatgctcctgatccgccgcttcgaagagaaggcgggccaactctacggcatgggcctcatcggcggcttctgccatctctacatcggccaggaagccgtggtggtcggcctcgaagccgccgccaaggagggggacaagcgcatcacctcctaccgcgaccacggccacatgctggcctgcggcatggatgccaagggcgtgatggccgagctcacgggccgcgagggcggctattcgaagggcaagggcggctcgatgcacatgttctcgaaagagaagcatttctacggcggccacggcatcgtgggcgcccaggtgccgctcggcgcggggctggccttcgccgaccgctatctcggcaacgacaatgtcaccttcacctatttcggcgacggtgccgcgaaccagggccaggtctacgaggcctacaacatggcccggctctggagcctgccggtgatcttcgtgatcgagaacaaccagtatgcgatgggcaccagcgtgaagcgctcgacgaaatcgccctcgctctgggagcgcggcgcggcctacggcatcaagggcgagtcggtggacggcatggatgtgctggccgtgaaggccgcgggcgagaaggcggtcgccgcctgccgcgcgggccaggggccctacattctcgagatgatgacctaccgctaccggggccactccatgtccgacccggccaaatatcgcacccgcgaggaagtccagcggatgcgcgacgagaaggacgcgatcgaacatgtccgcgacctggctgatccagggcaatctcgcgaccgacgacgacctcaaggcgatcgacaaggagatcaaggccgtggtgaacgaggccgccgacttcgccaaggagagccccgagcccgcgctcgaggaactctggaccgacatctac

SEQ ID NO: 31690 - DNA, 1389 bp, Rhodobacter sphaeroides
atggcaacccaggttctgatgcccgccctgtcgccgacgatggaggaaggcacgctcgccaaatggctggtgaaggaaggcgatgcggtcaagtccggccagatcatcgccgagatcgagaccgacaaggccacgatggaattcgaggccgtcgacgagggcacggtgggcaagctgctcgtggccgagggcacgtccggcgtgaaggtgaacacgcccatcgccgttctggtcgaggagggggagagcgccgacgaggtgcaggctccggtcccgacccagaaggaaaagcagcccgagcccgccgaagcctcggaaggcaaggccgtggacgagccgctcgtctcctcgccgggcgccccggtgccgggcaagcgcgaccgctcgcccgactggccggacggcacgcagatgaagaccatgacggtgcgcgaggcgctccgcgaggcgatggcggaagagatgcgcggcgacgagcatgtcttcctgatgggcgaggaagtgggcgagtatcagggcgcctacaagatcagccagggccttctggacgagttcggcgaccggcgcgtggtcgacacgccgatcaccgagcatggcttcgccggcatcgcggtcggcgcggccttcggcgggctccgccccatcgtcgagttcatgaccttcaacttcgccatgcaggcgatcgaccagatcatcaactcggccgccaagacgctctacatgtcgggcggtcagatgggctgccccatcgtgttccgcggcccgaacggcgccgccgcgcgcgtgggcgcccagcacagccaggattatgcggcgtggtatgcgcagatccccggcctcagggtggtgatgccctattcggcggcggatgcgaaaggtcttctgaagaccgcgatccgcgacccgaacccggtgatcttcctcgagaacgagatcctctacggccggtccttcgaggtgccggtgatggacgatttcacgatccccttcggcaaggcccggatctggcgcgaggggacggatgtcaccatcgtctccttcggcatcggcatgacctatgcgctggaagcggccgacaagctcgccgccgagggcatctcggccgaggtgatcgacctgcgcacgctgcgccccatcgattacgagacggtgatcgagtcggtgaagaagaccaaccgctgcatcaccgtcgaggagggctggccggtgggctccatcggcaaccatctcgccgcgacgatcatgcagcaggccttcgactggctcgatgcgccggtgctgaacctgacgggcaaggacgtgccgatgccctatgccgccaatctcgagaagcacgcgctcgtgaccacggccgaggtggtcgaggccgcgaaatccgtctgctaccgc

SEQ ID NO: 31691 - DNA, 1323 bp, Rhodobacter sphaeroides
atggcaaccgagatcctgatgcccgcgctgtctccgacgatggaggaggggacgctcgcgaaatggctgaagaaggaaggggatgaggtccgctcgggcgacatcatcgccgagatcgagaccgacaaggccaccatggagttcgaggcggtcgacgagggcatcctcggcaagatcctgatcgccgagggcacggcaggcgtgaaggtcaacacgcccatcgccgtgctggtggaagagggcgagagcgtggacgccgtgtcctccgccaaggtgccggagccgcaggaaccggccgacgaggccgcacccgcgcagggggctccgaaggaggcccctgccccggccgccaaggcgcccgcggcgcaggcggcccgatccgagggagagcgcgtcttcgcctcgccgctcgcccgccggatcgccaaggagaaggggatcgaccttgccgcggtgcagggctcgggcccgcgcggccggatcgtgaaggccgatgtcgagggggcgcaaccctcggccgctcccgccgccaaggcggacgccgcggcaccgaaggcagaagcgcccgccgctgcggccgcgcccgtcgccgcgccggccgcctccgcggcttcggtggcgaagctcttcgcggatcgcgactatgaggaagtgaccctcgacgggatgcgcaagaccattgccgcgcgtctgtccgaggccaagcagaccatcccgcacttctacctccggcgcgaggtggctctggatgcgctgatggctttccgcgccgatctcaatgcgaagctcgagagccggggcgtaaagctctcggtcaacgacttcatcatcaaggcctgtgcggtggcgctccagcaggtgccgaacgcgaatgccgtctgggccggagaccggatcctgcggctgaagccctcggacgtggcggtggccgtggcgatcgagggcgggctcttcacgccggtcctgcgcgatgcgcaccagaagagcctgtcggcgctgtcggccgagatgaaggatctcgccgcccgcgcccgcacgaagaagctcgcaccgcacgaatatcagggcggcagcttcgcgatctcgaacctcggcatgttcggggtcgagaatttcgatgcggtcatcaacccgccgcacggctcgatcctcgccgtcggcgcaggcatccgcaagccggtggtgggcaaggacggcgcgatcacgacggccaccatgatgtcgatgacgctctcggtggaccaccgggtgatcgacggcgcgctgggggccgagttcctgaaggcgatcgtcgagaatctcgagaacccgatcgccatgctg

SEQ ID NO: 31692 - DNA, 1380 bp, Rhodobacter sphaeroides
atggcgccgaggttcggaacgagcggcctgcgcggcctggtgacggagctgacgccggatctggtctcggcttatgtcagggccttcctgcgggcctgtccgcagggcgcagggctttacctggggcacgacctgcgaccctcctcgcccgccctggccggggtggtggcggaggcggcccgtcatgcgggtgttcctgtgaccgattgcggagcgctgcccacgccggcgctggcgctggccgcgaggcgggcaggcgcgcgcgcggtgatggtgaccggcagccatatccccgccgaccgcaacggattgaagttctatggtccgggcggcgagatttccaaggcggacgaagccgccatcctgtcgggcctcggcgagccgttgccgccccggacgccgccggcgcctctcgcctgcgatgcgagcgcaggcgaggcctgggtccaccgctacgtcacggccttcgggccagaagccctgacgggcctgcgcatcggggtctggagccacagcgcagtcagtcgggacctgctgcttgccgccctgcgtgccctgggtgctgcggcggtggtggaactcggccgctcgaccgcgttcgtcccggtcgacaccgaggcggtaccggagggggtgcgcgcccggatcaaggcctggactgccgaacatcgcctcgatgccctgatctcgaccgacggggatggggatcgcccgcttctggccgatgcctgcggacagatcgtcccgggcgacctgttggggcagatcaccgcggcgctggtcggggccgaaacggtggtcaccccggtcagttccaacaccggcgtcgaggcgggaggtcggttccggcgggtgatccggacgcggatcggctcgcccttcgtcatcgcggccatggaagaggctgggggccgcagcgtgggctacgaggcaaacggcggcttcctgctggggttcgacgcgcaccttgaaggtcctctgccgcaacttccgacacgggacagcctgttgccgctcctggctccgctgtctctcgcgcaggcggccggcgggctggccgcgctggtcgggcgcgagccggcccgcttcacggccgccgaccggctcgagggcgtgccggacgggaaggcccaggcgctggttgcggagttcggggccagtcctgaggagcttgcaggatttctggcgatcctcggcgaggagatccgcagcctcgatcgtaccgacggtctgcgtgcgacctgcgcgtccggacggatcgtccacatccgcccctcgggcaatgcgccggaaatgcggctctatgtcgaggccgaaacccccgctgcggcgcgggatctgctggagcgaggcttgcggaagcttgagctgaccttgatg

SEQ ID NO: 31693 - DNA, 2556 bp, Rhodobacter sphaeroides
acggacccgcacagccgccccgccgaagcctgccttgaagccctcgacgtttgccccagtggcctcaccgacgccgaagccgccgcccgactggcgcgccacggtccgaaccgcctgcccgaggcgcgcacgcgcggcccggtccgacgcttcctcgcccagttcaacaatgtgctgatccatgtgctgctcgtggcctcggtcgtgacggctgcgctgcagcactgggtcgacaccggcgtgatcctggcggtcgttctggccaatgcggtcatcggcttcatccaggagggcaaggcggaatccgccatggcagcgatccgcgggatgctggccccccacgccgccgtcctgcgcaacggacggcgcgtctcgatcgacggcgctcatctcgtgcccggcgacattgtcctgctggaggccggcgacaaggccccggccgacctgcgcctgatcgaggcgcgcggcctcgcggcgcaggaggcgatcctgacgggcgagtccgtcccggtcgagaaggcgacctaccccgtcgcggccgatgccccgctcggtgatcggcgctcgatgctctggtcgggcacgttggtaacgcagggcgcggcccgcggcgtcgtcaccgccaccggcgccgcaaccgagatcgggcggatcggcggcctcctggcgggggtggagcagctgaccacgccgctcgtcgcgcagatggaccatttcgcgcgctggctgtctttcctgatcctgctcgtcgcggcccttctcctgctctggggctatttcgtcggccacatggtgttcgtcgatctgttcatgaccgtcgtcgccatcgccgtggccgccatccccgagggcatgccggcggtgatgacgatcacgctggcgatcggcgttcaggccatggcacggcgcaacgccatcgtgcgccgcctgccggcgatcgaatccatcggctcggtctcggtcatctgcaccgacaagaccggcacgctgacgcgcaacgagatggtggtggtcgccgcggaaacgccccagggcgccttccgcatcgccggcgagggctatgcccccagcggcgagatcacccctccgggcgacctgacgcggctggcccgcgcggccgcgctgtgcaacgacgcggccctgcacgaccggagcggcgtctggtcggccgagggcgacccgatggagggggcgctgctggccttcgcgggaaaggccgccagtggccctgccgcgacccggctggatgccattcccttcgacagccgccatcgcttcatggcggtgctgacggaaggctccgggggccggatgatccatgtgaagggcgcgcccgaacgcgtcctgagcatgtgccgcgatgcagaccatgcccactggcacgaccgcgccgaggcgatggcgcggcgtggcctccgtgtgctggcgctggcggagaagcccgaggacagcgcccacattgacgcggccgtgctggaaggcgggctctccttcctcggtctcgtcgggctgatcgaccctccgcgccccgaggccgtggccgccgtggccgaatgccgcgccgccggcatccgggtcaagatgatcacgggcgaccacgcgggcactgccgcagccatcgccgcgcagatcgggctggagaacccgcatcgtgtgctgaccggggccgacctcgaccggctggacgaggcgcaactggcgctggaggtgcagggcgtcgacgtcttcgcccgcaccagccccgaggacaagctgcgcctcgtcaccgcgctgcaggcaaacggcctgtcggtcgccatgaccggcgacggggtgaacgacgcgcctgccctgaagcgcgccgacgccggcatcgccatgggcctcaagggatccgaggcggcgaaggaggccgccgatctggtgctggccgacgacaacttcgccaccctcgcggcagcggtgcgcgaagggcgcaccgtctacgacaacctcaagaaggtcatcagctggacccttcccacgaatgcgggcgaggcgctggtggtgattaccgcgttggtggcgggcatggctctgcccatgtccgcggtgcagatcctctggatcaacctgatcaccggcatcaccctgggccttgcccttgcgttcgagccgaccgagaggggcaccatggcccgcccgccccgcccgcgcgaggcgccgatcctctcaggcgagctggtgtggcatgtggtgctggtggccgtcctgttcctcgctgcggtcttcggcatgttcacctatgcgctggacaagggctatgcgcttccgctcgcccagaccatcgcgttgaacacgctggtggtgctggagatctgccatctcttcttcatccgcaacattcacggcacctcgctgacctgggccgccgtgcgggggacgaaagtggtctggatcgtggtgatcgccatcaccctggcgcaattcgccgtcacctatgtgccgttcctgcagcgcattctcgggactgaggcggttccgctggcggacgggctgcttgtcgttgccgtcggcgcgatctttctggccatcgtc

SEQ ID NO: 31694 - DNA, 1116 bp, Rhodobacter sphaeroides
atgacgaagaccgccctgattaccgggatcacggggcaggacggctcgtacttggcggagttccttctggagaagggctatgaggtccacggcatcaagcgccgggcttcaatgttcaacacccagcgaattgaccacatctacgaagatccgcacgcccgcaatccaaggctgaagctgcattacggcgatctgaccgacagttcgaacctcacccgtatccttgcccagatccaaccggacgaggtttacaacctcggcgcccagagccatgttgcggtgagcttcgagagccccgagtataccgccgatgtcgatgcggtgggagcgctgcggctgctcgaggcgattcgcttcctcgggctggaaaaaaagacgcggttttaccaagcatcgacctctgagctttacggcctcgtgcaagagataccgcagcgtgagacgacgccattctatccgcgctcgccctatgccgtggccaagctctatgcctattggatcaccgtcaattaccgcgagtcttacgggatctacgcctgcaacggcatcctctttaaccatgagtccccgcgccggggcgagaccttcgtaacccgcaagatcacccggggcctttcccatatcgcccagggactggagccctgcctatacatgggcaacatcgactccctccgcgactggggtcacgccagggactatgttcggatgcagtggatgatgctgcagcaggagaaacccgatgatttcgtgattgcgactggcttgcaatactcggtgcgcgagttcatcaagtggtcggccgccgagctcggcatcacgctccgctttgaagggcagggcgtggaggaaatcggggtcgtggaagacgtctgtggcgatatggcgcctgaggttacgcgcggcgacgtgatcgtgcgcatcgacccgcgctatttccgcccggcggaagtggagacgcttctaggcgatccggcgaaggccaagcagaagctcggttgggtaccggaaatgaccgtgcgcgagatgtgcgccgagatggtggccgaggatctgaaatccgcccgccgccatcgacttcttcgtgagaacgggctgcacctgcccgtggcgctcgaa

SEQ ID NO: 31695 - DNA, 1329 bp, Rhodobacter sphaeroides
ctgccggccgatgccgtcatccatgacgaggccgagacccgcgcctacgaatgcgacgcgctgaccgcctatcgctgcccgccgcttgcggcggtgctgccgcgctccacggccgaagtctccgccgtcctgcggatctgccacgaggagcgggtgccggtggtgccgcgcggctcgggcacctcgctggccggaggcgcgctgcccaccgcggattgcgtgattctgggcgtggcccggatgaaccgggtgctcgagaccgactatgccaaccggttcatccgggtcgagaccgggcggacgaacctctcggtgacgggcgcggtcgaggtggacggcttcttctatgcgcccgatccctcgagccagctcgcctgcgccatcgcgggcaatatcgccatgaactcgggcggggcccattgcctgaaatacggtgtgacgaccaacaatctgctgggcgtcaccatggtgctgatggacgggaccgtggtcgagatcggcggggcgcatctcgacgcgccgggcctcgatcttctgggcgtgatctgcggctcggaggggcagctcggcgtcgtgaccgaggccacgctgcgcatcctgcccaagcccgagggggcgcgaccggtgctgatgggcttcggctcgaacgaggtggctggcgcctgcgtgtcggacatcatccgtgcgggtatcctgccggtggcgatcgaattcatggaccggccctgcatccgggcgacggaggccttcgccaaggcgggctatcccgattgcgaggcgctcctcatcgtcgaggtggagggctcgcctgccgagatcgacgaccagctggcccggatcctcgagatcgcgcggcggcacgatccggtcgagctgcgcgagagccgctcggaggaggagagccggcggatctggctcgggcggaaatcggccttcggcgcgatggggcagatcaacgactacatgtgcctcgacgggacgatcccggtgacggagctgccgcgggtgctgcggcggatcggcgagttggccgccgaggcggggctcgaggtggccaatgtcttccacgcgggtgacggcaacatgcatccgctgatcctgttcgatgcgaaccggcccggcgatctcgaacgctgcgagcggctcggagccgagatcctgaagctctgcgtcgaggtgggcggctgcctgaccggcgagcatggcgtgggggtggagaagcgcgacctgatgggggtgcagttcgcgcccgcggatctcgaggcgcagatgcgggtgaaggatgtgttcgatccgcgctggctgctcaatccggccaaggtctttccg

SEQ ID NO: 31696 - DNA, 1443 bp, Rhodobacter sphaeroides
ctcaaggacccgtcgctgctcgaaacccgcgccttcgtggccggcgagtgggtcgatgccgacgacggcgcaaccttcgaggtgacgaaccccgcccgcggagacgtgatctgcacggtgcccgacctcggccgggccgagacggcgcgcgccatcgccgccgccgaggaggccatgaaggagtgggccgcccgcaccggcaaggagcgcgcgcaggtcatgcgcaagtggttcgacctgatgatggcgaaccaggacgacctcggcgcgatcctcaccgccgagatgggcaagccgctcgccgaggcgaagggcgagatcgcctacggcgcctcgttcatcgagtggttcggcgaagaggccaagcgcatctatggcgagaccatccccggccacatgcgcgacaagcgcatcacggttctgaagcagccgatcggcgtcgtgggctcgattacgccgtggaacttcccgaacgccatgatcacccgcaaatgcgggcccgcgctggcggcgggctgcggcttcgtcgcccgccccgcggccgagacgccgctctcggcgctggcgctcgccgtgctgggcgagcgggccgggctgcccaagggcatcctctcggtcatcacctcgagccgctcctcggacatcggcaaggagatgtgcgagaacccgatcgtccgcaagctcaccttcaccggctcgaccgaggtgggccgcatcctgctgcggcaggcggccgatcaggtgatgaaatgctcgatggagctcggcggcaacgcgcccttcatcgtcttcgacgatgccgatctcgacgccgcggtgcagggcgccatggcctcgaagttccgcaacaacggccagacctgcgtctgcgcgaaccggatctacgtccagtcgggcgtctatgacgccttcgccgaaaagctcgccgccgccgtgaagaagctgaaggtgggcgacgggctcgtcgaaggcaccgaggccggcccgctcatcaacgagaaggcggtggccaaggtcgaggaacatatccgcgacgtgctcgacggcggcggtcaggtgctgaccggcggcaagcgccacgcgctcggcggcaccttcttcgagccgacggtcgtgaccggcgtgaagcaggagatgaaggtttcgacggaagagaccttcggcccgctcgcccccctcttccgcttcgaaaccgaggatgaggcggtgggctacgccaacgacacgatcttcggcctcgcctcctacttctatgcgcgcgacgtgggccgcatcacccgcgtgcaggaggcgctggaatatggcatcgtgggcgtgaataccggcatcatctcgaccgaggtggcccccttcggcggcgtgaagcaatccggcctcggccgcgagggctcgcgccacgggatcgaggattacctcgagatgaaatacatctgcctctcgatc

SEQ ID NO: 31697 - DNA, 918 bp, Rhodobacter sphaeroides
cgccacctgctcggcatcgagcatctggcccccgacgagatccgctccgtcctcgacctcgccgacagttatgtggacctcaaccgccgcacgatgaagcagtcggacgcgctggcggggatgacccagatcaacatgttcttcgagaattccacccgcacccagtcgagcttcgagcttgcgggcaagcggctcggcgcggatgtgatgaacatggcggtggcgcagagctcggtgaagaagggcgagacgctcctcgacaccgccatgacgctgaacgcgatgcaccccgatctcctcgtggtgcgccacccggcctccggcgccgtcaacctcctggcctccaaggtgaattgcgccgtcctcaacgcgggcgacggacggcacgaacatccgacgcaggcgctcctcgatgcgctcaccatccgccgcgccaagggccgcatccagcgcctgaccgtcgccatctgcggcgacatcgcccacagccgggtcgcgcgctcgaacctgatcctgctcggcaagatggagaaccgcgtgcgcctgatcgcgccgcccacgctgatgccgccgggggtgggcgagttcggctgcgagctgtacgacgacatgaagaagggcctcgaaggcgccgatgtggtgatgatgctgcgcctccagaaagagcggatggacggggccttcatcccttccgagcgcgaatactaccaccggttcggtctcgacgccgagaagctcgccttcgccaaggaggatgcgatcgtcatgcatccgggcccgatgaaccgcggggtcgagatcgacggcacgctcgccgacgacatcaaccgctcggtgatccaggatcaggtcgagatgggggtggcggtgcgcatggcctgcatggatcttctggcgcggaacttgcgtgccgagcgg

SEQ ID NO: 31698 - DNA, 777 bp, Rhodobacter sphaeroides
atggtccagctcacgctccccaagaattccaaggtccgcaccggcaagacctggccgaagcccgcggatgcgaagaacgtccgcaagttcatgatctaccgctgggacccggacacgggcgagaatccgcgcgtcgacacctacttcctcgacatggacaagtgcgggccgatggtcctcgacgccctcatcaagatcaagaacgaggtcgaccccaccctcaccttccgccgctcctgccgtgaagggatctgcggctcctgcgcgatgaacatcgacggcatcaacacgctggcctgcatctacggtctcgacgagatcaagggcgacgtgaagatctacccgctgccgcacatgccggtgatcaaggacctgatccccgacctgtcgctgttctacgcccagcatgcctcgatcatgccctggctcgagacgaagacggtggagcccgccaaggaatggcgccagtccgtcgaggaccgggcgaagctcgacggcctctatgaatgcgtcatgtgcgcctgctgctcgacctcctgcccgagctactggtggaacggcgaccgctacctcgggccggcggcgctcctgcacgcctaccgctggatcgtggacagccgcgacgaggccacgcccgagcgtctcgacatgctcgaggacccgttcaagctctaccgctgccacacgatcatgaactgcgccaagacctgccccaagggtctgaacccggccaaggccatcgccgaaatcaaaaagatgatggtcgaacgcgtcatc

SEQ ID NO: 31699 - DNA, 1800 bp, Rhodobacter sphaeroides
atggcagcttacacttacgagacgcatgactacgacgtcgtggtggtgggcgccggcggcgccggcctccgcgcgacgctcggcatggccgaacagggcctgcgcaccgcctgcgtcaccaaggttttccccacgcgcagccacacggtggcggcgcagggcggcatcgccgcctctctcgccaacatgggcccggacaactggcagtggcacatgtacgacaccgtgaaagggtcggactggctgggcgacacggacgcgatggaatatctcgcccgcgaggccccgaaggcggtctacgagctcgagcattacggcgtgcccttctcgcgtaccgaggagggcaagatctaccagcgcccgttcggcggccacaccacccagttcggcgagggcccgcccgtgcagcgcacctgcgccgcggccgaccgcaccggccacgcgatcctgcacacgctctacggccagtcggtcaagaacaacgccgagttcttcatcgaatatttcgcgctggatctcatcatccaggacggccgctgcaccggcgtggtggcgtggaagctggaagacggcacgatccatgtcttcaacgccaagctcacggttctggccacgggcggctacggccgcgcctacttctcggccacctcggcccacacctgcaccggcgacggcggcgggatggtggcgcgcgccggcctgccgcttcaggacatggagttcgtacagttccacccgaccggcatctacggctcgggctgcctcatcaccgagggcgcgcgcggcgagggcggctacctcaccaactcgaacggcgaacggttcatggagcgctacgctccgacctacaaggatctggcctcccgcgacgtggtcagccgctgcatgacgctcgagatccgcgagggtcgcggcgtgggcgagcatggcgaccatatccacctgcacctgaaccacctgccgcccgagacgctggccctgcgcctgccgggcatctcggaatcggccaagatcttcgcgggggtcgacctccacaaggagccgatcccggtgctgccgaccgtgcattacaacatgggcggcatccccaccaactactggggcgaggtgctggcacccaccgagggcgatcccgaccgcgtcttccccggcctgatggccgtgggcgaggcgggctgcgcctcggtgcacggggcgaaccgcctcggctcgaactcgctcatcgacctcgtggtcttcggccgcgccgcggcgatccgcgcgggccagatcgtgaagccgcacgaattccatcccgacgtgccgaaggtccaggtggacgagatcctcggccggttcgacgatctgcgccacgcgaacggcgcggtgccgacggccgagctgcggctcgagatgcagcgcaccatgcaggccgacgcggcggtgttccgcaccgacaagacgctggccgaaggcgtcgagaagatgaagggcatcgcggcgaagctcggggacctgaaggtcaccgaccgcagcctcatctggaactcggacctgatggagacgctcgagctcacgaacctcatgccgaacgcgctcgccaccatcgtcgcggccgaggcgcgcaaggagagccgcggggcccatgcccacgaggactggcccaaccgcgacgacgagaactggcgcgtccacagcctggcggtcgtgaagggcaacgaggtcacgctgaccacccggcccgtccatctcgatccgctcacgaagcagaccgagggcgggatcgatctgaagaagatcgcccccaaggcgcgggtctac

SEQ ID NO: 31700 - DNA, 960 bp, Rhodobacter sphaeroides
atggccagacccaagattgcgctgatcggtgcggggcagatcggcggcacgctcgcccatctcgccgcgatcaaggaactgggcgacgtcgtcctgttcgacatcgccgaaggcacccctcagggcaaggctctggacatcgcgcaatcgggcccctcggaaggcttcgacgccgtgatgaagggcgcgaacagctacgaagagatcgcgggcgccgacgtctgcatcgtgaccgcgggcgtgccgcgcaagcccggcatgagccgcgacgacctgatcggcatcaacctcaaggtgatgaaatcggtcggcgagggcatcaaggcccatgcgccgaacgccttcgtgatctgcatcaccaacccgctcgacgcgatggtctgggcgctgcagcaattctcgggcctgccggccgagaaggtggtgggcatggcgggcgtgctcgactcggcgcgcttccggcatttcctgtcggtcgagttcaacgtctcgatgcgcgacgtgacggcgttcgttctgggcggccatggcgacacgatggtgccgctcgtccgctactcgacggtggccggcatcccgctgcccgatctcgtgcagatgggctggaccacgcaggagaagctcgaccagatcgtgcagcgcacccgtgacggcggcgccgagatcgtgggcctgctgaagaccggctcggccttctacgcgcccgccacctcggccatcgagatggcggaagcctatctcaaggaccagaagcgtctgctgccctgcgcggcctatgtggacggcgccttcggcctgaacggcatgtatgtgggcgtgcccaccatcatcggcgcgggcgggatcgagaagatcgtcgacatcaagctcaacgacgacgagcaggcgatgttcgacaagtcggtcaatgcggtgaagggcctcgtcgaggcctgcaagggcatcgactcctcgctcgcc

SEQ ID NO: 31701 - DNA, 1188 bp, Rhodobacter sphaeroides
atgaacatccacgaataccaggcgaaggcgctcctgcgcagctacggtgcgccggtgtccgacggccgggtcgtgctgaaggccgacgaagccaaatccgcggcaggcgagctcggcgggccgctctgggtcgtcaaggcgcagatccatgcgggcggacgcggcaagggcaaattcaaggagccggaagcgggcgagaagggcggcgtgcgtctggccaagtccgtgggcgaagcggccgagcttgccaagcagatgctgggccgcacgctcgtcacccaccagaccggcccggccggcaagcaggtgaaccgcatctacatcgaggaaggctcggacattgcgcgcgagctctacctcgcgctgctggtggaccgcggcacctcgcgcatctccttcgtcgtctcgaccgaaggcgggatggacatcgaggaagtggcggcctcgacgcccgagaagatcgtctccttctcggtcgatccggcctcgggcctgtcggacttccacggccgccgcgtcgccttcgccctcgggctcgaaggcgcgcaggtcaagcaatgcgtgcagctggtcaagaacctctaccgcgccttcgtcgagaaggacatggagatgctcgagatcaacccgctgatcgtcatgaccgacggcaacctcaaggtgctcgacgccaaggtgggcttcgacaacaacgcgctctaccgccagtccgacgtcatggcgctgcgcgacgagaccgaagaggatccgaaggaactcgcggcctcgaagttcgacctgaactacatcgcgctcgacggcgagatcggctgcatggtgaacggcgcgggcctcgccatggccacgatggacatcatcaagctctacggcgcggagcctgcgaacttcctcgacgtgggcggcggcgccacgaaggagaaggtgaccgaggccttcaagatcatcacctcggacccgaacgtgaagggcatcctcgtcaacatcttcggcggcatcatgcgctgcgacatcatcgcggaaggcatcatcgccgcggtgaaggaagtggggctgcaggttccgctggtcgtgcgcctcgagggcacgaacgtcgagaagggcaaggagatcatcgcgaattccggcctcaacgtcatcgcgggcgacaatctgtcggacgcggcacagaagatcgtcaaagcggtgaag

SEQ ID NO: 31702 - DNA, 882 bp, Rhodobacter sphaeroides
atggccgttctcgtcaacgaaaataccaaggtcatctgccagggcatcaccggcagccagggcaccttccacaccgagcaggcgatcgcctacggcacgaagatggtcggcggcgtgacgcccggcaagggcggctccgagcatctggggctgcccgtgttcaactcggtctacgaggcccgcgaagtcaccggcgccaacgcctctgtgatctatgtcccgccgcccttcgcggccgactcgatcctcgaggcgatcgacgccgagatggagctcatcgtctgcatcaccgagggcatcccggtgctcgacatgatgaaggtcaagcgcgcgctgcagggctcgtcctcgcggctgatcgggccgaactgccccggcgtcatcacgcccggcgcctgcaagatcggcatcatgccgggccatatccacaagcggggctcggtcggtgttgtttcgcgctcggggacgcttacctatgaggccgtgaaacagacttcggatctcgggctcggccagtcttcggccgtgggcatcggcggcgacccgatcaagggcaccgagcacatcgacgtgctcgagatgttcctcgccgacccggaaacccagtcgatcatcatgatcggcgagatcggcggctcggccgaagaggaagcggcccagttcctcgccgacgagaagaagcgcggccgctggaagcccaccgcgggcttcatcgccggccgcacggcgcctccgggccgccgcatgggccatgccggtgccatcgtctcgggcggcaagggcgatgcggagtcgaagatcgaagcgatgaagagcgcgggtatcgtcgtcgccgacagcccggcccatctgggcgaagcggtgatgcaggcgctcggcaag

SEQ ID NO: 31703 - DNA, 2952 bp, Rhodobacter sphaeroides
atgacggaacagtctccgaacgcgcagttccatgcctcgagtttcctccaggggcagaatgccgagtatattgaccagttgcaggcacgttatgccgaagaccccgcctccgtcgatgcgggctgggcggagttgttccgttcgctgggcgacagcgagctcgacgccaagcgtcaggcgcatggcccctcctggtcgcggccggactggccgccgatgccggcggacgacctgaccgccgcgctgaccggcgaatggcccgccgctcctgccaaggaggcgaaggctgccgggcagaagattcaggccaaggccgccgaacagggcgtgagtctcagcgacgctcaggtgcagcgcgccgtgctcgattcgatccgggcgctgatgattatccgggcctaccggatccgcggccacctcgccgccgatctcgatccgctcgggctgcgcaacaccacgaaccaccccgagctcgacccgaagtcctacggctttaccgatgccgacatggaccggccgatcttcatcgacaatgtgctcggtcttcaggtcgcttccatgcggcagatcgtggatatcgtcaagcgcacctactgcggcacttttgcgctgcaatacatgcatatttccgaccccgaacaggcggcctggctcaaggagcgcatcgagggctacggcaaggagatccacttcacccgcgagggccggcgtgcgatcctgaacaagctggtcgaggccgagggcttcgagaagttcctccatgtcaagtacatgggcaccaagcgcttcggtctcgacggcggcgaggcgctcatccccgccatggagcagatcatcaagcgcggcggcgcgctcggcgtgaaggagatcgtggtgggcatgccgcaccgcggccgcctctcggtgctggccaacgtgatggccaagccctaccgcgccatcttcaacgaatttcagggcggcagcttcaagccggaagaggtcgacggctcgggcgacgtaaaatatcacctcggcgcctcctctgaccgtgacttcgacggcaacaccgtccacctgtcgctgaccgcgaacccctcgcacctcgaggcggtgaacccggtcgtgctgggcaaggtccgcgccaagcaggagcaggccggcgacaagacgcgccacacggtcctgccgatcctgctgcacggcgacgcggccttcgcggggcagggcgtcgtggccgaatgtttcggcctgtcgggcctcgtcggtcaccgcaccggcggcacgatccatatcgtggtgaacaaccagatcggcttcaccaccgcgccttccttctcgcgctcctcgccctatccgaccgacatcgcgctgatggtcgaggcaccgatcttccatgtgaacggcgacgatcccgaggcggtggtccatgccgccaaggtggcgaccgagttccggcagaagttccacaaggatgtcgtcatcgacatcttctgctaccgccgcttcggccacaacgagggggatgaaccgatgttcaccaacccctcgatgtatacctcgatcaagaagcacaagacgacgctccagctttataccgagcgtctggtgcgcgacgggctgatccccgagggcgagatcgaggacatgaaggccgccttccaggccaagctcaacgaggagttcgaggccggcaaggacttcaagcccaacaaggccgactggctcgacgggcgctggaagcacatcgaccggcacggcgacgaatatcagccgggccgcacctcgatctcggccgagaccctgcaggagatcggtcaggcgctgacgcgcgtgcccgagggcttcgacctgcacaagaccgtcgggcgccagctcgaggccaagaagcagatgttcgagaccggccgcggcttcgactgggcgacgggcgaggctctggccttcggctcgttcgtggtcgagggctatccggtgcgcctctcggggcaggactgcacccgcggcaccttcagccagcggcattcggccttcatcaaccagtcgaccgaggaacgctactacccgctgaacaacatccggtcgggtcaggcgcgctacgaggtcatcgactcgatgctgtcggaatatgccgtgctcgggttcgaatacggctactcgctggccgagcccaatgcgctggtgatgtgggaggcccagttcggcgatttcgccaacggcgcccagatcatgttcgaccagttcatcaactcgggcgaatcgaagtggctgcgcatgtcgggcctcgtcgtcctgctgccgcacggcttcgaggggcagggccccgagcactcctcggcccggctcgagcggttcctccagatgtcggccaacgacaactggatcgtggccaactgctcgacgcccgcgaactacttccacatcctgcggcggcagatccaccggaacttccgcaagccgctgatcctgatgacgccgaagtcgctgctgcgccatccgctctgcatctcgaacgccgaggatttcaccaccggctcgggcttccaccgggtgctgtgggacgatgcgcagaagggccactcggaaacggtgctgaagcccgacgagcagatccgccgtgtcgtcatgtgctcgggcaaggtctactacgacctcctcgccgagcgcgacaagcggggcatcgacgatgtctacctgatgcgtctcgagcagttctatcccttcccggcgctgagcctcgtgaaggaactgggccgcttcaagaatgcccagatcgtctggtgccaggaggaacccaagaaccagggcggctggaccttcgtcgagccgaacctcgaatgggtgctgacgcggatcggcgccagccacacgcgcgccatctatgccggccggtcggcctcggcctcgcccgccacgggtctcgccagccgccacaaggccgagcaggacgcgctggtgaatgacgcgctgacg

SEQ ID NO: 31704 - DNA, 1215 bp, Rhodobacter sphaeroides
atgatcgacgtgatggtgcctgcccttggggaatcggtgtccgaggcgaccgtgtccacctggttcaagaagccgggcgataccgtggcgcaggacgagatgctctgcgagctcgagaccgacaaggtctcggtcgaggtgccggcgcccgccgcgggcgtgctggccgagatcctcgtgaccgagggcacgacggtcgccgcgggctcgaagctcgcgctgatctcgtccgacgggcagggcgtggccgccgcgccgaaggccgagacgccgaagaagaccgaggccgcccccgcgcaggagcccgcgccgaagaaggatgtcgaggatgcaccctcggccaggaaggcgatggccgaggccggcctctcgcccgacgcggtgcagggcaccgggcgcgatggccgcatcatgaaggacgacgtagcccgcgccgtctcgggcgcctcgcaggccgcggcccccacgcccgccccgcagcccgcgctgccgcgccagccggtcccggccgacgatgcggcgcgtgaggagcgggtcaagatgacccgtctgcgccagaccatcgcccgccgcctgaaggaggcgcagaacaccgccgccatgctcaccacctacaacgaggtggacatgtcgggcgtcatgggcctgcgcaacgaatacaaggacgcgttcgagaagaagcacggcaccaagatgggcttcatgtccttcttcgtgaaagcctgctgccatgcgctgaaggaagtgcccgaggtcaatgccgagatcgacggcaccgacatcgtctacaagaactacgtccacatgggcgtggcggtgggcaccccctcgggcctcgtggtgccggtggtgcgcgacgccgaccagatgggcttcgcccagatcgagaagaagatcgccgaactcgggctgcgtgcccgtgacggcaagctctcgatggccgagatgcagggcggcagcttcaccatctcgaacggcggcgtctatggctcgctcatgtcctcgccgatcctgaacccgccgcagtcgggcatcctcggcatgcacaagatccaggagcggccggtggtcgagaagggccagatcgtcatccgcccgatgatgtatctcgcgctcagctacgatcaccgcatcgtcgatggcaagggcgcggtgaccttcctcgtccgcgtcaaggaggcgctcgaggatccgcgccgcctgctgctcgacctc

SEQ ID NO: 31705 - DNA, 1386 bp, Rhodobacter sphaeroides
atggcaactttcgacgtcatcatcatcggcgcgggccccggcggctatgtctccgccatccgctgcgcccagctcgggctgaagaccgccgtggtcgagggccgcgaggcgctgggcggcacctgcctcaacgtgggctgcatcccctcgaaggcgctgctgcacgcgacccacaacctgcatgaagtccacgagaatttcgagaagatgggcctgatgggcgcccatccgaccgtcgactggtcgaagatgcagggctacaagcaggaggtcgtcgacggcaacaccaagggcatcgagttcctcttcaagaagaacaagatcacctggctcaagggctggggctcgatccccgagccgggcaaggtgaaggtgggcgaggagatccacgaggccaagtccatcgtgatcgccaccggctccgagcccgcgagcctgccgggcgtcgaggccgacgagtcggtgatcgtgacctcgaccggcgccctcagcctcggcaggatccccgagaccatggtggtgatcggcgcgggcgtcatcgggctcgagctcggctcggtctatgcccggctcggcaccaaggtgacggtcgtcgaatatatggaggcgatcctgcccggcatggatgccgaggtggtcaagaccacccagcgcatcctcgccaagcaggggctgagcttcgtcctcggcgcggccgtcaagggcgcgacggtgtccgacggcaaggcaaccgtcacctgggccgcgaagaaggacggcaaggaaaccagcctcaccgtcgatacggtgctggtggcgacgggccgcaaacccttcaccgaagggctcgggctcgaggctctgggcgtcgagatgctgccgcggggcgtggtgaagatcgacgaccatttccgcaccagcgtgccgggaatctatgccatcggcgactgcgtgccgggcatgatgctcgcccacaaggccgaggacgagggtgtggcgctggccgagatcctggccggcaagcatggccatgtgaactacggcgtgatcccgggcgtgatctacaccacgcccgaggtggcaagcgtcgggcgcaccgaggagtcgctgaaggaagagggccgcgcctataaggtcggcaagttccccttcatgggcaatgcccgcgccaaggcggtcttccaggccgagggcttcgtgaagatgatcgcggacaaggagaccgaccggatcctcggctgccacatcatcggcccggcggcgggcgacctgatccacgaggtctgcgtggcgatggaattcggcgcctcggcgcaggatctggccatgacctgccacgcccacccgacctggtccgaggcggtgcgcgaggcggcgctggcctgcggcgacggcgcgatccacgcc

SEQ ID NO: 31706 - DNA, 996 bp, Rhodobacter sphaeroides
atggacccggagaaggcccattccctctcgctctcggcgctgcgatcgggcctcgtgcccctcccgggtccggtcacctcgccgcggctggcgaccgttgtcggagggctcgtgctgccgaacccggtggggctcgccgcgggctacgacaagaatgcggtggcgctcgccgcgctgatgcgggcgggcttcggctttctcgaagtgggcgcggccacgccccggccgcagcccggcaatccgcagccgcggctcttccggctgaccgaggaccgcgcggcgatcaaccgcttcggcttcaacaacgacggcgccgccacgatctgcgcccgcctcgccatgcggccgcggggcgcggtgccggtggggctcaatctcggcgcgaacaaggacagccccgaccgggccgccgatttcgccgccgtgctggccgcctgcggcccccatgccgatttcgcgaccgtcaatgtctcctcgcccaacaccgagcggctgcgcgacctgcaggggcggcaggcgctgacggcgctgctcgagggggtgatgcaggtgcaggccggcttcgcgcggccggtgccggtgtttctcaagatcgcgccggacctgtcggacgcggatctggccgagatcgccgaggtggcgctggcatcgggcatcgcggggatcgttgcgaccaacacgacgctggcgcgcgacgggctgcgcagcgcccatgcccgcgaaacgggcggtctgtcgggcgcgccgctcttcgagcggtcgacccgcgttctggcgcggctgtcggagctgaccgaggggcggctgccgctgatcggcgtgggaggcgtggcgagcgccgaggaggcctatgccaagatccgcgccggcgcttcggcggtgcaactctacaccgcgatggtctatcagggcatcgggctggccgcgcgcatcgcccgggggctcgatgcgctcctgctgcgcgacggcttcggctcggtcgccgaggcggtgggc

SEQ ID NO: 31707 - DNA, 1602 bp, Rhodobacter sphaeroides
ccccgcactgtgtcggcacctgtccagaccgggagctttgacatgaaatccacccttctcgcctcggcggcgctggtggcgctgaccacgggcgcggcgcgggccgacttcgcgctcaccatcctgcacacgaacgatttccacgaccggttcgagccgatctcgaaatacgattcgacctgtccgccagaggacaatacggcgggcgaatgtttcgggggcatcgcgcggctggtgacggcgatttccgaggcgcgcgggcagggcggaacgcggcttctcgtggatgcgggcgaccagttccagggctcgctgttctattcgcgctacaagggcgagctggcggccgaattcatgaatgcgctcgattacgacgccatgacggtgggcaaccacgaattcgacgacggccccgccgtgctgaccgacttcgcgagaaagctcgaggcgccgcttctgatggccaatgccgatctgaccggcgagcccgggctgcgggccgagctgcagaagtcggtggtggtcgagaagggcggcgagaagatcggcatcgtggggctgacgccgctcgacacggcggaactcgcgagcccggggccgaacgtgatcttcaccgagccggtgcaggccgcacaggccgaggtggaccggctgacggacgagggggtgacgaagatcgtgctgctctcgcatctgggctacgaggccgacaaggagatcgcttcggcgctgaagaatgtcgatgtgatcgtgggcggccattcccacacgcttctgtcgaacgaggatggggcggcggccggcccctatcccaccatggtgggcgatgtggcgatcgtgaccgcctatgcctatggcaagtatctgggcgagctgaacgtcaccttcgacgatgcgggcaggatcgtctcggccgagggcgcgccgatgctgctcgacgcctccgtggccgaggatgaggcgacggttgcgcgggtgaaggaactggcggcgccgctggaagagatccgctcgcgcgtggtggccgaggtcagcgcgcccatcgacggctcgcgcgagagctgccgcagcggcgaatgcgcgatgggcaatctcgtgtccgatgcgatgctcgaccgggtgcgcgatcagggcatccagatcgcgatttccaatggaggcgggctgcgcgcctcgatcgatgcgggcacggtcaccatgggcgacgtgctgaccgtgctgccgttccagaacacgctctcgacctttcaggtcaagggcgaggccgtggtggcggcgctcgagaacggggtgagcgagctcgaggagggggcgggccgcttcgcgcaggtggccgggctgaaatatgctttcgacccggcggcgccggtgggcgcgcgcatctcggacgtgatggtgatggaggagggcggctggcagcccatcgatctcgccaaaacctatggcgtcgtgtccaacaactatgtccgtcagggcggcgacggctttgccatgttcgtcgatgcggccaatgcctatgacttcggcccggacctcgccgatgtgacggcggactatctggtggcccatgccccctacacgccggtgatcgagggccgcatc

SEQ ID NO: 31708 - DNA, 720 bp, Rhodobacter sphaeroides
tccgcgctgcgcgatgcgcccgacgagtgggcgctctttctcgacatcgacgggacgctggtcgacatcgccgagcagccgcacgacgtgcgcgtggccgcgagtctgccgcaggatctggcgcgactggccgaccggctcgggggggctctggctctcgtgaccgggcggcgggtcgactggatcgacgcccacttcgggccgcatctctttcctgccgcgggtcttcacggggtcgagcgccgccgcgcctcgggagaactcgaccgcgcgggcctcgcgccgtccctgaacgcgctgcgcaaggatctgggtcggcgcacggcgcggatgcccggcgtcctcctcgaggacaaggtggctgcggtggcgctgcattaccggcaggcgcccgaacgcgagcccgatgtgcgggcgatgatggaaatggctttgaaggtgatgggagacggttgggtgctgcagcacggcaagatggtggtggaactgcggccggcctcggccaacaagggcacggcgctcgaggcctttctgacggagccgcccttcgccgggcggaggcccgttgcgataggcgacgacgtgaccgacgaggagatgttccgggtggtcaatgcctgcggcggcctctcggtgcggatctgcgagaccgaggcgccgacgctggcccgggcgcggctcgcctcgccgcaggcgctccgcgacctcgtggcggagctc

SEQ ID NO: 31709 - DNA, 1389 bp, Rhodobacter sphaeroides
atgagtcgtctcgtcgtcgtctcgaaccgcgtgccgctgccggacgagaacggcaacccgccgcccggcgggctggccgtcgccgtccatgccgcgctgcgcaagaacggcgggatctggatgggctggtcgggccgctcgaccggcgaggaggagccgcagggcctgaccacgctggagcaggacaagatcagctatgtgctgaccgacctttcgcaggcggacctcgacgaatattacaacggcttcgccaaccgggtgctctggccgatcttccactgccgtctcgatctggccgaatatgcgcggcaggagatggcgggctatttccgcgtcaatcgcctgttcgccgaccgtctggtgccgatgctcgagcccgacgacgtgatctgggtgcatgattaccacctgatcccgctggcgcaggagctgcgcaagcgcggcgtgcgcaaccggatcggcttcttcctccacattccatggcccccggccgacatcctgaccgctctgccggtctacgagatcatcatgcggggccttgcggcctacgacctcgtggggttccagaccgactacgatctcgacaatttcgtgggttgtctgcgccgcgagggctggggcgactggtcgacgccgggctggctccgcgccttcgacaaggaggtggcggccgcggccttccccatcggcatcgagaccggggatttcgcgcggctcgcggccaagacggacgggctcgatctggtcaccgacatgcagcagagcctgcatggcagttcgctcatcatcggggttgaccggctcgactattccaagggcatcgccgcgcggatcgacgcgttcgagcggtatctgatgcgcaatcccgatcaggcgggcaaggtcacgctgctgcaggtggcgccccactcgcgctcggacgtgcccgagtatctcgagatgcaggggcaggtggagtcgcattgcggccgggtgaacggcgcgcacggcaccatcgagtgggtgcccatccgctatgtgaaccagtcgctcacccggcctgtgctggcgggcctctaccggctggcgaaagtggggctcgtcacgccgctccgcgacgggatgaacctggtggccaaggaatatgtggcctcgcaggatccggccgatccgggcgtcctcatcctctcgcgcttcgcgggcgccgcgcgcgaactggacggggccatcttcatcaacccctacgacaccgagcagacggcgggggccatcggccgtgcgctctcgatgccgctcgacgagcggatcgcgcgctggcggcgcatgatggatcatctcgagtcccacgatgtgctctggtggtgccgcacgttcctcgccgccctgaacgaggcgcccgaggacaacggt

SEQ ID NO: 31710 - DNA, 1371 bp, Rhodobacter sphaeroides
atggaaggcttggcgcaggcgaacgacctcagcgaggtgattgaggcggaccgcgcacatatgtggcaccacctgagccagcacaaacaatacgagacggtcgatccccggatcatcgtcgagggcaaggggatgcgggtctgggatgcggccggcaaggagcatctcgacgcggtctcgggcggcgtctggacggtgaacgtgggctacggccgcgaaagcatcgccaatgcagtgcgcgaccagctcatcaagatgaactatttcgcccattccgcaggctcgatcccggcctcgcgcttctccaaacgcctgatcgagaagatgccgggcctctcgcgcgtctactattcgaactcgggctccgaggcgaacgagaaggtcttcaagatggtgcgccagatctcgcaccggcaccatggcggcaagaagggcaagatcctcttccgcgagcgcgactatcacggcaccaccatcaccgcactcgccacctctggccagccgcagcgcgccgagcagtacgggccgctcacgccgggcttcgtgatggtcccgcactgcctcgaataccgcaagcagtgggacgtcgagaattacggcgagcgcgccgccgacgccatcgaggaggtgatcctgcgcgagggccccgatacgatcggcgcgctctgcctcgagccggtaacggccggcggcggcgtgatcgtgccgcccgcgggctactgggagcgggtgcaggagatctgccggaaatacgacatcctcctccatatcgacgaggtggtctgcgggctcggccgcaccggcacctggttcggctatcagaacttcggcgtgaaacccgatttcgtcaccatggccaagggcgtggcctcgggctatgcggccatctcctgcacggtcacgaccgaggccgtcttcgacatgttcaaggacgatccctccgatccgatgagctacttccgcgacatctccaccttcggcggctgcaccgcgggcccggtcgcggcgctcgagaacatgcggatcatcgaggacgagggtctgctcgagaacacgctgaagatgggcgcgcgcgtggtcgagaacctctccgcgctgcaggagaagcacgccgtcatcggcgacgtgcgcggcaagggtctgttctgcggggccgagctcgtggccgaccgcgccacgaaggagcccatggacgagaagcgcgtggcggccgtggtggccgacgtgatggcgcagggcgtcatcatcggcatgacgaaccgcagcctgccgggcttcaacaacacgctctgcctctcgcccgcgctgatcgccacgcccgacgacatcgaccagatcacggacgccatcgaccgcgccctgacccgcgtc

SEQ ID NO: 31711 - DNA, 1611 bp, Rhodobacter sphaeroides
tggtggaagaacgccgtcttctattgtctcgatgtcgagacctttcaggacagcaacggcgacgggatcggagatttcgcggggctgacccggcggctcgaccatctcgaccggctgggggtgagctgcatctggctgatgcccttctatcccagcccgaaccaggacgatggctacgacatcaccgactattactccgtcgatccccgcctcggcacgctgggcgatttcgtcgagttcctgcgcgcggcccatgaccgcgggatgcgggtgatcgcggacctcgtggtgaaccacacctcgcgcgagcatccgtggttccaagcctcgcgcgccgatcccgattcgccctaccgcgactggtatgtctggcgcgatgagaaacccgacgaggatgccgcctcgctggtcttccccggagaagagaacagcagctggacctgggacgcgaaggcggggaaatactatctccaccgcttctacagccaccagccggacctgaatgtcgagaaccgcgcggtgcgcgacgagatccagcggatcgtgggcttctggctccagctcggcctgtcgggcttccgcgtggatgccgtgcccttcctgctcgagcagatgtcgacggtggacacgggcttcgcgccgcaccgctggctgcgcgacctgcgcgccttcatcaaccgccggtcgggcgatgcggtgcttctgggcgaggtgaacctcgactacccggacgtgcgccgcttcttcggcgacgaggatggcgacgagctgcacatgtgcctcgacttcaacctcaatcaggcgatggcgctggcgctggcccgcgaggatgcggggcccatcgtccacgggctgcgccacatgcccgaactcgcgcccgacgatggctgggcgcatttcctgcgcaatcacgacgaatggtcgctcgacaagctgaccgaggccgagcggcaggaggtcttcgcctccttcgggcccgatccctcgatgcagctcttcggacgcggcctgcggcggcggatgcccaccatgctgaagggcaatcccgaccggctgcggatggcctatgcgctgatggcctcgatgccgggctcacccgtgatcttctatggcgaggagatcggcatggcggaaaatctcgagatccccggacggctcgccgtgcgcgcgccgatgcagtgggatgccggcccgcatggcggtttctcgaacgcgagcaccgaggccctgcaccggcccatggtctcggatccgcaatggggacccgggaaggtcaatgccatcgaccagcaggaccggccggacacgatgttccacttcatggagcatctcctgcggcggcggcgggagtgccccgagatcgccttcggcgagcatgccgtgctgccgtttcccgagcccgagatcttcgccatccggcacgactgggagggccgtacgctcatcgctctcgccaatctcggcgcaaagccgcagaaggtgacgctcacgctgccgaaggcctcggggctgggcaggctgcggcccatcctcggcgaggggaaggtctcgctgcgcaaagacgagctgacggtcgagctcgggggctacgggctgcgctgggtgcggttc

SEQ ID NO: 31712 - DNA, 783 bp, Rhodobacter sphaeroides
ctcggcttcatgaagatgcatggggcgggcaatgatttcgtggtgatcgactcgcgcggacgcggcggggcgctggtgacggccggcctcgcgcgggcgctgggcgaccgacaccgcggcgtgggcttcgaccagctggccgagatccgcgatcaggagggggcggattgcgcgctcgacttctggaactcggacggctcgcgctcgggcacctgcggcaatgccacgcgctgcgtcagcgactacctgatgcgggatctgggccgggacgaggtgaatctcgtcaccgcgcgcggccgcctgcacgcgcggcggcgcgaggacgggctcgtcgcggtgaacatgggcgcgccgcagctcctgtggtccgagatcccgctcgcccgcgcgatggagaccgacagcctgccgctcgagggcacgccctcggcggtgggcatgggcaatccgcattgcatctacttcgtcgaggatgccgaggcggtcgatctggcagggcggggggcggcggtcgagaccgatccgctgtttcccgagcgcaccaatgtggagttcgcgagcctgatcggcccggaccggctgcggctgcgcgtctgggagcgcggggcgggcatcacgctcgcctgcggctcgggcgcctgcgccacggcggtggcggcggcccggcgcggcctgacggggcggcaggtgcggctcgagatggacgggggcgtgctggaagtggactggcgcgacgagggcgtctggctctcggggccggtcgcgcgggtgttcgaggggcac

SEQ ID NO: 31713 - DNA, 1512 bp, Rhodobacter sphaeroides
atgaccgcaccgaaacccgtcgtcctctgcatcctcgacggctgggggcttcgtgccgagcgcgaggcgaatgccgtggcgctggccgaaaccccgaccttcgaccggctgatggcgacctgcccgaacgcgaccctcgtcacccacggcccggatgtgggactgccgcggggccagatgggcaattccgaggtcgggcacaccaacatcggcgcgggccgcgtggtggcgatggaccttggcgccatcgaccttgccatcgaggaggggtcgtttccgcaaaacccggcgctgcgcgacttcatcgggaaggtgaaggccaaaagcggcacggcgcatctgatgggcgtcgtctcggacggcggcgtgcacgggcatatccagcatctcatcagcgcggtcgaggttctggcgggcgagggcattccggtcgtaatccatgcgatcaccgacgggcgcgacgtggcccccacctcggcgggcgagttcgtgggccagctcgtgcgggtgctgcccgagggcgcccgtatcggcacggtcatcggccgctactgggcgatggaccgcgacaagcggtgggaccgggtgaagcgcgcctccgacgcgatgctccatgccacgggcgagcacgcgcccgacgccgaggccgcggtggcggccgcactggcgcggggcgagaccgacgaattcatcgcgccgaccgtggtcggcgactatgcaggcgcccgcgacggcgacggcttcttctgcctcaacttccgcgccgaccgggcgcgcgagatcctcgccggtctcgcccagccgggcttcgacgcctatgacacgggcgcgcggccggactggtcggccttcctcgggatggtcgactattccaaggagcatgaccgcttcatgaccacggcctatcccaagcccgtgatccgcaacacgctgggcgaatgggtggcgagccatgggctgcggcagttccgcatcgcggaaaccgagaaatatccccatgtcaccttcttcctgaacggcggccgcgaggcgccggagacgggcgaggatcgctacatggccaattcgcccaaggtcgcgacctacgacctccaaccggagatgtccgcccccgacgtgagcgaccatctcgtcgaggccatcggcgcgggctatgacctgatcgtggtgaactacgccaaccccgacatggtgggccacacgggcgatctgaaggccgccatggccgccgtcgaagaggtggaccgcgggctcggccgggcggtcgaggcggtgacgaaggcgggcggggccatgatcgtgacggccgatcacggcaactgcgagacgatggtcgatcccgaaaccggcggcccgcacacggcgcacaccacgaacccggtgccggtgatcctcgtgaacgggcctgcgggtgcgcgcctccatgcgggccgtctcgccgatctcgcgccgacgctgctgcaactcatgcagctgcctcagcccgaggagatgaccgggcggagcctgatc

SEQ ID NO: 31714 - DNA, 855 bp, Rhodobacter sphaeroides
ccgatgacccaccatcccaaaccgccgttccccgatcaggaacagccgatgcccggcaagacctcccgcctcgatccgcaacccgatcacggagagaagagctatcgcggctcgggtcgcctgcaggacatgaaggcggtcatcaccggcgcggacagcggcatcggccgggccgtggcgctggccttcgcgcgcgagggggcggacgtgctgatctcctacctgtccgaggacgaggatgcggccgagaccgagcggctggtgacggaagccgggcgcaaggcggttctggtgcgcggcgaccttcaggacgcggcccactgccgcgccgtgatcgaccgtgccgtcgaggaattcggccggatcgacctcctcgtgaacaatgccgcccatcaggcgagcttctccgatctgggcgacatcccggacgacgaatgggagctgaccttccgcgtgaacatccatgcgatgttctatctgtcgaaggcggcggtgccgcatatgggcccgaacagcgcgatcatcaacacggcctcggtcaatgccgattcgccgagcccgcatcttctggcctatgccaccaccaagggcgcgatccagaacttcaccggcggcctcgcccagatgctggccgagaaggagatccgggtgaactgcgtggcgccgggcccgatctggacgccgctcatcccctcgaccatgcctgcggagaaggtgaagaacttcggaacgcaggtgcccatgcagcggccgggacagcccgcggaactggccacggcctatgtgatgctggccgatccgctctcgagctacacgtcgggggcgaccatcgcggtgacgggcggcaagcccatc

SEQ ID NO: 31715 - DNA, 1518 bp, Rhodobacter sphaeroides
atgccgcagtcggccgaaaaggttctggatcacaaggatctgttcaaggaacccgaatatcaggcgatgctcgagaagaagcgcgccacctacgagaatgcgacgcccgccgagacggtggccgaaaccgcggactggacgaagtcctgggactatcgcgagaagaacctcgcccgctcctgcgtgaccatcaacccggccaaggcctgccagccgctcggcgcggtcttcgccgccgccggctatgacagcaccatgagcttcgtgcacggctcgcagggctgcgtggcctactatcgctcgcacctcgcccgccacttcaaggagccgtcctcggcggtgtcctcctcgatgaccgaggatgcggcggtgttcggcggcctgaacaacatggtggaaggcctcgccaacacctatgcgctctattcgccgaagatgatcgccgtttccaccacctgcatggcggaagtcatcggcgacgacctcaactcgttcatcatcaagtcgaaggagaaggaaagcgtcccggccgattttccggtgcccttcgcccatacgccggccttcgtgggcagccacgtcgacggctacgacaacatgcagaagggcatcctgtcgaacttctggaaggacgcgccgcgcaccgcgggcgaaggcctgaacatcatcccgggctttgacggctactgcgtgggcaacgtccgcgagatgaagcgcatgctcggcctgatgggcgtcgaggcgaccgttctgggcgatgcctcggacgtctacgacaccccctcggacggcgagtaccgcatgtatgcgggcggcaccacgcaggaggagatcaaggaggccctgaacgcgaaggccaccctctcgctgcaggaatattgcacccgcaggacgctcgccttctgcgaggaagtgggccaggagaccgcgtcgttccactatccgatgggcgtcaaggccaccgacgagttcctgatgaaggtctcggacctgaccggcaaggagatcccggaagcgctccgcctcgagcgcggccgcctgatcgacgccatggccgacagccaggcctacctgcacggcaagacctacgccatcttcggcgacccggacttcgtctatgccatggcccgcttcgtcatggagatgggcggcgagccgaagcactgcctcgccaccaacggcggcaaggactgggaagtgcagatgaaggagctgctggcctcctcgcccttcggcgaaggctgccaggtctgggcgggcaaggacctctggcacctgcgctcgatcctcgccacggaaccggcggacctgctgatcggcagcagctatggcaagtatctcgagcgcgactgcaacgtgccgctgatccgcctgaccttcccgatcttcgaccgccaccaccaccaccgcttcccgaccttcggctatcagggcgcgatccaggtgctggtgaagatcctcgacaagatcttcgacaagctcgacgacgagtccgacatctcgttcgacctgacccgc

SEQ ID NO: 31716 - DNA, 864 bp, Rhodobacter sphaeroides
gaggtgcgcgtcgctgtcgaggcgtgcggggtctgtgcctcgaacctcggcccatggtcggcgcccgactggatgacctatcccaccgagccgggcggcatgggccacgagggctggggcatcgtcgaggcgctggggccggatgtgacgggcgtcacggtgggcgagcgcgcggccttcctcggccagcgcagctatgccagccacgagatcgtgcccgcgacccatctcgtgcccctgcccgagggcaccgccttcccggccgaacccgtggcctgcgcgctgaacatcttccgccgctcgggcatcgggcgcggcgaccgggtggccatcatcggcgtgggctttctcggcgcgctcctcacccggctggcggcggatgcgggcgccgaggtgatcgccatctcccggcgcgaggagacgctggccctcgcccgccgcatgggggctgcccgcacggtgccgatgatcgaccatcacgagatcgtcgacgaggtgcgcgagctgacgaacggctcgttctgcgaggtggtgatcgaggccgtgggcaagcaatggccgctcgatctggccggagagctggtggccgagggcgggcggctcgtgatcgcgggctatcatcaggacgggccgcggcaggtgaacatgcagcagtggaactggcgcgggatcgacgtggtgaacgcccacgagcgccgccccgagacctatcttcgcggcatgcacgaggcagtcgaggcggtgcagaagggctggatcgacctttcgggcctcctcacccacagctatccgctcgaggatctggccgcagcgctcgacgccacgcgcgacaagcccgagggcttcgtgaaggcggtggtgaca

SEQ ID NO: 31717 - DNA, 883 bp, Rhodobacter sphaeroides
cgcatcatctcggtcggcgagtgcatggtcgagatggcgccgacgggcgaaggcaccttcgcgatgggctttgcgggcgacacgctgaacaccgcttggtatctgcgccgcgccctccccccccgaggcggaggtggactatctgaccgccgtcggcaccgatgcgatctcggaccggatgctcggctttctccgcgacgcgggtctcgggacaagccgcgtcgcgcgcatcccggaccggaccgtggggctctatctgatcgagctcaccgacggcgagcgcagcttcgcctactggcgcggccagagcgcggcgcgccttctcgcccgcgatccggccgtgctggcggcaggctttgccggcgcctcgatgatctatctctcgggcatcacgctcgcgatcctcgaaccggcggatcggtcgcagcttctcgccgctctgtcggcagcgcgggccgcgggcagcgcagtggcgttcgatccgaacctccgcccccggctctggcccgatgccgccaccatgtgcgcggccatcatggaggccgcgcggcacgccgacatcgtgctgccctcgcacgaggacgaggccgccttcttcggcgacgaggatgccgcggcgaccgccgcgcgctatgccgccgccggcgccgcgctcgtggtggtgaaggacggggcgggaccgatggtgacgctcacacccgaaggccagcagagccacgcgcccgagacggtgagccaggtggtcgacacgaccgcggccggagacagcttcaacgcgggcttccttgccgcccacatcgcgggcgcgccgctggccgaggccgtccgcgccggagcccgtctcgccgcccgcgtgatcgggcagcggggcgcgctggtgacc

SEQ ID NO: 31718 - DNA, 717 bp, Rhodobacter sphaeroides
tccttctcgctcgaggggcagcgcgcgctggtgaccggcgccaacaccgggatcggacaggcgatcgcggtgggtctggccggggcgggggccgaggtgatcgccgccggccgctcctcctgcgccgagacggtggccatgaccggcgggcgcgagctgcggctcgacttcgccgatccgatggccgcgcgggacgtgttcgaggccgagcgcatcgacatcctcgtgaacaatgcgggcatcatccggcgggccgatgcggtggagttcaccgaagaggactgggacgcggtgatggatgtgaacctcaaggccctcttcttcacctgtcaggccttcggccgcgcggcgctggcgcgtggaacgggcgggcggatcgtgaacatcgcctcgctcctcagctttcagggcggcatccgcgtgccctcctacacggccgccaaacatggcgtcgcgggcatcacgaagctgctcgccaacgaatgggcgggcaggggcatcaacgtgaacgccatcgcgccgggctatatcgagaccaacaacaccgaggcgctccgcgccgacgaggcgcgcaaccgcgcgatcctcgagcggatcccggccgggcgctggggcaaggccgacgacatcgcgggcgccgcggtcttcctcgcctcgcccgccgcggcctatgtccatggcgcgatcctcaatgtcgatggaggctggcttgcccgc

SEQ ID NO: 31719 - DNA, 1218 bp, Rhodobacter sphaeroides
atgtcgaagatcaaggtagcgaaccccgtcgtcgagctcgacggcgacgagatgacccgcatcatctgggacttcatcaagcagaagctgatcctgccctacctcgacatcgacctgcattactacgacctcggcatcgaggagcgcgaccgcaccgaggacaagatcacggtcgacgcggcccatgcgatcaagcagcatggcgtgggcgtgaaatgcgccaccatcacgccggacgaggcgcgggtcgaggaattcggcctgaaatcgatgtggaagagcccgaacggcacgatccgcaacatcctcggcggcgtgatcttccgccagccgatcatctgccgcaacgtcccgcgcctcgtgccgggctggacaaagcccatcgtcgtcggccgccatgccttcggcgaccagtatcgcgcgaccgacttccgcttcccgggcaagggcaagctcacgctgaaattcgtgggcgaggacggcgcggtgatcgagcgcgaggtgttcgacgcgccgggctcgggcgtgaccatggcgatgtacaacctcgaccagtcgatcatcgacttcgcgcgcgcctcgatgaactacgggctgaacctcggctggccggtgtacctctcgaccaagaacacgatcctcaaggcctatgacgggcgcttcaaggacctcttccagcaggtctacgaggaggaattcgccgagaagttcaaggcggcgggcatcacctacgagcaccggctgatcgacgacatggtggcctcggcgctgaaatggtcgggcggctatgtctgggcctgcaagaactacgacggcgacgtgcagtcggatacggtggcgcagggcttcggctcgctcgggctgatgacgagcgtgctgatgacgccggacgggcagacggtggaggccgaggccgcgcatggcacggtcacgcggcacttccgccagcatcaggcgggcaaggagacctcgaccaactcgatcgcctcgatctacgcctggacgggcggcctcaagcaccgcgccaagctcgacggcaatgccgatctcgcccgcttcgccgagacgctcgagcgggtcacggtgcagacggtcgaggacggcttcatgacgaaggacctcgcgctcctcgtgggcccggatcagaagtggctgaccacgatcggctatctcgagaaggtcgacgaatatctcgaccgcgcgctcggcgcctgagcg

SEQ ID NO: 31720 - DNA, 651 bp, Rhodobacter sphaeroides
atgatcgagctgcgcaacgtctcgaagagctacgtcctgaacgggacgcgcaaggtggtggcgcgcgacctgaacttcaccttcccctcgggcgagagcgtggggcttctggggcgcaacggggcgggcaagtcgagccttctgcggatgctcgcgggcaccatgctgcccgacacgggcgagatcctttccagcggcacgatctcctggccggtgggcttctcgggcagcttccaccccgagctcaccggggcgcagaacgtgcgcttcgtggcccgcctctacggcgtcgataccgaggcgatgatcgccttcgtgcgcgacttcgccgagatcggccagcatttccacctgccggtgcgcagctattcctcggggatgcgctcgcggctggccttcggcatctcgatggcggtgcccttcgacacctatctcatcgacgaggtgacggcggtgggagacgcagccttcagcgccaagagcaacgcgatcctgcgcgcgcggctggaggagagcggagcggtgatcgtctcgcactccatgccgctcttgaagaagctctgccgctcgggggcggtgctccacgacgggcagctcttctattacgagcgcatcgaacaggcgatccgccaccacgagagcatgatgcgc

SEQ ID NO: 31721 - DNA, 867 bp, Rhodobacter sphaeroides
atgagtgttcgtaagggtatcattctcgccggcggctcgggcacgcggctctatccgctgaccatcggcgtctccaagcagctgatgccggtctatgacaagccgatgatctactatccgctctcggtgctgatgctggccgggatccgcgagatcgccatcatcaccacgccgcaggatcaggagcagttccgccgggcgctcggcacgggcgcgcaatgggggatctcgctcacctatctggtccagccccggcccgaggggctcgcccaggcctatacgatcgccgaggagttccttgcgggcagcccctcctgcatggtgctgggcgacaacatcttcttcggccacggcctgcccgaccttctggctctggccgatgccaagacggagggcggcacggtcttcggctatcatgtggccgatcccgaacgctacggcgtggtggcgatggacgagcgcggccgcgtgacccagatcgtcgagaagccgaaggtcgcgccctcgaactatgcggtgacggggatctatttcctcgatgcccgcgcccccgatctggtgcatggcatccggccctccgagcggggcgagctcgagatcgtctcgcttctcgagatctatctcgaggaggggctgctcgacgtccagcgcatgggccgcggcttcgcctggctcgacacgggcacccatgcgagcctgctcgatgcgggcaatttcgtgcgcacgctgcagctgcgtcaggggatgcagacgggctgccctgaggagatcgccttcgccaggggctgggtcgatgccgaggccctgaccggcatggcggcgcagctttccaagaacgattacggccgctacctgcaggggctgctc

SEQ ID NO: 31722 - DNA, 2106 bp, Rhodobacter sphaeroides
tcgacgctgcgcgcggtgtttctggtggcggcccatcacggggtgctgctcggccccgacgagctgcccccgctcgagaccggcgatttcgcgcccgatctgctgcggcttctgggcggcaaggggctgcgctgccggctgctggccgatgcgggctggcgcaccgcctcgcggctcgggcaggcctatcccgcgctggcggagctgcggggcgggcactgggcggtgctggtccatgcgggcggggccgagggcgcgcggaccgtggccctcctcgatccgcggaacgaggcccagggggtgcagcccctgccctgggaggacttcgcccgggactggaccggccggctgatcctgatcgggcgccccgaccggccgagggccgccgagaccgccttcgggctgcgctggttcctgcccgcgctcgcgcgcgagaaggggctctttctcggcgtcgcggtggcggtggtgatcggcaacctgatctcctacgcgctgcccctcctcatgcaggcgatgatcgaccgggtgatcgcctaccgggcctggaacacgctcgccgcggtcgccgcggtcttcgtgctgctggcgctgttcgacgcgggcttcggctatgtccgccagcggctgagccagatcgcgggcggccggatcgacgcccatctgggggccgagagcgtggcccatctgctctcgctgcccatgacgctgttcgagaccacgcccgcgggcgtgctcgcgcgcaacatccagcagaccgacaggatccgccagttcctgaccgggcggctgctgcagaccctgctcgacgcggccctcctgcccgtgctcttcgccacgctggccttcctgtcgggccggctcgcgctggtgatcgcggcctacgggatcgccatcgcgggctgcatcgccctcatgctgccgctcctccagcggcggctgaacgcggtctatgcggtcgaggccgagcggcaggcgcttctggtcgagacgctgcacaacatgcgcgcggtgaaatcgctcgcggtcgagcccgcccgcggcgcgctctgggaggagagcctcgccctctcggtgcgccggcagtgggatctgggccgcgtctcggccgtcacgagcacgctcaccagcctgctcgagcggctgatgcaggtgagcgtggtggccttcggcgtggcgctggcgctcgagggcgcgatcacggtgggcacgctcgtggcggtgctgatgctggccgggcgggtcagcgggccgctcgtccagatcgtggggctcgtcaacgaatggcaggaggccgccctgtcgatcgggatgctgcgccggatcatggatcatccgcccgaacggcccgacaccgccgccctcgcccgccccgccctcaccggcgcgctcgagatccggggggtgagcttcgcctatcccggcgccgccacgcccgcgctcgatcaggtgagcctcgccatcgagcccgggcaggtgatcggcatcgtcgggcgctcgggctcgggcaagaccacgctcacccggctcatccagggcatcgagaccccgcaggccgggctgatcctgttcgacgggatcgacatccgcagcatcgcgctcggccctctgcggcggcaggtggggatcgtgctgcaggacaatctgctcttccgcggcacgctgcgcgagaatatcgccctcgcccgccccgaggccgggctcgaggcggtggtgcgcgcggccgcccttgcgggggccgacgaattcatccgccgcctgccgcggggcttcgacacgcccgtcgaggaggggggcgcgaacctctcgggcggccagcgccagcgggtggcgatcgcccgcgcgctgctcaccgatccgcgcatcctgatcctcgacgaggccacgagcgcgctcgaccccgagtccgaggcggtggtcaaccgcaacctcgccgccatcgcccgcggccggaccatgatcgtggtctcgcaccggctctcgtccctcgtgcgcgccgaccggatcgcggtgctcgaccagggccggctcgtggccttcgccccgcacgaggcgctgctcgcgggctgcgagatctatgcccatctctggcgccagcagaccgag

SEQ ID NO: 31723 - DNA, 723 bp, Rhodobacter sphaeroides
atcgatctggccggccgcgtggccgtggtgacgggcggcgcgcaggggatcgggcgcgccgtggccgagcggctgatcgcctcgggggcgcgggtctgcctgtgggaccgcgacgccgggcgggccgcggcgacggcggccgaactgggcgggaacagcttctttcaggtggtggatcaggtggatttcacggcggtaaaggccgccgccgacgccaccgaagccacgggcggccggatcgacatcctgatcgccaacgcgggcatcgccggcagcaatgcgccggtcgccgactacccggtcgaggaatggcaccgcatcatcgatatcaacctgaacggtgtcttccattgctgcaaggcggtggtgcccggcatgaaggcccacggatacgggcgcatcgtcacggtcgcctcgatcgccggcaaggaaggcaatcccaatgcggccgcctattcggcctcgaaggccggggtcatcgctttgaccaaatcgctgggcaaggaggtcgccggccaggatatcgccgtcaattgcgtgaccccggccgccgcccgcacgcagatcttcgaccagatggcgcagagccacatcgactacatgctgtcgcgcatcccgcgcggccgctttctggatctggacgaggccgcggcgatgatcgcgtggctggccagtgccgagaacagctttaccaccggtgccgtcttcgatctctccggcggc

SEQ ID NO: 31724 - DNA, 708 bp, Rhodobacter sphaeroides
gacatgcaggaaaagaccgtcctcatcacggcggccgggcagggcatcggccgcgcctgcgccgagcgtttcctggccgccggcgcgcgggtattggccagcgaccgcgatgcgcggcttctggatgggctggcggccgagtgccatgcgctcgatgtgcgcgacggggcggcggtggaggccctggtcgcggggctcggcccggtcgatgtgctcgtgaactgcgccggcgtcgtgcatggcggcacgatactcgatcagaccgaggccgagctggatctggcgctggacatcaacctcaggggcacgatccgcaccattcgggcggtgctgcccggaatgctggcggcgggctcgggcagtatcgtcaacatcgcctcggtggtcagcagcctcaagggggcgcccgaccgctgcgtctatggcaccagcaaggcggcggtgatcggattgaccaaatcggttgcagcggatttcgtttcgagaggcatccgctgcaatgcgatctgccccggaaccgtcgagagccccagcctgcgcgagaggctcggcgccacaggcgatgcggaggccgcccgtgcggccttcgttgcccgccagccgatgggtcggctgggcacgccggaagagatcgccgatctcgcgctctggctggcctgttcgggctatacgacagggcaggccatcgcgatcgatggcggctggacg

SEQ ID NO: 31725 - DNA, 2331 bp, Rhodobacter sphaeroides
ttgaccgctaccctgaccgccatcgtccttgccctcgccgggctgggcctcctcatcccgggcgcctggctggccgttctgggcgggagctggttctacctcgtggccggagccctcatgctgctgacggcatggcaggtgttccgccgctcctcctccgccgaatggatctatggcggcctcatcctcggcgcgctcgtctggtccgtctgggaagtgggcttcgactggtgggaactcattccccgcggcggcatcatcgcgcttctgggcatctggctctacctgcccttcatgcggcggcagctgctgaccgaggacggccgccccgcgcccggcctgcccttggccctgccccttctggcggccatcggggccgccatctggtcatggaccggagacgaagcgggacatgcaggctcgctgccgacggaagtggtcagcgccgagcccgatctcggcccctccgcgcctcccggcgagtggcaccagtacggccgcacgcagtacgggcagcgctacagcccgctcgaacagatcaacatccagaatgtcgccgagctcgagcaggtctggcagtatcagaccggcgatgtgaagctgccgcaggacgtgaccgagaccacctatcaggtcacgccgctgaaggtcgccgaccgtctctacatctgcaccccgcacgatctggccatcgcgctcgatgcggcgaccggcaaggaagcctggcgcttcgacgcgcgctccgggctcgagtccgaccggcagcaccagacctgccgcggcgtgacctactggcgggatccggcacgcgccgagggagagctctgcgccgagcgggtctatctgccgacggccgatgcgcggctgatcgcgctcgacgcaaagtccggcgcggtctgcaccttcttcgccgacgagggtacgctccatctcgagaacgggatgccctacaccccggcaggcttctactattccacctccccgcccgtggcggtcggaggccggatcatcatcggcggcgcggtcaacgacaatttctcggtctattcgcagtcgggcgtgatccgggccttcgatgccaacaccggggcgctcctgtggaactgggacagcgccaaccccgacaagaccgcccccatcgactggatgaacggcgagacctataccgcaaattcgcccaactcctggtcggtcttctcggtcgatgaggaacgcggcctcgtctacatcccgctcggcaaccaggtccccgaccagctgggcttcaaccgctcgcccgccgtcgaggaacattcctcctcggtcgtggcgctcgacgtggcgacgggtcagaaggcctgggtgttccagaccgtgcaccatgacctgtgggacatggacgtgcccgcccagcccgttctgatcgatctcgacatcgacggtcagacggtgcccgcgctcgtgcagccgacgaagcagggcgacatctatgtgctcaaccgcgagacgggcgagccgatcctgcccgtcaccgaagagcccgccccgcaggagggcgctctgcgcgaagagacccctgccccgacgcagcccacctcggcgctgagcttcaaacccgaggcgctgcgcgagaaggacatgtggggcgtcacgctctacgaccagctcgcctgccggatccagtatcaccggttgaactacgagggccgctacacgcccccgtcgctgaacggcaccatcgtctatccgggcaatttcggcaccttcaactggggctccgtcgccgtcgatcccgagcggcaggtgatgttcggcatgcccacctacctgcccttcacgagccagctggttccggccgaggacatcccgccgcccggcgcagatcagaaggccagcgaacagggcctgaaccgcaacgagggcgcgccctacggcgtcatcatggggcccttcctcgggccgctcggcgtgccctgctcggcgccgccgtggggcttcgtcgcgggggcggacctccgcaccggagagatcgcctacatgcaccgcaacggcaccgtgcgcgacatgacgcccctgccgctgcccttcaaggtgggcgtgccggggatcggcgggccgatcgtcacgcgcggcggcgtggccttcctcggagcggcggtcgacgactacctgcgcgcctacgatgtgaccacgggcgatcagctctggcaggcgcggctgcccgcgggcggccagtcgacgccgatgacctacgagcaggacggccggcagttcgtggtgatcgtggcgggcgggcacggctcggtcggcacgaaaccgggcgactatgtgatcgcctacgccctgcccgac

SEQ ID NO: 31726 - DNA, 1530 bp, Rhodobacter sphaeroides
gatctcttcatcatcggcggcgggatcaacggctgcgggatcgcccgcgatgccgccggccgcgggctgagcgtgacgctcgccgagatgggcgatctcgcgcaggccacctcctcggcctcgaccaagctcttccacggcgggctgcgctatctcgaatatttcgagtttcgcctcgtgcgcgaggcgctggaagagcgcgagacgctgctcgtcgccatgccgcacatctcctggccgatgcgcttcgttctgccctggcagccggagatgcgctttgcgggcgacacgcccaccgcgcggctcctcggccggctgatgccctgggcccgcggccgccgcccggcctggctcatccggctcgcgctcgagacctacgaccggctgggcgggcgcaagatcctgccgccggcgcgctccgtcgatctgacccgcgatccggcgggccgtgcgttgcagccgcgcttcaccaagggctgggaatattccgattgctgggttgaggattcgcgcctcgtggtgctgaacgcccgcgacgccgagatccgcggcgccacgatcctgacccggacgaaggtggtcggggccgagcggcggggcgatctgtggcatgtgacgaccgagggcgcgcgcggacggcaggtgcatcgcgcccgcgccctcgtcaatgcgggcgggccatgggtcgcgcggatcatccgcgagacgctggccctgcccacgaccgagggcgtgcgcctcgtgcgcggcagccatatcgtgacgaagcgtctcttcgaccatgaccgctgctatttcttccaggggacggacgggcggatcatcttcgccatcccctacgagaccgatttcaccctgatcggcaccaccgatcaggaccatcgcggcgccccggacgaggcgcgctgcacgccggaagagcaggactatctctgcaccttcgcctcggactatttccgcaagcccgtcacgcgcgaggacatcgtctggacctattccggggtccggccgcttcatgacgacggggcacgctcggccacggcggcgacgcgggattatgtgctctcgctcgacagccggggcgcgccgcttctgaacgtgttcgggggcaagatcaccacctatcggcggctggccgaaagcgcgatggccaagctcgcggggcatttcccgcaggcgcggggcgcctggacggcccgggtgccgctgcccggaggagacttcccctgggacggggcgcctgcgctggccgaggggctgcggcgggactatccgttcctcaccgaacgctgggcgatgcggctggtgcgggcctacgggacggacgcgcgaaatctgctcggcccggcgcgcagcgcgcttgatctgggacgggacttcggtgctaccctcaccgaggccgaagtgcgttggctgatggatcgcgaatatgccgagcgggccgaggatgtggtctggcggcgcagcaagctgggcctgcggctcacgcccgaagaaatcgcggcgctcgatggctggatgaaggatgcg

SEQ ID NO: 31727 - DNA, 962 bp, Rhodobacter sphaeroides
gcgctgaaggagatggatcatgtctggcaggacggcggcgcctatgcgctgctcggcgcctcgggctgcggcaagaccacgcttctgaacatcatctcaggccttctgcgcccgagccagggccgcgtgctcttcggcgagaccgacgtgacggatgctcccaccgccgcgcgcaacatcgcgcaggtattccagtttcccgtggtctacgacacgatgaccgtgcgcgagaacctggccttcccgctccgcaaccgcggacgggacgcggcctatatcgcggcgcgcgtcgagcagatcgcggcgatgatcggcatggaggcgatgctctcctcgaaggcgcggggcctcacggcggatgccaagcagaagatcagcctcgggcgcggcatggtgcgcgaggatgtgaacgcgatcctcttcgatgagccgctgacggtgatcgacccgcacatgaagtgggagttgcggacccagctgaagcagctccaccgcgagttcggtcacacgatgatctatgtgacccacgaccagaccgaggcgctgaccttcgccgacaaggtggtcgtcatgcacgagggccgcgtcgtgctagaccggcaccccggaggaactgttcgagacgcccgagcacacgttcgtgggttatttcatcggctcgccgggcatgaacctgttcgaggccgaggtcgagggccccatggcgcgcgtgatgggccatccggtgccgctctcggaaagctacccggcgacgcgcggccgggtgcagatcgggatccggcccgagttcgtgcagctcgccgacgagggcctgcccgtggtcatcacccgggtcgaggatgtgggccgccaccgcatcctgcgcggcgaggccttcggccagcccgtgaacctgcttctgcccgaggagatccccgccgccacggggcccgccttcctgcggctcgcgcccgagaagatca

SEQ ID NO: 31728 - DNA, 1446 bp, Rhodobacter sphaeroides
atgaaccacatcctcgccatcgatcagggcaccacctcgtcgcgcgcgatggtcttcgacgaggccctcacgctgaagtcggtcgcgcaggaggaattcccgcagatctacccgcgcccgggctgggtcgagcacgacccctcggacctctggtcgagcgtcgccgccaccgcgcgggcggcggtcgagcgggccgagatcgacggcagcctcgcggcgatcgggatcaccaaccagcgcgaaaccgtcgtcgtctgggagcgtgcctcggggcatccgatccacaatgccatcgtctggcaggaccggcgcacggccgatctctgccatgccctggccgaggcagggcacgagcccacgatcaccgagcggacgggcctgctgctcgatccctatttctcggccaccaagctcaaatggctgctcgatcatgtggagggcgcccgcgcccgcgcgcggcggggcgagctgctgttcggaacggtggacagctacctgatctggaagctcaccggcgggcgcgcgcatgtgaccgacgccaccaatgccgcgcgcaccatgctcttcgacatcggccgcggcatctgggacccggagatttgcggccttctcgacattccgatggagatgctgcccgaggtccgggattgcgcggcccccttcggcatgacgcgcgcggatctcttcgggcgcgagatcccgatcctcggcgtggcgggcgaccagcaggccgccacctgcggccaggcctgcttccggcccggcatgatgaaatcgacctacggcaccggctgcttcgcgctgctgaacaccggcgaggagcgggtgacgagccgcgcgcggctgctgaccaccatcgcctatcagctcggcggcaagcgcacctacgcgctggagggctcgatcttcatagcgggcgccgtggtgcaatggctgcgcgacgggctgaagatcatccgtgaggcgggcgagacgcagggcctcgccctctcctcggacgcggcgcaggatctggtgatcgtgcccgccttcaccggcctcggcgcgccctggtggaagcccgagagccgcggcgcggtcttcggactcacccgcaactcgggccctgcggaattcgcccgcgccgcgctcgaaagcgtgggctaccagacgcgcgacctgctcgaggcgatgcgggcggactgggcggcgggggccgagggcgtgctgcgggtcgatggcgggatggcggcctcggactggtcgttgcagtttctggccgacatcatcggcgcgccggtcgaccggccggtggtgcgcgagacgacggcgctcggtgtcgcgtggctcgcggggatgcaggcggggctctgcccggggccggaggagttcgcggccgactgggcgctggagcgacggttcgagccgcaaatggaggcgtcggtgcgcgaggcgaaatacgaccgt

SEQ ID NO: 31729 - DNA, 777 bp, Rhodobacter sphaeroides
ctgcccatgaagatcgctaccttcaacatcaacggcgtcaaggcgcgcctcgaggcgctgctggcctggctggaggcggcggagcctgacgtggtgctgctgcaggagatcaagtcggtcgacgagggcttcccccgtgccgccttcgaggacaagggctggcatctcgagacgcacgggcagaagggcttcaacggcgtggcgatcctgtcgcgcctgccgctcgaggatgtggtgcgcggcctgccgggcgacccggaggatgtgcaggcgcgctggatcgaggccaccgttgtgggcgagcgcgcggtgcgggtctgcgggctctacctgcccaacggcaaccctgcgccgggaccgaaatacgattacaagctcggctggatggagcggatgaaggcgcgcgcggccgagcttctcgccaccgaggagcccgtggtgctggccggcgactacaacgtgattccgcaggccgaggatgcggcgcggcccgaggtctgggtgacggatgcgctgttcctgcccgagagccgggccgccttccgccggatcgtgaacctcggctataccgaggccttccgcgcccgcaccttcgggccgggccattacagcttctgggactatcaggccggtgcctgggagaagaacaacggcatccgcatcgaccatctgctgctctcgccgcaggcggcggacctgatgaccgatgtccgcatcgaccgcgaggtccgctcgggcgagaaaccctcggaccatgtgccggtctgggtcgagctg

SEQ ID NO: 31730 - DNA, 900 bp, Rhodobacter sphaeroides
ctgatcggcgcgccgatcgacagcggccagcgccgcccgggctgcctgatggggcctgcggcctatcgcgtggcgggcctcggccgcgcgctcgccgatctcggtcacgcggtcgaggatcgcggcgacgtggccctcgggcccctgcccgagatgacgccgccggagggtccggttcacgacctgcccgagacgatcggctggaccgcggcgctgaagaccgccgtcgaagaggccttgggcgacggctttcccatcgtgatgggcggggatcattcgcttgccctcggcaccgtggccggggccgcggcccatgcggcggcggtggggcggccgctgttcctcctctggctcgacgcccattccgacttccacacgctccagaccaccacctccggcaatctccacggcgtgcccgtggcctatgccgccgggcgcgacgggttcgacggcttcccgcccttccccgcgccgctgccgcccgagcggatctgcctcttcggcatccgctcggtcgatcccgaggaacatgcggcgctcctcctccacgatgtctcgatcatcgacatgcgggtgatcgacgagttcggcatctgcgcgccgatgcgcgagttcctcgagaaggtgcgcgcggccaacgggatgctgcacgtctcgctcgatgtggatttcgtcgatcccgcccatgcgcccgcggtgggcaccaccgttccgggcggcgccacggtgcgcgaggcgcatctggtgatggagcttctgcacgagagcggtctcgtgacctcgctcgatctggtggagctgaacccgttcctcgacgagcgcggacgcaccgcgcggctgatggtcgaactcgccgcctcgatcatggggcgcaaggtcttcgacaggcccacgcgcagc

SEQ ID NO: 31731 - DNA, 798 bp, Rhodobacter sphaeroides
ttcgccccctcgccgacggggccgctgcatctgggacacgccttctcggcgctgaccgtctggcagcgcgccgcgggcggcacggccctcctccggatcgaggatatcgaccgcagccgatgccgcccggaatgggaggcgcagatcttcaacgacctgcactggctgggcctcgcgtggcccgagccggtcctgcggcagtccgaccgcggcggggcctatcgcgcggcgctcgaccgcctgaccgccatggagctcacctatccctgccgctgcagccgcgccgacatccgagcggccctcgccgccccgcaggagggggtgccggtcggacccgacgggatcgtctatcccggcacctgccgcggccgccccatggccgaggccggtcccgacgatgcaatccggctcgacatggcgcgggcggaggagcacgcgggcgggctccgcttccacgagaccggcccggaggccgagggctggcacgcaccgcagaacctcgcccgcagcgtgggcgacgtgatgctggcccggcgcggcttcggcacctcctaccatctcgccgtcgtggtggacgatgccgcgcagggcgtcaccgaagtggtccgcggagccgatctgttcgaggcgaccgcgatccatgtcctcctgcagcgcctgctgggcctgcccgtcccggacttccaccatcaccggctgatccgggatgcagccggaaagcggctcgccaagcgcgacgattcgaaggcgctggggaaataccgtgccgagggcctgagcccggccgaggtccgcgcg

SEQ ID NO: 31732 - DNA, 969 bp, Rhodobacter sphaeroides
atgacaatacgcgccgtggtgaggggcgtcgggcactatctgcccgaccgtgtcgtcccgaactccgaactcgaggcgatcgtcgagacgaccgacgaatggatccgcacccggtcgggcatcgaacggcggcatttcgcggcggagggacagacgacctccgacctcgccgcccgcgcggcgcgtgcagcgctcgaggacgcggggcttcagccggacgacatcgacacgctgatcgtcgccacctccacggccgatctcaccttcccctccgccgccaccatggtgcaggcggccttgggcatgacccgcggcttcgccttcgacgtgcaggcggtctgcgcgggcttcgtctatgcgctggccaatgccgatgcgctgatccgctcgggtcaggcgcagcgcgtgctcgtgatcggggccgagaccttcagccgcctgatggactggaacgaccgggccacctgcgtgctcttcggcgatggcgcgggcgcggtggtgctcgagggcaccgagagcgccggcacctccgccgaccgcggcatccttgcgaccgacctgcattcggacggccgcttcaaggacctgctctatgtcgatggcggctcctcgaccggcaccacgggccacctgcggatgcagggacgcgaggttttccgccatgccgttgagaagcttgcagaaacagcgcatacggcactggagaaggcgggcctcggcgccggcgatgtcgactggatcgtgccgcatcaggccaacctgcgcatcatctcggccaccgcccagcggatgcaggttccgatggaccgcgtgatcctgacggtgcaggatcacggcaatacctcggccgcctcgattcccctggccctctcggtcggcaaggcacgcgggcagatcaaggaaggcgaccttctggtcaccgaagcgatcggcggcgggctcgcctggggctcggtggtcctccgctgg

SEQ ID NO: 31733 - DNA, 1869 bp, Rhodobacter sphaeroides
atttcaagaaatcaacatcgggaggagccaatgaagatgctgaagacgggtctcgtagcgaccctattgctctcgtctgcgccggtctttgccaacgactcggtcctcaaggcgaccgacgatccgaagcagtgggcgatccagaccggcgactatgccaacacccgctattccgagctgaaccagatcacccgcgagaacgtgggcaagcttcaggtcgcctggaccttctcgaccggcgtgctgcggggccacgagggctcgcccctcgtcgtggacggcatcatgtatgtccacacgcccttcccgaacaacgtctatgcgctcgatctggccaatgacggcaagatcctgtggcgctacgagccgcagcagaaccccgacgtcatcggcgtgatgtgctgcgacacggtcaaccgcggcgtggcctatgccgatggcatgatcttcctgcatcaggccgatacgaccgtcgtggccctcgacgcgaagagcggcgaggtgaaatggaccgtgcagaacggcgacccggccaagggcgagaccaacaccgcgaccgtgctgccggtcaaggacaagctcctcgtcggcatctcgggcggcgagttcggcgtgcgcggccatgtcaccgcctatgacatgaagacgggcaagcaggtctggcgcgcctattccaccggccccgacgccgagatgctggtcgatccggaaaagaccatggtgctcggcaagcccgtgggcgccgacagctcgatcaagagctgggaaggcgaccagtggcagatcggcggcggcaccacctggggctggtattcctacgaccccgacctgaacctcgtctattacggcaccggcaacccctcgacctggaacccgtcgcagcgtccgggcgacaacaagtggtccatgaccatcatggcccgcgatgccgataccggcatggccaagtggatgtatcagaagaccccgcacgacgagtgggactatgacggggtaaacgagaacatcctcgtcgatcaggagatcgacgggcagatgcgcaagctgctggtgaacctcgaccggaacggcttcggctacacgctcgaccgcgagacgggcgagcttctggtggcgaagaaatacgacccggcggtgaactgggcgaccgaagtggtgatggacaaggagtccgatcaatacggccgtccgcaggtggtggcggaatattcgacggcgcagaacggcgaagacaccaacaccaccggcgtctgcccggccgcgctcggctccaaggaccagcagcccgcctccttctcgcccaagaccggcctcgtctatgtgccgacgaaccacgtctgcatggactacgagccctaccgggtcagctactcggccggccagccctatgtcggcgccaccctctcgatgtatccggcgccgaacagccatggcggcatgggcaatttcatcgcctgggacgcgacgaagggcgagatcaaatggtcgctgcccgagcagttctcggtctggtcgggggctctggccaccgcgggtgacgtggtgttctacggcacgctcgaaggctatctgaaggccgtcgatgcggagacgggcgagctgctctatcgcttcaagaccccgtccggcgtcatcggcaacgtgatgacctacgagttcaacggcaagcagtatgtgggcgtgctctcgggcgtcggcggctgggcgggcatcggcctcgccgcgggcctgaccaaccccaacgagggtctgggcgccgtgggcggctatgccgcgctgtcggactatacccagctcggcggtcagctcaccgtctttgccctgccggactgagcccgatcctgaccctgccggagcccccgggctccg

SEQ ID NO: 31734 - DNA, 1128 bp, Rhodobacter sphaeroides
atgcgcacccgtgccgccgtcgccgtcgaggccggcaagccgctcgagatcatggaggtcaatctcgaaggccccaaggccggcgaggtcatggtcgagatcaaggccaccggcatctgccacaccgacgaattcaccctctccggcgccgatcccgagggcatgttcccggcgatcctcggccacgagggcgcgggcgtggtggtcgaggtcggccccggcgtgaccagcgtgaagcccggcgatcatgtgatcccgctctacacgcccgagtgccggcagtgcccctcctgcctcagccagaagacgaacctctgcaccgcgatccgcggcacgcaggggcaggggctgatgcccgacggcaccagccgcttctcgatgctcgatggcacgccgatcctgcattacatgggctgctcgaccttctcgaactacacggtcctgcccgagatcgcggtggcgaaggtgcgcccggatgcgcccttcgacaagatctgctacatcggctgcggcgtcaccaccggcatcggcgcggtcatcaacacggccaaggtcgagatcggcgccaaggccgtggtgttcgggctgggcggcatcggtctcaacgtgatccagggcctgaagctcgcgggcgccgacatgatcatcggcgtggatctgaacaacgccaagaaggaatggggcgagcgcttcggcatgacccatttcgtgaatccgtccgagatcgacggcgatgtggtggcgcatctggtcaatatgaccaagacgcccttcgaccagatcggcggggcggactacaccttcgactgcaccggcaacgtgaaggtgatgcgtcaggcgctggaggcgtgccatcgtggctggggccagtcgatcgtgatcggtgtggcgccggcgggggccgagatccagacgcggccgttccagctggtgacggggcgggtctggaagggctcggccttcggcggcgcgcgcggccggaccgacgtgccgaagatcgtcgactggtacatggagggcaagatccagatcgacccgatgatcacccacatcctgagcctcgaagagatcaacaagggcttcgacctcatgcacgcgggcgagtccatccgctcggtcgtggtgttc

SEQ ID NO: 31735 - DNA, 1212 bp, Rhodobacter sphaeroides
atgcgcatcgcagttctgggtggggacgggtttgtcggctggccgacggcgctccacctgtcggacctcggacacgagatccatatcgtcgacaacctgtcccggcgctggatcgataccgagctgggcgtgcagtccctgaccccgatggactcgatccaggagcgctgccggatctggcatcaggagaccggccagcggctgcatttccacctgctcgacctgcgcgaatacgaccggatccgcgcctggctcgccgaataccgccccgaggccatcatccacttcgccgagcagcgcgccgcgccctattcgatgaagtcggaccgccacaaggtctacaccgtcaacaacaacgtcaatgcgacccacaacctgttggccgccatggtcgagaccggcatcgatgcccatctcgtccatctcggcaccatgggggtctatggctattcgaccgtgggcgcgcccatccccgagggttatctcgacgtctcggtcgagaccccggcgggcccgaaagagctcgagatcctctatccgacgcggccgggctcggtctatcacatgaccaagagcctcgatcagatcctcttccagtattatgctcagaacgacgggctgcggatcaccgacctgcatcagggcatcgtctggggcacgcacacgaaccagacccgccgccatccgcagctcatcaaccgcttcgactatgacggcgactatggcaccgtcctgaaccgcttcctgatccagtcggcgatcggttatccgctgaccgtgcacggcaccggcgggcagacccgcgccttcatccatatccaggattcggtgcgctgcgtcgagctcgcgctgtcggatgcgcccaaggccggcgaacgggtgaagatcttcaaccagatgaccgagacgcaccgcgtgcgagatctggccgaactggtggcgaagatgaccggcgccaaggtctcgttcctgcccaacccccgcaaggaggccgacgagaacgagctcgtggtcaggaacgaccagttcctcgcgctggggctgaagcccatcacgctgcaggaagggctgctgggcgaggtggtcgatgtggcgaagaagttcgcccaccggatcgaccgcagccgcgtgccctgcgtctcggcctggacgaaggacatcgcgcagcgggtcgagcacgatcccgaggggcggcggctgcgctcggtgtcc

SEQ ID NO: 31736 - DNA, 831 bp, Rhodobacter sphaeroides
cagaaggtcaccactgccattttccccatcgcaggcatggggacgcggttcctgcccgcgaccaagtcgatcccgaaggaaattctcacgctcgtcgacaagccgctgatccagtatgcggtcgaggaagcccgcgaggccggcatcgaggacttcatcttcgtcacctcccgcggcaagggggcgctcgaggacttcttcgacgtgaaccagacgctggagcgggccctgcgcgcggcgggcaagaccgagcttctggcaacgctcgaggccaccaatatcgacagcggccatgtgacctacgtccgccagcacgaggcgctgggcctcggccatgccgtctggtgcgcgcgccgcctcgtgggcgacgagcccttcgcggtgatcctgcccgacgacatggtggtcgccgacaagccctgcctcgcgcagatgatcgaggcccatgaagaggtcggcggcagcatcatcgccacgatggaagtgccggcggaaaaggcgtcctcctacggcgtcctcgacatcgaagagcgtcagggcgcgctgatccgtccgcgtggcatcgtcgagaaaccgaaggccggcaccgcgccttcgaacatggcggtcatcggccgctatatcctcgggccgcgcgtcatgcagcatctcgaccggcgcaccgtcggagcggggggcgagatccagctgaccgacgccatcgcgcacgagctggccacccatccgggctcggtccacggcttccgcttccagggcgagcggttcgactgcggctcgaaggcgggcttccttcaggccaccgtcgcgctggcgctggagcgcgaggatctg

SEQ ID NO: 31737 - DNA, 1806 bp, Rhodobacter sphaeroides
ctcggcaacgtgaccgagggcatctcgatcctcctgctgctgccgatcctgacgctcgcgggccggggcgcgcccgactatgcgatcgacctcggcggacggcatgtcatgggctatgcgctgcccgacgtgagcgtggggctcgagtttctgctcggggccatcgtggtgctggtggcgctgcaggcggccttcaatcgggtgaaggcggtctatctctcggatctcctgcaggatttcgccaacggcacccgggcggggctgttctcggccgtggcctcggcgcgatgggagacggtggtgcggatgcgccgtgccgatctcgaacatgcgctgaccggtgagatcgaccggatcaccttctcgggcttcgtctcgctcaacctcatgcagatcgtcgtggggctcgcgatctatttcgtgctctgcctcgcggtttcggtgccgatgacgctctttgccttcggcttcgggctgatcgcgctgctgctgctgaagccctaccgcaagctcgccgagcggttcggccagaagatccagtcggcgcgcaccgtgcaggcgcggctggtatcggagttcatctcggggctgaagaccgcccgctcgatgaaccaggagccgatgcatgtggcccagttcgagcggacgctcgatgcgaccaaagccgatgcgcatgactatgcccgccggaacgcgctcggcaacgggctctttcaggtggcgctggccatcggtgccgcaggcttcgtgctgctctcgctccgtatcgcggggcttgagatgtcgcagatgctggtgctgctcgtgatcctgatgcgagtgacgccgcgctttcagggcgtgcaggcgcaggtgcaggcgctgctcgtggatctgccggcctggtggcgggtggccgatcttcagcagcggctcgaggccaaccgcgagggcggcaggggcttcgcctcggccccggtgcccgtgccgcggcaggagatcctgctcgaccgcgtgacctaccgccacaaggaagggtccgaggaagcggcgctgtccgactgcacgatccgtctgcccgtggggcaggccacggcgctgatcggcgcgtccggcgcgggcaagagcacggtggccgacatcgtgatggggctgatccggcccgaggccgggcgcttcctcgtcgacgggcgcgagctttcggaggccgagcggcgcggttggcgcgaacatctggcctatgtcccgcaggagaccttcctgttgcacgacacgatccgggcgaaccttgccatcgtggcccccggggcgaccgaggccgagatgcgggaggctttggccgatgcggcggcggaccgtttcgtggccgcgctgcccgaggggctcgacacgcgcgtgggcgaccggggcacgctgctttcgggtggcgaacggcagcggatcgcgctggcgcgcgccttcctgcgccgtccggcggtcctgatcctcgacgaggccaccagcgcgctcgactgggagagccagagccgggtggccgaggcgctggcccggcgagcgggcagcatgacggtgctgaccatcgcgcaccgcccctcgatggtggccttcgcggatcgggtctacacgctcgaggcgggccgcgtcgtcgaagagggcgccatggccgacctcatgcggaacggcgagggccatctggcgcggatgttcgcgcacgaggcgtctgagccgggccgccggcgtctggcacagggtgcgtgagcttctgcggtcacgggccgttgcgggacgtgctcgctgagaagttattcgggaatcgcaagtcttctg

SEQ ID NO: 31738 - DNA, 669 bp, Rhodobacter sphaeroides
ccggctggccgagctggaggcgctcatcggatgacggcagaggcagacggggaggatccggccgaacgcaagatgcggttcctgttcgccgtccgctcgcggggcgtcacggatgcccgcgtgctcgccgccatggagcggatcgaccgcggcgccttcgtccgcggcatcttcgccgaccgtgcctatgaggacatgccgctgcccatcgcctgcggccagaccatcagccagccctcggtcgtggggctgatgagccaggcgctggcggtgaacccgcgcgacaaggtgctcgaggtgggaaccggctcgggctatcaggccgccgtcctgagccagctcgcccgccgcgtctacaccgtcgaccgtcatcgccgcctcgtgcgcgaggcgaccgaggtcttccaccgcctgtccctgaccaacatcaccgcgctcattgcggacggcagtttcggcctgccggaacaggccccgttcgaccggatcctcgtcactgccgcggccgaggacccgcccggccccctgttggcacaattgaagatcggcggtatcatggtcgtcccggtcggccagaccgatgcggtgcagaacctgatcaaggtgacccggctcgagcagggttacgattacgaggaacttcgtccggtgcgcttcgtgcctctggtc

SEQ ID NO: 31739 - DNA, 759 bp, Rhodobacter sphaeroides
atggatctgggtattcgcggtcgccgggcactggtctgcgcctcgtcgaaggggctgggccttggctgtgcggcggctctggccgaggccggtgtcgatctgatgatgaacgcgcgcggcgccgaggcgctcgaggcggcggccgaggatctgcggcagcggttcggcgcgaacgtgaccacggtggcggcagacatcgtctcggaagaggggcgggcgcgggtgctcgaggccgcgggcgcggtcgacatcctcgtgaccaacgcgggcggccccccgcccggcctctggtcggactggacgcgcgacgatttcatccgggcgctcgatgccaacatgctgacgcccatcgcgctgatgaccgcgctgctgccggccatgatcgaaagcggctggggccgcgtcgtcaacatcacctcgcagtcggtgcgcgccccgatcccggcgctcggcctgtcgaactcggcgcgcacggggctgacgggctatgtggcgggcacctcgcggcaggtggcgcagcacggtgtctgcatcaacaacctgctgccgggcatccatgacaccgaccgggccgaggcgctcgaccgcaatgcgatgaaggcgcagggcatcacgcgcgaagaggcccgcgcgcagcgggcggccagcatccccacccgccactacggccgggccgaggatttcggcgccgcctgcgccttcctctgctccgagcatgcgcgcttcatcgtgggccagaacctgctggtcgacggcggc

SEQ ID NO: 31740 - DNA, 1158 bp, Rhodobacter sphaeroides
tgggaggatcccttccggatggagcttcagctctccgaggaggagcggatgctgcgcgacggcgcccgcgcctatgcgcaggagcggctgatgccgcgggtgaccgccgcctaccgcgaggaacagaccgatccggccatcttccgcgagatgggcgagatgggcctcctcggcgcgaccgtccccgaggaatatggcgggctcggcgcctcctacgtctcctacggcctcatcgcgcgcgagatcgagcgggtggattcgggctaccgctcgatgatgtcggtgcagtcctcgctggtgatgtatccgatctacgcctacggctcggaggatcagcgccgccgctacctgccgggcctggcaaagggcgagctcatcggctgtttcggcctgacggaacccgacgcgggctccgacaccgcgggcatgaagaccgtggcccgcaagaccgcgcagggctacgtcctttccggctcgaagatgtggatctcgaacgcgcccatcgcggatgtcttcgtcgtctgggcgaagtccgaggcccacggcggcaagatccgcggcttcgtgctggaaaaggggatgaagggcctctcggccccgaagatcggcggcaagctctccctgcgcgcctcgatcaccggcgagatcgtgatggagggggtcgaggtcggcgaggaggcgctcctgcccggcgtcgaagggctcaagggcccgttcggctgcctcaaccgcgcccgctacggcatcagctggggcgtgctcggcgcggccgaggcctgcctccatgccgcgcgccagtacgggctcgaccgcaggcagttcggccgcccgctggcccagacccagctctaccagctcaagctcgccaacatgatgaccgacatcgcgctcggcgcacaggcgagcctccgcgtcggccgcctcctcgacgaggccaatgccgcgcccgagatgatctcgatcgtcaagcgcagcaactgcggcaaggcgctcgaggccgcgcgccacgcccgcgacatgcacggcggcaacgggatccaggaagagttccatgtcatgcgccacatggcgaacctcgagacggtgaacacctacgagggcacccacgacgttcatgccctcatcctcggccgcgcgatcaccgggctgcaggccttc

SEQ ID NO: 31741 - DNA, 1440 bp, Rhodobacter sphaeroides
gcagccaccggcggcagcctgtccgtcctctcgcccatcgacggggccgagatcggccgcgtccgccccacagaccccgccgccatgcccggcctcatcgcccgcgcgcaggaggccttccgccactggcgcgaggtgcccgccccccggcggggcgaactcgtccggctcttcggcgaggaactgcgcgcggccaaggccgagctcggcgccctcgtgacgctcgaggcgggcaagatcacctccgagggtctgggcgaagtgcaggagatgatcgacatctgcgatttcgcggtgggcctgtcgcggcagctctacggcctgaccatcgcctccgagcggccgggccaccggatgatggagacctggcacccgatggggccttgcgcggtcatctcggccttcaacttcccggtggcggtctggtcgtggaacgcggcgctggcgctcgtctgcggcaatccggtgatctggaagccctccgagaagacgccgctcaccgcgctcgcctcgatggcgatcttcggccgggcgctcgcccgcttcggcgacgcgcccgaggggcttgcgcaactggtgatgggcgggcccgagatcggcgaggcgctggtgctctcgcccgaggtgccgatcgtctcggccacgggttccacccggatggggcggatcgtcgggcccaaggtagcggcccgcttcggccgcccgatcctcgagctcggcggcaacaatgcgatgatcgtggcgccctcggccgatctcgacatggcggtgcgcgccatcgtcttctcggccgtgggcaccgctggccagcgctgcacctcgctccggcggctgatcgtgcatcattcggtgcgcgaggaactggtggggcggctggtcaaggcctacgcgtcgctgaagatcggcgatccgcgcgcggacggaaccctcgtcggtccgctgatcgacgcggcctcgcgcgaccggatggtggcggcgctcgaccgggcgcgggccaagggcggcaccgtccatggcggcaagccggtcgagggcgtgccgggcggcgcctacatccagcccgcgctggtcgagatgccggcccagaccggcgtcgtctgcgaagagaccttcgcgccgatcctctatgtcatgggctacgagacgctggacgaggccatcgcgctgcagaatgcggtgccacagggcctgtcctcctgcatcttcacgctgaacctgcgcgaggccgaggccttcgtctcggcggcgggctcggactgcgggatcgccaatgtgaacatcggcccctcgggcgccgagatcggcggggccttcggcggcgagaaggacaccggcggcggccgcgaaagcggctcggacgcctggcggggctacatgcggcggcagacgaacacgatcaactggtcggcggcgctgccgctggcgcagggggtcaggttc

SEQ ID NO: 31742 - DNA, 960 bp, Rhodobacter sphaeroides
gagttgcaggacgtgatggaccgtctgggctcggtcgcgatcgaagtcgcgaaccggatcgcccgcgggggtatcgacgaggatctcgccggtctctgcggaaccaacaccgacggggacgggcagaaggcgctcgacgtaatcgccgacgacgccttccgcgtggcactggaaggctcggcggtccgcttctacgcctccgaggagcaggacacggcggtgacgctgaacgaggccgggacgctggccctcgccatcgatccgctggacggctcgtccaacatcgacaccaacctctcggtcggcacgatcttcgccatctggcctgccgcggccacggccgaggcgagcttcctgcgcctgggctccgagctcatcgcggcgggctatgtcatctacggcccgcaagtctgcatgatggtgagcttcgggaaggggacgcagaaatatgtgctcgatcccggcagccgcagcttcgtgctggtcgaccgtgccgtgaaggtgccgcccagctcgaccgaattcgcgatcaacgcctcgaactaccgccactggccgaagccgatccgcgcctatatcgacgattgcgtggcgggtaccgaggggccgcggggacgcaacttcaacatgcgctggctggcctcgctggtggccgagacccaccgcatcctcgcgcggggcggcgtgttcctctatccgcgcgacagccgcaagggctacgagcagggtcgcctgcgctatctctacgaatgcgcgcccatcgccttcgtcatcacccaggcgggcggcggggccaccgacggcgagaatccgatcctcggacagacgccctcgcggcttcatgcccgcacgcccttcgtcttcgggtccgccgagaaggtggcccgcatcaccgcgtatcacgacctgcccgagcaggagacgtcggccctcttcggcaatcgcggcctgttccggagc

SEQ ID NO: 31743 - DNA, 1068 bp, Rhodobacter sphaeroides
atggccctgatcacgctcagacaattgctcgaccatgccgcagagcgcggctatggcgtgcccgccttcaacatcaacaacatggagcaggggctcgccatcctcgccgccgcccgcgcctgcgacgcgccggtgatcctgcaggccagccgcggggcgcgcagctatgccggcgacatcatgctgcgccacatcgtcgaggcgctggccgaaatgtatccgcagatcccgatctgcctgcatcaggaccacggcaacaacgaggccacctgcctctcggcgatccggcacggcttcacctcggtgatgatggacggatcgcttcaggccgacatgaagacggtggcctcctacgattacaacgtggacatcacccgccgcgtgaccgacgcggcccactgggtcggagcctcggtcgagggcgagctgggggtgctgggcagcctcgagaagggcgaggcggaggccgaggacggctcgggtgcggaaggaaagctcgaccacagccagatgctgaccgacccggatcaggcggtggagttcgtgcaggcgacccgcgtcgacgcgctggccatcgccatgggcacgagccacggcgcctacaagttcagccgcaagccggacggcgagatcctcgccatgcgcgtgatcgaggagatccacgcccggctgcccgcgacgcatctggtgatgcacggctcgtcctcggtgccgcaggcgctgcaggatctcatcaacgcccatggcggcgatatgcctcagacctacggagtcccggtcgaggagatcgagcgcggcatccgtcacggggtccgcaaggtcaatatcgacaccgactgccggatggccctgaccggccagttccgcaaggtcgccatggagagcccgaaggagttcgacccgcggaagttcatgatccccgcgatgaaggagatggaggccctcgtccgcgaccggttcgagcggttcggcactgcgggcaatgcttcgaagatcaccgtcatcccgatggatgacatggccaagcgctacgcgagcggagcgctcgatcctgcggtcgcgaccgcc

SEQ ID NO: 31744 - DNA, 690 bp, Rhodobacter sphaeroides
atgatcgaggcgatccttttcgacgtggacgggacgctcgccgagaccgaggagctgcaccggcgcgcctttaacgagaccttcgccgcgctgggggtggactggttctgggaccgcgaggaataccgcgagcttctgaccaccacgggcggcaaggagcgcatcgcgcggttcctgcgccatcagaagggcgatccggcgccgctgcccatcgccgatatccaccgcgccaagaccgagcggttcgtggcgctgatggccgagggcgagatcgcgctgcgcccgggcatcgccgacctgatcgccgaggcgaagcgcgccgggatccggctcgccgtggccaccaccaccagcctgcccaatgtcgaagccctgtgccgggcctgtttcggccatcccgcgcgcgagatcttcgacgtgatcgcggcgggagacatggtggccgagaagaagccctcgccggacatctaccggcttgcgctgcgcgagctcgacgtgccgccggagcgggccgtcgcgctggaggattcgctcaacggtcttcgggccgccaagggggcggggctgcgctgcatcgtctcgcccggcttctacacccggcacgaggagttcgcgggggccgaccggctcctcgacagtttcgccgagctcggcgggctggccggcctcgacctgacggcgccggtggcc

SEQ ID NO: 31745 - DNA, 819 bp, Rhodobacter sphaeroides
ctggcgggggtgatcggatcgcccatcgcccacagccggtcgccggcgctgcatggctactggctgaagcgctatgggctgaagggccactatattccgatggatgtggcgcaggccgacctgcgcgacgtgctggccgcgatgccgcggatggggttcgtgggctgcaacgtgacgatcccgcacaaggaatcggtgatcggtctggccgatatcgtgaccgaccgcgcggcgctgatcggtgcggccaacacgctgatcttcggcaaggacggcaagatccacgccgacaacaccgacgggaccggcttcaccgccaacctgcgccagaatgcgcccgcctggcagccccagtcggggccggcggtggtctggggcgcgggcggggccgcgcgcgccgtcatcgccgcgctgatcgaggtgggcgtgcccgaaatccggctcgcgaaccgcagccgggcgcgggccgacgcgctccgctcggacttcggcgccaaggtgcatgtgcatgactgggtgcaggccggcaacatcctcgaagatgcgatgacggtcgtgaacaccacctcgctcggcatggtgggcaagcccgagtttcgtgttccgctcgatgcgctgaacccgaaggccgtggtgacggatctcgtctatgcgccgctgcggacgcggcttctggtcgaggccgaggcggcgggctgccggaccgtggacgggctcgggatgctcctgcaccaggccgctcccggcttcgagcgctggttcggcgtccgccccgaggtggatgaggagacccgggccgccgtgctggccacatgaggc

SEQ ID NO: 31746 - DNA, 2613 bp, Rhodobacter sphaeroides
gacaccgtcacgccgatgatggcgcaatatctcgagatcaaggcgcagaaccccggcgccatcctgttctaccggatgggcgacttctacgagatgttcttcgacgacgcggctctggccgccgaggcgctcgacatcgcgctcaccaagcgcggcaagcaccgcggcgaggatatcgccatgtgcggcgtgcccatccatgcggccgagggctatcttctcacgctgatccgcaagggcttccgcgtggccatcgccgagcagatggaggatccggccgaggcgaagaagcgcggctccaagtccgtggtccggcgcgaggtcgtgcgcctcgtcacgcccggcacgctgaccgaggacacgctgctcgaagcgcggcggcacaactacctctgcgccttcgccgagatccgcgacgaggcggcactggcctgggccgacatctcgacgggtgagctcagcgtcacggcctgcccgctgccgcgcctcatgcccgaactggcccgcctcgccccgcgcgagctgctggtggccgacgagcgggagctcgactggatcgaggaggtgggctgcgcgctgacgccgctctcgcgggcgagcttcgacagcgcctcggccgagaagcggctctgcgcgctcttcggcgtgggcacgctcgaaagcttcggcaatttcacccgggccgagctttcggccatgggggcgctggtcgactacctcgacctcacccagcgcggcaagctgccgctcctgcgcccgcccgtgcgcgagacagtaggcggcacggtccagatcgacgccgccacccgtcgcaacctcgagatcacgcaggcgcttgccggaggccgcgacggctcgctcctctccgccgtggatcgcaccgtcaccgctccgggcgcgcgcctgctcgaacggcggctctcgagccccacccgcgacctcggcctgatccacgagaggctcggcgcggtgcgctggctgaccgaagagccgcgcctgcgcgaggaaatgcgcgcgagcctccgccgcgtgcccgacatggaccgcgccctctcgcggctggcactcgaccgggccggtccccgcgatatggccgcgatccgggcaggcctcgcccaggcccaggagatcgcgcagcggatgcccgccgaggcgcccgccctcgtcacccgcgcactcgaggcgctcggcggccacgaggcgctggtggatctcctcgatcaggctctcgtggccgagccgccgcttctcgcccgcgacggcggcttcatcgcacaggggttcgatgcggatctcgacgagacgcgccgcctgcgcgacgagggccgcggcgtcatcgcctcgatgcaggcgggcttcatcgaggtgaccggcatccagagcctgaagatcaagcacaacaacgtgctgggctatttcatcgaggtcacctcgacccatgccgagaagatgctctcggccccgctctccgagcgattcatccaccgccagaccaccgccgggcaggtgcgcttcacgacggtggagctgtcggagctggaaacgcggatcctgaacgcgggcaaccgcgcgctcgacctcgagaagatgcatttcgcagccctgcggacggcgatcctcgatctcgccggccagatcggtcgcgccgcccggtcgctggccgagctcgacctgatctcggccttcgccgacctcgcggtgaccgaggactggaccgagcccgagatcgacgacagccgcgccttcgccatcgaggccgggcgccatccggtcgtcgagcgcgccctgcgccgcaccggcacgcccttcgtcgccaaccactgcgacctctccaccggcgagacgccggcggtctggctcatcaccgggccgaacatggccggcaaatccaccttcctgcgccagaacgccctgatcgcgctcctcgcacaggcgggcagcttcgttccggcccgccgcgcccatatcggcctcgtgagccagatcttcagccgcgtcggcgcctcggacgatctggcgcgcggccgctcgaccttcatggtcgagatggtcgaaaccgcggccatcctgaatcaggccgacgaccgcgctctcgtgatcctcgacgagatcggccgcggcaccgccacctgggacgggctctccatcgcctgggccacgctcgaacatctgcacgaccggaaccgctgccgcgcccttttcgccacccactaccacgagatgaccgcgctggcgggcaagctcaagggcgtggaaaacgcgaccgtcgcggtgaaggaatgggaaggcgacgtgatcttcctgcacgaggtgcggcgcggtgcggccgaccgctcctacggcgtgcaggtcgcacggcttgcgggcctgcccgcctcggtgatcgagcgcgcacgcaccgtgctcgacgcgctcgagtcaggcgagcgcgagagcggcgggcgacgccagacgctcatcgacgacctgccgctcttccgcgcggccccgccgccgcccgcgcccgcggcgccgaagacctcacccgtggaagagcggctgcgcgagatccagcccgacgacctcagcccgcgcgaggcgctgaagctcctctacgatctccgcgcgctgctg

SEQ ID NO: 31747 - DNA, 1182 bp, Rhodobacter sphaeroides
aagaaagtcgtccttgcctattccggcgggctcgacacctcgatcatcctgaagtggctgcagaccgaatatggctgcgaggtcgtgaccttcaccgccgacctcggccagggcgaggagcttgagcccgcccgcgagaaggcggtgatgctgggcatcaagccagaaaacattttcattgaggatgtgcgcgaagagttcgtgcgcgacttcgtcttcccgatgttccgggcgaacgcgctttacgaagggctctatctgctcggcacctcgatcgcgcggccgctgatcgccaagcggctggtcgagatcgcggcccagaccggcgccgacgcggtggcccacggcgccaccggcaagggcaacgaccaggttcgcttcgaactgacggcctatgcgctcgacccggcgatcaaggtgatcgcgccctggcgcgaatgggacctgacttcgcgcacgaaactcctcgaattcgccgaacagaaccagatcccgatcgccaagaacaagcgcggcgaagcgcccttctcggtcgatgcgaacctgctgcacacctcgtccgagggccgcgtgctggagaacccgggcgaggaagccccggattacgtctaccagcgcaccgtcgatcccgagaaggcgcccgacgcgcccgagttcgtggagatcgccttcgagaagggcgatgcggtcgccatcaacggcgaagccatgtcgcccgcgaccatcctcacgaagctcaacgagcttggcggcaagcacggggtgggccgtctcgatctggtggaaaaccgtttcgtcggcatgaagtcgcgcgggatctacgagacgcccggcggcacgatcctgctggaggcccaccgcggcatcgaacagatcacgctcgactcgggcgcaggccacctgaaggattcgatcatgccgcgctatgccgagctgatctacaacggcttctggtacagccccgagcgcgagatgcttcaggcactgatcgacaagtcgcaggaacatgtcaccggcaccgtgcgcgtcaagctttacaagggcttcgcccgcaccgtcgcccgttggtcggagcattcgctttattccgagaagcacgtcaccttcgaggaggatgcgggcgcctacgaccagaaggacgcggccggcttcatccggctgaacgccctgcggctgaagctg

SEQ ID NO: 31748 - DNA, 1842 bp, Rhodobacter sphaeroides
aggcccccgatgttccgcttcttcgagaacctggtcgatccctatgcgccctgggatcggaccgatacgccgccgcgccgcctgtggcccttcctgaaggactatgtgcggcccttccggaaggtgttcgcgatcaccggcctgatgtcggtgctgaatgcgtccgtcgaggtgctgctgatctggtatgtgggccgtctcgtggacctgctggccgagggtgcgccgcaggaggtctgggcgagccacgggtccgagatcctggcggtggcgctggccatcctcctgatccgaccgctggtggccggggtggatgtggcgctactgcacaacacgatcctgccgaacttcggcacgctcatccgctggcgggcgcacaaccatgtgctgcgccagcccgtcggctggttcgagagcgacttcgccggccggatcgccaaccggatcatgcagacgccgcccgcggcgggcgatgccgtcttccagaccttcgacgcgggcgccttcgccatcaccacggtgatcggcgcagtggccgtgctcgcggatgccgacccgcgcctgaccctgccgctgattctgtggttcgcgctctatgcgctgctggtgcgctggacgatccgccacgcgggtcctgccgccaaggcctcgtcggacgcgcgctcggcggtgacggggcgggtggtcgatgcctataccaacatccattccgtgaagctcttcgcccatcacgaccgcgagctctcctatgcccgcgaggccatcgagaccgcccgcaccaccttccagcgcgagatgcggatcatcacgcgcatggatgtggcgctgacgcttctgaacggcgcgctcatcacctcggtcacgggctgggcgatcctgctctggtatcaggggcaggcgagcgtggggatcgtggccgcctcgacggctctggtgctgcggctgaacaacatgacctactggatcatgtgggccacgagttcgctcgtgcaggcgctgggggtggtggccgaggggatggagaccatcgcccagcccatcggcctcgtcgacaagccgggggcgcggcccctgcggctcacgcagggcggcatcgcactcgatcaggtctcgcaccattacggccgcggctcgggcgggctcgaccgggtgacgcttgccatcgcgccgggcgagaaggtggggatcgtcggccgctcgggcgcggggaaatccacgctcgtgaagctcatgctgcgcttctacgaccccgagagggggcggatcctcatcgacgggcaggacgtgaccgaggtgacgcaggaaagcctgcgccgcgccatcggcatggtgcagcaggattcgagcctcctgcacaggtcggtgcgcgacaacatcctgtatggccgccccgatgcgagcgaggaggagatgatcctcgccgccaagcgggccgaggcgcatgacttcatcctgacgctggaggatcccgaaggccggcgcggctacgacgcccatgtgggcgagcgcggcgtgaagctctcgggcgggcagcgccagcggatcgtgctggcgcgcgtcatgctgaaggacgcgccgatcctcatcctcgacgaggccacctcggcgctcgacagcgaggtcgaggccgccattcaggagacgctctaccgggtgatggagggcaagaccgtgatcgccatcgcgcaccgcctgtcgaccatcgcggcgatggaccggatcgtcgtgctcgaggagggccgcgtggccgagatcggaagccatgccgagcttctggcgcggggcgggctctatgcccggttctggacacggcagtccggcggcttcatcggcaccgaggat

SEQ ID NO: 31749 - DNA, 1026 bp, Rhodobacter sphaeroides
ctcgcccatgcgcccgcagaccatccggagctgccgcagcccaagatcggcatcctgctcgccaatctcggtacgccggacaattacgactactggtcgatgcgacgctacctgaacgagttcctctcggacaagcgggtgatcgactatcccgcctggaaatggcagccgctgctgcagatcctgatcctgtccaagcgccccttctcgtcgggcgccaactacaagctgatctggaaccatgacaagggcgagagcccgctcatgacgatcaccaaggaccagacagccgccatcgccgccgagatccgcagtctctacggcaaccgcgtcatggtcgatttctgcatgcgctacggcaacccctccaccgagagccgcgtgcgggccatggtcgaggcgggctgcgagaagatcctcttcttcccgctctatcctcattatgcaggcgcgacctcggccacggcgaacgacgagttcttccgggccatgatgaaggaaaagcggcagcctgcggtgcggaccgtgccggaatattacgacaatccgctctacatcgacgcgctcgcgcagtcggtcgagcgcgcctatgcccagctcgaccacaggccggacgtgctggtggcctcttatcacgggatgcccaagcggtatctgatggcgggcgatccctaccattgccagtgcgccaagacctcgcgcctgctgcgcgagcggctgggatgggagaagggcgcgatcgacaccaccttccagtcggtcttcggacccgaagaatggctcaagccatatacggtcgagcatgtggcggagcttgcccgcgccgggaagaagcgcatcgcggtgatcgcgccggccttctcggcggactgcatcgagacgctggaagagatcaacggcgagattcgcgaggccttcgaggaagcgggcggcgaggagttcacctacatcccctgcctgaatgacgacgaggcgcatatccgcgcgctggtctcggtgatcgaggacaatctcgcaggctggctc

SEQ ID NO: 31750 - DNA, 1404 bp, Rhodobacter sphaeroides
atgtatatcggtctcgatctcggcacctcggggctcaagggcatcctcatcgacgaggagcagcgcgtcctcgccgaagcggtggcgccgctcgccgtgagccgtccgcacaagggctggtccgaacagtcgcccgccgactggatcgccgccgccgaggcggtgatggatcagctggcagcccatgggctctcggacgtgaagggcatcggcctctcgggccagatgcatggcgcgaccctgctcgatgcctcggacgaggtgctccgcccctgcatcctgtggaacgacacccgcagccatgccgaggcggcggcgctcgacgccgacccgcgcttccgggccgtcacgggcaacatcgtctttccgggcttcacggcgccgaagctcgtctgggtcgagcggcacgagccggcgatccgcgagcgggtggccaaggtgcttctgcccaaggactatctgcggctctggctgaccggcgagcatgtggccgagatgtcggacgcggccgggacgagctggctcgacgtgggcgcacgcgactggtcggacgcgctcctcgccgcgaccggcctcacgcgcgatgcgatgccgcggctggtggagggctcggccgtctcgggtgcgctgcggcccgcgctggccgcccgctgggggttgccccagggcgtggcggtcgcgggcgggggcggcgacaatgccgcctcggcggtgggggtgggcgtcgtgcgcgcgggcgaggctttcgtcagcctcggcacctcgggcgtgctctttgccgccaacgacggctaccagcccgcgcccgagaccgcggtccataccttctgccacgcgctgcccggcgcctggcaccagatgggggtgatcctcgccgcgaccgacgcgctcaactggtatgcgcgcctcgtgggacaggaagcctcggccctgacgaaggaactgggcggccttcaggcccccggccggaccctgttcctgccctatctcggcggcgagcggacgccgctcaacgatgccgcgatccggggcgccttcacggggctcgaacatgcgaccgaccgggcggcgggcacccgcgccgtgctcgagggcgtgaccttcgccatccgcgactgccgcgacgcgctggccgccaccggcacccggctcgagagcctgatcgccgtgggcggcggctcgcgctcggactactggctctcggccatcgccaccgcgctcgacgtgccggttctattgcccgcggcaggcgatttcggcggcgccttcggagccgcgcggcttgcgctcatggccgccaccggagccggggccgagatcgcgaccctgccgcccatcgcccggaccctctcgcccgaccgcggcctgaccgccgccttcgacgacgcccacgcgcgccatcgc

SEQ ID NO: 31751 - DNA, 1908 bp, Rhodobacter sphaeroides
atggccaaagtcatcgggatcgacctcgggacgaccaactcctgcgtcgccatcatggacggcgcgcaaccccgcgtgatcgagaactccgaaggggcgcggacgacgccctccatcgtcggtttcaccgacagcgaacgcctcgtgggccagccggccaagcgtcaggcggtcacgaacccctcgaacaccgtcttcgccgtcaagcggttgatcggccgccgcgtgggcgacgccgaggtggaaaaggacaagaagctcgttccctattccatcgtgaacggcggcaacggcgacgcctgggtcgaggtgcgtggcgagaaatattcgcccagccagatctccgccttcatcctgcagaagatgaaggaaaccgccgaggcctatctcggcgagtcggtgacgcaggccgtcatcacggtgcctgcctacttcaacgacgcccagcgtcaggcgaccaaggacgccggcaagatcgcgggcctcgaggtgctgcgcatcatcaacgagccgacggccgcggcgctcgcctacggtctcgacaagaaggacaccaagacgatcgcggtctatgacctcggcggcggcaccttcgacatcaccatcctcgagatcgacgacggcctgttcgaagtgaaatcgaccaacggggacacgttcctcggcggcgaggacttcgacatgcggatcgtcaactacctcgcggacgagttcaagaaagagcacggggtcgacctgacgctcgacaagatggcgctgcagcggctgaaggaagccgccgagaaggccaagatcgagctcagctccagccagcagaccgagatcaaccagcccttcatcagcatggaccggaacaccgggcagccgctgcacatggtgatgaagctgacccgcgcgaagctggaaagcctcgtgggcgatctcatcaagaagtcgctgaagccctgtgaagccgcgctgaaggatgcgggcgtctcgaagtcggacatcgacgaggtcgttctcgtcggcggcatgacccggatgccgcgggtggtcgaagaggtcaccaagttcttcggcaaggagccacacaagggcgtgaaccccgatgaggtcgtggcgctcggcgcggcgatccaggcgggcgtgctgcagggcgacgtgaaggacgtcgtgctgctcgacgtgaccccgctctcgctcggcatcgagacgctgggcggcgtgttcacccgcctgatcgaccgcaacaccacgatcccgaccaagaagagccaggtcttctcgaccgccgaggacaaccagaacgcggtgacgatccgcgtcttccagggcgaacgcgagatggcggccgacaacaagctgctcggccagttcaacctcgaagatatcccgccggccccgcgcgggatgccgcagatcgaggtgaccttcgacatcgacgccaacggcatcgtgtcggtcagcgccaaggacaagggcaccggcaagtcgcagaacatcacgatccaggcctcgggcggtctctccgacgaggatatcgagaagatggtgcgcgacgccgaggccaatgccgaggccgacaagaagcgtcgcgagctggtcgagaccaagaaccagggcgaaagcctgctgcactcgacccgcaagtcgatcgaggagcacggcgacaaggtggacccgtccaccgtcgaggcgatcgagctggccatgggcgcgctcgaagaggccctcaagtccgaggacgccggcaagatcaagggcggcatccagaacctgaccgaggccgcgatgcgtctcggcgaggcgatctacaaggccagccaggccgagggaggcgccacgccggacgaggaggggccccggtcggtggatgacgacatcgtcgacgccgacttcgaggatctcggcgagaacaagcggaag

SEQ ID NO: 31752 - DNA, 1146 bp, Rhodobacter sphaeroides
atggcaaagcgcgattattacgaggttctgggcgtatcccgcacggcctcggctgacgagctgaagaaggcctaccgaacgaaggcgaaggaactccaccccgaccggaacgcggacaaccctcaggccgaggcccagttcaaggaagtgaacgaggcctacgacgtccttcgcgacgccgacaagaaggccgcctacgaccgctacggccatgcggccttcgagggcggcatgggcggcggcgcccgcgccggcggcggctacggccagcagggggatttcgcctccgccttctccgacgtgttcgaggatctgttcggcgacttcatggggggccgcggcggcgccccgcggagccgcgcgcaacgcgggtcggacctgcgctacaatctgcgcgtgacgctcgacgaggcctatcgcggcgtccagaagacgatcaacgtcccggcctcggtggcctgcgacgcctgcaagggcaccggcgccgaaggcggggccgaggccgtcacctgcccgacctgctcgggcatgggcaaggtgcgggcgcagcagggcttcttcaccgtggagcgcacctgcccgacctgtaacggcatggggcagatcgtgaagaacccgtgcaaggtctgccacggcgcgggacgggtcgagaaggaacggtcgctctcggtcaatatccccgcgggggtcgagaccggcacgcggatccggctggccggggagggcgaggccgggatgcggggcggcccctccggcgacctctacatcttcatcgaggtgcgcgaacatgcgctgttccagcgcgacggggtgcatctcttctgccgcgtgccggtctcgatcgcggccgcggccctcggcggcgaggtcgaggtgcccaccatcgacggcgggtcgagccgcgtgaagatcccggccggtagccagaccggcaagcagatgcgcctgcgcggcaaggggatgcccgcgctccgcggcggcggggcgggcgacatgctgatcgagctggcggtcgagaccccggtcaacctgaccgcccgccagaaggagctcctgcgcgagttcgagaagctctccgaggacaacaaccccgagggcaagagcttcttctcgaaggtgaagggcttctgggacggcatgaccggc

SEQ ID NO: 31753 - DNA, 1188 bp, Rhodobacter sphaeroides
ctgccggccatcggcggggtggaattctccgccgtcgaggccggagtgcgctaccagaaccgcaaggatgtgatgctgatccggctcgcgccgggcacggccatggcgggcgtcttcacccgctcctcgacgcgggcggcctgcgtgctcgactgtcaggccaagatcggcgccgcctccgaggccggtgcggcgatcatcgtgaactcgggcaactcgaacgccttcaccggcgccgtgggcgtcgaggcggtcgaggccgtgacccgcggcgtggccgaggcccttggcctgccggtggagcgcgtcttctcctcctcgaccggcgtgatcggcgagccgctgccctacgagcgcatcaccgcgcagatccccgcgctggtcgagggcctgtcgggagacgccatcgagatggccgcgcgcgccatgatgacgaccgatacgttcccgaaaggcgcctcggccacggtcgagggcgagggcggatcgatccagatcgccggcatcgccaagggctcgggcatgatcgcgcccgacatggcgacgatgctggtctatatcttcaccgacgcgaagatcccgcagccgctgctgcagaagatgctgtcgcggcaggtggaggccaccttcaacgcgatcaccgtggacagcgacacctcgacctcggacgcgctgctgctcgccgccaccggcacgagccccgctgccgagctcaacgggcgctcgaaggccgggcgcgacttcgaggcggcgctggggcgggtgatgctcgatctcgcgcagcaggtggtgcgcgacggcgagggcgcgtcgaaattcgtcgaggtccgggtcacgggcgcggccagcgccgaggatgcccacaaggtcgccatggcgatcgccaattcgccgctggtcaagaccgcgatcgccggcgaggacccgaactggggccggatcgtcatggcggtgggcaagtcgggcgccgcggccgaccgcgacaagctctcgatccgcttcggcgacatcctcgtggccgagaagggctggcgcagccccgactaccgcgaagaggacggcgcggcctacatgaagcaggccgaactggtggtggcggtcgatcttggcctcggcaccgacagccgcacggtctggacctgcgacctgacgcaccgctacatcgacatcaacgccgactaccgctcg

SEQ ID NO: 31754 - DNA, 2505 bp, Rhodobacter sphaeroides
atgagcgatacagacggcaagaaacccctcggcctgggtggcggctcgcgttcgggccaggtgaagcaaagcttcagccacggccgcacaaagagtgtcctggtcgaaacgaagcgcaagcgcgtggtcgttccgaagccgggtgcctcggggtcttcgaccacgacgagctcgccgtcgcatctcggcgacccggcgaagcgccccgccggcatctccgatgccgagatggagcgccgcctcgccgccctgcgcgccgccaagctgcgcgaagtcgaggacgccaagcgccgcgccgatgaagagcgccagcgcgaggaagagcgccagcgccgccgcgaggaactcgaggcgaaggaacgcgaagagcgtgagcgcgccgaggccctgcgccagaaggccgaggacgaggaacgcgcccgccgcgaggccgaagaggccgcccgccgcgccgaagaggccaagcgcgccccggctccggccgcgccgcaaccggcgcccgccgagtcgcgcgcatccgcgccgccgtcggccaagcccggcctgccgccctcgcgcaaggagcgtgagcgcgaggccgatcgcgaccgcacgaccaagaaggacgactcgcgtcgttcgggcaagctcacgctgaacgaggcgctctcgggcgaaggcggccgcacgcgctcgctcgccgcgatgaagcgcaagcaggagaaggcccgccagaaggcgatgggcttcggccacaaggccgagaagcaggtccgtgacgtgcagctgcccgaaacgatcctggtgcaggagctcgccaaccgcatggcggagcgggcggctgatgtggtcaaggcgctcatgaagatgggcatgatggtcacgatgaatcagtccatcgacgccgatacggccgagctggtgatcgaggaattcggccaccgcgccgtgcgcgtgtcggatgccgacgtcgagcatgtgatcgacacggtcgaggacaaggcggaagacctccagccgcgtccgccgatcatcacgatcatgggtcacgtcgaccacggcaagacctcgcttctggatgcgatccgcaagaccagcgtcgtttcgggcgaggcgggcggcatcacgcagcatatcggcgcctatcaggtgaagaccgagagcggcgcggtcctgaccttcctcgatacgcccggccacgcggccttcacctcgatgcgcgcccgcggtgcgcaggtgacggacatcgtggtgctggtggtggcggccgacgacgcggtgatgccgcagacggtcgaggccatcaagcacgccaaggcggccaaggtcccgatgatcgtggcgatcaacaagatcgacaagccggacgcggacccgaacaaggtgcgcaccgacctgctccagcacgaggtgatcgtcgagaagatgtcgggcgacgtgctcgatgtggaagtctcggcgaagaccggcctcgggctcgacgagctgctcgagaacatcgcccttcaggccgagatcctcgacctgcgcgccaacccgagccggcaggcgcagggtgcggtgatcgaagccaagctcgacgtgggtcgcggcccggtggccacggttctggtgcagtacggtacgctcaagcggggcgacatcttcgtggtcggccagcagtggggcaaggtgcgcgcgctcatcaacgacaagggcgagcgtgtggatgaggccggcccctcggttccggtcgaggtgctgggtctgaacggcaccccggaagcgggcgacgtgctgaacgtcgtcgagaccgaagcccaggcgcgcgagatcgccgattaccgtgagaaggcggcgcgcgacaagcgtgcggcagccggcgcggcgacgacgctcgagcagctgatggcgaaggccaaggccgatgccgacgtggcggaactgccggtggtcatcaaggccgacgtgcagggctcggccgaggcgatcgtgcaggcgctggagaaggtcggcaacgacgaggtccgcgtgcgcgtgctccactacggcgtgggcgcgatcaccgagaccgacatcacgctggccgaggcctcgcaggcggcggtcatcggcttcaacgtccgggccaatgcctcggcacgtcaggccgcgaaccagaagagcgtcgagatccgctactacagcgtgatctacgacttggtggacgatgtgaagaaggcggcctcgggcctgctcaaggccgaagtgcgcgagcatttcatcggctatgcgcagatcaaggaagtcttccgcatcaccggcgtcggcaacgtggcgggctgtatcgtcaccgagggcgtggcccggcggtctgccggcgtgcgcctgctgcgcgacaacatcgtgatccacgagggcacgctgaagacgctcaagcgcttcaaggacgaggtcaaggaagtgcagtccgggcaggaatgcggcatggccttcgaacgctacgaagacatccgtcccggcgacgtgatcgagatcttcgagcgcgaggaggtccagcgcaagctg

SEQ ID NO: 31755 - DNA, 768 bp, Rhodobacter sphaeroides
aaggccgtatttcccgtcgcaggactgggcacgcgctttctgccggcgaccaagtcgatcccgaaagagatcatgacgctggtcgaccgccccctgatccaatatgcgatcgatgaggctcgggcggccggcatcaaggaattcattttcgtcacctcgcgcggcaagagcgcgctcgaggattatttcgacaatgcgcccgaactcgaagccgcgctgaagaagcccggcaaggagcatctgctcgacgtgctggaaagcaccaacatggaaagcggcgccatcgcctatgtccgccagcacaaggcgctgggccttggccatgcggtctggtgcgcgcgccgcctgatcggcgacgagcccttcgcggtgatgctgccggatgacgtgatcgcggccgagaagccctgcctgcagcagatggtggaggcctacgaacagaccggcggcaacatggtggccgcgatggaagtgccgcccgagaaagcttcggcctatggcgtgctctcggtcgccgaggacatgggctcgatcgtcaaggtcaatggcatggtcgagaaaccgaaggaaaatccgccgtccaatcttgccgtgatcgggcgctacatcctgacgccgcaggttctgaacaacctgaaccgcaagaaggaaggcgccgggggggagatccagctgaccgatgcgatcgccgaagagatcgacgagtccggcaaggtctacggcttccgcttccgcggccagcgctacgactgcggctcgaaggcaggc

SEQ ID NO: 31756 - DNA, 1191 bp, Rhodobacter sphaeroides
atggccttcctctccgacacgcttgcccgcgtcaaaccgtcccagacgatcgcggtcaccaacaaggcgcgagagcttgcggccgccgggcgcgacgtgatcggcctcggcgcgggcgagcccgatttcgacacgcccgacaacatcaaggccgcggccaagcgcgccatcgatgcgggccgcaccaaatacaccgcggtcgacggcatccccgaattgaagcgcgcgatctgcgagaagttcgagcgcgagaacgggctgaaatacacgccggcgcaggtgacggtcggcaccggcggcaagcagatcctctacaacgcgctggtagcgacgctgaacccgggcgacgaggtcatcatccccgcgccctactgggtgagctaccccgacatggtgcttctggccggcggcacgccggtcagcgtggcggccgggatggagacgggcttcaagctcacgcccgagcagctcgaggcggcgatcacgccccgcaccaaatggttcatcttcaactcaccctcgaacccgacgggggcggcctacacccgcgccgaacttgccgcgctctgcgaggtgctgatgcgccatccgcaggtctggatcatgtccgacgacatgtacgagcatctggtgttcgacgatttcgatttcaccacgcccgcgcagatcgagcccggcctctacgaccgcacgctgacctgcaacggcgtctccaaggcctactgcatgaccggctggcgcatcggctatgcggcgggcccggtcgagctgatccgcgccatgggcaccatccagtcgcaatcgacctcgaacccctgctcgatcgcgcaatatgcggcgctcgaggcgctgtcggggccgcaggagttcctcgccacgaaccgcgaggccttccagcgccgccgcgatctggtggtctcgatgctgaacgaggccaagggcgtgacctgccccaaccccgagggcgccttctacgtctatcccgacatctcgggctgcatcggcaagacctcggccggcggcgcgaagatcacggatgacgaggccttcgcctcggcgcttctggaagagacgggcgtggcggtggtcttcggcgcggccttcggcctctcgcccaacttccgcatcagctatgccaccgccgacgaggtgctgcgcgaggcctgcgcccgcatccaggccttctgcgcc

SEQ ID NO: 31757 - DNA, 930 bp, Rhodobacter sphaeroides
atggccgccgtcaacgggctgatccgcgagcggatggcctcgaaacacgcgccccgcattcccgaggtcacggcgcatctggtcgaggccggcggcaagcggctgcggccgctcctgacgctcgccgcggcgcggctgtgcggctacgaggggccctatcacatccatctggccgcgacggtggagttcatccacacggcgacgctgcttcacgacgatgtggtggacgaaagccaccgccgccgcggcaaacccacggcgaacctgctgtgggacaacaaatcctcggtgctggtgggcgactatctcttcgcccgcagcttccagctgatggtcgagaccggctcgcttcgcgtgatggacatcctcgccaatgcctcggccaccatctccgagggcgaggtgctgcagctgaccgcggcccaggatctgcgcacgaccgaggacatctacctgcaggtggtgcgcggcaagacggccgcgctctttgccgcggcaaccgaggtgggcggcgtggtcgcgggcgtgcccgaggcgcaggtcgaggcgctccacgcctacggggacgcgctggggatcgccttccagatcgtcgacgacctcctcgattatggcggcgtggatgcccagatcggcaagaacaccggcgacgacttccgcgaacgcaagctgacgctgccggtcatcaaggcggtggcccaggccgatgccgaggagcgcgccttctggcagcgggtgatcgagaagggcgaccagcgcgagggtgacctcgagcaagcccatgcgatcatgtcccgccacggcgccatggaggccgcccggcaggatgcgctccgctgggtcacggtggcgcgcgaggcactcggccagctgccggagcacccgctgcgcgagatgctgcacgatctggccgatttcgtggtcgaacgc

SEQ ID NO: 31758 - DNA, 720 bp, Rhodobacter sphaeroides
atgtccaaggttgctctggtgacgggcggttcgcggggcatcggcgccgccatctcggtggcgctgaagaacgcgggctacacggtcgccgcgaactatgcgggcaatgacgaggcggcgcggaagttcaccgaagagaccggcatcaagacctacaaatggtccgtcgcggattacgatgcctgcgctgcgggcatcgcgcaggtcgaggccgagctcgggccggtggctgtgctggtgaacaacgccggcatcacgcgggattcgatgttccacaagatgacgcgcgaccagtggaaagaggtgatcgacaccaacctgtcgggcctcttcaacatgacccacccggtctggtccgggatgcgggaccgcaagttcggccggatcatcaacatctcttcgatcaacggccagaagggccaggccgggcaggcgaactattccgcggccaaggcgggcgacctcggcttcaccaaggcgctggcgcaggagggcgcgcgggcgggcatcaccgtcaatgcgatctgccccggctatatcgcgaccgagatggtgatggccgtgccggaaaaggtgcgcgagtcgatcatcgcccagatcccgaccggccgcctcggcgagccggaggagattgcccgctgcgtggtcttcctcgcctccgacgatgcgggcttcgtcaccggatcgaccatcacggcgaacggcggccagtatttcgtc

SEQ ID NO: 31759 - DNA, 1173 bp, Rhodobacter sphaeroides
atgaccaacgtggtaatcgtgtcggcggcgcgcacggccgtcggcagcttcaacggcgccttcgcgagcacgcccgcccatgacctcggcgctgccgtgatcgaggccgtggtggcccgcgccgggatcgacaaggcggacgtgagcgagacgatcctcggccaggtgctgaccgcgggtcagggccagaaccccgcccgtcaggcccacatcaaggcaggcctgccgcaggaaagcgccgcctggagcatcaaccaggtctgcggctcgggcctgcgcgcggtggcgctggcggcgcagcacgtccagctgggcgatgcctccatcgtcgtggcgggcggccaggaaaacatgagcctctcgccccatgtggcccatctgcgcgcggggcagaagatgggcgacctgagcttcatcgactcgatgatcaaggacgggctgtgggacgccttcaacggctatcacatgggccagaccgccgagaacgtcgccgcgaaatggcagatcagccgcgacatgcaggacgaattcgccgtcgccagccagaacaaggccgaggcggcacagaaggccggccgcttcgccgacgagatcgtgcccttcgtcatcaaaacccggaagggcgacgtgacagtggatgccgacgaatacatccgccacggcgcgacgctcgacgcgatggccaagctgcgccccgccttcatcaaggacggcaccgtgaccgcggccaacgcctcgggcatcaacgacggcgcggcggcggtcctcgtgatgagcgccgaggaggccgagaagcgcggcctttcgccgctggcccgcatcgcctcctatgccacggcggggctcgatccctcgatcatgggcgtgggtccgatccatgccagccgcaaggcgctcgagaaggccggctggaaggtgggcgatctcgatctggtcgaggccaacgaggccttcgcggcgcaggcctgtgccgtcaacaaggacatgggctgggatccctcgatcgtgaacgtgaacggcggcgccatcgccatcgggcacccgatcggggcctcgggcgcgcgcgtgctgaacacgctgctgttcgagatgcagcgccgcaacgccaaaaagggcctcgccaccctctgcatcggcggcggcatgggcgtcgccatgtgcctcgagcgcccc

SEQ ID NO: 31760 - DNA, 1371 bp, Rhodobacter sphaeroides
tatcgtgcgccgctggccgacttccgcttcctgctgggccatgtggtgggcctcgatcaggtggccgcgacggagcggttcgccgaagccacgcccgagacggtcgaggccatcctcgccgaggcgggcaagctctgcgaggaggtgctggcgccgctgcagcggccgggcgatctgcatccggcccggctcgagaatggcgtcgtgcgcacctcgcccggctatgccgagggctaccgcgccattgcggacgggggctgggtggggatcgccgccagccccgagcatggcggcatgggcctgcccatggcggtgacgaccgccgtgaacgagatgatgtcctcggcctgtctctcgctccagctcaatccgctgctgacgcagggccagatcgaggcgctggagcatcacgcctcggatgcactgaaggcgctctatctgccgaagctcatttcgggggagtggagcggcacgatgaatctgaccgagccgcaggcggggtcggacgtgggcgcggtgcgcacgcgggccgagccgctggaggacggcacctatgcgatcaccgggcagaagatctacatcacctgggccgacaccgacttcaacgcgaacgtctgccacctcgtgctggcgcgcttgccggacgggccgcagggcacgcgcgggatcagcctcttcctcgtgccgaagttcctgcccgacgccgagggccgtccggggccgcgcaatgcggtgacggtggtgagcctcgaggagaagctgggcctgcatggctctcccactgccgtcatggattatgacggggcgaagggctggctggtgggcgcgccgcacaaggggatggccgcgatgttcaccatgatgaacaacgcccgtctcggggtcggcgtgcagggcgtgggggtggccgaggccgcgacccaggcggccgtggcctatgcgatggagcgccggcagggcgggccgggcggcatcatcgaacatgccgacgtgcgccggatgctcgccgtgatgaaggccgagaccttctcggcgcgcgccatcgcgctcgcctgtgccgtggccctcgacatgggccgcgcgacgggccagccggaatggcaggcgcgggccgcgcttctcacgccgatcgccaaggcctacggcaccgatgtgggcatcgaggtcgcctcgatgggggtgcaggtccatggcggcacgggcttcatcgagggcaccggcgccgcgcagttcctgcgcgacgtgcgggtgacggcgatctacgaggggacgaacggcatccaggcgatggacctcgtcggccgcaagatgatggacgggggcgaggcggccttccgccttctgcaggagatcgaggacgcggccgagacc

SEQ ID NO: 31761 - DNA, 1257 bp, Rhodobacter sphaeroides
atggaccatttcctctaccgcaacgggtcgctccacgccgaggaggtgccgctctcggacatcgccgcgaccgtcggcacgcccttctactgctactcggcggccacgctcgaacggcactaccggctcttcaccgaggcgctgacgcccctgccgcatctggtctgcttcgcgatcaagtcgctgtcgaacctcgcggtgctgaaacttctgggcgatctcggcgcgggcatggatgtggtctcggcgggcgaatatctgcgcgcgcgcgccgcgggcgtgccgggcgaccggatcgtcttctcgggcgtgggcaagacccgcgaggagatgcggatcgcgctcgagggcgggatccggcagttcaacgtggaatccgagcccgagatgcgggcgctgtccgaggtggcctcctcgatggggctgcgcgcgcccatcgccgtgcgggtgaaccccgacgtcgatgcccgcacccacgagaagatcgccacaggcaagaaggagaacaagttcggcatcccgatagagcgcgcctccgaggtctatgccgaggccgcggccctgcccgggctcgaggtcatggggatcgacgtccatatcggctcgcagctgaccgagctcgagcccttcgagcaggcctatctgaaggtggcggagcttaccggccgcctgcgcgccgagggccacgagatccgcaggctcgacctcggcgggggtctgggcatcccctatacccgctcgaacgaggccccgccgctgcccaccgactacggcgcgctcatcaagcgcaccgtgggccatctcggctgcgagatcgagatcgagcccgggcggctgatctcgggcaactcgggcgtgctggtgagccgggtcatctatgtcaagaacggcgagggacgcgacttcctgatcctcgacgcggcgatgaacgatctcgtgcggccctcgatgtatggcgcgcaccacgacatcgtgccgctggcggaggccgcgccgggcaccgaaagccagccctacgacgtggtgggcccggtctgcgagacgggcgacaccttcgccaaggcgcgcgcgctgccgccgatggccgagggcgatctggtggccttccgctcggccggggcctatggcgcggtgatggcctcggaatacaattcccgcccgctggtgcccgaggttctggtgcgcggggatcacttcgccgtcatacgggcgagaccgacgtttgacgaaatgctcggccgcgatagcatccccgaa

SEQ ID NO: 31762 - DNA, 1362 bp, Rhodobacter sphaeroides
atgtggggcggccgcttcgccgcgggccccgatgcgatcatgcaggcgatcaacgcctcgatcgggttcgacaagcggctctacgcgcaggatatccgcggctcgcgggcccatgccgcgatgctcgcggcgcagggcatcctgacttctagggatgccgaggccatcggggaaggccttctcaccgttttgtcagagatcgaggccggcggcttccccttccgggtcgagctcgaggacatccacatgaacgtcgaggcccgcctgaaggagctgatcggcgagcccgccggccggctgcatacggcgcgctcgcgcaacgatcaggtggcggtcgatttccgtctctgggtccgcgaccagtgcgatgcggccatctcggggatcgaggcgctgatgcgggccttcctcgcgcaggccgaggcgggggccgactgggtgatgccgggcttcacgcatctgcagaccgcgcagccggtcacctggggccatcacatgctggcctatgtcgagatgctggcgcgcgaccgctcgcgcttcgtggatgcccgcgcgcgcatgaacgaatgcccgctgggcgccgcggcgctggcgggcacgggcttccccatcgaccggcacatgacggcggcggcgctcggcttcgaccggcccaccgccaacagcctcgattcggtctcggaccgcgactttgcgctcgagttcctgtcggcctcggcgatctgcgccctgcatctgtcgcgcttcgcggaagagctggtgatctggtcctcggcccagttccgcttcgtgcgcctgtcggaccgctggaccaccggctcgtcgatcatgccgcagaagaagaaccccgatgcggcggaattgctgcgggccaagatgggccgggtgctgggcgcggccgtcgcgctcttcaccgtgatgaagggcctgccgctgacctattccaaggacatgcaggaggacaaggagcaggtcttcgacgcggccgacacgctgatgctggggcttgccgccatgaccggcatggtgggcgacatgcaggccaaccgcgagagcctcgccgccgccgcggcctcgggcttctcgacggcgaccgatctggcggactggctggtgcgcgagctgaacctgccgttccgcgacgcccatcatgtgacgggcacgctcgtggcccgcgccgaggcccggggctgcgacctgcccgatctctcgctcgccgagatgcaggaggtgcatccgggcatccgcgaggacgtgttcgccgtcctcggcgtcgagaattccgtgcgcagccgcacctcctacggcggcaccgcacccgacaatgtccgcgcgcaggccgcgcgctggaaagagctgctg

SEQ ID NO: 31763 - DNA, 612 bp, Rhodobacter sphaeroides
atggaacttgacgcggtaagccggagctacaaacgctgggcgccgatctacgacttcagcttcggcaaggtgagcgagagcccgcggcgccggacggcggcccatgtgaatgcccgcggcggccgcgtgctcgaggtgggcgtgggcacgggcctgtcgctgccgctctacagccaccgggtggccgtgacggggatcgacttctcgcacgagatgctggcccgggcccgcgagaaggtcgaggagatgggcctcgagccggtcaaggagctgcgccagatggatgcgcgcgagctcgacttccccgacgagaccttcgacacggtcgtggccatgttcctcgtctcggtcgttcccgaacccgagcgcgtggtctcggagatggcgcgcgtctgccgcaagggcggcgaggtggtgatcgtgaaccatttcgcgcgcgacaagggcccgctcgccgccgtcgagaaggcgctggcgcggttcgagaacacgctgggctggcactccgacttcgcgatcgagcgcgtgaccgccgatccgcgcctcgaggtggtcgagcagaccccgatgagccccggcggcctcttcaccttcctgcgcttccagcgccgc

SEQ ID NO: 31764 - DNA, 1269 bp, Rhodobacter sphaeroides
gccgggcccgccggcgggcggctcgtcctgtcgctgcctaccgcccattgcgccgcctgcatgaccaccgtcgagggcggtctcgagaagctcgcgggcgtgcgctcggcgcgggtgaacctcacgctgcgccgggtctcggtcgatgccgagcccgaggtgacggcggcccagctggtcgaggcgctgtcgcggctgggctacgaggcccacgagctcgatgccgggatgctgtcggccaccgagaccgaccggcaggggcgcgacctcctgatgcgcctcggcgtggccggcttctcgatgatgaacgtgatgctgctgtcggtggccgtctggtcgggcgccgaggccgcgacgcgcgatctctttcactggatctcggccgccatcgccctgccgaccgtggtcttcgcgggccagcccttcttccgcaacgcctggacggcgctccgcgccgggcggctcgggatggatgtgccgatctcgctcgccatcatcctcgcctcgtcgatctcgctcttcgagaccttccattccggccaccacgcctatttcgacgcggcggtgatgctgaccttcttcctgctcgcgggccgctatctcgaccaccgcacccgcgccgtcgcccgttcggcagccgaggaactggcggcgctggaagtgccgcgcgccatgctcctgcgcgatggcgaggaagtgacggtgccgattgccgagcttgccgcgggcgatctggtgcgcgtgcggcctggagggcggatgccggtcgacggtgtggtggccgaaggcttctccgagctcgaccgctcgctcctcaccggcgagagcctgccggtgccggccggccccgaaaccgtggtctcggcgggtgaggtgaacctcaccggcccgctcacggtgcgggtgacggcggccgggcgcgacagctcgctgcatcggatggccgatctcgtggcggtcgccgaaagcgccaagacccgctacacgtccctcgcggaacgcgcctcgcggctctactcgccgctggtccatatcctctccttcaccgccttcggggtctggatgtggatcacgaagggcgacgtgcgcacctcgatcaacatctcggccgccgtgctcatcatcacctgcccctgcgccctggggctcgccgtgcccgccgtggtgacggcggcgagcgggcggctcttccgcaaggggctgctcatcaaggacggcaccgcgctggaacgtctcgccgaggtggatacggtcgtcttcgacaagacc

SEQ ID NO: 31765 - DNA, 765 bp, Rhodobacter sphaeroides
ggcaagacggccatcgtgaccggggccgccgccggcatcggcctcgcggtggcgcggcacttcgtcgacaagggcgcgaacgtgatgttcgtggacatggacgaggaacggctcgccgaccagatcggcgaggaggcgcgggccgagggcccggtgcgcatgttcgcgggcgacctgcgcgagaagctgacgatcaccaacctcctgtcggccacgatggatgccttcgaccgggtcgacatcctcgtgaatgcgagtcgtcaggtggctctgtccgatccgctctgcccggaagaggatgcggtcgagacgcttctgcagcagaatatgctgaccagcctgcgcctcacccagctgacggccaagcggatgatcgcgcgggccgagaagagcgacgagaagcccacgcaggtgggctcgatcatcaacctctcctccatcgccgcgatccgcacccagcccgagcttctggcctattcgatcagctgcgccgcggtcgagcagatgacgcggtcgatggcggtggcgctggcctcgaagggcatccgggtgaatgcggtctccttcggctcggtcatgagcgcgagcctccagaccgcgctgaaggacagcccggcgatgcgcgcccagatcaccgagcgcacgccgatgaagcgcatcgcctcgccggccgagatcgtcgagacggtgcagttcctcgcctcggacgcggcggccttcatgacgggacaggtggtgacgctcgacggcggacgcagcctgatc

SEQ ID NO: 31766 - DNA, 846 bp, Rhodobacter sphaeroides
aaggcgcgggcctcggagtggttccgcgagctgaggaaccgcatcctcgcggccttcgagggactcgaggatgcggccacaggcggctctcccgcggatgccgcgcccggccggttcgagatgaccgagacgagccgcgaggcgggcggcggcgggctcatgagcgtgatgcgcggcgggcgcgtattcgagaaggtgggcgtgaatgtctcgaccgtccatggcacgctggcgagccgggcgcagcaggcgatggccgcccgcggtgtgccgggcatggccgaggatccgcgcttctgggcctcgggcatcagcctcgtggcgcatatgcagaacccgcatgcgccggctgtccacatgaacacccgcatgttctggaccccgcacgcctggtggttcggcggcggctcggacctcaacccctgcctcgattatcccgaggataccaagcatttccacgccacgctgcgccatgcctgcgaggcgcacggggcggactactatccgcgcttcaaagcctgggccgacgaatatttcttcatcccccaccggggccgggcccgcggcgtgggcgggatcttcttcgacgacctgaataccgacgactgggaggccgatttcgccttcacccgcgcggtgggcgaggccttcctgccggccttcgtgcccctcgtcgagcggcgcatggaaacgccctggaccgaggccgaccgcgaggcgcagctcatccaccgcgggctctatgcggaatacaacctcgtctatgaccggggcacgaaattcggcctcgagaccggccacgacgccaacgccgtgctgatgagcctgcccccgctggccaagtgg

SEQ ID NO: 31767 - DNA, 1017 bp, Rhodobacter sphaeroides
aagacgatgctgcgtgcgctgaagggcgagacgctgcccacgcctcccatctggctcatgcgtcaggcggggcgctatctgccggaataccgcgccacgcgcgcccaggcgggggacttcctctcgctctgctacacgccggatctcgcggcggaagtgacgctccagccgatccgtcgctacgggttcgacgcggcgatcctctttgccgacatcctgctcctgccgcaggcgctgggggcggacctgtggttcgaaaccggcgaagggccgcgcatgtcgaccatcaccgacatggcgggcgtgaccgcgctgaagggccgcgacgacatccacgagacgctcgcgccggtctatgagacctgccgcatcctcgcccgcgaacttcccaaggagacaaccttcatcggctttgcgggcatgccctggacggtcgcgacctacatgatcgcgggccgcggcagcaaggatcaggccgctgcgcacaagctgaaggacaccgaccgtcccgccttcgaagcgctgatggaccgcgtgaccgaggccaccatcgaatatctcgccaagcaggtcgaggccggctgcgaggtggtgaagctcttcgacagctgggccggctcgctgaagggccaggacttcgaggatttcgccgtggcccccgccaagcggatcgtctcggaactcaaggcccgcttccagggcctgccggtcatcgccttcccgcgcgaggcgggcgagggctacatcggtttcgccgagaagaccggggccgactgcgtggccatcgacaattccgtcagcccggaatgggcggccgagaaggtgcaggcgggccggacctgcgtgcagggcaacctcgatccgaaatacatggtgacgggcggcgaggaactggtgcaggccacgaaacgtgtggtcgaggcgttccggaacggcccgcacatcttcaacctcggccatggcatcacgcccgaggccgatcccgagaacgtgacgctgctcgtcgagacgatccgc

SEQ ID NO: 31768 - DNA, 903 bp, Rhodobacter sphaeroides
ctcaagatcggcacgcgcggctcgccgcttgcgctggctcaggcctacgagacccgcagccgcctgtcggccgccttctcgctgccggaagaggcattcgaaatcgtggtcataaaaaccacaggtgacaaggtcttggaccgtccgctcaaggagatcggcggcaagggcctgttcacccgcgagatcgaggaggccctgctgtcggggggaatcgacatcgcggtccattcgatgaaggacatgccgacgcttcagcccgaggggctgatcctcgacacctacctcccgcgcgaggacacgcgggatgccttcatcaccttcgccgagggggggctggcggatttgccgcagggggccacggtcggctcgtcgagcctgcgccgccgcgcgcagctgctgaacaagcggccggacctgcaggtggtcgagttccgcgggaacctccagacccgtctgaagaagctgaacgacggggtggcgcggggcaccttcctcgctatggccgggctgaaccggctgaagatgaacgaggtgccgcgggtgccgatcgagtccgaggaaatgctctctgccgtggcgcagggcgccatcgggatcgagcgccggaccgacgatccgcgggcgcaggagatgctggccgcgatccacgacgtgcccacggggcaccggctcgcggccgagcgcagcttccttctgaagctcgacggctcgtgcgagacgccgatcgcggggctcgcgatcctcgagggcgatcagctgtggctgcgcggcgagatcctgcggccggacgggtccgagtcgatctcgggcgagatccgcggtgcgatcgcggatgcggcggccctcgggtccgagctggcctcggagcttctgggccgggcgccggccgacttcttcagc

SEQ ID NO: 31769 - DNA, 1899 bp, Rhodobacter sphaeroides
aacgcgcgaaatatcgctttctgggtggtcctgtttctgctgatcctggcgcttttcaacctgttcagcggcggccagaccaccagcagctcgcgcaccatctcctattccgatttcatcgcccgggtggacaatggcgaggtttcctcggtcacgctcgacggcgaacgggtaatggtgcgcggcaaggacggcacgcagtatgtggcgatcaagccgcagggcgaagaggtgacagaccgtctgatcaatcatggcgtggaagtgcgtgccgaggcgcaggagcagtcgggcttcttctcgctgatctcgctctggcttcccttcctcgtgctgatcggcatctggatcttcttcatgaaccggatgcagggcggcgggcgcggcggggcgatgggcttcggcaagagccgggccaagcttctgaccgaaaagcagggccgcgtcaccttcgacgacgtggccggcatcgacgaagccaaggaagagctggaagagatcgtcgaattcctgcgcaacccgcagaaattcagccgtctcggcggcaagatccccaagggcgcgctgctcgtgggcccgcccggcaccggcaagacgcttctggcgcgtgccatcgcgggcgaggccggcgtgcccttcttcaccatctcgggttcggatttcgtcgaaatgttcgtgggtgtcggtgcctcccgtgtccgtgacatgttcgagcaggccaagaagaacgcgccctgcatcgtcttcatcgacgagatcgacgccgtgggccgcgcccgtggcgtgggcatcggcggcggcaacgacgagcgcgagcagacgctgaaccagcttctggtcgagatggacgggttcgaggccaacgagggcgtcatcatcgtcgcggccaccaaccgcaaggacgtgctggacccggcgctgctgcgccccggccgcttcgaccgcacgatccatgtgccgaaccccgacatcaagggccgcgagaagatcctgtcggtccatgcccgcaaggttccgctggggccgaacgtcgacctgcgcctgatcgcgcgcggcacgccgggcttctcgggcgccgacctgatgaacctcgtgaacgaggcggcgctgctcgcggcccgcgtcgggcggcggttcgtcacgatggacgatttcgagaatgccaaggacaaggtcatgatgggggccgagcggcgctcgatggtcctcaccgccgaccagaaggagaagaccgcctaccacgaggccggtcacgccatcgtcggtctgaaccttcccaagtgcgacccggtatacaaggccacgatcatcccgcggggcggtgcgctcggcatggtggtcagcctgcccgagatggaccggctgaacatgcacaaggacgagggcaagcagaagatcgccatgaccatggcgggcaaggcggccgagatcatcaaatacggtgaagaggcggtctcctccggcccggcgggcgacatccagcaggcctcggcgctcgcgcgcgccatggtgatgcgctggggcatgtcggacgtcgtcggcaacatcgactatgccgaggcgcatgagggctatcagggcaataccgcgggcttctcggtctcggccgagaccaagaagatgatcgaggcggaggtgaagcgcctgatcgacgagggctaccagaccgcttaccggatcctcaccgagaagtcggaagagttcgaacgtctggccaagggcctcctcgaatacgagacgctcaccggcgaccagatccgccgtgtgatcgcgggcgagccgatcgactcggacgacgatgccgaccgtccggtgggcggcggctcggtggccgcgatcccgaagacccggccgaaggtcatcaaggcggatggcgggctcgagccctccgtctgagcc

SEQ ID NO: 31770 - DNA, 901 bp, Rhodobacter sphaeroides
atgacggcgaagcggatcgacggcaaggccttcgcggcgggcgtgcgcgcccgggtggccgaagaggtggcgcggctgaaggaggggcacggcatcgtgccgggcctcgccgtggtcctcgtgggcgaggatcccgcgagccaggtctatgtgggcgccaagggcaagcagacggtcgaggtgggcatggcctcgttcgagcaccggctgcccgccgggacctccgaggcggaacttctcgcgctgatcgaccggctgaaccacgacccggccgtgcacggcatcctcgtgcagctgccgctgcctgcgcatctgaatgcggatctcgtcatcaatgcgctcgatccggccaaggacgtggacgggttccacatctccaacgtgggccgtctcggcaccgggcagaagagcatggtgccctgcacgccgctcggctgtctgatgatgctgcgcgatcatctgggtgctctctcggggctgaatgccgtcgtggtgggccgctcgaacatcgtgggcaagcccatggcgcagctcctgctgggcgagagctgcacggtcaccatcgcccactcgcggacccgggacctcgccgccgtctgccgcggcgccgacatcctcgtggcggcggtgggccggcccgagatgatcaccggcgatttcgtgaagccgggcgccacggtcatcgacgtgggcatcaaccggatcgagcgcgacggcaagacgaagctcgtgggcgatgtggactatgcctccgccgccgaggtggcgggcgccatcacgccggtgccgggcggcgtggggccgatgaccatcgcctgcctgctggccaacacgctgaccgcctgctgccgtgcgaacggcctgcccgagccgcagggcctgacggcctgacgcccgcggc

SEQ ID NO: 31771 - DNA, 1308 bp, Rhodobacter sphaeroides
atgaagattgcgatgatcggcacgggctatgtgggcctcgtctcgggtgtgtgcttttcggacttcggccacgaggtggtctgcgtcgacaaggatgcgacgaagatcgccaagctgcgggacggcaaggtcccgatcttcgagccgggtctcgaggcgctgatggcgcggaacgtggcggcgggacggctgtccttcacgctcgatctggccgaggccatgcgcggcgcagatgccgtcttcatcgccgtgggcacgcccacccggcgcggcgacggccatgcggacctcacctatgtgatggccgccgccgaagagattgcccatgcgctcgatcattacgcggtggtggtgacgaaatcgaccgtgccgatcggcaccaaccggaaggtggccgagacgatccgggcggccaatccggccgccgatttcgacgtggcctcgaaccccgagttcctgcgcgagggcgcggccatcgacgatttcatgcgccccgaccgggtggtggtgggcgtcgagaccgagcgcgcgaagaagatcatggccgacatctaccgcccgctcttcctgcgcgacttcccggtggtctacacagggctcgagagcgccgagatgataaaatatgccgcgaacgccttcctcgcgacgaagatcaccttcatcaacgagatcgccgccctctgcgagcgggtgggggccgacatcaaggccgtgtccaagggcatgggcctcgacggccgcatcggcaacaagttcctgcatgcgggcccgggctatggcggctcgtgtttccccaaggacaccaaggcgctcgcccggatggggcaggatcatgcctcgccgatccagatcgtcgagagcgtcatcaaggtcaatgacgagatcaagcgccggatgatcgagaagatcgaggatctctgcgaaggctcgtgccgcgacaaggtgatcgcggtgctgggcgtgaccttcaagcccaacaccgacgacatgcgcgatgcgcccgcgctgaccatcgtgcccgctctggtgggggcgggggccaaggtgcgggtggtcgatcccgagggccggcgcgagggcgagcatctcctgcccggcgtccgctggatggaggatgcctattcggcggccgaaggcgcctcggtgctggtgatcctgaccgagtggaacgagttccgcgcgctcgatctccagcggcttgcgcgcggcatggccgacgcgcggatggccgatctgcgcaacgtctatgcgccggcggatgcccgcgccgcgggcttcacccattatgtgggcgtcggacggtaggat

SEQ ID NO: 31772 - DNA, 975 bp, Rhodobacter sphaeroides
cagcgggttctggtgacgggaggggcgggctacatcggctcgcacgcctgcaaggtcttgaagcgggccgggttcgagcccgtcaccttcgacaatctctcgacggggtgggagcaggccgtgaagttcggcccgctcgcccgcggcgacctgatggaccgcgcgagcatcgacgcggcgctcgagacctggaaacccgtggcggtgatgcatttcgcggcgctctcgctcgtgggcgagtcgatgcgcgatcccggcacctactggcgcgtgaacgtgaccggcgcgctcaacctgctcgaggcgacggtggcggccggggtgaagaacttcgtcttctcctcgacctgcgccacctacggcgatcaggacggcgtggtgctcgacgaggatacgccgcagcgcccgatcaacgcctatggcgcctccaagcgcgccatcgaggagatggtggcgaatttcggcgcggccttcgggctcaaccacacgatcttccgctatttcaacgtggcgggcgccgaccccgagggcgaggtcggcgagcagcacgatcccgagacgcatctgatcccgctcatgctcgatgcggtggcgggccggcggcccgcgctcaccgtcttcggcaccgactatcccacgcgcgacggcacctgcatccgcgactatgtgcatgtgatggatctggcccaggcccatgtgctgggcctgaaccgcctgctcgacggcggcccgaaccgggtcttctgcctcggcaccgggcgcggcttctcggtgcgcgaggtgatcgaacaatcgcgcgccgtaaccaaccgcgaagtgcccatcctgttcggcgaccgccggtcgggcgatgcggcggccctcgtctgcggctcggagcgcgcggtgcgtgaactgggatgggagcccgagctttcgaccctgccgcacatgatcgccgatgcctggcgctggcatcgggccccgaaattccac

SEQ ID NO: 31773 - DNA, 1260 bp, Rhodobacter sphaeroides
atggattcgattctcgtaaagggcaatggcgagctgcgcgggcagatcccgatcgcgggggcgaagaatgcctgtctggcgctgatgccggccacgctcctgtcggacgaaccgctgacgctgaccaatgcgccgcggctgtcggacatccgcacgatgacgcagcttctgcagtcgctcggcgcggaggtggcgagcctgcagggcgggcaggtgctggcgctctcgtcgcatgcgctgaccgaccatcgcgccgattacgacatcgtgcggaagatgcgcgcctcgatcctcgtgctggggccgatgctcgcgcgcgacggccatgcggtggtgtcgctgcccggcggctgcgccatcggggcgcggcccgtcgacctgcatctgaaggcgctcgaggcgatgggggccgagctcgacctgcgcgacggctatatccacgccaaggccccggcgggcgggctgaagggggcgcgggtggtcttcccgctcgtctcggtgggagcgaccgagaatgcgctgatggccgcgaccctcgccaagggcacgaccgtgctcgagaatgcggcgcgcgagcccgagatcgtcgatctggcccgctgcctccggcggatgggggcccagatcgagggcgagggctcctcgatcatgaccattcagggcgtggaccggctgggcggggccacgcaccccgtcgtcaccgaccggatcgagctcggcacctacatgctcgcgcccgcgatctgcggcggcgaggtcgagcttctgggcgggcggatcgagctggtcggcgccttctgcgagaagctcgatgcggccggcatctcggtcgaggagaccgagcgcgggctgcgcgtggcgcgcaggaacggccgggtgaaggccgtcgatgtgatgaccgagcccttcccgggttttcccaccgacctgcaggcgcagatgatggcgcttctctgcaccgccgagggcacttccgtgctcgaggagaggattttcgagaaccgcttcatgcatgcgccggagctgatccggatgggggcgcggatcgaggtgcacggcggcaccgccacggtgacgggcgtcgagaagctgcgtggggcgccggtgatggccaccgacctgcgcgcctcggtgagcctgatcctcgccgggctcgccgccgagggcgagaccatcgtgagccgggtctaccacctcgatcgcggctatgagagggtggaagagaagctgagcgcctgcggcgcgcagatcagaaggatc

SEQ ID NO: 31774 - DNA, 1200 bp, Rhodobacter sphaeroides
gtggccgggatcatcgcggatgtgcgggcgcgcggggatgcggcggtgatcgagctgaccgcgcggttcgaccggctggagctgacgcccgaacggcttgccttctcggaggcggagatcgaggcggagatcgcgaccgtatctgccgaggaccgcgcggcgctggagctcgcggccgagcggatccgggcctatcatgcccgccagatgccggagaatgcgcgctggaccgatgcggccggcgccgaactcggctggcgctgggggcccatcgcctcggccgggctctatgtgccgggggggctcgcctcctatccgtcctcggtgctgatgaatgcgatccccgccagggtcgcgggagtggagcggctggtcgtggcctgccccacgccgggcggcgtggtcaatccgctggtgctgctggccgcgcggctggcgggcgtggatgccgtctaccggatcggcggggcgcaggcggtggcggcgctggcctacggcaccgagacgatccggccggtcgacaagatcaccggcccgggcaatgcctatgtggcggcggccaagcggcgggtcttcggccgggtggggatcgacatgatcgcgggcccctccgagatcctcgtgatcgcggaaggcgcggtcgatcccgactggatcgcgctcgaccttctgagtcaggccgagcatgacgagagcgcgcagtcgatcctcgtcacgcccgacgaggcgctcggacgggccgtcgtgcaggcggtcgaggcgcggctcgagacgctcgagcggcgggcgatcgcgggcgcctcgtggcgcgactacggggcggtgatcgtgacgcgcgatctggaggaggcggcggcgctgtcggaccgggtggcgcccgagcatctcgaactgtgcgtggccgatcccgaggcgctggccgcgcggatccgccatgcgggggcgatctttctcggcggctggacgcccgaggcgatcggcgactatgtgggcgggccgaaccatgtgctgcccaccgcccgctcggcgcgcttctcgagcggcctgtcggtgatggatttcctcaagcgcaccacgctcgcccggatgacgcccgcggcgctgcgcgccgtgggccccgccgccgagcggctggccatttcggagagcctcgaggcgcacggcctgtccgtccgcgcccggctcgaccggctgaacgag

SEQ ID NO: 31775 - DNA, 786 bp, Rhodobacter sphaeroides
ctacatctcgaaggtaagattgccttggtgaccggaagcagcaagggcatcggcgccggtatcgcacgcgggctggcacgcgcaggcgcggtggtgatggttcacgggcgcgaccgggaacaagcgactgccgtggcgcggcaaatccggcaggacggcggaacggcgcatgtcgtgacgggggatctgacagaggaagcggaggttgatactcttctcgctgaggtgcgcgccatcggagacatcgacatcctcgtcaacaacgcaggcggctcgggcgggaattcggactgggccacgacaaaggctggcgcatgggcagcaacttatgatgccaacgtgctggcggccatgcgcattgcgaaggcggtcctgccacagatgcgccatgccgggtggggacggatcatcaacatttccagcctcgccgcgctgatgccacctgccggcaacccggactattcggccgccaaggccgcgatgctggcgatgtctgcctcgatggccaaggccgttgcggccgatggggtgaccgtgaataccgtgtctcccggcacgatccacagcgagaagctcgaccgcaagtttcgcgaggtggcgcagcagcggggcattgcgccggaagcgccatgggaagtggtggaagcagaggcccttccactcttcgcgagcgtccccacaggacgggttggcacgctggatgagatcgcggatgccgtggccttcctcgccagtccccgcgcctcttacatcaccggctcgaaccttcgcctggacgggggaatg

SEQ ID NO: 31776 - DNA, 1497 bp, Rhodobacter sphaeroides
cagcccaacatcctcatcctgatggtcgatcagctgaacggaacgctgtttcccgacgggccggccgactggctgcacgcgccgaacctgaagcggctcgcggaccgctctctccggttttcgaacagctatacggccagccccctctgcgccccggcgcgggcctccttcatgtcgggtcagctgccctcgcgcacccgggtctatgacaatgcggccgagttcgcctcggacattcccaccttcgcacatcatctgcggcgcgccggctatcagaccacgctctcgggcaagatgcatttcgtggggcccgaccagctgcacgggttcgaggcgcggctgacgaccgacatctatcccgccgacttcggctggacgccggactatcgcaagccgggcgagcggatcgactggtggtatcacaacttgggctccgtcaccggcgcgggcgtggccgagatcaccaaccagctcgaatatgacgacgacgtggcgcatcaggcgatccagaagctctacgacctgtcgcgcggcgccgatccgcggccctggtgcctcacggtcagcttcacccatccgcacgatcccttcgtggcgcgccggaaatactgggacctctacgaggaccatccaatgctcgagccgcccgcctccattccctacgaagcccaggacagccactcgcgccgcctgatggatgcctgcgatttcaaggcgttcgacatcacgcccgagcaggtgcgccgcgcgcggcagggctacttcgccaatatctcctatgtggacgacaagatcggcgagatcctcgccgtactcgaggcctcgcgtcaggaggccatcgtcgtcttcgtctcggatcacggcgagatgctgggcgaccgcggcctctggttcaagatgagcttcttcgagggctcggccagggtgccgctgatgatcgcggctcccggcctgcccgccgggcggatcgcggcgccggtttcgaccatcgacgtgacgcccacgctctgcgcgctggccggcatcgacatgggcgagatcgcgccctggaccgatggcatcagtctggtcccgctggccgaaggcgaactgcgtcccgagcccgtgttcatggaatatgcggccgagggttcgatcacgccgctggtggcgatccgcgaggggcgctggaaatatgtccgctgtctcgcagatcccgaacagctgttcgatatcgaggcggatcccggcgagcggacggatctggcggccgatccggcccatgccgacacgctggcgcggctgcggtccctctcgcaggcgcgctgggatctcgcggccttcgacgccgccgtgcgcgaaagccaggcccggcgctggatcgtctacgaggcgctgcggcagggcggctattacccgtgggattaccagccgctgcagaaggcttccgagcgctacatgcgcaaccacatggatctgaatattctcgaagagagcaagcgcttcccgcggggcgaa

SEQ ID NO: 31777 - DNA, 912 bp, Rhodobacter sphaeroides
ctcatcaacgacgcaacgctgcgcgaagggaatcaggcttcgggcgtaaggttcagcgtacacgacagcgtagccattgccaccgcgcttgacgggatcggcgtcgacatgatcgagatcggtcacccgctcgccggaccatacgagcaccagcgcaccgaggccgttgcgaagctcgggctcggcgcaaagatcattgcgcacgcccgtgcacatcgcaccgatattgaggccgtcagccgtaccggggccacttgggtcgggatcttcctgggtgtcaacgacatcacgacgaaggcccgggtgatcggtcgcagcaccacggaactgatccgaatggtcgccgacgcggtgaaggtcgccaaggattgcggcttgaacatccgctacagttgcgaagatgctagccgcaccaacacactgttcctagtggacgtgttcggcgcggcgatcgacgcaggcgccgaccgcatttgctacgccgatacgctcggaatcgccgagcctgccgaagttgcgcgcaaggtcaccctgatgaagtccgaattccccgatgcggaggtggaggtgcatctgcacgacgaccgcggcctcgccatggccaactcgctcgccgcgatcgacgccggtgtcgactctatatccgtctcggtgaatgcgttgggcgagcgctgcggcatcacggacctagcgaccttactcgtcaatcttggatttcgaggcgagcgcgcactgcccgacatctcggagcttcgagcactgtcacgattggtcgccatgtcatcgaatacgcccttcgacgcgctgcggccgatcgtcggcgacaacgcgttcaagcatggatcaaaacttcaccaacgcgccacgcagtacgagccgcgtgcctacgactggatcaaggagttcatctac

SEQ ID NO: 31778 - DNA, 1206 bp, Rhodobacter sphaeroides
tcgctggttgcgccgatctatcagaccacggccttcgaactcccggaggccgacgaggccgcagcgctgttcgcgctggagaagctcacaccgatctatgcgcgcaccgacaatccgacgacgcgcgtccttgaggaacggatgcgggccgtcgaacagggcgaggcttgcatctgcttcgccactggcaaggccgcgatagtcgcggcgatctgcgcggtcaccggagccggagacaatatcgttgcgtcacgcaacctgttctcaggcacaatggcaatgttctccgcgacgctgaagaacttggggatcaatgtccgattcaccgagcaggacacggccgaagcgttcgaggccctaagtgatgaacgcactaaactgtggtatgctgagaccttgtcaaacccgctgctgaaggtcttcccaatcgccagcgtcgcacggcgatcgcactcgctcggtatcccactggttatcgacaacacgctgggcgtgggcctatgccagccgctggcgttcggcgcagcggtttcggttgtctccctctcgaaatacgtggcgggcgatggctcgactatgggcggagccctaagcgaagggaactttgagtgggccagcgcgcgtgaccggtttacttggctgttccagccagatcccgcattcgctggcgttgtgtgggccgatcttgcccgcaagcatcgcactacgccgtacatgctgcggcttcggttcgtcatgctgcgggatttcggcgctaccttaagtccattgtctgccttcttgctatctcaggcgacggaaacgctcgcactgcgcatacagcgccatgccgaatccgcgcgtcgcgtcgccaccttcctggatggccaccctcgcgtgcgatcggtctgtcatcccacgatcggtacggccgacgaggtacggcgaaatgcggatacgattcccggcggcgcctgcgggatggtgtcggtcgacatccatggcggccaagtcgccggacagcgtttcgtggcgggcctgacgctgttccggcatgtggcgaccgccggatcaagcgccagcctcgccatccatccctattccacgcagctgcggcaattgacggaggacgagcgtcgcagaacaggcgttccggaaggattcgttcgcctgtcaattggcttggaggatccggacatgctgatcgacgatcttcaacagtctctc

SEQ ID NO: 31779 - DNA, 996 bp, Rhodobacter sphaeroides
cggatcgcgatcaacggcctcgggcggatggggaaactcttgctgcgcgaactgatcgaccgcggcatgggcgacgggatcatgcttctgaacgatgctgagggcgatccggcgcagcacgcgctgctgatggagttcgacagcgttcacggccgctggacgacgccggtgacgcatgacgccgagagcctgacgctcgccggccaccgcatcccgctgcggcgcgaacggcggatcgaggatctgccgctgggcgagctgggtgtcgatctggtggttgactgcaccggcgtcttcaagaccgccgcgaaaatcgcgccctatttcgaggcggtgaagaaggtcgtggtctcggcgccggtgaaggatggcggggcgctgaacctggtctatgggatcaatcaccagctctacgacggcagccagcggctggtgacggcggcctcctgcacgacgaactgcctcgcgccggtggtgaaggtgatccacgagaggttgggcatccggcatggctcgatcaccacgatccatgacgtgaccaatacccaaaccatcgtggaccggccggcgaagaacatgcgccgcgcccgctcggcgctggcgaacctgatcccgacctcgaccggctcggccaccgcgatcgggctgatctaccccgagctgaagggccggctgaacggccatgcggtgcgggtgccgctgctgaatgcctcgctgaccgactgcgtcttcgaggtcgagcgcccgaccacggccgaggaggtcaacgccctcttcgccgaagccgctgccgggccgctgaaaggcatcctcggctatgaggagcggccgctggtctcgtcggatttcctgaatgatccccggtcggcggtggtcgatgcggcctcgaccatggtggtgggcggcacgcaggtgaagatctacgcctggtatgacaacgaatggggctatgcctgccggatggccgacatcacccggctggtggcggagagcctg

SEQ ID NO: 31780 - DNA, 1023 bp, Thermobifida fusca
gacgtcactgtctccgagcccgcccccgacgaagtcctcatccgcgtcgcagcctccggtgtctgccacaccgaccggaccatgcagcagggagccaacgaccttcccctgcccctcatcctcggccacgaagtcgcaggaatcgtggaacgggtaggcagcgccgtcaccgccgtcgaacccggcgaccacgtggtgacctgtgcttccgccttctgcggcacctgccgctggtgcatgcgcggcgaactccagcactgcgcgcacaagcgccgctccagagaccccggccagccgccgcggctctcccaaggcgacacccccgtcgaaccgttcgtcggcctcggcggattcgcagaacaggtcctcgtctacgaaggcgccgtcgtcaaactgcccgaggagatgccgctcgaccgcgccgccctcctcggctgctccgtcatcaccggcatgggcgcggtacgcaacgccgcccaggtgcaatccggtcagactgtggccgttatcggctgtggcggtgtgggcctcaacgtgatccaaggagcccgactgtgcggggccgcgcagatcatcgccatcgaccggctcgccgacaaactcgacctcgcccggcaattcggcgccacccacaccatcgacgccagcaccaccgatccggtggaggccgtgcgcgaactgaccggcggcggagtcgaccacgccattgaagtggtcggcatcgccgcgaccatggagcaggccttccggatgctcgacaccaagggcaccgccaccgtcgtgggtgtggcccaccccgaggtgcaggtgagcatccgcgccaccgacctgctgctggaaaaacgcctccagggatccaagatgggctctgcccgcccccggatcgacatccccttctactgccagctctacctggacggccgcctcaaactcgacgaactcctcaccgcccgggtgcccctcagcgaggtcaacagcgccctggccgccctcgacaacccgctcggcgcacgcacggtcctc

SEQ ID NO: 31781 - DNA, 1839 bp, Thermobifida fusca
atggcacgtgcggtcggcatcgaccttggtacgacaaactctgtcgtcgcggtcctggaaggcggcgaacccacggttatcgccaacgccgaaggagctcggaccactccgtccgtcgtcgccttcgcgaagaacggtgaggtgctcgtcggtgagatcgccaagcgccaggcggtcaccaacgtcgagcggaccatccgctcggtcaagcgccacatgggcaccgactggaagacccacatcgacggcaaggacttcaccccgcagcagatcagcgccttcgtgctgcagaagctgaagagggacgcggaggcctacctcggcgaggaagtcaccgacgccgtcatcaccgtcccggcctacttcagcgacgctgagcggcaggccaccaaggacgcagggaagatcgccggcctcaacgtcctgcgcatcatcaacgagcccacgtccgctgcgctcgcctaccacctggagaaagagggcgaggccaccatcctggtcttcgacctcggcggtggtaccttcgacgtctcgctgctggacgtcggcgacggcgtggtcgaggtgaaggccacccacggtgacaaccacctcggtggtgacgactgggaccaggccgtcgtggactggctggtcgagcggttcaagagcagcaacggcatcgacctgtccaaggacaagatggcgatgcagcggctccgcgaggccgcggagaaggccaagatcgagctgtccagctccacggagacctcgatcaacctgccctacatcaccgcctccgccgagggtccgctgcacctggacgagaagctcacccgcgccgagttccagcggctcacgtcgcacctgctcgagcgcaccaagggcccgttcttccaggtcatcaaggacgctgggatcagcgtcgaccagattgaccacgtggtcctggtgggtggctccacccggatgcccgccgtggtcgacctggtgcgcgagctgaccggcggcaaggagcccaacaagggcgtcaacccggacgaggtcgtcgcggtcggcgcggccctgcaggccggtgtgctcaagggtgacgtcaaggacgtgctgctgctcgacgtgaccccgctgtcgctgggcatcgagaccaagggcggtgtcttcaccaagctcatcgagcgcaacacggccatcccgaccaagcgctcggagatcttcaccacggccgaggacaaccagccgtcggtgcagatccaggtctaccagggtgagcgggagatcgctaagtacaacaagaagctcggcgtcttcgacctgaccggcatcccgccggcgccgcgcggtgtgccgcagatcgaggtcaccttcgacatcgacgccaacggcatcgtcaacgtcaccgcgaaggacctcggcaccggcaaggagcagtcggtcaccatcaccggtggctccgcgctgccgaaggaagacatcgagcggatgatccgcgaggcggaggagtacgccgagcaggaccgcaagcgccgcgaggaagcggagacccgcaacaacgccgagtcgctggtctaccagaccgagaaggtcatctccgagaacgaggacaagatccccgaggacgtcaagaacgagaccaaggaggcgctggacgggctgaagaaggcgctcgaaggcagcgacatcgaggcgatccgcagcgccagcgagaaggttgccctggccagccagaagatcggctccgccatctacagccagagccagcaggcctccggcgcagcggcgggcggccagcagaacgccgaggacgcggaggtcgtggacgcggagatcgtcgacgaggagcccaagcgcgaaggcaactcg

SEQ ID NO: 31782 - DNA, 1101 bp, Thermobifida fusca
atgagcaccaaggactacctggagaaggactattacaaggtcctcggagtctcaaagacggccaccgcggacgagatcaggagtgcctaccgcaagctcgcgcgcaagtaccaccccgacgccaacaagggcgacgcgcaggccgagaagaagttcaaggagatttctgaggcctacagcgtcctgtcggacgagaagcgccgcaaagagtacgacgaggcccggtcgctgttcggcggggcctaccggcctggcgggggcggtatcggcgacttcaacctcggcgacctgttcggccacaccacgaccgggggtgaacggctcaccgacctcttcggtggactgttcggcggccgcggccgcgccacccagtcgcggcggggcgccgacctcgaaaccgagaccacgctcagcttcaccgaagcggtctccggcaccacgaagagcttcacgctcacgaccaccgtctcgtgccccacctgccggggcagcggggccaagcctggaacgaccccgcgggtctgcccccggtgtgcggggaccgggcacgagagcaccaaccttggcggcttctccctgtccgaaccgtgcgctctgtgcaagggacgcggctacttggccgacgacccgtgtctgacctgcagcggaacggggaatgtgaagggcactcgcaccgtgcaggcccgcattcccccgggagtgtccgacggccagcggattcggctgcggggcaagggcgaaccaggggaacgcggcggccccgctggcgacctgttcgtgaccgtccgggtcaccccgcaccccgtgttcggccggtccggagacaacctgaccctcactctcccggtgaccttccccgaagccgtgttcggagcggaggtgcgcgtgcccaccctgagcgggccaccggtcaccgtgcggattccgccgggcacccgcaacgggcgcgtgttccgggtccgcggcaagggggctacccggcgggacggcacaactggagacttgctagtgaccgttgaggtggcggtaccgcagaatctcaacagtgaggcgcgggaggcgttgcagcgattccaggccgccacagccgaccacaacccg

SEQ ID NO: 31783 - DNA, 2556 bp, Thermobifida fusca
accaggaagagtcaggaggcgttgtccgcggcaatccggagggcaaccgcggacggtaacccccaggtcgaaccggtgcacctgctgtctgccctgatcggccaggctgaaggagtcgtccggcccctgctcaaagaggtgggggccgatccaggcaggctcagcaccaaggtggaagaggagatcgcccgactgcctcgcgcgtcggggagtacggtcaacgcgccggcgagctcccggcagctcatcatttcgctgaacacggcggcccagcgcgccaagcagatggaggacgagtacgtctccaccgagcacctgctggtcgggctggccgcggacggggggacggcagccaccctgctgcgggaggcaggcgcgacaccggaagcgctgctggacgcgttcagccgggtgcggggcagcgcccgtgtcacttcggagaccccggaagacacctaccaggcgctcgagaagtacggggtggacctcacccagcgggcccgcgaaggcaaactggacccggttatcggcagagacgcggagatccgccgggtgatccaggtgctgtcccggcgcaccaagaacaacccggtgctcattggtgaaccgggtgtcggcaagaccgcggtggtcgagggcctcgcccagcgtattgtcgccggcgacgtccccgagtcgctgcgcgacaagcggctgatctcgctggacttgcccgcgatggtggcgggtgccaagtaccggggcgagttcgaggagcggctcaaagcggtcctcaacgagatcaagcagagcgaagggcagatcatcacgttcatcgacgagctgcacaccgtggtcggcgcgggtgcggccgagggggcgatggacgcgggcaacatgctcaagcccatgctggcccgaggcgaactgcgcatggtcggggcgaccacgctcgacgagtaccgcgaacgcatcgagaaggacccggcgctggagcggcggttccagcaggtgatggtgaacgagccgtccgcggccgacacgatcgcgatcctgcgcggcctcaagggccgttacgaggcgcaccacaaggtgcagatcgccgactcggcgctggtggcggcggcgaccctgtccgaccggtacatcactgcccggttcctgccggacaaggccatcgacttgatcgacgaggcagcatcccggctgcgcatggagatcgactcccagccggtggagatcgacgaactgcagcgcgtggtcgaccggctcaagatggaggagatggcgttgagcaaggagtccgacgccgcctccaagcagcggctggaacggctgcgcgccgacctcgccgacaaggaggagcagctcaatgcgctcatcgcccgctgggagcaggagaaggccgggctcaaccgggtcggtgagctcaaggagaagctggatgagctgcggggccaggccgaacgcgcccagcgcgacggcgacttcgaggaagcctcccggttgatgtacggggagatcccgcaactggagcggcagttggaggaggctctctccgaggaagactcggccgagcacgctaccatggtcaaggaggaggtcggcgccgacgacgtggccgatgtggtgtcgtcgtggaccggtatccccgtggggcggctcatggagggggagagcgccaagctgctccggatggaggaggagatcggaaagcgcctgatcgggcagcggcgcgctgtggccgccgtctccgatgcggtgcggcgggcccgcgcggggatctccgaccctgaccggccgaccggctccttcctgttcctcggccccaccggcgtgggtaagacggagctggcgaaggcgctcgccgagttcctgttcgacgacgagcgcgcgattgtgcgcctcgacatgagcgagtactccgagaagcactcggtggcccgactggtcggtgcgccccccggctacgtcggctacgaggagggcggccagctcaccgaggcggtgcggcggcgcccctacacggtggtgctgctcgacgaggtggagaaggcccacatcgaggtcttcgacaccctgctgcaggtcttggacgacgggcggctcaccgacgggcagggccgccaggtggacttccgcaacacgctgctgatcctgacctccaacctggggtcgcagttcctcatcgaccccacgctggacgacgcccagcggcacgagaaggtcatgcaggtggtgcggaacaccttcaaaccggagttcttgaaccggttggacgacgtgatcgtgttcgacgcgctgtccaccgacgacctgaccaagatcgtcgacctgcaggtggatcggctggcccggcggctggcggaccggaggctcaagctggaggtcactccggctgcccgcgagtggctggcgctggccggctacgacccggtctacggtgcgcgtccgctgcggcggctggtgcagaccgcgatcggcgacccgctggcccgggaactgctggcgggcaacctcgttgagggcgacacagtccgggtggatgtggacgagtccaaggattcgttgacagtg

SEQ ID NO: 31784 - DNA, 795 bp, Thermobifida fusca
aagcgagcggccgtcctcggttcgccgatctcccattccctctcgccggtgctgcacacggcgggctataccgcgctcggtatcgcggaccagtggcattacggccgttacgaatgcgacgagcacggtctcgccgcgttccttgaccagtgcgacgagtcctgggcgggcctctcgttgaccatgccgctcaaaaaggtcgcgctgaccctcgcagatgaggtggaggacacggccgcagcggtcgggggcgcgaacaccatcatcttcgacaaggggcggcggcacgcctacaacaccgacgtcacggggattaccgaggcgctgcgtgaggcgggcatccaccggcttgacacggtcaccatcctgggggcgggggcgaccgccgcgtccgcactcgctgctgtgcgccggctcggcgctaccgaacccggcgcggtcaccgtgctggcccgtgacctttcccggacccgggacctcgcggctgcggcggagcggatgggcgcccaggtgaagttcgcgctgctcaccgagatcgaccagcacgtgcatgcggatctggtggtgtcgacgcttcccgcgggggcagccgaccagtgggcggagccggtggccgcggcgaagaccccggtgttcgacgtcgtctacgccccgtggcctaccgtgctggggagcgcagccgccgcagcgggagcggtggtggttggggggttccccatgctgctgcaccaggcggtggcccagttgaccctgatgacggggtacgaggccccggttgaagcgatgcgtgctgcc

SEQ ID NO: 31785 - DNA, 873 bp, Thermobifida fusca
atgcaactcggcatgatcggcctcggcaagatgggcggcaacatggccgcacggctgcgcgacaaggggcacgaggtcatcggctacgacgtcaaccccgagctgcgcgacgtggactccatcgccgaactcgtggaacgactgtccgccccgcggaccgtgtggctgatggtgccggccggggagcccacccggaacacgatccgggagctcgccgacctcctcgacgagggcgacctcgtcatcgaaggcggcaactcccactaccgggacgaccgcgtgcacgccgacgaactcgcccgccgcggcatcgaataccttgatgcgggagtcagcggcggaatctggggacgcgaaaacggctacggcatcatggtcggcggcagcgccgagaacgtggcccgcgccaagccgatcttcgacgccctcacccccgaggccgggagcgggttcgtccacgccggggaaatcggtgccgggcacttcgtcaagatggtccacaacggcatcgaatacggcatgatgcaggccttcgccgaaggctacgagctcatggccgcctctgggatcgtcaaagacgtccccggcacgctcgccagttggcgccaaggcaccgtggtgcgctcctggctgctggacctgctggtccgcgccctggaagaagaccccgagctggagcagttgcgcggatacgctgaagactccggtgaaggacgctggaccgtgcaagccgccgttgaccacgcggtgcccgccccagttatcaccgccgccctgtacgcccggttcgcctcccggcaggaggacagcccggcgatgaaagtcatcgccgcactccgcaaccagttcggcgggcacgcggtcgtcaagaag

SEQ ID NO: 31786 - DNA, 1026 bp, Thermobifida fusca
atgggctatacggcggcggtcgccggcgccagcgggtacgtaggaggggaactgctgcgcctcctgctcgcccaccccgacattgagatcggggcactcaccgcgggcggcaacgccgggacccggctcggcgagcaccaccctcacctgaccccgctcgctgaccggatcctcaccgaaaccacccccgagacccttgccggccacgacatcgtcttcctcgccctgccccacggccactccgctgcgctagcagcccagctcgacgccgacaccctcatcgtcgactgcggcgccgacttccggctggccgatgccgcggcctggcagaagttctacggctctgaacacgccggcacctggccctacggtttgcctgaactccccggggcccgtgccgcactggcccagacccggcggatcgcggtccctggctgctaccccacctgcggaaccctcgccctgatgcctgctttcgcggagcagctcgtcgaaccggaggtcgtggtggtcgccgcctccggaacctccggcgctggcaaagccgccaaaccccacctcatcgccagcgaagtcatggggtcggtgagcgtctacggtgtcgggggagcacaccggcacaaccccgaattcgtccagaacctgtccgcggtggcagagaccccggtgcgcgtgtccttcaccccggtcctcgtgccgatgccgcgcggcatcctcgccacctgctcggcaccgctcaagcccgccatcggcctcgacgaagtccgcgccgcctaccagcgccactacgacgcggaacccttcgtccacctgctgcccgagggacagtggcccaccaccgcgatgaccctcggcgccaacaccgccgctgtccaagtcaccgtggacgaagcagcgggccgcctcgtcgcggtcgcagccatcgacaacctcaccaagggaaccgcgggtggtgcgatccaaagcgccaaccttgccctcggcctccccgaaaccaccggactccctatgactggagtggcaccg

SEQ ID NO: 31787 - DNA, 1143 bp, Thermobifida fusca
gttaccgcgcctttaggctttcgggcggcaggagtagccgccggcatcaaagacggcggccagcgcgacgtcgccgtcgtcatcaacgacggcccgcaccactccgccgcggcagtcttcacgaagaaccgggtcaaggctgcaccggtgcagtggtcccagcaggccgtcgccgacggccaagtgcgcgccgtcgtcctcaactctgggggcgccaacgcctgcaccggggccgcgggcttccaggacgcgcgcaccaccgcggaacacctggccgcagcgctcaacgactccgcggaccggatcgtggtctgctccaccggtctcatcggggaacgcctgcccatgccgaaactccttgccggagtggacgccgcagtggcggaggcggcgcgcgacggcggcctcaacgcggccgacgctatccgcaccacagacaccgtctccaaaatcgccttccgccgcggcagcggctacaccatcggcggcatggctaaaggagcgggcatgctcgccccgtcgctggccaccatgctgtcggtcctcaccaccgacgccgtgctcacccccgagcagtgcaccgccctactgcgcgccgccaccgaagtgaccttcgaccggctcgacaccgacggctgcacctccaccaacgacaccgtggtgctcatggccagcggcgcttccggcaccaccccggacgaggcagagttctcccgcctgctcaccgaagtctgccaggacctgtgccgccaactcctggccgacgcggaaggcgcgaccaaagccatcgccattgaagtcgtgggcgcggccagcaccgacgacgcggtcaccgtcggacgcgctatcgcccgcaacgccctcttcaaatgcgcgatctacggagaggaccccaactggggacgcgtcctcgccgcagtaggcactaccgacgccgtcttcgaaccggacaacatcaacgtcgccatcaacggcgtatgggtgtgccggggcggatcggtcggcgacgaccgcgccaaagtcaacctcaaaccccgggacgtcaccgtcaccgtcgacctctccgcgggctccgcctccgccacagtgtggaccaccgacctgaccgtcgactacgtacacgagaactcggcctactccaca

SEQ ID NO: 31788 - DNA, 864 bp, Thermobifida fusca
acccgccaggaagccctggacaaggcgaagaccctcatcgaagcgctcccctggctgagcgccctccacggcaagaccgtggtcgtcaaatacggcggcaacgccatgaccgacccggacctgcgggcgcgcttcgctgagaacatcgtgttcctgcggtacgccggcctgcgccccgtcgtcgtccacggaggcggcccgcagatcaacgcgcacctggaacggctcggcgtggaaagcaccttcaccgccgggctgcgggtcaccacgcccgagacgatggagatcgtccgcatggtcctcgtcggccaggtcaaccgcgagatcgtcgggctcatcaacgagcacggccccttcgccgtcggcatgtccggtgaagacgcccacctgttcaccgccgaacgcaaatacgccatggtcgacggcgaacccgtcgacatcggactcgtcggcgaagtcgtggacgtccaacccggggccgtgcgcagcctgctggacgacggacgcatccccatcatctccagcatcgcccgctccgccgaaggcggcgtgtacaacgtcaacgccgacaccgcggccgcggcactggccgtggctttgggcgccgccaaactcatcgtgctcaccgacgtggaaggcctctacgccgactacccggtcaactcggagctcatcagccacatgaccgccagcgagctggaggaaatgctgccgaccctgtcgtccggcatggtgcccaagatggaagcctgcctgcgcgcagtccgcggcggcgtcccccaagcgcacgtcctcgacgggcgcatccccaacgcgatgctgctcgagatcttcaccgacgaaggagtcggcaccatggtcctg

SEQ ID NO: 31789 - DNA, 1176 bp, Thermobifida fusca
agcgccaccgaacagttgcagaaacgcttcgaagcggtcctcatgcccaactacggcatcccgcccgtggccctggtccgcggcgaaggatgccgggtcaccgacgccgacgggaagacctacctcgacctcatcgccgggatcgcggtgtcgtccctgggatacgggcaccccgccctggtcgcagcagtcaccgagcaggccgccaccctcatccacaccagcaacctgttcctgcacgaacgggaagtcgaactcgcggagaaactcgtcagcctgctcggcgggtccgcgcgggtcttcttcgccaactccggcacggaagccaacgaggcagcgctgaaactcgtccgacgtgccgcgggaccggaacgcacctactacgtctccaccgtggccggcttccacggccgcacctccggctcgctcgccctcaccggcaaacccgcgattcgggacccgttcggccccttcaacctggacgtgcggttcgtcccccacggcgacgtggcagcgctgcgcgaagccgtcaccgaccagtgcatcgcggtcttcgtcgagcccgtgcaaggggaggccggagtcgtcccggcccggccaggctacctggccgcggtccgcgagatctgcgacgccaccggagccgccttcgtcctcgacgagatccaaagcgggatcggccgcaccgggcactggttcgcacaccaggccgaaggggtccgccccgacgtcctcactctcgccaaaggactcggcggtggactgccgatcggggcctgcgtgggcttcggccggtacggcaccgccttcgccaaaggcgaccacgggtccacgttcggcggcaaccccgtggcagccgcggcagccctcgccgtcctcaccaccatcgaacaggaccggctcctggaatcggtcaccgaactgggggagctgctcgccgccgaaatcaccggcatcggccaccccctggtggcggcagtgcgcggcgtcggcctgtggcgcggaatccagctcaccgcaccggcagccgcccacgtccaaacccgcgcggccgaagccgggttcctcgtcaacgctgtcacacccgaggtggtccgcctggccccgccgctcatcatcaccagggccgaaatcctcgagttcacccgggcactcccggacatcctgaacgccgcc

SEQ ID NO: 31790 - DNA, 1185 bp, Thermobifida fusca
atgaccgagcgggtcgtactcgcatactcaggaggactcgacacctccgtggctatcggctggatcgccgaagagaccggggctgaagtcatcgcggtcgccatcgactgcggccaaggcggagaggacatggaagtcatccgccagcgggccctggcttgcggcgcggtggaggcggtcatcgccgacgccaaggaggagttcgccaacgactactgtgtgccggccatccaagccaacgcgctctacatggaccgctacccgctggtctccgcgctgtcgcggccgctgatcgtcaagcacctggccgaggctgcgcgctaccacggggccaccatggtcgcgcacggctgcaccggtaaaggcaacgaccaggtgcgtttcgaagcgggcctggcagcgctcttccccgagctgaaggtcctcgccccggtccgggactcgggcatgacccgcgacaaggcgatcgcgttcgctgaagagaagggtctgccgatcgacgtcaccaagaagtcgccgtactccatcgaccagaacctgttcggccgcgccgtggagaccggcttcctggaggacatctggaacggccccatcgaggacatctacgactacacccagaacccggccgagccgcgggagcccgacgaggtcgtcatcaccttcaccgccggggtgcccaccgccctcgacggcaaggagctcagcccgctggagatcatccaggagctgaaccggcgcgccggcgcccagggcgtgggccgtatcgacatggtcgaagaccgcctggtgggcatcaagagccgcgaagtctacgaggcgcccggcgcgatcaccctcatcaccgcgcaccaggagctggagaacgtcaccgtcgaacgcgagctggcccgcttcaagcgctgggtggaccagcggtggggcgagctggtctacgacggcctgtggttctccccgctgaagaacgcgctggacaagttcatcctcgaagccaacaagcacgtcaccggcgacatccggatggtgctgcacggcggccgggccgtggtcaccggtcggcgcagcgaggcctccctctacgactaccacctggccacctacgacagcggcgacacctacgaccagagcctggcccgcggattcatcgacatctggagcatgcccgccaagatcgccaacatgcgcgac

SEQ ID NO: 31791 - DNA, 1374 bp, Thermobifida fusca
ctgtggggcggccgtttcagcggcggcccgtccgaagcactggcccgcctctcccaaagcacccacttcgactggcggctcgcccgctacgacattgcgggatcccgcgcccacgcccgtgtcctgcacgcagcgggcctgctcgacgacgcggaactcgcgcagatgctgcgcgggctggaccagttggaggctgacgtcgcctccggcgctttcacacccagccctgacgacgaggacgtgcacaccgcgctcgaacggggcttcatcgaacgggtcggcccggaactgggcggacggctgcgcgccgggcggtcccgcaacgaccagatcgccacgctggtgcgcatgtacctgcgcgaagaggcccgcgcgatcaccgcgctcctcctcgacctggtcgcagcactggcagaccaggctgaagccaacctcgacgtgccgatgccgggccgcacccacctgcagcacgcccagccggtgctgctggcccaccacctgatggcgcacgcctggccgctgatccgcgatatcgaacggctgcgcgactgggaccggagagccgacatgtcggcgtacggctccggggcgctcgccggatcctccctgggactggaccctgaagcggtcgccgcggaactgggtttctcccggtcggtgcccaactccatcgacggcactgcagcccgcgacgtggtggccgagttcgctttcgtggcggcgatgatcggggtggacctgtcccggatctccgaggagatcatcctctgggccaccaaggagttttcgttcatcaccctggacgacgcgttctccaccgggtcgtcgatcatgccgcagaagaagaacccggacatcgccgaactcgcccggggcaaggcagggcggcttatcggcgacctggcgggcctgctcagcaccctcaaagggctgccgctcgcctacaaccgcgacctgcaggaggacaaggagccggtcttcgacgccgtcgacaccctcaaagtcctgcttcccgcgttcaccggcatggtcgccaccctcaccgtcaaccgggagcggatggcggaactagccccgcaggggttctcgctcgccaccgacatcgccgaatggctggtgcggcagcgggtgccgttccgcgaggcgcacgagatcgccggggcatgcgtgcgggtctgcgaggaacgcggcatcgacctgcccgacctcagcgacgcggacctggccgccatctccccgcacttgaccccgcaggtgcgcgaggtcctcaccgtccaagggtcgctggagtcgcgggccgcccgaggcgggactgccccggcgcgggtccgggaacagctcgccgaactgcggaaggcgatcgacgaccaccgc

SEQ ID NO: 31792 - DNA, 1392 bp, Thermobifida fusca
tggctcggcgtggacttgggcaccagcggggtcaaggtcgtggtggtggactcagagtccgccgtggtgggggagggcgaagcctcctacccggtgcgttcaccccgtccggggtgggcggagagcgatccgggtgactggtgggaggcaacggtggccgcggtgcggcaggcgctcgctgctgccgggcagcctcggatcagggcggtcggggtggacgggcagatgcacggcctggttctcgcccgcgaggacgcgatgccgctgcgttccgctctcttgtgggcggaccggcgtgccgcggctgagctcgccgcgtggcgtgggcttgccgacaccgagcgggaggcgctcgctaacccgctggtgccggggatgaccggtcccctgctggcgtggatagcacgccatgaaccacggctgttggctgaggcacggtgggcgttgctgcccaaggactggctgcggctgcggttgacggggaaagctgcgaccgatccgtctgacgcgtcagcgaccctgctgtgggatgtgcccgcggacacgtggtcgctgccggcacttcgtgccgcgcagctccccgcggacctgctgccgccgctggcggcttccgacgacgtcgcaggggtcctgaccggggacgctgccgcagaactggggatggatccggggactcccgtggctgtcggtgcgggcgacaccccggcagcgctcttagctaccgcggcgggcgaggagcaggcgcagctcaccgtgggcagcggcgcgcagattgttgcggccactactgatcccagcccggtgccgggcgttcacgtctaccgcaccgcggaacgtgccggctggtatcggatggctgccgtgcagaatgtcggggttgttgtggagtgggtgcgcaccctgctgggcgcaacgtgggaggaggtgtatgccgcggcaggggaggagccggatcgtgggggagtggtgttcctgccgcatttgacgggggaacgcacccccgtgctggggatgaccggagtgctggcagggctgcggttggacactgaccgcacagcggttctgcgcgccgcagtggaaggagtggctttcacgatccggcatgccgccatgatgcttcccggtggcttgccgccggtggtgcgtcttgccgggggagggagccgagacccgcgtttccgtgcactgctcgccaacgtgttaggggtggagttacgtccggtgcggctgcggagcgcgtcggcggtgggggcggcgcatcttgccgcccgggcggtgggggcgggggtcgctcgcccagagcttcactacgagccggtggtatcccccacccaccataaggaaatctacgatgtaaagttcgaggtttatcttcatcatctccgcaggaac

SEQ ID NO: 31793 - DNA, 1017 bp, Thermobifida fusca
gtcgatgccgaactggcggccttcgtcgcgagccgacgcccgctgctgctggagatcggcgcggagtgggaaccggtgctggccgccctcgaagccatgatcagcggcggcaagcggctgcggccggcgttctgctactggggatggcgcggcgcgggcgggggagaggagcccggcctctacacggccgcggcagccttggagctgctccaggcgtgcgcgctgatccacgacgatgtgatcgacaacagcgacacccggcgcgggcagcccgccgtgcaccgcaggctcgccgccctgcaccgggagtcgggatggcacggcgaccccgacgagttcggccggggcgcggcgatcctgctgggggacctgtgcctggcgtggtgtgaagacatgtaccagtcgagcgcgctccccgcggaagcgctcgctgcggggcggggccccttcgacctgatgcgcaccgaggtggtggccggccagtacctggacttggtggagcaggcgcgcggcgcggacaccgtggaggcagcgctgcgggtgatgcggttcaagtcggccaagtacaccattgagcagcccctccacctgggtgcagcgctggcgggacggtacgccgagctggcccccgcctacaccgcctacggcatcccgttggggatcgccttccaactgcgcgacgacgtcctcggggtgttcggggacccggaggagacggggaagcctgcaggggacgacctgagggaggggaagcgcacggtgctggtggcagagacgctgcgccgggcggcagcggacgacgccgagcagttccggcgcctgctgggcgaccccgagctgggggccgaggagatcgcctggatgcgttcggtcatcgtggacagcggtgcgctggaagcctgcgaagcccggatcgccgactatgtggccgatgcgacgcaggccctggagaacgacgtgatcgccgacgacgcgcgttccgcgttggcggacctcatcgtcgctgccaccgcacgt

SEQ ID NO: 31794 - DNA, 1002 bp, Thermobifida fusca
atggtcatcgttatggcgcccgacgccccttccgacaccatcgactccatcgttgacctcgtcgcctcggtgggtggtgaggcctacgtgacccggggggtgagccggaccatcatcggcctggtaggcgacgtggaacggttcgagacgcttaatctgcgtgccctccccggcgtcgccgacatcctgcgcatctccactccctacaagctggtcagccgggaaaacacgactgagcggtcggtcgtgcaggttgctggggtaccgatcggcggcgaccatatgacactcatcgccggtccctgcgcggtggaaaccccggagcagactttggaagcggcgctgatggcgaagcgtgcgggtgccgcgctgctgcgcggcggcgcctacaagccgcggacctccccctacgcgttccagggcctgggcgagaccggtctgaagatcctgtcggatgtgcgtgcggagaccggcctgccgattgtgaccgaagtggtggacgcctccgacgtggagctggtcgcctcctacgccgacatgctgcagatcggcacccgcaacatgcagaacttcgcgctgctgcaagccgtgggcgacgcgggcaagccggtgctgctcaaacgcgggatgagcagcacgatcgaggagtggctgatggccgccgagtacattgcgcagcgcggcaacttgaacatcgtgctgtgcgagcgcggcatccgcacgttcgagaaagcgacccgtaacacgctggacgtgagcgcggtcgccgtggcgcagcggctgtcgcacctgcccgtggtggtggacccgtcgcattcgggcggcaagcgggaactggtgctgccgctgtcgcgtgcggcgatcgcggtgggcgcggacggcctcatcgtcgacgtgcaccctgctccggagacggcactgtgcgacgggccgcaggcgctcacgcacgcagacttggccgagctggcgcacgtggtgacggcgctgccgccgctcgtgggc

SEQ ID NO: 31795 - DNA, 1050 bp, Thermobifida fusca
tccagacgattcaaggagtacacgcaaatgcgagtcggggtactgaccgggggtggcgactgcccgggcctgaacgcggtcatccgtgcggtggtccgtaagggcatcaaggaatacggatacgagttcgtcggattccgtgacgggtggcgcggccccctggaaggcgacaccatgccgctggacatcgaggcggtccgcggcatcctcccgcgcggcggtaccatcctcggctcctcgcgcaccaacctcatgaagatcgagggcggtgtcgagcgggtcaaggacaacatggccgcgctcggggtggacgcgctcgtcgcaatcggcggtgaggacaccctcggcgtcgcgcgccagctccacgaccacggtgtcaacgtggtcggtgtgcccaagaccatcgacaacgacctcaacgccaccgactacaccttcggcttcgacactgcggtcaacatcgcgaccgaggccatcgaccgcctgcacaccaccgccgagtcgcaccaccgtgccctggtcgtcgaggtcatgggccgccacgcgggctggattgcgctgcacgcgggcatggcggccggcgccaacgtcatcctgatccccgagcgcccattcgacatcgacgaggtcgtcgcctacatcgaaagccgcttcaagaccaactacgcgccgatcatcgtggtcgccgagggcgcccacccgaaggagggccagctcaccctggccagcgcggaacgcgactccttcggccacgtccgcctcggcggcatcggccagcgcctcgccgaagagatcgaggcgcgcaccggcaaggaagcccgctcggtggtcctgggccacgtgcagcgcggcggtacgccgtccgccttcgaccgggtgctggccacccggctgggcctgcacgccatcaccgcggtccacgacaaggacttcggcaagatggtcgccctgcgcggcaccgaaatcgtccgcgttgacctgtccgaagccaccgaccagctcaagactgtcccggtcgagcggtacgaggaagccgaagtcttcttcggc

SEQ ID NO: 31796 - DNA, 1794 bp, Thermobifida fusca
gtgcgtgagtacaccacccccgcggtaaaggaacttgacccggatacacgactcactgacaccgtcttcacccgtgcggctcaggaacccaacgccgtgatgttccggcggctcgtggacggtgcgtggcgagacgtgacctgcgctgaattccaccgcgacgtcatgggcgtggccaaggcgctcatcgccgccgggatcaaccacggcgaccgggtagcgctcatgtcgcggacccgctacgagtggaccgtcatcgactacgccatctggaccatcggcggagtgaccgtccccatcttcgacacctcctccgaagagcaggtcgagtggatcctccgcgactcgggaagcacgctcgccttcgtggagaacgacgagcacgcggaacgagtccgggctgtctccgcacaactcctggaacccgaccgcatcgtgcagatcgaaagcgacagcttccccgctttcgtcgccaccggcgcggacgtggctgactcggtggtggaggagcgccgcgccgccaccggcctcgacgacctcgccaccctgatctacacctcgggcaccaccggccgtcccaaaggctgcgagctcacccagcgcaacctggccttcgacgtcatgagcgtcaacagcggccccatgaaggacgtcttcaccatggaggggcgctccaccctcctgttcctcccgctggcgcactcgctggcccgcatcatccaggtcggctgcgtggagacgaagaccgtcatgggccacttcccctccaccggcccggacctgctggacgcgctcgcttcgttccgccccatgttcctgcttgccgtgccccgcgtgttcgagaaggtctacaacaaggctgagcagaaggccatcgccagtggcaagggcgacatcttccggaaggccgcggagaccgccatcgcctacagcaaggcgctggacaccgggaaggtgagcctggggctgcgtctcaagcgcgccgtgttcagcctgctcgtctaccgcaagatcctggctgcggtgggcgggcaggccaagtacgccgtctccggtggttccgccctgggtgagcggctcggccacttcttccgcgggatcggcctgaccgtcctggaaggctacggtctgaccgagacgtccgcccccaccaccgcgaatgcccccgacaccaacaagatcggcacggtgggccgccccatccccggcacgtcgatccggatcgccgacgacggggagatcctcgtcaagggcgacaacgtgatgcgcggctactggaacaacccgaaggcgacgaaggaggcgttcaccgaggacggctggtaccgcagcggcgacatcggcgaactcgacgaggaaggcttcctgcggatcaccgggcggaagaaggagatcatcgtcaccgcaggcgggaagaacgtcgcccccgcggtcatcgaggaccggatccgcagccacgcgatcgtcagccagtgcatggtcgtcggcgacaaccgcaagttcgtcgccgcgctcatcaccatcgacccggaagccttcgagttctggaagaagcagcacaacaagaccggcaccatcgccgagctggtggacgaccccgacctgcgggccaccgtgcagaaggcggtggacgacggcaacaaggcggtctcccgggccgagtcggtacggaagttcgccatcctgccggtggacttcagcgaggctgaaggccacatgaccgcgtcgctgaaactcaagcggcacgtcatcgaaaagcagttcagcgcggagatcgaggcgctctacgccgag

SEQ ID NO: 31797 - DNA, 1248 bp, Thermobifida fusca
tggcctgccccgaccgtgtcccgtcctgtggacgccacggtcagcctgcccggctccaaatcgatgaccaaccgcgcgctgatcctggccgcgctgtcggagactcccagcgtggtgcgcgcccccctgtacagccgcgacaccacgttgatggtgggcgcgctgcgggcgctcggtatcggcgtgcacgaagcagacggggactgggaggtgactccgacaccgccgcagggccccgcagccatcgacgtgggcaacgccgggacagtgatgcggttcgtgccgccgctggccgccatggcccgtggcgaggtgtccttcgacggcgacccgcgcgcccgggagcggcccgtcggtcccctcctcgccgcgctgcgcaccctgggcgcggagatcgacgacgggggtcgcggcgcccttcccatggtgatccgcggccgaggtgaactccccggcggtacggtcaccctggacgcttccggctcgtcccagttcgtctccgccctcctgctcagcggagcccggttcagcaagggcgtggaggtgcggcacgtggggcccccggttccttcccagccccacctgaacatgaccgtgcagatgctgcgcgacgccggggtggaagtggacacggacacccccgacgtgtggcgggtcgcgccgggaccgatccgggtcaccgagatcacggtcgaacccgacctgtccaacgctgcccctttcctggctgccgccctggtcaccggtgggcgggtcacggtccgcggctggccgcggcacaccacccagccgggggacgcattgcgcaccctgttcgccgagatgggcggccgtgtcgagttcaccgacgaagggctgaccctgcacggcaccggggaaatccgtggactcaccgctgacctgcgcgacgtcggagagctcaccccgaccatcgcggccgtggccgcactcgcgtccaccccgtcccgtctcaccggtatcgcgcacctccgcaggcacgaaaccgaccggatcgcagcgttggtccgcgagatcaaccgcctaggcggggacgcagaagagcttcccgacgggctggtcatccgcccgcgccccctgcacggcggtgtcttccactcctacgacgaccaccggatggccacttccggggcggtcatcggactcgtggtgcctggagtggaggtggaaaacatcgctacgacaggcaagacccttccggactttccccgtctgtggagcgaggttctc

SEQ ID NO: 31798 - DNA, 987 bp, Thermobifida fusca
atggccaaggctccagtcaacgtcaccgtcaccggcgctgccggacagatcggctacgcactgctgttccggatcgcctcgggccagctcctcggcgtagacacgcccgttcggctccgcctgctggagatcccgcaggcgatcaaggcggccgagggtaccgcgatggagcttgacgactgcgcgttcccgctgctcgccggggtcgacatctacgacgacccccgcaaggcgttcgacggcgtgaacgtggccctgctggtcggcgcccggccgcgcacgaaggggatggagcgccgcgacctgctggaagccaacggcggcatcttcggtccccagggtgcggccatcaacgacggtgccgctgacgacgtgcgcgtcctcgtcgtgggcaaccccgcgaacacgaacgcgctgattgcgcaggcgcacgccccggacatcccggcggaccggttcaccgcgatgacccggctcgaccacaaccgggcgctgtcccagctcgccgccaagctgaacgtgtcggtgagcgacatcaagaagctgacgatctggggtaaccactccgcgacccagtacccggacatcttccacgccgaggtcaacggccgcagcgcggtggaggccgtcaacgacgaggagtggctgcgcgacacgttcatcccgaccgtggccaagcgtggtgcggcgatcatcgaggcccgcggcgcttcctcggctgcgtccgcggcgaacgctgcgatcgaccacgtctacgactgggtgaacggtaccccggagggcgactggacgtcggtggcgctgccgtccgacggctcctacggcgtgccggagggcctggtgtcgtcgttccccgtggtgtcccggaacggctcctgggagatcgtccagggcttggagatcaacgagttctcccgcgagcggatcgacgcgtcggtgcgcgagctggaggaggagcgggaagccgtccgcgctctgggtctgatc

SEQ ID NO: 31799 - DNA, 1812 bp, Thermobifida fusca
atcgtgactactgcggtccacggaaataacgtggctccgactagccatcaggaactagtcgactgggtacgcgagatcgcggaactgacacaaccggacgaagtggtctggtgtgacggttcggacgccgagtgggagcgactcacctcccagctcgtcgaacagggaaccctgatccggctcaacgaagagctccgcccgaacagcttctactgccgctccgaccccagcgacgtcgcccgagtcgaggaccgcaccttcatctgctcagagcgccaagaggacgccgggcccaccaacaactgggtggaccccgccgaaatgcgcgccaccctcaaggagatcttcaccggatgcatgcgcggccgcaccatgtacgtggtgcccttctgcatgggaccgctcggcggcaagatctcccagctcggcgtggagatcaccgattccccctatgtcgtggtgtcgatgcgcatcatgacccggatgggcgcgcccgcactgcgcctcatcgaggagcgcggcaccttcgtcaaagcggtccactccgtgggcgcccccctggagcccggccagaaggacgtgccgtggccgtgcaactccaccaagtacatcacgcacttccctgagacccgggagatctggtcctacggctccggctacggcggcaacgcgctgctcggcaagaagtgctacgcgctgcgcatcgcctcggtgatggcacgcgacgaaggctggctggccgagcacatgctcatcatcaaagtcaccccgccgtcgggcgaaccccgctacattgccgcggcgttccccagcgcctgcgggaagaccaacctcgccatgctccaaccgaccatccccgggtggaaggtggagacgatcggcgacgacatcgcgtggatgcggttcggggaagacggccgcctctacgccatcaacccggagtacggcttcttcggggtcgcccccggcaccggcgagtccaccaacgccaacgcggtcaaggcgctgtggggcaacagcatcttcaccaacgtggcgttgaccgacgacggggacgtgtggtgggagggcctcaccgacgagcctcccgcacacctgaccgactggcggggccgcgactggacccccgactccggcgagcccgccgcgcaccccaacgcccggttcaccacccccgcttcgcaggcgcccacgatcgcccccgaatgggaagaccccaacggggtgccgatctcagtgatcctgttcggcggccgccgcgccaccgcggtgccgctcgtcgtcgaggcgttcaactggcagcacggcgtctacctgggcgcgaacgtggcctccgagcgcactgccgccgctgaaggcaaggtcggtgaactgcgccgcgacccgttcgcgatgctgccgttctgcggctacaacatgggcgactacttcggccactggctgaagatcggccgccagaccgacccggacaaactgccccggatctactacgtgaactggttccggaagaacgacgagggcaagttcatctggccgggcttcggcgagaacagccgcgtgatcaagtggatcatcgaacggctcgaaggcaaggcagcagcccaggacaccccgatcggccgggtgcccacgcctgaggcgctcgacaccgagggcctggacatctcccaggaggacttggagctgctgctgtcggtggaccgcgaggtctggcgtcaggaagccgacctggtccccgacttcttcaactccttcggggaccgcctgcccaaggagctgtgggacgagtatgaggcgctgcgtcagcggctc

SEQ ID NO: 31800 - DNA, 723 bp, Thermobifida fusca
cggaccgctctcgtaaccggcgctgccagcggcatcggccgcgcctgcgcgacccgcctagccgccgccggggccaccgtccgcctcgtcgacctcaaccgggaagccctcgacgaactcgcccagcgcggaataggcgaaccccaccacgtagacctcaccgacctggacgcggtcgacactgtggcacgcggcgtcgacatcgtcgtcaacaacgctggagtgcagacagtctgccccgtccacgaattccccccggaacgcttctccatgatggtgaaactcatgctggaagccccgttccggatcgtgcgggccgcgctgccgcacatgtacgcgcgcaactgggggcggatcatcaacatctcctccgtgcacgggctgcgggcctccgcctacaagtccgcctacgtggccgccaaacacggtttggaaggcttctccaaagtcgtcgccctcgaaggcgccccgcacggagtcacctccaactgcatcaaccccggctacgtgcgcacccccctcgtggaacagcagatcgccgaccaggcgcgcgcccacgggatccccgccagcgacgtagtggaaaccgtgctgctggcccgcagccccatcaaacggctcatcgaacccgccgaagtcgctgaaatggtggcctacctgtgctgtcccgaggcgtctttcatcaacggcgcctccctgaccattgatggagcatggagcgcg

SEQ ID NO: 31801 - DNA, 1383 bp, Thermobifida fusca
ccgctcgtcgccggagttgactcctcaacccaatccaccaagatcgtcgtacgcgacgcagaaaccggagccctcatccgtcaaggccgtgccccccaccctgacggaaccgaagtcaacccccacgtgtggtggcatgccctcctcaaagccgccgaagggggcctcctcgacgacgtcgccgccatctccatcgccgcccagcaacacggcatggtcgccctcgacgccgacggcacccccgtccgcgacgcactcctgtggaacgacacccgttccgcagacgccgccaccgacctcatcaacgaactcggtggccccgccgcatggagccaagccgtcggctcagtccccgtcgccagcttcaccgtcaccaaactccgctggctcgcccaacacgaacccgacaacgccgcccgagccgaaagcatcctcctgccccacgactggctcacccaacgccttacccaagccaccgaacccgtcaccgaccgcggcgacgcctccggcaccggctactacgaccccgccaccaacacctaccggaccgacctgctcaccctcgccttcggccgcgaactccgcaccccgcgagtcgccgcccccgccgaagtcgtcggcagcgtcaccacccccgaactccccgccatcgacgtcgtcggccccggcaccggcgacaacatggccgccgcactcgccctcaacgcccgacccggcgacgtcgtcgtctccatcggcacctccggaaccgccttcgccgtcgccgaaaaacccaccgccgaccccaccggcaccatcgccggattcgccgacgccaccggacgcttcctccccctcgtctgcaccctcaacgcagcccgcgtcctcaccgccggagccgctgcgctcggcgtcaccctcgaagaattcaaccaactcgccctcaccgcaccccccggcgccggcggcctcgtcctcttgccctacctcgacggcgaacgcacccccgacctgcccaacgccaccggccgcctcgacggcctcacccgagccaacctcacccccgccaacctggcccgcgccttcgtcgaaggcatgctctgcggcctcgctgacgccgtcgacgccctcgtccaccaaggtgtccccgtcaaccgtgtcctcctcatcggcggcggcgcccgctccgccgcagtccgcgccatcgccccccaaatcctcggccgccccgtcaccatcccagccgaaggcgaatacgtcgccgacggcgccgcccgccaagcagcctgggcactctccggcaaacccaccccacccgaatgggaagacgccggaaccgtcgtcagcgaagccgaccccaccccgcaggtacgcgaacgctacgccgaagcccgaaaccgactc

SEQ ID NO: 31802 - DNA, 1386 bp, Thermobifida fusca
cgtcgagcaaagattgtcgcgacccttggaccggctacctcgagccctgaagtcctccgcaagctcgtcgacgccggcctggacgtagcgcgactcaacctcagccacggtacccacgacgaccaccaaaccatgtatcgcaacgtccgcgccgcagcggaggccagcggacgtaatgtcggtattctcgccgacctgcaagggccgaagatccgtctcgggacgttcgtcgacggatccgtgaccctcagccccggtgacgagttcaccatcaccatcgacgatgtacccggggaccgccaccgggtctccaccacatataaaggactccctggtgatgtccgtcctggcgaccgcgtcctcatcgacgacggtcgcgttgttttggaatgcgtcaaaagcaccagcacggatgtccacacccgcgtcatcgtcggcggcccggtatccaaccacaaagggctcaacctgcccggggtgtcggttgcggtccccgcgctgaccgaaaaagacgaacgggacctgcgctgggccctggagcagggcgtcgacatggtggcgctctcttttgtgcgcagccccgccgacgcggaagacgtccaccgggtcatggacgagatgggcgtgcacgtccccctcatcgccaagatcgaaaaacctcaggcggtggagcggcttcaggacatcatcgaggctttcgacggcgtcatggtcgcccgcggcgacctcggtgtcgaactccccctcgaaaatgtgcccatggtgcagaaacgcgccattgaacggtgccgggacaaagccaaaccggtcatcgtcgccacgcagatgctcgaatccatgatccacaacccgcgccccacgcgggctgaggcttctgacgtggctaacgccgtcctcgacggcgcggacgcagtcatgctctccggcgagaccagcgtcggaaagtaccccgtggagaccgtgcagaccatggcgcggatcatcgccgccgccgaacaggagtccctgcgcgcctcccacatcctccaccgggtcccggagaccgtgggcgggtcgatcgcccgagccgctgccgaagtcggagccaccgtgggcgccaaggcccttgtcgccttcaccagcagcggggagactgcacgccggctcgcccgctaccgttcccccattccgctgctggcgttcaccaccgagcctgccacccgcgcccagctctccctcacctggggtgtggaaacccacctcgtgccgtgggtggacaacaccgacgacatggtccgccaggtcgagaacgaactcctggacatggactaccagaagggcgacaaagtcgtcatcgtcgcgggaagcccgcctggcacccgagggtcgaccaacatgttgcgcgtg

SEQ ID NO: 31803 - DNA, 3560 bp, Thermobifida fusca
gtcctcggcgccgtcgccgaacaggtcatcctgcccgccatcatggagcagcgcaccaccgtggccgcggtcgccaccgcgtccgcggtcgtgttcgcggtcggcttcctcaaagccctcggactgggggcgcgccgcttctacgccgggctcatgcagtaccgcatgcaggcgcgctaccggcgcgcggtcgcccgccggtacctggaactcccgctggcctggcaccagcggcaccccgcagggcagctcctgtccaacgccaacgccgacgttgaagcgacctggcagccgcttgccccgctccccatggccgtgggcagcaccgccatgctggtgatcgccgcgggggcgatgctcgccaccgacctcgtgctcgccctggtgggcttcgtcgtcttcccgctcctcgccatcgccaacctcgtcttccagcgccgcgtgtcccccgcagccacccacgcgcaagccctgcgctcccaggtgagcgaggtcgcccacgagtccttcgacggcgcactcgtcgtcaagaccctgggacgcgaagacatggagacggaacggttcacccgggccgcggaacgcctccgcgacgcccagatccgcgtgggccggatgcgggccgcattcgacccgctgctggaggcactgcccaacctgggcgtgctcgtggtgctgctcatcgggttgatccgcttgcagcggggcgacgtcaccgcaggcgacatcgtccagatcgcctacctgttcaccctgctgtcgctcccgatccgctccctgggctggctgctcggggacctgccccgcagcgtggtgggctggcggcgggtcagcgcagtgctcaacgcgcaaggaggcaccgactacggcaaggaacggctgcacggcgagggcggcctggcggtaagcgtccgcaacctcagcttctcctacgccgacacctcccccgccgacctcggccgggacaccctggaaggcggacgcggcctggacgcgaccggaaacgaagaaacaccacgcatcaccgtgctgcgcgacgtcaccctggacctggcgccggggaaggtgaccgccctggtcggccccaccgggtccgggaagtccaccctcaccatgttgctggcccgcctcgtcgaccccgaccacggcgacgtcctggtgaacggggtggacgcccgccgctacgcccccggggaactcgcctgcgctatcgcgctcgtgccgcagacgacgttcatcttcgacgacactgtccgcgacaacatcaccctgggcttggacgtcgacgacaccgaagtctggcaggccctgcgcctcgcccacgccgactctttcgtggcggccctgccccgagggctcgacacgcggctgggggagcgcggcaccagcctgtccggcgggcagcggcagcgcctcgccctggcccgctccctggtgcgccgaccccgactgctcatcctggacgacgcgacctccgcggtcgacccccaggtcgaagcccggattctcggcgggctacgggaagccgacctggcgggagccaccgtcgtggtcgtggcctaccgccgggccactatcgaactcgccgacgaagtcgtctacctcgaacaaggcacagtccgcgaccggggcacccacgaagagctgctggcccgctcccccggataccgccgtctcgtcaccgcctacgagcaggctgcccaacggcgcgctgccgccgcgtcccgatccgccgaccaggaggctgtccgatgagcgccccgacccgtacccggacttcccccgcccaggcccccgcggaggcttccacgcctgcgcccaccgcgcccgccctgcaccggtctaccgagtcagcgtgggccactctgcgccgcggggtcgccctgtcccccgaattcactcgcggcctgccggtgaccgtggccctcgccgtggtggcgaccctcggcaaagtgatcgtgccgctcgccgtccagcagatcatcgacaacgggctgctcgccgaaggcggacccgacatcggcttcgtggtggccacggtcgcgctctgcacagccctggtcgtcgtcaccgcgctgtgctcctacctgatgaacgcgcgcctctaccagtccaccgaatccgggctggccacgctgcgccgcacagcgttccgccacgtgcacgacctgtcggtgctcacccagaacagtgaacgcaaaggcgccctggtctcccgcgtcaccagcgacgtcgaccagatcagcaccttcatgcagtggggcggcatcctgctcatcgtcagcaccggccagttggcgatcgccaccgtgctcatggccgtgtactcctggcagttgaccctgctggtgtgggtgtgcttcctgcccctgcttttcggggtgcgctggctgcagcggctgctctccaaggcctacctgaaagtccgggaacgcacgggggagatgctcggcgtcatcggggagaccgtggtgggcgccgcggtgatccgcgcctacggcactgaggagcgcacggcgcggcgcatcgaccggaccgtactggccacccgcaacgcccaagtcaaagcccagcgcctctccatggcggtctccccgctggccgagctcgtctccgcgttcacctacgcggtcgtcatcgcggtcggtatctggctgggggtcatcggctcgctcaccgcgggacagctcgtggccttcctgttcctcatcaacctgttcgtcgcccccatgacgatggccaccgagatcttcaacgaagcccagaacgcgatcgcgggctggcgacgggtcctgggggtcctcgacaccgaacccgacatcgcggatccgggagcctccggcacccccctgccgcacggcccgatctccatccgcttcgaccacgtcaactacgcctaccccggcggcccccgcgtgctcgacgacatcaccgtggagatcgccccgggcagccgtgtcgccgtggtcggggagaccggttccggcaagaccaccttcgtcaaactccttacccggctcatggacccggacgaaggcaagatcctgctcaacggggtgaacctgcgcgaagtggcgttctcctcgctgcgctcccgcgtggtgctggtcccccaggaagggttcctgttcgacagcactctggccgacaacatccgcttcgctcggcctgaggccaccgacgagcagatcaccgaggcgatcacccagttggggctcagcgaatggctggcgggcctaccgcacggcctggccacgcccgtggggcagcgcggcgagtccctgtccgcgggggagcggcagctcgttgccttgatccgggcctacattgccgaccccgatctgctcatcctggacgaggccacctcggcggtcgacccggccacggaggtccgcatccagcacgccctggacctcctcacccggggccgcacttcggtggcgatcgcgcaccggctgtccaccgcggaggccgccgacgaagtgctggtcttcgaccgcggccggatcgtccagcgcggcacccacgccgaactggtcgcccgtcccggcgtgtacgcg

SEQ ID NO: 31804 - DNA, 1962 bp, Thermobifida fusca
cgtatcgccatcgtcaaccgtggtgaagccgctatgcggcttatccatgccgtacgggacatcgccgcagagaccgggacgcggatcgaaacggtcgccctgtacaccgatgttgaccgcaccgccgccttcgtccgtgaagccgacatcgcctacgacctcggtcccgcgtccgcacgtccctacctcaacttggaagtgctgcagcgtgcgctcgtcgacaccggcgctgatgccgcctgggtcggctgggggtttgtcgcggaagaccccgctttcgcggaactgtgcgaacagctcggagtcacctttatcggccccagcccgcacgcgatgcggcagctcggcgacaagatcggcgcgaaactcctcgccgaacaagtcggagtgcccgtggccccgtggagccgcggccccgtcaccaccctcgatgaggccatcgctgcggcccgcaccatcggctatccgctgatgctgaaagccgccgccggcgggggcgggcgcggcatccgcatcatcaccaccgaagccgagcttgtcgacacctatgagcgggcccgccaggaagcagcccgcgccttcggcagcgacaccgtgttcttggaaagcctggtcaccggcgcccgccacgtggaagtgcaggtgatcgccgacggccaaggcaccgcctgggcactgggggtgcgcgactgctctgtgcagcgccgcaaccagaaaatcatcgaagaatccgcgtcccccgtgctcagccctgtgcaggccgccgacctgaaagccgccgcggaacgcctcgctcttgctgtcggctaccggggtgccgccaccgtcgaattcctctaccggcccgacgacaaactcttcgcgttcctggaagtcaacacccgcctgcaggtcgaacaccccatcaccgaagccaccaccggattcgacctggtcaaagcccaactgtgggtggccagcggcggcaaactcgaaggggaaccccccatcgagcaggggcatgccatcgaagcacggctgaacgcggaagaccccgaccgggacttcgcgccctcccccggccggatcgtgcacctggaactccccaccgggccaggcatccgtgtggacaccgggttcacggaaggggacgtcatcccctccgacttcgactcgatgatcgcgaagatcatcgcgcacggccgtgaccgcgaggaagcgttgagccgcctgcgccgcgccctcgcccacaccaccgtcctcatcgaaggcggcaccaccaacaaaagcttcgtcctcgacctgctcaaccagccggaggtagtcaacgccaccgcagacaccggctggatcgaccgggtccgcagcgaaggccgcctggtcagccacacgcattccgcgatcgccctgatcgccgccgcgatcgaagcctacgaagaagaggaacgcgtcgaacagcagcggctgttgaccaccgcgttcggcggccgcccccaagtccagcacgacagcggccaaccactcgacctcaaactccgcggcaccacctaccggctgcgagtggcccgcgtcggcgcccaccggttccgcgccgccattgacaccggtggcgtggtgcgcaccgctgatgtggaactggaccggttcggcccgcacagtggacgtatcaccgtcaacggcacccgctaccggctcctgaccggcacccacgggcccacgttcctcgtcgaagtcaacggggtcacccaccgggtcagccgggacgaaggcggcgtgctgcgctcccccacacccgccctggtggtcgccaccccggtcgccgtggacgcggaggtggaggccggcgaccccgtgctggtcgtggaaagcatgaaaatggaaacggtgctgcgcgcaccgttcaaagcccgcgtcaaaaaatgcctggtcaccgtgggcacccaggtggagtccggcgcacccttgatgcggctggaaccgctc

SEQ ID NO: 31805 - DNA, 786 bp, Thermobifida fusca
ctggtcattgcgacggtcaacgtcaacgggctgcgcgcggcagcgcggaaagggttcgtggagtggctggcgggcaccaaagcggacgtggtgtgtctgcaggagacccgcgcggaactcgatcagcttccccccgaggtggctgagccggacggctggcatgtggtgctggtgcctgccgcaaccaagggtcgtgccggagtggccgtgtattcgcggatgaaaccggatgcggtgcggatcggattcggttctgcggagttcgcggattcggggcgttacgtggaggcggacttcgggccggtgagcgtggccagcctgtatctgccttccggacaggtgggcacgccgttgcaggaggagaaagagcggttcatggcggaattcctgccctatctggtgcgtcggcgcaccgaagtggaggcccaggggcgggagcttgcggtgtgcggcgactggaatatcgcgcaccaggaggctgacttgaagaactggcggggcaaccgcaagaactcgggtttccttccggaagagcggcagtggctttcccgggtgtatgaggaggcgggatacgtcgacgtggtgcgggcgttgcaccctgatcaggacggcccgtacacgtggtggtcgtatcgggggcgggcgttcgacaatgacgcggggtggcgcatcgacttgcaggtcgctacgccgggtttggctgcgcgcgcccaggaggcgtgggtggagcgggcgccgtcccatgaccagcggtggtcggatcacgcccctgtcacggtggtgtat

SEQ ID NO: 31806 - DNA, 1374 bp, Thermobifida fusca
accttcggtgacctctcccgccgtgccgcacacctgtccgctgtcctggcctcccacggagtcacccccggcgaccgggtcgccaccctgctgcccctcggcatcgacctgaccatcagcgccgtcgcagtgtggcggctaggcgccgtcctcgtccccctccccccggtgctggccgcctccgccatcgactggagactgcgccaagtcaacgccacagccgtcctcgcccccgccgaccagaccagcaaactcaccaccggctcctggaccgtgatcgacccgcacaaggaagccgccacacccccacccgaccccgccaccgtgggacccgacgaccccctgctcatcagccacactcccggcatatccgggcccccgcggcaaatcaccgtccccgtgcgcgccctggccgccttccacatccaccaccactacggcctgcacatcagcgacgacgacatctactggtgcttcagcgaacccggcgacccccacggcctgtactacggcctggtctcccccctccttgccggacacacctgcctgcacctgcgcgccggcttcgacccggaactcaccttggacgtcatggaaacattccaggtgacccgcctcgccgccgcgcccaccatctaccgggccctgcgcaccgccacgaaaaccctgccccccggcatcatggtgcaaggactcgccaccaacggcgacgagttccgcaccgacctgtccgaatgggcgctcggcaccttcggcgtcggcatcagcgaccactacggccaccccgaatcagggatcgtcgccgtcaacgacgggcacggcggccccctgaccgccctcccaggattccggctgacagtcctcgagccgctcagcgacaccccggccgaaacaggagtccccggacgcgtagcaatcgacacccacaacagccccgcctggtggttcgcgggctacccggacgaccccctggccacagcccagcacttcagccctgacggacgctggtacctgaccggagacaccggcaccgtggacgacaccggcgccgtccacctcacccgccacaacggtgaagtgatcatcacctccggctaccggatcggcccctacgacgtggaatcagtactgctggaacacgacgccgtcgacgaagtcgccgtctacggaatccccgacccgctccgcggcgcactggtagcagccaacgtcgtcctcaccccggacgcctcccccagcgacgaactcgccgaggagctcaaacgcctcgtcgctgaacggttcgcagaaaccgcggccccccaccaggtgacgttcgtgccgcacctgccgaaaaccgcgagcggcaaactacgccgcaaccggctgcgcgcc

SEQ ID NO: 31807 - DNA, 3573 bp, Thermobifida fusca
cttcaccgaaagtacctcgccgatcccaactcagttgataaggcatggtggaatttcttcgcggactacaagtccggaaccgccgccgacgggtcaacctcccctgctaagagcaccgtagccggcaacggtgctggcggcgcggtcagagccgcggcatcgaaggcggccgcccggcccgccacagccaccacccccgacggctctgacgatgcactcgcggtgtcccaggaacggctgcgtggtgcatcggcccgtaccgccgcgaacatggagtccagcctcaccctgcctaccgccacaagcgtgcgcgcggtgccggtgaaactcctgttcgacaaccgcatcgtgatcaacaaccacctgcggcgcgcacggggaggcaaagtctccttcacccacctgatcggctacgccatggtcaaggcgctggagtcggtcccggtgatgaactactcctacaccgagatcgacggcaagcccgccgtggccaagcccaagcacgtcaacttcgggctggcgatcgacctcgccaaaccggacggctcccggcagcttgtggtgccgaacatcaaagctgccgacaccatgaacttcaaggagttctggtccgcctgcgaggagcttgtccgcaaggcgcgcagcaacaagctgaccgtggccgacttccagggcaccactatcaccctgaccaacccgggcggtatcggcacggtgcactcggtgccgcggctgatgccgggccagggcaccatcctgggcgtgggtgctatggagtacccggccgagttccagggcgcttctccggcgaccttgaacgagctcgccgtcagcaaggtcatgactctgacctccacctacgaccaccgcatcatccagggggcggagtccggagagttcctgcggcggatccaccagctgctgctcggcgaggacggcttctacgacgagatcttcgagtcgctgcgcatcccctacgagccggtccgctgggtgcaggacatctcggttaaccgggacaaccagcttgacaaggccacccgcgtccaggagctcatccacgcctaccgggtgcgcggccacctgatggccgacacggacccgctggagtacaagcagcgccgccaccccgacctggacgtcctcgagcacggcctcaccctgtgggacctggaccgcgagttccccaccggaggcttcggcggcaagccggtgatgaagctccgcgagatcctggggatcctgcgggacagctactgccgcaccgtgggcattgagtacatgcacatccaaagccctgaggagcgggagtggatccaggcccgggtggagcgggagccggagaagctcagccgggaagagcaactgcacatcctgaagctgctcaacagcgctgaggcgttcgagaccttcctgcagaccaagtacgtgggccagaagcgcttctccctggagggcggagaatcgctgatcccgctgctggacggggtgatcaccaaggcggctcgagcccagttggacgaggtcgtcatcggtatggcccaccgcggccgcctcaacgtgctggccaacatctgcggcaagtcctacgcgcagatcttcggcgagttcgaaggcaacctcgacccgcgcagcgcccacggttcgggtgacgtcaagtaccacctcggtaccgagggcaccttcaccacgatcaccggcgagaagatcgcgatcagcctggcggccaacccgagccacctggagacggtcaacccggtcgccgaaggtatcgtgcgggccaagcaggacatcctcaacaagggggccacgggcttcacggtcctgccgatcctgatccacggcgacgccgcgttcgcgggccagggtgtggtcgccgagaccctcaacctgtcgcagctccgcggctaccgcaccggcggcaccatccacatcatcgtcaacaaccaggtcgggttcacgacctcgcccaaggacagccgctccagcgtgtacgcgacggacgtggcccgcatggtgcaggcgccgatcttccacgtcaacggggacgacccggaggctgtggtgcgggtggcacggctggcgttcgcctaccgccaggagttcaacaaggatgtcgtcatcgacctggtctgctaccggcggcgcgggcacaacgaggcggacaacccctcgttcacccagccgctgatgtacgacatcatcgacgccaagcggtccacccggaagctgtacaccgaggcgctgatcggccgcggcgacatcacgctggaggaggccgaggaggcgctgcgcgactaccaggagcagttggagcgcgctttcgccgagacccgcgaggccgccaagaagccgatcgaaccgggttcggtcatcaagcccgaggtgttcaccgaggccccgatcgaccactccgcgaccccgaccgcggtcagcgaagaggtcatcaagcgggtggcagagacccaggtcacgttccccgagggcttcaccgtgcatccgcggctgctgccgcaactgcagcggcgggtccgcatggtcgaggagaacgcgatcgactgggcgatggccgagacgctggcgttcggttcgctgctgatcgacggccacccggtgcgcctggtcggccaggacagccgccgcggtacgttcggccagcggcacgccgtcctcgtggaccgcaagacgggcgaggagtacaccccgctcaaggtcttcgaccggggcaccgccaagttccacgtgcacgactcgctgctgagcgagtacgcggccctgggcttcgagtacggctactccttggagcgtccggacgccctggtggcctgggaggcccagttcggtgacttcgtcaacggcgcccagaccgtcatcgacgagtacatcagctcgggcgagcagaagtggggccagaagtcgagcgtgaccctgctgctgccgcacggctacgagggccaggggccggaccactcctcggcgcgcatcgagcgtttcctgcaactgtgcgcgcaggagaacatgacggtcaccatcccgaccacgccggcgaactacttccacttgctgcgctggcaggtgaagtcgccgtaccggcgcccgctgatcgtgttcacgcccaagtcgatgctgcggcacaaggcggccgtgtcggcggtgtcggagttcacctccggatcgttccgtccgctcatcccggacaccagcggcatcgctccggaggacgtgcggcgggtgatcctgtgcgcgggcaagatctactacgagctggacgcggcccggaagcggaccggtgaccagcacaccgcgatcatccgggtggagcggctctacccgctgccgatcgacgagatccgccagcagctccggtcgttccccaacgcgggcgaggtgctgtgggtgcaggaggagccggcgaacatggggccgtggccgtttgtggcgctggtcttcgccgagcagctcgaccgtccgttcacccggatctcgcgttcggcgagctcctctcctgccacgggttccgccaagcggcacgaggtggagcagcaggccctggtgaacacggtcttcccgccg

SEQ ID NO: 31808 - DNA, 495 bp, Thermobifida fusca
tctattgtgatccgtccggcccggcctgacgacgttcccgtcatcaccgcgctggtccgcgaactagcggagtatgagaaggagccccagtccgcgacagccaccgaagaggacttcgctgccgcgctgttcggcccgaacccggcggtcttcgcgcacgtcgccgagcacaccgccgaggacggttccccgatggtcgtgggcatggccctgtggttcctcaacttctccacgtggaccggacgccacggcatctacttggaagacctgtacgtacgccctgagttccgggggcgcggctacggcaaggcgctgctgaccgaactggcgcggatctgcgtagcccgcggctaccgtcggctggagtggtcggtgctcgactggaatacgcccgcgatcgagttctacaagtcgcttggcgcggtgccgatggacgggtggacggtctaccggctcaccggggaggcgctgaccgccctcggccagcagtgaccc

SEQ ID NO: 31809 - DNA, 1737 bp, Thermobifida fusca
atgtcgactcccgttaccatgcccgatctgggcgaaagcgtcaccgagggcactgtcacccaatggctcaagcaggagggcgacacggtcgaggtcgacgagccgctgctcgaagtctcgacagacaaggttgacaccgaaatcccctcccccgtctccggtgtcttgacgaagatcctggtcggcgaagacgagactgttgaggtcggcgcgcagatcgcgatcatcactccggctggggaggcgccgccggctcagcccgctcccgagacggcggctgagccggcggcccagccggaaccggagccggagcctgctccgcagcctgccgcggaggcccgcaccgagcccgctgctccggtggctgacgccggtgccgctaccccggtgaccatgccgaacttgggggagagtgtcagcgagggcacggtcacccagtggctgaagcaggagggcgacacggtcgaggccgacgagccgctgctcgaagtctcgacagacaaggttgacaccgaaatcccctcccccgtctccggtgtcttgacgaagatcctggtcggcgaagacgagactgttgaggtcggcgcgcagatcgcgctgatcagtcctgccgggcaggctgctgcgcctgctgccccggcggctccgcagcccgcacccgagccgaagccggaggcacggcccgagcccgcaccgcagcctgctgcgcagccggaagctgcagcccgcacggagcccgcaccgcagccgcgccgcacccgggacgatgagaccccgaccgtggacttggagacgatcagcggcaccggccaggtgctgggcacggacgcgaccagtgaagggtatgtgaccccgctggtgcggaagcttgccgcccaggagggtgtggacctgtcccaggtgaagggcaccggggtgggtggccggatccgcaagcaggacgtgttggaggcagcgcggcggatgcgggagcagcggcagcgtgctgctgcggcaccggcgcccgcggccgcggacacggcgctgcggggccgcacggagacgatgtcgcggctgcggcagacgttcgccgagcagatcgtcgagtcgctgcacacggcggcgcagctcacccaggtggtggaggtggatgtcaccgcgatcgcccggctgcgggagcaggtgggcgagcggttcgccgccgagaccggcgtggagttgggcttcttcccgttcttcgcgctggccgtggtggaggcgctgcagcggcacccgaagctcaacgcggtgatcgacggcaccgaggtgacctaccacgacaccgagaacctggcggtggtggtcgacaccgagcagggtgtgctggccccggtggtcaaggacgcgggccgcttgtcgctgcgggagctggcccggcggatcgacgacttgggggcgcgggcgcgcacggcgcggctggtgccggacgagttgagcggcggcacgttcaccatggtggacagcggcgcgtacggcgcgctggtggagacgccgatcatccaccagccgcaggtggcggtgttgagcacgggcaccgtggtgaagcgtccggtggtggtcgaggagccgcagctgggcgaggtgatcacggtccggtccatggtgtacctgtcgttgagcttcgaccaccggctcatcgacggcgcggatgcggcccggttcctctccgatgtgaagcgccggttggaggagggcgcgttcgaggacgctgtggggctc

SEQ ID NO: 31810 - DNA, 1449 bp, Thermobifida fusca
cggacgttatgagccgcgtccgggctcgccaccggtgtgtgatcacaccgcaggaaaaggagtgtccttcccgtgagtgaaagcggcggcacattcgatctcgtcatcctgggcggcggtagcggtggctactcggccgccatccgcgcctccgaactcggcatgcgtgtcgccctgattgagaaagacaagctcggcggcacctgcctgcactacggctgtattccgaccaaggccctgctgcacgcgggtgaggtcgccgacacggtgcgggccagcgagaagttcggtgtccgggcctcgttcgacacaatcgacatggcccgtgtccacgagtacaaggacaaggtcgtcagtggtctgcaccgcggcctgaccggtctgatcaaggcccgcggcatcaccctggtcgagggtgagggcaagctgaccggtgtcgacgaggtcacggtcaacggggtggcctacaagggtcggcacatcatcctggccaccgggtcccaggcgcgttcgctccctggtctggagatcgacggggagcggatcatcaccagctacgaggcgctccgcttggaccgggtccccaagtccgcgatcatcctgggcggcggtgtcatcggcgtcgagttcgccagcgtgtggcgttcgttcggcgccgaggtgacgattgtcgaggcgctgccgcacctggtcccggcggaggaggagtccagctccaagctgctggagcgggcgttccgcaagcgcgggatcaagttcgagctgggcagcccgtttgagagcgtgaagctcaccgagaccggggtgagcatgacgctggcgagcggcaagaccgtggaaggcgagctgctgctggtggcggtgggccgcggtccggtctcccaggggctgggctacgaggaggtcggcatccgcctggagcgcggcttcgtccaggtcgatgagaacctgcacaccggagtcggcaacatctacgcggtgggcgacttgatccccacgccgcagttggcgcacgtcggctttgccgagggtattttcgtcgccgagcacattgccgggctgaacccggtgaacatcgactacgacggtattccgcgggtcacctactccgacccggaggtggcgtccgtggggatcacctccaagaccgcggccgaacgcgggatcgagaccaccgagttcgtctacaacttggcgggcaacgggaagagccagatcctgcagacccagggcgcggtcaaggtcatcgcggccaaggacggcccggtgctgggtgtgcacatggtgggcagccgcgtcggcgagctgatcaccgagggccagctgatctacaactgggaggcgctgccgtctgaggtggcgcagctcatccacgcgcatccgacccagtccgaggcgttgggcgaggcccacttggcgctagcgggcaagccgttgcacgtccacgac

SEQ ID NO: 31811 - DNA, 957 bp, Thermobifida fusca
atggaattccgtcatctcggcaagagcggacttgttgtcagcgaaatcgcctacggaaactggatcacccacggctcccaggtcgaagaggagacggcgatagcgtgcgtgcacgctgcgctggacgagggcatcaccacgttcgacaccgccgacgtctacgcccaggggcgtgccgaggaggtcttgggcaaggcgctcaaagggcagcgccgtgacggcatcgagatcttctccaaggtgtactggccggtgggtccggggaagaacgaccggggcctgtcgcgcaagcacatcatccgcggggtggaggagtcgctgcgccggttgggcaccgactacctggacttgtaccaggcgcaccggttcgactacgccaccccgttggaggagacgctgcgcgccttcgacgacttggtgcgccagggcaaggtcctctacgtgggtgtctcggagtggcgtgccgaggagatcgagcaggcgctgaagatcgccgacgagatgggcttcgaccggatcgtgtccaaccagccgcagtacaacatgctgtggcgggtgatcgaagccgaagtggtgccgctgtgcaagcgggaaggcatcgggcagatcgtctggtcgccgatcgcgcagggcgtgctgaccggcaagtacaagccggggcagccgccgccttccggttctcgggccacggacgagaagtcgggtgcccagttcatccggaagttcctcgacaaccagcagttgctggagcgggtgcagcagttgctgccgctggccgcggaggccgggctgactccggcgcagttggcggtggcgtgggtgctgcagaactcgaacgtgtcggcggcgatcatcggcgcgtcccggccggagcaggtgcgggacaacgccaaggcggcgggggtgaagctcgacgccgagctgatgcgccgtatcgacgagatcctgggggacgct

SEQ ID NO: 31812 - DNA, 408 bp, Thermobifida fusca
accgtgctgctgctcaacggccccaacctcaacctgctgggtttgcgcgaccccgcccagtacggcaccaccacgctcgccgagatcgaaaaacgggtcgtgtcgctcggtgccgagctgggagtggacgtggtgtgcgcgcagagcaaccacgaaggcgagctgatcgaccgcatccatgccgcccgcgagctggacggcatcgtgttcaacccgggcgcttacgcccacaccagcgttgcactgcgcgacgctatcgacgcggtccccaccccgtgtgtggaagtccacatctccaacatctacgcccgggaaccgttccggcacacgtcgatgaccgccccggtcgtcaacggcatcatcggcggctgcggggtgcacggctacgaactggcgctgcggcacatc

SEQ ID NO: 31813 - DNA, 1472 bp, Thermobifida fusca
acttttccgaaaagaccgcctcgctcccctgcctgcgacgcactaccctgggctcctgaaccggttcacatgcgagcatgcaccagctaccaggagcgctagtgagcaacgaccacctccccgagttcccggccggattctggttcggcgcggctacggccagctaccagatcgagggtgcggtccacgcggacggacgcggcccgtccatctgggacacctacagccacacaccgggcctggtcctcaacggcgacaccggcgacgtggcctgcgaccactaccaccgctaccccgaggacgtggagctcctgcgccgcctgggggtggacgcctaccgcttctccatcgcctggccgcgcgtcatgcccacgggatcaggcgacgtcaaccagcgcggcctggacttctacgaccgtctcgtcgatgcgctgctcgaagcggggatcaccccggtgcccaccctctaccactgggacctgccgcaggccctggaggatgccggcggctggcgttcccgcagcaccgcggagcacttcgccgcctacacccgggcggtcgttgcccgtctcggcgaccggatccgccactggatcacgctcaacgagccgttctgcagcgctttcctgggctatgccgtgggccggcacgcccccggggcccgggaaggcacgcctgcgctcgccgccgcgcaccacctgctcctcgcccacggcctggcagtgcaggaactgcgcgctgccgatgcgggcgaggtcggcatcaccctcaaccccgaccggatcctgcccgcctccgacagtgcggccgaccgcgcggctgccgaccgcgcggaaaccctgcacaaccgggtctggttcgacccgctgttcgccggccgctaccccgcgaacgaagccgacgtgtggggagagctcgcggacggctcgtaccggcgcgacggcgacctggagatcatcggccagccgctggacttcctcggcatcaactactaccggccgctcaaagtcgccgacggcccgctgaccgaagccgacccggcacgccgcaccgccgtagacatccgcgcccaccagcagcgtttcgatggagtgcggcacacagccatggactggccggtcgtccccgaatccttcacggacctgctgctggacctcacggagcgctacccgaaccttccgcccatctacatcacagagaacggctcagccgagcacgacgtcgtctcccctgacggacgggtgcacgacacggaccgcatcgcctatctcaacgaccacctgcatgccctggccgcggcgatccgcgccggggtggacgtgcgcggctacttcgtctggtcgctgctcgacaacttcgagtgggcgttcggatacgagcggcgtttcggcatcgtccgggtggactacgacaccttggaacggcttccgaaggacagctacttctggtatcagcggctcatcgagcaccac

SEQ ID NO: 31814 - DNA, 1863 bp, Thermobifida fusca
gcgtctctgtggttcggcggcgactacaaccctgaccagtggccggaaccggtctgggacgaggacatgcggctcatgcggcaggccggagtcaccctggccacggtcggcgtgttctcctggagcctgctggaacccgaagaagaccgctacaccttcgactggctggaccgggtcctggacctgctgcacgccaacgggatcagtgcctgcctcgccaccccgaccgcgtccccgcccccgtggttcaccctcgcccaccccgacgctctgccggtgactgccgacggggtgcggctgacccacggcagccgcgacacctacgacgtgtgcgcccccgcctaccgggaggcgtctttacgcatcacccgggcgctcgcggaacgctatgcccaccaccccgcgctggcgctgtggcatgtgcacaacgagtacggcacccacacctacggggagcacgctgcccgcgccttccgcacctggctgcgtggccgctacggcagcctggccacgctcaacgacgcgtggaccacggcgttttgggggcagcgctattcggactgggagcagatccacccgccgcgcgccacccagtacctgcccaacccggcacacctgttggacttccgccgtttcctctccgacgccatgcgcggccactactgcgcccagcgcgacatcctgcgggccgccaacccggatgtccccgtcaccaccaacttcgcgttcggctcctgggttccggtcgacccgtggcggtgggctgccgacctggatctcgtagcggttgacgtctacccggacgccaccggggaggctgcggcccaccagcacgcgttcgccgctgacctggcccgctcctggggaaggggccggccgtggctgctcatggagcaggccaccggctatctcggggctcgggtgcggcccaaagctcccggggagatcatccggcacagtctgagccacgtggcccgcggctcccggggggcgatgttcttccaatggcgggcctccgtgggcggagccgaacagtggcatcccgcgatgttgccgcacaccggcgcggactcccccgtctttgcggaagtgtgtgagctgggagcactgttgggccgccttgcggaagtccaggacacccgggttgtggaggacgcggccgtggtgtgggatcccgagtcctggtgggcgctgcagtcgccgtcactcccctcccccgacctggactatctcgccgcagtccggcaagtgcaccgggtgctgtggcggcagggacgcacggtcgcgttcgtctccccccactcccctatgccggatcttcccctgctcgtcgtgccgctgctgtacttgacctccgcggcgactgcgcgtttcctcgccgactatgcggagcaaggcggcattctcgtggtcacctacggcagtgggaccgcagacgagcatgcgcgggtgtggcctggaggctacccgggggcgctccgcgacctgctgggagtgcgtgctctgcagcactatccgctcgatccggcggtcgacgcggtcacggtgtgcggggaggacggtgaatactgggggcgggcgcgccggtggagtgaagagctcgacgtggccgacgctaaggtggtagcacgctatgcggacggcccgttcgcggggcgtgccgcggtcacgcgggtggggcgcggcgcgggacaggcgtggtacgtctcctgcgatctggaggacgctgggttggggaaggtcctgtcccgcgccggcctgtccgggggcaccgctactccccccgcggtggaagtggtacaccgggattcccgggacgagcagtgggtgttcgtgctcaaccacggcaacggcccggtgaca

SEQ ID NO: 31815 - DNA, 1976 bp, Thermobifida fusca
tcaccgaccagggaatccacctcaaggccgccaccaccacgggcgaaaccctcaccgccagcatcaccgcctccgcacccggcgtcatccgcgtccgcctcagcgcccaacccgacgccgccccccgcgcaacacgcgccctcaccatggtccacccccaccccgacgccaccgccgacgtcaccatcaacgacgaccacatcgtcatcgctagcggaccactccacgcccacctcaccctcgacccctggcacctgcgcttcaccgacgacaccggccgcctcctcaccgaacaagaccgcggccacgtcgacatcagcggacgctgccgcaccctccccttcggccgcagcaccgtcgacggcgtcaccgcctaccacgactccttcaccctcgccagcgacgaacgcctcggcggcctcggagaacgcttcacccccttcgacctgcgcggccgccgcgtccgcatgtggaacttcgacgccttcggcgccgaatccgaccgcgcctacaaaaacgttccgctctacatctccagccgcggctacggcctcctcctccacaccggcagccccgccgaattcgacatgggacagtccacgcacagcagcgtgcaactcctcgtccccgacgacatcctcgactaccacgtcatcgccggccccagcccacgcgacatcctcgaccgctacaaccagctcacctgccgccccgccctaccccccaaatgggcgttcggcacctggatctcctccggattcatccacgacacccaacagcgggtcatggaacgcgcccgcaccatccgcgaacgcggcatcccctgcgacgtcctccacctcgactgctactggcaagccgaaggacactggtccgacctggactgggaccgcaacgccttccccaaccccgaacagatgctcgccgacctcgccgacctcggcttccgcgtctgcctgtggatcaacccctacatctcccacctcagcccccacttcgaaaaagccgccaaacacggctacttcctccgccgcaccaccggcgaggtctacctcgccgacgcctggcacggctcccacccgcccgtcggcatcgtcgacttcaccaaccctgaagccaccgagtggtacaccgcccggctccgcaccctcctgcagcaaggcgtcgccgtcttcaaaaccgacttcggggaaggcgtccccgccgacgccgtcgccgccaacggcatgaccggcaccgacctgcacaacgtctacaccctgctgttcaacgacgccgtcgcccaagtcacccgcgacgtcaagggatacgacctggtctgggcccgctcctcctatctcggcgggcaacgccactccgcccaatggagcggcgacagccaatgcaccttccccgccatggccgccaccctgcgcggcggactcagccacggactcagcggcgtccccttctggagccacgacgccggaggattcaacggcacccccgacaccgtcctctacgcccgctgggcccaattcggcgcgttctcccccctcgtccgcttccacggcaccaccacccgagaaccctggcggttcgcccccgaagcagaagacgccgcccgcgaagccctccacctgcgctaccggctcatgccctacctgtactcggccgccgccgtcgccgcacgcaccggaacaccgctcatgcgcgccctgtgcgtcgactacccggacgacccgctggcctggcaggccgaactggaatacctcctcggccctgacctgctcgtcgcccccgtctgcgggccggaaggcatccgcaacgtctacctgccgcccggccactgggtcgactactggagcggacgcctccacgacggcggccgcaccgtgaaactccacagcccgctcaaccgcttcccgctcttcgtgcggttgggcgccctcatcccggtagtggaagcaaccaccaccatccccgacggcccattc

SEQ ID NO: 31816 - DNA, 2640 bp, Thermobifida fusca
atgtccgtcactgaacctcctccccgccgacgcggccgtcacagccgggcgcgccgcttcctcacttccctgggagctaccgcggccctcaccgcgggcatgctgggcgtccccttggccacgggaaccgcccacgccgaaccggcgttcaactacgccgaagccctccagaagtcgatgttcttctacgaggcccaacgctccgggaaactcccggagaacaaccgggtctcctggcgcggcgactccgggctcaacgacggcgcggacgtgggactcgacctcaccggcggctggtacgacgccggcgaccacgtgaaattcggcttccccatggccttcaccgcgaccatgctcgcctggggcgccatcgaaagcccggaaggctacatccgctccggccagatgccctacctcaaggacaacctgcgctgggtcaacgactacttcatcaaagcccacccctcgcccaacgtgctgtacgtgcaggtcggcgacggcgacgccgaccacaagtggtggggtccggccgaagtcatgccgatggagcggcccagcttcaaagtggacccctcctgcccgggcagcgacgtcgcagccgaaaccgccgcggccatggccgcgtcctccatcgtgttcgccgacgacgaccctgcgtacgcggccaccctcgtgcagcacgccaagcagctctacacgttcgccgacacctaccgcggcgtgtactccgactgcgtgcccgccggagcgttctacaactcctggtcgggctaccaggacgagctcgtctggggcgcctactggctgtacaaggccaccggggacgactcctacttggcgaaggccgagtacgagtacgacttcctctccaccgagcagcagaccgacctccgcagctaccggtggaccatcgcctgggacgacaagtcctacggcacctacgtgctgctcgccaaggaaaccggcaagcaaaaatacatcgacgacgccaaccggtggctcgactactggacggtcggcgtcaacggccagcgcgtgccctactcccccggcgggatggctgtgctcgacacctggggagccctgcgctacgccgctaacaccgcgttcgtcgccctcgtctacgccaaggtgatcgacgaccccgtccgcaagcagcggtaccacgacttcgcggtgcggcagatcaactacgcgctcggcgacaacccgcggaactccagctacgtggtgggcttcggcaacaacccgccgcgcaacccccaccaccgcaccgcgcacgggtcgtggaccgacagcatcgcctcgcccgcggagaaccggcacgtcctctacggcgccctcgtcggcggtcccggctccccgaacgacgcctacaccgacgaccggcaggactacgtcgccaacgaagtcgccaccgactacaacgccggattctccagcgcgctggccatgctggtcgaagagtacggcggcaccccgctggcggacttcccgcccaccgaggagcccgacggaccggagatcttcgtggaagcccagatcaacacgccgggcaccacgttcaccgagatcaaagccatgatccgcaaccagtcgggctggccggcccggatgctggacaagggcaccttccggtactggttcaccctcgatgaaggcgtggaccccgcggacatcacggtgagctccgcctacaaccagtgcgccaccccggaggacgtccaccacgtctccggcgacctgtactacgtggagatcgactgcaccggggagaagatcttccccggcggccagtcggagcaccgccgcgaagtccagttccgcatcgccggcggccccggatgggacccctccaacgactggtccttccaaggcatcggcaacgaactcgcccccgccccgtacatcgtgctctacgacgacggtgtaccggtgtggggcaccgcccccgaggaaggggaagagcccggcggcggagaaggaccgggaggcggcgaagaacccggcgaggacgtgaccccgccgagcgcgcccggctcccccgcggtccgggacgtcacctccaccagcgccgtgctcacctggtccgcgtccagcgacaccggcggcagcggcgtagccgggtacgacgtcttcctccgcgccggcacaggccaggagcagaaggtgggatccaccacccggaccagcttcaccttgaccggtctagaacccgacaccacctacatcgcggctgtcgtggcccgggacaacgcgggcaacgtctcccagcggagtaccgtctccttcaccacgctggccgagaacggcggcgggcctgacgcctcctgcacggtgggctacagcaccaacgactgggactccggattcaccgcttcgatccggatcacctaccacggcacggccccgctctccagctgggagctctccttcaccttccccgctggccagcaggtcacccacgggtggaacgccacgtggcgccaggacggggccgccgtgaccgccacccccatgtcctggaacagctccctggcgcctggagccaccgtcgaggtcggcttcaacggctcctggagcggcagcaacacacctcccaccgatttcaccctcaacggcgagccctgcgccctcgcc

SEQ ID NO: 31817 - DNA, 1257 bp, Thermobifida fusca
accatgactgacatcgagcgggacgtccgcaaggtcgctgagcgcgctcgggacgccgccgcagacctcgccccgctcagccgggacgctaaggacgaggcgctcaccgccgtggccgacgccttgcgcgagcggaccgaggagatcgtcgcggccaacgccaaggacgtcgctcaagccagggagaacggcatcagcgaggcgatgatcgaccgcctcaccctgacccccgcccgtatcaccgcgatcgcggacgcggtccacgagatcgtcgaactgcctgacccggtcggcgaagtcgtccgcggcaagaccctgcccaacgggctggaactgcgccagatccgggttccgctcggtgtcatcggcatcatctacgaggggcgtcccaatgtgaccgtggacgccgccgcgctctgcctcaagagcggaaacgctgtcctgctgcggggctcctcctccgcgtactcctccaacacggtcctcaccgacgtgatccgccaggcgctggccagcacgcgggtgccggtcgacgccgtgcagatggtgcccggcaagagccgcgagtcggtcaagcacctgatgcgggcccgcggcctggtagacgtcctcatcccgcgcggcggtgcctcgctcatccagaccgtggtcaacgagtccacgatccccgtgatcgagaccggcaccggaaactgccacgtctacgtcgacgaagcagccgacctcgaccaggcgctgaagatcgtgctcaacagcaagacccagcgctgctcggtgtgcaacgccagcgaaaccctgctcgtccacgccggtatcgccgacgccttcctgccgcgggcgctggccgaactgcgcgaggccggagtcaccatccacggcgatgagcgggtccgctcctacgacagcagcgtggtgcccgccaccgaagaggactgggccaccgagtacctctccttggacctggcggtccgcgtcgtggactccctggacgaggccgtggcgcatatccgcgcctactcttcggcgcacaccgaggccatcatcaccgactcccaggcagcggcacgccgcttcgtctccctggtggactccgcggccgtcatggtcaacgcctccacccgcttcaccgacggcggcgagttcggcttcggtgcggagatcggcatctccacccagaagctgcacgcacgcggtccgatgggcctgccggaactgaccaccaccaagtacgtggttaccggggaaggccacgtgcgc

SEQ ID NO: 31818 - DNA, 1421 bp, Thermobifida fusca
ggagaagtgggtgagcagtgaactgtcagtcttccgcgtccaacctcgccaaccacatcaacgcggtgtacgagctgcgccgcgcctatgcgcggctgtccgccgacaagccggtgcgcctggcgaagaccacctccaacctcttccgcttccgcagccgggacgatgccgcgcgtctcgacgtcagcgctttcacctcggtgatcagcatcgacacggaggcgcgggtcgcggaggtgggcggcatgaccacctacgaggacctggtcgccgccaccctgcggcatggcctgatgccgccggtggttccgcaactgcgcacgatcaccctgggcggtgcggtcaccgggctggggatcgaatcctcgtccttccgcaacgggctcccgcacgagtcagtggaagagatggagatcctcaccggcagcggccaggtggtggtggcccggcgcgacaacgagcaccgcgacctgttctacggtttccccaactcgtacggcaccctcggttacgcgctgcggctccgcatccagctcgaaccggtccgcccctacgtccacctgcggcacctgcggttcaccgatgccgcagcggccatggccgcgctggagcagatctgcgcggaccgcacccacgacggggagaccgtcgacttcgtcgacggcgtcgtgttcgcccgcaacgagctgtacctgaccttggggacgttcaccgaccgggctccgtggaccagcgactacaccggaaccgacatctactaccggtcgatcccccgctacgcgggccccggccccggcgactacctcaccacgcacgactacctgtggcggtgggacaccgactggttctggtgctcccgcgccttcggactgcagcatcccgtggtgcgccgcctgtggccgcgttccttgaaacgctccgacgtctaccgcaagctcgtcgcctgggaccggcgcactgacgcgagccgcctgctcgactactaccgcgggcgcccgcccaaggaaccggtgatccaggacatcgaggttgaggtggggcgggctgccgagttcctcgacttcttccacaccgagatcggcatgtccccggtgtggctgtgcccgctgcggctgcgagaagacacagccgacgatacggaaccggtctggccgctctaccccctcaaaccccgccgcctctacgtcaacttcgggttttggggcctcgttccgatccgtcccggtggaggcaggacataccacaaccggctgatcgaaaaagaagtgacccggttgggcgggcacaagtcgctctactcggacgccttctacgacgaggacgagttctgggagctctacaacggggagatctaccgcaagctcaaagctgcctacgaccccgacggtcgactgctcgacctgtacaccaagtgcgtcggc

SEQ ID NO: 31819 - DNA, 1527 bp, Thermobifida fusca
ctgctggaagacggcgcacgcaaccggccggagcgcgatgcgatcgtctttggcgacatgcggctgaactacgccctggtcaacatgatcgccaaccaggtagccaacctcctggtatcccgcggtatccgccccggggacaaggttgcgctcgcctgtccgaacgtcccgtactttcccttcgtctacttcggtgcgctcaaggcgggagcggtcgtcgtccccctgaacgtcctgcttacgccgcgcgaaatcgaataccatctccgcgactccggcgctaaagcgctcttcgcgttcaccggcaccccggaactccccctcggggagcgcgcctggcaagcattccaggaagtcgccgaatgcgagctctacatcgacctgccggccgccgcgggggcgaccacgtccgcaatcccgggcgcagaaaccttctgggccgcgctcaacgggcagcccggcgagttcgagtcggtgcgcaccgaaggcgacgacgtcgcagtgatcatctacaccagcggcaccaccggccagcccaaaggcgcccagctcacccacaccaacctgctcttcaacgcggtcgcctccagcgccctcttcgaccaggctcccgacagccacgacgtgttcctcaccgtgctgccgctcttccacatcttcgggcagaccacgatgatgaacgcggctctctaccggcacgggaccatggtgctgatgccccgcttcgacggggatgaggccctctccctcatggaaaaggagaaggtcaccatcttcgccggggtgcccaccatgtactgggggctcctcaacgcccaaggggaccacgacatcaagcagatctcccagaccctgcacaccgcggtctccgggggcgcctcccttcccgccgaagtcgcccggaaagtcaaggagaagttcggcatcgaaatcctggaaggctacggcctctccgaaacctctcccgtggtgtccttcaacaaccccaagcgcaaagccaagccgggatcgatcgggctgcccatctggggcgtggagatgaagctcgtcgacgagaacttcaacaccattgaaggcgaagggccgggagagatcgccgtgcgcggccactgcgtgatgaagggctaccacaaccgtcccgaggccaacgcgcaggtgatgcgggacggctggttccgcaccggggacatcgcccgccgcgacgaggaaggcttctacttcatcatcgaccgctccaaagacatgatcatccgcggcggatacaacgtgtacccgcgggagatcgaagaggtgctgatgacgcacccccaggtgagcctggccgccgtggtgggtgtcccgcacgacacgcacggcgaggagatcaaagcgttcgtgatccccgccgagggggccaccctcaccgaagacgaactgatcgcctgggccaaggagcgtctggcggcctacaagtacccgcggatcgtggagttccgcacggaactgcccatgacggcgaccggcaagatcctcaagcgggaacttcgc

SEQ ID NO: 31820 - DNA, 2802 bp, Thermobifida fusca
atgaccgagacggtgagcggctctgccacgcgtaaaggcagaaaacctcgcaggggggtgaagatccaacgcgtcttcaccactcctggagtccacccctacgacactgtggagtgggaacgccgcgacgtcgtcatgaccaactggcgcgatggctcggtcaacttccggcaggatggggtcgaattccccaagagctggtcgatgaacgccacccagatcgtggccagcaagtacttccgcggcgccttgggcaccccgcaacgcgagtggagcctcaaacagctcatcgaccgggtcgtcgacacctacaccgcagccggtcgggagcacggctatttcgcctccgacgaggacgctgagatcttcgatcacgagctcaagtacgccctcgtccaccagatgttcagcttcaactccccggtctggttcaacgtcggaacctcgtcgaaggcgcaggtctccgcctgcttcatcctgtcggtggacgacaccatggagtcgatcctcgactggtacaaggaggaggggctgatcttcaagggcggctccggcgcgggggtgaacctctctcgcatccgctccagcaaggagctgctctcctctggtggaaccgcgtccggcccggtgtccttcatgcgcggcgccgacgcctctgccggaaccatcaaatccgggggcgccacccggcgggccgccaaaatggtggtcctcgacgtcgaccacccagacatcgaagagttcatcgaatgcaaggcacgcgaagaacgcaagatccgggtgctgcgcgacgccggcttcgacgtggacctgggcggcgctgacatcatcagcgtccagtaccagaacgccaacaactccgtgcgggtctccgacaagttcatgcgtgccgtggagaacgatgaggatttcgacctcatcgcccgcaccaccggggaagtcatcagcaaggtccgggcccgggacctgttccgcaagatggctcaggccgcctgggagtgcgcggacccgggcatccagtacgacgacaccatcaacgactggcacaccacaccggaaagcggtcggatcactgccagcaacccctgctccgagtacgtccacctggacaactcgtcctgcaacctggcttcgatcaacctgatgaagttcctcgacgaggatggctcgttccgcgtcgaggagttcgaacggctcaccgagctggtcatcacggcgatggacatctccatctgcttcgccgacttccccaccgagaagatcgccgagaccacccgcgcgtaccgccagctcggtatcggctacaccaacctgggcgccctgctcatggcgaccgggcacgcctacgactccgacgggggccgctcggtggctgccgcgatcacctcgctgatgaccgccgcggcctaccggcgcagcgcggaactggccggggtcgtcggcgcctacgagggctacgccaagaacgcggaggcccacaagcgcgtcatgcgcaagcacgcggcagccaacgacgcactccgcccggtcggacagttggagaagccgatccacgacgccgccacccgcgcgtggaaggagtgcctggaactcggggaacgccacggatggcgcaacgcccaggccagcctgctcgcccccaccggcaccatctccttcatgctcgactgcgacaccaccggcatcgagcccgacttctccctggtcaagatcaagaagctcgtgggcggcgggtccatgaagatcgtcaaccagggcattccgcgggcgctgcgcaccctcggctacaacgaagaccagatccaggccatcgtcgactacgtcgctgagcacggccacgtcgtcgacgcccctgaactgcgcccggaacactacgaggttttcgactgcgccaccggcaagcgctacatccgacccatgggccacgtggagatgatggcggcagtccagccgttcctctccggcgcgatctcaaagaccgtcaacctgcccgaggaagccacggtcgaggacttcgaacgcctctacttcgaaggctggaagaagggcctcaaggcgctcgcggtctaccgcgacaactgcaaggtcggccagccgttgtccaccacgaagaaggaagaggagaagaaggaggagtcccgccccgtcgagctccggagcccggtgcggcgccggctgccgaagcggcgtcccagccagaccatctcctttacggtcgggggtgctgaaggctacatcaccgccggctcctaccccgacgacgggttgggcgaagtgttcctcaaactcggcaagcagggctctacgctcgccgggatcatggacgccttctccatcgcgatctccatcgcgctgcagtacggggtgccgctgcagacctacgtggagaagttcaccaacatgcgcttcgaaccggcggggatgaccgacgaccccgacatccggatggcgcagtcggtcgtggactacatcttccgccgcctcgccctggactacctgccgtacgaggagcgcgccgcactcggcgtcttcaccgcggaagagcgggctgcccaggccgccggcgaggacccggcccaggtcgctgcccaagtggtcacctacgcccagtccgcgccggtcaccgagacgctgaccgcgcctccggaaccggagccgaagccgcggagtacggtggagtccacggagtcccgcaaagagttcagcgctgacgcgccgctctgcgtgagctgcggcaccaagatgcggccgtccggaagctgctacgtctgcgaaggctgcggctcgaccagcggctgcagc

SEQ ID NO: 31821 - DNA, 1431 bp, Thermobifida fusca
atgagtgtcctcgccctagggttgagccaccggagtgcgcccgtgacgctgctcgaacgggtagcgctcagcggtgaagtacgcctcaaactcatgacggagatggtcaacacctctgccgtgaacgaggcgatggtggtctccacctgcaaccgcaccgaggtctacgccgacgtcgaccagttccaccctggggtcgccgccatctgcgaactcctctcccagtacaccggtgtctcccaggaagaactcacccagcactgctacgtgcactacgaggagcgcgccgtccagcacctgttctccgtggcctgcggcctggactccatggtcgtcggcgagggccagatcctcggccaggtccgcaacgcgctcaaagacgcccagcacgtcggcacgctcggaagggtcctcaacgacctcggccagcgcgccctgcgcgtcggcaaacgcgcccacaccgagacccacctggacaaggccggagccagcatggtcagcttcgggttgaccgtcgccggacgcttcctcacccccgatcgcgaaccgcagccgtctgccgctgcagcggtctgtccggtcgacggcgacaccggcgtcgaggtcagcgccgcgctgcctgacccccagctcctcaccgggcgccgcatcatggtgctgggcgccgggtcgatgagcgccctggccgccaacacggtggcccgccacggcgccagcacgatactcatcgccaaccgcaccttcgaccgggcgcagcggttggcagaatgcctcactgaaggctacgagtcggtccgcagcagcgcggtgcccttcgaggacgccgcccgccacctcgccgacatcgacctggtgatctcctgcacgggagcgcaagggatcgtcctcaccgccgagcaggtggctgcgggcggcgaccgcgccacccgccccctggtcttcctggacctcgcactcccccacgacatcgacaaggccgtgcgcaaactgcccggcgtccacctcgtcgatattgaagagctccgcgacgccgctgaagacggcaccgcgaccggacaggtggccgacctcaccgcggtgcgcgacatcgtggccgaggaggtcgccgaataccaggcggtgcgcagcgcagaacgggttgcccccaccgtggtcgcgctccgcagcaaagcccagaaggtggtggaaagcgaactggaacgtttgaacgggcggctacccggtatcgatgaccgcacccgggcggaaatcacccgcactgtgcggcgcgtcgtcgacaaactgctgcaccagcccacggtgcgagtgaaacaattggcgaccggccctgaaggggccgtctacgccgaggcattgcgcgaattgttcgacctcgacccggcaatcccgagcgcggtagtgaaacccgggaccgctctcggcgaggagaga

SEQ ID NO: 31822 - DNA, 942 bp, Thermobifida fusca
atgtccaccacaccggccaggctcggcacccgccgcagcactatggccaccaaccagtcccgcagggtcgccgagatcctcaccgcacgcaccggagtaccggtcgaactggtcctgatcaccagcttcggcgacatcacccgcgcgcacctgacccaactgggcggcaccggggtttttgtgagcgcgctccgcgacgccctgctcgccggcgaggtggagttcgccgtccactccctcaaagacctgccgaccgcccccactgaggggatcgtgctcgccgccgtcacagaacgggacgacccgcgggacgccctgtgcgcccgcgacggcctcaagttcgccgacctgccccccggcgccacggtgggcaccgggtcgccacgccgggtcgcgcagctcgccgcgctccgccccgacctgcgctacgtgccgatccgcggcaacgcagagacccggctgggcaaagtcgcttctggagaactcgacgcggtcgtactcgcctacgccggactgcaccgggtgggccgcctcgacgacgttaccgacgtcttcgacgtggaccaggtcctgcctgcccccggccagggcgcgctcgccgtcgaatgccgcaccgccgacttcaccggaccgttgcgctatctcaccgcggtcgaccatctccccacccgggccgcggtcaccgcggaacgtgtcatcctggcggaactagaagccggatgcgccgccccggtgggcgcctacgccgagttcgtggctgaggatcgcctccgcctgcgcgccgcggtcgtcgccacggacggcagtcaggctgtgcgcgccgagcagaccgtcaccgtcaccgaattccccgacgcggtccaggcggccaccgcactcggccgccagctcgcccacgacatgatcgagcagggggccgatcagatcgtggccgacgccgcg

SEQ ID NO: 31823 - DNA, 969 bp, Thermobifida fusca
ttcccgctggcgcgaccgcggcggttgcgcaccacagccgcgatgcggcggctggtcgcggagacccgcgtccggcccgaagagctcatcctgccgatgttcgtcaaggagggcatcgacgcgccgcaggagatcagctccatgccgggcgtctaccagcacaccctggacagcctgcggaagagcgcggaagaagcggtcgaggccggggtcggcgggatcatgctgttcggggttcccgccgtcaaggacgaacgcgggtcagcagccgacgaccccgacgggatcgtccaggtggcgttgcggaaactcaccgcagacctgggcaatgcggtcgtcgtgatgaccgatctgtgtttggacgagtacacttcgcacggacattgcggagtgctcaccgaagggaacgaggtcgacaacgacgccaccctggagcggtacgcctccatcgcggtggcccaggccgaggccggcacggatgtggtcgcccccagcggcatgatggacggccaggtcggggcgatccgcgccgcattggacggggccgggtacaccggcgtcgcgatcctctcctacgctgccaagtacgcttcggcgttctacggaccgttccgagacgccgccgagtgtgcaccgcagttcggtgaccgttccagctaccagcaggacccggccaacgctaaggaggcgctgcgcgaggtcgagctggacctggccgaaggagcggacatggtgatggtcaaaccggggctggcctacctggacatcgtggccaaggtcgccgaagccgtcaccgtgccggtctccgcctaccaggtcagcggcgagtacgcgatggtcgaggcagcagcccgcaacggctggctggaccgggagcgagtgatcgtggaaatcctcacctcctaccggagggcgggagccggacagatcctcacctactgggctaccgaagcagcgcggctcttgcgg

SEQ ID NO: 31824 - DNA, 1266 bp, Thermobifida fusca
tcgcatgagctgttcaaccgtgcccgatccgtcatccccggcggggtgaactccccggtccgggcgttcaaagcggtgggcggcacgcctccgttcatggtctccggtaagggcccgtacctcaccgacgccgacgggaacacctatgtggacctcatctgctcgtgggggccgctgatcctcggccacgcccaccccgcagtcgttgaggcactggcgaaagcagccgcccaggggacgtcctacggggcgccgaccgaagccgaggtggagctggcagaagagatcgtgtcgcgcaccccggttgagaaagtgcggctggtcaactcgggcaccgaggccacgatgtccgcgatccgcctggcccgcggggccaccgggcgcgccaaagtggtcaaattcgccggaaactaccacggccacgtggacgcgctgctggccgctgccggatcaggggtggccaccttcgccctccccgactcgccgggcgtgaccggggccagcgcagcagacaccatcgtgctgccctacaacgacatcgctgcggtcgaagcggccttcgccgaagccggcgacgagatcgcctgcgtcatcgccgaagcctgccccgccaacatgggtgtggtcccgccccgcgacggtttcaacgccaaactgcgggagatcaccgcccgccacggggcactgctcatcctcgacgaggtgctcaccgggttccgcgtcagcccctcgggatggtacggccttgaaggagtcgccccggacctcatgaccttcggcaaggtcatgggcggtggactgcccgctgccgcgttcggtggacgcgccgacctgatggaccagctcagcccggagggctccgtctaccaggcgggcaccctgtcaggcaacccgctggccaccgccgccggccttgccaccctgcggaacgccacacccgaggtctacgcgcacatcgacgctgccgcggcgcgggtctccgccgcggtgagcgaggcgctgaccgctgaaggggtgccgcaccgcatccaacacggcggcaacctgttcacggtgttcttcaccgacacagaagtcgtcgacttcgacggcgcccgcgcgcagaacaccgcgcggtacgcggcgttcttccaggcgatgctggagcagggcgtgtacctgccgcccgccgcattcgaagcgtggttcttctccgccgcgcatgacgacgctgccctggaccgggtcgtctccgcgcttcctgccgcggcgaaagcagccgcccag

SEQ ID NO: 31825 - DNA, 822 bp, Thermobifida fusca
atgagccgcgccgacgtccttgtggacgccgactgggtggaggctcacctggacgacccgaacgtcgtgatcgtcgaggtcgacgaggacacctcggcctacgacaagggccacatccgcaacgcgatcaagctcgactggaggaaggacctccaggacccggtccgccgcgacttcgtcgacaaggccgggttcgaggcactgatgtccgagcgcggtatcgccaacgaccacaccgtggtgctctacggcggcaacaacaactggttcgccgcctacgcctactggtacttcaagctctacggccacgagaaggtgcgcctgctcgacggcggccgcaagaagtgggagctggactcccgcgagctggtcaccgaggtgccggagcgcccgaagaccaactacgtcgccaaggagcaggacacctccattcgcgccttccgcgacgaggtcgtcgacgcgatcggcaagaaggccctcgtcgacgtccgttcccccgacgagttcgttggcaagcttctggcccccgcgcacctgccccaagaggtctcccaggttcccggccacatccccaccgcccgcaacgtcccgtgggccaaggtcgtgaacgaggacggtaccttcaagtccgacgaggagctccggaagctgtacgaagaggccggggtcgacctggacaaggagatcatcgcctactgccggatcggtgagcgctcctctatcgcgtggttcgcgctccacgagctcctcggcctgccgaacgtgaagaactacgacggatcctggaccgagtacggatctctggtcggtgttccggtggaa

SEQ ID NO: 31826 - DNA, 1418 bp, Thermobifida fusca
agcgcaccctgcgcttttcgtccccccacgcctctgcggaggcgtgttccccgaaaggactaccggcagtgggcagaatgacccccctgacgcgacgactgcgtgccggagcagccgcgatcgcgatcggagcgtctgctcttatccccctgacttcctcccccgcagccgcctcaggcaccgctgactggctgcacacggacggcaaccggatcgtggactccgcgggcaacgaggtgtggctcaccggagccaactggttcggcttcaacaccagcgaacggatgttccacgggctgtgggccgccaacatcgaggacatcaccagtgcgatggccgagcgcggcatcaacatcgtgcgtgtccccatcagcacccaactgctgttggagtggaagaacggccaggccggaccgagtggagtcaacgagtacgtcaaccccgaactggcggggatgaacaccctcgaagtgttcgactactggctgcaactgtgcgaagagtacggcctcaaagtcatgcttgacgtgcacagcgcggaggccgacaactccgggcactactacccggtctggtacaagggcgatatcaccaccgaggacttctacacggcctgggagtgggtcaccgagcggtacaagaacaacgacaccatcgtcgccgcagacatcaagaacgagccccacggcaaagccaacgagaccccgcgcgccaagtgggacggctccacggacatcgacaacttcaagcacgtctgcgagaccgccggtaagcgcatcctcgcgatcaacccgaacatgctcatcctgtgcgaggggatcgagatctaccccaaggatgggcaggactggtcctcgaccgatgggcgggactactactccacctggtggggcggcaacctgcgcggcgtcgccgaccaccccgtcgacctgggcgcccaccaggaccagttggtctactcgccgcacgactacggtcccagcgtgttcgagcagccctggttcgaaggcgagtggaaccggcagaccctgaccgaggacgtgtggcgtcccaactggctctacatccacgaagacgacatcgctccgctgctcatcggcgagtggggcggcttcctggatgggggcgacaacgagaagtggatgacggcgctgcgctcgctcatcatcgacgagaagctgcaccacaccttctgggcgctgaacccgaactcgggtgacaccggcggcctgctcaactacgactggacaacctgggacgaggccaagtacgcgttcctcaagcctgcgctgtggcaggacgccaacggcaagttcgtcggcctggaccacgatgtgccgctgggcggggtgggctccaccaccggtgtgtcgctgaaccagtactacggcgggggcggaccgagccagccgcccacg

SEQ ID NO: 31827 - DNA, 843 bp, Thermobifida fusca
cctgaccggtccaccgcccactactgggcaacgtgagaagggtgtgactccatgatcgcgatcattggggcagggcggatgggtgaagccctgctcgccggaatcctccacaccgggcgggacgccgcggaggtgctcatcagcgaagcgcgcgaagaccgcgccgcagaactctgccagcgctacggggtcgccgccgcctccccggccgaagccgccgcccgcgcagacacgctgctgctcgcagtcaaaccgcaggacatggtcgcggcgttgaacgagattgccccggcactgccccccgggcgcctggtgatctccgtagccgccggaatcaccacagccgtgctggaaaagcaccttcccgcggagaccgccgtggtccgagccatgcccaacacccctgccctggtcggccaggggatgaccgccatcgcagccggaacccacacccttgaggagcacctcgaccgcgcggagaccctgctccgatcggtgggcgaggtcgtgcgcgtaccggagaagcacctggacgcggtcaccgccctctccggaagcggccctgcctacttctacctcgtcgcggaagcgatgatcgaagccggagtgctcctggggctgccgcggccgaccgccgagcggctcgtcacccagaccgcggtgggctccgcggcaatgctgcgcgactccggggaccatccgaccctgttgcgggaagcagtgacctcgcccgggggaacgaccgccgctgccctgcgggaactcgaacgccacggcctgcgcagcgcgttcgctgacgcggtggaagccgcgtgccggcggagcgcggaactcgctgaaggc

SEQ ID NO: 31828 - DNA, 1095 bp, Thermobifida fusca
cttgcgcccgtccgggtcgagctgaccatggagctctgccgccgcctcggcgtgttcgatgcgcccggtgtctccttcgcaccggtcgagcctgctgacgacgccctgctggagcttgtccacagccgcgactacatcgctgccgtcaagcaggcagggaaaaccctggaacccaacatgaagtacgcgctgggcaccagcgacaacccggtcttccccgacatgcacgaagcgtccgccctggttgcaggcgcgtccgtggcggcggcgcgcgccgtgtggcagggggaggcggagcacggcgcgaacatcgcgggcggcctgcaccacgccatgcccaacaaggcctggggattctgcgtctataacgacgccgcggtcgccatcgcctggctgctggagcagggcgccaaacgggtcgcctacgtggacgtggacgtccaccacggtgacggggtgcaggagatgttctacaacgacccccgggtgctcaccatcagcctgcacgagtcccccctgaccctcttccccggcaccgggtaccccgaggagatcggcggcccggacgcggaaggctatgcggtcaacgtggccctgcccgcggggacgaacgacgccatgtggctccgcgcgttccacgccatcgtcccgccgctgctgcgcgagttccagccggaggtgctcgtcacccagcagggctgcgacacccacaccctcgacccactggccaacctgacgctcagtatcgacgggcagcgccggacctacgaggccctccacgagctggccaaggagaccgccgcagggcgctgggtgctgctcggcggcggcggatacgagctggtgcaggtggtgccgcgtgcgtggacccacctgctggccgaagccgcgggcaccccgatcgacccggagacccgcacccctgatgagtggcacgagttcgtcaaggaacgcaccggcgaggtcccgcccctgcacatgacggacgggcggaaagccgactacgtcccgttcgaagcgggcttcgacccggcggacgcggtggaccgcgcgatccgggcgacccgggccgcggtgttcccgtgccacggcatc

SEQ ID NO: 31829 - DNA, 1522 bp, Thermobifida fusca
atgcgtaccgtgagcggcccgacggaccacgtcgtcgtggtgggggcaggcctgtccgggctcgccgcaaccctgcacctgctcggtgcgggacgccgggtcaccgtctttgagcgtgaggagtacccgggcggccgggcgggacagctcgacctggacggcttccacatcgacaccggtccgaccgtgctcaccatgcccgacctgctcgacgaggcactggccgcggtaggcgaatccctcagcgaccgcctcgacctggtccagctctcccccgcgtaccgtgccgtcttccccgacggatcggtgctcaacgtccacaccaacgcggacgctatggccgacgaggtcgctcgcgtgtgcggatcacacgacgccaaggggtacctgcggctacgcgcctggctgcgggaactgtacgagctggagatggcccggttcatcgacacgaacttcgactccccgttcacgctcctctcccccgagcttgtccggctggccgccctcggcggtttccggagcctctccgcggcggtaggccggttcgtccgcgacgagcggctgcgccgcatcttctcgttccagtccctgtacgcgggggtaccaccgcaccgcgccctcgccgcttacgcggtcatcgcgtacatggacaccgtcgccggcgtctacttcccgcgcggcggcatgcgttccctgggagaagccctggccgccgcagccaccaaagccggggcggaactgcactacggaaggactgtcacccggctggaacggcgcggcaaccgagtgcgtgccgtggtgcttgccgacggggaacgggtgccctgcgacgccgtggtcgtcaccgtggacctgcccttggcctaccgtctcctcggccggaccccgtggcggatcgtccccctccagttcgctccctccgcggtcgtcctccacgcgggcaccgaccgcacctggccggtgctcgaccaccacaccctcctgttcggcacggcgtggcggcgtactttcaccgagatcacccggttggggaaaccgatgagcgacccttcgctcctggtgacgcagccgaccgtgaccgaccgcagcctggccccgcctgggcggcacctgctctccgtggtcgcgccctgcccgaatctgcgcactgggcggatcgactgggtgtccttcggccctcgctaccgggagcagctcggagcagtcctggaggaccgcggcctcaccggattctccgagtctgtgcgcgtcgaacggctcgtcaccccgcacgactggtcgcacatggggcacgcgttcggcaccccgttcgctaccgcgcacaccctcttccagaccggtccgttccggccgcgcaacctcgtgtcggggatcgccaacgcggtcttggcgggatgcgggaccactccgggggtgggcctgccgacggtcctcatctcggggaagctcgccgcggcacggatcaccgggtgcacctcgcccacgcggtccacgatcaccggttcggggagacggcggtgaa

SEQ ID NO: 31830 - DNA, 1593 bp, Thermobifida fusca
gccttcccgaaccgtgaggactgggccctgcccacggtgctgcgccaccgcgccgcccaggcccccgacgcgatctacctcgacactccggaagagggccggcgctggacgtacgctgagacgctcgccaccgccgaaaaggtcggccgttcactgctcgcgcacggcgagccgggagaccgggtgctcatcatggcccgcaactcctcggcgttcatcttcacctggctcggcagcgccatggcgggcatggtcgaagcccccatcaacaccgcctacaagggcgacttcctcacccaccaggtgcgtgtcgcacgtccccgctgggccgtgatcgacgccgagctcgccgaccgcttcaccgacgtcgccgacgagatcgaggacatcgaacgcttctgggtgatcgacaacggcgacgtcgaccaggcgatcgacaagctgcgcaaggccggatggcaggcggaacggtgggaggacctgaccgtcgaccgtgacggagaactgcccgaggtctccccgcgctccctggcctccatcttcttcacctccggcaccaccgggccgtccaagggcgtggcgatgccgcacgcgcagatgttcttcttcgccgcggagaccgcctgcctgacccggctcaccgacaaggacgcggccatggcggtcaccccgctgttccacggcaacgcccagttcatgtcggcctaccccgcactgatcagcggcgcccgcttcgtgctgcgcagccggttcagcgccagccggtggatcgatcagatccgggagtcgcaggtcacggtcaccaacttcatcggcgtgatgatggacttcgtctacaagcagccgcgccgacccgatgacgccgacaacccgctgcgctgcatcttcgcggctcccacggcttcctccatcctcgaagacttcaagaagcgcttcggtatcgaggcgttcgtcgaggtcttcggcctgaccgagacgtccgcgccgatcctgtcgccctacggggaggaccggcctgcgggtgcggccggactcgtggccgacgactggttcgacgtgcgcctggtcgacccggagaccgacgaggaagtccctgtcggcgaggtcggcgaactggtggtgcggcccaaggtcccgtggatcaccagcctgggctactacggcatgccggagaagaccgccgaggcctggcgcaacctgtggttccacaccggggacgcgctgcgccgcgacgaagagggctggttctacttcgtcgaccgctacaaggacgcgctgcgccgccgcggcgagaacatcagctcttatgaggtggagcaggcgatcctcggctacaagtcggtcgtggagtgcgcggtcgtcgccgtgcccgccgacgtggacgcgggcgaggacgaagtgatggcgtgcgtcgtggtgcgcgagcccaccacccccgaggagctgtgggagtggtgcgactcccgtctgcccgccttcgctgtcccgcgctacctgcgcttcgtggaggcgctgcccaagacgccctcggagaaggtgcagaaggcggtgctgcgggagcagggggtcaccacggacacccacgaccgggag

SEQ ID NO: 31831 - DNA, 720 bp, Thermobifida fusca
ctcaacggcaaggtcgccctcgtcaccggtgcgagccggggaatcggggccgcgatcgcccgcggctacgctgaacgcggcgcgctcgtcgtcggagcagcccgctccaccgaccagttgcgcgaactcgaggccacgaacccggagcgcatctccaccgccaccgtcgacctgcgcgacgcggagtcgctcaacagcctcgtcgacctcgtcgtcgaacggcacggacggatcgacatcctcgtcaacaacgccggcgtggccccggcagccgacttcgccaccgagcccatcgagcagtggcgcaccaccttcgaggtgaacgtcatcgccccgatgaccctggcccaagccgccggccgctacttcatcccgcagcgcagcggcaagatcatcaacatcgcttcgaccaccggtatccgcggcaagcccggactggtcggctactccgcctccaagggcgccgtagcgcggttcaccgaagccctggctgccgagtgggcccgccacaacatccaggtcaactgcatcgcccccggcgctttcgccactgacgcgcaaagcgcggtcctggagtcgcccgacctgctccaccgccgggtgcgccgcatccccgccaagcgcatgggagacgtctccgagctcgtcccgctggcctgcctgctggccgcccccggttccgacttcatcaccggctccatcttcgtcatcgacggcggc

SEQ ID NO: 31832 - DNA, 1374 bp, Thermobifida fusca
gccggcgagacctgggacgtctacaaccccgccaccgaagaggtcatcgccaccgtcagcggagccactaaagaacaggtcgacgaggcgatccgggccgcccgcaccgccttcgacacctggtcgaagatgtcgggcgaggagcggtccgccgccatgcacagcctcgccgaccgcttggaggcccggtgggaggagctgctggcctccatcgtcaacgaggtgggcacccccgtctccaccgccgagttcctccaggtgaagatgggtctcggccacctgcgctggttcgctgacgcggcgaagaaggaccgcaccgtccacctgggcccctacgacgtgcccgtgccgacgatgagcgacgtcgaccactacccggtgggtgtggtcgccgcgatcaccggctacaactacccgctcaacctggctggcttcaagtacggtgcggcgctggccgcgggctgcaccgtggtgctgctgccgtcgccgcgcaccccgctgaccaccctgctgctcggcgagatcatccgcgagtcggacctgcccgacggggtgatcaacgtcgtcctcggtggggcggacatcggccagtacctgtcctcccacccgggcgtggacaaggtgtccttcaccggttctgacgcggtgggcgccaagatcatggagcaggcggcggccaacctcaacgacgtcgtcctggagctgggcggcaagtccgccaacatcgtcctgcccggctgcgacgtggagtccttcgcggtggacatgcacatgcgctggtcccgcaactccggccaggggtgtgcggcactggcccggctgctggtccacgaggacctcttcgaccgcttcatgaaggcgggcgccgaggcgttcccgaagatgaaggtcggcgacccgtgggacccggagacccacatcggcccgctgatccgccccgatcaccgcgaccgcgtcaacgggttcatcaccgaggcgctcgagcagggcggcaaggcgctcctccaggtggagaccccgctgccggagaagggctggtacgtcaacccgatcctgctgggcaacctgccgcacagcgcccgcgccgtgcagcaggagatcttcggcccggtcgccgtcgtcctcacctacaaggacgtcgacgaggcgatccggctggccaacgacaccgcctacggcctggctgccaacgtgtgggcgcccaccctggaggagggccgccgcgtggccgagcagttgcgggccggcaccgtgtggatcaacggcggcggtgcaatgcgtcccgacgcacccttcggcggctcgggccgttccggtatcggcagggagctcggtgagtggggcatccaggagttcctggagccgcgccacatc

SEQ ID NO: 31833 - DNA, 1164 bp, Thermobifida fusca
atggacttcagcaaagacacggtgcacgaggacatccgccaagcagtccgggacctgtgcgccaaattccccgacgaatactggatgaagcacgaccagtcgcaggaattcccctgggagttctacaacgccatcgtcgaggcgggctggttgggcttgaccgtccccaccgagtacggcggcggcggactcggcgtcaccgaagccgccatcgtggaacaggagatcgccgcctccggcgcgggcatgaacggatgcagcgccgtccacatcggcatcttcggtttcgaaccgatcatcaagtacggcagcgaagacctcaaacagcgtttcctgccccgcctggtcagcggtgacctgcacgtgtccttcgccgtgaccgagcccgacgccggcacggacaccaccaacctctccaccttcgcccgcaaggtcgacggcggctggctggtctccggcaagaaggtctggatcaccaaggcccaggaagccgaacggctcatcctcctggcccgcaccaccccgcgcgaccaggtggccaagaagaccgacgggctcaccctgttcttcgcgcccatggaccgcgaacgggtcaccgtgcgccccatccccaagatgggccgcaacgcggtcgacaccaacgagctgttcatcgacgacctgttcgttcccgacgaagacgtcatcggcgaagtcggaaagggcttcaagaccatcctggccgggctcaacgccgagcgggtcatctccgccaacgccgccatcggcatcggccgcgccgccctgcgccgggccaccaactacgccaaggaacgcgtcgtcttcggccgtcccatcggcaagaaccagggcatcgccttccccctggctgaagccctgatcaaactcgacgccgcggacctgatgtgccagcaggccgcctggctgatcgacaacggctaccccgcgggacggcaagccaacgccgccaagttcctggctgccgaagccggattcttcgccgcggacgcggcactgagcgtgcacggcggctacggctacagcaaggagtaccacatcgaacggtacttccgggaagcccggctgatgcgcatcgcccccatcagccaggaaatggtcctcaactacgtggccgagcacgttctgggtctgccgaggagctac

SEQ ID NO: 31834 - DNA, 738 bp, Thermobifida fusca
cgtatcgccgccatcgtcggcggtggatccggtatgggccgcgccatctcgcaccgcctggcctcagagggagccaccgtctacgtcgctgacctcagcgaagagtccgcgaagaaagtcgccgaggagatcaccgcccaaggcggcaaggccgttcccgtccaggtcgacgccaccaacaacgacagcctccgggcgctgttcgaccgcatccgctccgaccacggcgtcctccacgtcctccacgcccaagtcggtatgcccggccccggcggcatcgagaccagcgacgaggagtggcagaagaacatcgacgtcaacatcaagagcgcctactacacctgcaccctcggctacgacctcctcaaatccgccaacggcaaggggtcgatcaccatgacctcctccacctcggcgctcgtcggatccccctttagccccatctactcgctgaccaagggctcccttgtccccttcgcccgcgccctcgcactcaagggcgccccggacggcatccgcgtcaacgtcatctgccccggcaccgtgcagacccccatgctcgcccagttcttcggtcgggaaccgggagccgacgtctccgagctgaccaaggacttcatcaagaacatcccgctcggccgcggtgcccagcctgaagagatcgcctcggtcatcgcgttcctcgccagcgacgacgccagctacgtcaccggcgtcaccatccctgtcgacggcggc

SEQ ID NO: 31835 - DNA, 1116 bp, Thermobifida fusca
ttcgacctgggaccgcgtcaccgcgagatccagcgcatcgcgcggtccgtggccgagcgggtggaagagtacgctgacgaggcagacgcggcggtcgaggtccaccagggcgtggcagagatcctgcgggagagcggtctggcacgccatgtggttcccgccgcctacgggggagaaagcgacgttctcgacccactggcgatcgccgtcatccgcgaagcgctgatgtacacctcggcccacctggactccctcttcggcatgcagggggtgggcagctactcgctggcggtcggcggaaccgaggagctcaaacgcgagtggctccctaaggtggcgcgcctggaagcgatcgccggactcgccctgaccgaaccggacatcggctccgacctgcgcggggtcaccacgacgatcgaggccacccccaccggggtgcgggtcagcggacgcaagtcgttcatcaccaacggcggtgccgccgacttctactgtgtcctcggccgggagggcgagggctactccatggtgctggttcccgccgacacccccgggctgacggtcgagcgtggcgacgacctgatcgctccgcacatcctcggcgaactgcacttcgacggtgcggaagtgcccgaaaaccaccggctcggcgtgccgggtaaagcgttctccctcatgctgcagacactcgcggtgttccgggtcaccgtggcgggctcggcggtcggcctggcccaggctgcgctggacgaggcgctacgccacgccaagacccgtacccagttcggccgcccgctcctggaactgggggcagtgtcccagagcctggccctgtcgtggaccgaggtggagacggcccgggccatcacctaccgagcggcagcgctcgccaagaacgatccgctcgcgcacctggactactcctcgatcgccaaggtcagcgcaacggaggcggctggacgagtggtcgaccgcgcggtgcaggccatgggccgcttcgggctgatccgcgggtccaagatcgagcgcctctaccgcaatgcccgcccgctccgcatctacgagggcgccacggaggtcctgctcgactccctggcccgcaggctcgccaagcgc

SEQ ID NO: 31836 - DNA, 1116 bp, Thermobifida fusca
gagtacacggagatccgcgaactggcttcaaaggtcgcccgcgaggtatacgggccgatcgccgagcaactggacgtggaacggaagccgatctcccgcgaagagcggatccgtctcggggagctcggattcctcggcatcgcccaccaggagcgttacggcggtgccggagccccgctggcccaggcgctggcggtgattgaggagtttgcccgggtctgccgcccggccgccttccagatcttcgaggccaacaccggtccggcccaggtgatcaactacctggggactgaagagcagcgcgaacgctggctgccggacatcatctccggtgagaagaccatggcggtcgctatttccgagcccgacgccggatcggccgcaaccgacatgcgcaccacggcccgcccctccggcgacggctacgtcatcaccggaaccaaacggtggatctccaacggcggtgaagccgacctctacctcgtctacgcccgcctcaccgacgaacccggctccaaggggatcggcgccctcgtcgtcgagaaaggcacccccggcctcagcttcggtccccccgaacggctcatgggcttccgcggcattccctccgctgacgtcatcctcgacgaagtctgggtccccaaggagaacttggtcgtccccgccggcggttttggcaagctgttcggagtcttctccatcgagcggctcggcaacaccaccatgagcctcggcatcggccaggaggcactcgaccgcaccatcgcctatgtccaagagcgggagcagttcggcaaaccgctcatcgagttccaaagtgtccagatcactttggccgacatggtgatgcaagtggactccgcgcgcctgctgcagcagcgcgccgcggccagcgccgagggcgggaagctgcccgacccgctgcaggtctccctggccaagtgcgccgccaacgagatggccaagcgcgtgaccgacatggccatgcaactgcacggcggcaacgggtacacggaagagtacggcatcgagcggctgcaccgggacgcccacggctgggctatcgcgggcggtaccccgaacatgcagcggatccgaatcgtctccgagctgctg

SEQ ID NO: 31837 - DNA, 1164 bp, Thermobifida fusca
gtcatcgtcgacgcggtgcgcaccgccgccggtcgcggacgtgagggcggagccctcgccgacgtccacccggtggacctgctcgcccagacgctccgccaactgatttcgcgccacgacctcgacccggggaccgtggacgacgtcatcattggctgtgtgtcgcaggtgggcgagcagtcggcgacccccggacgcatggcctggcttggcgctggtttccccacccatgtgccggcgacaacgatcgaccgcaagtgcggctccagtcagcaggcagtccactttgccgcccaaggcatcatggccggcgtctacgacatcgtggtcgccggcggtgtcgagtcgatgagccgcgtcgtcatgggttccgcgcgtatgggcgctgacccctacggcaccctcgtcgccaagcgctaccacccgggcctcgtctcccagggagtggcggccgaactggtcgcggcgcgctggaacctggaccgcaccgcgctggacgagtactcggtccgctcccacacgctggccgcccaaacccaagaagcaggactgttcgaccgggagatcatcccggtggagacgccgtccggcacggtcaaccgcgacgagacgatccgccccaacagcaccgtcgagaaactcgccaccctcaaaaccgtcttcggcacccccgagctgtccgagcgtttcccggagatcgagtggcggatcaccgcgggcaactcctcccagatcacggacggggccagtgcgctgctgctgatgagccgcgccaagtgcgaagagctcggctacaccccgcgtgcccgcatccactccatggcggtgtgcggtgacgacccgctgctcatgctgacggcccccatccccgccacccggaaggtcctggaacgctccggcctttcgctgtccgacatcgaccacgtcgagatcaacgaagccttcgctccggtccccctggcctggctctccgagttcgacatcgacatcgacaaggtcaacccccggggcggcgcgatcgcgctaggccacccgctcggcgcctcgggcgcgcggctgatgaccacgatgctgcacgccctggaagacaacgaccagcagttcggcctgcaactgatgtgcgaggccggcggtatggccaacgccaccatcatcgaacgcatc

SEQ ID NO: 31838 - DNA, 1035 bp, Thermobifida fusca
cccactctcgccgttgtgggggccaccggtgcggtgggcactgtcatgttggacattctttccacgcgtaagaacgtgtggggggagatccgcctggtggcgtcggcccggtctgcgggcaagcggctcacggtccgcggcgaggaggtcgaggttcaggctatttccccggaggtcttcgacggggtcgacgtggccatgttcgacgtccccgacgaggtgtccaaggagtgggcgccgatcgcggcggagcggggcgcggttgtcgtggacaactctggtgcgttccgtttggacgacgacgtgccgctggtggtgcctgaggtcaacgccgagcaggtgcgcaaccgtccgcgcaacatcatcagcaacccgaactgcacgaccctgtcgatgattgtggcgatcggggcgctgcaccgggcctacgggctgacggacctggtggtgagctcgtaccaggcggcgtccggtgcgggccagcagggggtcgacacgctgtacgaccagatcgccaaggtggcgacggaccgcacgttgggtactcgtgcgggggatgtgcgggctgcggtgagcgacttgggtccgttcccggcgccgctggcgttgaacgtggtgccatgggcggggtcgttgaaggacgacggctggtcgtcggaggagttgaaggtccgcaacgagtcccggaagatcctcggactgcctgacctgcgggtgtcggcaacgtgtgtgcgcgtgccggtggtgaccacccactcgcttgcgatccacgcgacgttctccacggaggtggatgcggacgaggcgcggcgcctgctggcttcctctcctggcgtggtggtccaggacgacccggcgaagggcgagttcccgaccccgattgacgtggtcggtacggacccgacgtgggtgggacggatccgccgttcgctggacgacccgcggtcgctggacttgttcctgtgtggggacaacttgcgtaagggtgcggcgttgaacaccgcccagatcgctgagctgctcgctgaggagttc

SEQ ID NO: 31839 - DNA, 1269 bp, Thermobifida fusca
gtggctttgatcgtgcaaaagtacggcgggtcgtccgtcgctgatgcggatgccattaagcgggtagccgaacggatcgtcgctcagaagaaagccggatacgacgtggtcgtcgtggtctccgccatgggcgacaccactgacgagcttctcgaccttgcgaagcaggtgagtccgctcccgccgggccgggagttggacatgctgctgactgccggggagcggatctcgatggccctggttgcgatggctatcgggaacttgggctatgaggcccggtcgttcaccggttcgcaggccggggtgatcaccacgtcgctgcacggcaacgcgaagatcatcgatgtcaccccggggcggatcagggatgcgctcgccgaaggggcgatctgcatcgtcgctggcttccaaggggtgtcgcaggacagcaaggacatcaccacgttgggccgcggtggttcggacactacggctgtggcgcttgctgcggcgctcaacgccgacttgtgcgagatctacaccgacgtcgacggggtgttcactgctgatccgcgtatcgtgccctccgctcgacgcatcccccagatctcctacgaggagatgctggagatggcggcctccggcgccaagatcctgcatctgcgctgcgtggagtatgcgcggcggtacaacattccgctgcacgtgcgctcgtctttcagtcagaagcccggtacctgggtcgtctcggaagttgaggaaaccgaaggcatggaacaaccgatcatctccggcgtggcgcatgaccggagcgaagccaagatcacggttgtgggggtgcccgaccgtgtcggcgaggcagcagcgatcttcaaggcgctggccgacgctgagatcaacgtggacatgatcgtgcagaacgtgtccgcggcttccacgtcgcgtacggacatttctttcactctgcctgccgactcggggcagaacgcgctggccgcgttgaagaagatccaggacaaggtcggtttcgagtcgctgctgtacaacgaccggatcggcaaggtgtcgctgatcggcgcggggatgcgctcctatccgggggtgactgctcggttctttgacgctgtggcccgcgagggcatcaacatcgagatgatttccacttccgagatccgcatctcgatcgtggtggcgcaggacgacgtggacgccgcagtggccgccgcgcaccgtgagttccagttggacgccgaccaggtcgaggccgttgtgtatggaggtaccggccga

SEQ ID NO: 31840 - DNA, 1137 bp, Thermobifida fusca
ccccgcgaacccgccagaggggcgataaaaccgaaaaatccccgcccggcagcgccccaacccccctggtccccgccccgggtccagccaccccggtggaaacaactcatcacgaagaaacccgtggccggcatcctcaccgcagtcgccacggccggcctcgtcgtgtccttcctcgtctggcagtggacactccccgagaccccgctgcgccccgacagcagcaccgccccctcagagtccgctgacccgcacgaactcaacgagcctcgcatcctcaccaccgaccgggaagcggttgccgtcgcattcagccccggcggatccctcctcgccggcggcagcggcgacaaactcatccacgtgtgggacgtggcaagcggcgacgaactccacaccctggaaggccacaccgactgggtgcgtgccgtcgcgttcagccccgacggcgccctcctcgccagcggcagcgacgacgccaccgtgcggctgtgggacgtggccgccgcagaagaacgagccgttttcgaaggacacacccactacgtgctggacatcgcgttcagccccgacggctcgatggtggccagcggtagcagagacggcaccgcccggctgtggaacgtcgccaccgggacagaacacgccgtcctcaaagggcacaccgactacgtctacgctgtcgcgttcagccccgacggctcgatggtggccagcggcagcagagacggcaccatccgcctgtgggatgtcgccaccggaaaagaacgcgacgtgctgcaagcacccgccgagaatgtcgtctccctcgcgttcagccccgacgggagcatgctcgtccacggcagcgacagcaccgtccacctgtgggacgtagccagcggcgaagcactgcacaccttcgaaggccacaccgactgggtgcgtgctgtcgcgttcagccccgacggcgccctcctcgccagcggcagcgacgaccgcaccatccgcctgtgggatgtcgccgcccaggaagaacacacaaccctggaagggcacaccgagcccgtccactccgtagccttccacccggaaggcaccacgctagccagcgcaagcgaagacggcactatccgtatctggcccatcgccacggaa

SEQ ID NO: 31841 - DNA, 894 bp, Thermobifida fusca
gactccagcttggttccccggtttgctggtccggcgacttttgcccgactgccccgcaccgatgaggtagccaagaccgatatcgccgtggtcggtatcccgttcgacagcggtgtgtcctaccgtcccggcgcccggttcggtcctgctgctatccgtgaggctagtcggctgctgcgcccctacaacccggggttggatgtgtccccgttcgctgaagtccaggtggccgacggcggtgacatcgcggtcaacccgttcgcgatcaaggaggccattgcaacggtcgaagcctcagccagcgagttgttgtctcagggtactcgcttggtgactttgggtggagaccacacgatcgcgttgccgctgctccgcgccgtgcaccgggtgcacgggccggtggcgctcctgcacttcgacgcccatttggacacgtgggacacctatttcggtgagccttacacgcacggcaccccgttccgccgtgccgtggaggaggggattctcgacacggaagccctcacccacgtggggatccgcggccccctctacggcaagaaggacttggaggacgaccgccggttcggtttcggtatcgtcaccgccgcggacgtgatgcgccgcggggtggacgagatcgctgacatggtgcggcagcggatcgggaaccggccgctatacgtgtccgtggacatcgacgtcctcgacccggcgcacgctcccggcaccggcaccccggaggcgggcggcctgaccagccgggaactgttggagctgctgcgtgggctggcctcctgcaacctggtgggggccgacgtggtggaggtttcccccgcatacgaccacgcgcagatcacggcgaccgcggccgcccacgtcgcctacgacttggtg

SEQ ID NO: 31842 - DNA, 1131 bp, Thermobifida fusca
gtcacacgcttgatgccgtcccaagaaaccgcagacctggtcgaactcgtccgcgaagtagcgtcgcgggaactcgcaccacacgtcgccgaagccgaagaaaccgaacgcttcccccgagaagcgttccgcacactcggcaaactcggtgtcctcggcctcccctacccggaggagtacggcggaggcggccaaccctacgaggcctatctcaacatcctcgaagaaatcggagcagtctgggcctccgtcggcgtcggcgtcagcgtgcacgtactctcctgctacgccctcgccgtctacggcaccgaagcacaacggcaacggtggcttcccgacctcctcagcggcgacctgctcggcgcctactgcctctccgaaccgcacgccggctccgaccccgccgccatgaccacccgtgcccgacgcgacggcgaccactacatcctcgacggcgtgaaagcgtggatcacccacggcgggcaagccgacttctacacggtcatggcccgcaccagcgacgaccgttcccgcggcatctcctgcttcctcgtccccgccgacaccccgggcctgagcgccgaccgccccgaacggaaaatggggctgaccgcctcgcacaccaccatgctgcgcttcgacggggtgcgcatccccgccgaccagcgcatcggcgccgaaggccaaggcctgtcgatcgcgctgtcctccctcgacgccggacggctcggcatcgccgccgttgccaccggcctagcccaagccgcgctcgacaccgccgtcgactacgcccggcagcgcgaagccttcggcaaacccatcatcgaacatcaagggcttgccttcctgctcgccgacatggccgcagccgtagaaaccgcccgcgccgccaccctgcgcgccgcccgcctcaaagactccggcctgccctacagcaaagaagcgtccatcgccaaactcatcgccaccgacaacgcgatgcgcgtcaccaccgacgcagtccaagtcctcggcggctacggctacacgcgcgacttccccgtcgaacgctacatgcgcgaagccaaagtcatgcagatcttcgaaggcaccaaccagatccagcggctcgtcatcggccgccacctcgcc

SEQ ID NO: 31843 - DNA, 831 bp, Thermobifida fusca
gttggagtggtcgggctcggcacgatgggcgccggcatcgtcgaagtgttcgcccgtgcgggcttcaccgtcaccggggtcgaaatcgacgacgccgccctggaacgcggccggacacacctggagaaatccctggccaaagccgtcgccaaaggcaaactcactgaagacgagcaacgcgccatcctcggacgcgtcacattcaccacatcccgcgacgacctcgccgacgcgcacctcgctgtggaggcagtcccggagcgcctcgacatcaaacgctctgtctttgcagacctggaccgcatcctgccgcccgccgcgatcctggcgaccaacacgtcctcgctgtccgtcaccgaaatcgccgcactcaccagccgcccaggaaaagtcatcgggctgcacttcttcaaccctgcaccggtgatgcggctcgtcgaaatcgtcaccacggtcgtcaccgaaccccacgtgcgcgagacagcgacccaggtcgtcacccggctgggcaagaccccggtagcggtcggcgaccgggccgggtttgtggccaacgcgctgctcgtgccgtacctcaaccacgccgtcgccgtctatgagcagggcctggccacccgggagcagatcgacgccgccatcaccagcgcggcaggattccccatggggccgctcaccttgatggatctcgtcggcctggacgtgctcctcgacgtcatggacgtcctgtgggacgaattccgccgcccccgctacgcggcggccccgctgctgcgccgcatggtggccgcgggcctgctcggccgcaagagcggacgcggattctacgactac

SEQ ID NO: 31844 - DNA, 1158 bp, Thermobifida fusca
gtcattgtcggcggcgcacgcacccccatcggaaagctcctcggagcactctccggtttcgccgccgtggacctgggggcgatagcgatcaaagctgccctgcagcgggcagggatctccggtgaccaggtggactacgtcatcatgggccaggtcctgcaggccggccaggggcagatcccctcacggcaggcctccgtcaaagccggaatccccatgagcgtgccttcgctcaccatcaacaaagtctgcctctccggcctcgacgcgatcgccttggctgatcagctcattaccgccggggaattcgacgtggtcgtggccggcggaatggaatccatgacgaatgccccgcacgtcctccccaaagcccgccacggctacaagtacggctccatcgaggtcctcgacgccaccgcccacgacgccctgaccgacgctttcgaccacgtgtccatgggcctgtccacggagcggtacaacgcccgccacggcatgacccgggaagagcaggacgcgttcgcggcgcgctcccaccagcgggccgccgccgctatcgaagcgggactgttcaaagacgagatcgtccccgtcgaagtaccgcggcggaaaggcgaccccacgatcgtcgacaccgacgaaggggtgcgccccgacaccactgtggaagccctggcccggctgcgccccgcgttcgacccggacggcacgatcaccgctggatcctcctcccagatctccgatggcgcgtgcgcggtcgtggtgatgagccggacgaaagcagaagagctgggatgcgagatcctcgcggagatccaggcgcacggcaacgtcgcaggcccggacaactccctgcactgccagccggcgaacgcgatcaagcacgcgctggccaaagcgggacgggatgtcgctgacctcgacctcgtcgagatcaacgaggcgttcgccagcgtggccatccagtccatgcgcgagctgggcgtcagcgaggacatcgtcaacgtcaacggcggagcgatcgcgctaggccacccggtcggcatgtcgggggcacggatcgtgctgcacctcgtccacgagctgcgccgccgcggcggtggactgggtgccgcaggcctgtgcggcggcggcgggcagggcgacgccctcctgctg

SEQ ID NO: 31845 - DNA, 1701 bp, Thermobifida fusca
gtcgtgggatccgcggcccacccgtcgtccttgtggaaggaactgtctcgtttcggccagttgtcggggtgccgctgggcggctttgggccgtacctcgaccgcgccgtagccgcacgtgtcctgaccggggggccgcatgcacagcattccctccccctggtcgacctcccacccctggggcgcgttgatcttgacgccctcaatgttgagctgggtgaaccccgcgggtgcgggcgcctcggcagcttcgaggacaccgccgtaggtggcctccggttcgggaacggggggacgctccgacgaggccgagtcggagtcgtcgctgcaccccgtcattgccagggctccggcggccaaagccgccatcaggcggacggggagacgtctccgaggggcttcgaaccgcgatcggctggggatgccggacatgcgattcccttctctacacgcttgacctcaacgacgatagcgggcgaatctgacgttctgcgccacactctgtgacaccgaccgcccagatgcgagaggacccccggtgcgtatcatcggctactttccccaatggggtatctacgaccgtcactactttctccgtgacgtccactccagcggacaggcagccaaactcacccacctcacctacgctttcggcgagctggacgagaaaggcgtctgtgtcatgaccgacgaggcgaccggggacgcctgggcggactaccaatgtcggttcagcactgcgcaaagcgtagacggccggggcgattcctatgaacagcccctggccggaaactttaaccagctccggaaactgaagaaacggcaccggcacctcaaggtggggatctccttcggcggctggaacgcctcccgctacttttccaacgccgcacgcacccccgcgtcacgggccgcgttcgcttcttccctggtctccctctacttcgacggcaatctccccatcctgccgggcgagccccagggcggccccggggtggcggcgggaatcttcgactatgtcgacttcgactgggagtggccagggtccccgggccacgagcacaacgtggtccgggcagaagaccggcgcaactacacgctgctcgtcgccgagacccgccgccagttggacgcgttcacggcccggactggccgccccgtggagatcagcgcctacctgcccgccgacccggagcgggccgcggcagggatcgaaccggagctcttcgactacctggatttcgggatcgtccagggctacgacttcaacggcgactgggacctgaccacgaaccacgcgtcccagttgtacacgcccccggatgacccttcgccccgcaaactcagcctggacgtcggcgtagttacctacctggaaatgggggttcccccggagaagctggtgatcagcgtgcccggcttcggtcggggctggcgcggggtgccccgcggccgccgcaacggcctctaccaacgagcccgggaagtcgcccccggcacctgggagccgggggacgaagactacaagaccttggcgcgccgccccgggcggcggttccgcgaccgggagtacggggcgctgtggctgtacgacgggaacgagttctggagctacgacgacccggaaatcatccggatgaaagccgcctacgccaaagacctggggctgggcgggttgagcctgtggtcgctggacaacgac

SEQ ID NO: 31846 - DNA, 1671 bp, Thermobifida fusca
gttcccgacacgttcacccacgcaaagccgcgcgacccctactggtacaagcacgcggtgttctacgaagtcctcgtccgcggcttctacgactccaacggggacggcaccggcgacttgcggggcctcatcgaaaaactggactacctgcagtggctcggcatcgactgcctctggctgctgccgatctacgagtccccgctccgcgacggcggctacgacgtctccgactacatgaagatcctgcccgagttcggccggatctccgacttcgtggaactcgtcgaaaaagcccaccagcggggcatccgggtcatcaccgacctggtcatgaaccacaccagcgaccagcacccgtggttccaagcctcccggcacgaccccgacggaccgtacggcaacttctacgtctggtcggacaccacggaacgctacagcgacgcgcgcatcatcttcatcgacaccgagcagtccaactggacctacgacgaagtgcgcggacagtactactggcaccgcttcttctcccaccagcccgacctcaacttcgagaacccggacgtccaggacgccatcctcgaagtgatgcggttctggctggaccttggcatcgacggtttccgcttggacgccgtgccctacctgtacgagcgggaaggcacgaactgcgagaacctcaaggagacccacgagttcctcaaacgcatccgcgccgaagtcgaccggctctaccccgaccgggtcctgctcagcgaagccaaccagtggcccgccgacgtcgtcgactacttcggcgactacgaatccggcggcgacgaatgccacatgaacttccacttcccgctgatgccgcgcatgttcatggcggtccggcgcgaacagcgctaccccatctcggaaatcctcgcgcagaccccgcctattccgcgcaactgccagtgggcgatcttcctgcgcaaccacgacgagctgaccttggagatggtcagcgatgaagagcgggactacatgtactccgaatacgccaaagacccgcggatgcgcgccaacatggggatccgccgccggctggcacccctcctggaaaacgacctcaaccagatcaaactgttcaccgcgctgctgctgtcgctgcccggctccccggtgctctactacggcgacgagatcgggatgggcgacaacatctggctgggggaccgcgacagcgtgcgcacccccatgcagtggaccccggaccgcaacgccggattctcccgctgcgacccgggccgcctctacctgccggtgatcatggacccgatctacgggtaccaggcgatcaacgtcgaagcacagcagaacaacccgaactcgctgctgaactggacccgcaacatgatccagatccgcaagcagcacccggtgttcgggacgggggacttcaccgaactccacgcgagcaaccccagcgtgttcgcgttcgtgcgcgaatacggcgacgaccggatgctgtgcgtcaacaacctgtcccggtttccccaaccggtggaactggacctccgccgcttcgaagggatcaccccgatcgaatgcacggggggagtgcacttcccgcccatcggggaactgccctacctgctgactctccccgggcacggcttctactggttccagcttccgcccgtcgcc

SEQ ID NO: 31847 - DNA, 1047 bp, Thermobifida fusca
gctcgtactgtgaagctggccgtgatccccggtgacggcatcgggcccgaagtcgttgccgaagggctcaaggtcctctccgccgtcgccccccggcacggactcaccctcgacaccaccgagtacgagttgggtgcccaacggtggcatgccaccggtgaggtcctgccggacgcggtcgaggaggagctgcgccagcacgacgccatcctccttggagcggtcggcgaccccacggtgcccagtggagtcctggagcgtggcctgttgctgcggttgcgcttcaacttctcgcactacgtcaacctgcggccggtccggctctacccgggggtgaccaccccgctggccggtgtcgcacccgaagacatcgacatgctggtcgtgcgcgagggaactgagggcccctacgccggcatgggaggcgtgctgcgcaagggcaccccccacgagatcgccacccaggacagcgtcaacactcgtctcggtgtggaacgcgtcgtccgctacgccttcgccaaagccgctgagcgtccctgtcacaagctcaccctggtccacaaggacaacgtgctgacctacgccggcgaactgtggcagcgcgtggtccgcgaggtcggcgccgaatacccccaggtcgaagtcgactacctgcacgtcgacgcagccaccatgttcttcgtgacccagccgcggcgctttgacgtggtggtcaccgacaacctcttcggcgacatcatcaccgacctcggcgcggccgtggccggcggtatcggcctggccgctagtggcaacatcaaccccgagggcgacttccccagcatgttcgagccggtgcacggatccgcacccgacatcgcaggacagggcaaggctgaccccacggcgactatcctgtctgtctccctcatgctggaacacctgggctacgccgacgcagcagcacaaatcgaccaggcggtagccgaggacctgcaggaacgtgctaagaacggtggagtccgctccaccacccagattggcgacgacatcgctcagcgagtagcg

SEQ ID NO: 31848 - DNA, 1431 bp, Thermobifida fusca
ctgaactccgtgactgacaaggctattcgtacccgcttcgcgccctctccgacagggatgttccacgtgggcggcgcgcgttcggcgctgttcaactgggcgctcgccctgcagcagccggaaggcaagttcgtgctccggatcgaggacaccgacgccgcgcgcaaccgccccgaatggaccgagggcatcctgcgcgccctgtccgcgctgggaatcgacgaacgcgacccgcacttcgaagggccctacttccagtcggcctacgccgacaagcaccgggaggtcgcagaggagctctaccgcaagggccgcgcctactactgcgactgcacccgggaacagatccaagagcggcggggcaacccccacctcggctacgacgggtactgccgggaccgagggctggagccggggccgggccgggccctgcgcttccgggtacccgagggcgggcccaccgtcgtggacgacaagatccgcggccgggtggagttcgaccacagcgcgatcgaagacttcgtgatcgcgcgctcggacggctccccgctgttcgtcctggcgaacgtggtggatgacgtggaaatggccatcacccacgtggtccgcggcgaagagcacctgtccaacacgcccaagcagcaactgctttgggaggcgctgggccagactccgccggtctgggcccacctgccggtgatcgtcaacgagaaacggcagaagctgtcgaagcgccgcgacaaggtagcgctcgaggactacctcgccgaaggctacttgcccgaggcgatggtcaactacttgatgctgctgggctggggcccgggcgacgaccgggagatcatgccgttctccgaaatggtgccgctgttccggctggaggacgtcaacagttcgagcgcgttcttcgacgagaagaagctgcgcgcgttcaacggcgagtacatccgcgcgctcgacacgaccgagttcgtggagcggtgtgcgccctggctgggatcggagaaggcgccctggccggcggagaacttcgacgcccaggtgttcgaggccgtggcgccgctggcgcagacccggatctcggtcctcagcgagatcgtctcctacgtggacttcctcttcctggaccgccccgtggaggacgagaagagctgggccaaggccatgaagccgggggtgggtgaggagatgctcaccgcggccttggagcggttctccgacccgaacctggagtggcgggccgagccgctcaaggctgccttggaggaggttgccgcggcacaggggctcaagctgggcaaggcccaggcgccggtccgtgtcgccgtcactggacgcacggtggggctccccctgttcgagtcgctggaactgctgggccggagccgggtccaggagcgtctccgcgcggcgttggagaagctcaaagct

SEQ ID NO: 31849 - DNA, 1164 bp, Thermobifida fusca
gaacggatcattgtggttgacggtgcgcggacgccagtcggcagttttggcggcgcgttcaaggatgtgcccgcccacgaactcggtgcggtggcggcccgggcagcgctccagcggtccgggatcgcggcgtccgacatcgacgaggtggtcatgggctgcattggccaggttggcccggacgcttacaacgcgcggcgggtcgctatcgccgctgggcttccggagagtgtccccgcctataccgtcaaccggttgtgcggtagcggtctgcaggcggtgtggtctggggcgatgcagatccgctggggtgcggccgacattgtcctggccggcggtgacgagaacatgagccggatgccgttctacgatttcggggcgcgttccggttatcggctgggggaccgcacgctggtggacggcacggtggcgatgctgacggacccgttctccaacgtgcacatggggtgcacggctgaggcggtggcccgaaagtacggggtgagccgtgctgagcaggatgagtttgcgttggagtcgcagcgtcgcgcggctgctgatgcggcgcgtgccgcgttcgctgaggagatcaccccggtggaggtggggggccgtaagccggtggtggttgaggtggatgagcatcctcggccggacaccacgttggaggggttggcgcggctccgtccggtttttgagaaggacggtacggtgacggcggggaacgcgtcggggatcaatgatggtgcggccgcgttggtcctggctcgtgagtcggtggtgcgtgagcggggcctgaagggtctggctgtggtggagtcggtggcgaccgcggcgatggatccgcagctgatggggtatgcgccggtgcttgcgttgcgcaagctgtttgagcagacggggacgagcccggctgtggttgatgtggtggagttgaatgaggcgtttgcggcgcaggcggttgcggtgatccgggacgctggtctggatccggagaagaccaacccctatggtggggcgattgcgttgggtcatccggtgggggcgaccggggcgattcttacgttgcgggtggcccgggatttggtacggcgtgatcttgagcttggtgtcgtcacgatgtgcattggtggcggacaggctttggccgctttgttgcgtcgg

SEQ ID NO: 31850 - DNA, 1214 bp, Thermobifida fusca
gcgagaccgtccgcagcaggagggcagggaagaatggatcggacggtagtccacggcctgggaaagctgcgatggaacgcacactcttcgaacccgctcacgtcgagttccgggatgcggtgcgggagtttctccggcgtcacgctgtcccccactatgcacggtgggaggcggaaggcatcgttgaccgggagctgtggcggcaggcgggtcgtgccggttttctggggacggctatccctgccgcgtacggtggcgggggtgaaccggatttccgctacaacgcgattctcaccgaggagtgtgcgcgtgccgggatgctctcgctgagctccggtttcggggttcacaacgatgtggtcaccccctatctgctgtcgctggcttccgaggagcagaagcagcgttggcttcccggactgtgttccggggacctggtgaccgcgattgcgatgaccgagccgggggcgggcagcgacctcaaagcggtgcgcactaccgcggtccgggacggcgattcgtatgtgctcaacggcacgaagacgttcatcaccaatgggatccacgcggatttggtgatcgtcgtcgcgaagactgatccgtcggcccaggcccgcggcatcagccttgtggtggtggaacgcggcatgccggggttccgccggggtcgtaacctcgccaaggtggggctgcacgcccaggacactgccgaacttgttttcgaggatgtgcgggttcccgcggccaatcttctcggtgaggagaaccaggggttcggctatctgatgcgtaatctgccgcaagagcggctgtcgatcgcggtgatcgcggtcgctgcggcacgcgccgctgtggagtggacgatccggtactgtcgggagcgtacagcgttcggccaggagatcggccgttttcagcacaacaagttccagttggcggaaatggccaccgaggtggatatcgcccagacctatgtcgaccgggcggtcctcgcccacaacgcgggcaggctgagccctgtggatgcggccaaagccaaatggtggaccactgagttgctgaagcggaccgctgacacgtgtctgcaactgcacgggggctacggatacatggacgagtatccgatttcccggttgtggcgggatgcccgggtgcacacgatcttcggggggacgacggagatcatgaaagagatcatcggccgtgatctcggt

SEQ ID NO: 31851 - DNA, 1113 bp, Thermobifida fusca
gccgacgctgtggaacgcgaccgcgccggccaaaccccgtacgccgaagtccaactcctcaaagactcgggcctggtcaccctgctcggcccggtcgaatacgggggcggcggacagacctgggagaccgcctaccgggtgacccgggaagtctccaaggccgacgggtccatcgggcaactgctgggctaccactacctgtggtcgtgggcggtgcggttcctcggcaccccgcagcagatcgccgcagtcgaggagctcgccaccaccaaccggtacttcttcggtggcgcagtcaacccccgcgacgacgacctcgtgatcaccgaagacggcgacacgctcgtcttcaacggacgcaaaaccttctccactggaagcaaggtctccgacctcaccgtgctagaaggcgtactggaaggaacagaccagcacattttcgcgatcgtcccctccgcccaggacgggatcgtcttcgcagacgactgggacaacatcggccagcgtctcaccgaatccggcagcgtccggatcaccaacgtccgcatctcctgggacgacgcagcaggctacgtcaaccgggagttccgcccactcgtctacaacacgctgaacctgccggccatccaactcgtgttcaccaacctgtacctggggatcgcccagggggcgctggagaccgccgccgcctacacccggtccacgacccggccgtggccctacggcggggacaacaaagagtccgcggtcgacgagtggtacatcctcgaagcctacggggacctgcagtcgaagctgtggtccgtggaggcgctcaccgaccaggtcggcacgcagctctcccagatcctccacggcgaccgggaagccgtgaccgcacgccagcgcggcgagatcgcggtccgggttgcggccgccaagcagcgggctatcgacgtcggcttggaggtcacgtcccgcatcttcgaagtcacaggtgcgcgggccaccgcatcgtcggtggggctcgaccggttctggcgcaacctgcgcactcacagcctgcacgacccagtggcctacaagcggcgcgaagtgggacgctacacgctgctcaacgagatccctgaaccc

SEQ ID NO: 31852 - DNA, 981 bp, Thermobifida fusca
atccccgcccccgtggccggccccggacaggtcgtcctcgaagtcaccgccgccggcctgtgccactccgacctggcggtcatgagccgaccgcccgaagccctgccctacaagctgccgatcaccctgggacatgaagcggtcggcgtggtcgtcgacgtcggcgcgggcatctccggcctggccgaaggcgacacggtcgcggtgtacggtccgcacggctgcggcgcttgccgcacctgccggagcggggcagaaaaccactgtccacacgcccgggcggcaggcatcctgccgcccgggctgggcgcggacggcgcacttgccgactaccttcttgtcccccattcccgccacctggtccccctgcgcggtctcgacccggtccgcgctgccccgctcaccgacgcggggctcacctcctaccacgcggtccggtccgcgctgccccggctgccgcccgacggcaccgccctcctcatcggtatcggcgggctcggacacctcgcggtccagatcctgcgtgccctcagcagcgcgcagatcatcgcggtagacatggccgccgacaagcgggaactggcgctccgctgcggggcggacacggccctgccctccacggacacggtccccgaccaggtgcgggacctcaccgaaggggtaggcgctgacgtggtcttcgacttcgtcgccagtgacgccaccctgcgcatggctgcacgcagtctccgccccggcggggagatcagcatcgtgggggtgggggaggggcggctgcccgtggccgtaaacctggtgcctctcggagcggtcgtccgcaccccctactggggcacccagtccgaccttgtcgacgtgctcgcgctcgcccgcgagggacggatcaccgtggaggttgaagagtacgcgctggaggagacgcccctggcgtacgaacggctggcacgcggcaacgtccggggccgcgccgtggtgaatccc

SEQ ID NO: 31853 - DNA, 762 bp, Thermobifida fusca
ctgaccgacaaaagagtcctcgtcaccggggctggcggcgggatcgggcgggagatcgcggtggaagcggcccggcagggcgcggcctgggtgactgttgcggacctcaacccggccgcggccgctgagaccgcggaaatggttgcaggggtcggggcgcgcgctcacgcggtcgccgttgacctggcggattccgctcaggtgcggcgcatggtggaggaggctgtggctgcgggaggcgggctggacacactcgtcaacaacgctggcgtgctggactcggctttcaccgacacccccacggtggaggagctgccggaggaggcatgggaccgggtttatgccgtcaacgtcaaagcggtctggctggccaccaagttcgcggcaccccatttgcgggcctcggagcgcggcccgtctgtggtgaacgcggcgtcggtagcggggatgaccggctacggttccccggcctacgcgtcgagcaagggcgcggtcatccagctcacccgttccatggcgattgcgctctcaccgcaggtgcgctgcaacgcctactgccccgggtcgattgagactccgatgagccgggcgcacctggaggcgagcgaggaccgggaagcgcggctgcgctccatgatcggcgcgcatttgatcccccgtttcggcaggcccagcgaggtcgccaaagtggtgtgcttcctcgcgtccgacgatgcttccttcgtcaccggcgggatttttcccgtggacggggggacaact

SEQ ID NO: 31854 - DNA, 762 bp, Thermobifida fusca
atgacccaacgcctgcgaggacgtgtcgcggcgatcaccggcggagccagcgggatcggggaagccaccgtgcggcgcttccacaccgaaggggcgagcgtggtcatcgccgacatccaagcggaagcgggccggcgcctggccgacgaactgggcgaccgcgcagtgttcgtccggaccgacgtcagcgaggaagcggacgtggctgcgctcgtcgacaccgcagtggaccgcttcgggcagctcgacatcatggtcaacaacgccgggatcatgggtgcgctcggcccaatcgacgccacccgcatgtccgacgccgacctcaccatcgcagtcaacttgcgcggcgtcatctgcgggatgaagcacgccgcccgcgtcatgaaaccccggcgcagcggtgtcatcatctccacgtccagcccggctggagtgctcggcgggatcggaccgcacatctacagcgcggtcaaagtcggcatcatcggcctgtcgaactcggtagccgcggaactacgccagcacgggatccgggtcaacacgatcatccccggctcggtggtgtcccccatgaccgcgggcatcgtcgtcgacgatgcgcacaacctcgccggagcccaggaagtgctgggccgcaccgcgctcctggggcgccccatccaacccgcggacgtggccgccggaatcctctacctggccagcgacgacgccgcgttcgtcaccggcgcggtcctgccggtggatgcggggctgaccggggcg

SEQ ID NO: 31855 - DNA, 1425 bp, Thermobifida fusca
ctcttcatcggcggacgctgggttgacagcaaaggcggccggaaagtcgacgtgcacaacccggcaaccggggcctacgtcggcagcacggtcctggcttcgactgccgacatcgacgctgcggtcgcctcagcccgcgctagtttcaactccggggtatgggccaacactccgcctgaggagcgtgccgctgtcctgcaccgtgccgccgacctgctcgaggaacgcgccccggagctcgccaagctcatcacctcggaactgggctgccccatctggttcagtgagcgcgcccacgtccccaaccccatccgccacctgcgctactacggcaccctcgccaaagacttcgcctacgacgagcgccgcagcgacggcaccaacaccagcctcgtcacccaggtccccgtcggggtcgttgccgccatcactccctggaacgggccgttgagcaccccgtccctcaaagtcgcccccgcgctcgccgcaggctgctcggtcatcctcaaaccgccgccggaaaccccgctcaccgcctacaacctcgctgacgcgctgagccaggccgggctgcccgacggggtcctcaacatcgtccccgccgaccgggaggaaggcgcctaccttgtcagccaccccgacgtcgacaaggtcgccttcaccggaagctccgccgcgggcaagaagatcatggccgcctgcgctgaacggatcgcccgcgtcaccctggaactcggcggcaaatccgctgcgatcatcctcgacgacgcggacgtcgacacggtcgtccccgcgctcctgccgatggcgttcatggtcaacggccaggcctgcatcgcccagacccggctgctggtcccccgctcccgcaaagacgagttcattgacgcgttcgcccaagccgtggctgcgcagcgggtcggcgacccgatcgacccggccacgcagatcggccccatggtgagcagacgccagcaggagcgcgtcgaaggctacatcgccaccggacgccaggaaggcgcccgggtcgttgtcggcggcgagcggccctccctgccttctgagctggcgggcggctggttcgtcgcccccaccctgctcgccgaagtgcacaactcgatgcgcgtcgcccaagaggagatcttcgggcccgtgctcgccgtcatcgaatacgacggggacgacgaggcggtcgctatcgccaacgactcggtctacggcctgtccggatcggtgtggagcagcgacgaggaacgcgcgctggcgatcgcccggcggatgcgcaccggcatggtcagcatcaacggtcggccccaggccgccaactcgcctttcggcggtttcaaacagtccggcatcggccgggagatgggccccgaaggtttccacgcctacctggaaaccatgtccatcgctgtcggctcc

SEQ ID NO: 31856 - DNA, 1134 bp, Thermobifida fusca
gcggagcggttccgcgccgaggtgcgtgcgctgcttgccgagcaccgcacggtggacgagcacggccgggaggagtacgaccgggaaggtctgcgcgcagccatggcggaacgcggactgttcagtctcggctggcctgaggagctgggtggtcggcgggctggggttgccgagcgggccgtgctgaatgaggagatgaagtatgcgtgcggcccggtggaccgggcgatgagcgccaccatgctgctcggacattcgatcctgcggcacggcaccccgcagcagcaggccgagttcttgccgttgatccggcgcggtgagctgcgtttctgcttgggctacagcgaaccggaggccgggtcggatctggcgtcgctgcggacgcgggcagtgcgggacggcgaccactgggtgatcaacggtcagaaggtgtggacgacccgggcgcacacggccagccacgtgtggttggcggtgcggaccgacccggatgcggtgccgcgccacgcgggcatcacgattttcctggtgccgatggacacgccggggatcacggtccagcagcacaccgcgctgtccggcgaggtgtcctgcacggttttctacgacaacgtgcgggtgccggacagtatgcgcgtgggcgaggtcaacggcgggtggcgggtgatcacggacgcgttggccgccgagcgggtcgtcatgggcggggttgcggccacgctgctccggcagctcgacgacctgttgggttatctgcgtgctgatccgcagcggctgctcggtgctgaggattcggcagcccgggaccggttggaagggttggcggcccggctgcaggcgacccgggccttggtgttggaagcgacccgggcgatggcggaaggcaaggcgtcggatctggctgcccccatggcgggggtgttgggcggggagcttgccgaggatttcggtcaaggcgtgctggagctgctggggccggaggctgctttgggagcagaagtgcccggggttcccggccacggagtgttcgaacgggctttgcgcacgtcgccgatgttcgtgatcggtggcggtaccaacgacatccagcgtgcgatcatcgcgcgcggcctggggctgccgcgggaagagcgt

SEQ ID NO: 31857 - DNA, 756 bp, Thermobifida fusca
cgtttgacggacaagatcgcactcatcaccggagccggatcgggattcggacgcgccagcgccctgcgtttcgcagctgaaggagcctccgtggtctgcgtcgaccgcaacgccgacgctgcccacagcgccgctgacgacatcgccgccgcaggcggcaccgccctcgcactcaccgccgacgtgtcctccgctgccgacgcggaacgaatgactaccaccacgctggaacacttcggccgcatcgacatcgtcttcgccaacgcgggcatccccggctccggcgacgcccacaccaccaccgaagaagaatgggaccgggtcatcgccatcaacctcaaaggcgtctggctgacctccaaatacgcgctgccgcacatggtcgaacgccgcagcggggtcatcaccaaccaggccagcgtcggcgggctcatcggcatccccggcatcttcccctacgccgcagccaaaggcggcgtgatctccatgacccggcaaatggccgccgcctacgcaccccacaacatccgggtcaatgcgatctgcccgggcggggtctacaccccgctggtggaactgtcccgtcaaaagcgcggcctgaccgccagcagcgtcgaggaagccaacgctatcgccgcacgcaactaccccctgggccgtctcggcacagtggaggagatcgcctccctcgccctcttcctcgccagcgacgaagccgcctggatcaccgggggcatctaccccgttgacggcgga

SEQ ID NO: 31858 - DNA, 954 bp, Thermobifida fusca
atgatccacgctagtgcgttgaccaaacacttcaccacccggaaacggacggtggaagcggtccgcggcatcgacctgaacgttgaagcaggggagatggtagcgatcctaggccccaacggggccggaaagtccaccaccctgcggatgctcaccacgcttctcctccccacctcaggcaccgcccaagtcgcgggagccgacatccgcacccaaccgcgccaagtgcgctcccgtatcggctacgtcggccaaggcaccggatcggggtacaaccagcgcggtcgagacgaactcatcagccaggggcgcgcctacgggatgagtacggaccaggcccgccgccgcgccgaggaactcatcgcctccctcgacttgagcaatgtcgccgaccggcgttcctcctccctgtcgggaggccagaaacgccggctggacatcgccctggggctgatgcacacgccgccactgctgttcctcgacgaaccgtccaccgggctagacccgcaaaaccgggccaacctgcatgaacacatccgtgaactgcgttcccggcacgacactacgatcgtgttcaccacccactacctggacgaggccgaccaactcgcggaacgtgtggtggtgatcgaccacggcacgatcatcgccgatgacaccccggaacggttgaaagccgaatacgcgggcgaccgcatcacgctcacgttcgaccgggccgacgacgccaagcgggcttttggccatctcatggcccgggcggaaagcgcgcggggtacccacgacggtgtccgcgtggtgctggaggttgacggcggctcccggctcgcacccgccctgctgcgggagctcgaagaagccgacctgccggtcgctgcggtggagatcgcccggcctacgctcgacgacgtgttcctcaacttgacgggccgcagcctccgcgacgccgctgct

SEQ ID NO: 31859 - DNA, 1620 bp, Thermobifida fusca
agtttcgccgaccttggcctccggccggaactgctcgatgccctcgccgaggtcggctacgaggagcccacggccatccaacgcgaggcgatcccctcgctgttggaaggccgtgacctgctcggccaggccgcaaccggtacggggaagaccgcagccttctccctgccgatcctgcaccggctgccggacagcgaccgcggggacactccctcggcgctcatcctggtgcccacccgggaactggccttgcaagtatcggaagcactccaccgctacggccgccacctgaaggcacgcatcctccccatctacggcggccagcccatcggccgccagttgcgggccctggaacgcggtgtcgacgtcgtcgtcgccaccccgggacgggccctcgaccacatcggccgcggcaccctcgtcctggacacggtgcgcacggtcgtcttggacgaagccgacgagatgctcgacatgggcttcgccgaagacatcgaggcgatcatcgaagaagtgccggagaaccgccagacagtgctgttctcggcaaccatgcccgaccgcatcgaaggcatcgcccgacgccacctcaccgacccggtgcgcgtacgcatcgcccgcacttctcccgcacccggagaagagccgaaagtccggcagaacgcctacatcgtggcccgcccctacaaacccgcggccctgggacgcgtcctcgacatggaatcccccaccgcggccctcgtgttctgccgcacccgtgaggaagtcgaccagctcaccgagacgctcaacgctcggggataccgcgctgaagcgctccacggcggcatgagccaggaacagcgcgaccgggtcatggcgcgcctccgcggaggaaccgccgacctcctcatcgccacggacgtcgccgcccgcggactcgacatcgaacacctcacccacgtggtcaactacaatgtgccgtcggcaaccgaaacctacgtgcaccgcatcggccgcgtggggcgggccggccgagaaggcgtcgcgatcaccctcgtcgagccgcgggaacaccggatgctcaaaaccattcagcgcagcacgagcggcccgatcagcgtcgagaagctccccaccgtcgcggacctgcgggcccgccgcgtcgaactgacccgtgctgcgctccacgaagctctgaaggaggaggacgacgaccgcgaggcgttccgcgtggtcgtggagtcgctcgccgaagagttcgacatcatggagatcgcgctggccgcggtgaaactggcgcatgaagccagcggcgccgtcaccgaagaggaggagatccccgaaccggtgctccgccccgagcggagcgaacgccgcgaacgccgtggacggcgcggcggaccgggccgcggtgaacggcgcggccgaggcccctccgacggcatgacccgcctcttcgtcggcattggacgcaacgcccgggtccgcccccaagaccttgtgggagcgatcgccggggagaccgcattgagcggacgggacatcggcgcgatcgaaatcgccgaccgcttctccctggtggaagtgcccgaatccactgccgacggtgtgatcgcggcactgaagaaaagcacgatt

SEQ ID NO: 31860 - DNA, 522 bp, Thermobifida fusca
accgacgtcagcacgctgatcgaccgctacgtccgtgacatccccgactatccgcagcccggggtggtcttcaaggacatcaccccgctgctgtcccaccccaccgcgctgcgcaccgccatcgacgcgctcgctgaacccctgctcggcagcgagatcgacctggtcgccggcttggaagcacgcggtttcatcttcgctgcccctgtcgcggtgcgcctaggggcggggttcgtcccgctgcgcaaagccgggaaactgcccgcggagactctcgccgagtcctatgatctggagtacggtactgccaccgtcgagatgcacgccgacgcggtacccccggggagccgagtgctgatcgtcgacgatgtgctcgcgaccgggggcacaggacgggccgcggtggaccttatccggcgagcgggtggtaccgtcgttggactctcagttcttctggaactcgggttcctcaagggacgcgagaaactggccgacgtcgaactgcgggcactggctactgtc

SEQ ID NO: 31861 - DNA, 522 bp, Thermobifida fusca
atgggcgtctcggggagcggcaagaccacggtggcccgaggggtcgcccaggagttgggactcccgttcgccgacgccgacgacttccatcccgaagccaacatcgccaagatggcgcgcggcattccgctgaccgacgaggaccggctcccctggctccaggcgctggcagcgtggatcagcgaacgggagcgggaagggacttcctcggtcgtgacgtgttcggcgctccgccgctcctaccgggaccttctgcggcgcagcgctcccggcgtgttcttcctccacttgcacggctcggctgaactgatcgggaagcggatccgggagcggcgtggccacttcatgccgccccaactcctggactcccagttcgccacattggagccgcttgcccccgatgaggcaggtgccgtcctcgacgtgtccgcttcccctgaggacctcatcgccgaagcggtgcggatcgtcaccgggctccgcaacgcccaggcgtagcagtccaggagacgttcagaccgg

SEQ ID NO: 31862 - DNA, 1344 bp, Thermobifida fusca
taccgcatcgagcgggactcgatgggcgaggtcaaggttcctgtcgaggccaagtggcgggcgcagacccagcgcgcggtcgagaacttccctatctcggggcagggcctggaggccgcgcacatcgcggcactgggccacatcaaggctgcggcggcgaaggtcaacgctgagctcggtgtgatcaaggaggacatggccgaggcgatccgcgaggccgcgctggaggtcgccgcgggcaagtggaacgaccagttccccgtggacgtgttccagaccgggtcgggcacgtccagcaacatgaacgcgaacgaggtcatcgcgacgctggccacggagcggctgggccagccggtccaccccaacgaccacgtcaacgcgtcccagtcgtccaatgacgtgttcccgtcctcgattcacatcgcggcgacctccgcgctgatcaacgagctgattccggcgctgaagcacttggaggagacgctgtcggcgaaggcgtcggagttcgccaccgtggtgaagagcggccgcacccatttgatggacgcgactccggtgaccttgggccaggagttcgacgggtacgccgcgcaggtgcggtacggcattgagcggatcgaagcgtccctgccgcgggtcgcggagcttccgctgggcggtacggccgtggggaccgggatcaacacgccggagggcttctccgcgaaggtgatcgcggagattgcgcgggctacggggctgccgctgaccaaggcgcgcaaccacttcgaggcccagggggcgcgggacgctctggtggagctgtccggtcagctgcgcacgatcgcggtgagcttctgcaagatcgccaacgacatccggtggatgggttcgggtccgcggaccggtctcagcgagatcttcctgccggacctgcagccggggtcgtcgatcatgccgggcaaggtcaacccggtgctgtgcgagtcgatgctccaggtggcctcgcaggtggtggggaacgatgccgcggtggcgttcggcgggtcgaccggcaacttcgagctgaacgtgcaactgccgctgatcgcccgcaacgtgctggagtcgatccggctgctggccaacatttcccgggtgttcgcggaccggtgcgtggccgggatcaccgctaacgaggagcggtgccgcgagtacgcggaatcgtcgccgtcgatcgtcaccccgctcaaccgctacatcggctacgaggaggccgccaaggtcgccaagcaggcgctcgcggagcggaagacgatccgccaggtggtgatcgaacgcgggtacatcgcccagggcaagctgaccgaggcccagttggatgag

SEQ ID NO: 31863 - DNA, 903 bp, Thermobifida fusca
tcgccaccggcgatctcgctccgcggggtcgtgaaacgcttcggcgacatcaccgccgtcaacggcctcgacctggacgtcccccaaggtgtcgtgctcggactgctcggccccaacggggcaggcaagtccaccaccatgcgcatcctcaccgcgcagagcaccgtggacgaaggacacgtcagcgtcctcggccatcccatcccccaaaagtcgaagtgggcgcgctccctcatgggagtggtgccccagcacgacaatctcgacgaggaactcaccgtcgaagagaacctgcgcagcttcacctacctgtaccgggtgccgcgccgcgaacgcgacgccgccgtggagcgggcactgcgcatcgcccacttggagcatcggcgacacgagttcaccgagaagctttccggggggatgcgccgccgactgctcatcgcccgcggcctcgtccaccgcccccgcgtgctcctcctcgacgagcccactgtcggcctcgacccgcaagtccgccaagaactgtgggggctcatctccgccctccgggacgagggggtcacggtcctcatgtccacccactacatcgaagaagcggagcggctctccgacgaagtggcgctcatggccaagggacgcatcgtcgaacgcggcgaacccgccgacctgatcgccaaatacgccgggaaaaccgtcgaggagtaccagatcggggcggaaggtgtcgaagaactagagaaagtcatccaccacgccgggttcactacgcggcgcaccggctccaccctttccgtgctccgcgccgaagaactccccgattcgctgcgggaccggctcggcacgggaatgcgccgcgccagcaacctggaagacgtgttcgtcaccctgaccggggagaccgtagag

SEQ ID NO: 31864 - DNA, 1992 bp, Thermobifida fusca
cagatctccccggacggccagcgtgtcgcgttcttgagaagccgggacggtaccgacaccgcgacctgcctgtgggttgcggaaccggacggcacggagcggatcatcgcggacccgcgcacgatcggtgacacgggggaggatctgccgccggaggagcgggcccgccgggagcggctgcgtgagtcaggaagtggcatcgtctcctacagcgtggacaaggcgttcacccgcgccgtgttctccttgtccggcaggctctacagcgtggagttggacggctccggcactccccgggagctgcccgcggcctccccggccatcgacccggtgctggaccccacgggacggctagtggcctacgtccacaagggcgccatccacgtgcttgacctcgccgacggcttggaccgcgtggtggccgccccggacgggaagaacatcacctggggtctggccgagttcatcgccgccgaggagatgggacgccaccgcggcatgtggtggtctccggacgggactttcctgctcgccacccgtgtggacacgaccccggtgcggcgctggcacatcagcgacccggggaaccccgaagccgtgccgcagacggtcgcctacccggcggcgggcaccgacaacgccgaggtgcggttggcggtgctgcgggccgacaacaccggggagccggtgtgggtggaatgggaccgggatgccttcccgtacctggtcaccgcggggtggacccagcggttgaagggcacgtcgaccatcgtgttcaccgtgcaggaccgggcccagcgcacgctgcgggcgtgcaccgcggacccgctcaccgggcacctccacgagctgtggacggagacctccgacacctgggtggagatcatgccgggggtgccggagttcgacgcttcaggcgcggcactgcgtttcggggtggactcttccggggagcgggcgctgtacctgggcgaccggatggtgaactcccccgggcagtacgtgcgggccgtactggacgtggacgggtgctgcgtgctgtattcggcgtcccctctcggggagccgcacatcgtccggctgtggctgtacgacagtcggacagacacgcgcactgagatgagcttccccggggcggacggtccttccggggtgcattctgggctgctgcgcggcgacaccttggtgatccagcggcgcgacctgtccagtccgggggtgcgcaccgcgatcgtgcggggtgtgcacgaggagcagtccgtgaccgaggtggagagccgggcggagcgccccgacctgcccggtgtgcacgtgcagctccagcggttgggcgaacgggagatccctgccgcgctcgtgctgccgtcgtggtatacgccggattctgatccgctgccggtcctcctggacccctacggcggcccgcacgcccagcgggtgctctgcgcccagagcgcctacctgaccgcgcagtggttcgcggagcaagggttcgcggtgctgatcgctgacgggcgcggcactccgggcatcggcctggcgtgggagcaggccatccaccggaacatggcggaaaccgtgctggaggaccaggtggcggcactccacgcggcgccggaggcgttcggggtgcgcctggacttgaccaaggtggggatccgcgggtggtcgttcggcggatacttggcggcgctggcagtgctccgccgcccggacgtgttccacgcggccgtggcgggtgctcccgtcaccgactggcggctgtacgacacgcattacaccgagcgctacctggggcatccggacgacgatccggaatgctacgagcgggagtcgctgctggtggacgcgccgaagctgcagcgcccgctgctgctgatccacgggctcgctgacgacaatgtggtgttcgcccacacgcagcggctgtcgtcggcgctgctcgcggcgggacgtccgcacacggtgctgccgctgtccggagccacccac

SEQ ID NO: 31865 - DNA, 1314 bp, Thermobifida fusca
acttttcgcgatctcggcgtcatcgacgacatcgccgacgccttggaagccgagggcatcgtcgcccccttccccatccagtccatggccctgcccttggcactgaccggcgccgacatcatcggacaggcgcgcaccggaaccggtaagacgttcgctttcgggctcccgctgcttcagcgggtccacacacagcccggatcagccaagcgcccccgcgcgctcgtggtggtgccgacccgggaactcgcgatccaggtggccgcggacctggccacggcaagcaaacgcatcgacgtgcggatcgccaccgtgtacgggggacgcgcctacgagccgcagatctctgccctgcgcaagggtgtcgacatcgtcgtgggcaccccggggcgcctcctggacttggtgaagcagcgccacctgatcctgtccgaggtgaccgcgctcgtcctggacgaagccgacaagatgctcgacctcggcttcctgcccgacattgaacggatcctcgcgaaaacccctgaccagcggcagaccatgctgttctcggcgacaatgccgagcgaaatcgtggcgctgtcccgcaaatacctgcgccgccccacccacatccgcgctgaagacgatcccctcgacaccggttccggccaggtcacccagcatgtcttccgcacccatccgctggacaagctggaaatgctggcccgcctgctccaggcgcgcaaccggggcctgaccatggtgttctgccagaccaaacgggaatgccaccacgtctccacggagctgtgccgccgcgggttcgctgccgcagccgtccacggcgacctggggcaaggccagcgggagcgggcgctgcgcgcgttccgcaacggcaaagtcgacgtgctggttgccaccgacgtggccgcccggggcatcgacgtggacgacgtgacgcacgtggtcaactacgagtgccccgacgacgagaagacctacacgcaccgcatcggccggaccggccgggcgggacggtccgggaccgctgtcacgttcatcgactggcaggaactcctgcggtggaagctgatcaaccgggcgttggggctgcctttcgctgacccgccggagacctactccacgtcgccgcacttcttcgacgctctcgacattccgcgggacgccaagggagtgctcgccaaggaggagcaggaccgggccggtctggcagcggaagaagtagaggacatcggggagaccgggcgggcctcccgcaccaaggaccgggagcgttcgcggcagcgccggtcccggccccggaaacgcacccgg

SEQ ID NO: 31866 - DNA, 1050 bp, Thermobifida fusca
ctcgcttccgctaccgcagcccaaactgacctggatcgacgcgtaccccccgagaccatcgacctcctcaccgacgccggcttcttccgctggtcagtgccggccgactacggcggagccgcaggttccttcaccgacctggcccgccacgtggtccacctgtcccggcactgcccctccaccgggtggctcgcctcgctcttcgggcactccggccgctacgtcgcctgcctgcctgaagaaggccggaaagaagtgtggggcagcagccccgacgtccggatcgtcagcgtcgtcaaaccgctcggccgcgccacccgcgtagcgggcggctggcgcctgagcggccggtggacctacgccagcggggtggagtactccgactgggccctcctcgccgggcccgcgcaaggacccggatccgatggcggcccaccgcgcttcttcgctgtcccgcgcagcgactacacctacgaggacacgtggcacaccctgggcatgcgcgggacgggaagccacgacatcgtcatcgacgacgccttcgtccccgaccaccgcacctgtcttcgcgaagacgccatgcaagggcgcaccgcggaaggggaccgccgctacgcacccacccgggccgtcaacggcctcaccttcgtcacccccgcgctgggggctgcgctcggcgcactcgacgcggccctgcccctgctcaaaggccccgcagccggcccccgggcagcctcacaccaggcgtaccagatcgcctacgcccgcgccgcgggacagatcgacgcggcacgtctccttctggaccgggtcgccgaaaccgcagacgcaggccggttcacccccgaactcgtgcagcggagcaggcgagactccgccctcgccctggaaatgctgacctctgccgtcgacgcgctcgcccgcaccggcggtacccgcggacaggccgacagccaccccttgcagaggtactggcgcgacgtccggtccgtgtccggacacgcggtcatgcagttcgaacaggccggtctcgcctacacgcagagcctt

SEQ ID NO: 31867 - DNA, 963 bp, Thermobifida fusca
gcaccccctgtggcgctgctccttcccgggcaaggcgcccaataccggaggatgggggcggcgctccacggatacgaccgggtgttcaccgaggtgatggacgagttcctggagctgctcggcgcggacggggagcggctgcgggaactgtggctgaccggcgagcccgccgacggtgtccacgacggcctcaacgcccagcccttactgttcggggtggcctacgcggcagcgaaaagcctggagcaccggggcctgcgaccagccgtcctgctcggccacagcatcggcgaattgtgtgcggcaaccctcgccggcgtgtgggatcttcccgcggccgcccggatccttgcggcccgctcctcgtccctggggaaggcgccccgtggcggcatgctggcggtggcggcagcccctgacaccgttgaaccgctcatccccgccgagtgcgcccgtgcgggggtggccgtcggcgccgtcaacggggccgcccagacggtcctggccggtccggaggctgagctcgccgccaccgacgcggtcctcaaagccaaagggatgacgacgcgtgcggtcagaaccgcacagccgttccactcgcctgccatggctgaagcggcacgcgtgttccaggaggctatcgccgccgagcagcgcaacagtcccgcgattcccctcgtctcctcgctgaccgcagaaccggtcactgaacaacaggcgctcgaccccggattctgggcgtcgcagatgtcgcggcctgtcctgttttggccggcgttgcaggcgctcgaccggcgcggcgcacacacctatgtggaagtcggaccgggcaagggccttgccgccgcggcacggcggctgcctaccgtgctggaggggagcagccgggtcgtctccacgcttccttcggaacgcggggacacggtcgccacatgggagtccgcgctggctgcgctagcgtca

SEQ ID NO: 31868 - DNA, 1347 bp, Thermobifida fusca
agagtcctgatcgccaaccgtggagagatcgcggtgcggatcgcccacgcgtgtcgggaggcaggactggtcagcatcgccgtgtacgctgacgcggaccgggacgccctgcacgtccgcgccgccgacgaagcctacgcgctgcacggcgagaccgcagccgacacctacctcaacatcagcaaactccttgccgtagccgccgccagcaaagcagatgcagtccaccccgggtacgggttcctcgccgagaacgccgcgttcgcccaggctgtgcgcgaggccggactcacctggatcggtccgagcgccgaaacgatcgcactgctcgccgacaaggtcgccgcacgccgcatcgcctgcgacgtgggagtccccgtcatgccgggaaccggtcggcccgtgaccacagcagcagaagtcgccgacttcgcccgcagccacggatacccggtcgcggtcaaagccgcccacgggggcggcggccgcgggatgcgcatcgtccacgacacccggcagattcccgagctgctggaagcagcggtacgcgaagccgccagcgccttcggccgcggagactgcttcgtggaacgctacgtggcccgcccgcgccacgtagaaacccagtgcctggccgacgcgcacggcaatgtcgccgtcctgtccacccgagactgctcgatccaacgccgccaccagaagctcgtggaggaagccccggcgccggggctcaccccgcaccagtgggagctcctccgcgaagggtccgcagccatcctccgcacaaccggatacgtgggtgccgccacatgcgagttcctcctggcggaggacggcaccctgtccttcctcgaagtcaacacccgactgcaggtggagcaccccgtcaccgaagaagtcaccggggtcgacctcgtccaggaaatgctccggatcgccgacgggcagcggctggaacgcaccgacttcccggtgcacggccatgccgtggagttccgcatcaccgcggaagacccccaccgcggcttcgccccggtcgcgggccgtctcgaccagctcgtctttcccaccggaccgggaatccgagtggataccggataccagcagggcgacaccgtccccccgcacttcgactcgctcatcgcgaaactcatcgtccgaggggacactcgcgcacacgccctcgcccgggcacggcgcgccctcgccgacgtcacggtcgccggcgtccccacccttctcccgttccaccgggccctgctggacaccccggaattcacggcggacgtgccacgcatccacacccgctgggtggaaaccagcttccctttccacctgcttgaagaa

SEQ ID NO: 31869 - DNA, 768 bp, Thermobifida fusca
cgaaccgcgatcgtcaccggagccaccagcggcatcgggctcgctgtggcccgagaactggccaaccggggccaccgtgtcttcatctgcgcccgcaacggggaacgggtagcggaaaccgccaaacaactctccgacaacgggaatctccccgtcgacggccaagcctgcgacgtccgctccctcgacgacatccgggccatggtccgcgccgcggtcgaacgcttcggcaccatcggcatcctcgtcaacaacgcgggacgcgggggaggcggggtcaccgccgacatccccgacgacctgtgggacgacgtcctcgccaccaacctcaccagtgtgttccgcgtaacccgggaagtgctcaccaccggcggaatgcgcgaagcctcctggggacgcatcatcaacatcgcctcgaccgccggcaagcaaggagtggtcctgggcgcgccctactccgcttccaaacacggcgtcgtcggattcaccaaagccctcggcaacgaactcgcgcccaccgggatcaccgtcaacgccgtatgccccggctacgtggaaacccccatggcggaagcggttcggcagcgctacgcccaagcctggcagatcagcgaggacgaagtcctcgcgaaattccaagccaaaatcccgctcggccgctactccacccccgaagaagtggccggactggtcggctacctcaccaccgagaccgcagcgtcgatcacttcacaggcactcaacgtctgcggcggcctcggcaacttc

SEQ ID NO: 31870 - DNA, 1185 bp, Thermobifida fusca
gtggtgaccggactcggagtgatcgcccccaccggcctcggcgtcgacgactactggaaggccaccctggaaggccgcaacggcatcgcgccgatcaccaagttcgacgcgagcggataccccagttcgctcgcggggcaagtcgtcggattccacgccgccgaccacctgcccggccgtctcctgccgcagaccgaccacatgaccagaatggcgctcgccgccgcccagtgggcatgggacgacgcgggcctggaccccgcccagttgccggagttctccgccggagtggtgacggccagctcctcaggcggctacgagttcggtgaacgggaactccgcaacctgtgggccaaaggcgccagctacgtcagcgcctaccagtcgttcgcctggttctacgcggtcaacaccggtcagatctccatccgccaccagatgcgcggccccacgggagtcctcgtctccgaccaggccgggggagcagacgcgatcgcccacgcccgccggcagatccgcaaaggcgcccgtgtcatgctcgccgggggtgtcgacagctccctgtgctcctgggggtggatcgcccacctcgcttcgggacgggtcagcaccgcggacgacccccgccgcgcctacctcccgttctctgccgacgcccgagggcacgtgcccggggaaggcggagcactgctggtactcgaagaggaaaccgcagcccgggcccgcggcgcccgcatctacggggttgtcgcgggccacgccgccacgctcgaccctccgcccggaagcggccgtcccagcaccctggaagcggccctgcgcggcgccctcgccgacgcggacgtccaccccgacgaagtcgacgtggtcttctgcgacggcgccgccatcccggaactcgaccggatcgaagccgcagccatcaacgccgtcttcggggaaggggccgtccccgtcaccgttcccaagaccatgaccggacgcctcttctccggggcggtcgcgctcgacgctgccgcagccctcctcagcatccgcgacggcgtcatcccacccaccatcaacgccaccgccgcccccgacctcgggctggacctggtcaccgaaacccctcggagcctgcccgtccgcatcgccctgatcgtcgcccgcggaatcggcggcttcaactccgccctcgtcctc

SEQ ID NO: 31871 - DNA, 1245 bp, Thermobifida fusca
cgacgcgtagtcatcaccggcatcggggtgatcgcacccggcgggataggcacgcaggccttctggaacctgctgaccgaaggcaggacagcgacccgccccatctccctgttcgacgcgagcgtcttccggtcccggatcgccgccgaagtcgacttccaccccgaagagcacggactcaccgcccagcaggcccgcaccatggaccgggccgcccagttcgctgtcgtcgccacccgcgaagccatggcggacagcggcctgaccatcgaccgcccagaccgggtcggcgtggtcgtaggcagcgccgtcggcgcatccaccagcctggaaaaccagtaccggctgtccagcgacgacggacagcttgaccccgtccgctacgaccccgcggtcaccgacctctaccggcacttcgtgcccagctcgttcgctaccgacgtggcctgggaggtaggggcggaaggaccagccaccgtggtgtccaccgggtgcacctctggactggactcggtgggctatgccgccgacctggtccgagaaggcatcgtcgacgccgtcgtcgtcggcagcaccgacgcccccctcacccccatcacctcggcctgcttcgacgcgatcaaggcgacctcaccccgcaacgacacccccgccaccgcgtcccgcccgttcgaccgcacccgcaacggcttcgtcctcggtgaaggatgcgccatgttcgtcatcgaggaacgcgagcacgcccgggcccgcggcgcccgcatatacggcgaactcgcaggctacgccacccggtccaacgcctaccacatgaccgggctccgcgcggacggccacgaaatggcggaagccatccgggtcgcgctgcacgaggcacgcgtcaaccccgacgacatcgactacatcaacgcgcacggctcaggcaccaaacagaacgaccgccacgagaccgccgccttcaaaaaagccctcggcagccacgcctaccggacaccggtcagctccatcaagtccatgatcggccactccctcggcgcgatcggctccatcgaaatcgccgcctgcctcttggccatgcgggacaacatcgtgccgccgacagccaacctgaccgaacccgaccccgagtgcgacctcgactatgtgccaatcaccgcgcgtgagcaccgagtcgacacggtgctcacggtaggcagcggcttcggcggcttccaaagcgcgatggtcctcaccacagcggacagg

SEQ ID NO: 31872 - DNA, 843 bp, Thermobifida fusca
aacggagccgagttcttcttcctgcgccccaaggacatcgccgtctacgtcggtgaaggcatcctccacgtgggaatcaccggccgcgacatgctcatcgactccggcgcccccgtcgaagaagtgctggcgttgggcttcggcaattccacgttccgcttcgccgcgcgcaacggctcctcgatgacggtggaagacctcgctgggaagcggatcgccacctcctacgaagggctgctcacgtcctatttgaagaagcgcggcatcgaagcccgggtcatccacctcgacggcgctgtggagagctcgatccagctgggtgtggccgacgcggtcgctgacgtcgtgtccacgggcacgaccctgcgccaggccggactggagccgttcggggagcccattctggaatccgaggcggtcgtcatccgtcgcaaaggggaaccggacgacccgaaagtcgagcagttgctgcgccggctgcgcggtgtgctcgtcgcccgcgactacgtgatgatggactacgacgtgcacgccgagcacttggaggaggccatcgctctcacccccggcatggaggggcccaccgtctcgcccctgcaccgggaaggctgggtggcggtccgggccatggtgccgcgccgcgacgcccagcggatcatggacgacttgtgggagatcggggcccgcgccatcctcgtcaccgatatctacgcctgccgactctgaagcacgatggacaggtccgcacaaggagtaccggggttctctgacaccgctgcgcccgtggtggtcgaccggacccagggggtcagcggcggggacctggtgctgcggcgggtcggc

SEQ ID NO: 31873 - DNA, 792 bp, Thermobifida fusca
gcggagctcaccgaccgctacggcgtgcccgcgcagtgcctgcccgccgatctcaccgacgacaaggacctcgccacggtcgaagagcggctgcgagtcaccggtgacaccgctgacgccccgatcgacctgctggtcaacaatgccggacaggcgcacggcggcgatttcgcgacgattccggtcagcgcgatcgaggacacgctcgcactgaacatccgtgcgctcacccggctggcgcacgcggtactccccgtgcagatcgaacgggcccgccagctccgcgaggcagggagctcccgcccgctcggcatgatcaacgtggcgtccatggccggactgctgccggccgctcccggcggcgcggtctactccgcgtccaaggcctatgtgctctccctcaccgacacgctcgcggtcgaagcggcccggcacggcgtgcgggtgaccgcggtcctccccggctacgtccgcaccgatatgacccggtccttgcaggagaaaggggcgcccgatatcgcgttcgtcccgcgggagcgcgtggtgaccgactcgctgcgcggctgggcttcgggccggacccgagtcgtgccgggcgcccagtacaaggcggtcaacgccctgctccatgcccttcccccagggctgttccacgcggtcgcaaaacgcaccagtgcgtgaccacccgcggcacaccccggacagctccccgcagtgttcacttccgcttcgaccgcctccactttccgtctccgaccggctgcgcctaccctaggagagcacgcagtcaag

SEQ ID NO: 31874 - DNA, 1086 bp, Thermobifida fusca
tagtgatatctgtcacgatgggtggtagggctgttcgaccccacccgttaccccgggacgggtcgggcaggcaacaggccgaccagcggtaccccgtcagtcggccccgagaccgaggagcgacaggtgtccgacagcaccgttcgtgaagagcctgagctgatccagctcttgacccccgacggagagtacgtcccgcaccctgactacccgttcgaacccgccacggcacaggtccgcgacctctaccgcgacctcgtcctcgtgcggcgcctcgacgccgaagccgtggccctgcaacgccaaggcgaactgggcctgtgggcctccctcctgggccaggaggccgcgcagatcggttcagcccgcgccctcgaaccgcaagacatggccttcccgtcctaccgggagcacggggtggcctggtgccggggagtccgcccccgggacctactggccatgttccgcggcgtcaccaacgggggctgggacccgtacgagcacaacttccacctctacacgatcgtcatcggcagccagacgctgcacgccaccgggtatgcgatgggtgtgcagcgggacggggcactcggtgaagacggcaccgctgtcatcacctacttcggcgacggagccaccagccagggcgacaccaacgaagccttcaactacgccgcggtcaacaatgccccggtcgtgttcttctgccagaacaaccagtgggccatctccgagcccaacgaccgccagagcaaagcgccgatctaccagcgggcagccggcttcggcttccccgggattcgcgtggacggcaacgacgtcttcgcctgcctggcggtgacccgcaaagccttgcagcacgcccgcgaagggcaaggccccaccctgatcgaagcgttcacctaccggatgggcgcgcacaccacctccgacgaccccacccgctaccggacgtccgcagagatcgaagagtggcgccgcaaggaccccatcgcccggctgcgggcctacctggtccgcgaaggcaaagccgacgacggcttcttcgacgcggtagaagccgaggcggagaagctcggggagcag

SEQ ID NO: 31875 - DNA, 960 bp, Thermobifida fusca
catcttccgcgaggtctacgcggaaccgcaccgcgagctcgaccggcagcgcgccgaattcgcggactacctggcgtcgtttgagggggcggagggagcggcccgatgagcggaaccgaactcaccctgggcaaggccatcaacgcgggactgcgccgcgccatggagaacgacccgaaagtcctggtgatgggggaggacgtcggacggctcggcggggtcttccgcgtcaccgacggcctgtacaaggacttcggcgcagaccgggtcattgacaccccgctcgcagaatccggcatcatcggcaccgcgatcggcctggcgctccgcggctaccgcccggtctgcgagatccagttcgacgggttcttcttccccgccgccgaccagaccttcacccagctcgcgaaactgcgggcccgctccgagggacggctgagcctccccgtcgtgatccgcatcccctacggcggcgggatcggtgcggtggaacaccacagtgagtcgcccgaggcctacttcacccacactgccggcctgcgggtggtcaccgtagccacccccgaggacgcctactggatgatccagcaggccatcgcctgcccggacccggtggtcttcctcgaaccgaaacgccgctactgggacaaggcccccgtccgcacggacggcagcgtggacaccgccaccccgatgggggaagcgcggatcgtccgccccggtaccgacgtgaccctggtggcctacgggccgatggtcaaggtcgcgctccacgccgctgaagcggacaccgagcggtccatcgaggtcatcgacctgcggtcgctctctcccgtggactacgacaccgtctacgagtcggtccgccgcaccggacggctcgtcgtcacccacgaagccccggtgaccagcggactgggcgcggaaatcgctgcccgggtcaccgaggcctgcttctac

SEQ ID NO: 31876 - DNA, 1335 bp, Thermobifida fusca
ttcgcgtcggcggattcgacaccccctatccgccgtcccggttggaggagtactacctcccggacctggaccgggtcctcgacggtgtcgaccgcacgttcgcgtactagagggctgggcatgactcaccaaggaatccaacagtttgtgctgcccgacgtgggcgaaggcctcaccgaggccgagatcctcacctggcacgtgcagccaggggaccaggttgacgtcaaccaggtcatctgcgagatcgaaacggccaaggccgtcgtggaactccccagcccgtttgcgggtcgcgtcgaggcgctgctggtcgaggccggggagaccgtcccggtcggaactccgatcatcgcggtggacaccggcggtgccgcgggcgagccgcggcctgagcctgctcccgccgcagccccggcggaaccgccagcggaggagaagcgggaaccggtcctcgtcggctacggcgtcaaaagcggggccaccaagcgccgggcccgccgccgcaccccttcggccgtgccggcgcagaccgtcggccagcgcaccgtggtgctcgccaagcctccagtgcgcaaactggcgaaagacctgggggtggacctgcgtacggtcgtgcccagcgggccgaacggggtcatcacccgagacgatgtgcggcgccacgccgagcagaaccagccgcagccctcagcgccccgcgtgcccgagccggcggcgcccgcaccggctgcgtcgcctgctcccgagcgggacgtgcgggaagagcgcatcccggtcaagggggtgctcaagcacatggcggcggcgatggtcgacagcgcgttcaccgcaccgcacgtcaccgagtttctgcaggtggacgtcaccaagaccgtgaaggtcgtgcagaagctccgacagcggccggagttcgcggacgtgaaggtctccccgctgctgctggtcgcccgggcactgcttatcgcggtgcggcggcacccgcggatcaacgcgtcctgggacgaggccaaccaggaagtcgtcgtcaaacactacgtgaacctgggcatcgcggcggccacggatcggggcctggtggtgcccaacatcaaggaggccgaccggctgccgctgcctgacttggcgcgggcgttgaccgacctcaccgagaaggcgcgggcgggacagaccgcccccgcggacttgaccggcggcaccatcaccatcaccaacatcggcgtcttcgggatcgacggcggaacccccatcctcaaccggggagaggctgcgatcctggccctggggcagatccgcgacatgccgtgggtgcacaagggcaagatcaagatccgc

SEQ ID NO: 31877 - DNA, 510 bp, Thermobifida fusca
cgacgagcggttctggaaggccccgagatctcccgggcgctgacccgcatcgcccacgagatcctcgaacgcaccaaagggggccacgacctcacccttctgggcatccgcaccggaggcgtgcccctcgcgcagcggctcgccgaacgcatcgaacgcgtcgaacagcgcccggtcccctggggcgccctcgacatcaccatgtaccgcgacgacctgcggctcgccccggcccgcgccctcggcagcaccgacattccccccgaaggcgtcgacgggcggaccgtagtcctcgtcgacgacgtgctcttctccggccgcacggtccgcgccgccctggacgccctcaacgacctgggacgcccgcgcgccgtgcaactggcggtcctcgtcgaccgcggccaccgggaactccccatccgcgccgactacgtggggaagaacctgcccacctcgctccgcgaaagcgtcaccgtgctgctcgaagaactccacgggcgcgacgcggtc

SEQ ID NO: 31878 - DNA, 927 bp, Thermobifida fusca
cagcacctgctttccgccggagacctcacccgagacgaggccctgctcatcctcgacaccgcgcgggaactctcccaggtcagcgaacgctccgtgaagaagctgccgaccctgcgcggccgcaccgtcgtcaacctgttctacgaagactccacgcgcacccggatctccttcgaagccgccgccaaacgcatgtcggcggacgtcatcaacttctccgcccgcggctccagcgtctccaaaggagaaagcctcaaagacaccgcgctgaccctgcaggccatgggcgccgacggggtcgtcatccggcacagcgcccccggagcggcgcgccgcctcgccgactgggtggacggcgtcgtcatcaacgccggcgacggcacccacgagcaccccacccaggcgctgctcgacgcctacaccatgcgggaacggctcggccgcgtcgaaggcctgcgggtcgccatcgtcggcgacatccggcacagccgcgtcgcccgctccaacgtgctgctgctcaccaccctcggcgccgaggtcaccttggtcgccccgcccaccctgctgcccgtctccgtcgacacctggccctgcgcggtctcctacgacctcgacgaagtcctgcccaagagcgacgtcgtcatgatgctgcgggtgcaggccgagcggatgcactcctcgttcttcccctccgcgcgcgaatacagccgccgctacggcctggacgccgaccgcctggcacggatggccgaccacgccatcgtcatgcacccgggccccatggtccgcggcatggagatctccgcggaggtcgccgactccgcccgctccaccgtcaccgaacaggtgaccaacggtgtcagcgtccgcatggccgtgctgtacctgctgctcggcggtgccatccacagaccgggaaaccagggg

SEQ ID NO: 31879 - DNA, 1101 bp, Thermobifida fusca
gcgatcctggtcctggaggacggccgagtcttccacggggtctccttcggtgcagaaggggagaccttcggtgaaatcgtgttccacaccggaatgaccggataccaggaggtcctcaccgacccctcctaccaccgccagatcgtggtgatgaccgcaccgcacatcggcaacacgggggtcaacgacgacgacgccgaatcccaccggatctgggtgtccggatacgtcgtccgcgaaccctcccgcatcgtctcgaactggcgggcccagcgcaccctcgaagaggaactgcgccgccaaggagtcgtcggcatcgccctctccggcacccgggcgctcacccgccacctgcgcgacaagggtgtgatgcgcgccgccatcagcaccgtggaaaccgacccggacaagctgcgggaacgcgtcctcgccagcccgcagatggtcggcgcgaacctggccggagaggtcaccaccgccgagccgtacacggtccgcccgccggacggcgtccccgtccgcttcaccgtcgcagcggtcgacctcggcatcaaagcgatgaccccgcagcggctcgccgaacgcggctgcgaagtgcgggtgctgcctgcccacaccacggccgagcagatcctcgccctcaacccggacggcgtgttcttcagcaacggccccggcgaccctgccgccgccgacgccgtggtggagaccatgcgcggcatcctggacgcgggcaccccgctgctcggcatctgcttcggcaaccagatcctgggacgcgccctcggcctggagacctacaagctgcccttcggccaccgcggcgccaaccacccggtccgcgagacccggaccgggcgcgtctacatcaccagccagaaccacggattcgcggtccgcgcgcccctcgacggcccgttcgacactccctacggccgcgccgaagtgagctacatcggcctcaacgacggcgtggtggaaggactgcggctgctcgaccgccccgcgctcagcacccagttccacccggaggccgcctccgggccccacgacgccgcggacgtgttcgacaccttcgtggagatgatgaccgcccaccgg

SEQ ID NO: 31880 - DNA, 3270 bp, Thermobifida fusca
atgccgcgccgtactgatctttcgtctgtgctcgtgatcggctccgggccgatcgtcatcggccaggcgtgcgaattcgactactcgggcactcaggcgtgccgggtgctcaaagccgaagggctgcgggtgatcctggtcaactccaacccggccacgatcatgaccgaccccgaattcgcggacgccacctacgtggaacccatcaccccggagatggtcgagaagatcatcgccaaggagcgtcccgatgcgctgctgcccaccctgggcggccagaccgcgctcaacaccgcggtggcgctgcacgaggccggggtgctcgacaagtacggggtcgaactgatcggcgccaacatcgacgccatccaggccggggaagaccgcgacagcttcaaacgcgtcgtggagcgggtcggtggcgagtcggcccgctcggtgatctgccactccatcgaagagtgcctggccgccgccgaagaactgaactatccggtcgtggtccgcccctccttcaccctgggcggcgccggctccgggttcgcccacaacgaggaggagctgcgccgcatcgcggggcaagggctcgcgctctccccgaccaccgaggtgctccttgaggagtccatcctcggctggaaggaatacgagctggagctgatgcgcgacgccaacgacaacgtgatcgtcgtctgctccatcgagaacctcgaccccatgggcgtgcacaccggcgactccatcacggtcgcccccgcgatgacgctcaccgaccgcgaataccagcggctgcgcgacctggggatcgccatcatccgcgaagtcggggtcgacaccggcggctgcaacatccagttcgcggtccaccccgagaccgggcggaccatcgtcatcgagatgaacccgcgcgtctcccggtcctcggcgctggcgtccaaagccaccgggttccccatcgcgaagatcgcggccaagctcgccgtcggctacaccctcgacgagatcaccaacgacatcaccgccaagacgctggccagcttcgagccgaccctggactacgtcgtcgtcaaagtgccgcggttcgcgttcgagaagttccccggcgccgactccggcctgaccaccaccatgaagtcggtcggcgaagtcatggcgatcggccggtccttccccgaagcgctgcagaaggccatgcggtcgctggagaagaaaggcagctccttcacctggacaggagaccccggggacaaagaggagctgctgcgggcggtccggacccccagcgaacaccggctgcgccaagtccagcaggccctgcgggccggggccacggtcgcggaactccacgaggccaccaagatcgacccgtggttcctcgaccagatcctccggttggacgagaaggcccgcgaactcgccgccgcgccccgcctcgacgcggacctgctgcgctccgccaaacagctcggcttctccgacgcgcagatcggcgagatcaccggccgctccgaagaagtcgtgcgggagctgcgcgacgccctcgacgtgcacccggtctacctggccgtggacacctgcgccgccgagttccccgcgaccacgccctacctgtactccagctacgacgaggagaccgaggtcccgcccagcagcaagcccaaggtcatcatcctcggctccggacccaaccggatcggccagggcgtggagttcgactacagctgcgtccacgcgtccttcgccctgtcggaggccggctacgagaccgtcatggtcaactgcaaccctgagacggtctccaccgactacgacaccagcgaccggctgtacttcgagccgctgaccctggaagacgtgctcgaagtggtgcgcgccgaacagcagaccggcgaagtcgtcggcgtgatcgtgcaactgggcggccagaccccgctcggcctggccaagaagctcaaagaagccggggtgccgatcgtgggcaccagccccgaggcgatcgacctggccgaagaccgcggcgagttcggccgggtcctggccaaagccgggctgcccgcccccaagcacggcaccgcccagtccttcgacgaagcccgggccatcgccgaagagatcggctacccggtgctggttcgcccctcctacgtgctcggcggccgcggcatggagatcgtctacaacgaggccatgctcgccgactacatcgagcgcaacgcggaagtcagtgccgaacacccggtgctggtggaccgcttcctcgacgaagccatcgagatcgacgtggacgccctctacgacggcaccgaactgtacctgggcggtgtcatggagcacatcgaggaggcgggcatccactccggcgactccgcctgcgctctgcccgcgatcaccctgggccaggaggacattgaacgcatccgctactccacggaggccatcgccgccggggtgggggtgcgcggcctgatcaacgtgcagtacgcgctctccgccggcgaactctacgtgctcgaagccaacccgcgggcgtcgcgcaccgtgccgttcgtgtccaaggccaccgcggtccccctggccaaggctgcagcccggatcatgctgggggcgaccatccaggagctgcgcgacgagggcctgctgccgcggcacggcgacggcggcactctgcccccggacgcaccggtcgccgtcaaggaagcggtcctgccgttcaaccgcttcattgaccgccacggccagggcgtggacaccgtcctgggcccggagatgcgctccaccggtgaagtcatgggcttggacgtggacttcggcaccgcgttcgccaagtcccaactggccacctacggcacgttccccacgtcgggaaccgtgttcgtctccgtggccaaccgcgacaagcgcaccatgatcttcccggtccggcggctggccgacctcgggttcgagatcctggccacggaaggcaccgcgctggcgctgcgccgccacggggtgcaggcccgcgtggtgcgcaagcacagcgaagggcctggaccggacggggagccgaccattgtgcagcgcatccacaacggtgaagtggatctcatcgtcaacacgccgttcggcggccccggccagtccggaccgcgcctggacggctacgagatccgcaccgccgcagtggcgcgcggcgtgcccagcgtgaccacggtccaaggcctggccgccgccgtgcaagccatcgagtcgctggtcaacggcaggatccaggtgcgttcgctccaggag

SEQ ID NO: 31881 - DNA, 897 bp, Thermobifida fusca
ctgcgggtcaggctgggggaactggagctggccaacccggtggtgaccgcggccggatgcgccggggccgggcgggagctggcgcggttcttcgacattgcgcggatcggcgcggtggtcaccaagtcggtcaccgtggagccgcgggccggctggcctgcgccgcgtatcgccgagaccccgagcggggtgctcagcacggttggcttgcaggggccaggcatcgacgtgttcgtgcagcgggacctgccgtggctgctctcccgcggggcgcgtgccgtggtgtcggtggccggggggagtgtcgacgagtacgtcacgctcgcccagcggctctccgaagctcccggggtcaccgcgatcgaagtgaacctgtccagcccggacttgagccgcgggggcgagcatttcaccgcggaccccgaggccgcagcccaggtggtggcggcggtgcgggagaccgcacggtccgacatcccggtgttcgcgaaactctccccggacgtcgccgacctggtggcgctcgccggcaagtgcgtggctgcgggcgccgacgggctggccctcgtcaacacggtgcggggcatggtcatcgacgtcgacacgatgcgtcccgccgtggccggggggatgggcggcctgtccggtcccgcgatccggccgatcgcggtcgcctgcgtctaccaggtgcatgccgcatacccggaggtgcccatcatcgggatgggcgggatcggcaccggccgggacgcgctggagttcctgctagccggggcgagcgcagtagcggtcgggaccgcgctcttccacgacccttcggcgtgcatgcgcgtgctgcgggaactggagcgggagctgatcgaccggggagtggagcgggtcgagtcgctgatcggg

SEQ ID NO: 31882 - DNA, 1188 bp, Thermobifida fusca
gtgtcccgtcgacttttcacctccgagtcggtcaccgaaggccaccccgacaagatcgctgaccagatcagtgacgcgatcctcgactcgatgctcagggatgacccccacagccgggtcgcggtggagaccctcatcacgaccggcctggtccacgtcgccggcgaagtgaccacatccacctacgtcgacattcccaccatcatccgcgagaagatcctggagatcggctacgactcctcggccaaggggttcgacggcgcctcctgcggagtgtccgtgtcgatcggcgggcagtcacccgacatcgcccagggcgtcgacaacgcctacgaggcccgggaggaagagatcttcgacgacctcgaccggcagggcgcaggcgaccaaggcctcatgttcggctacgccaacaacgagaccccggagctgatgccgctgccgatcacgctggcccacgccctgtcgcagcgactcgctgaagtgcgccgcgacgggaccatcccctacctgcggcccgacggcaagacccaggtcaccgtggagtacgacgggaaccggcccgtccggttggacaccgtggtggtctccagccagcacgcgcccgacatcgacctgcgggaactgctcaccccggacatcaaggagcacgtggtcgacccggtagtggcccgctacaacctggaggccgacaactaccgactgctcgtcaaccccaccggacggttcgagatcggcggcccgatgggtgacgccgggctgaccggccgcaagatcatcgtcgacacctacggcggctacgcccgccacggcggtggcgcgttctccggcaaggacccgtccaaggtggaccgctccgccgcgtacgccacccgctgggtcgcgaagaacatcgtcgccgccgggctcgccgaccgagtcgaagtccaggtcgcctacgcgatcggcaaagcccacccggtcggcgtgttcctggagaccttcggcaccgagaaggtcgccccggagcagttggagaaggcggtgctggaggtcttcgacctgcgtcccgccgcgatcatccgcgacctggacctgctgcgccccatctactcccagacctcggtctacggccacttcggccgggagctgcccgacttcacctgggagcgcaccgaccgcgtcgacgctctcaaggctgccgtgggc

SEQ ID NO: 31883 - DNA, 1170 bp, Thermobifida fusca
cctgccgcccctgacccgctggattttctggccgtggactcttcgctcagcgcggaggagcgtgctgtgcgcgacacggtgcgcgagttcggccgtcgcgagctgctgccgcacgtcgctgaatggtttgcggccggcacaatccccgacccgcacggcctagcccggaagttcgggcagctcggcctgctcggcatgcacttggacgggtacgggtgcccgggggcgggcgcggtcgcctacgggctggcctgccgggagctggaagcggtcgactcggggctgcgcagcttcgtctccgtgcaggggtcgctcgccatgaccgccatccaccgctacggctcggaagaacagaagcagcagtggctgccccgcatggccgcgggggaggcgatcggctgcttcggcctgacggaaccggactcggggagcgaccccggggcgatgcggacccgggcccgccgggtgggtgctgactgggtgctcaccggcaccaagatgtggatcaccaacgggtcagtcgccgacgtggccgtggtgtgggcgggcaccgaagaggggatccgggggttcctcgtccccgccggcacccccgggttcacggccacggtgattgaacgcaagctctccctgcgggcgtcgatcaccgccgcgctctccttggacgaggtccggctccccgactccgcgcggctgccgctcgcagcagggctgcgcgctcccctgtcgtgcctgaccgaggcccggtacggcatcgtctggggtgcggcgggcgcggcccgcgcctgctacgaggcagcactggaatacgccacctcccgcgaacagttcggccagcccatcgccgcgttccagctcacccagcgcaaactcgcggagatggtggtggacgtcaaccaggcgtcgctgaccgccctgcatttggggcggctcaaagaagcgggggcatgccaccactaccaggtgagtttcggcaaactcgccaacgtggccgcggcccagcgggtagccgccaaggcccgatccgtgcacggcgccaacggcatcaccttggactacccggtgctgcggcacctgctgaacctggagacggtcgccacctacgagggcacggaggagatccacacgctcagcctcggccaggcggtcaccggaatctccgcgttccgg

SEQ ID NO: 31884 - DNA, 1179 bp, Thermobifida fusca
atgttgcgctggctgaccgctggggagtcccacgggccggcactcgtcgcgatcctggagggcctaccggccggcgtgtccgtcacctcggacgacatcgccgccgccctgctccgtcgtcgcgccgggtacggccggggcgcccgcatgaagttcgagaaggacgaggtctccatcattggagggatccgtcacggccgcaccctcggcgggccggtggcgatccaggtgggcaacaccgaatggcccaaatggcagaaagtcatgtcccccgaccccgtgcccgccgaggagctcgaaggggtggcgcgcaacgcccccctgacccgcccccggcctgggcacgccgacctcgtgggcatgcagaagtacggctatgacgaagcccgcccgatcctggagcgcgccagcgcccgcgagaccgccgcgcgcgtcgccctgggtgaagtcgcccgccagttcctccgccaggcgctcggcgtggaaatcgtcagccacgtcgtggcgatgggcagcgtctccgtccccgacgacgcccccatccccgccccggaggacctcgcccgcgtcgacgccgacccggtgcgctgcttcgacccggagaccagcgcccgcatggtcgccgaagtagacgacacccgcaagaccggcgacaccctcggcggagtcgtcgaagtcatcgcctacgggctgccgcccggcctgggcagccacgtccactgggaccgccgcctcgacgcgcggctggctggggccctcatgggcatccaggcgatcaaaggcgtggaattcggcgacggcttccgcaccgctgcccggcgcggttccgccgcccacgacgagatcgacgtcggccccgacgggatccgccgccgcagcaaccgggccggcggcgtggaaggcggcatgagcaccggcgacccgctgcgggtccgcgccgcaatgaaacccatcgccaccgtgccccgggccctggacaccatcgacgtgagcacgggccagcccgcccaggcccaccaccagcgcagcgacgtcaccgcggtcccggctgcgggagtcgtcgccgaggcgatggtcgccctggtgctggccgacgccgccctggagaagttcggtggagactcggtcgcggaaaccgtccgcaacctgcgcggctacctggactcgctgatcgtccgg

SEQ ID NO: 31885 - DNA, 1032 bp, Thermobifida fusca
ccctacgacgtagtcgtgggcaacggcatcctgggagaactgcccgccctcgtgggggagcgcgcccagcgggtcgcagtcatccaccccgacaccctggaggagaaggcccggcccgtgtgcgagatcctgcgcaccgccggatacgacgtcttcccgctccccgtcccggacggggaggccgccaaagacgtctccgtggccgcagacctgtgggctcggctcggccaggctgccttcacccgcaccgacgtgatcgtgggcgtgggcggcggggccaccaccgacctggccggattcgttgcagccacctggctgcggggggtgcgcgccatcctcgtgcccaccaccctcctcggcatggtcgacgccgcggtcggcgggaagaccgggatcaacaccgctgaagggaagaacctcgtcggcgcgttccacccgcccgccggagtcgtgtgcgacctcgacaccctgccgtccctgccgcgggaggactacatcggcggcctcgccgaggtcatcaaagccgggttcatcgccgacccggtcatcctggacctggtcgaagccgacccggaggccgccacccggcccgacggcgcacacacgcgggaactcatcgaacgggccatcgcggtcaaagccgaggtggtctccgctgacctgcgcgaaagcggacgccgcgagatcctcaactacgggcacacgctcggccacgccattgaacgcgccgagaactacacgttccggcacggctacgcgatctccatcggcatggtctttgccgccgaactggcccgcctggacggccggatcgatgcggcgctcgtggcccggcaccgccgtatcctggaatcggtgggacttccggtgcgctaccgcgccgacgcctggcccgccctgcgggacacgatccgggtggacaagaagacccgcggcgcaaccctgcgcttcgtcgtcctcgacgacgtggccgcacccgcgatcctggccggtccctccgatgccctgctggcccaggcctaccaggcggtg

SEQ ID NO: 31886 - DNA, 798 bp, Thermobifida fusca
gaagagccggagcagatcggcgggcaccggatcgtcgaacggatcggcaccggaggcgccgcggcggtctacgccgccctcgactccgcaggccactgggtggcagtcaaagtcctccacccgatggtcgccgccaacaccacttgccggaaccggttcgcccgcgaagtcgccctgctgagggaggtcgccgacacgtacacggccccgctcctcgacgccgacatccacaccgagcggccctggctggccatgcgctacatcgcaggccccaccgtgggccgccgcgtcgacgcggaaggaccgctcatgggggtagagctcctcgagttcgccgccgggctggccgaagcggtcgcggccctccaccgtgccgggatcgtgcaccgcgacctcaaacccggcaatgtcctcctcgccggagacggcccgaagatcatcgacttcgggatcgcccggcgcaccagcgaaaccggcgacgcggacagcggcaagatcctcgggtcccccgggtggatcagcccagaacagttccaccaccgcgttcccggacccgccgccgacgtcttcgcctggggcggcctcgtcgcctacgccgccaccgggcggcggccgttcggatccggcacactgcggcagaccgtggaacgcgtcctccacggggaagccgacctgcgcggcacccccagcctgctgctgccctgggtgcaggccgccttggacaccgacccggaccgcaggcccgcggcagcggaactcgccgcagcaatcggcgccctccgggacgggcaccagccc

SEQ ID NO: 31887 - DNA, 1281 bp, Thermobifida fusca
gtgatctcccgaatcgatcttcgaggcaaccccgcagacccgcgcgcatcactgccgcgcgctgagatagacgtcgcgtccgcagtcgaaaaagtccgacccatctgcgaagacgtacgccatcgcggggttgaggcgttgatcgagctaggggagcgcttcgacggcgtgcgccccgcccacatccgggtgcccgccgacgcgctggaaaccgccctcgccggacttgaccggaccgtgcgcgccgcactggaagaggcgatccgccgggcccgcatcgtccaccgcgaccagcgccgcaccgacaccaccacccgggtcgtgcccggaggaaccgtcaccgaacgctgggtgcccgtcgaccgggtcgggctgtacgtgcccggtggccgtgccgtctacccctccagcgtggtcatgaacgtcgtgcctgcccaagaagccggggtgccctccctcgccgtggcctccccgccgcaggccgaattcggtggactgccgcaccccaccatcctggcggcctgtgccctgctcggcgtagacgaggtgtacgccgtgggcggtgcccaggccatcgccatgttcgcgtacggtgcgggcgagtgcgctcccgtcagcatggtgaccggccccggaaacatctgggtcgccgccgccaaacgcctcctcaaaggcatcatcggcatcgactccgaggcagggccgaccgagatcgccatcctcgccgacgacaccgccaaccccgcctacgtggcagcggacctgatcagccaggccgaacacgacgtcgtcgccgcctcggtcctcgtcaccccgtcaaccgccctcgccgaccgcgtggaagccgaactcgcgcgccaggttcccgccgccaagcaccgggaacgcatcacccaggccctgggcggcccccagtccggcattgtcctcgtcgacgacatcgaccacggcctggacgtcgtcaacgcctatgcccccgaacacctggaggtcatgaccgccgacgcccagtccgttgccgcccgcgtccgcaacgcgggagcgatcttcatcggcgaccactctccggtgtcgctgggagactactgcgcgggttccaaccacgtgctccccaccggcggggtggccgtccactcctcgggactgagcgtgcagagcttcctgcgcggcatccacgtcgtcgaatacgaccgtgccgcactggccgaagtcgcccaccacgtggtggccctcgccgaagccgaagacctgcccgcgcacggtgcggctgtcaccgcgcgc

SEQ ID NO: 31888 - DNA, 1056 bp, Thermobifida fusca
ttcagcatcgacgacctgccgctccgcgacgacctgcgcggccaggccccctacggcgccccccagttgacggtgaaagcggtcctcaacaccaacgagaacccgtacccgccgtccccggaactggtggaggcgatcggccgtgccgccgcggaagccgccgtcggcctcaaccgctaccccgaccgcgaagcaaccgccctgcgccaggccctcgccgactacctcggccacggggtggacgccgccaacgtgtgggcagccaacggctccaacgagatcctccagcagatcctgcaggcgttcggcgggcccgggcacaaagccctagggttcgaaccgtcctactccatgcacccgatcatcgcgcgcggcaccgccaccgaatgggtgtcggtcccccgcaccgcagacttcgacgtggatgcggacgccgccgtcgccgcggtcaaagaacacgagccgtccgtcgtcttcctcacctcgcccaacaaccccaccgggaccgcgctcccgctggccacggtggaggcgatcgctgcagccgcccccggtgtcgtcgtcgtggacgaggcgtacgccgaattccgccgggaagggacccccagcgcgctgtcgctgctgcgcacctaccccaacgtcatcgtgtcgcgcaccatgtccaaggcgttcgccatggcaggggtccgcttgggctacctggccgcgcacccggctgtcgtcgacgccctgcaactggtgcggctgccctaccacttgtcgaccgtgacccaggcggtagccttgactgccctgcggtacgccgacgaactgctgagtgcggtcgccaccctccgcgccgaacgcgacgccctcgtcgactggctgcgcgcccacggcttcgaggtcgccgactccgacgccaacttcgtcctcttcgggcggttccccgaccgctcggcggtcttccagcaccttctggaccagggggtgctcatccgggaagtgggaccgcccgaatggctgcgggtcaccgtcggcacccccgaggagatggcgatcttccgagaggcgttg

SEQ ID NO: 31889 - DNA, 591 bp, Thermobifida fusca
atgagccgcatcggccgcgtcgaacgcgccaccaacgagaccaaggttttcgtcgaggtcaacctcgacggcaccggtgccgccgacatttccaccggcgtcggtttctacgaccacatgctccaccagatcgccaagcacggactgttcgacctgaccgtgcgcaccgaaggcgacctgcacatcgacgcccaccacacgatggaggacaccgccctcgccctgggggcggcgttccgggaagccctcggcgaccggagcgggatccgccgcttcgccgacgccaaagtccccttggacgaggcgctcgccgaagtcaccgtcgacatttcgggccgcccctacctggtgcactccgaacccgaaggcatggccccgatgatcggccgggactacgacaccacgatgacccggcacatcttcgagtccttcgtcgcccaggcgcggatcaccctgcacgtccacgtgccctacgggcgcatcccccaccacatcgtggaatgccagttcaaggcagtggcccgcgcgctgcggtccgcctgcgaacgcgacccccgcgtcaccggggtgccgtccaccaagggcacgctg

SEQ ID NO: 31890 - DNA, 768 bp, Thermobifida fusca
atgagcctggcagtacgcgtcatcccctgcttggacgtggatgggggccgggtcgtcaaaggcgtcaacttccagaacctgcgggacgcgggcgacccggtggagctggcccggcgctacgacgctgaaggcgccgacgagctgacgttcctcgacgtcaccgcgtccagcagcaaccgcgagaccacctacgacgtggtgcgccgcaccgccgagcaggtgttcatccccctcaccgtggggggaggggtgcgcagcaccgaggacgtcgaccggctcctgcgcgccggagcagacaaggtcagcatcaacaccgcggccgtgcggcggcccgaactgatccgcgaaatcgcccaggagttcggcagccaggtcctcgtgctctccgcggacgtgcgccgcaccgtcaacggcacggccacccccagcggtttcgagatcaccacccacgggggccgccaagggaccggcatcgacgcggtcgaatgggtgcagcaggctgaagagctcggggccggggagatcctgctcaactccatggacgccgacggcaccaagtccggcttcgacctggagctcatccgcgcagtccggaaagcggtgaacgtgccgctcatcgccagcgggggagcgggcgcggtcgaacacttcgcccccgccgtggacgcgggcgccaatgcggtcctcgccgccagcgtgttccacttcggggagatcaccatcagcgacgtcaaagccgagctgcgggccaaaggctacccggtgcgc

SEQ ID NO: 31891 - DNA, 2286 bp, Thermobifida fusca
tcacgcgcgccgcaggaagacccccgtcaggacacgcccgcgatcagcgctccgacccggtcggccgcgggtatcccggcggtcatcaacagcctgcgggtggtcagccgccagtccggtgccgcgcgcggcctggcaaccttgcgtgacgtcaaccagaagacaggcttcgactgcccgggatgcgcctggccggaggggaagcgccgccacctcgcggagttctgcgaaaacggcgccaaagcggtggcggaagaagcgacacgccgcgcagtgacccccgagttcttcgcccgctactcggtggcggaactggccacccgctccggctactggctgggccagcagggacggctcacccacccggtcttcctggacaagggcgccacccactacgtgccggtgtcctgggagcgcgctttctccctgatcgctgaggagctagccgcactggactccccggacgaggccgtgttctacacctcgggccggaccagtaacgaagcagcgttcctctaccagcttttcgcccgcaagttcggcaccaacaacctgccggactgttccaacatgtgccacgagtcctccggggtggcgctcaccgagacgctcggcgtcggcaaaggcagcgtgctgctggaggacctctaccaggcggatctgatcattgtggccgggcagaacccgggcaccaaccacccgcggatgctcagcgccttggagaaggccaaacgcggcggcacccgcatcatcacggtcaaccccctgcccgaagtggggctgatgcggttcaagaacccgcagaaggcgcgcggcattgtcgggggcggcacccggctcaccgacctgttcctgcagatccgcctgggcggggacttggcgctcttccgcgcctggaaccggatgcttgtcgaagcggaccgggacaactccggctcagtgctggatcgggagttcattgccgagcacacccacggcttcgacgcttttgtcgacgaactgtgcgccgacagcgacgagaagttctgggccgacgtcgacaccgccacgggcctgccgcgggagcagatcaccgaagcactggagatgatccaggccagcaagcggatcgtcgtgtgctgggcgatggggctgacccagcacaagcattcggtgcccacgatccgcgaggtcgtcaacttcctgctgctgcgcggcaacgtgggccgccccggagcaggcgtgtgcccggtccgcgggcacagcaacgtgcaaggcgaccgcactgtcggcatcgtggagaagccgaaagaggagtttctcgacgcgctcggcgcagaattcgggttcgagccgccgcgccaccacggctatgacacggtgcgagcaattcgtgccatgcgggacggcaaggtgggggtgttcttcgcgatgggcggcaacttcgtgtccgcctcccccgacacgcttgtcaccgaggacgcgatgcggcggtgccggctgaccgtgcacgtgtccaccaagcttaaccgttcccacgtggtcaccggggctcgggcgctcatcctccccgccctagcccgcaccgaccgcgacctgtcgggcggcaaggagcagtttgtcacggtggaaaactcgatggggatggtgcactcgtcccgcgggtcggtgcggccgctctctgaccagatgcggtcggaagtgtcgatcgtggcgggcctggcccggcgggtgttcggcccggacgacccggtgccgtgggaggacttcgcccgcgactacgacctgatccgcgaccggatcgagcgggtcatccccggttttgcgaactacaacgagcgggcgcgccgccccggcgggttcctgctgccgcatgcgccgcgcgacagccgccgcttccccaccgccacggggaaagccaacttcacggtcaaccggatgactccgctgactgtgccggaaggacgtctgctgctgcagaccctgcgctcgcacgaccagtacaacacgacggtctacgggctcgacgaccgataccggggggtacgcggcggccgacgggtggtcctcgtcaacccggaggatgcgcagcggctcggcctggctgacggctcgtacaccgacattgtcagcgaatggccggacggtgtggagcggcgggccgcccactacctggtcgtgtactatccgacggctccgggctgtgccgccgcctactatccggagaccaacgtgcttgtgccgttggactcgaccgcggaagggtcgaacacgcccacgtcgaagtcgatcgtggtgcggttcgaa

SEQ ID NO: 31892 - DNA, 891 bp, Thermobifida fusca
aacggaatcctgttcttcccgctgacccccttcgacgagcggggagacgtcaacgaggccgcgttcgaacagcacgtggcttctggactcgaccatggggcgggcggcgttttcgcggcctgcggcacgggtgagatccacgccctgtccgctgaggagcacgcccgcgtcgtgcgccgcgccgtcgcggtgaccgcgggacgggtccccgtgatcgcgggcgccgggggcagtgtgagcaccgcgatcgagcaggccaccgcggcccgggaactgggcgcggacggggtcctgctgctcccgccctacctggtgcacgccccccagcgcggcctggtggaatacgtgcgcgcagtaacctccgccgtggacattccggtcatcgtctaccagcggggcaccatggtgttcaccccggacagcgcggccgagctcgcggagatccccacagtggtggggttcaaagacggggtgggcgacgtgggcaccatgcgccagatcgtgctgaccgtccggcagcggcgcggcgacaactttgttttcttcaacggcctgcccaccgccgaactgaccttccacgcctaccaggggatcggggtgccgctgtactcttcggcggcgttcgcgttcgtgcccgaggttgccaccgcgttctaccgggccgcccacgcgggcgaggaactcgccgaccgcctgctccgcgacttctacgacccgttggtgcggttgcgggaccgcgtccccggatacgcggtctccttgatcaaggcgggggcgcggctgcgtggcgcggacgtgggcggggtgcggccgccgttcgtcgacccgagtgaagagcacctcgcggaactgcgcacgatcatcgacaccggcctggcattgctcaaggag

SEQ ID NO: 31893 - DNA, 1014 bp, Thermobifida fusca
ccgctgggcgcggtgacgatcatccttccccccacctgggcgctggcggtcctcgccaccagtctcccgcacgccctcgtcgcggggaacaccgtgatcgtcaccccctcgccgaccgctccgctgaccgtcgtccgcaccctccaactgcttgccgaacggctccccgccggagtcctcaacgttgtcaccggaagcgacgaagccgtctccccgaccatccgggacccccgggtacggcggatcgtcttcaccggcagtccggaggcgggccggaccatcctgcgggtcgcagccgacaccatcacccgggtgacgctgcaactcggcggaaacaaccccgcgatcctgctcgacgacgtcgcccttgacgcggtcaccatcgaacggatcgccgtcggcgccttcatgatcgcgggccaactgcaccggggagtgaaacgcctctacgtccaccgctcccgctaccaggaactggtcgaagccctctccgcgcagctcgccaaccaccggatcggacacgggctgcacccggacaccaccatggggccgctcatcaacgcccgggatcgcgaccacgcccgcgaccttagcgaccgtgcccgcgccatcggctgcgaagtgcgggaattcggggaaatcggcgaagagacccagcagagcggaggctacttcctgcgccccgccctggtcctcgacccgcccctggacgagagcatcgtggtcgaagcccagtccgggccggtcctgccgatcctgccctatgacgacgtggaccgggtggtcgcggcagtaaaccaggaccgggccgggctgtgctcctcggtgtggagcacagacctggaccgtgccggcgaagtcgccgcccgcctccgcacgggaaccacctggatcaacggtgccggagtgctcgccgaggacgaccgcgccccgtccggcggattccggcagagcggcatcggcctgcagaaaggcatcgaaggcctcatggagatgagcgaaacgcacaccgtg

SEQ ID NO: 31894 - DNA, 798 bp, Thermobifida fusca
gtccctactgtcaccctcaacaacggggtcaccatgccccaactagggttcggcacctggcaggtaggctacgacgcggtcgctgcggcgctggcggccgggtaccgctgcttcgacactgccgagatgtaccgcaatgagactgcggtcgccgcggcgctcgctgactccgggctggaccgctcggacgtgttcatcaccaccaaactgtggaacaaccaccacggattccaaccggccttggacgcgttccacgccagccgccgcaggctcggcctcgacgtcatcgacctgtacctcatccactggcccaacgcgtccgatgcagtcaacgtggaaacgtggcgggcccttgagcagttgtacgcggaaggcgtggtacgcgcgatcggcgtgtcgaacttctcccccgcccagctcgccgtcctccttgaggcctgcgacgtggtgccagcggtcaaccagatcgagctcaacccgtcccggccgcgcctcgaagagcgcgtctaccatgcccgacacggcatcgccacccaagcgtgggcaccgttggcgaaagggggagccctgctcacccacccggtgatcactgagatcgcggaagcccatcagaagaccccggcccaagtggtgctgcgctggcacctgcagcacggcatcctggtcatcccccgctctgccacgccggagcggatccgcagcaattttgctgtaaccgacttctccctcgccccgcaggagatggctgccgtggatgccctgggcgcgtgacacgcccggtctggcagcgggccgtgc

SEQ ID NO: 31895 - DNA, 726 bp, Thermobifida fusca
ggcaaagtcgcggtggtgacgggcgccagccgaggcatcggattcgccgtggcacgccgcatcgtcgacgaaggaggccgggtggtggtcaccgcgcggggtgcggaagccctcgccgaagccgtcacccagctcggcggccccgaacacgcgctgggcatcgcaggacgggcccacgaccaggcccaccgcgccgaagtcgtccaacgcaccctggacacgtttggccgtgtcgacgtcctcgtcaacaacaccggcatcaaccctgtcttcgactcgatcctcaaggtcgacgaggcagccatggccaagatcttcgaggtcaacgtgatcgccgcggtgggctgggtgcgcgaggtctacaacgcgtggatgggggagcacggcggggcgatcgtcaacgtggcctccctcgccggccagcacccctcgcccgggatcggcatctacggcgccagcaaggcggcactgatcaacctcacccagcagttggcctacgaactggcgcaccgacggatccgggtcaacgcggtcgcacccgccgtcgtcaaaacccgtttcgccgaagcgctgtacgcggagaacgaagagaaagtcgcggccggatacccgctgggacggctgggtgaacccgatgacatcgcggcagccgtcgcctacctggcgtcctcggacgcttcctgggtgaccggacaggtcatcactttggacggcggcaagaccctg

SEQ ID NO: 31896 - DNA, 1398 bp, Thermobifida fusca
gtgtctacaacgggagaggcccccagcagcggtgaagtgaacatcgcccacgtggtgatgattgcggcagccgcggcgatgggcggattcctgttcgggtacgacagtgccgtcatcaacggtgcggtgagcgcgatccaggacacctttcgggtcggctccactgtcatcgggttcacggtggccgctgccctgatcggttccgcggtgggggcggcgatcgcgggtgccctggccgaccggatcggtcggatccgggtcatgcagctcgcggctgtgctgttcgcggccagcgcggtcggatccgcgctccccttcaccgtctgggacctggcctggtggcgcgtggtcggcggcgtggcgatcggtatcgcctcggtgatcgccccgacctatatcgccgaagtgtccccgcccgcgttccgcggccgcctcgcctcgctgcaacagctcgccatcgtcctcgggatcgccacctcccaactggtcaactacgggctggccgccgcggtgggtggcagcgccctccaccggctcggcccgctgcaggcctggcagtggatgctcggcatcgaagtgctgcctgccgccacgtactttgtactgaccctggtcattcccgagtcgccccgccacctcgtccgcatcggccgcgatgcccgcgcacgccgcgtcctcgctgaagtcgaaggcggtgacgtggacggccgtgtggcggagatccgccgggtgctcggccgggaacgccgcccccgcctgcgcgacctgcgcggccgctacgggctgctggccatcgtgtgggtgggcatggccctgtccgcgttccagcagctcgtcggcatcaacgtgatcttctactattcggcggtgctgtggcagtcggtgggtatcgcggaaaccgactcgctgctgctgagcctgttcacgtccatcgtgaacatcgtcggcaccctgatcgcgatcggcctggtagaccgggtgggacgcaaacccttgctgctggccggatcggcggggatgacggtggcgctggccttcaccgcattcgcgttcagccacgcccgaggggaaggagacgacgtggtgctgtcaacggcgtgggccttgaccgccctggtctccgccagcacgttcgtcctgttcttcgcgctctcttggggagtggtcacctgggtgctgctcggcgagatgttcccgctgcggattcgcgctgcagccatggccgtggccaccgccacccagtggatcaccaactggctggtgaccgtcaccttcccgtcgctgcgtgactggagccttcccggcacctacctggtgtacacggcgttcgcgctgctgtccttcgggttcgtgctccggttcgtgcgggaaaccaaaggccggacactggagtcgatg

SEQ ID NO: 31897 - DNA, 1392 bp, Thermobifida fusca
ggtgcgcctgcggctagcgaccgcaactcgctgagcgtgggcagcaacggcccgctgctgctgcacgacgtacggctcgttgagacgctcgcccacttcaaccgtgagcgggtccccgagcgcaacccgcacgccaagggcgccggtgccttcggtgtcttcgaaaccacggaggacgtctcccagtacaccaaggctgccctgttccagaagggtgcccgtaccgagatgctcgcccggttctccacggtcgctggtgagcagggctccccggacacctggcgggacgtgcgcggtttcgctctgaagttctacacctctgagggcaactacgacctggtcggcaacaacacgccgatcttcttcgtccgcgacccgatgaagttcccgcacttcatccgctcccagaagcggatgccggacacgggtctgcgcgacaacaacatgcagtgggacttctggaccctcaacccggagaccgcccaccaggtcacctacctcatgggtgaccgcggcctgccgcggacctggcgccacatgaacggctacggttcgcacacctacatgtggatcaacgccaagggcgagaagttctgggtcaagtaccacttcaaaaccgaccagggcatcgagaacatgaccaacgaggaagccgagcgtctcgccggtgtggacgccgacttccaccgtcgtgacctggtcgaggccatcgaacgcggggactacccgagctggaccctctacgtgcaggtcatgccgtacgaggacgccaagacctaccggttcaacccgttcgacctgaccaaggtctggccgcacagcgactacccgctcatcaaggtcggcaagatgaccttgaaccgcaacccggagaacttcttcgccgagatcgagcaggccgcgttcgcgccgtcgaacctggtcccgggtatcggcgtctccccggacaagatgctgctgggccgcgtcttcgcctacgcggacgcccaccgggcccggatcggcaccaactacttccagctgccggtgaacaagccgcgggtgaaggtcaactcctacaccttcgacgggcacatgacctacgagcactccggcaaggccccggtgtacgcgcccaactcctacggccgtccctggtctgaccagaccggcccggtcgaggacagctgggaggccgacggcgagctggtgcgcagcgcctacgagctgcacgctgaggacgacgacttctcgcaggccggcaccctggtccgcgaggtcttcgacgacgcccagcgggaccggctcgtggagacggtcgccgaccacctgtccaagggtgtcgtcgagccggtgctctcccgggccttccagtactggaagaacatcgacgagaccatcggcgagcggatc

SEQ ID NO: 31898 - DNA, 1143 bp, Thermobifida fusca
agtgacttcgacctctaccggcccaccgaggagcacgaagccctccgcgaagccatccgctccgtcgctgaagacaagatcgccccgcacgcggccgacgtcgacgagcagtcccgcttcccgcaggaggcctacgaggcgctgcgcgccagcgacttccacgctccccacgtcgcggaggagtacggcggtgttggcgcagacgcgctggcgacctgcatcgtcattgaggagatcgcccgggtgtgcgcctcctcttccctcatccccgcggtcaacaagctcggctcgatgccgctgatcctctccggatctgacgaggtgaagcagcgctacctgcccgaactggcatctggcgaggcgatgttctcctacgggctctccgagcgcgaggcgggatccgacaccgcgagcatgcgcacccgtgccgtccgcgacggcgacgactggatcctcaacggccagaagtcgtggatcacgaacgccggaatctccaagtactacacggtgatggcggtcaccgacccggacgggccgcgcggacgcaacatcagcgctttcgtcgtccacatcgacgatcccgggttctcttttggagaaccggaacgcaagctcggcatcaaaggttcgcccacgcgcgaactgatcttcgacaatgtccgtatccccggcgaccgcctggtgggcaaggtcggggaaggactgcgtaccgcgctgcgcaccctcgaccacacccgcgtcaccattggcgcccaggctgtgggcatcgcccagggggcgctcgactacgccctgggctatgtcaaggagcgcaagcagttcggcaaggccatcgccgacttccaaggcatccagttcatgctcgccgacatggccatgaagctggaagcggcccgccagatggtttacgtcgctgccgccaagtccgagcgcgacgacgccgacctctccttctacggtgccgccgctaaatgcttcgcctcggatgtggcaatggagatcaccactgacgcggtgcaactactcggcggctacggctacacccgggactacccggtcgagcggatgatgcgcgacgccaagatcacccagatctacgagggcaccaaccagatccagcgggtggtcatggcccggcagctc

SEQ ID NO: 31899 - DNA, 669 bp, Thermobifida fusca
ccacgaccgttgcacgaaatcatggagagcgggtgggccgaggcactggagcccgtggccgaccgtatcgcgcagatgggtgactttctgcggcaggaggtggccgaaggccgcacctacctgcctgctggggagaacgtgctgcgcgccttccagcagcctttcgaccaagtgcgggtgctccttgtcggccaggacccctaccccacgccggggcacgctgtcgggctgagcttctccgtctcccccgaagtgcgccgcctgccgggcagcctgcgcaacattttcctcgaatacacccaagacctcgggtatccgatgccgtccagcggggacctcaccccgtgggcggaacgcggcgtgctgctgctcaacagggtgctgaccgtgaccccgcgcaaaccgggatcgcaccgcggcaaaggctgggaagccgtcaccgaccaggcgatccgcgccctcgctgcccgcggcaaaccactcgtggccatcctgtggggccgggacgcgcgcagcctacgcccgctcatgccggacgtgccgtgcgtagagtccgcccaccccagccccatgtcggcgcaccacggcttcttcggttcccgcccgttcagccgcgccaatgccctgctggaacagcagggcgccgaacccatggactggcggctgccc

SEQ ID NO: 31900 - DNA, 747 bp, Thermobifida fusca
ggcgcagagcgcctgcacgtgcgggcgtgggccccggctgccggcgaccccgccttcttggtggtgctggtgcacggctacggcgagcacatcgggcgctacgagcatgtggcgcgctggctgtgcgagcatggcgcggtctgctacggggtggaccaccgcgggcacggcacctcctcgggggaacgggtgctcatcgacgacttcgcggggattgtggaggacgtgcaccgggtggtcacccaggcgcgcaccgcctaccgggcgctgccgctggtggtcgtcgggcattccatgggcgggctgatcgcggcccgctacgtgcagacccatccagaggaggtgtccgggctggtgctgagcgggccggtgctcggcgagtgggcggtcgtcgacgagctgctggcccacgacgagattcccgaggtgccgatcgacccggcgaccctgtcgcgtgaccccgaggtgggcgcggcctatgccgccgacgagctcgtgtggcacggcccgttcaagcggcccactctggaggccttccgcgtggaattggcgcgcgctacggcggcggggaaggtggaggcacccctgttgtggctgcacggctctgacgacgctctggtgccgttggagggcacggtgcgggggattctcaccctggcggggccggacacgacggcgcggatcttcccgggggcgcggcacgaggtgttcaacgagaccaaccgcgacgaggtgctcggggaagtg

SEQ ID NO: 31901 - DNA, 1119 bp, Thermobifida fusca
ggacggcccgaccaaccccccaacatcctgttcatcctcgccgacgacctcggctgggccgacctgggctgctacggttccaccactatccgcactcccaacctcgaccagctggccgcccaaggcatccggttcacccacggctatgcgggatcaccttggtgctcctccaccaggatcagtctgtacacggggcgctacccgggacgcttgcaagccggcctcgaagaaccgctcgtcacccgttccccggaaaacggcatcccggaaggccaccccaccctttcctcacttctcgttgaggccgggtacgccaccgccatgttcggtaaatggcactgcggctggctgccgtggtacagcccgttgcggatcggcttcgaaaccttcttcgggaacttcgacggggccctcgactacttcgaacacgtcgacactcttggcaaagccgacctgtacgaaggggagaccccggttgaggaagtcggctactacacggagatcatctccgagcgggccgctgaatacatcaccgcgcaccgcaaccggccgttctacgtgcaactcaactacaccgcgccccactggccgtgggaaggacccgacgaccacgaagtcggacaagaaatccgccgccgctaccagcagagatgggagcactccccgctgatgcacctggacggcggttcgatcgctaaatacggcgaacttgtggaagccatggacgcgggcatcggacaggtcctggccgctctcgacagggccggggccgccgacaacactatcgtcgttttctcctccgacaacggtggggaacgctggtcgaaaaactggccgttcgtgggggagaaaggcgacctcaccgaaggcggcatccgtgtcccgctcatcgtggcctggccggaagcgatagccggaaaccaggtgagcgaccatcccgtcatcaccatggactggacagcgaccctgctcgccgccgcgggaaccgaaccgcaccccgactggccgctcgacggtgtggacctgctgccgtggctggtcgacggcgccgactttcccgcccacgacctgttctggcgcacctccaaccagggggcgctgcggcgaggccggttcaaa

SEQ ID NO: 31902 - DNA, 1344 bp, Thermobifida fusca
ctcgatgagaaactgtccccgatctacgaggaaatcctgcggcgtaacccgggggaggtcgagttccaccaggctgttcgcgaagtcctggagtgcctcggccccgtggtggccaagaaccctgacatcagccacgccaagatcatcgagcggctctgtgagccggagcgccagctgatcttccgggtgccctggatggacgactccggtgagatccacgtcaaccggggtttccgggtggagttcagcagctctttgggaccttacaagggcgggctgcggttccacccgtcggtgaacctgagcatcatcaagttcctcgggttcgagcagatcttcaagaactcgctgaccggattgccgatcggcggtgcgaaaggcggcagcgacttcgacccgaagggccgttccgacgccgagatcatgcggttctgccagtcgttcatgacggagctgtaccggcacctgggtgagcacacggacgtgcctgccggtgacatcggcgtgggccagcgtgagatcggctacctgttcggccagtacaagcggatcaccaaccgctacgagtcgggcgtgttcaccggtaagggcctcagttggggcggttcccaggtgcgtcgtgaggccaccgggtacggctgtgtgctcttcactgcggagatgctgcgagcccgcggcgactcgctggaaggcaagcgggtctcggtgtcgggttcgggcaatgtggcgatctacgcgatcgagaaggcccagcagctcggcgcgcatgtggtgacctgctcggactccaacggctacgtggtggacgagaaggggatcgacctggagctgctcaagcaggtcaaggaggtcgaacgcggccgggtgtccgactacgccaagcggcgcggctcccacgtccgctacatcgactcgtcgtcgtccagcgtgtgggaggtgccctgcgacatcgcgctgccgtgcgcgacgcagaacgagctgaccggccgcgacgctatcaccctggtgcgcaacggggtgggcgcggtggcggagggcgcgaacatgcccacgaccccggaggggatccgggtgttcgcggaggcgggcgtagcgttcgcgccgggcaaggccgcgaacgcgggcggggtggcgacgagcgcgttggagatgcagcagaacgcgtcccgcgactcgtggtcgttcgagtacaccgagaagcggctcgcggaaatcatgcgccacatccacgacacctgctatgagacggcggaacgctatgggcggcccggcgactatgtggcaggtgccaacatcgctgctttcgagatcgtcgctgaggcgatgctcgctcagggcctgatc

SEQ ID NO: 31903 - DNA, 1170 bp, Thermobifida fusca
agcgaagacctcatccacatccgcgactgggtccacgaattcgcccgcgacgtcatgcgcccagccgccgccgaatgggacgaacgcgaagaaaccccctggccgatcctccaagaagccgccaagatcggcctctactccctcgacttcttcgccaaccagatgttcgaccccagcggcatcgccatccccgtcgtctacgaagagctgtactggggcgaccccggcatcgcgctcgccctcaccggcaccaccctcgccgccgtcgccgtcagcgccaacggcacccaggagcaaatcctggaatggaccccccaaatgttcggcacccccgacgacatcaaactcggcgccttctgcgtctccgaacccgacgcgggaagcgacgtcggcgccatccgcacccgcgccgtctacgacgaagccaaagacgaatgggtcctcaacggcacgaagacctggatcaccaacggcggcatcgccgacgtccacgtcgtcgtcgcctccgtcgacccggaactcggcacccgcggccaagccagcttcgtcatcccgcccggcactaaaggcctctcccaaggccagaagttcagcaaacacggcatccgcgcctcccacaccgccgaggtcatcctcgacgacgtgcgcatccccggccgctgcctgctcggtggcaaagagaaactggaccagcgtcttgcccgtgcccgcgaaggccgccgctccaagggccaagccgccatgaaaaccttcgaagcctcccgccccgccgtgggagccatggccgtgggctgcgcacgcgccgcctacgaatacgcccgcgactacgtccgccagcgcgaacagttcggccgtcccatcggcgacaaccaagccgtcgccttcaccctcgccgacatggcgacccgcatcgacgccgcccgcctgctggtgtggcgcgcctcctggatggcccggtacggaaaagaattcgccaacgccgaaggctccatgagcaagctgtacgccagcgaaaccgctacctgggtcacccagaacgccatccgactgctcggcggcaacggctatacccgggactacccggtggaacgctggcaccgcgacgccacgatcttcaccatcttcgaaggcgcctcggagatccagcgtctcatcattggtcgcgccatc

SEQ ID NO: 31904 - DNA, 2244 bp, Thermobifida fusca
cagcttctcgaaggtctcaacgagctccagcgcgccgcggtgctccaccacggcagcccgctgctgatcatcgctggagcggggtcaggcaagacccgtgtcctcacccaccgcatcgcctacctgctggccgagcggggagtccgccccagcgaggtgctcgcgatcaccttcaccaacaaagccgcagccgagatgaaggagcgtgtcgagcggctgctcggtgaacgcacggccagcgccatgtgggtgatgaccttccactcggcctgtgtgcgcatcctgcgccgcgaggcggcccgcctgggataccccagcagtttcaccatctacgactccgcggactcccagcggctgatgcaactggtctgccgcgaactcgacctggaccccaaacgcttcccgcccaagtcgttctccgcccaggtgtcgagcctgaagaacgaactggtggactacgacacgttcgcggggcgggcagaaaccgtgcaggagcgcgctctcgcggaggcgtaccagctctaccagcagcgcctctacgaggcgggggcgatggacttcgacgacctcatcatggtcacggtccatctgctgcagatgttccccgaggtcgccgagcactaccggcggcggttccggcacctgctggtcgacgagtaccaggacaccaaccacgcccaatacgccctgatccgggagctcgtaggcgacggcgaccccgccaccccgggaccggaattgtgcgtggtgggcgacgccgaccagtccatctacgccttccgcggggcgacgatccgcaacattctggagttcgagcgcgactacccgcaggccaccaccatcctgctggagcagaactaccggtccacgcagaccatcctctccgcagccaacgccgttatcgcgcacaacacggagcgccgcccgaaaaacctgtggtccgcccagggagagggcgagcctatcgtcggctatgtcgccgacgatgagcgcgacgaggcaacgttcgtcgtccaggagatcgacgccctcaccgacgcgggaacctgcacccccggcgatgtcgcggtgttctaccggaccaacgcccagtcccgcgtactggaggaagtgttcgtccgcaccggcatgccgtaccggatcgtcggcggggtgcggttctacgaacgcaaggagatccgcgacatcctcgcctacctccgcgtgctggccaaccctgaggactcggtgagcctgcgccgcattctgaacgtgccgaaacgcgggatcggggagcgggccgagcaggtcatcgaacagttcgcggcacaggagcggatcacgttcgcgcaggccctgcgccgcgcagacgaagcaccgggaatcgccacccgctcgctcaaagcgatcaaagagttcgtcgcgctcctcgaagaactcgaggagctggctgccacccgcagcccggccgagacgattgaagcggtcctggaacgcaccggctacttggaagagctcgtcaactccaaggacatccaggacgagagccgcgtggagaacctcgaggagttcgtcggcgtcgcccgcgagttcgaatcgtcttttgacgccgcgctggccgcagaaggagccgacggggaaaccggccgcgacggtgcggaaccgaccctggtggacttcctcgagcaggtctccctcatcgccgacaccgaccagctccctgacgaggacgaccagggcggggccgtcaccctcatgaccctccactcggccaaaggattggagtttcccgtggtcttcctcaccgggttggaggacggggtcttcccgcacctgcgggcgctcggcgaccggtccgcactggaagaggagcggcggctggtctacgtcggtatcacccgtgcccaggagcggctctacctgacccgggctgcgacacgcagctcctggggggccgcggcctacaaccctccgtcgcggtttttggacgagattcccgcagaactcgtgacctggcgccgggcagagtccacgacggaggcgctccgccgttccgtgtcccctgcccgcacgtcgcggccgacccgcaaggccgagcgcccggtgctagcgctgcggccaggcgacaaggtgaaccacgactcctttgggctgggcaccgtgctctcggtcgacggcaccggggatcggacgcgggcccgtgtcgacttcggagcgggggtcgggcagaaggacctcatggtcaagttcgctccgttggagaag

SEQ ID NO: 31905 - DNA, 1395 bp, Thermobifida fusca
cgccacgtggtcagcagtaccggccgtaccgtcgtcaccacggcacccttcaccggggaacctctcgccaccctgccccagtcctcggccagcgacgtcaccgaagcgttccgccgcgcccgcgccgcccagcgcgaatgggcgcagcgctcgccccgccagcgcatcgcccccttcctccgcttctccgacctgctgctcgaccggcaaaccgaaatcctggacatcctgcaatgggagaccgggaaagcccgcaagaacgctttcgaagaagtctgcgacgcggccctcggcaccctccactacgcacgccatgccccccgactcctccgccgccgccgcgcgcccggcgccatccccctcgccacccggaccagggtgaactaccagcccaaaggggtcgtcagcgtcatcaccccgtggaactacccgctcaccctgcccgtcgcagacgctgtccccgccctgctggcaggcaacgccgtcgtcgccaaacccgacacccagaccgcgctgagcgcgctgtgggccatcgacctgctcgtcgaagcaggactcccccgcgacctgtggctcgtcgtcctcggcgaacccgcggagatcggtgacccgctggtcgacgaggccgactacgtcgccttcaccggctcctcagcgaccggagcccgcatcgcccagcgtgccgcctcccggctcatcggctgctccgcggaactcggcggcaagaacccgatgatcgtgtgcgcagacgccgacctggaccggaccgtgcacggcgccgtagccgcctgcttcagcaactccggccaactgtgcatctccatggaacggctctacgtccacgactccatctacgacgcgttcgtcgagaaattcgtggcagagacgaagaacctgcggctcggagcggacctcgactactccgcggacctgggctctctcacgtcccaacgccaattcgaccgggtcgtcgcccacgtcgaggacgcccgcagcaaaggagccaccgtcctggccggaggccgcccccgccccgacgtgggaccgctgttctacgagcccaccgtgctcaccggcgtcgacgagtccatgaccttgtgcgccgaagagactttcggaccggtcgtctccctctaccggttcaccaccgaagacgaagcgatcgaacgcgccaaccacaccccctacgggctcaacgccagcgtgtggactcgggacgtggcccggggacgccgcatcgcggaacggctgaaagccgggacagtcaacatcaacgaaggctatggcgccgcgttcgccagctacggcgcccccatgggcgggatgaaacgctccggcctgggacgacgccacggagtggagggcatcctgcgctacaccgaagcgcagaccgtg

SEQ ID NO: 31906 - DNA, 1704 bp, Thermobifida fusca
gaccccgcgcaccagatgacggcagcacggttgggaccacaggaacgggacgccgccctcagggccatggccgacaccgaactcgacgtgctggtggtcggaggagggatcgtcggagcgggtgtcgctctggacgcggtggcgcgcggcctctccgtcgggctcgtggaggcccgcgacttcgcttcaggaacctccagcaggtccagcaagctcatccacgggggcctgcgctacctggagcacttggacttccctctcgtccgcgaggcgctcaccgaacgcggcctgctcctcagccggatcgccccgcacctggtgcgcccggtgccgttcctgttcccgctccgctcccactgggaacgcccctacatcggggcgggggtggccctctacgacgcgctggccctgtccggcacccgcacccgcggcctgcccggccaccgccacctcagccgccgtgccgccctgcggatcttccccgcgctgcgccgcgacgccctcgtcggcgccgtgcagtactgggacgcacaggtggacgactcccgctacgtggtgatggtgctccgcaccgccgccacctacggcgcgcacatcgcctcgcgtacccaggccgtcgggttcctgcgggaaggggagcatgtcaccggggcccgcgtcgtcgacctggaaaccggccgagagttcgcggtccgcgcgaaacaggtggtcaacgcggccggggtgtggaccgacgagatccaggagatggtgggcgggcgcggccagatccacgtgcgcgcctccaaaggcgttcacctggtggtgcctcgggaccggatccacgcatcctccgggctgatcctgcgcaccgagaagagcgtgctgttcgtcatcccgtggggacggcactggatcctcggcaccaccgacaccgcatgggacctggacaaggcgcaccccgcggccagccgaaccgacatcgactacgtgctcaaccgcgtcaacgcagtcctgaaaaccccgttgaccagagacgacgtggagggggtgtatgcggggctgcggccgctgctcgcgggggagtccgaggagacctcccggttgtcccgggagcacaccgtggcgcacccggtgcccggcctagtcctcatcgcgggcggaaagtacaccacctaccgggtcatggccaaggacgcggtggacgcggtcgcccacgggatgggcgggggagtgcccccgtcggtgaccgaccggcttcccctggtgggcgccgacggctatttcgcgctgtggaaccagcgtcgcatcctcgcccgccgcaccggcctgcacgtgtcccggatccagcaccttctgcgccgctacggttccctcatccacgaagtgctgggactgatcgccgaacagccggatttgaagcagccgttgaccggcgccgacgactacctgcgtgccgaagtggtctacgcggtccgctacgaaggggcccgccacctcgacgacgtgctcagccgccgcacccacatcgccattgagacgtgggaccgcggccttgccgcggctgaggaggcggcacagctcatggccggcccgctcggctgggacgatgcccaaatcgcccgagaagtggagtactaccgtgcccggatcgaagcggaacgggccgcccaggagcaagacagcgaccaggaagccgacgcggtccagcacggtgccccggat

SEQ ID NO: 31907 - DNA, 1092 bp, Thermobifida fusca
gttgagatcgggctgggcaaggccggacggcgggcgtacgagctcgacgagatcgggattgtgcccgcgcggcgcacccgcgaccccgaagaggtctccctctcgtggcagatcgacgcctaccggttcgacacgccgctgatggtgagcccaatggacagcgtggtctcaccgaagaccgcgatagccatcggcgagctgggcggcctggcggtgcttgacctagaagggctgtggacccgctacgaggaccccgagccgctgcttgcggagatccgggaactcgacgacgccacagccacccggagactgcaggagatctacgccgaaccgatcaaagaagaactgatcggccgccggatcgaagagatccgccgcgccggggtagtcaccgcggcccgcctctccccccagcgcacggcccagtaccacaaggccgtgatcgaggccggggtggacattttcgtcatccgcggcaccacggtctccgccgaacacgtctccggccgcacggagcccctcaacctcaagcagttcatctacgacctcgacgttcccgtcgtggtcgggggatgcgccacctacaccgccgccctgcacctcatgcgcaccggtgctgcgggggtgctcgtcggtttcggcggcgggtcggggcacaccacccgcagcgtgctgggggtggccgtgcccatggcgaccgcgatcggcgacgtcgccgcggcccggcgggactacctcgacgagtccgggggccgctacgtccacgtcatcgcggacggcgggatgacccgcagcggcgacatcgctaaagcgttggcctgcggcgccgacgcggtcatggtcggctccccgctggcccgcgccgtcgaagcccccggcggcggctaccactggggcagcgaagcacaccaccaccagttgccgcggggccagcggctcaaggtcggcacgatcggcaccttggaggagatcgtgcgcggcccggcttccaccagcgacggctccatgaacctcatgggcgcgctccgccgcaccatggctaccgccgggtacaccgatgtgaaggaattccagcgggtcgaggtcgtcgtg

SEQ ID NO: 31908 - DNA, 1848 bp, Thermobifida fusca
atgtgtggaatcgttggctacgtcgggccgaaaccggcgctggaagtcgtcgtcgaaggtctggccaggcttgagtaccggggatacgactccgcgggagttgcagtgctcagtgacggcaaactccagacggagaaacgggccggcaagctggcgaacctgcgggccgcgctgcaagccaatccgcgttccgccgacggcatcggcatcggccacacccgctgggccacccacggtgcgcccaccgacggcaacgcccacccccacgtagacgagatgaaccgtgtggcggtggtccacaacggcatcatcgagaacttcgcgcaactgcggatggagttggaggagcgtggctgcaagttccgctccgaaaccgacaccgaagtcgtcgcccacatgctcagcgagcagctcactgagcacaacggcgaccttggtgcggctatgcgctcggtgtgccgccgtcttgagggcgccttcaccctggtcgcgatctccgaagacgacccgggactggtggtagccgcgcgccgcaactccccgctggtcgtcggccgtggcaacggagagaacttccttgccagcgacgtggccgcgttcatcgcgcacacccgcgacgccatcgaactgggccaggaccaggtggtcgagctgcgggccgactcgatcactatcaccgactacgacggtgcccctgcccaggtgcgcgaataccacgtggactgggacgcttccgccgcggagaagggcggctatgactacttcatgctcaaggagatcgccgaacagccgcgtgcgatcgcggacacgctgctcggccgggtcgccgtggacggcacgctgaccctggacgagatgcggctggctcccgaggagctgcggcagatctccaagatcgtcatcgtcgcctgcggcagctcgtaccatgcgggcctgatcgccaagtacgccatcgagcactggtgccgtatcccgtgcgaggtcgaggtcgccagcgagttccgctaccgcgacccgatcctggatccccagacgctggtcatcgccatctcccagtcgggggagagcatggacaccctgatggcggtgcgctacgcccgggagcagcagtcccgggtgctggcgatctgcaacgtcaacggctccacgattccccgggagtccgacggggtgctgtacacgcacgccggccccgaggtgggtgtggccgcgaccaagaccttcctcacccagctcgtcgcctgctacctggtcggcctctacctggctcaggtgcgcggcctgaagttcggcgacgagatcaacgcgatcatcgggcagctcgcccgcatgccggagcaggtggagaaggtactcaacaccgtgcagccggtccgcgacctggcccgctcgctcgccgaagcgaagacggtgctcttcctaggccggcacgtgggctacccggtggctatggaaggcgccctcaagctcaaggaactggcctacatgcacgcggaagcgttcgcggccggggaactcaagcacggaccgatcgcgctcatcgaggacggtctgccggtcgttgtcgtggtgccgtcccgcgagggccgcagcgtgctgcacgacaagatcgtctccaacatccaagagatccgggcacggggtgcgcggaccatcgtgatcgcggaggagggagacgagagtgtccgcccctactctgacactctgatcgaaatccccgccgtgcccaccctgctgcaaccgctcgtggcaaccgtgcccctgcaggtgttcgcctgcgagctggcactggccaagggcaacgacgtggaccagccacgcaacctggccaagagcgtgaccgtggag

SEQ ID NO: 31909 - DNA, 1329 bp, Thermobifida fusca
cggctgtttggcaccgacggagtccgcgggcttgcgggccgcgatctcactgctggactaaccctggagctcgccattgcggcggctgaagtcctcccagagcgaggcattcccggaaagcggccccgcgccgtggtcggccgtgatccgcgtgcctcaggcgagttcctggaagcggccgtagtagcgggactcgccagcgccggggtggacgtcatccgcctcggtgtgctgcccacgcctgccgtggcttttctgacaggcgaactggacgcggacttcggggtgatgctctccgccagtcacaatccggctccggacaacggcatcaaattcttcgcccgcggcggccacaaactgtcagacgaggtggaagacgagatcgaacggcggctgggccgtgccgtggcgggggcaaccggccgggacgtcggccgggtcaccgacgatacggacagcgtggaacgctacatcacccacctggtgaactccctgcccaaccgcttggacgggttgaaagtcgttgtggactgcgccaacggtgcggcagcggggatcgccccggaggcgctgcgccgtgccggcgccgacgtgatcgcgatcggcgacaagcccgacgggttcaacatcaacgagggatgcgggtccaccaacctggacgcgctgcgcgcggcggtgctggagcacggcgccgatgcgggcatcgcgcacgacggggacgctgaccgctgccaggcggtggccgctgacggatctgttgtcgacggcgaccagatcatggccgtcttggcgctggaactgtacgaggcgaacgcgctgcacaacaacaccctcgtggtcacggtcatgtcgaacctgggactcaaactcgccatgaaggaagccgggatcaccctggtcgaaacccaggtgggcgaccgctacgtcctcgaagccatgcgggctgggtcgtattcgctgggcggggagcagtccggccacatcatcctgctggaccatgcgacgacgggcgacggcctgctgaccggcatgcacctgctcgccgcggtcaaccggaggggagtggcgctggctgagctcgccaaggtcatgaaccggctgccgcaggtgctggtgaacgtgtccggggtggacaagacccgggttgccacatcggagcggatcgctgcggaagtggctgcggccgaggcggagctcggggacagcggccgcgtcctgctgcggccgagcggcaccgagccgatcgtccgggtgatggtggaggcaacgtcgcaggaccgtgctcaggccatcgctgaccggctggccgacgtagtccgagacgaactg

SEQ ID NO: 31910 - DNA, 822 bp, Thermobifida fusca
atgggcattcgaaagtacaagccgacgagcccagggcgtcgcggggggagcgtcagcacattcgctgagatcacccgctcgaagcctgagaagtccctggtccgtccgctgcactccaagggcgggcgcaacggtcacggtcgcatcactgcccgccaccagggcggcggccacaagcgcgcctaccggctgatcgacttccgccgccacgacaaggacggtattcccgccaaggtcgctcacatcgagtacgacccgaaccgcaccgcacgtatcgcgctgctccactacgtggacggcgagaagcggtacatcctggcgcctgtgggtctgaagcagggcgaccgggtcgagaacggccccgcggctgacatcaagccggggaactgcctgccgctgcgcaacatccccaccggtacgttcgtgcacgcggtggagctcaagccgggcggcggtgccaagctgggccgtgcggccggagcggcgatccagctcctcgccaaggagggtgcctacgccaccctgcgtatgccctcgggcgagatgcggcaggtcgaggtcgcatgccgggccactgtgggccaggtcggcaacgtcgaacacgccaacatcagctggggtaaggccggccggatgcggtggaagggcaagcgcccgagcgtccgtggtgtggcgatgaacccgatcgaccacccgcacggtggtggtgagggccggacctccggtggccgccaccccgtcagcccgtggggtaaggccgagggccggacccgtaagaagggcaagcccagcgaccggctcatcgtgcgtcggcgtagcaag

SEQ ID NO: 31911 - DNA, 666 bp, Thermobifida fusca
atgttcggttttgtgaagacagacatggtcgacccggccaaggcgttgcccggccgcgacacgccgatgccggtcccggaacgccacgaagtgctgggcaccccgcttgctccgccctacccggaacacgcgcagctcgccgatttcggcatgggctgcttctggggggtggaacgcatcttctggcggctgggagccgagaacggcatcatcaccacggccgccgggtatgcgggcggctacaccccgaaccccacctacgaagaggtctgcaccggccgcaccgggcacgccgaagtagtgcgggtcgtgttcgaccccgaacgcatctcctacaccgacctgctcaaggtgttctgggagaaccacgaccccacccagggcatgcgccaaggcaacgacgtgggcacccagtaccggtcgatcatcctctaccacaacgaggagcagcgggccgccgcggaagccagccgggacgccttccagccggtgctgacccgaatgggatacgggcctatcaccaccgagatcgttccagccaccccgttctactttgccgagccctaccaccagcagtacctgtcagaggcgaagaacccccacggctactgcggggtgagcgggaccggcgctacctgcccggtcggtgtggcccgcaccagcggg

SEQ ID NO: 31912 - DNA, 957 bp, Thermobifida fusca
gacgaaacgctcgcccgggagatccaggcagagctggagcaggtcgagaaggtgctccgcgacgcggtggccgagagcgacccgctgctcagggaagcagcctcgcatctgctggaagccgggggtaagcgcttccgcgccatcctggtcctgctgtctgcccgcttcggcgacgcaaccaaccccgacctcgtctcggccgcggccgtggttgagctgacccacgtggccaccttgtaccacgacgacgtcatggacgaggccgagctgcggcgggggagtcccagcgccaaccggcgctgggggaacacgatcgcgatcctcaccggcgactacgtgttcgcgcgcgcctccgagatcctcgctgatctgggcaccgaggcggtccggctgcaggcgcagaccttcggccgtctggtgcgcggccagatcctggagaccgcggggccccgccccggcgtcgacccgatgaagcactatctcgacgtgatcgcggacaagaccgcgtcgctgatcgcttcgtcggcccggttcggtgcgatggtcggcaacgccgaccccgaggtggtggagacactcacccgggctggggacgcgctggggatggccttccaactgtcggacgacatcctggacgtggcgagcgagaccgaggagtccgggaagacgcccggcaccgacctgcgggagggtgtgctgaccctgccgatgctgtacgcgctgcagggcaccgagcccgagcatgcgcgtctgcggtctctgctgggccgtccgttgaacgacgaggaggccgcggaggccttggctttgctgcgcgcccacccggcgatggacgaggcgcgggcggacttggcagcctggggggagcgggcccaagcggagctggccaccctgccggaatgcccggccaagaccgctttcctggccatctgcgactatgtggtcaaccggaagggc

SEQ ID NO: 31913 - DNA, 2385 bp, Thermobifida fusca
gtgccgccagaggacctcgtcaccgttaccatcgacggtttcgaaatccaggttcccaagggcaccctgctgatccgggcggccgaactgctcggcatccagatcccgcggttctgcgaccacccgctgctcgacccggtcggtgcctgccgccagtgcctggtggagatcaccgacatgggcaacgggcgcggcatgcccaaaccgcaggcctcctgcaccatcaccgtcacggacggcatggtcgtcaagacccagctgacctctccggtggcggagaaagctcagcgcggtgtcatggagttcctgctcatcaaccacccgctggactgcccgatctgcgacaagggcggtgaatgcccgctgcagaaccaggcgctgtcccacgggcagggcgagagccggttcgtcgacgtcaagcggaccttccccaagccgatcccgctgtccacgcagatcctgctggaccgggagcgctgcatccagtgcgcccgctgcacccgcttctccgcgcagatcgccggtgacccgttcatcgacctgatggaacgcggcgccaaggagcaggtgggcatcgccgaaggacagccctttcagtcctacttctccggcaacaccgtgcagatctgtccggtcggcgccctcaccggagccgcctaccggttccgcgcccgcccgttcgacctggtgtccacgcccagcgtctgcgaacactgcgcgtccggctgcgcccagcgcaccgaccaccggcgcggcaaggtcacccggcgcctggccggggacgacccccaggtcaacgaagagtggaactgcgacaagggccggtgggcgttcacctacgccacccagcccgaccggctcaagcacccgctggtgcgggacgaggacagccgcgccctggaagccgcgtcctggccggaggccctccaggtggccgcccgcggcctggccgccgcccgcggccgggtgggtgtgctcaccggcggacggctcaccctggaagacgcctacgcttacgccaagttcgcccgggtcgcgctgcacaccaacgacatcgacttccgggcccgcccccactcggctgaggaagccgaattcctcgccgcccgggtcgccgggcacggcatcgaagtcacctacaccgacctggagaaggcgcccgccgtcctcctcgtcggcttcgaacccgaagacgagtcgcccatcgtcttcctgcggctgcgcaaggcggcccgcaagaacggcacccgagtgttctcgatcgcgccctacgccagccgcggcctgaccaagaccaacggaaccctgattcccacggttcccggcggtgaggccagcgccatgacctccctgggcacggtggcccccgaagcgctggaagccctgcactctccgggcgccgtcatcctggccggggagcggcttgctgaagtgcccggggcactgtccgcggtggcccgcctcgccgacaccaccggtgcccgcctggcctgggtgccccgccgcgccggtgaccggggagccatcgaagccggtgcgctgcccaacctgctgccggtcggccgtcccgtcacggacgcggtcgcccgggccgaagtcgcccgcgtttgggcggtctccgacctgccggctaccgagggccgcgacaccgcgggcatcctcgccgccgcagcagccggagagctcgacgccctggtcatcgcaggcgtcgacctggacgacctgcccgacccggaggcagcccgagccgctctggcgaaggtgccgttcatcgtcagcctggaactgcgggccagcaacgtcaccgaccgcgccgacgtcgtcttcccggtcgccgccgtcgccgagaagtccggcacgttcgtcaactgggaaggccgcggccgcccgttcggcaccgcgctgcaagtgcccggagcaatgtccgacttgcgggtgctggccgcgatcgccgacgaaatggacgtccacctgggccttccggacccggccgctgcccggcgggaactcgccgaactcggcgcctggaagggcaccccgctgcccaccccggtggtccgccccgccgacgtcgctatcccgcaacccggccaggcggtcctggccacctgggaccagttgctcggccaaggacggatgcaggacggcgaaccgcacctggcgggaaccgcccggcccgccgtcgcccgcctctcggctgccaccgccgccgagatcggcctcgccgacggccagacactgcgggtcgagggaccggccggagcagtgcgcctcccggccgtcatcaccgagatgccggaccgtgtggtgtggctgccgaccaacgccgcaggctgtgccgtccggcgcgacctcggcgcgagcacggggaccgtggtgtccctg

SEQ ID NO: 31914 - DNA, 1245 bp, Thermobifida fusca
gccgacgtcatcgtcgtcggagcaggcccggcagggagcacggcagcccactacctggccaccgcgggcctcgacgtcctgctgctggagaagactgctttcccgcgggagaaggtctgcggagacggcctcaccccccgtgcagtcaaacagctcgtcgctatggggatccccatcaacgaagaagacggctggatccgcaaccgcggcctccgcatcatcggcggcggaacccgactcgagcttccctggcctgaactttcggaataccccggattcggtctggtacgcacccgctacgacttcgaccagatcctcgcccgccacgccgtgaaaaccggtgtgcggctcctggaacgcaccaacgtcaccgcgcccatcatcgacgagcgcagcaaccgcgtcgtcggagtccaagccaaagacgccgaaggccgcatccgctccttccgcgcacccctcgtcctcgccgccgacggcaactcctcgcgcctggcgatcgccctgggcatccgcagacgcgacgaccgccccatgggcgtggccgtccgcacctacttcaccaccccccggcacaacgacgactacctggagtcctggctggaactctgggacaccaccgacggcaagcaggtgctgctccccggctacggctggatcttcggagtcggcgacggcactagcaacgtaggcctggggatcctcaactccacccccgccttccagaagatcgactaccgcaaactgctgcgccgctggacgcagagcatgcctgaagagtgggggttcaccgaggagaaccagaaaggacccatccgcggcgccgccctgcccatgggcttcaaccggacaccgcactacgcccgtggcatgatgctggtcggtgacgcaggaggcatggtcaacccctttaacggcgagggcatcgcctacgcgatggaagcaggtcggatcgccgctgacgtggcggtccaggcgctgagccgtcccacaccgcgggaccgcgaacgcaccctgctgcgctacccggagatcctgcgggatacctacggcggctattacacgctggggcgctacttcgtgaagctgatcggcaacccctacttcatgaagtacgccaccaagtatggtctcccgcggcccctcctgatgcgcttcaccctcaagatgctggcgaacctcacggaacccagccacggcgacgcgctggaccggctcatcaacggcctgtccaagatcgcgccc

SEQ ID NO: 31915 - DNA, 1902 bp, Thermobifida fusca
agccaggtcttccctcccgacgaagcgttcgtggcacaggctaacgccaccgcggacctctacggtgaagcggaagctgaccgggaggcgttttgggagaagcaggccgagcggctgcactgggagaccaggtggaaccaggtgttggactggtccaatgcaccgttcgccaagtggtttgtgggtggcaggctcaacgtcgcctacaactgtgtggaccggcatgtagagaacggttacggcgatcaagtcgccatccactgggtgggtgagcccggagacacccgcgacatcacctacgcccagttgaaggacgaggtgtgcaaggccgccaacgcgctgtcttctttggggctgaagccgggcgaccgggtcgctatccagatgcctatgatccccgaggcgatcgtgtccatgctggcctgtgcccgcctgggcctggtgcacagcgtggtcttcgggggtttttcgccttccgcgctgcgttcccgggtggaggacgctgacgccaaggtggtcatcactactgacggccagtaccggcgcggcaaggccctgccgatgaaggccaacgtggacgaaggcatcgaggggatcgacgcggtccagaacgtcatcgtggtccgccgcaccggcatggacgttccgtggaccgagggccgcgacctgtggtggcacgacctggtcgactcccagtcggccgagcacacccctgaggcgttcgactccgaacaccccctgttcatcctctacacgtcgggcaccacggggaagccgaagggcatcctgcacaccactggcggttatctgacccaggcggcgtacacccaccacgtggtgttcgaccacaagccgggcaaggacgtctactggtgcaccgccgacatcggctggatcaccgggcacagctacatcgtttatgggccgctcgcgaaccgcgccacccaggtcgtctacgaaggcaccccgaacaccccgcacgaggggcgccactgggagatcgtgcaggagtacaaggtcacgatctactacacggctcccacgctgatccgcacgttcatgaagtggggggaggagatccccgcccgctacgacctgtcgtcgctgcggctgctgggcagtgtaggcgagccgatcaaccccgaggcgtggctgtggtaccgcaagcacatcggcggtgacaagaccccgatcgttgacacctggtggcagaccgagaccggcgcgatcatgatttcgccgctgcctggcgcgttgagcctcaagccggggtcggcgctgcgggcgctgccgggggtgagcgcgaaggtggtcgacgagaagggcaacgaggtttcgcacggttcgggcggctacctggtgctggacaagccgtggccgtcgatgctccgcgggatctggggcgacgagaagcgctaccgcgaaacctactgggcgcggttcgcggacaagggcttctacttcgccggggacggcgccaagtacgacgacgacggcgacatttggctgctgggccgggtcgacgatgtcatgaacgtctccgggcaccggatttccaccactgaggtggagtcggctctggtggcgcacccgacggtggcggaggccgctgtggtgggtgcgtccgacccgacgacgggccaggcgatcgtggcgtttgtgatcccgcgcgccggggtggcccaggacgaggcgagcggcgaggaggccatcaagacgctgcgggagcacgtggcgaaggagatcggtccgatcgctaagccgcggcagatcatcgtggtgccggagctccccaagacccgctccggcaagatcatgcgccgcctgctgcgtgacgtggcggagaaccgggagatcggtgacgtgaccacgctcgccgactcgtcggtgatggacctcatc

SEQ ID NO: 31916 - DNA, 2205 bp, Thermobifida fusca
gaacgggttgaactcctcatcggcggcatgacctgcgcgtcgtgcgccaaccgagtggaacgcaaactcaacaagctcgccggggtgcgggccagcgtcaactacgccactgagaaagcgtcagtggagttcgacagcggcgtcaccatcgacgacctgatcaccacggtcgagaaagcaggctacacggcggccctccctgccccgccctgcgccgcccaggacacggaagaccaggccgctgacccggtggcagcgctgcgcacacggctgctggtcagcgcggtgctgtcgattccggtcatcgccatggcgatgatcccggccctgcagttcacctactggcagtgggcgtccctcgtcctggccgctccggtggtggtgtggggtgcgctgcccttccacatcgccgcggtcaaaaacctgaggctgggggaggccaccatggacacgctggtgtccatgggcacgctggcggctttcgcctggtcgctgtatgcgctgttcttcggggaagcgggcatgcccggcatgacgcacccgttcgagttcaccatcagccgcaccgacggttctgccgccatctacttggaggtcgcggccggggtcaccacgttcatcctcgccggacgctacttcgaagctcgggctaagcggcgggccggggccgcgctgcgcgccctcctggaattgggcgcgaaagaggtcacggtggtgcgcggcggccgggagacgcggatccccgtggagcagctcgccgtcggtgaccggttcgtggtgcgtcccggggagaagatcgccacggacggggttgtggaggagggcgcctccgccgtggacgcgagcatgctcaccggtgagtccgtgcccgtcgaagtcggggtcggcgacgcggtggtcggcgccacggtcaacgtcggcggccggctcgtggtgcgcgcaacccgcgtgggcgcggacacccagctcgcgcagatggcgaagctggtggaggaggcgcagagcggcaaggccgaggtgcagcggctcgccgaccggatttccggggtgttcgtgcccgtggtgatcgcgctcgcggtggccacgctcgggttctggctgggggcgggcggcccggtggaggccgcgtttaccgctgctgtcgcggtgctcatcatcgcctgcccgtgcgcgctgggcttggccactcccacggcgctcctggtgggcacgggccgtggagcccagctcggcatcctcatcaaaggccctgaagtgttggagaacacgcgccgcgtggacacggtggtgctcgacaagaccggcacggtcaccatgggcacgatggcgctcgtcgacgtggccgctgccgacggggaggacgccgacgaggtgctgcggctagccggggctgtggagcacgcctccgagcaccctattgcgcgggcgatcgcccggagcgccgccgaccgggtcgggaatgtgccgccggtgactgatttcgctgccaccgcagggctgggggtgcggggggtagtggacggccgcacggtcctcgtggggaaggccgccctgctcgcccaggaaggcgtggccgtgccggaggcggtggcgcggaaggccgcacaggcggaagccgcaggccacaccgcggtcctggccgcctgggacgggaaggctcgcggggtgcttgtcgtcgccgacacggtgaagcccacgagcgccgaggccgtggcccagttgcggcagctggggctcaccccgattctgctcaccggcgacaacgcggccgtggcccgcacggtcgccgaacaggtcggtattgacgaggtcatcgccgaagtgctgcccgccgacaaggtggacgtggtcaaacggctgcaggacgaaggccgcgtggtggcgatggtcggtgacggggtgaacgatgcggccgcactcgcccaagccgatttggggctggcgatgggcactggcacggatgcggcgatcgaggccgcggacctcaccctggtccgcggggatctgcgggtcgccgcggacgcgatccggctgtcccgccgcaccctggccacgatcaaaggcaacctgttctgggcgttcgcctacaacgtggcggcgctgccgctggccgctgccgggctgctcaacccgatgattgcgggcgcggccatggcgttctccagcgtcttcgtggtcagcaacagtctgcggctgcggggcttc

SEQ ID NO: 31917 - DNA, 1266 bp, Thermobifida fusca
ttcgaaaccaagcagatccacgccggagcggcccccgatccggccaccaacgcacgggccacccccatctaccagaccacgtcgtacgtcttccgggacacgcagcacggggccgacctgttctcgctcgcagagccgggcaacatctacacgcggatcatgaaccccacccaggacgtgctggaaaagcgggtcgcggctctggaaggcggggtcgccgcggtcgcgttcgcgtccgggtcagctgccatcaccgctgccgtcctcaacctggcgggtgcgggtgaccacatcgtgtccagcccgtccctgtacggcggcacctacaacctgttccgctacaccctgcccaagctcggcatcgaggtcaccttcatcaaagaccaggacgacctcgacgagtggcgtgccgcggcccgcgacaacaccaagctgttcttcgcggaaaccctgcccaacccggcgaacaacgtgctcgacgtgcgcgcggtggcggacgtcgcccacgaggtcggtgtgccgctcatggtcgacaacaccgtgcccaccccctacctgcagcggcccatcgaccacggcgcggacatcgtggtgcactcggccaccaagttcctcggcggccacggcaccacgatcgcgggcatcgtggtggacgccggcaccttcgacttcggcgcccacggcgaccggttccccggcttcgtcgaacccgaccccagctaccatggcctgaagtactgggaggcgctgggaccgggtgcctacgctgccaagctgcgggtgcaactgctccgcgacacgggcgcggccatctcgccgttcaacagcttcctgatcctccaggggatcgaaacgctgtcgctgcgcatggaacggcacgtcgccaacgcccaggcgctcgccgagtggctggaatcccgcgacgaggtggcgaaggtctactacccgggcctgccttccagcccctactacgaggctgcaaagaagtacctgcccaagggggcgggtgcgatcgtctcctttgagctgcacggcggtatcgaggccggacgcgccttcgtggacggcaccgaactgttcagccagctcgtcaacatcggtgacgtgcgcagcctcatcgtccacccggccagcaccacgcacagccagctcacccccgaagagcagctcgccagcggggtcactcccggcctcgtgcggctgtccgtgggcttggaacacgttgacgaccttcgcgcagacttggaggccgggctgcgcgcagcc

SEQ ID NO: 31918 - DNA, 2607 bp, Thermobifida fusca
tgggacacggtccccgactcggcggcccggcgggcaggcaccgcgatggtgatgacacgcgagccgcaggctgaccccctgcaagggcggccggttcccgtccgcagcggcctcaccggccccgacgctgcccggcggctcggccacgacggccgcaacctcgtgcctccgccgcagcgcaccctgcctttcctgctgttggcgagctcgttcacccactctttcgcgctgctgctgtgggctgccgcggcgcttgccttcatcggcggcctgccggaagcggcctgggctgtggtcaccgtgatcgtggtgagcggcctggtcggtttcgtgttggactactggtccgaccggatcgggcagcggcttcgccgccgcgcgcccgccgccgtgcgcgtcatccgtgacggacggcaggcccgagtcaacgctgacgagctcgtcgtcaacgatgtggtgctgctgcgcgccggcgaccgggtgcccgcggacatccgccttacggaagtccacgacttcgtagtggtggaggtcggggtgaccgggatgcgggaaatgctgcgctgcgacgaaggcaccaccgtgttcgccggcacgcacgtggccgcgggggaagccgaaggggtagtggtcaccaccggcatgtggacgcggctcggccaggactctccgctgctgcggcacgcccgccgcccgtccgggccgctggtggagaacctgcgcgacctgacggcggccgccgcggcagccgccaccgggaccgctctcgtcgtgttcctgctcaccctgctggtgggagttccgcccgcggaagggtttctgcccgcggtcggcctggcagtggcgctggtaccgctgggactgcggtccatcgtccacttgtgtctggcgtgggcggcgcagcggatggctgacgcgcacgccctcgtccggcattccgcggctgtgcagcagttgggcacggtcacgttcctgtgcattcccgcggccggggtcctcacccggggcgagcctgtggccgtggaagtgtggactccggaaggcaccgtgcaggtcaccggtaccggttatgccccggagggcgcgctggtgggggacgcggccgcggtggctgccgcccacgacctggcgttgagcgcggccttgtgctccagtgacggctacttcttcactgacggccagtggcggcccgtgggggatccggttgaagcggcctgtcacgtgctggctgcccgggccggggtggatgtttcgctcgccgcggtggagcgccgctatcctttcgacccccaccgcaggcgggcttccgcgttcgcgaaaggatccgtgcacgtcaaaggcgctcccgacgcggtgctgccgcgctgccgggctgtggcgggcgccgcggacgcttccgctgcgatggcggaccgcgggctgcgcgtgctggcggtcgcgcgccgcgaccttgccgccccgccggagcaggccgaggacgcggaacgcgacctcaccctgctggggctgatcgggttggcggacccgccgcggtcggacgcgcgcaccgcggtgacccgctgccgcaggttaggcatccggctggcgctggtgaccggggaggatccgcgcaccgcgctggccgtggcccgcgccaccgggctggctaggccgggcgccccggtcctccacggcgcggagcttcctgacgacctgcgggagatcggggagctgttggacagcgacggggctgtcgtcagccgggtcacgcccgaggaccggcggcgggtgacagtcgctctccagcaccgcgggtacacggtggcgaccacggcgggcggggccgccgacgatgcggcgctgcgccgcgccgacgtgggcatagccccggggtatgcgggggcggacacggcgcgggactccgccgaccttgtgctgctcgacagcggcatcgccacggtggcggccgcgctgggtgcgggccgcgcgatccgcgtcacgctgcgccgggccctcacctaccggttgacgggggtggtggcgatggctacccctttcctggtctgggcggtgaccgggggcgcggtgccgcccgcgttgacgctcggccaggtgctcgcgatcggggtgggcgtggacctgcttcccgctctggcgttgggggtggggccgcgcgggtggcgtgccctgcgtgatccgccgccggacggggagttcttggtggaccggcggctcgctgtccgggtgggcggcgtgctgggcccggtggaggcggtcacggcactgttcacgtttggcgtggtgctgtgggtcaacggctggcagtgggggcagtcgcctgcgccgctgctgctcgcccaggcttccggggcggcgttcgccaccatcgtgctgggtcaggtcgcggctgctttggcgtgccgcagtgagacccggccgtttgatgcggtgccgtggcgcagcgacccgctgccccgcgggctcggcgcacagcttctcctgctgtggctgttcttcaccgcacccccgctggccggatggctggggagcacggtgccgcccggcttcgtctggccgggggtggtgtgcgtggtgcctgcgctgctggccgcggacacgatccacaag

SEQ ID NO: 31919 - DNA, 945 bp, Thermobifida fusca
atgcgtgctttgactgtggtgcccacccagcccggatcgctggaggtccgggacctcgccgatccggtcgctggtgcgggggaactactcgtcgacgggatcgcgctggggatctgcggcaccgaccacgagatcgtccacggcgtctacggctcagcccccgctggcacggaccgcctcgtgctggggcacgagtcgctgggacgtgtgcgggaagccccgccggacagcggtttcacccccggagacctggtggtcggcgtggtccgccgcccggacccggtcccctgcggggcgtgcgcccacggctacttcgactcgtgccgcaacggccagttcaccgagcgcggcatcaagaaacggcacggctacggatcggaacaatggacggtggaagccgagtacgcggtccggctcgacccgtccctggaggaggtcggcgtcctgctggagcccgcctcggtggtcgcgaaagcgtgggagcagatcgagcagatcggggagcgttcgtggttcgtcccgcagcgcctgctggtcaccggtgccggacctatcggcctgctggccgccctgctgggcatgcagcgcggccttgacgtgcacgtcttcgaccaggcggcgcacggggtgaagccggagctggtggccgggctggacgcggcctaccacaccggtgatctcgcggctgttgctgccacggtcaaaccggatgtgctcatcgaaaccacaggggtgccccggctcgtcgtggacgcgctcaccaccaccgcagttttcggcatcgtctgcctggttggactgtcgtccgagggggcatcgatcccggtggacgcgggggcgctcaaccgcacgatcgtgctcggcaaccacgcgttcttcggctcggtcaacgccaacctgcaccactacgagctggctgcgcgcgccctgtcgtgggcggacctc

SEQ ID NO: 31920 - DNA, 1677 bp, Thermobifida fusca
tccgcaaccgagaactatcgtcgcgcccgcgacaccctgctgggactgtccggagaccaccgcaccgcggtggagacgttccgctggcctgacctgggaccccggttcaactgggcgatcgactggttcgaagtctacgcgcgggacaacgacaccacggcgctgtggatcgtcgaagaggacggcagcgaagcgaagtacagcttcgctgagatggtccaccgctccgaccaggtagccgcttggctggcagagcagggggtgcggcgcggcgaccgggtgatggtcatgctcggcaaccaggtggaactgtgggagacgatgctcgccgtgatgaagctcggcgcggtgatcctcccggccaccaccgccctgggcccggccgacctggctgaccggatcgagcgcggcggcgccaaacatgtggtgacctctgccgcgaacaccgcgaagtttgccgaagtgcccggcgactacggcaggatcgtcgtggacggcgacgtcccgggctgggccgactaccgcgctgccgccacgatcgctgaaccgaagatcgcacacccggagaccgccccggacgacccgctgctgctgtacttcacttccggtactacgagccgccccaaactcgtccagcacacccaagcctcgtatcccctcggccacttgacgaccatgtactggatcggggtgcgccccggcgacatccacctcaacatcagctcgccgggctgggcgaaacacgcgtggagctgcttcttcactccctggatcgccgaagccaccgtgttcgtctacaactactcccggttcgacgctgcggcgctgctcgcgcacatccgccgcgccggggtcaccacgttctgcgcaccgccgaccgtgtggcggatgctcatcaacgcggacctctccggcggccccggcgcgctgcgggagatcgtcgccgcaggtgagcccctcaaccccgaggtgatcgaccaagtgcgccgagcctggggcctgaccttgcgcgacggattcgggcagaccgagatgaccgctgtcgtggggaacaccccgggctccccggtcaaacccgggtcgatgggccgcccgctccccggctgcccggtcgtgctgatcgatccccgcagcggacagcccgccgaggaaggcgagatctgcctcgacctgtcggcccgtccggtgatgctcatgcgcggctaccaggacgacccggagcgcaacgcggaggcgatggaaggcggctggtaccacacgggcgacatcgcccggagggacgctgacgggtacatcacctacattgggcgcaccgacgacgtgttcaaagcctccgactacaagatcagcccgttcgagctggagagcgtgctcatcgagcatccagcggtggcggaggtcgcggtggtgcccgcccctgacccggtgcggctggcagtgcccaaagcgtacgtggcgctggcccccggatacgagccgacacgggagacagcgctgtcgatcctgcggtatgcccgggagaatctcgcaccttttcagcgggtgcggcggctggagtttgccgagttgccgaaaacgatctcgggcaagatccgccgagtggaattgcggcagcaggagcaggaacgtgctgagggcacgggacaggcgagtcaggagtggcgcgacgacgagttt

SEQ ID NO: 31921 - DNA, 1074 bp, Thermobifida fusca
cggtcgctgctcgccccggggcggtatgtgcaggggcggggggttctcgcggatctcggcacctatgtcgcagcgatcgggtccgtgccgctgatcctggctgatcccgtggtccggcagttgacggaggccacggtgaccgagtcgttccggcaggcggggctcgcggtgcggttcgaagagttcggcgggatccccaccgccgctgaggcgcggcgggtcgccgacgtgctctctgaccgcggctgcgacgtgatcatcggtctcggcggcggttcgacgatcgacactgccaaggctgccggggacaacgcggggatccggtgggtgagcgtgccgacggtggcgtccacggacgcccccacttcggcgctgtcggtcgtctacagcgaggaaggcgtcttcgaaacctaccggttctactcgcgcaaccccgaccttgtcctcgtggatacgcagctcgtcgccaacgctccggcacggttcctggtctcgggtatcggggatgcgctcgccacgtggatcgaagcgcgcgccgtgcagcgggcgaacggccccacgctcgccgggggaatggcgacgcacaccgggatcgcgttggccaaactgtcgtgggacctgttgtgggagaacgcgctgccagcggtcgaggcggtgcggagcaacctggtcacccccgccgtggaggcggtggtggaggcgaacacgctgctgtccggtctcgggttcgagtcgggaggcttggcggcggcgcactcggtccacgacgggttgacggtcgtgccccacacccaccacctcatgcacggcgagaaggtgaacatcgggtcgatcacccagctcatcttggaggcggcggcagccgaggagatccgcgagttcatcgagttcaccgcgcggctcggactgccgaccacgttgacggaggcaggcctgggccacgtggacgacgaagtgctccgcatggtggtggaggcggcgctcgccccggaggagacgatccacaacctgccgttctcggtttcggagaacgacctgttggacgcgttgaagatggtggaagagctggggcgg

SEQ ID NO: 31922 - DNA, 1011 bp, Thermobifida fusca
agcgcggtcgcgggcggcggccaccacctggagcaggactaccccgaccccttcacccacgacgggaaataccgcagcatcctggctcagcagttcagctcagtctccccggaaaaccagatgaagtgggagtacatccatcctgagccggaccgctacgacttcgccatggccgacaagatcgtcgacttcgcggagcgtaacgaccagaaggtccgcggtcacaccctgctgtggcacagccagaaccccgagtggctcgaagagggcgactactcccctgaggagctgcgcgagatcctgcgggaccacatcaccaccgtggtcggccgctacgccggacggatccaccagtgggatgtggccaacgagatcttcgacgagcagggcaacctgcgtactcaggagaacatctggatccgcgagctcggccccggcatcatcgctgacgcgttccgctgggcgcacgaggcagacccgaacgcggagctgttcttcaacgactacaacgtggagggcatcaacccgaagagcgacgcctactacgaactcatccaggagctgctcgacgacggggttccggtccacggcttctccgtccaggggcacctgagcacccgctacggcttcccgggcgacctggaacagaacctgcgccggttcgacgagctcggtctggccacggcgatcaccgagctggacgtgcgcatggacctgccggccagcggcaagccgaccccgaagcagttggagcagcaggccgactactaccagcaggcgcttgaagcgtgcctggccgtggaaggctgcgactccttcacgatctggggcttcacggacaagtactcctgggtgccggtgttcttccccgacgagggcgcggcgacgatcatgacggagaagtacgagcgcaagcccgctttcttcgcgctgcagcagacgctgcgggaagcccggtgcgcggacagccccaagccgggaccgggcaagccgaagccgggcaagggcccc

SEQ ID NO: 31923 - DNA, 1032 bp, Thermobifida fusca
atgcatgccgtccaataccgtgaggtcggccagccgccccgcgtcgtcgacgttgacgtgcccactcccggccccggccagatcctgctgcgcgtcaccgccgcgggaatctgccactccgacctcacagtcatgcactgggacgccaaaaccctcccctaccagttgccgctcaccctgggccacgagggcgctggcgtcgtcgaagccgtgggggagaacgtgaacgccgtctccgtcggcgactcggttgtcgtctacggaccgtgggggtgcggcacctgccacgcctgctcgcaaggccgggagaactactgtccgcgcgccgcgcgcctcggcatcatgcccccgggactgggccgtcccggagcactagcggaatacctgctcgtcgactcggagcggcacgtggtgccgatcggggacctcgacccggtgaaaaccgtcccgctcacggacgctggactcaccccgtaccacgcgatcaaacgctccatgtccaagctggaaccgggcagtgtcgcggtggtcatcggcgcaggcgggctggggcacgtcggcatccaactgctgcgcctcatgtccgcagccaccgtggtggccttggacatccgcgaggagagccgggaactggcgttgcgcagcggagcgcaccacgcgctgccgtccgactccaaagccgtgggcctggtgcgggagctgaccgacggcgcaggcgccgacgtggtgttcgacttcgtgggggcacaggtcaccctcgaccttgccgcgcagatggcaggcttggactcccacatcaacatcatcggtatcggcggtgggtcgctgccggtgtcgttcgactcgctcccctacggcaccagggtgagcaccagctactggggcacccgctccgagctgatcgaactcgtcgaactcgccaaacagggcgcgatcgacgtgcacgtggaacgctacgagcttgaggaaggccccgaggtgtacaagcggatggaggccgggaagatccagggtcgcgcggtgttggtgccc

SEQ ID NO: 31924 - DNA, 1356 bp, Thermobifida fusca
atcctcggcggcggtggtttccgcgtcccgctcatccaccgcgccctgctcgccgacgcacggcacccggatccgcccatcaccgagctcgtgctgttcgacaccgcaccggagcgggtggcggtgatccgcaccatcctggaacagcagcgtgaagcccaccgggccgtctacggcgaacccccgctcaccgtccgcgtcgcagacaccctggacgaggcgttgcggggaagcgccatcgtcttctccgcggtccgtgtcggcggcgccgaaggccgggtccgcgacgagcgggtggcgctcgccgctggagtactcggccaagaaaccgtgggcgcgggcgggatcagctacgggctgcgcaccgtgccggtggccgtggccatcgcccagcatgtggcccgcctcgccccccaagcatgggtgatcaacttcaccaacccggccgggctgatcaccgaggcgatgacccagatcctcggcgaccggatcatcggtatctgcgactccccggtcgggctcggccgccgcgccgcccgggcactgggcttggacccggcgcgcgtccacttcgactacgcgggcctcaaccacctcggatggctgcgcggcctgcacgccgacggccgcaaccggctccccgacctgctcgccgacgaggccgcgctgacctcgttcgaagaaggccgactgttcggcgcggcgtggctgcgcgccctgggcgccctccccaacgagtacctgcactactactatctggcccgcgaaacccgcgaagagatcgcccgcactcttgcggccggcggccacacccgcggggagcagctcgtcgtccagcagaaagagttctaccggctggctgcggcccgccctcgcgacgcctacgacctgtgggagcagacccgtcgggagcgggaagagacctacatggccgacaaccggcgcgccgccggaggagtggaacgcgacgaagccgacttggacggcggcggctacgagcaggtggcgctagcggtcatgcgcgcgatcctccgcgacgagcccgcccggctgatcgtcaacgtccgcaaccggggcgccctgcccggcgtggacgctgacgcagtcgtggaagtgccctgcctggtcgacgcttccggggcccgcccactcgccgtggacccgctcgccccgcaccaactcgctttggtgcacgcggtcaaagccgtggaacgggaagtcctgcacgcggtccgcaccggttcacggactgcggcgctgcgggctttcgccacccacccgctcgtggactcggtggctgtcgcccaacgcctcctcgacggctacctgcaggctttccccgaactggcccgcatc

SEQ ID NO: 31925 - DNA, 774 bp, Thermobifida fusca
tcctgccccggcggggtggcgaacatggcggtggccgcatcccggctagggctgcgcaccgcagtggcggcagcgttcggggaggacgtgtacggcgacttctgctgggagacgctggcgaaccaggagatggtggatctgtctgcgtctcggcggattcccaactggcattccccgttcacggtgtcgctggcctaccggggtgaccgcagcatggtcacccacgagcatccgtcaccgatcccgttgcaggacatggcgcgcgatttgccgcaggcgcgggctgcgttcgtcagtttgagcaatgaggacggggtaccggagtgggcgcaggagcaggcgaagaacggcacgctcatcttcgccgatgtgggatgggacgatagtcagcgctggtctccgtccgtgttggagcagctgcggcactgtcacgcgttcatgccgaacgcgatcgaggcgatggcgtacacgcggacgggcagcccggcgctggctgtggcggcgctcgccgagcacgtgccggtcgcggtggtcacggacgggccgcgcggggcgatcgcgattgaccagaccacgggtgaggaagccgaggtggaaggcatcgtgattgatgccgtggacaccaccggtgcgggcgacgtgttcggggccgggttcatcatgggcacgctggccgggtggcctttggagcagcgcctgcggttcgctaacttgtgcgcggcgctgtccgtgcagcacaccggggggtcgctgtcggctccggggtgggcggat

SEQ ID NO: 31926 - DNA, 1692 bp, Thermobifida fusca
gcgcaacggatgacggaggatcggatggaaccggaccgggggtgctcccccgctgctggagaacagaccctgaccggggtcgcggccagcccgggcaaagccacgggaccggttgcggtcctggccgcgccgccgacgcttcccccacggcgcccggcggtcaccgatcctgacgcggagatcgcccgggctacggccgcgctccaccaggtcgccgaccagttccgccgccaagccgccacggtggacggcgaggcgcgggagattctcgaagcccaagcgctcatggccagcgacccgcaactcgctgcggggatcgctgagcgggtgcgcaacgggcttgccgcggagtgggcgctcgacgaggcggtcgcctcctatcaggagctgctccgcggtgcaggggagtacgtggcgggacgcgccgcggacctcggtgacatccggaatcgggcgttagcggtgctgttggatgtccccatgccgcggccgcccgtcccggggcacccgttcgtcctggtcgctgacgatcttgcccccgcggatgtggccaggttggacgcggacacggtgctggcgatcgtcacccgggtgggcggggccacggaccacaccgcgatcctggcccgttcgctcggcattcccgcggtggtgggttgtgctgaggcgcaccagttgtgcgaggggaccccggtcacggtggacggagaccagggcacggtcgtggtgcattcctccgcgcagcagtgcacgacccagcggcattcccgcccccaggctgccagagggctcgctacggggccgggccgcaccaaggacggacagcgggtggagctcctcctcaacctgggcggggaggatccggaacgcgcggcccggcacgactgcgagggcgtggggctgctgcgcaccgagttcctgttcatggaccgggtggccgagccgacgggtgcggagcagagcgccgcctatgcgcgggtgttccgcgcgttcggcggccgtgtggtgacggtccgcacgctggatgtgggggcggacaagccgctggcgttcttggcgcaggagaacgagcccaatccggcgttgggggtgcgcgggttccgcatggtgcgcacctcccctgaggtgctgcgccggcagcttgccgcggtggcccgggccgcgcaggagacgcggacgcgcgtcagggtgatggcgccgctggtcgccaccccgcaggaggccgcggatttcgtggctttggctcgggaagcagggatcgccgaggtcggggtgatggttgaggtgccgtcggccgcgctgctggccgaccgggttgtgcgcgaggtggatttcgtgtcgatcggcacgaacgacctcgcccagtacacgctggcggcagaccgcacccgccccgcgctgtccgacttgctggacccgtggcagcccgcggtactgcacctggtgggccgggtcggggcggcaggccgggaggcgggacggccggtgggagtgtgcggggaggctgcggctgatccactgctcgctttggttttcgtggggctcggggtgacgagtctgtcgatggctgccgcggctttgccagtggtgcgcggggcgctggcccggcacacggtggcggactgtcggaagctggctgcgctggcaatggacgctgccgggccctgcgaggcgcgggagacggtccgcgcc

SEQ ID NO: 31927 - DNA, 804 bp, Thermobifida fusca
atgcgtttcgccaagggccacggcacagagaacgatttcgtcattcttcccgacccggacggggagctcgacctcgatgcagcgacggttgccgcactgtgcgaccggcgcgccggtctgggagcggacggggtgctgcgagtggtccggaccaaagcattggacgagccgttgacgggggaggcggcgaccgcgcagcgctgcgagtggttcatggactaccgcaacgctgacggcagtgtggcggagatgtgcggcaacggggtgcgggtgttcgcccgctatcttcaggaggccggcctggtcggcgccgcagccttcgaagtgggcacgcgggccggggcacgccacgtggtgctggagcccgacgggaacatcaccgtcgacatggggccggtgcggatcctggggccggggagtgcccggttggccgacggcccggtgcacgggacgcggatctcggtggggaacccgcatttggcgtgccgggtggcgcggcctgtcgccgaagtcgacttgagcgctcctccgctgctgcgggctgaggagttcccgcagggcgccaacgtggaagtgttccgcgaagtcgcctcgggcgtattggagatgcgcgtctacgagcgcggggccgctgagacccggtcctgcggtacggggattgtggctgccgcggccgccgcgactcccccgggcgaggatgcccggtggacggtgcgggtgccgggcggggagtgcacggtggtgctcgagtctggagcagctcggctgagcggccccgcggtgatcgtcgccgagggggacgtc

SEQ ID NO: 31928 - DNA, 1572 bp, Thermobifida fusca
tggtggcgccacgcggtcatctaccagatctacgtccgcagcttcgcagactccaacggcgacggcgaaggcgacctcaacggcatccgggagcgcctgcccgccctggtctcgctcggcgtggacgcgatctggctgacccccttctacgtctcccccctcgccgacggcggctacgacgtcgccgactaccgtgacgtcgacccgcggttcggaacgctggccgacttcgacgccctcctggccaccgcccacgacctgggcctccgggtcatcatcgacatcgttcccaaccacacctcctccgcccaccgctggttccgcgacgcgctggccgccggaccgggcagcccggagcgcgaccggtacgtcttccgcccggggcgcggggagaacggggagctgccgccgaacaactggcagtcgatcttcggcgggcccgcctggacccgggtgacggagccggacgggacgcccggcgagtggtacctgcacctgttcgacgtagagcagcccgacctgaactgggagaacccggaggtccgggccgaattcgccgacattctgcggttctggctggaccgcggggtggacggcttccgcatcgacgtggcccacggcatgatcaaggaccccgcgctgcccgacatcgccgaaggccagaaggcggacatgctcgacggccacacgcggctgccctacttcgaccaggacggggtccacgagatctaccgggagtggcgcgccatcgtcgacagctaccccggggagcgcgcgctggtggccgaggcgtgggtggagaacgcggaacgcgtggcccgctacctccgccccgacgagctgcaccaggcgttcaacttcgagtacctcaccgcagactgggacgctgcaacgctgcgcgccgtggtggaccgctccctggccgcgaacaacgcggtgggggcgccgaccacatgggtgctctccaaccacgacgtcacccggcacgtcacccggttcggcgggggcgcgcaagggctggcgcgggcacgcgccgcgctcctgctgatgctggccctgccgggatcggtctacctctaccagggtgaggagctgggacttcccgaggtcaccgatctgccggaggaggccctgcaggaccccacgtggaagcgctccggatacaccgagcggggccgcgacggatgccgggtgccgctgccttgggaaggcgacgagcccccgttcggcttcggctgctcggcggagcgcagttggctgccggtgcccgcggagtggcggtcgctgacccgggaggtccaggagcgcgacccggactcgaccctgtcgctgtacaagaaggcgctgcggctccgccgcgaactgctgctccccgcagaggacgcgctgcactgggcggacgccccgcagaacgtgctggctttccgccgggaaccgggtttcacctgcgcggtgaacttcggcgctgacccggtcacgctgccgttcgagggcgaagtggtgctgtccagcggtccggtggagcaggacggcacgcacctcgtgctgcctggggacaccgcggtgtggctg

SEQ ID NO: 31929 - DNA, 1137 bp, Thermobifida fusca
gtggccagagactattacgagatccttggtgttcgccgcgacgcgacccaggacgagatcaaaaaggcataccgccggctcgcacgtgaactgcatcccgacgtcaaccccgacccagagacccaggagcggttcaaggaagtcgcccaagcctacgaggtgctctccaacccggagaagcgccgcatgtacgacatgggcgtcgacccgttcgcgcgcggcggggcagcgggcggcggagccaccggcttcggagcgggcttcccgttcgacgacttgatgaacgcgttcttcggggggagcacgggaacccgcgcggcacgcgagcggatgcgccggggccggagcatcaaggtgcgggtcgagctcgacctcgaagagaccgcgttcggcgtcaccaaggacatcacgttccccaccgcggtcgtgtgcaacacctgccagggtgagggcacggcgcagggaacccaccccgagacctgcgacatgtgcggtggccgcggtgaagtctcccaggtcactcgctcgttcctcggccaagtcatgacgactcggccgtgcccgcagtgcgcgggccagggcacgatcatccgcaacccctgcccggactgcgccggggaaggccgggtccgggagcgcgtcacccgcaaagtgcagatccccgcgggtgtcgaggacgggacccagatccagctggcgggcgaaggcgaggtcggcccgaacggcggaccgcgcggcgacatcttcctggagatcgtggaacgcccgcacccgatcttcgaacggcgcggcgacgacctgcactgcacggtcaccgttccgatgaccgcggccgcgctgggggcgacgctgaccatcgacaccctcgacggcccggaggagatcgacctgcgccccggcaccaattccgggcaggtcatcaccctgcagtcgaagggctgccaccacctcaacgcgccgggccgcggcgacctgcacatccacgtcacggtggagacccccacccgactggacgaagagcaggaagcgctgctgcgcaagctcgcggaactccgcggcgaggaccggccgccgggcaagttcagcccggggcagggcaatttcttctcccgcatccgtgacgcgttcggcgcgcgg

SEQ ID NO: 31930 - DNA, 2682 bp, Thermobifida fusca
gtgcccaagtacgtgtacgacttcaccgaggggaacaaggacctcaaggatctcctcggaggcaagggtgccaacctcgcggagatgaccaaccttggccttcccgtgccgcccgggttcaccatcaccactgaggcgtgccggcactacctcgagcacgggaccatgcccccggggttagacgcccagatcgaagagaagctggccgcccttgaagcgaccatgggcaagcgcctcggccagcccgacaacccgctgctggtgagcgtacgctcgggcgccaagttctccatgcccggcatgatggagaccgtcctcaacatcggtctcaacgacgagtcggtcaaaggacttgccgcccagtccggcaacgagcggttcgcctgggactcctaccgccgcctcatccagatgttcggcaagaccgtactgggcatcgatggcgacctgttcgaggacgccatcgacgacctcaaggcccgcaaaggcgtcaccagcgacctcgacctagacgccgccgacctcgccgggctcgtcgacacgttcaagaccatcgtccgggaagccaccgacgcggagttccccaccgacccgcgcgaacagatgcgcctggccatcgaagccgtcttcaagtcctggaacgccccccgcgccgtcctctaccggcgccaggagcgcatccccagcgacctgggcaccgcggtcaacatctgctccatggtcttcggcaacctcggcatggactccggcaccggagtggccttcacccgcgaccccgccaccggccagcagggcgtctacggcgactacctgcagaacgcgcaaggtgaggacgtcgtcgcggggatccgcaacaccatccccctcaccgaactggagcggatcgaccccaagagctacgccgaactgctcgagatcatggagaaactcgagcggcactaccgcgacctgtgcgacatcgagttcaccatcgagcgcggcaaactgtggatgctgcagacccgcgtgggcaagcgcaccgctgccgcagccttccgtatcgccaaccagctcgtcgaccaggggctcatcaccctggaagaagcggtgaaccgggtcagcggcgagcagctcgcccagctcatgttcccccgcttcgacgagaaggccgaacgcgacctgctgggccggggcatgaacgcctccccgggcgcggccgtggggcgcgcggtcttcgactccgccaccgccgtcgcgtggtcgcgcaacggggagaaggtcatcctgtgccgccgggagaccaaccccgacgacctggaaggcatgctcgctgcccagggcatcctcaccagccgcggcggcaagacctcgcacgccgccgtcgtggcccgcggcatgggcaagacctgcgtctgcggtgccgaagagctcgacatcgacaccaagaaccgccagttgaccgcgccggacggccgggtcatcaaggaaggcgacgtcatctccatcgacggcaccaccggtgaagtgttcctcggcgaagtccccgtcgtggcctccccgatcgtgcgctacttcgaaggcgagctcgacccctcctcggcggaagccgacgacctggtccgcgccgtcgaccggatcatgcggtacgccgacgccaagcgccgcatggctgtgcgtgccaacgccgacacccccgaggacgcggcccgcgcccggcgcatgggcgcccaggggatcggcctgtgccgcaccgagcacatgttcctcggtgaccgccgcgccctggtggaacggctgatcctcgccgacaccgaccaggagcgggacgaggctctcgccgccctcctgccgctgcagcgcgaggacttcaccggcatcttcgaggcgatggacgacctgcccgtcaccgtgcggctgctcgacccgccgctgcacgagttcctgcccgacatcactgaactgtcggtgcgtgtggccgtagcggaggcgcgcggtgagaagaacgaaggggacctgcggctgctccaggccgtccaccggctgcacgagcagaacccgatgctgggcctgcgcggggtccgcctcggcctcgtcgtaccgggactgttcaccatgcaggtacgggcgatcgccgaggctgcggccgcacggatcaagcagggcggccgtccgcgccccgagatcatgatcccgctggtcggcaccgtccaggagctggagatcatccgcgaggagtcggtgcaggtcatccgcgaggtcgccgccgagcacggggtggagctcgacatcccgatcggcaccatgatcgagctgccccgcgccgcgctcactgccgggcagatcgcggagagcgccgagttcttctccttcggcaccaacgacctcacccagaccacctggggcttctcccgcgacgacgtggaagcctccttcttctccacctacctggagaagggagtgttcggcgtctccccgttcgagtcgctggacgtcgacggggtgggacggctggtccgcatcgccgcggaggaaggccgcgccactcgccccggcctcaagctcggggtctgcggtgagcacggcggcgacccagcctcggtgcacttcttccacgaggtgggcctggactacgtctcctgctcgccgttccgcgtccccgtcgcccgcctcgaagcgggacgggccgcgctccgctaacctgcg

SEQ ID NO: 31931 - DNA, 1396 bp, Thermobifida fusca
cgcgactaatagtggtatgtcgcggacattccgtcacggggcgggatacgttgaaaccatggcgggtcgacaccggattcttccagcacggcgccgtacctttgcacccacctgggtcgtgctgctggtcgcggccggcgtggtggccctgtgcggcggggtcgtcgtgctcctcggcccgcgcctggggaactggtggaccaggcccacggcggagcggatcgcctacttcgctgactggaataccgccaaccgcggctacacgatcaaagacgtggacgagagcggggctgccgcactcctggaccggctgatctgggcgttcggggatgtgagcgaagacgggctgtgccacatccccgctgaggcggaccagccgtggcagatcttccagcgccgctacgaggccgcggaaagcgtggacggccaagccgacacctacgagcagccgctcgccgggagcctcaaccagttgcgcaaactccagcagaagtacccggacttgcgcgccagcatctcgctggggggatggaactggtccacgtacttttccgaggcggtgcggactcaggagtcccgggagcgtttcgtcgcctcctgcatcgacctgtggctgcgcggcaacctgccccgcctcgagggggagccgcagggaggcgaaggggtcgccgcagggattttcgacggtatcgacctcgactgggagtggccgggcggcaacggccatcccgacaacgtcgagcaccccgacgacaagcggaatttcaccctcgtcgtgcaggagttccgcgcccagttggacgccttggaacgcgagaccgggcgggagtacaccctgtcggcgtccctgagccacgacccgaagatcatgcgggacagctacgagcctgaggtcttcgactacctggacttcgctaccgtccagggctacgacttcaccgggtcgtggcgggacatcaccggccaccacgcgcagttgtacgcgcctgaccaggatcccgaccagcccagcgtcgaccgggcagtccgccagtacctcgactacgggctgcccgccgagaagctcgtgctcggcatccccggctacggtcgcggctggcgcggggtgccgccggggcccaacggcgacgggtggctggtcgaagcggaacagccggcggaaggcggctacggggaggcgacacacgcctacgaaacactggagcagcatcccggggagcgtttcttcgaccgcgagaccggggccgcgtggatctacgacggcgacgagtggtggtcctacgacaccccggaagtggtgcgccgcaaaggcgcctacgccgtccgccacggcctgcgcggcctggtgctgtggaacctggacatggatccggaaggggagctggtcgccgcgatg

SEQ ID NO: 31932 - DNA, 1173 bp, Thermobifida fusca
atgaccgacgtgtacatcctcgacgcggtacgtacccccttcggacggtacggtggcgcactgtccgggatccgccccgacgacctggccgcgcacgtcctgcgcgcgctcgcggaacgctcccccgggctggaccccgccgcggtcgacgacgtcttcttcggcgacgcgaacggggctggggaggacaaccgcaacgtggcccgcatggccgcgctgctcgcgggctggcccacctcggtgccgggcgtgaccttgaaccggttgtgcggttccggcatggaatccgtgatcgccgccaaccgcgcgatcgccgtgggcgacgcctccctggcggtggccgggggtgtggagtcgatgagccgggcaccctgggtgctccccaaacccgctcagggcttccccaccggccacgaaaccctgtactccaccacgctggggtggcggatggtcaacccggccatgccggagcagtggaccgtctccctgggagagagcaccgagcaggtcgccgccacgtacggcatcagccgcgccgaacaggacgctttcgcgctccgcagtcacgagcgcgcagcccgcgcctgggcggaaggagtgttcgacgcggagatcacccaaatccccggcgcggaactggaacgggacgagagcatccgggagacgtccgcggagaaactggccgcgctcaaacccgcgttccgccccgacggcacgatcaccgcgggcaacgcctccccgctcaacgacggggcggccgcgctcctcatcggggacgcggcagcagctgaacgggtcggccgcgagccgctggcccggattgtcagccgcggggtcgccgcagtcgaccccgacgtcttcggaatcggcccggtccaggcagccgagatcgcgctgcgccgcgccgggatcggctgggacgacctgtcggtggtggaactcaacgaagcgttcgccgcccagtccctggcctgcctgaaactctggccggacctggacccggagatcgtcaaccccaacggcggcgccatcgccatcggccaccccctgggcgcgtccggtgcccggatcgtcggcacgctcgcccacgaactgcaccgccgcggcggcgggtgggggctggccgcgatctgcatcggcgtgggccagggcctcgccgtagtgctgcaccgc

SEQ ID NO: 31933 - DNA, 837 bp, Thermobifida fusca
gggctccacgtcaagaacggccgcctgtatgaggccaacggccaggagttcatcatccgtggcgtcagccacccccacaactggtacccccagcacacccaggcgttcgccgacatcaagtcgcacggcgccaacaccgtccgggtggtgctgagcaacggtgtccggtggagcaagaacggtccttctgacgtcgccaacgtcatctccctgtgcaagcagaaccgccttatctgcatgctggaggtgcacgacaccaccggctacggcgagcagagcggggcctccacgctcgaccaggccgtcgactactggatcgagctgaagagcgtgctccagggcgaggaggactatgtcctcatcaacatcggcaacgagccctacggcaacgactccgcgaccgtcgcccgctgggcgtcggacacctccgccgccatccagcggctgcgcgccgccggattcgagcacaccctcgtggtggacgcccccaactggggccaggactggacgaacaccatgcggaacaacgccgaccaggtgtacgccagcgaccccaccggcaacaccgtcttctcgatccacatgtacggcgtctactcccaggcgtccacgatcaccagctacctggagcacttcgtcaacgcgggcctgccgctcatcatcggcgagttcggccacgaccactccgacggcaaccccgacgaggacacgatcatggccgaggccgagcggctcaagctgggctacatcggctggtcgtggagcggcaacggcggcggggtcgagtacctcgacatggtgtacaacttcgacggcgacaacctgagcccgtggggc

SEQ ID NO: 31934 - DNA, 1398 bp, Thermobifida fusca
atggcgaaatcccccgccgcccggaagggcggccctccggtcgctgtcgcggtgaccgcggccctcgccctgctgatcgcgctcctctcccccggagtcgcgcaggccgccggtctcaccgccacagtcaccaaagaatcctcgtgggacaacggctactccgcgtccgtcaccgtccgcaacgacacctcgagcaccgtctcccagtgggaggtcgtcctcaccctgcccggcggcactacagtggcccaggtgtggaacgcccagcacaccagcagcggcaactcccacaccttcaccggggtttcctggaacagcaccatcccgcccggaggcaccgcctccttcggcttcatcgcttccggcagcggcgaacccacccactgcaccatcaacggcgccccctgcgacgaaggctccgagccgggcggccccggcggtcccggaaccccctcccccgaccccggcacgcagcccggcaccggcaccccggtcgagcggtacggcaaagtccaggtctgcggcacccagctctgcgacgagcacggcaacccggtccaactgcgcggcatgagcacccacggcatccagtggttcgaccactgcctgaccgacagctcgctggacgccctggcctacgactggaaggccgacatcatccgcctgtccatgtacatccaggaagacggctacgagaccaacccgcgcggcttcaccgaccggatgcaccagctcatcgacatggccacggcgcgcggcctgtacgtgatcgtggactggcacatcctcaccccgggcgatccccactacaacctggaccgggccaagaccttcttcgcggaaatcgcccagcgccacgccagcaagaccaacgtgctctacgagatcgccaacgaacccaacggagtgagctgggcctccatcaagagctacgccgaagaggtcatcccggtgatccgccagcgcgaccccgactcggtgatcatcgtgggcacccgcggctggtcgtcgctcggcgtctccgaaggctccggccccgccgagatcgcggccaacccggtcaacgcctccaacatcatgtacgccttccacttctacgcggcctcgcaccgcgacaactacctcaacgcgctgcgtgaggcctccgagctgttcccggtcttcgtcaccgagttcggcaccgagacctacaccggtgacggcgccaacgacttccagatggccgaccgctacatcgacctgatggcggaacggaagatcgggtggaccaagtggaactactcggacgacttccgttccggcgcggtcttccagccgggcacctgcgcgtccggcggcccgtggagcggttcgtcgctgaaggcgtccggacagtgggtgcggagcaagctccagtcc

SEQ ID NO: 31935 - DNA, 795 bp, Thermobifida fusca
cccacgctctctttcgacggcgtcaccccgtacgcccactacaccgccgtctccacgctgctgtcgttgcagcgcccccgcaccgaggagcccgctgagaccacgttcctcgtcgccacacaggtcatggagctgctgttcgcgctgatccggcacgaatgggagcaggcccgcgacgcggtcgacgccgatgacgtgcccgcggccctggccgcgctgcgccgcggccacaaggcccaggacgtgctggccgagtcttgggagctgttggctcccatgactcccaccgagttcaaccggtttcgcgaccagttgggtgaggcgtcgggcttccagtcgtacggctaccgccatctggagttcctgctcggcaacaagtcggcggccatgatccgcccgcaccgtgccgatccgcacgtcagcgcggagctggagcgggccctcgccgagccgagcctgtacgacgcggtgctgcgcctgctgcaccgccgcggtttcccggtgcccgccgagcgggtggaacgcgactggacccagccggcggagccccatccgcaggtggtgcgggtctgggagctggtctacgccgacgacaggcccgataacgagctgctcgcgttggcggaggcgctgctggacaccgcggagcgggtgaccctgtggcggcaccgccatgcgatggcggtgaagcgcacgatgggcgccaaagcgggcaccggcggctcgtctggtttgcaatggttgatgagaaatgtccaaaaggatgtgtttccggagctctggcagctgcggacc

SEQ ID NO: 31936 - DNA, 1062 bp, Thermobifida fusca
ctgcttcgccgtgttgatgcagaacgcgcccatcgggtgagtttcgccgggctgcgcgccctcgccgcggtgcccggcacgacccgtctgatgcgccgcgtgctagggccgcgcgagcccgagctgcgggtgcgcgtgttcggccgggaattccctggaccgctggggctggccgcggggttcgacaagaacgcccgcggtgtggccgcgctcaccgcactggggttcagccacgtcgaaatcgggacggtgaccggccagccgcagccgggaaacccccggccccggctgttccgcctggtcgcggaccgcgccatcgtgaaccggatgggcttcaacaacgagggctcgcaggcggtgtcggagcggctgcgcgcccaccgcgcccgccgggcccgcgacctcatcgtcggggtcaacatcggcaagaccaaggtggtcccggacagtgacgctgtcgccgactatgtgacgagcgcacgccggttcgcggacctcgccgactacctggtggtgaatgtcagttcgccgaacacgccgggcctgcgggacttgcaggccacggaacggctgcggccgctgctgagcgcggtgcgccgcaccctcgacgaggcgggacgccccgacctgccgctcctggtcaagatcgcccctgacctggctgacgaggacatcgacgcggtggcggacctggccgtggagctgggtttggacggcatcatcgccaccaacaccacggtgtcccgcgacggcttggccactgacccggaggaggtggccgcgctcggcgcgggcggcctgtcgggggcgccgttgaaggagcgtgccctgcaggtgctgcgccgtctgcgcgcccgggtgggggaccggctcgtcctcatcgcggtcggcgggatcgagaccccggaggacgcgtgggcgcggatccgggccggggccacgctcgtccagggctacaccggtctcatctacggggggccgctgtggccgcgccgcatccaccgcggggtggccgcgttggcccgccgtgacggtttcgcgtcgatcgctgaggcggtcggc

SEQ ID NO: 31937 - DNA, 933 bp, Thermobifida fusca
ttgatcaccgtcgtaggcgaagcactcatcgacctcatcagctcggagagcggcacctaccgttccgtcccgggtggggcacccgccaacaccgcggtggcactggcccggctcggcgtgccgtcgtccctactcgcccggatgagcaccgaccgcttcggccagcagttgcgcgcctatgtgggatcccgcggggtcagcacccgcgacatcgtcgtctccgacgagcccaccaccctggctatcgccacccttgacgagaccggccgcgccacctacgacttctacgtcaaaggcaccgtcgactggcagtggcggcccgaagagctgcccgacccgctcgccgacgacgtgaccgccatccacgtgggctccctggcgatggcgatgccgccgggcgcggccgtggtggaagagtgggtggcccggcagcgcggccgcgcggtgatcagctacgaccccaacatccgccccgccctcgccgggaccccggcgagcgcccgcgaacgggtagaacgccaagtcgccctcgccgacctggtgaaagtcagcgacgaagacgtgtactggctgtacgagcaggaccccgcgaccgggtctgctgacctgctcgtggaggtcggccggtcgtggttgcgccgcggaccgagcctgatcaccatcacctgcggcggcgaccagacgctcgtactggtgcggggccgcgaggaccggccgctgtccgtggcgccggaaccggtcgacgtcgtcgacagcatcggcgccggggacgcgttctgcgccggactgcttgatgccctcggccaagccggagccttgggggcagacgggcgcgagcggctggccgccctcaccgacgcccagctcaccgtgtgcgtggcacacgcccaccgggtcgccgcgcacacctgccgccgcgtgggagcagacccc

SEQ ID NO: 31938 - DNA, 1338 bp, Thermobifida fusca
ttcgtgtggggagtggcgaccgcttcgttccagatcgaaggctccaccacggccgacggccgcggccccagcatctgggacaccttctgcgccactccgggcaaggtcgagaacggcgacacgggcgaccctgcctgcgaccactacaaccggtaccgcgatgacgtggccttgatgcgggagctgggcgtgggcgcctaccgcttctccatcgcctggccgcggatccagcccgagggcaagggcacgcccgtggaggccgggctggacttctacgaccggcttgtggactgcctgctggaggccggcatcgagccgtggccgaccctctaccactgggacctgccgcaggcgctggaggacgcgggcggctggcccaaccgggacacggccaagcggttcgccgactacgcggagatcgtctaccgccggctcggcgaccggatcaccaactggaacacgctcaacgagccgtggtgctccgcgttcctgggctacgcctccggcgtgcacgccccgggccgccaggagccggctgctgcgctggccgccgcccaccacctgatgctgggccacgggctggccgctgccgtgatgcgggacttggcgggccaggccggacgttccgtgcggatcggtgtcgcgcacaaccagaccacggtccgtccctacactgacagtgaggccgaccgggacgctgcgcgccggattgacgccctgcggaaccgcatcttcaccgagccgctggtgaagggccgctacccggaggacctgatcgaggacgtcgccgcggtcaccgactacagcttcgtccaggacggcgacctgaagaccatctccgccaacctggacatgatgggcgtcaacttctacaacccgagctgggtgtcaggcaaccgggagaacgggggctccgaccggctgcccgacgagggctactcgccgtcggtcggcagcgagcatgtcgtggaggtggaccccggcctgccggtgaccgccatgggctggccgatcgacccgaccgggctgtacgacacgctgacccggctggccaacgactacccgggcctgccgctgtacatcaccgagaacggcgccgccttcgaggacaaggtggtcgacggcgcggtgcacgacaccgagcggatcgcctacctggactcgcacctgcgggccgcgcacgctgccattgaggcgggcgtgccgctcaagggctacttcgcctggtcgttcatggacaacttcgagtgggccctcgggtacgggaagcggttcggcatcgtgcacgtggactacgagagccagacgcgcacggtgaaggacagcggctggtggtac

SEQ ID NO: 31939 - DNA, 1146 bp, Thermobifida fusca
atgtcctaccgtctcagcgacgaacacgaagaactgcgccgcaccgtcgccgaattcgcccgcaccgaagtcgcgcctgtcatcggcgactactacgaacgcgccgccttcccctacgagatcgtcgccgccatggggcgcatgggcctgttcggcctgccgttccccgaagacgtcggcggcatgggcggcgactacctggcgctctgcctcgccctggaagaactcgcccgcgtcgactcgtccgtcgccatcaccctggaagccgccgtctccctcggcgcaatgccgatctaccggttcggcacccctgaacagcaagccacctggctgccccggctctgctccggagaagccctcggcgcgttcggcctcaccgaacccgaaggcggctccgatgcgggcgccacccgcaccaccgcccgcctcgatgccggagaatgggtcatcaacggcaccaaaagcttcatcaccaactccggcaccgacatcaccgcgctcgtcaccgtcaccgcggtcaccggacaacggcccgacggacgccccgaaatctccgcgatcatcgtccccgccggcactcccggcttcactattggccagcggtactccaaagtcggctggtgcgcctccgacaccaacgaactcgtgttcaccgactgccgggtccctgaagccaacctcctcggcgaacgcggccgcggctacgcccaattcctgagtatcctcgacgaaggccgcatcgctatcgccgcgctcgccgtcggactcgcccaaggctgcgtcgacgaatgcctgcgctacgtcggccagcgcgtcgccttcggccgcgaaatcggccgctaccaggcgatccaattcaagatcgcggacatggccgcccgcgtgcacaccgcccggctcgcctactacgacgcggccgcacgcctgctggccgggcagccgttcaaaaaagaagccgccatcgccaaactcgtcgcgtcccacgcggccatggacaacgcccgcgacgccacccagatcttcgggggctacgggttcatgaacgaatacccggtcggacgcttctaccgcgacgccaaaatcctcgaaatcggcgaaggcacctcagaaatccagcggatggtcatcgcccgggaactcggactg

SEQ ID NO: 31940 - DNA, 1980 bp, Thermobifida fusca
gtcctcgtcgccaaccggggcgaaatcgccgtgcggatcatccgcaccctgcggcagctcgccctgcccgccatcgccgtctacaccgaccaggacgcggacgcgccccacgtgcgcgccgccgacagcgcgctacgcatccccgactacctggacggggacgcgatcatcgccgcggcacacgccagcggagcagccctcatccaccccggctacgggttcctcgccgaaaacgccggcttcgcccgcgcctgcactgcggccggactcgtcttcgtcggcccgaccccggactcgatcgccgccatgggcgacaaaatccgcgccaaacagaccgtggccgccgccggagtgcccgtcctccccggattcgcggaagaccccggccaccccctgtccgcaaccgacctcaccgccgcagccgcacagatcggctaccccctgctcctcaaaccctccgctggcggcggcgggaaaggcatgcggctcgtccacagcccggacgagctcgcggacgccgcagccgccgcccgccgcgaagcccgcgccgccttcggcgacgccaccctgctcgcggaacggtacgtcgcccgcccccgccacatcgaagtgcaaatcctcgccgacacgcacggcaccatcgtccacctgggggaacgcgaatgcagcctccagcgccgccaccagaagatcgtggaagaagccccctccccgctgctcacccccgagcagcggaacgccatgggccaggccgctgtggccgcggcacgcgcctgcgggtacgtgggggcgggcaccgtggaattcatcgtgcccggggacgacaccgaccgcttcttcttcctcgaaatgaacacgcggctccaagtcgaacaccccgtcaccgaagccgtcaccgccatccgcggcacccgcggcatcgacctggtggaagcgcaactccgcatcgccctcggcgaagccctgccgttcacccaagacgacatcacctggcaggggcacgcgatcgaatgccgcatctatgcggaagacccggcgcggaacttcctgcccaccggcggccgcatcctccacgtcgccgaaccccacgggcccggcatccgcgtcgactccggcatcagcgaaggcaccaccgtcacctccgcctacgacccgctgctcgccaaactcgtcgtctgggaccacgaccgcgctagtgcgctccgccgcgccgacgcggccctcgcccgcaccacactgctcggctgcggcaccaacaccgcgttcctccgcgccctgctcgcccaccccgacgtcgccgccggacagctcagcaccgggctcgtcgaacacctccaccccgagctcgcccccgccctccaggcaggccccgacgtgctcgccgccgcggccctcgaccggcacctcgacctggtcgcgaccagcgaccccgccaaccggttcaccatccccgacgggtggcggctcggcgaacctgcgtggaccgtgtggcggctccactcgcccggcagcgaccccgtcaccgtgcgcgtccgcgccgaccacgaccacccgcaccgcttccacgtgcgcgtcgccgacgccgacccgcacgaagccaccgcggtccgctccccagacgggcgcagcctgcacgtcacctacgcgggccaggcccgccactacacccgcgccacggacgggcacgacctgtggctcggccatgcgggcgcggcctggtgcttccgcgacgccccccgcaccgccccgctgcgccgcaccagcgggcacgccgacggcgccgtgcgcagccccatgcccggcaccgtcctcgacgtgcccgtcgccgtcggcgacaccgtccgcgccggacagaccctcgccgtcgtcgaagccatgaaaatggagcaccccgtggccgcacccgtcgacggcaccgtcaccgaactgcacgcccgtcccggacagtccgttccccttgatgccctcctcgccgtcgtc

SEQ ID NO: 31941 - DNA, 1770 bp, Thermobifida fusca
cgcagatccctggccgcgctgctcgcggccctgctgggttgtgccacgtccctggttgcgctgaccgtcgcggcttcccccgctcatgccgcgccgtcaggcaaccgggacgtcatcgtccacctattccaatggcggtggaagtcgatcgccgacgagtgccggaccacgctcggcccccacggcttcggcgcagtccaggtctccccgccgcaagagcacgtggtcctgcccgctgaggactacccctggtggcaggactaccagccggtgtcctacaagctcgaccagacccgccgcggcagccgggccgacttcatcgacatggtcaacacctgccgggaggcgggcgtcaagatctacgtcgacgcggtcatcaaccacatgaccggcaccgggtccgcgggtgccggtccgggcagcgcgggctccagctacagcaagtacgactacccgggcatctaccagagccaggacttcaacgactgccgccgcgacatcaccaactggaacgacaagtgggaggtgcagcactgcgagctggtcggcctcgccgacttgaagacgtcctccccctacgtccaggaccggatcgcggcctacctcaacgagctgatcgacctcggcgtggccgggttccgcatcgacgccgccaagcacatccccgagggcgacctgcaggcgatcctctcccgcctgaagaacgtccacccggcgtggggcggcggcaagccgtacatcttccaggaggtgatcgcggacagcacgatcagcaccggctcctacacgcacctggggtcggtcaccgagttccagtaccaccgggacatcagccacgcgttcgccaacgggaacatcgcccacttgaccggcttgggcagcgggctgacccccagcgacaaggccgtggtgttcgtggtcaaccacgacacgcagcgctacgagccgatcctcacccacaccgacggggcgcgctacgacctggcgcagaagttcatgctggcccacccgtacggcacaccgaaggtgatgtccagctacacgtggtcgggtgacgacaaggcggggccgccgatgcactccgacggcacgacccggcccaccgactgctcggcggaccgctggctgtgcgagcaccgcgcggtggcgggcatggtcggcttccacaacgcggtggccgggcagggcatcgggtctgcggtgaccgacggcaacggccgcctggcgttcgcccgcggctccgccgggtatgccgcgttcaacgcgacgaacaccgcgtggacgcgcacgttcaccacttccctgccggacggcgtctactgcgatgtggcgaacggcactttcgtcgacggggtgtgcgacggccccagctaccaggtgtccggcgggaagttcaccgctacggtgcctgcgaacggcgcggtggcgctgcacgtggaggcgcccggctcgtgcggcccggacgggtgcggtacgccgcctggtggcggggacgactgcaccacggtcacggcccggttccacgcgaccgtcaccacctggtacggccaggaggtcgccgtggtggggtcgatccccgagctgggctcctggcagcccgcccagggggtgcggctgcgcacggactcgggcacctatcccgtctggtcgggcgcggtggacctgcccgccggggtcggtttcgagtacaagtacgtgaagctcaacccggacggcaccgtggagtgggagcagggcggcaaccgcatcgccaccgtggatgacagcggg

SEQ ID NO: 31942 - DNA, 1413 bp, Thermobifida fusca
acggccgcacccacaacggtgaccggccgcatcgcccgggtcatcggcccggtcgtcgacgtggagtttcccgtcggctccctgcctccgatctacaacgctctgaagaccgaagtcaccctcggcggggagacccggaccatcacgctcgaagtcgcccagcacctgggagacaacctggtccgcgccatcagcctcaacccgcaggacggcctggtccgcggcgctgaggtgcgcgacaccggtgcgccgatcagggttccggtgggcgacggcgtcaaagggcacgtgttcaacgccctgggtgagccgcaggacatcccgaagtcggaactgcaggtcaaggagtactggccgatccaccggccggccccggccttcgaccagctcgaggcgaagaccgagatgctggtcaccggtatcaaggtcatcgacctgctcaccccgtacgtgcgcggcggtaagatcggcctcttcggtggtgcgggtgtcggcaagacggtgctcatccaggagatgatcacccgtatcgcccgcaacttcggtggtgtctccgtgttcgccggggtgggcgagcgtacccgtgagggcaccgacctcttcctggagatgcaggagatgggcgtcctcccggacaccgccctcgtcttcgggcagatggacgagcccccgggtacccgtctgcgggtcgcgctgtccgcgctgaccatggcggagtacttccgcgacgtgcagaagcaggacgtgcttctgttcatcgacaacatcttccgcttcacgcaggcgggttcggaggtctccaccctgctgggccgtatgccctcggcggtgggttaccagccgaacctcgctgacgagatgggtctgctgcaggagcggattacctcgacccgcggccactcgattacctcgatgcaggcgatctacgtgcccgcggacgactacaccgacccggctccggcgactaccttcgcccacctggacgcgacgaccgagctctcccgcccgatctcgcagaagggtatctacccggcggtggacccgctgacctccacctcccgcatcctcgacccgcagtacgtgggccaggagcactacgaggtggcgcagcgcgtcaaggagatcctgcagcgcaaccacgacctgcaggaccagatcgccatcctcggtatcgacgagctgtccgaagaggacaagatcatcgtccaccgggcgcggcggctggagcgcttcctgtcgcagaacatgttcgtcgctgagaagttcaccggtaccccgggcgtgttcgtgccgctggaggagaccatcgcctccttcaaggcgatctgcgacggtgagtacgaccacctccccgagcaggcgttcctgaacgtcggcaacatcgagatggccgtcgagaaggcgaagaagctg

SEQ ID NO: 31943 - DNA, 912 bp, Thermobifida fusca
atgggtgcacagcttcgtgtctatcgccggaggatccgctcgacgaagtcgatggcgaagatcacccgtgcgatggaactgatcgccgcaacgcgcattaccaaggcgcagcgtgcggccgaggcggctgccccctacgcacgggagatcaccagggcggtgtccgcggtggccgctcgggtcagcgaccacccgctgctgaccgaggcggagaaccccactcgggccgccgtcctggtcatcaccagtgacaagggccttgctggcgcctacacggccaacgccatcaaggaagccgaacgcctcactgcgctcctcaacgagcagggcaaagaggtgctcacctacatggtggggcgcaagggcatcggcttctacaagttccgcgagcgtcccctggcggactcctgggagggcttcactgagcgcccctcctacatgcacgccatggagatctcctcggccctgatggagaagttcatccaggagaccgcggagggcggcgtcgacgagatccacatcgtgtcgaccgagttcatctccatgatcaaccagcgggcccgggcttcccggatcctgccgctggaggtggaagaggtcgactccaaggtgctcgaagccgagcaggggccgctgcccctctacgagttcgagcctggggctgaggaagtgctggaccagctgcttccgaagtacgtgaccaaccggatctacttcgccctcctcgagtcggccgcatcccagcacgcgtcgcgccgcgccgcgatgaaggcggccaccgacaacgccgaggagcttgtcaagaccctgacccgccaggccaaccaggcccgccaggcggagatcaccaacgagatcagcgagattgtcggcggcgccgacgcacttgctgctgccagcgcggggagtgag

SEQ ID NO: 31944 - DNA, 1521 bp, Thermobifida fusca
ctgacgatccgaccggaggagatccgggacgcgctgcagcgcttcgtccagtcgtacgagcctgacgccgccgcacgcgaggagatcggaaccgtcacctactccggtgacggcatcgcccgcgtcagtggccttccctctgcgatggcgaacgagctgctggagttcgaggacggcacccagggcattgcgcagaacctggagatcggcgagatcggtgtcgtcgtcctcggtgacttcaccaacatcgcagaaggccagacagtgcggcggaccggacaggtcttgtccgtcccggtaggcgacgcctacctgggccgagtagtcgaccccctgggccggccgatcgacggcaagggcgaaatcgagacgaccgagcgtcgcgagctcgaactccaggctgccacggtcatgcagcgcaagccggttcacgagccgctgcagaccggtatcaaggcgatcgacgccctgaccccgatcggtcgcggccagcgccagttgatcattggtgaccggcagaccggaaagaccgcggtctgcatcgacacgatcatcaaccagaaggccaactgggagtcgggcgaccccaacaagcaggtgcgctgcatctacgtcgcggtgggccagaagggctccaccatcgccggtgtgcgcgccgcgctggaagaggccggagcgatggagtacaccaccatcgtggcctcgcccgcctccgaccccgcgggcttcaagtacatcgcgccctacaccggctcggccatcggccagcactggatgtaccagggcaagcacgtcctcatcgtcttcgacgacctgaccaagcaggccgaggcctaccgcgcggtctcgctgctgctgcgccgcccgccgggccgtgaggcctaccccggtgacgtcttctacctgcactcgcggctgctggagcgctgcgcgaagctctccgacgagatgggcgccggctcgctgacgggtctgccgatcatcgagaccaaggccaacgacgtgtcggcctacattccgaccaacgtcatctccattaccgacggtcaggtcttcctggagtccgacctgttcaaccagggacagcggccggcgatcaacgtcggtatctcggtgtcccgtgtcggtggcgccgcgcagaccaaggccatgaagaaggtggtcggctccctgcgcgtgggtctggcccagtaccgcgacctggaggcgttcgccgccttcggttcggacctggacgcggcctccaaggcgcagctggagcggggtgcccgcctcatggagctgctcaagcagggccagtactcccccttcccgatggaggaggaggtcgtctccatctgggctggtaccaccgggcacttggacgacgttccggtcgaggacatccggcgcttcgagtcggagttcctcgcctacctgcgccgtgagcacagcaagatcctcgacgttatccgggagacggaggacttcggggacgacaccgctgaggcgctcactgacgcgatcaaggagttcaagaag

SEQ ID NO: 31945 - DNA, 1263 bp, Thermobifida fusca
gtggcgctgctgggttgcggcgttgtgggttctcaggtggtccggctgctcaacgagcagtcgcgtgaacttgcggagcgcatcggaacgcccctggagatcggaggcatcgcggtgcgccgcctggaccgcgcccgggggacgggcgtggaccccgacctcctcaccaccgacgccatgggtcttgtgaccagagacgacatcgacctcgtggtggaggtcatcggcggcatcgagcccgcccggtcgctcatcctggccgcgatccagaagggcaagtctgtggtgaccgccaacaaggcgctgctcgccgaggacggcgcgaccatccacgccgctgcccgggaagcgggagttgacgtgtactacgaggccagcgtcgccggggccatcccgctgctgcggccgctgcgtgactccctggccggggaccgcgtcaaccgggtcttgggcatcgtcaacggcaccaccaactacatcctggaccggatggacagcctgggcgccggcttcaccgagtcactggaggaagcccaggccctgggatacgccgaagccgacccgaccgccgacgtggagggcttcgacgccgccgctaaagccgcgatcctggcccggctcgccttccacacaccggtgaccgctgccgatgtgcaccgcgaaggcatcaccgaggtctccgcggccgacatcgccagcgccaaggccatgggctgcgtggtgaaactcctcgcgatctgccagcgctccgacgacggctccagcatcggcgtgcgcgtccacccggtgatgctgccccgcgaacacccgctcgccagcgtcaaaggcgcctacaacgcggtgttcgtggaagccgagtccgccgggcagctcatgttctacggcgcgggcgcgggaggcgtccccaccgccagcgcagtcctcggcgacctggtcgcggtggcacggaaccgcctggcccgcactttcgtggccgacggccgggccgacgcgaaactgcccgtccaccccatgggggagaccatcaccagctaccacgtggcgctggacgttgccgaccggcccggcgtgctcgccggggtcgccaaagtcttcgcggccaacggcgtgtcgatcaagcacgtccgccaggaaggccgcggggacgacgcccagctcgtcctggtcagccacaccgcgccggatgccgccctggcccggaccgtggagcaactgcgcaaccacgaggacgtccgcgcggtcgccagcgtgatgcgggtcgaa

SEQ ID NO: 31946 - DNA, 1302 bp, Thermobifida fusca
gacctcctcgagctccacccccgcgtctggccgagcacagccacccgagtcgacggcgagatcaccatcggcggtgtcggcgtcaccgaactcgcccggaaattcggcaccccgctctacgtcatcgacgaagcagacttccgggcccgcgcccgcgactaccgtctcgccttcgaggacgccgacgtctactacgcgggcaaggccctgctcaccaaggcggtggcccgctgggtggccgaggaagggctcaaactcgacgtgtgcaccggcggcgagctcgctgtcgccctggccgcggggttcccgcccgagcggatcggcatgcacggcaacaacaagtccgcggccgaactggcccgggccgtcgaagtcggcgtcggacggatcatcatcgactccttcgacgagatcgaccggctggagcggatcgccgcggagcgaggccgtgtccccgaagtgctgatccgtgtcaccaccggcgtggaggcacacacccacgagttcgtcgccaccgcccacgacgaccagaagttcgggctgtccctcagcaacggggcggctgccgaggcggtgcgccgcctgctcacctccccgcacctgcgcctcgtcgggctccactcccacatcggatcgcagatcttcgacaccgcaggcttcgaagtcgccgcgcgccgtctcagcaccttcctcacccagatctacgctgaacacgggatctccctccccgaactcgacctcgggggcgggctggggatcgcttacctccccgacgacgacccgctggaccccaagagcatcgcggacagcctgcggtcgatcgtcgaacacgaatgcgccgcccagaacctgccggtgccgcggatcgcggtcgaacccggccgcgccatcgccggaccggcgggcatcaccctctacgaggtcggcacggtcaaggacgtggaggggatccgcacctatgtcagtgtcgacggcggtatgagcgacaacatccgcaccgcgctgtacggtgcggagtacacctgtgtgctggcctcgcggcacagcgacgccgagccgatgctgtcccgcctggtcggcaagcactgcgagagcggcgacatcgtcgtgcgcgacctctacctccctgccgacctgcgtcccggcgacctggtagcagtggccgccaccggcgcctactgctactccatggccagcaactacaaccacgtgccccggcctgccgtggtcgcggtccgcgagaagaacgcccgcgtcctggtgcgacgggaaaccgaagaagacctgttgcggctggacgta

SEQ ID NO: 31947 - DNA, 1497 bp, Thermobifida fusca
gtgatcagaaccggctcgggcgacgtgcgaggaagcaaagagaacgggatcgcggtcttccgcggaattccctacgctgagccgcctgtcggcgcccaccgctttaccgcaccccgcccgccccgcccctgggacggggtacgggacgccaccgaattcagcgccaccgcgccccgcccgccctaccccgaagccatcggcgcgctgctcatcgaacggttcatcccgggggacgactacctcacgctcaacgtgtggaccccggaccccaacgccgtcggcctgccggtcatggtgtggatccacggcggggcgttcaccaacggctccggctcagaacccgtctacgacggcgccgctttcgcccgcgacggcgtcgtctttgtgagcttcaactaccggctcggcatcatcggcttcgccgacctgcctgacgctccttccaaccggggcctgcttgaccagatcgctgccctggaatgggtgcgcgacaacatcgcccgcttcggcggcgaccccggcaatgtcaccgtgttcggggaatccgcgggcgccatgagcgtgtgcaccctcatggccaccccgcgagcccgcggcctgttccgccgtgccatcctccagtcaggcgcaggcaacatggcagtggcagccgaagatgccaccaccatcgccgcagtgatcgcccaccggctgggggtcgaacccaccgcggcagccctcgcccacgtccccgtcgcccagctcctcgacgtccaacaacaggtcgcccaagaaatccagggagcccccgaccctgcagtgtggggggaacggatcgccggcggcagtgtcctgttgccctttgcccccgtcatcgacggagaactcctctcccagcgccccgcggaggccatcgccggcggcgccggacacgacgtcgacctgctgttcggcaccaccaccgacgaataccggctgttcctcgcccccaccgggctgctgcccttcatcaccggcgactacgtgaccacccacctcgccaagtccgggctggacgcggacgccgccaaggcctacaccgcggaaggacgcggcgaagaacccggcgacatcctcgcctcgatcatcaccgaccaggtgttccgcatccccgccctccgcatcgccgaatcccgcgtcgacgcgcccgcccgcaccttcggctacgaattcgcctggcgcactccgcagctcgacggaatcctgggtgcctgccacgcggtcgagctccccttcgtgttccgcaccctggaccgggccgcctccctcgtcggcaccaaccccccggaagagctcgccgagaccgtccacaacgcctgggtgcgtttcgctacctccggcgacccgggctggcccgcatggaaccccgaaacccggtcggtcatgcgcttcgaccaccccgtctcggagatggtcacggacccgtaccccgccacccgcgccctgtgggacggggtgccgctgtagcccgggccgcgg

SEQ ID NO: 31948 - DNA, 1437 bp, Thermobifida fusca
gtgcgctttctcaacgaccaggtgcccacccacgacctgacctacggcgatgtgttcatggttccccaacgttcatctgtaggttcccggatgaacgttgacctgacatcgcatgatggtacaggtacgactattcctatcgtagtggcgaacatgacagcggttgccggtcgccgcatggccgaaaccgtggcacgccgcggtggtctggtcgtcctaccccaggacatccctaccgatgtggtagcggatgtgatccagtggacaaaaacccgtgatctggtgcacgatacgccgatcactctggcgccgacggagacggtcggccacgcgctcaacctcttgcctaagcgggcgcacaacgcggtcatcgtcgtcgacgaggaacgccgtcccatcggtgtcgtcaccgaggcggactgtgtgggggtggaccgcttcacccagttgcacgaggtgatgtccaccgagttgctcaccctcgccgcgggcaccgacccgcaggaggcgttcgccatcctgcacgactcccggcaccgcctggcccccgtggtcgacagcaacggggctctggtcggggtgctgacccgcaccggggcgctccgcgccaccctctaccggcccgccgtggacgcgcaaggacggctgcgtgtcgccgccgccgtgggcatcaacggcgatgtggcgggccgggcagcgaaactcctggaggccggggtggacaccctggttgtggacactgcgcacggccaccaggagaagatgctcgaggtgctccgccaggtgcgggccctggacccgcaggtgccggtggtggcgggcaacgtggtgaccgctgaaggggtgcgcgacctcgtcgaggccggcgccgacatcgtcaaagtcggggtggggccgggggcgatgtgcaccacccgcatgatgacgggggtgggccgtccccagttctccgccgtggtggagtgcgctgccgccgcccgggaactcggcaagtgggtctgggctgacggggggatccggcacccgcgtgacgtggcgctcgcgctggccgccggggcgagcaatgtgatgatcggctcctggttcgccgggacctacgagtctcccggggatgtgctgcgggactcggagggacggttgtacaaggagagcttcggcatggcctcggcccgcgcggtccggctgcgcaccgcggacgattcgccgttcgagcgggcgcgtaaagccctgttcgaggagggcatctcttctgggcggatgtacctggacccggagcgccccagcgtcgaagacctgatcgacatgatcgtggcgggggtacgcagcgcgatgacctacgctggcgcggcgaacttggcggagttccacgagcgcgcggtgatcggagtccagagcgtcgccgggtacaacgagggcaagccggtgctgcacggctgg

SEQ ID NO: 31949 - DNA, 717 bp, Thermobifida fusca
caagtgagaatcaccctgcgtgtgtggcgtcagaagagcagggacgacgaaggccggatggtcacctacgagctcgatgacgtcaacgagaacatgtccttcctggagatgctcgacgtcctcaacgagaagctcacgctccagggcgaggacccgatcgcgttcgaccacgactgccgggaaggcatctgcggcgcgtgcggcgtggtgatcaacggtgtcgcccacggccccgaagtgacgaccacctgccagctgcacatgcgcagtttcaaggacggcgacgtcatcgaggtcgagccgtggcgggccaaggcgttcccggtgatcaaggacctggtggtcgaccggagcgcgttcgaccgcatcatccaggcgggcggttacatcagcgcgcccaccggcacggccccggacgcgcactccgtcccggtgcccaaggctgacgcggaccgcgcgttcgacgccgccacctgcatcggctgcggcgcttgcgtggcggcctgccccaacgcctcggcgatgctgttcaccgcagccaagatcacccacctgggcatgctcccgcagggacagcccgagcgggcctcccgcgtggtgaagatggtcaaccagcacgacgaggaaggcttcggcggctgcaccaacatcggcgaatgtgcagcggtctgcccgaagggcatcccgttggacacgatctcccagctcaacaacgac

SEQ ID NO: 31950 - DNA, 1683 bp, Thermobifida fusca
cgcaagctctcgatcatcatcgtgggtaccggtctggctggcgcctccgcggcggccaccctgggcgaggccgggtacaacatcaagtcgttctgctaccaggacagcccgcggcgcgcgcacagcattgccgcgcagggcggcatcaacgcggcgaagaactaccgcaacgacggggacagcatctaccggctgttctacgacaccgtcaaaggcggcgactaccgggcccgcgaatccaacgtctaccggctggcccaggtcagcgtcgagatcatcgaccagtgcgtggcccagggcgtgcctttcgcccgcgaatacggcggtctgctcgacaaccgctccttcggcggtgtgcaggtctcccgcaccttctacgcccgcggccagacggggcagcagctgctgctcggtgcctaccaggcgctggaacggcaggtcgcggcgggcacggtggagatgtacacccgccacgagatgctggacctcatcgtcgtcgacggccgggcgcgcggcatcatcgtgcgcgacatggtcaccggtgagatcgagacccacttcgcggacgcggtcgtcctcgccaccggtggctacggcaacgtgttcttcctgtccaccaacgcgatgggcagcaacgtcacggcgatctggcgggcccaccgcaagggcgcgttcttcgccaacccctgcttcacgcagatccacccgacgtgcatcccggtcagcggcacctaccagtccaagctgaccctgatgagcgagtcgctccgcaacgacggccggatctgggtgccgaagaagaagggtgacacgcgcgacccgcgggacatccccgaagaggagcgcgactactacctggagcgcatgtacccggccttcggcaacctggtgccgcgcgacatcgcttcgcgggccgccaagcgggtctgcgacgaaggacgcggggtcggccccggcggcctgggcgtctacctggacttcgctgacgccatcaagcggatggggcgcgacgcggtcgaagccaagtacggcaacctgttcgacatgtacgagcgcatcaccggggagaacccgtacgaggtccccatgcggatctacccggcggtgcactacaccatgggcggactgtgggtcgactacgacctgcagagcaccatccccggcctgttcgtgatcggtgaggccaacttctccgatcacggcgccaaccggctgggcgccagcgcgctcatgcagggcctggccgacggctacttcgtgctgcccaacaccatcaacgactacctggccgacggacccttcgagaagatcgacgagaaccacccggaggtcaaggaggcagtcgagggcgtgcgcgcccgcctcgagaagctgctgtccatcaacggcagccgcaccgtggactccttccaccgcgagctcggcaagatcatgtgggactactgcggtatggagcgcacggaggaagggctgcgcaaggcgatcacgctcatccgcgagctgcgggacgagttctggcgtgacgtcaaggtcaccggcgtcaacgaagaactcaaccagaccctggagcgggctcaccgagtcgccgacttcatggaactggcggaactgatgtgcatcgacgcgctgcaccgccgcgagtcctgcggtggccacttccgcgccgaaagccagaccgaagac

SEQ ID NO: 31951 - DNA, 1188 bp, Thermobifida fusca
ctcagccccaaggccaaggactacctggccaacctccaggagttcatggacgaacacgtctacccggcggagcccgtctaccacgcctggcgccagcaggcgggccccgacaaccatgaactcccgcccatcatggaagacctcaaagccgaggcccgccgccgcggcctgtggaacctgttcctcccggacgtcagcgggctcagcgtcctcgactacgctcccctcgctgagctcagcggccgctccagcctcgccccgcaggcgatgaactgctccgccccggacaccgggaacatggaggtgctgcacatgttcggcacccccgagcagaagaagcggtggctggaaccgctgctggacggcaggatccgctcggccttcgcgatgaccgagcccgacgtcgcctcctccgacgccaccaacatccgcacctcgatcgtgcgcgacggcgacgagtacgtgatcaacgggcggaaatggtggatcagcggggcggccgacccgcgctgcgagatcttcatcgtcatggggaagaccaaccccgacgcggacctacaccggcagcagtccatgatcctggtcccccgcgacacctccggggtcaaagtgctgcgctccctgcccgtcttcggctaccaggaccaggaaggccactgcgaagtcgaattcgacaacgtccgggtccccgccgagaacctcatcgcgaacgaaggcgacggcttcatgatcgcccaggcccgcctcggccccggccgagtccaccactgcatgcgggccctcggcaaagcagagcgcgccctcgaactgatggtgcgccgtgccaccagccgggtcgccttcggcaagcccttgtccgagcagggcatcgtccaagcacacatcgccgagtcgcggctggagatcgagcaggcgcgcctgctcgtcctcaagaccgcgtggatgatcgaccggtacggggcgaaagccgcacgcaacgaaatcgccgcgatcaaagtggtggcgccccgcgtggccgcggccgtcatcgaccgcgccatccaagtccacggcggcgccggggtcagcgacgtggtgccgctcgcggaaatgtacgccggagcgcgcgccatgcgcatcttcgatggccccgacgaagtccacctgcgctcgctggcccgccgcgagatcaaacggcactcctgatcg

SEQ ID NO: 31952 - DNA, 600 bp, Thermobifida fusca
ctgttcgacctcgacggaactctcatcaacagcgaaccgcggagtgtggcggtgtgggccagggtgctccaggaccgcggggtcgaaccggacgaggcgctgctgtgcaagttcatggggcggcgcggcgaagacgtgatcaacgagctcgcccacctgttcccgggcgagtccgtggaggacatcttcgctgaccgctggcgctacggccaggatccggacctgcccccggtggagcagctgcccgagtccgtggcgtttctgaagtacctacacgcccagggagtgccgtttgcgttggtgacctcggccgggcggcagtgggcagaaagcaccctggaatggctgggggtccgcgacatgttccgcgggatcatctctgcggacgatgtcacggtcggcaaaccgcaccctgaggggtatctcagcggagccgagcttgtcggctacggccccgagcacatcgtggtgttcgaggacaccccggcggggatcatggcggggcgcaacgcggggatgcgggtcgtcggagtcacgacgacgcatccgccgcaggcgctggcccacgcccatctcgtcgtggagcatctgggacaggtg

SEQ ID NO: 31953 - DNA, 1428 bp, Thermobifida fusca
ttcgacttcaaggtcgccgacctctcgctggccgagttcggtcgcaaggagatccgtctcgccgaacacgagatgcccgggcttatggccacccgggcagaattcggaccgaaaaaaccgcttcggggtgcgaagatcacgggctcgctgcacatgaccgttcaaaccgcggtcctgatcgagaccctggtggagttgggcgctgaagtccgctgggcgagctgcaacatcttctccacccaggaccacgccgccgcggccgtggtggtgggtccggacggaaccccggacaacccgcgcggggtgccggtgttcgcgtggaagggcgaaacgctcgaagagtactggtggtgcacggaacaggcgctcacctggccggacggcgaaggcccgaacatgatcctcgacgacggcggggacgccaccatgcttgtccacaagggggtgcagtacgagaaggcgggggcggtccccgacccggataccgccgacagcgaggagttccgcatcgtcttggaactgctccgcaggaccttggcggaaaacccccgcaagtggacagagatcgcctcccggatcaagggggtcaccgaggagaccacgaccggggtgcaccgcctctacgagatgcagcgttccggcacgctgctgttcccggcgatcaacgtcaacgactccgtcacgaagagcaagttcgacaacaagtacggctgccgccactcgctgatcgacggcatcaaccgggccactgacgtgctcatcggcggcaaggtcgcggtggtggccggatacggcgacgtcggtaaaggctgcgcggagtcgctccgcggccagggcgcccgcgtcatcgtcaccgagatcgacccgatctgcgcgctccaggccgctatggacggctaccaggtgaccacgctcgacgaggtcgtcgagaccgccgacattttcatcaccgcgacgggcaaccgggacgtcattactgccgagcacatggcccggatgaagcaccaggccatcgtcggcaacatcggccacttcgacaacgagatcgacatggcggggctggccgcgattcccggcattgagaagatcgagatcaagccgcaggtgcacgagtggcgcttcccggacgggcactccatcatcgtgctgtctgaggggcgcctgctcaacctgggcaatgccaccgggcaccccagcttcgtgatgtccaccagcttcactaaccaggtcatcgcgcagatcgagctgttcaccaagaccgaccagtacccgaccggcgtgtacgtcctgcccaagcacctcgacgagaaggtcgcccgcctgcacttggacgcactcggcgtgaagctgacccggctcaccaaggaacaggccgagtacatcggagtggacatcgacggcccctacaagtccgaccactaccggtac

SEQ ID NO: 31954 - DNA, 1170 bp, Thermobifida fusca
gaatcgctgcagccgaacgaccccaccacgttcggtcaatacagcgtgattggacgtctagggcgcgggggccagggaatcgtctaccttgctcgcgactccgaaggccagaaatacgcgatcaaggtgctgaacgagcagtggtcgcaggacaccgaactgcgtaaacggttcgaaaaggaggttcgtgctgcacagaaagtggcctccttctgcaccgctgcgatccatgaggccaacctcgacgctgacccgccctacgtggtcagcgaatacgtggaagggccggacctgcaagaagcggtgtccaaggaggggccgcgcaagggggcagccctccaacgcctggccgtgtccaccgcgaccgcgctggtcgccatccaccaggcggggatcgtgcaccgcgacttcaaacccggcaacgtgctgctgggccccgacggtccgcgggtgatcgacttcggtatcgcccgggtcacggacagcaccgcgacgatgaccaactccatcgtcggcaccccgtcctacatggcgccggagcagatcacggggaagaacatcaccgacaaggtggacgtcttcgcctggggctgtgtgatggcgttcgcctccaccggcaacgcccccttcggctcggacagtgtgccggcggtcgtgcaccgggtggtcagcgcacccccggacatcagcgaagtgccggagccgttgcgggagatcgtcgccgactgtttgaacaaggacccggacaagcggcccaccgctaagcagttgctgatgcgcctgctcggccacaacgtggaggacgagacgaaagtctccacctcgcaggcagtggaggagggggagaagcgcgcgatcagcccgacccccttcgtctcgccctacccgaatcagcaggtcagcgagagcggtccgcagaccccgttcccccctcagccgccccccgccccgcccaccccgccgcacaccgggccgcagtcgggctaccggtacccccaaccgggcccgccggtacccaaccccaactcggggggacgggcgcatccgaacgtgacgacgcacagttcgatgccttcgctcccgccccaccccccgatcacgacgccgcggccgaactatcccacgctgccgcagaccacgagccagcaggcagacgacccggtgctctcg

SEQ ID NO: 31955 - DNA, 1362 bp, Thermobifida fusca
cagatttttaaggcatacgacatccggggcgtcttccccgacacgctcgacgcggatatcgcgcgggcagtgggggcggcgtttgcgcgcatcgtcgacggcgacacgatcgtcgtcgcccacgacatgcgcccctcatcccccgagctggccgccgcgttcaccgagggcgctaacgcccaagggcgcgacgtgatcatggcgggcctcggatcgaccgacctgctctacttcgcttcgggcaagttcaacatccccggagccatgttcaccgccagccacaaccctgcccagtacaacgggatcaaaatgtgccgggccggggcagcgcccatcggcgtggagaccgggctggcggagatccgggaactcgtcgaacaaggcgtccccgcctacgacggccctcgcggaaccgtcaccgagcgggacctgctcgccgactacgccgcgcacctgcgcaagctcgtggacctttccgggattcgcacactcaaagtcgtggtggacgcgggcaacggaatgggcggacacacggtgcccgcggtcctcggcgaccagctcctggacgccctccccttggagatcatccccctctacttcgagctggacggcaccttccccaaccacccggccgacccgatgaaccccgccaatatcgtcgacctccaggcgaaagtccgcgagaccggggccgacatcggcttggccttcgacggggacgccgaccgctgcttcgtcgtggacgagcgcggcgagccggtgccgccctcggcgatcaccgcgctggtcgcggtccaagaactcgctcaagaaccgggcgcgaccatcatccacaacctcatcacctcccgggcggttcccgagatcgtggccgagcacggcggggtcccggtgcgtacccgggtcggccactccttcatcaaggccgccatggcccagaccggagcgatcttcggcggcgagcactcggcccactactacttccgggacttctggaaggccgacaccggcatgctcgccgcgatgcacgtgctgcgggtgctgggcacggaccaccggccgctgtcggagatcaccgccgaatacacccggtacgtggcctcgggagagatcaactcccgggtcgccgaccaggcgggacgcatggcagcggtggaggaggcattcaccgggcgcgcggatgtggagagcgtggaccaccttgacggtctcaccgtgaacctcaccgggaaacgctggttcaacctgcgggcgtccaacaccgagccgctgctgcggctcaacgtggaggcccctgacaccgagtccatggcggagctgcgcgacgaggtcctggcgatcatccgggcctgaccgctgcac

SEQ ID NO: 31956 - DNA, 1023 bp, Thermobifida fusca
attgacgtgcggcggggagcgatcgcggacctgggacttctcctcgcggatcggaggatcgccaatgagggacggatcgcggtggcggtcggccccggccagggcgcccggatcgtcgcggacctcaaccttccccactgcgaggtcttccaggtcgacgaaggtaccgtcgacgtcgccaacgaactcggcaagaagctgcggacggaggctttcgaagcggtcgcggggatcggcggcggcaagaccatcgacgtcactaaattcgccgccaccatggcgggaatcccgatgatcgcggtcgccaccaacctctcccacgacggcatcgcctccccggtgagttcgctggagcacgagagcggcaagagctcctacggggtgaacatgccggtcgccgtcgtggtggatgtggactacgtccgctccgcacctgaccggctggtccgctcggggatcggggacgtgctcagcaacctgtccgcgatcaccgactgggagctggccggcaaggagatggacgaaccggtcgacgggatggccgtcaccttcgcccgggtggccgccgagtccgtgctgcaccgccgcgactccgtggaatccgagagcttcctcaccgcgctcgccgaggccctggtgctgtcggggatggccatgtcggtggccgggtcgagccggcccgctagcggcgctgaccacgagatcctccacgccatcgaccagctctacccggggaccagcaaccacggagaactggctgggctgggcacgctgttcgccttcttcctccgctcccgctacctgggccacggggaacagcagctcgaggacatccgcgccagcctgctccgccaccggcttccgactctcccctcggacgtggggctggacgaagagcagttcgtcaaagccgtggtccacgcgccgtccactcggccgggacgctacacggtcttggagcacctcaacctctccgaagacgagatcaggcggagcgttcgcgactatgtccaaaccttcggt

SEQ ID NO: 31957 - DNA, 1311 bp, Thermobifida fusca
ctcagaatcgcggtgctcggcaccggatacctcggagcgacccacgccgcgtgcatggcggacctggggttcgacgtcctcgggctcgacacggaccagagcaagatcgcaagcctctcctccggtcgggtgccgttctacgaaccgggtctcgaagaggtgctcaaccgcaacctggccgctggccggctgcgcttcaccaccgactacgccgaagtcgcggccttcgctgacgtgcacttcatctgtgtcgggaccccgcagcaggccaactccaacgcagccgacttacggtatgtcgacgccgtggtcgacacgctggcccccctgctgactcggcccgccgtcatcatcggaaagtccacggtgccggtgggtaccgcggcccgcctcgccgcccggttccgggccctcgcccccgcgggtgaagccgtggaactgggttggagcccggagttcttgcgggaaagccacggggtggaagacacgctcaacccgaaccggatcgtcctcggcaccgactccccccgggtcgagcaggtgatgcgggaaatctgcgccagccagatcgaacggggcatcccgttcctggtcaccgacttgcagaccgcggaactggtcaaagtctccgccaacgcgttcctcgccaccaagatctctttcatcaacgcgatggccgaggtgtgcgaagcggtgggcgcggacgtgatccagttggccaaggcgctctcctacgacgaccggatcggcggcaagttcctcggccctggcctgggtttcggcggcggctgcctgcccaaggacatccgcgcgttcatggcgcgcgccgacgagctgggagtggaatcggccctgtcgttcctgcgcgaggtcgacgccatcaaccagcggcgccgtgcccgcacgatcgacatcgcgcgcggcctcatcggcgggagcttcgccggacgcaccgtcggtgtgctgggcgcgtccttcaaaccgaactccgacgacatccgggactctcccgcactggacgtggcggctacgatcaactcgctgggcgcccgggtcacggtctacgacccggaggctttggagaacgccaagcgcgcctacccgcagttgaacttcgcgcacacgatgctggaagcggtccgggacgccgaagtggttctcctcctcaccgagtgggccgagttccgggatgccgacccggacgagctcggcaaggtggtggctgagaagcggatcgtggacggccgcaacgcgctggaccccgactactggcgttcccgcggctggacgtaccgggctcttgggcgcccg

SEQ ID NO: 31958 - DNA, 2586 bp, Thermobifida fusca
cttcgccgcgacgtccggttgctcggcgaaatgctcggcaccgtacttgccgagagtggcggtcaagacctgcttgacgatgtggaacgactccgccgcgccgtcatcggagctcgcgaggggacggtcgagggcaaagagatcaccgagctcgtcgcctcgtggccactggaacgcgccaagcaggtggcgcgtgccttcaccgtctacttccacctggtcaacctggctgaagagcaccaccgtatgcgcgccctgcgggaacgcgacgacgcggccacaccgcagcgcgaatcgctggctgccgcagtgcactccatccgcgaagacgccgggccagagcggctgcgcgaactcatcgcgggcatggaattccacccggtcctgaccgcgcaccccaccgaagcgcgccgtcgcgccgtctccaccgcgatccagcgcatcagtgcccaactggaacgcctgcacgcggcccacccgggaagcggcgccgaagccgaggcgcgtcgcagactcctcgaagaaatcgacctgctgtggcgaacatcacagctccgctatacgaagatggacccgctcgacgaagtgcggaccgccatggccgccttcgacgagaccatcttcaccgtcatccccgaggtctaccgcagcctcgaccgggcgctcgaccccgaaggctgcggacggcgccccgcgctggcgaaagccttcgtccgctacggcagttggatcggcggtgaccgcgacggcaaccccttcgtcacccacgaagtgacgcgggaagccatcaccatccagtccgagcacgtgctgcgcgccctggaaaacgcctgcgaacgcatcggccgcacccacaccgagtacaccggcctcaccccgcccagcgcggaactgcgcgccgcgctgagcagcgcccgggctgcctacccgcgcctgatgcaggagatcatcaagcgctcgcccaacgaaccccaccgccagctcctgctgctcgccgcggaacggctccgcgccacccggctgcgcaacgccgacctcggctaccccaacccggaagcgttcctcgccgacctgcggaccgtccaagagtcgcttgctgccgcgggcgctgtgcgccaagcctacggcgaactccaaaacctcatctggcaggccgaaaccttcggcttccacctcgcggaactggaaatccgccagcacagcgcagtccacgccgccgcactcaaggagatacgcgctggcggggaactgtccgaacgtaccgaggaagtcctcgccaccctgcgggtcgtcgcctggattcaggagcggttcggcgtggaagcatgccgccgctacatcgtcagcttcacccagtccgctgacgacatcgccgccgtctacgagctcgccgagcacgccatgcccccgggcaaggcgcccatcctcgacgtcatcccgctcttcgaaaccggtgccgacctggacgcggccccccaggtcctcgacggcatgctccgcctgcccgccgtccagcgccgcctcgagcagaccggccgccgcatggaagtcatgctcggctacagcgactccgccaaggacgtcggcccggtcagcgccaccctgcggctctacgacgcccaggcgcggctggccgaatgggcgcgcgagcacgacatcaaactcaccctgttccacggccgcggcggtgccctgggccgcggcggcgggcccgccaaccgggccgtcctcgcccaggcccccggatcggtggacggccgcttcaaggtcaccgagcagggcgaagtcatcttcgcccgctacggtcagcgggcgatcgcccaccgccacatcgaacaggtgggccacgccgtgctcatggcctccaccgaaagcgtgcagcggagagccgccgaggcagccgcccggttccgcggtatggctgaccgcatcgccgaagccgcccacgccgcctaccgcgccctcgtcgacactgaagggttcgcggagtggttctcccgggtcagcccgttggaggagctgagtgagctgcggctggggtcgcgtccggcgcgccgctcggctgcccgcggcctcgacgacctccgcgctatcccgtgggtgttcgcctggacccagacccgggtcaatctgcctggctggtacgggctcggcagcggcctggccgcggtcgacgacctggaagcgctgcacaccgcctacaaggagtggccgctgttcgcctcgctgctggacaacgccgagatgagcctggccaagaccgaccgggtgatcgccgagcgctacctcgcgctgggcgggcgtccagagctcaccgaacaggtcctcgccgaatacgaccgcacccgggaactggtcctcaaagtcacgcggcacacccgcctcctcgagaaccgccgggtgctgtcccgcgcggtcgacctgcgcaacccctacgtggacgccctttcgcacctgcagctgcgtgctctggaagccctgcgcaccggggaagccgaccggctgtccgaggaggaccgcaaccacctggaacggctcctgctgctctcggtcaacggtgtggccgcagggctccagaacactggg

SEQ ID NO: 31959 - DNA, 1755 bp, Thermobifida fusca
gtgcgtaaagttctcatcgccaaccgaggcgagatcgctgtccgggtggcgcgcgcctgccgggacgcaggcctcggcagcgtcgcggtctacgccgaacccgacatcgacgcgctccacgtcaaagtcgccgacgaagcctacgccctcggcgggcagacccccgccgacagctacctcgacatcgacaagatcctggcgatcgcggccaagtcgggggcggacgccgtccaccccggctacggatttctcgcagaaaacgctgacttcgcccaggccgtgatcgacgctggactgacctggatcggccctccccccgaggcgatcaccgccctgggcgacaaggtcaaggcccgccacatcgcgcaaaaggtcggcgcgccgctggtcgcgggcaccccggacccggtgtccggcgtcgacgaagtgctggccttcgccgagcagcacggcctgcccatcgcaatcaaagccgcgttcggcggcggtgggcgcggcctgaaggtcgcccgcaccatggaggagatccccgacctgtacgagtcggcggtacgtgaagcagtcaccgcattcggccgcggcgaatgcttcgtggaacgctacctggaccggccgcgccacgtggagacccagtgcctggccgacgcccacggcaacgtggtcgtggtctccacgcgcgactgctcgctccagcgccgccaccagaagctggtcgaagaggcccccgcccccttcctcaccgacgagcaggtggaactgctgtactcctcctccaaggcgatcctgcgggaggccggctacgtcggcgcgggcacctgcgagttcctggtcggcgccgacggcaccatctccttcctggaagtcaacacccgcctgcaagtggagcacccggtcaccgaagaagtcaccggtatcgacctggtgcgggagatgttccgcatcgcagccggggaagaactgggctacgacgaccctgaggtacgcggccactccttcgagttccgcatcaacgccgaagacgccggccgcaacttcatgcccgcccccggcacgatcacgtcgatgcggctgcccggcggaccgggcgtgcgcgtagacaccggctgcgagcccggtttcaccgtgccgcaggcgttcgactcgatggtggccaagctcatcgtcaccggccggacccgcaccgaagccctggagcgggcgcggcgcgccctcgccgagttcgaagtcggcggcatgcccaccgtgatcccgttccaccaggcggtcgtccgccacccggcgttcgccccggccgacccggagcagccgttcagcgtgcacacccggtggatcgaaaccgaattcgacggggtgatcgagccgttctcgggcgacgtggagcagaccgaagccgcggaacgggagaaggtcaccgtcgaagtcgacggcaaacggctcgaagtggtcctgcctgccggcttgggtgcggacctgtccgcttccgcccccgcgaagaagtcgggcaaacgcggcggctcacggaagaagtccgcggcagcggtgagcggcgacgccctggtcagcccgatgcagggcacgatcgtcaaagtcgtggcttccgacggccaggaggtttcggaaggcgacacgatcgtcgtcatcgaagccatgaagatggagcagccgttgaccgcgcacaagtccggtaccgtcaccggcctgtcggtgagcgccggcgagaccgtcggaaacggcgcggtgatctgcgagatcaaa

SEQ ID NO: 31960 - DNA, 1365 bp, Thermobifida fusca
gtgacgaaggtcgtcattatcggaggcggacccggaggttacgaggcggccctcgtcgctgcgcaactgggagccgacgtcacggtcatcgaacgcgacggtatcggtggtgcatccgtactcaccgactgcgtaccctccaaaacactgatcgccacgtccgtgcgcacctcgtacgtcaaagaggcagcgacactgggtatcaacgtgggcaacgaacccgaggacaaagaccttgtccgggtcgagctcaaaaccgtcaatgcgcgagtcaaacgcttggcgcaagcccagtcggtcgacaccgcgaaccggctgaggacggaaggcgtcgagatcatcatcggcgaggccagactggtcgatccgcacatcgtcgccgtcggcgacgagcggatccgcgccgatgtcgtgctcatcgctaccggggcgcatccgcgcgaactgcccacggcccgcccggacggtgagcgcatcctcacctggcggcagttgtacgacctcaacgagctgcctgagaaacttatcgtggttggatccggagtgaccggggccgagttcgccaacgcctaccaggccctcggatccgacgtgaccctcgtctcctcccgggaccgggtcatgcccacccaggatgcggacgctgcccgcgtgctggaagacgtgtttgcccgccgcggcatgaccgtgctggggaactcccgcgccgagtcggtgacccgcaccgatgccggggtgctggtccggctcaccgacggccgggtcattgaaggcagtcactgcctcatgacggtcggcatggtgcccaacaccgccaacctcggcctggaagaagcgggaatccggctggacgagcggggtttcgtccaagtcgaccgggtgtcgcggacctccacccccggggtgtatgcagccggggactgcaccggcgtcaacatgcttgcctccgtggccgccatgcaggggcggatcgcgatgtggcacgcgctcggggctgccgtgtccccgctgcgcctgtccactgtcgcttccacggtgttcacccatcccgagctcgccgcagtcggcgctaccgaggacgacgtggtgtcgggccgggtggacggccgcatcgtcaaactgccgctggccaccaacccgcgcgccaagatgcacaacacgcgcgacggcttcgtcaagctcatctgccgccagcacaccgggatcgtgctcggcggcgttattgtcggtccgcgagccagcgagctcatcctcgcggtctccctggcggtccagcagcggctcaccgtcgacgacgtcgcgcacacgttcgcggtctacccgtcgctgtcgggaagcgtgaccgaggcggcccgctccctcatg

SEQ ID NO: 31961 - DNA, 1209 bp, Thermobifida fusca
aagatcaaggttgagaaccccgtagtagagctcgacggcgacgagatgacccggatcatctggtccttcatcaaggagcggctgatcctgccgtatctcgacatcgacctcaagtactacgacctgggtattgaggagcgcgaccgcaccgaggaccaggtgacgatcgacgcggcccacgccatcaagaagtacggtgtcggcgtcaagtgcgcgaccatcaccccggacgaggctcgggttgaagagttcgggctgaagaagatgtggcggtcgcccaacggcacgatccggaacattctcggcggtgtggtcttccgcgagccgatcatctgctctaacgtgcctcgcctggtcccgggctggaccaagccgatcatcatcggccggcacgcccacggcgaccagtacaaggccagcgacttcaaggtgcccggtcctggtaccgtgaccatcacctacaccccggagaacggcggcgagcccatcgagatggaggtcgccaagttccccgagggcggcggtgttgcgctcggcatgtacaacttccgcaagtccatcgaggacttcgcgcgggcctgcttcaattacggtctcgaccgcaactacccggtctacctgtccaccaagaacacgatcctcaaggcctacgacggcatgttcaaggacgtgttcgcggagatctacgagaacgagttcaaggagaagttcgagaaggccgggctgacctacgagcaccggctgatcgacgacatggtggccgccgcgctcaagtgggagggcggctacgtgtgggcctgcaagaactacgacggtgacgtgcagtcggacacggtcgcgcagggcttcggttcgctgggtctgatgacttcggtgctgcgcacctccgacggccgggtcgtggaggccgaggccgcgcacggtacggtcacccgccactaccggcagcaccagcagggcaagcccacctccaccaacccgatcgcgtcgatcttcgcgtggacgcggggcctggagcaccggggcaagctcgacaacacccccgcggtcatcgagttcgcccgcaccctggaggacgtggtcatcaagaccgtggagagcggccagatgaccaaggacctggcgatcctgatcggccccgaccaggagtggctgaccaccgagcagttcctcgccgtgctcgacgagaacctgcagaagcgcctggcg

SEQ ID NO: 31962 - DNA, 834 bp, Thermobifida fusca
gcacaggtactggatgggaaggcgaccgctgcggcgatccgggaggaactgaaggagcgggtggccgcgctgcgcgcccgcggggtggtgccgggcctcggcacgatcctggtgggcgacgatccgggaagccacgcctatgtgcgggggaagcaccgcgactgcgctgaggtcggtatcgccagcatccgcaaggacttgccggcggatgcgacgcaggccgatgtggaagccgcggtggcggagctcaacgctgacccggcgtgcaccggtttcatcgtgcagcttccgctccctcgcgggctggacgagaaccgggtgctggagaagatcgacccggccaaggacgcggacgggctccacccttccaacctgggcaagctggtgctcatggaggaggctccgctgccgtgtacgccgcgcggcatcgtggagctgctgaaccgctacggggtgtcgctccggggcgccgaagtggtcgtggtcggccgcggggtgacggtgggccgtcccctggggctgctgctcacccgccgctcagagaacgcgacggtgacgctgtgccacaccgggacccgtgacctggcggcgcacacgcgccgcgccgacatcgtggtggccgcggccggggtgccggggctgatcaccaaggacatggtgagcccgggggccgtcgtgctggacgtgggggtcacccgcacggagaagggcctggtcggtgacgtggctccggacgtggccgaggtcgccgggtacctgtcccccaacccgggcggggtggggccgatgacccgcgccatgctgttgacgaacgtggtggaagctgcggagcgg

SEQ ID NO: 31963 - DNA, 924 bp, Thermobifida fusca
atggctatcttcctcaccaaggacagcaaggtcctcgtccagggcatgaccggctccgagggcaccaagcacacccgtcgcatgcttgccgcgggcaccaacatcgtcggtggtgtcaacccgcgcaaggccggccaggtggtggacttcgacggcacccaggtaccggtcttcggctcggtagccgaaggcatgaaggccaccggtgctgacgtcaccgtcatcttcgtgccgccgaagttcgccaaggacgcggtgatcgaagcgatcgacgcggagatcggcctcgcggtcgtcatcaccgaaggcatcccggtgcacgacaccgccaccttctgggcccacgcgtgcagcaagggcaacaagacccgcatcatcggcccgaactgccccggcctcatcacccccgggcagtccaacgccggcatcatccccgccgacatcaccaagccgggccgtatcggcctggtgtccaagtccggcacgctcacctaccagatgatgtacgagctgcgggacattggcttctccacctgcgtgggtatcggcggtgacccgatcatcggcaccacgcacatcgacgcgctcgccgcgttcgaagccgacccggacaccgacgtcatcgtgatgatcggtgagatcggcggtgacgctgaagaacgggccgctgaatacatcaagaagcacgtcaccaagcctgtcgtgggctacatcgcgggcttcaccgcgcctgaggggaagacgatggggcatgccggcgctatcgtctccggttcttccggtaccgctgcggcgaagaaggaagccttggaagccgtgggcgtcaaggtcggtaagacgccgagcgaggccgcgaagctggtgcgttccctgttctaacacgctacgcgtgtcggagggcctgctcccgcggaggggcgggcc

SEQ ID NO: 31964 - DNA, 1176 bp, Thermobifida fusca
gtggacctgttcgaataccaggcgaaggcactcttcgcggaatatggggttccggtaccccaaggaaaggtggcgagcacgcccgaggaggtgcgtgccatcgccgaagagttcgcggcggcgggcaagccccgcgtcgtggttaaagctcaggtcaagaccggaggccgaggcaaggcgggcggtgtcaaggtggccgacggccccgacgacgcagtcgctaaggccaagcagattctcggcatggacatcaagggccacaccgtccaccgggtcctcgttgaagaggccagcgacatcgcggaggagtactacttctccttcctgctggaccgggcgaaccgttccttcctctccatctgctctgccgagggcggtatggagatcgaggaggttgcggcaaccaaccccgacgccgtagcgaaggtccccatcagcccgctcaagggggctccggctgacgtcgcggccgacatcgttgcccaaggcaaactgcccgaggctgctgcccagggcgccgtcgacgtcatcaccaagctgtggaaagtcttcgtggagaaagacgccacgctggtcgaggtcaacccgctcatcctcaccaaggacggccgggtggtcgcccttgacggcaaggtcaccctggacgacaacgccgagttccggcaggacctggagtcgctagcctccgccgcggaaggcgacccgctggaagtcaaggccaaggagaagggcctcaactacgtcaagctcgacggtgaggtcggcatcatcggtaacggcgccggactcgtcatgtccacgctggacgtggtcgcctacgccggtgagcagcacggcggagtcaagcccgccaacttcctcgacatcggcggtggcgcctccgccgaggtcatggccaacggcctggagatcatcctgagcgaccccgcggtcaagagcgtcttcgtgaacgtcttcggtggtatcaccgcgtgcgacgcggtcgccaacggtatcgtgcaggcgctcgaactgctggaatcccggggcgaggatgtgaccaagccgctggtggtgcgcctggacggtaacaacgccgaactcggtcgctcgatcctcaacgaacgtaaccacccagcggtccgccaggtggacaccatggacggcgctgccgcactagccgccgaactggccgcg

SEQ ID NO: 31965 - DNA, 357 bp, Thermobifida fusca
ttgagcgttcccgcggagctgggttacaccaaggagcacgagtgggtggcgatcaacgaagggatcgctaccgtcggcatcacagccttcgctgccgaagcgctgggagacattgtctacgtcgaaccgccggaagtcggttcgaccgtcaccgccggtgaaagctgcggtgagatcgaatctcacaagtcggtcagcgagctctattctccggttgacggtgaggttgtcgatgtcaaccaggctgcggtggacgaccccgagttgatcggctccgacccttacggccggggctggttgttcaaggtggagctcgctgaggagcccgccgatttgctcaccccggagcagtacaca

SEQ ID NO: 31966 - DNA, 1038 bp, Thermobifida fusca
aacgacacacgtgtcgtcagctaccagccactcgtcgctccccacgacctcctggccgaactgccgatgggccccgagcgcacggcactagtcgaggaagccagagccgaggtgaaaaaagtactcgatggggaggacgaccggctgctggttgtcgtgggaccgtgctccgtgcacgaccccgagtccgccctggactatgcacgccgtctcaaggcgctgatcccgtccgtctcctctgaattgtgcgtggtcatgcgggtgtacttcgaaaagccgcgcaccaccctgggatggaagggcctgatcaacgaccccgggctcgacgggagcttcgacgtccaccggggcctgcggaccgcacgcaaactgctgctcgacatcggctccctgggcgtgcccgccggcaccgaattcctcgacccgatcaccccgcagtacatcgcggacgcggtgacctggggagcgatcggtgcgcgcaccacggaaagccaggtgcaccgccagctcagcagcggcctcagcatgcccgtgggcttcaagaacggcaccgacggcaacgtccaggtcgccgtggacgcctgccgggccgcagccagctcgcacaccttcttcggcgtggacccgagcggcagcggcgcggtcgtgtccacctccggcaacccggactgccacgtcatcctgcggggcggccgctccggccccaactacgacgcggacagtgtcgccgccgcgctcgacaccatcgaggccgcgggcctgccgcgccgcctcatgatcgacgccagccacgccaacagcggcaaggaccacctgcgccagccgggcgtggcccaggccatcgccgcccaagtcgcggaaggccagaccggaatcatcggggtcatgctggagagcttcctggtgcccggcgcccagaagctcggcgacccggccaagctcacctacggccagagcattacggacaagtgcatgggttgggagaccaccgaggaggtcctggcccatctggccgacgccgtgcgcagccgccgcaag

SEQ ID NO: 31967 - DNA, 1740 bp, Thermobifida fusca
gactacgacgtcatcgtcgtcggttcaggattcggcggctcagtcagcgcgctgcgccttaccgagaagggctaccgggtcggagtcctcgaggccggacgccgcttcacccccgagaccctgccgaagaactcctgggacctgcgcaacttcctctgggcgcctcggctggggttcttcggcatccagcgcatccacctgctgcgcgacgtcatgatcctggctggggccggggtcggcggcggctccctcaactacgccaacaccctctacgaaccactggacgacttctacaacgacccgcagtggcgggacatcaccgactggcgagaagaactcgcccccttctacgaccaagccaaacgcatgctcggggtgcggaccaaccccaccgtcacccctgcggacgtccacctgcgccacgccgccgaggccatgggggtcggctccaccttccacctcgccccggtcggcgtcttctttggcgacggcaaggacggggcggccacccaaccggtctcccccggcgaagcctgccgcgacccctacttcgggggtgccggcccgacccggcgcgcctgcctggagtgcggggagtgcatgaccggttgtcggcacggcgcaaaaaacatgctcaccgagaactacctgtacttcgcggagcgccatggcgccgtcatccaccccatgaccaccgtggtagcgatccgcgaacgccctgcctccctcggcggcggctatgcggtcgacaccgtagccaccggtgctttccgcacccggcgcgccacccgcacgttcaccgcccgctacatcgtgctcgctgctggcacctacggcacgcagcgcctcctgcacgccatgcgcgactccgggctcctgccccgcatctcccccaagctcggcacgctcacccgcaccaattccgaagccctcgtcggcgcgatgaccaaggcgatacgcccgccccaggacttcacgcagggcgtggcgatcacctcctccatgcaccctgacgcgcacacgcacatcgagccggtccgctacggcaaaggctccaacgcgatggggctgctcaccaccatgcaagtccccggcgggggacgcatcccccgctggctgcgcttcctcggcgtaatcgccgcccacccctacctcttcatgcgcagcctgtccgtgcgccgctggtcgcagcggaccatcatcggcctggtcatgcagtccctggacaactcgctgaccacctacacccggcggggactgttcggccggcgggtgctgacctctcggcagggccacggcgctcccaaccccacgtggatcccggtggcccagcagttcgccgcccagatcgccaaacagatcgacggctacccgggcagttgcgtcagcgaaatcttcgacatcccgttgaccgcgcacttcctgggcggctgcccgatcggcgcctcccccgaggaaggtgtaatcgacccctaccaccggctctacggccatcccggcatccacgtggtggacgggtcagccgtcaccgccaatctgggcgtcaacccgtcgttgacgatcaccgcccaagcggaacgcgccatggcgatgtggcccaacaagggggagcctgacccgcggcccgctccgggctccccctaccagcgggtggagccggtctacccggtccgtccagcagtgccggcaggcgcctacgcggagctgcggttcacccgccgcattgcgctccccttggac

SEQ ID NO: 31968 - DNA, 1116 bp, Thermobifida fusca
agcgaatccgagctgaatctgctgtacagcgagatcgagcaggagctgcgcgccagcgtccgggagctgctggcccaccggtgcccatggcagtccgtcctcgaccgtgtctcgcaccatgctccggcagaggtcaccgaccgtgccctgtggcaggaactggcggagctggacgtcctcggcctcttcgttcccgaaacgctcgggggcgccggcgctacggcacgggaggcgtcgtccgtcgctgaagagctgggccgggccgtagccccggtcccgttcctcggcagcgccgtgctggccaccggtgccctggtggcgctgggcactgcagaggagcaggtgcgcgccctgctcacggacctggcagccgggcagcgctgcgccacactggtagtgccgctacccacggcccccgggtctggcttcccctcccaggtccgcgcggacggctcccagttgacgggcacggttcccggcgtggtggacgcgctcagcgcggacgtgctggtcgtgcccgctctcggcgcggagggacccggcctgtacctgctccccgccgaccaggcgaccctgagtcctgtggtgagcctggaccagacccggccgctcgccgaagtgaccctcaccggtgccgaagcgaccagggtggccgtcggccagcaggcggtcgacgcagtggaggccgcactgctcaccggcgcggtcctgttggccgcagagcagctcggcactgctgagtgggcgttcgacacgaccgtggcctacctgaaggagcgcgtgcagttcgcccgcccgatcggttctttccaagcgctcaagcatcgggttgccgacctgtgggtactgctcgcccaagccagagccgtggtgcggcatgcggcgagtgcgctcgccgctgactcggaggacctcccgcttgctgcggcgctcgctcaagcctttgtgtccgaggtcgcggtgaaggtcacggaggaagcagtgcagttgcacggggggatcggcttcacctgggagcatccggtccacctgtacctgaagcgcgccaagagcgcgtcgctcagcctggggacggcggaccggcaccgggcgcggatcgcggatctcgtgggtctt

SEQ ID NO: 31969 - DNA, 1173 bp, Thermobifida fusca
gatgccgcggaactacgcgcccgcgtcgccgcattcgtcgcggaacacgaccccgccaccaccgaccagaccgagttcctcgccgcccggtacgacgcgggccttgcctgggtgcacttccccaaaggcgcgggcgggctcggcgctccctgcgcgttgcagaacgtcgtcgacgcggagttcgaacgcttcggtttcgtccccgtcgaccgggaaggcctcgtgatcggcctgggcatggcggcccccaccatcgctgccttcggcaccccggagcagcgtgaccgcttcctcaaaccgatctacaccggggaagaagtctggtgtcagttgttcagcgagcccggagccggatcagacctggccgccgtcggcacccgcgcggtccgcgacggaacagactgggtgatcgacggccacaaagtgtggacctcgctggcgcaccgggcccagtgggccatcctgctggcccgcaccgacccggacgtgccgaagcaccgcggcctgacctacttcctctgcgatatgaccgccccgggggtcacggtgcgcccgctgcgccagatgaccggggaagccgaattcaacgaggtatacctggacgaggtgcggatccccgacagcctccggctcggcggggtcggggaagggtggaaggtcgcgcagaccacgctgatgaacgagcgggtctccatcggcggccgccccgaaccccgggaaggcgggctcatcggcatagtcagcgacctgtggcggagccgtcccgacctgcgcacccgtggactccacgaggagcttctgcggctgtgggtcgccgcggaagccgcccggttgaccaaggagcggctgcgccagcagctcgccgcgggccagcccggccctgaaggatcggcgaccaaactctccttcgctgaactcaaccagcgcatcagcggtctggaactggagctccgcggggtggaaggactcacctacgacgactggaccttccgccgcccggagaaaccggacctgctgggtcggggccccggcttccgctacctgcgcgccaaaggcaactcgatcgagggcggaacctcagagatcttgcgcaccatcatcgccgaacgcgtcctgggactgcccccggaaccccgggccgacaaagacctcgcctggaaggacctgccccgt

SEQ ID NO: 31970 - DNA, 732 bp, Thermobifida fusca
cgtgtcgcaatcgtcacgggtgcggcccgtggaatcggcgccgccaccgcgcagcgcctggccgccgaagggcacgcggtcgcagtactcgacctcaccaaggagagcgcgcaggccacggtggacgcgatcaccgaagccggaggcaaagcgatcgccctcggtgcggacgtcagcgacacccagcaggttgaagccgcggtcaaggagaccgcagaacggctcggcccgccgaccatcctggtgaacaacgccggggtgatccgcgacaacctgctgttcaagatgaccgacgatgactgggacaccgtgatgcgggtccacctgcgcggtgcgttcctcatgtcgcgggcagcccaggcctatatgaccgagcaaggctggggccgcatcatcaacctgtccagcagctcggcgctaggcaaccgcggacaggccaactactccgcagccaaagccggcctgcagggcttcaccaagacgctggcgatcgaactcgggaaattcggcgtcaccgccaacgcggtcgctcccggattcatcgtcaccgacatgacacgggccaccgcccagcggatcggcgtggacttcgaagaattcaaggcggcccgcgccgcccagatcccggtgcgccgggtcggtgtgcctgaggacatcgccgccaccgtggctttcctcgccagtgaagaagccggctacatctccggacaggtgatctacgtcgccggcggc

SEQ ID NO: 31971 - DNA, 1836 bp, Thermobifida fusca
cccgtgctgtgcgtcgacaacctccacgtcaccttccccgccacaccgcacagccagcccgtccccgcggtacgcggcctcagctaccagctccaccgcggagaaatcctcggtatcgtcggcgagtccgggtccggaaaaacagcggccctcctcgccgtgctcggcctcctccccgaccgcacgcgcatcaccggatccatccgactccacgggcgagaactcctcggcctcaccgaacgggaactcgccgcgatccgcggagccactgtcgccaccgtgtcccaagacccgctagccgccctcacccccgtccacaccgtcggcttccacctggcagaagccctccgcctccaccagccccgactctcccgcgcccaagtcaaagaccgcatagtcgccctcctccgccgggtcggcatccccgacgcggaacgcctccccgacgcctacccccacgaactctccggcggaatgcgtcaacgcgtcatgatcgccatggcgatcgccaacaaccccgacgtcatcctctgcgacgaacccaccacagcactcgaccccaccgtccaaatccagatcctcgacctcctcgccaccatccgccgcgataccggcgctgccatcgtcctcgtcacccacgatctcggcgttgtcgcggaaatcgccgaccgcgttctcgtcatgtacgccggacagcccgtagaaacgggaaccgtggcagaggtgtaccggcatccccgcacgccctacaccatgggcctcctcgccgccctgccccgcgtcgacaccaccgaccccgcgcctcccgcgcccatcagcggcaccgcgcccccacccaccgccccgccccgcgggtgccccttcgcaccgcgctgccccatcgcactccccgcatgcacggctgaaccccccgccctgcaaccggtggaccccaccgcacccgccggccaccgtgcagcctgccaccgccttgccgacatcaccgcccaccagtggaccgcggccgacctctacccccagcccgcacccgcgtccccgacccggccgccccgagaccagcggtccaccgtgctcgctgtcgacagcctcgtcaaacaccacccgctgtaccggggcagccttttccgccgccgggccggggcgatccacgccctcgacggggtcagcttcgacctccgcgaacacgaaaccctggccctcgtcggcgagtcaggagcaggaaaatccacccttctcacggaaatcctcgaactcgcccgccccgcccacggccggatcaccgtcctcggccacgacacggccaccctcaccccgcaacagcggttcgcgctccgccgcgacctccaagtggtcttccaagactcctcgtccgccctcgacccgcggatgaccgtcgcccaaatcgtggcggaacccttgcagatccaccgctacccgcgccgcgacatcccccaccgcgtgcgcgaagtcctctccctcgtcggcctcgacagctccttcacccagcgccgccccgcccagctttccggtggcgaacgccaacgagtcggcatcgcccgagccctcgccctcaacccgaaactgctgctgctggacgaacccgtatcagcgctcgacgtctccgtgcaggcaggcatcctcgccctgctcacagaactccaagcccgcctgggactgtcctgcctgctcgtcacccacgacctggcggtcgtccgccacgtcgccgaccgggtcgccgtcatgcacctgggggtgatcgtcgaaatcggcgccaccgaaccggtcctcaccgcgccccgccacccctacacccaggcgctcctgtctgcccttccc

SEQ ID NO: 31972 - DNA, 1146 bp, Thermobifida fusca
cggcgatccgcgcacaactaccacccgctgcccgtggtgatcgcgcacggcgaaggagcctgggtgaccgacgtggcgggccgtcgctatctggactgcctcgccggatactcagcggtaaacttcggacaccgcaaccctgaactcctcgccgccgcccgcgctcagctcgaccggatcaccctcaccagccgcgccttccaccacgaccggttcgcaccgttcgtcgccgcgctcgccgatctcgtcggcaaagaacaggtgcttccggtcaacacgggagctgaagcggtcgaaaccgggatcaagatcgcccgcaaatggggatacgaggtcaaaggcgtccccgacgggcgcgccgtcatcgtcgtggccagcggaaacttccacggacgcaccaccacgatcgtgtccttctccaccgaccctgccgcctaccgcggcttcggaccacccactccaggattccgcatcgtgccctacggggacgccgcggcactcgccgacgctatcgacgccgacaccgtcgcagtcctcgtcgaaccggtgcagggcgaagccggggtgatcgtgccgcctgccgactacctgccacgcgtccgggacctgtgcacccgtgccggcatcctgctgattgcagacgaagtgcagtccgggctgggacgcaccggcaccgtgcgggcctgcgaccacagcggagtcgacgccgatatctacctgttcggcaaagcgctgggcggcggcatcctgcccgtggcggcggcggtaggcgacgcggaagtcttcgacgtgatccgccccggccagcacggcagcaccttcggcggcaacgccctcgcctgcgcggtcggcactgccgtggtgagcctcgtccgcgacggcccttacctggaccatgtccgcgccctcgcccccgtgctgcgcgcccgcctcgaccaactggtcggcaacggcgtggtcgcggcccgcagcatcggcctgtgggctgggatcgacgtcgacccgactctggccaccggaagagaactgtgcgaacggctcctgcagcggggtgtgctcgtcaaagacacgcacggctcaacgatccggctctccccgccgctggtcatcaccgaagacgaactgcactgggcagtggaccagatc

SEQ ID NO: 31973 - DNA, 1917 bp, Thermobifida fusca
cagccgccgatcctgtggagtcccgacgaggagcgcaaagaacgcgccaacctcaccgcgttcacccgctgggtgcgggagcaccgcggtgtggacgcaccggactacgaggcactgtggcgctggtcggtaaccgacctcgaaggattctggtccgcgatctgggagtactaccgggtgcgcgccgccaccccgtacaccacagtgctcgcctccgacgccatgcccggcgccgtctggttccccggcgccaccctcaactacgccgagcacatcttccgcgaccgtgacccatcagccgtggcgatccggcacgcgtccgaactccggccgttgaccgagtggacctggggagaactgcggacccgcaccgccgcgatcgctgcggccctccgcagcctcggggtgggccccggcgaccgggtcgtggcctacctgccgaacatcgccgaggcgacggccgcattcctcgcctgcgccgcgatcggtgcgacctggtcgtcctgttcccccgacttcggggtgcgcagcgtcctcgaccggttcgcgcagatcgaaccgaaagtgctgctggccgtggacggctaccgctacggcggtaaggacttcgaccgccgtgacgtgctcaaagccctgcgcgacggcatgcccagcctgcagcacaccgtcgtcctgccgtacctgggctgcggccctgtcgccgacaccctgtcctgggcggagttcgaagccgcgggcgaaggcgcggaactggagttcaccccgctgccgttcgaccatccgctatgggtgctgtactcgtcggggaccacaggcctgcccaaggccatcgtgcacggccacggcggcatcctgctggagcagttgaagaacctgcacctgcacctggacgcccacgccgacgaccgggtgttctggttcaccaccaccggctggatgatgtggaacttcctggtcagcgtgctgctcacggacgcgtccatcgtgctgtacgacggcagccctgcctaccccgacctgggagtgctctgggatctggcggaacgcgccgggatcaccatcttcggcaccagcgccggctacctggcgaactgccggaaagcgggcatccaccccaccggcgggcggaacctgtccgcgctgcacgccatcggctctaccggctccccgctgtccccggacgagttcgcgtggtgctaccaggagttcggctccgacctgtggctgttctccaccagcggcggcacggacatctgcagctgcctcgtcggcggggtgcccaccctgcccgtctaccagggagagatccaggcccgctccctcggcatggcagtggcctcctgggacagcgcaggcaacgaactcgtaggcgaagtcggggagctcgtggtgacccgtcccgccccgtccatgcccctctacttctggggggacaaggacggcagccggctccgcgacagctacttctccatgtacccgggggtgtggcggcacggcgactggatcgagatcaccgaccgcggcaccgcgatcatctacgggcgctccgactccaccatcaaccgcggcggggtacggatgggcaccagcgagatctaccgctccgtgctggccctggaagaagtcatcgacgccctcgtcgtcgacgtgccacagtccgacggaagctcccggatcgaactgttcgtggtactgcgcgagaacaccgtgctcgacgacgacctggtgcggcggatcaaacagggcatccgcgaagactgctcgccgcggcacgtgcccgacgggatccaggctattccggctgtgccgcgcaccctgtccggcaaagtgctcgaggttcccgtcaaacgcatcctcatgggagaaccaccggaacgcgtcgtcagccgcgactcgctcgccaacccggaggcgttg

SEQ ID NO: 31974 - DNA, 1977 bp, Thermobifida fusca
gacagtggaggccctatcgagggggaggctgccatgccccagcacggcgatacagcgagagtcgatgtcgaagcgctacgcgacctcttggacggccgttgggctgcggtgcggcgccgcgcccgcgacatactccgcggcccggagttcaccccccgctacgggctgagcgtggcggagcaccgcgcccgagtcaccgagcagttgcacgccttggcgcgtaccgacctggcccgctacggcttcgacccgcggtacgggggccgcggagaggtgggcgcctccgtggcagcgttcgaaatgctcgtctgcgatctgtcgctgatggtgaagatgggtgtgcagtgggggctgttcggcggcgcgatccaggcgctgggcaccgaataccaccacgccacctacctgccgggggtgatgtcgctggagatccccggctgttttgccatgacggaaaccggtcacggctctgacgtgcagcggctccgcaccaccgccaccttcgacccgaacacagacgaattcgtcgtccatacccccgacgaagcggcccgcaaagactacatcggcaacgccgcccgcgacggccggctcgccgtcgtgttcgcgcagttgatcactggcgggcagcggcacggggtgcacgccctgctggtccccatccgcgacgccgacggcaccgtactgcccgggatccgcatcgaagactgcgggcctaaggcagggctcaacggagtggacaacggccgtatctggttcacccaagtccgggtgccgcgcaccgcgctgctcaaccggtacggggatgtggccgccgacggcacctattccagtccgatcgagaacccgaaccggcggttcttcactatgctcggcacgctcgtccgcggccggatcagcgtggccgggggtgctggcatggcggcgaagaccgcgctggcgatcgcgatccgctacgggcaggtgcgccgccagttcctccgccccggcagcgacagcgaggtggcgctgctggactacctcgcctaccagcgccgtctgctgccggctctggcccgcacctacgcgctgcacttcgcccaagaggagatggtgtcccggttgcacgacggtttcaccgacgggcccctggacgagcgagcgcaacgggaattggaggcgcacgctgccgggttgaaggcggtcgccacctggcacgccgtcgacaccatccagacctgccgggaagcgtgcggcggggcaggctatctggcggagaaccggcttccccaactgcgcgcggacacggacgtgttcaccaccttcgaaggcgacaacacggtgctgctgcagctggtggggaaaagcctgctcaccaactaccgccaggagttcggcaaccttgacccgctgggcatggccaagttcgcggccgggcagttcctcggcaccgtgatcgagcgcacggctgcccgctcactgctggaccgcctggtccaggctgccccggggcgcggagacgaggacgacctgcggaaccgggaatggcagcgtgccctgctggcagaccgggagaaccacgtgctggaagggctggcgcgccggctccgcgccgcccccgccgatgccgacccgttcgacgtggtcaacaacgtgcaagaccatgtgctgctcgcagcccgcgcccacgtggaccggctggtgttcgaagcgttcgcttccggtgtcgcccggattgaagacgaaggcacgcgggcggtcgtggagcgcctgtgcgacctggctgcgctctccctggtggagcaggagcgcgcctggtttctggagcacgggcggctcaccccggcccgggccaaggcggtcaccgcgacggtgaacgcgctgtgccaggagctgcgccctcacgcccgcgacctggtggacgcgttcgggttgaacgacgaatggttggccgcgccgatcgcgctgggcgcggaaaccgcccgccaagatcagcag

SEQ ID NO: 31975 - DNA, 399 bp, Thermobifida fusca
gtggagcgcacccttgtcctgatcaagcccgatggcgtgcggcgcaacatcatcggcgaggtcatctcccgtatcgagcgcaagggcctcaagatcgtcgccatggagctgcgcaccctggacgaagagaccgcgaaagcgcattacgaggagcacgtcgaaaagccgttcttctcgtcgctggtggagttcatcaccggcggcccgctggtcgccatggtggtggagggcaaccgggcgatcgaggcgttccgctccctggcgggcgccaccgacccggtcctcgccgctcccggcaccatccgcggcgactacggtctcgacgtccaggccaacatcgtccacggttcggactccacctactcggccgagcgcgagatcaagctcttcttccctgac

SEQ ID NO: 31976 - DNA, 2538 bp, Thermobifida fusca
atgttcgagaggtttaccgaccgcgcacggcgcgtggttgtcctggctcaagaagaagccaggatgctcaaccacaactacattggcacggagcacatcctgctcggcctcatccacgagggcgagggcgtcgctgccaaggctctggagagcctcggcatcagcctggaagccgtccgtcagcaggttgaggagatcatcgggcaggggcagcaggccccgtccggccacattcccttcacaccccgtgccaagaaggtcctggaactgtcactgcgcgaggccctgcaactgggacacaactacattggcacggagcacatcctgctcggcctcatccgagagggcgagggtgtggccgcccaggtgctggtgaagctgggcgccgacctcaaccgggtgcgccagcaggtgatccagctgctccacggctaccagggcaaggagccgcaggccgccggcacggccgccgagtcggcaccgtccacgtccctggtgctggaccagttcggccgcaacctgacccaggccgcccgcgaaggcaagctcgacccggtcatcggtcgcgacaaggagatcgaacgggtcatgcaggtcctgtcgcggcgcaccaagaacaaccctgtcctggtgggcgaccccggtgtcggaaagaccgccgtggtcgaaggcctggcgcagaagatcgtcaagggcgagatccccgaaaccctcaaggacaagcagctctacacgctcgacctcggcgccctggtcgcgggcagccgctaccggggtgacttcgaagagcggctgcgtaaggtcctcaaggagatccgctcccgcggcgacatcatcctcttcatcgacgagctgcacaccctggtcggcgccggcgccgcggaaggcgcgatcgacgcggcctccatcctcaagccgatgctggcccgcggtgaactgcagaccatcggcgcgaccaccctggacgaataccgcaagtacctggagaaggacgccgcgctggagcgccgcttccagcccatccaggtcgaggagcccacgatctcgcacaccatcgagatcctcaagggcctgcgcgaccgctacgaggcgcaccaccgcgtgtccatcaccgacggtgctctggtcgccgccgcgcagctagccgaccgctacatcagcgaccgctatctgccggacaaggccatcgacctaatcgacgaagccggctcgcgcatgcggatccgccgcatgaccgccccgccggacctgcgcgaatttgacgagaagatcgccaaggtgcggcgtgacaaggaggcggcgatcgacgcccaggacttcgagcgggctgccgcactccgcgacgaagagaagcggctccaggcgcagcgcgcgcagaaggagaaggagtggaaggccggcgacatggacacggtcgccgaggtgaacgaggagctcatcgccgaagtcctcgccaccgctaccggcatcccggtcttccggctcaccgaggaagagtcctcgcgcctgctccgcatggaagaggagctgcacaagcgggtcatcggccaggacgacgccatcaaggcgctctcccaggcgatccgccgcacccgcgccggcctgaaggaccccaagcgtcccggtggctcgttcatcttcgccggcccgtccggtgtcggtaagaccgagctgtgcaaggcgctggccgagttcctcttcggcgacgaggacgcgctgatccagctcgacatgagcgagttcatggagaagcacaccgtgtcgcgcctgttcggctcgcctcccggctacgtcggctacgaggagggcggccagctcaccgagaaggtgcggcgcaagccgttctcggtggtgctgttcgacgagatcgagaaggcccacggcgacatcttcaactcgctgctccaggtgctggaggagggccgtctcaccgacgcccagggccgcaacgtcgacttcaagaacacgatcatcgtcatgaccaccaacctgggcacccgggacatctccaagggccagcccatgggcttcgcgcggccggacgacacccagaccacgtacgaccgcatgaaggccaaggtgaacgaggagctcaagcagcacttccggcctgagttcctcaaccgggtggacgacacgatcgtgttccaccagctgacgcagaaggagatcaccgccatcgtcgacctgatggtcgcccggctggacgagcggctcaaggaccgcgacatgggtatcgaggtccggccgcacgccaagaagatcctcgccgagcggggctacgacccggtgctgggcgcccggccgctgcgccggacgatccagcgggagatcgaagacgccctgtcggagaagatcctctacggcgaactcaagtccggccagatcgtcatcgtcgacgcggaaggcgaaggcgccgacgccaagttcaccttccgcggtgtgccgaagccgcaggcactgccggagaccgcagaggtgggcgctcagtagcaccgagctcttccatcgagcggtcccgcaccgacccgtaacgca

SEQ ID NO: 31977 - DNA, 1691 bp, Thermobifida fusca
ctgcggctgaccgcaccagagcccggctggaccgcacacaccgatgtggtcatcgtcggatcagggatcgcagggctcagcaccgcactgcgctacatcgagcggacccccacaggcagggtcgtgctcgtcaccaaggacctcatcgccaacggctccacccggtgggcacaaggcgggatcgctgccgccgtcgaccccggcgacaacccgtgggcccacctggtggacaccatcgaagccggggcagggctgtgcgacccagacgcggtccgcatcctcgttgacgaaggccccgcagccctgcactggctgatcgaccagggaaccgtcttcgaccgcaccgacaccggggacctcgccctcaccagggaaggcggccaccgcgcgcaccgcatcgcacacgccggtggggacgctaccggcgcggagatcgaacgcgccctcgtcgaagcggtccgcgcctgcgaccgcattgaactcatcgaacacgctttcgtccccgacctgctcgtcggcgtcgacacccaggggcagcgccgggtcgccggggtcaccgtgcacgtcatgggcgagggcgaacgcgacggcgtgggcgcaatccacgccacagccgttgtgctcgccaccggaggcatgggacaggtgttcgccgccaccaccaacccggaagtgtccaccggagacggtctcgcgttggcgctgcgcgccggagcacgcgtccaagacctcgaattcgtgcaattccaccccaccgtgctgtggctgggcgcccacgcccgcggccgccagcccctcgtctccgaagcggtccgcggcgaaggcgcgttcctcgtcgacgtgcacggccgccgcttcatgcgcggcgtccacgagctcgcggacctcgccccccgcgacgtcgtcgcccgcgaaatcgcccgggccatggccgaaaccggcgccgaccatgtctacctggacgcccgccacttcggcgccgacaagtgggaacgccgcttccccaccatcctcgcctcgtgccgcacccacggcatcgacccggtcaccgacctcatccccgtcgccccggccgcgcactacgcgtccggcggcatccgcgtcgaccacgacgggcgcaccgacctcgccggactgtacgcggtcggcgagaccgcccgaaccggcgtgcacggagccaaccggctcgcctccaactccctgctcgaaggagtggtcttcgccgaccggatcgccgccgccctcgccgacgagcagcctcccgcgttgaccggtccggtcctgcccgccggaggcggccccagcgggctcgcggacccggagatcctccccgaactgcgggaagccatgtcccgctacgtcggagtgcgccgcgacgcggcagggcttgccaaagccaccgcggtactggaagagctcaccgcccgcgctaccgccaccaaccccgcgccgggcgtgcccgcctggcaggccaccaacctgctcaccgtcgcctgggccctggtgcgggcagcggaacgccgccaggaaacccgcggctcccactggcgggccgactacgagcagccgtcggctcaggcacgctcccggaccttcatcctcgacccgtcgggaatcagggaggacacgtcgatgcgcccctacacgctgccggaggaactcgtcgaggagctcaaccggatcaccgtgcc

SEQ ID NO: 31978 - DNA, 558 bp, Thermobifida fusca
gaccagccgcggatcgagaaagcggtgcgggaaatcctgctggctatcggcgaggacccggatcgggacggtctcgtggagaccccggcccgggtcgcacgggccttcgcggagcagttcgctgggctcagccagcgccccgaggacgtgctgaccacggtgttcgaggccaaccacgaagagatggtgctggtcaaggacatcgagttgtactccacgtgcgagcaccaccttgtccccttctacggggctgcgcacgtggggtacatccccaacacggacggccggatcaccggactgtccaaactggcccgtctcgtcgacatctacgcccgccgcccccaagtgcaggagcggttgacgtcgcaggtcgcagacgcgttgatggagcggttggagccgcgcggcgtcatcgtggtcgtcgaagccgagcacctgtgcatgaccatgcgcggtgtgcggaaaccgggggcgaaaaccgtgacgtccgcggtgcgcggcgcgttccgggagagctacaagacccgcgccgaggcgatggacctcatcctgggacgc

SEQ ID NO: 31979 - DNA, 1776 bp, Thermobifida fusca
attgccatcctgctcatgctcctggtgacctcccagttcatgggatggggcagtggacccgaacacgtcaagaccgacacgtcgaaggtcttcaccctgatcgagcaggaccaggtcagggatgccaagatcattgacaaggaccagcgcatcgagctgaccaccgttgacggcaagctgtatgaggcttactgggtggacggccagggcgctgagctggccgaagctctccgcgccaaccagggcggcaacctggaggcgtacgacgtcgaggttcccggcgacaacatctggctatccctgctcttcagcttcctgccgctcctgctggtcatcgccgtcttcttcttcatcatgaaccagatgcaaggcggcggctcccgggtcatgaacttcggcaagtctcgggcaaagctgatctccaaagacactcccaagaccaccttcgctgacgtggcgggagcagacgaggcgatcgaagagctcaaggagatcaaggacttcctgcagaacccggggaagttccagagcctgggcgccaagatccccaaaggtgtgctcctgtatggtccgcccggtaccggtaagaccctgctggcccgggctgtcgcaggcgaagcgggagtgccgttctactccatctccggttcggacttcgtcgaaatgttcgtcggtgtgggcgcctcccgggtccgcgacctgttcgagcaggccaaggccaacgcccccgcgatcatcttcatcgacgagatcgacgcggttggccgccaccgcggcgccggcatgggcggcggccacgacgaacgcgagcagaccctcaaccagttgctcgtggaaatggacggcttcgactcccggggcggggtcatcctgatcgccgcgacgaaccgtccggacatcctcgacccggcgctgctgcgccccggccgtttcgaccggcagattgtcgtggaccgtcccgacctggagggccgcaaaggcattctccgggtgcacgcccaaggcaagccgctcggccccgacgtcgacctcgacgtcatcgcccggcgcacccccgggttcaccggtgccgacctggccaacgtgatcaacgagggggccctgctgacggcccgccgcggcaagcagcagatcgacatggccaccttggaggaggccatcgaccgcgtcatcgcggggccggagcgcaagagccgcgtcatgtccgaggcggagaagaagatcatcgcctaccacgagggcgggcacgccctggtgggccacgctctgccgaacgccgacccggtgcacaaggtcaccatcctgccgcgcggccgtgccctcggctacaccatgtcgctgccgaccgaggacaaattcctcacctcgcgttccgagatgatggaccagttggccatgatgctgggtggacgtgccgccgaggagctggtcttccacgagcccaccaccggcgcggccaacgacatcgagaaggccaccaacctggcccgcagcatggtcaccgagtacggcatgagtgaacggctcggtgcccgcaagttcggcaacagcaacaccgaaccgttcctgggccgggagatggcgcacagccgcgaatactccgaggagatcgcggccctcatcgacgaggaagtgcgccgccttatcgaagccgcccacgacgaagcgtgggagatcctcgtcgaataccgggacgtcctcgacgagctggtgctccagctgctggacaaggagaccctgtccaaggaggaggtcctggagatcttcgccccggtg

SEQ ID NO: 31980 - DNA, 546 bp, Thermobifida fusca
gtggacgcgaaggacatgggctccgccctggacaaaatcctggtcaccgaggaacagatcaggacccgcacccgggagttggcagccgaaatcgacgccgactacgcaggaaaggacttgctgctcgtcggtgtcctcaagggcgcggtcatggtgatggccgacctggcccgcgaacttcaccacccctgtgagatggactggatggcggtctcctcctacggggcggggaccacctcctccggtgtcgtccgcatcctcaaagacctggacaccgacatccaggggcgcaatgtgctgatcgtcgaagacgtcatcgactccgggctcaccctgtcctggctggtcggcaacctcaaatcgcgacacccggcgtcggtggagatctgcaccatggtgcgcaagccgatggcgttcaacgtcgacctggacgtcaaatacgtcggcttcgacctgcccaacgagttcatcgtcggatacggcctggactacgccgagaagtaccgcaacctgccgttcatcgcgactctcgccccgcacgtgtac

SEQ ID NO: 31981 - DNA, 726 bp, Thermobifida fusca
tcgactctggttctgctgcgccacggcgaaagcgtgtggaacgctgaagggctgttcaccggctgggtggacgtggacctgtccccgaaaggcgaagaggaagcccgccgcgggggcaggctgctggccgaggcgggaatccgccccgatgtggtccacacctccctgctgaagcgggccatccgcaccgccaacatcgcgcttgaggaggccggactgcactggattccggtcaagcgctcctggcggctcaacgaacgccactacggcgccctccaaggaaagaacaaggcgcagacccgcgccgaattcggtgacgagcagttcatgatctggcggcgttcctacgacacgcctccgccgccgctcgccgaagacagcgagttctcgcagcacaacgacccgcgttacgccaccctgccccccgagctgatgccgcgcaccgaatgcctggcagacgtcgtgcggcggatgctgccctactggtacgacgcgatcatccccgacctggctgcgggacgcaccgtgctggtcgcggcgcacggcaactcgctgcgcgccctggtcaagcacctggacaacatcgacgacaagagcatcgccgggctcaacatccccaccggtatcccgctggtgtacgagctcaacgacgacttcactccgcggaagacgggcggcgagtacctggaccccgaggcggccaaagaggccatcgaagcggtcaag

SEQ ID NO: 31982 - DNA, 1473 bp, Thermobifida fusca
atgacggaaacccgtcaccgtccttcgcggcgagccagacgctcgctcagcctcctcctcacctcggcgctgactgccgccggcctgctggtcacggccgccccggcacaggccgagtcgaccctgcgggaactggctgcccagaacggcggccgccacttcggtacggctatcgcctacagcccgctcaacagtgacgcccagtaccgcaacatcgcggctacccagttcagcgccatcacccacgaaaacgagatgaagtgggagtcgctggagccgcagcggggccagtacaactggagccaggccgacaacatcatcaacttcgccaaggccaacaaccagattgtgcgcggccacaccctggtctggcacagccagctgccgtcctggctgaacaacggcggcttctccggcagccagctccggtccatcatggagaaccacatcgaggtggtggccggacgctaccggggtgacgtctacgcctgggacgtggtcaacgaagcgttcaacgaggacggtacgctccgcgactcgatctggtaccgcggcatgggtcgcgactacatcgcccacgcgttccgcaaggcgcacgaggtcgaccccgacgccaagctgtacatcaacgactacaacatcgaaggcatcaacgctaagagcaacggcctctacaacctggtggtcgacctgctccgcgacggtgtgccgatccacggtatcggtatccagtcccacctgatcgtcggccaggtgccgtccacgttccagcagaacatccagcggttcgctgacctcggcctggacgtggccatcaccgagctggacatccgcatgcagatgccggccgaccagtacaagctccagcagcaggcccgcgactacgaggccgtggtcaacgcctgcctcgcggtgacccgctgcatcggtatcaccgtctggggtatcgacgacgagcgctcctgggtgccctacaccttcccgggtgaaggtgctccgctgctctacgacggccagtacaaccgcaagcccgcctggtacgcggtctacgaggctctcggcggcgactcctccggcggcggtccgggtgagccgggcggtcctggcggtccgggtgagccgggcggtcctggcggtccgggtgaaccgggcggccccggtgacggcacctgcgcggtgaactacaccgtggtcaatgactggggtcacggtatgcagggggcgatcaccgtctccaacaccggatcctcgcccatcaacaactggaccctgcagttcagcttctcgggtgtgaacatctccaacggctggaacggcgagtggagccagagcggctcgcagatcaccgtccgcgctcctgcctggaactccacgctccagccgggccagagcgtggaactgggcttcgttgctgacaagaccggcaacgtctccccgccctcccagttcaccctcaacggagccacctgctcc

SEQ ID NO: 31983 - DNA, 1584 bp, Thermobifida fusca
cggagctgccttcgacggattatccgctcccgtccgggtggtcgttagctgcggcatgtgccgggcagcgtacccgccagacggcggtaacgaccacgcccgagaggagatccgtctatgaccaccatagaacgtgaagcccggatcgtcgaacaggtccccaagcaggtgtgcatcggcgggcactggcgggacgcccagtccggggcgacgttcaaagtggaagaccccgctaccgggtcggtgctgtgtgaggttgctgacgctggcgtggctgacgggatggccgccctcgagatggcggccgctacccagcccacgtgggccgagtatccgcctcgggagcgcggggagatcctgcggcgcgcctacgagctcctcatgcaccgccaagaggacctggcagtgctcatgaccttggaaatgggcaagccggtagccgagtccaaaggggagatcgcctacgccgccgagttcttccggtggttctccgaggaggcggtgcggatcgacggcagttattcggttgctccgaacgggcagagccgtcttttggtcatgcggcagccggtgggcccgtcgcttctcatcacgccatggaacttcccgatggcgatgggcacccgcaagatcggtccggcgatcgccgccgggtgcaccatgatcctcaaacccgctcagcagaccccgctgtcggcgctggcgctcgccgacatcctgcacgaggctgggctgcctgagggggtgctcagcgtgctgcccacgactgacgcggccgggttgacggggccgctgctgcgtgacggccgtctgcgcaaactgtctttcaccggttctacgccggtgggccgcgcgctgatcaagcagagcgccgaccaggtgttgcgcacctctatggagttgggtggcaacgcgccgttcctcgtgttcgacgacgccgacttggacgcggccgtggcgggggcgttgcaggcgaagatgcggaacatcggtgaggcgtgcaccgcggccaaccgcttctacgtccagtccggggtggcggaagagttctcccggcggctcgcggagcgcatggccgggttgcggatggggcgcggtactgagccggacgtggacgtggggccgctcatcgacgacaaggcccgcaccaaagtgcagagtctcgtcgacgacgcggcgaaccggggtgcccgtgtgctgctcggcgggaagcgcggggacggcgccggctacttctaccatccgacggtgctcaccgacgtgccgaaggacagtgaggtgtgccgcacggagatcttcggtccggtggcgccggtgatcccgttcgacacggaggaggaggcgctcgcggaagccaaccgcaccgagttcggtctggtcagctatgtgtacacggagaacctgcggcgtgcgctgcgcatggcggagaagctggagagcggcatggtcggcctcaaccagggcatcgtgtccaacccggcggcgccgttcgggggtgtgaagcattccgggttgggccgtgaaggcggcagggtcggtatcgacgagtacttggagaccaagtacgtcggtatcgccggggtg

SEQ ID NO: 31984 - DNA, 2262 bp, Thermobifida fusca
atcagaaaggtggtagccgaggcgtgccaagggctgcccggcgcgtcagcagagacggtgatcgcggaagccacgcgcgggttctacccgggtatcacccccgctgagcttgaactcgccctgatcatggcggcgcgcacgttcgttgaaaccgaccccgactactcctatgtcagcgcccggctcctgttggacaagctgcgccgggaagccctgacgttcctcagcggacacccggatgaggccacccacgccgacatggctcggcgctaccccgaatacctgcgcgccttcatcacgcgcggtatcgaactggagcacctcacgcccgagctcgccgacttcgacctggaccggctcggtgccgcgctccgccccgaacgcgacctgaacttcacctacctgggcctgcagaccctctacgaccgctacttcctgcaccacgaaggcacccgctacgaactgccgcaggcgttcctcatgcgggtcgctatgggcgtggcgctccacgaagacgaccggaacgcgcgggccatcgagttctatgaactgctgtcgtcgttcgacttcatgtgctccacgcccaccctgttcaacgcaggcacccggcgtccgcagctctcctcctgcttcctcaccactgtcggcgacgacctcgcggagatcttccgcgccatcagcaacaacgccctgctgtccaagtactcgggcggtctcggcaacgactggaccccggtgcgcggcctaggcgcccacatcaaaggcaccaacggcaaaagccagggcgtcgtcccgttcctcaagatcgccaacgacacagcggtggcggtgaaccagggcggcaaacgcaaaggagcggtctgcgcctacctggagacctggcacatcgacatcgaggaattcctcgacctgcggaagaacaccggtgacgagcgccgccgcacccacgacatgaacaccgccaactgggtgcccgacctgttcctcgaacgggtggagagcgacgcccagtggaccctgttctcccccgacgaagtgccggacctgcacgaccgctacggcgaggacttcgcccgcgcctacgtcgcctatgagcgtgccgcggaccgaggggagatccgcgtgtttcgccgggtgcgcgccgtggacttgtggcggcgcatgctcaccatgctgttcgagaccgggcacccgtggatcaccttcaaagacccgtgcaacctgcggtccccgcagcagcacgccggggtcgtccactcgtccaacctgtgcaccgagatcaccctcaacaccagcctcgacgaggtcgctgtctgcaacttgggctcggtgaacctggccaaccacgtcggccccgacgggttggacgcggaacggctgcgccgcaccgtgcgcaccgcggtgcgcatgctcgacaacgtcatcgacgtgaacctgtacaccatccccgaggcggaacgcgccaacatgcggcaccgcccgatcggcctggggctgatgggctaccaggacgcgctgttcacgctgcggctgcccgtcgcctcccccgaggccgtggagttcgcggatgagagcatggagctgctcagctactacgccatcgaagcgtccgcggacctggcggcggaacgcggcagctactcctcgtttgaagggtcgttgtggagcagaggcatcctgccgatcgactcgctggagctgctcgctgaggcgcgccgcggcgacctggatgtggaccgcacccagcggctggactgggacacgctgcgggagaaggtgcgcaccacggggatgcgcaactccaacgtgatggcgatcgcgcccaccgccaccatcgccaacatcgtcggagtcaacccgtcgatcgagccgctctaccgcaacctctacgtcaaagcgaacatgtccggcgacttcaccgtcgtcaacccttccctggtgcgcgacctgaaagagcgcggcctgtgggacgaggagatggtgacggcgttgaagctccacgacggcagcctcggcccgatcgaccgggtgcccgaggacttgaagaacctgtacgccaccgctttcgaaatcgacccgatctggctggtcgacgccgcatcccggcggcagaagtggatcgaccaggcgcagtcgttgaacctctacatggctgagccgagcggccgcaagctcgacgagctgtaccggcgggcctggcgcaaaggcttgaagaccacctactacctgcggtcgcagggggcgacgcacgtggagaagagc

SEQ ID NO: 31985 - DNA, 1008 bp, Thermobifida fusca
cgcgtcgacgtcgaagacaagcggatgatcaactctcgcgccgacgtcaaccagctgctgccactcaaataccgctgggcgtgggaaaagtacttggctgcctgcaacaaccactggatgccgaccgaggtcagcatgcaggccgacatcgccctgtggaagtccaaggacgggctcaccgaggacgagcggctgatggtcaaacgcaacctcggtttcttcgccaccgcggagtctctggtagcgaacaacatcgtgctcgcggtctaccggcacctgaccaacccggaatgccggcagtacctgctgcggcaggcgttcgaggaggccgtgcacacgcacaccttccagtacatctgcgaaagcctcggcttggacgagggcgagctgttcaacatgtaccgggaggtgccgtcgatcaccgcgaaggacgcgtgggcgctgcgctacacccgcaacctggagaacccgaacttcacgaccggcaccccagaagccgaccaggcgttcctgcgggaccttgtcgcgttctacgtcgtgctcgaagggatgtggttctacaccgggttcgcgcagatcctgtcgctggggcggcgcaacaagatggtggggatcgccgagcagtaccagtacatcctgcgcgacgaaagcatccacctgaacttcggcatcgacgtcatcaaccagatcaagatcgaaaacccgcacctgtggaccgaggagttccaagacgaggtgcggaccatgctcatcgaggcgtgcgagcttgaagccgcttacgggcgcgagaccatgccgcgcggcatcctcggcctcaacgccaagctctgcgaacagtacatgcggttcatcaccgaccgccgcgccgagcagctcgggctggcaccgattttcggagagacggaaaaccccttcccctggatgtcggaaatgatggacctgaagaaggagaagaacttcttcgagacgcgggtcatcgaataccagacggggagcggtctttcctgg

SEQ ID NO: 31986 - DNA, 1020 bp, Thermobifida fusca
atgcctatcgcaacgcctgaggtctacgcagagatgctgggccgcgcgaagtctgagggcttcgcctacccggctatcaacgtcacgtccagccagaccctgcacgcggccctgcgcggtttcgccgaggctgaaagcgacggcatcgtgcagatctccaccggcggcgccgagttcctgtccggtaccaccatcaaggacatggtcaccggtgcggtggctttcgccgagtacgcccgggtcgtcgccgagaagtacccggtgaacatcgcgctgcacaccgaccactgccccaaggagaagctcgacaccttcgtgcgtccgctgctggcgatctccaaggagcgtgtcgccaaggggcaggagccgctattccagtcccacatgtgggacggctccgccgtggagctcgaggagaacctgcagatcgccgaggagctgctgaaggagtccaaggaggcccgcaccatcctcgagatcgaggtcggcgtggtcggcggtgaagaggacggcatcgtcggcgagatcaacgagaagctgtacaccaccccggaagacggcctgcgcaccgctgaagtgctcggcctcggcgagaagggctactacatcgccgccctgaccttcggtaacgtgcacggcgtgtacaagccgggccacgtgaagctgcgcccctccgtgctcaaggagatccaggacgtggtgggcgccaagtacggcaaggagaagccgttcgacctggtcttccacggcggctcgggctccagcctcgaggagatccacgaggcgatctcctacggtgtcgtgaagatgaacatcgacaccgacacccagtacgccttcacccggcccatcgtcgaccacatcatgaagaactacgacggtgtgctgaaggtcgacggcgacgtcggcaacaagaaggcctacgacccgcgctcctacggaaaggccgccgaagccggcatggccgcccgggtcgtcgaggctgcccagcagctcaagtccgctggcaagaagctcaag

SEQ ID NO: 31987 - DNA, 1269 bp, Thermobifida fusca
atgccggcgatcgcgctcgttggggctcagtggggtgatgaggggaaggggaaggcaaccgaccttgtcggtgaccgcgtcgattacgtggtccgttaccagggcggcaacaacgcggggcacacggtcgtcatcggcgaccaggagtacgccctgcaccttctgccgtcgggcatcctcacccccggtgtcattccggtgatcgccaatggcgtggtcatcgacccggcggtgctgttcgaagagctcgacgcgctcaccgcgcgcggcgtcgacgtgtcacgcctgctgatctccgccaacgcgcacctgatcatgccctaccaccgggctctggacaaggtcagcgaacgcttcttgggcaagggccggatcgggaccaccggtcgcggcatcggcccgacctacgctgacaagaccgcccgtgccggggtgcgggtccaggacatgttcgaccccaagatcctgcgtaagaagctggagctggcgctcaacgacaagaaccagatcctcaccaaggtgtacaaccggcgcgccctggaagtggatcggatcctcgacgaatacttgggctacgccgagaagatccggccttacgtggtggacacttccctggtgttgaaccgggcgctcgacgaaggcaagaccgtgttcttggaggggtcgcagggcaccctgctggacatcgaccacggcacttaccctttcgtcacctcctcgtctcctaccgcgggcggcgcctgctcggggtccgggatcggccccacccgtatcaccaaggtcatcggcatcctcaaggcctacaccacccgggtcggttcgggaccgttccccaccgagctggaagacgagtggggggagtggctgcgctcccggggccacgagtacggcactaccacgggccgcaaccgccgctgcggctggttcgacgcgccgatcgcccgctacgccacccggatcaacggcatcaccgacttcttcctcaccaagctggacgtgctgtccgggctggagcgcatcccggtctgtgtcgcctacgacatcgacggggtgcggcacgacgagatccccatgacccagacggagttccaccacgccacaccgatctacgagtacttggacggctggaacgaggacatcagccaggcgcgctccttcgacgacctgccgaagaacgcgcaggcgtatgtgcgggcgatcgaggagatgtccggggcgccgatttcagcgatcggtgtcggcccgggccgggagcagaccctggagctg

SEQ ID NO: 31988 - DNA, 1287 bp, Thermobifida fusca
gtccgcggcggtcatgccttgcacggaaccgcgttcatccaaggtgcgaaaaacgctgtcttgccgatgatcggagcggccctgctcgcatccaagggcaggaccgttctgcggaacgtccccgtgatcgaagatgtccgtcgcgctttggagctcgccgagtacgtgggggccaaagtcgagttccacgaagcggagcggaccatcgtcattgatgccaccgggctgaacgatcccaaccgggcggtgctgcccgcctccatcgcctcccgcttccgcggctccgtgctgttcatccccgcgctcatgcaccgtatgggccgcgcccggatcgagggggtgggcggatgcaacctcggcagccgcaaccttgacttccactaccggggttttgcgcggctgggcgccgaggtcaccgaggacccggagcgcaagcacatcaacgtgaaggcggacaatctcaagggcggacgcctctacctggacaccccgtcgcacacgggaaccgagaacctgatcatggccgcggccctcaccccgggcaccacggtgatcgagcacgcggccctcgagcccgaagtgctggacgtcatcgagttcttgggcagcatgggcgccaagatcagcggcggcggcaccgggttcatcaaggtcgaaggcgtctccgagctcaccgcggtggagcacacggtgatgccggaccgtatcgacacgggcgtgttcgcgatgatgacggccgcgaccggcggtgacgtgagcctcgtcggcgcgaacctggaccacctgggcgtggcccgctggaaactggagcagatgggcgtccagttcacccagcagggcgctgtactgcgggtacgccgcgacccgaacgtcccgctgcggcctatcaacgccgtcacttcgcccttccccggtttcgccacggacctgcagcctccgctgatggcgttggccaccctggccgagggggagagctacatccgcgaggccatcttcgacggccggttcgccctcgccgacgagctgaacaagatgggcgccaagatcgaggtcgagggtaaccgggcgatcgtgcacggtcccagcgaactgcacggcaccaaggtcaccgcccacgacctgcgctgcggtgcaggggcgatcatggcgggcctggtcgccaaaggcgagacgatcgtgagccccgcctaccaagtggaccgcggccattcccacttcgcgacccgcttgtcggctctgggcgccgatgttgtcagggaagaagtctcctagtccgaaaagtcggat

SEQ ID NO: 31989 - DNA, 1053 bp, Thermobifida fusca
ccttacctgagatcagcgctcgactcgatcccgccctaccggccgggacgcaaggtcgtcgggccggacggtcggtcagcgaaactctcctccaacgagagcccgttcggtccgctgccctcggtgcgccaggccatcgcggacgccgcggcagacctcaaccgctaccccgatcccgcggcagccgagctgaccgctgccctcgcccgccgcttccacgtccccgaagagcacgtggcgctcggcgcaggatccgtgggcctcctccagcagctgctggaagccaccgccgagccgggggcggaagtcgtctacgcctggcggtccttcgaggcgtacccgctgctgaccggtcttgccggggcgaccccgatccacgtcccgctgcgcgaggagacccacgacctggaggcgctcgccgcggcagtcaccgaccgcacccgcatggtgttcgtctgcaacccgaacaaccccaccggcaccgcggtgcgggagaccgaactcgccgagttcctcgacacggtccccgagcacgtgctggtggttctcgacgaggcctaccgcgaatacgtccaagacccccgggtgcccgacggggtgcagctctaccgggaccggcctaacgtcgccgtgctccgcaccttctccaaggcctacgggcttgctgcactgcgggtgggtttcctcatcggccatccacaggttgtggacgcagtccgcaaaaccctcgtgccttttgcggtcaaccacctcgcccaagccgcggctgtcgcgtcgctcgcggccgaacaggaactcttggagcgggtggctgtcaccgtcaaggaacgcgagagggtccgcgccgcgctgctcgccgacggatggaccgtgccggaaaccgaagccaacttcgtctggctgcggctcggcgaggacacgctcgacttcgcggccgcgtgtgaacaagccgggatcgcggtccgcccgttcgccggggaaggcgtccgcgtcagcatcggccttcccgacgacaacgatgctttcctgacggtggcccggacctatccgaaa

SEQ ID NO: 31990 - DNA, 2655 bp, Thermobifida fusca
cacactgtggccgcccacgaagtattcccggccttggagacgtccccggacgggctcaccgaggaggaggcgcgtcgtcgtctcgccgagtacgggccgaaccggttggaggaggccccgcctccgtcagccgtggcggtgttcctccgccagttcgccagcccggtcatcgcgatcctgctgttcgctttgctcctcacggttgtcctccgtgaatggctggacgccgcggtgatcgcggcagcgctgctggtgaacgcgggtatcggtttcgtccaggagcgcaaagccgaacaggcggtgcgggcgctgatgaatctgagtcagcctcgtgcccgcgtggtgcgggacggccgccgccgcgaggtggagagcaccgatctcgtgcccggggacgtggtgttcatcgagtccggcagccgtatccccgctgacatccgcctggtggaggcgcacgccctggaggtcgacgagtcgctgctgaccggggagtcggagccggtggtgaagtccacggcgacggcggccgccgacgccggggtgggggaccgcagcggcgtcgcgttttcggggacgatggtggtcagcgggcgcggcatgggggtggtgtacgccaccggtaggcgcaccgagctgggcgcgatcgctgggctgttgaagagcgaaccggagacggcgactccgctcaaggagcggatgacgcggctgtcccgggtgattgtggccgccaccctggtgtctgcgctgctggtcatggcgatcggtttggtgcggggcggcgacccgatggagctgctgctggtggcggtggcgctcgcggttgccgcggtgcccgaagggctgccgatcgtgctcacggtggctttggcggtcggggtgacccgcatggcccgccgcaacgcgatcgtgcgccgcatgctcgcggtggaagcgctgggcagcgccacggtgatcggctcggataagacgggcacgctgaccgagaaccggatgacggtgcggcggttgtggagcccggcgggcggggaggccggcccggcagcggtcaccccctattgggggaatatcacggagctgcctctcgaacaggtcgacccgtatgtgctgctggtgctgtgcggggcgttgacgaatgaggccacgatggcttccgaggaggggagggaagcttccggggatccgaccgaggtggcgctgctggaagccgcgtacgacgcggaactgctgcacacggcacgggatgtgcggtttccgaagaccgcggaggtgcatttcgaaccggcccgccgtttttccgcgacggcccgccgctgggggaaccgggaggtcttgttcgtcaagggagccccggaacgggtggtggagatgtgcgacgcccaagtgggccgggtggaagcgggacggtggcagcccgctgcgctgcggcccggggagctgcacgcggccggggagcggatggccgcggaagggctgcggctgctggctttggcggtgagcagaccgtacgagccgggagccgcatccgtggatccgcacgacccgtcggggctagtactgctcggcctggtcggcatcatggatccgccgcgccccggggtgcgggaggcggttcaggactgccgcgaggcaggggtccgggtggtgatgatcaccggggaccatgcggtcacggcccgcgcgatcgccgcagagctggggatctgcgagccggatgcgccggtgctcacctaccagcagattgcggggttggacgacgaggagttgcgggccgcggtcgcccaggtgaacgtctacgccaggattcccccggaaggcaagctgcggctggtgcgggcgttggaagccaacggcgaagtggtggcggtgaccggggacggggtcaatgatgcgcccgcgttgaaagcggcatcggtgggtgtggcgatgggccaggaaggcaccgatgtagcgcgggaggcagccgagattgtgttggctgacgacaacttcaccacgatcgtgcacgcggtggaggaggggcgggtcacgttcgacaacattcggcgcgccgtgttcttcctggtgtcgatcggcgcggccatggtggtggcgttgaccgtgtccacgctgctggggtggccgctgctcatggtgcccgcccagttgctgtggctgaacctggtgacgagcggggtgcaggacatcgctttggtgttcgaacgcgccgaaccgggcctgctgcggcggccgccgcgctcggtgcacgagggcattctctcgcggctgctgtggcagcgggtgggggtgacgggtgtggtgatggcagcgggcacgctcgcgatgttctggtgggagtggcagcgcaccgcatcgttgacggcggcgcagacgatggcgttgacgaccatggtggtgttcatggcgttccaggcggggaatgcccggtccgacacccggtcggtgctggggatgccgctgcggtacaacccttacctggtggtggccgtggccggctcgttcgcgctgcacgtggcagcgttgtatttcccgccgacccaggttttgctgcgggtggagccgttggacgctgccgcgtgggcgcggatcgctgcggtggcggtcagtgtcgtggtggtggttgagctggagaagatggtgcgccgcgcgtgggcgcgg

SEQ ID NO: 31991 - DNA, 714 bp, Thermobifida fusca
gaccggatcaccgcggtgctcttcgacatggacggggtgatcacagacaccgcgtccgtgcatgcggccgcctggaaacggaccttcgacgagttcctcctcgacctgtcccgcagtggcgggcccccgttccggccgttcgacctcatcgaggactaccgccgccatgtggacggcaaggcacggaccgcaggcatccgcgactttctcgcctcccgcggcctcaccctgcctgacaccgcgccacccgaccggcccgaaaccatgaccgtggcgacgctgggcgaccgcaaagaccgctacttcaaggactacatcgaccagtacggcgtcaccgcctaccctgccacggtccggctcatccaccgcctgcgggagcggggcatccgcctcgccgtggtctccgcgagccgcaactgcgccgcagtgctgcgcgctgccggaatcagcgacctgttcgacgtccgggttgacggggttgacgcggcccggctgcgtctgcccagcaaacccgaccctgccctgttcctggaagcggcccgccggttagacgcctcccccgctaccaccgcggtcgtcgaagactccctatccggggtcgaagcgggccgacgcggcggttttgccctggtcatcggggtcgaccgggcgcatcagcgcgccgcactctacgagaaaggggcgcacatcgtcgtgtccagcttggcgagcctg

SEQ ID NO: 31992 - DNA, 936 bp, Thermobifida fusca
ctcctcgactactaccggcagatgctgctgatccgccgcttcgaggagcgtgccgcgcaggcctacacccaggcgcgtatcggtggctactgccacctcaacctcggtgaagaagccaccatcgtcggtctcatggaggcgctccaggagcgcgactacctcttcaccaactaccgggaacacggctacgccatcgccaaaggcacccatccgcgggaagtgatggcagagctctacggccgctccaccggcgtctccaagggctggggcggctccatgcacctgttcgacgcccgaacccgcctcctgggcggctacggcatcgtcggcggccaactgccgctcgccgtcggcgctgccctcgccatcacctaccggggcagcgacgaagtcgtcatgtgccagatgggcgacggcaccaccaacatcggcgcgttccacgagtcgctgaacatcgccagcctgtggaacctgccggtgatcttcgtggtgatcaacaacttcaccggtatgggcacgccggtcgagcgctcctcggcagagcccgaactgtacaagcgcggctccgcttaccggattgaaggggtgcgcgtcgacggccgggacgtcctcgccgtccgcgacaccgccaccacactggtggagcgggcccgcagcgaacaccgccccttcctgctggaagccttcagctaccggatgaaaggccactccgtggtggacccggccaagtaccgcaccaaggaggaggcggaggaggccctcgccaacgatccgatcgccatgttcgaagaacgcctgaccgaggcgggcattctcaccgacgagatcaaaaaggagatcgccgaatcggtgaaagccgaggtcgccgacgccgccgatttcgcggagaacagcccgcaccccgaggtgtccacgctgttcgactacacctacgcc

SEQ ID NO: 31993 - DNA, 936 bp, Thermobifida fusca
atcacctaccgtcaggccctgcgcgacaccctgcgtgccgagatgcaccgcgacgaaaacgtcttcctcatgggtgaggagatcggcgttttcgagggctcctacaagatcactgaaggcctcctcaaagagttcggggagcggcgcgtccgcgacacccccatcgccgaggaggggttcgtcggtgcagccgtcggcgcagccatgctcggcctgcgcccggtcgtcgaaatcatgacgatcaacttctccctgctcgccctggaccagatcgtcaaccatgccgcgaagatctacggcatgttcggcggccagaacagtgtgccgatggtgatccgcaccccgggcggcggcggccagcagctcggcgccacccactcgcagaacgtcgagctgtactacgcgttcgtgcccgggctgaaagtcgtggcgcccagcacgcccgctgacgccgcagccctgctgcgtgccgcgatccgcgacgacgacccggtgctcttcctggagaacctcggcctgtacaacacgaagggcgaagtccccgacgaagaagtcgtcggcgaaatcggccgggccgccgtcgtccgtgaaggcaccgacatcaccctcgtcggctactcccggatggccatgatcgccactcaggtggcggaccgactcgctgaagagggaatcagtgtcgaggtcgttgacctgcgctccctgcgtccgctagaccgggagacgatcgtgaactcggtgaagaagaccgggtgtgcggtcgttgccgaagacgactggttgacctatgggatcggcgcggaaatcgccgcatccattcaagaaggcgcattcgactacctcgacgctccggtgcgccgggtggcgatggccgaagtgcccttgccgtacgccaagccgttggagaacgccgcactgccgtcagcggagtcggtc

SEQ ID NO: 31994 - DNA, 1335 bp, Thermobifida fusca
ccctgagagccgtcggccggagagtcggttaaggaaccacagatgtctgaaatctacatgccgcgcctctccgacaccatggaggaaggcgtcatcagctcctgggtgaagcaggtcggtgacaaggtctccgtgggcgacgtgctggtggagatcgagaccgacaaagccgtcatggagtacgaagcctacgaagacggctacctggtccagcagacggtccgcgaaggcgaaaccgtgccgatcggcgcggtcatcggggtgatcgccgacagcccggacgctgtccctgccgccccggagggcggggagggcgccgagcagaaggcggaggagccgcagcagcccgcgcccgccgcccaggaggccaaggaagagcagcccacggtcccggccccggccgccccggcagagcagggaggcaaaccgcgtccgctctcctcgccgctggcccgccgcctggcccgcgaatacggtctcgacatcaccaaaatccaagggtcgggccccaaaggccgggtggtgcgcgccgacgtggaagccgcagcccagcagaagcgggagcaggaggctgctgcaccgcagcccgctgccgccaaggcacccgcccctgccgcggccccgccgcagccggagttcgaggacctgcgtgcctccgaagaggttccggtcaccaacatccgccgggtgatcgcccgccggctgacccaggccaagcaggagatcccccacttctacctgcgccgccggatcgacgccgaagcgctcagagagttccgggcgcagatcaacgagcagctcgccccgaccggggtgaaggtcagcgtcaacgacctgatcgtcaaagccgtagccaccgtgctgcgcgaccacccggaggtgaactcctcgtgggtggacgacaagctgctgcggcacaagcggatcaacgtgggcatcgcggtggctgtggacaccggcctggtggtcccggtgctgcacgacgccgacaccctggcgctgtcggaggtcgcccggcgctcccgcgccctggtggagaaggcccgcgacggcaagctgagcccgcaggacatgagcggcggcacgttcagcgtcagcaacctgggcatgttcggtgtggagagcttctccgcggtgatcaacccgccggaggcggcgatcctcgccgtgggtgcgatgcagcaggagccggtggtgcgcgacggggagatcgtggcccggcacaccatcgcgctggaactctcggtggaccaccgcgcggtcgacggcgcggtcggcgccgccttcctcaaggacctggccgaagtgctggagtccccgatgcggatcgtgctg

SEQ ID NO: 31995 - DNA, 897 bp, Thermobifida fusca
atggtaggcagtacgacgccgaacgcgcccttcggccagatgttgaccgcgatgatcacccccatgctcgacaatggggaggtggactacgacggggtggcccgcctcgcgacctacctcgtcgatgagcagcgcaacgacggcctcatcgtcaacggaaccaccggagagtccgccaccaccagcgatgaggagaaggagcgcatcctccgcaccgtgatcgacgcggtcggcgaccgcgccaccatcgttgccggagcgggcagcaacgacaccaggcacagtattgaactcgcgcggaccgcggaacgcgccggagcagacggcctgctgctcgtcaccccctactacaaccggccgccccaagaaggcctgctgcggcacttcacggccattgccgacgccacagggctgccgatcatgctctacgacattcctggccgcacaggcacgccgatcgactccgaaaccctggtccggctcgccgagcacccccgcatcgtcgccaacaaggacgccaaagacgacctcggcgccagctcgtgggtgatgtcccgcaccgacctcgcctactacagcggcagcgacatgctcaacctgccgctgctgtccatcggcgccgcgggcttcgtcagcgtggtcggccatgtcgtcggctccgaactgcacgacatgatcgacgcctaccgggccggggacgtggcccgggctttggacatccaccgccgcctgatccccgtctaccggggcatgttccgcacccagggagtcatcaccactaaggcggtgctcgccatgttcgggctgcccgccggagtggtccgcgcccccctgctcgacgcgtcccccgaactcaaagagctgctccgcgaagacctcgccatggccggggtgaag

SEQ ID NO: 31996 - DNA, 1482 bp, Thermobifida fusca
cagtacgtagcggcaattgaccagggcaccacgtcgagtcgctgcatcatcttcaaccgccacggcgacgtggtcgccctcgggcagcgggagcaccgccagatcttcccccgcccgggctgggtcgagcacgacgcggaagagatctgggcgaacgtcgtcgccgtcgtggaggaggcgctcgccgcgggcgggctgcgccgccaccagttggccgcggtcgggatcaccaaccagcgggagacgaccgtggtgtgggaccggcagaccggtcaacccgtccaccacgcgatcgtgtggcaggacacccgcaccgaccgcctgctgcgagtcctgggcgggacggaaggccaggaccggttccggcagcggtgcggactcccgctcgccacctacttctccgggccgaaactgcgctggctgctcgacgaaatccccgggctgcgggagcgggcgcagcgcggcgaagtgctgttcggcaccatggacacctggctggtgtggcagctcaccgggcggcacgtcaccgacgtcaccaatgccagccgtaccatgctgatgaacctgcgcaccctggactgggatgccgaaaccctggacgcgatggggatccccgcagcgatgctcccggagatccggtccagtgcggaggtgtacggcacagccaccggccccttggcgggagtgcccgtggccgcagctctgggcgaccagcatgccgccttgttcgggcagacctgcttcgaccccggcgatgtgaaaggcacctacgggacgggggcgttcctggtgctcaacacgggtaccgagccggtcgtctccaccaacgggctgctcaccacggtgggctaccagatcggcggccagcccgcggtgtacgcgctcgaagggtcgatcgcgatggcgggctcgctcgtgcagtggctccgcgacaacctggggatgatcacgcacgccgcggagatcgaagaactcgcttcgcaggtcgcagacaacggcggctgctacatcgtgcccgcgttctccgggctgttcgcgccgcactggcggagcgacgcccgcggcatcatcgccggcctgacctcctatgtgaccaaagcgcacctggcccgcgcagtgctggaagcgacagcgtggcagacccgcgaagtggtggacgcgatgaacagcgactcagggatcccgctagcctcgctgaaagtggacggcggcatggtcgccaaccggctactgaaccagatcctcgccgacgtgctggacgtggaagtggtgcggcccaaagtggcggagacgacctgcctcggggctgcctacgcggcgggcctcgccgtgggctactggccggacttggacagtctgcgcgccaactggcagcacgacgccacgtggacgccgcagatcgacgcgcaggtgcgggaccgcgaataccgcaactggacgaaagcggtacgccgcaccttcggctgggtggaatccgaggag

SEQ ID NO: 31997 - DNA, 735 bp, Thermobifida fusca
attaaggtaggagtgttcggcgctctcgggcgcatgggatcagaagtcgtcaaggccgtggaagcggccgacgacaccgaactggtagccggaatcgacgtcggggacgaccgcggcaaggtgctcggcgccgacgtggtcgtcgatttcacccaccccgatgcggtgatggacaacctgcgctggctcatcgagcacgggatccacgccgtggtgggcaccaccgggttcgacgacgccagactcgccgaagtccgccgcatgctggacgcgaagccgggcgtcaacgtgctcatcgcccccaacttcgggatcgccgccgtactcatgatgcactttgcggcgaaggcggccccctacttcgagtcggcggagatcatcgaactgcaccacccgaacaaggctgacgcgcccagcggaaccgcctaccgcaccgccgaactgatcggcgcggcccgcgcccacgctggtttgggcgacgccccggacgccaccacgtcggagctgcctggtgcgcgcggcgcccaggtggacggggtgcgggtccacgcgctgcggatcaccggcatgatcgcccaccaggaggtcgtgttcggcacccacggggagacgctgcggatccgccacgattcgatgaaccgcgaatcgttcatgccgggcgtgctcttgggggtccgcaaggtcgcgtccctgccggatcggctcaccgtgggtttggagtccctgctcggcctg

SEQ ID NO: 31998 - DNA, 1287 bp, Thermobifida fusca
gtcggcaccactgtcaccctcctcgaacccggggacggcactggcctggtgcgccgtaccgtactgccgggtggtctgcgggtagtgaccgagaccatgcagggggtgcgttccgtagcttttgggatttcggcgaccaccgggtcccgcgatgaggacgcggagcacgcgggggccgcgcacttcctggaacacctgctgttcaaggggacggaacggcggagcgctctggacatctccgcgctgctcgacggggtgggcgccgactacaacgcctacaccaccaaggagcagaccacgtactatgccaaggtcctcgaccgcgacctgccgttggcgatcgacgtcatcagcgacatggtcgccaattcggtcctcgaccctgccgaagtggaaactgagcgcggggtgatcctcgaagagatcgccatgtatgaggacgagcctgccgacgtggtcgacgacgtgttcgccgcgcactttttcaaaggctcgcccctgggccgccccatcctgggcaccaacgacacgatccgcgcgttgacccgcgagcggatcctcgaacagtaccggagcgcctacgtgccctccgagctcatcgtcgccgccgcgggcaacctggaccatgacacggtggtgcgccaggtcgcggaagcgttccgggacaagctcgacgcggccggggacgcccgccctgctgcgccgcggatcggcaccgagcctcccgccaccaatccgggaacggtcctcgtcagccgggacagtgagcaggcccacctgatcctggggcgtgaaggggtcaaacgcaccgacccgcgctggtatgcgctgcgggtgctcagcgccatcctcggcgggggcatgtcgtcccgcctcttccaggaggtgcgggagaaacgcgggctggcttacgccgtccacggctacacgtgcagctattccgacacgggactgttccaggtgtacgtgggctgcctgcccgacaagatcgacgaagtcctcgacgtctgccgcaccgaactggagcgggcagcggctcacggggtggacgctgcggaactggcccgagccaaggggcagatccgcggctcctgggtgctgggtaccgaggggaccaatgcgcggatgagccggctgaccagccacgaactcggctaccgccgccacctgtcactgagcgaggacctcgccctcttcgacgcggtcacttctgaggacgtcagcgaggtcgccgcggagatcctcacccgccctgaagcgctggcggtggtcggcccgtacgaggag

SEQ ID NO: 31999 - DNA, 1401 bp, Thermobifida fusca
caacgtccgttctggctggccgggtcagcaactaccggcgacaacgaactcactgtcaccaacccctacacggggcagaccgtggcaacggtcgccgtcccctccccggaacaggtcgaccaggctgtggctgccgcgcacggtgccctcgacgccaccgcggcgctccccgcccacgtgcgcgctacggccctcgcccacgtggcacggcggctccaggagcgctccgaagagatcgcccagctcatcactgcggagagcgggaagccgatcttgtgggcgcgtgccgaggtggggcgggctgtctccgtgttcacctgggctgcagaagaggtccgccgcgacagcgggcgggtgcagcgcttggacaccgacagtgcgggggagggtcggatcgcgttgatccgccgcgtccccaagggtgcagtgctggcaatctccccgttcaatttccccctcaacttggtcgcgcacaaggtcgctccggcgatcgcggtgggcgcgcctatcgtggttaagcccgctcccgcgacgcctctttctgcattggtgctcggcgagatcctcgctgaaaccgatctgccggccggggcgttctccgtgctgccgatgccgaacgaactggcgcagccgctcatcaccgacgaacggctgccggttatctcgttcaccggcggccagttcggctgggagctgcgcaagatggccccgaacaagcacgtcaccctcgaactgggtgggaatgctgcggccgtggtgctggccgacgccgacttggactgggcggcccggcggatcgccctgttcggcaacaaccaggccggccaggtctgtatcggcgtgcagcgggtcatcgtggaggacgccgtctacgacgagttcgccgcgaagctggtccagcgggtcgaagagctggtgaccggggaccccgccgacgaggccacccaggtggggccgctcatcaacgaggctgccgcggcccgcgtcgagcagtgggtgaacgaggcggtggcgggtggggccacggttctcaccggcggcacccgggacggggtgaccatggctccgaccgtgctggcggacgtccccgacgacgcgaaggtggtgtgcgaggaggtcttcggcccggtgatggtgctgcgccgggtcagcggcgtggatgaggcgttcgccgaggtcaacaacagcaagtacggcttgcaggcgggggtgttcacccgggatctggcgacggcgttccgggcgcaccgcgagctgaaggtgggcggggtcatcatcggtgacgtgcccacgtaccgcgccgaccagatgccctacggcggcgtgaagaagtccggggtcggcaaggagggggtgcgttccgcgatggacgacctgaccgacgaacgggtgatggtgctc

SEQ ID NO: 32000 - DNA, 1323 bp, Thermobifida fusca
ctcccccaggaacgtcggctcgtcaccgagatccccggtccccggtcgcgtgcgctgcaggagcgccggaccgcggccgtcgctcaaggagtaggcagctccctgccggtctacgtggtgcgggccagcggcggcatcgttgaagacgtggacggcaaccggctcatcgacttcggttccggtatcgccgtcaccaacgtgggtaacgccaacccccgggtggtggcccgcgccagcgaacagctcgcccgcttcacccacacctgcttcatgatcaacccctacgaggggtacgtggacgtgtgcgaggcgctcaaccggatcacccccggcgaccacgagaaacgctccatcctcgtgaactcgggtgctgaggcggtggagaacgcggtcaagatcgcgcggcacgccaccggacgccaggcagtggtcgtgtttgaccacgcctaccacggccgcaccaacctgacgatggcgctcaccgcccggaacatgccgtacaagcagggcttcggcccgttcgccggcgaggtgtaccggatgccgatggcctaccccttccgctggccgaccgggccggacaactgcggtccggaagccgccgcccaggccatcgacctgatcaccacccagatcggcccggagaacgtggccgcagtgctcatcgagccgatccaaggcgagggtggtttcatcgtgcccggtgaagggttcctgcccgcgctcgtcgagttctgccgcaagcacggcatcgtgttcatcgccgacgagatccagaccgggtttgcgcgcaccggccgcctgttcgcttgcgagcacgaagggatcgtgccggacctcatcaccacggccaagggcatcgccggcggtctgccgctggccgcagtgaccggccgcgccgagctcatggacgccgtgcacggcggaggcttgggcggcacctacggcggcaacccggtggcctgcgcggccgcgctcgccgccttggagacgatcgaacaggacaacctggtggagcgcgcccgcgctatcggggacgtgctgctgtcccggctgcgcgcgctggcggaacgctacgacatcatcggcgacgtgcggggacgcggcgccatggtcgccatggaactggtggcgggtgcgggcgacaagacccccaaccctgaagcgctcgcctccgtcgtcaagtactgccacgccaaaggcctgatcctgctgaccgcgggcacctacggcaacgtgatccggctgctgccgccgctcgtcatcagcgacgcgctgctggacgaaggcctgaccatcatcgaagaagcgttcgcgcaactg

SEQ ID NO: 32001 - DNA, 1751 bp, Thermobifida fusca
tggaggagacccgcaagcgcggcctcctcatcggcaagggcggcttgcacggccagaccctgcgcatggcgccgccgctcaccctcaccgaggaggaagcagaagaaggggcggccatcctcgtcgacgcggtcaccgcggtcaacgacgccgtcgcgtaaccagttgaacgggcgcaccctcacgccgcacccgggggtgcgccccccacttgcccgcacactctcgtcacccgaagaggttgtccgttgtctgtcacgcacgtttcccactggatcgatggcaagccctggcagggcccggccgagcgccgcggcgacatctacaacccggccaccgggcgcgtgtcgggaaccgtcgacttcgccggaccggctgaagtcgacgccgcagttgccgccgcgaagcgggcattccccgcctggcgggacacttccctgtcccggcgcaccgagatcctgttcgcgttccgggaactggtccgcgcccaccgcgacgaactggcccgcatcatcagcgccgagcacggcaaggtggtctccgatgcgctcggcgaagtctcccgcggactggaggtcgtcgagttcgcctgcgggatcccgcacctgctcaaaggcggctattcggagaacgtctccacccgcgtggacgcctactccatcctgcagccgctgggcgtggtcaccgggatcaccccgttcaactttcccgcgatggtgccgatgtggatgttccccatcgcgatcgcctgcgggaacacgttcgtgctcaaaccgagcgagaaggacccgtccgccccgatgcgtctcgccgagctgtgggccgaagccggactgcctgacggcgtgttcaacgtggtgcacggcggcaaggaagcggtggacgcgctgctcacccacgaggacgtcaaagcggtcagttttgtcggctccactccgatcgcccgctacgtctacgcgaccgcggccgcccacggcaaacgcgtgcaggcgctgggcggcgccaagaaccacatggtggtgctgcccgatgcggacctggacttggctgcggacgccgccgtctccgcgggcttcggctcggcgggggagcggtgcatggcgatttccgcggtggtggcggtgggcggcatcgccgacgacctggtggcgcggatcaagcagcgggtggcgcaactgcgtgtcggccccggcgatgacgaacgcagcgaaatggggcccttggtcacccgggagcaccgcgatcgggtcgcctcctacctggagtccggggtgcgcgaaggcgcgaccctggtcgtggacggccggatccacccggtgatcggcggggaacgcgacggtttctggctgggtccgtcggtgctcgaccacgtcacccccgacatggcctgctaccgcgacgagattttcggcccggtgctgtcgatcctgcgcgtcgacacctacgaggaggcgatcgacctcatcaacgccaacccctacggcaacgggaccgcgattttcacgaacgacggcggggcggcacgccgcttccagaacgaggtggaagtgggcatggtcggtatcaacgtgccgattccggtgccgatggcctactactcgttcggcgggtggaagaattccctgttcggcgactcgcacgcacacggaaccgaaggcgtgcatttctacacccgcacgaaagcggtcaccgtgcgctggcaggaccccagccacggcggagtcaacctcggtttccccaccacgaagtaa

SEQ ID NO: 32002 - DNA, 801 bp, Thermobifida fusca
gatctgctcgcccgccaccgcgcggtcatgcccgcgtggatgcccctgtactacgagacgcctatcgagatcgtcagcggcaaaggaaaccgggtcgtcgacgctgacggcaacacctacctggactttttcgctggaatcgtcaccaacatgatcggctacgacgtggccgaagtccgggaggccgtcgaagcccagctcgcccgcggagtcgtccacacctcgaccctctacctgctgcgcggccaggtggagctggccgagaagatcgcccgcctctccgggatccccgatgccaaggtgttcttcaccaactccggcaccgaagccaacgagaccgcgctgctgctggccacctatgcgcgccgcagcgacgaagtgctcgcgctgcgcaacagctaccacggccgctcctacggcacgatcgcggtcaccggcaaccgcgggtggaagaactcgtcgctctccccgctcaccgtgcactacctgcacggcaccgaccgctcccacccggcgttcgcgcacctgtcggaccgcgagtacatcgacgtgtgcgtggccgacctgcgcgacgtgctcagcaccaccgcaccgaacgtggcctgcctgatcgcggaacccatccaaggcgtcggcgggttcgtgatgcccccggacggcctgttcgccgcctacaaggaagtcctggacgagcagggcatcctgttcatctccgacgaagtgcagaccggctggggccgtaccggcaccagcttctgggggatcggcaaccacggcgtcacccccgacatgatgacgttc

SEQ ID NO: 32003 - DNA, 3540 bp, Thermobifida fusca
gtgtacttgaagaccctcaccttgcgcggattcaaatccttcgcgtcggccaccacactccgcttcgaacccgggatcacctgtgtggtcggacctaacgggtcgggaaagtccaatgtggttgacgccctggcgtgggtcatgggggaacagggcgcgaagacgctgcgcggcggcaagatggaggacgtgatcttcgcgggaacgtcgtcccgccctccgctcggccgagccgaagtcagcctcactatcgacaacaccgacggtgcgctgcccatcgactactccgaagtcaccatcaagcggaccatgttccgcaacggcggctcagagtacgccatcaacggcgacccctgccgcctcctcgacatccaagaactgctcagcgactccggtatcggccgggagatgcacgtcatcgtcggccaagggcagctcgacacggtgctgcacgccggaccggaggagcgccgtgcgctcattgaagaagccgcgggcatcctcaaacaccgcaaacgcaaagagaaagcgctgcggaaactctccgcgatgcagagcaacctcgaccgggtgagtgacctggtcgcggagctgcgccgccagctcaaaccgctcggccgccaagcggaactggcccgccgcgccacggtcatccaagcggaactgcgggacgcccggctccggctgctcgccgacgacatcgtcaccctgcgggaagccctcgccaaggaggaagccgacgaggccgaggtccgcgcccgccgcgccgctgtcgaagcagagctcacccaagcccaggagcgcgaaaaccagttggagcaggccgcagccgaagccgctccgctgctcgcccgcgcccaagaggcctaccacgccctgcagcggctcaaagagcggctcagcgcggtcgccagcctcgccacggaacgccaccgcaacctcagcgccgccagcagggaagagcaccgcggccgcgacccggaagagctggaagcggaagccgcggagatccgcgccgaggaggaagagctccgcgcccaactggaagaggcgcgcctccggctggaagaggtcgtcgtggagcgggccgaagccgaggcggcgctgcgcgacgaagagcagcgggtggccgcggccgtgcgtgccgccgccgaccgccgggaaggcctggcccggctccacgaacgcgccgcagcgctgcgccgcaccctggaagcgcaggacgctgagattgaacgcctcacccaggctgccgcggaagcccgggaacgcgccgcccaagcccaagaggagttcgcggacgcccgcgccgacgcggaaagcctggacctcggggacagcgaactcgacgaagcctacgagcaggcccgcgaagagctcgccgccgcggaggcccgcctggctgagctgcgcgacgcagaacggaacgcggagcgggaacgtgccgccttggaggcccggcgggacgccctgcagatggggctggagcgccgggacggtgctgccgccctcctcaccgcggacggggacgcgctcggcctgatcggcgccctcacctccctcatcgacgtggccgcgggcgacgagagcgcgatcgccgcggcgttgggcgcggccgcggacgcagtggtcgtcggcacgcacgacgccgcccgcagcgccctggacctcctcaaacagcgtgacgccggccgagccgggatcgtggtcgccgacagcgctgaggtccagccgcgggagcagtggcccgacccgcccgcgggcgcccgctacgcggtggactccgtcaccgtccccccgcggctccgctccgccgtcactgcgctgctcgccgataccgtgctggtccccgacatggcgacggctgcccgtgtcatcgcggaacgtcccgccctgcgcgctgtcaccccggaaggggacgtgttcacttccgcgtttgtgcacggcggcgccgccaccgggcccagtcaactggaagtgcgcgctgccatcgacgaaacagccagccagttggccgcggccgaggaggtctgcaagcggatcaccgaggacctcggtgacgcccagctcgaacgggagcgggcggcggcagccgtggacgcgatcaccgcccgccgccgggaggcggaccggcgccgcagcgagattgcgcagcgcgtgggccgtctcggcgctcaagtccgctcagccacccaggaagccgaacggtacaccgctgccgtggagaaggccgtccgtgaacgcgaagccacccgggcagcccttgcggaactcgaggaacgggtcgcccaggcggagagcgaacccgtggacgaaagcgagccggacacggcccgccgtgaccagtgggccgcggaagccgctcggctgcggtccgtggaaatggaggcgcgcctggccgtgcgcaccgctgaagagcgggtccgcgcgatcactgggcgggcagaagggctcctgcgggccgcagccgcggaacgccgggcccgggaggaggcggcccgtcgccgacagcgccgcgccgcccaagccaaggtcgcccaggcggtcgcggaaggcgcctcccaggcgctggcacggatcaccgtctccctcgccgaagccgacggggagcgtcggctcgccgaggagcagcgcgacgcccgggaagccgaactcaaaacggttcgggtgcggatccgggaactttccacggaactggagaagctgcgctccgccgtgcacagcggggagatggcccgcgccgagcgccgcctgcggctggaacagttggagacgcgcgcccgtgaagagtggggcatggaagtggagacgctcgtggccgagtacggcccgcacgtgcccgtgcccccgccccccggcaccccggaggacgaggctgtcccggtgccgtatgtgcgcgcagtgcaggagaagcgcgcgaagaccgcggaacgccagctcaaccagctcggcaagatcaacccgctggcgttggaagagttcgctgccctggaggagcggcacaacttcctcaacgcccagttggaggacttgaagaagacccgccgcgacctgatgaccgtggtcaaagaggtcgacgaccgggttcaggagatcttctccgccgcctacgccgacgtggcacgggagttctcccgcgtcttcgcgcgcctcttccccggaggggaggggcggctcgtcctcaccgaccccgacgacatgctcaccaccggggtcgaagtggaggcccgcccgcccgggaagaaggtgaagcgcctctccctgctctccggtggggagcggtcactgaccgcggtcgctttcctcgtcgcgatcttcaaagcccggccgtccccgttctacgtgatggacgaggtggaggccgcgctggacgacatcaacctgcagcggctgctcgtggtcttcgaagagctgcgggccacgtcccagctcatcgtcatcacccaccagaagcgcaccatggagatcgctgacgccctgtacggcgtgacgatgcagggcgacgggatctcccaggtgatcagccagaagctggagcgg

SEQ ID NO: 32004 - DNA, 2402 bp, Thermobifida fusca
atccggttcgccaacgtctccctcacctacccggggcgcaacctgcccgcgctctcccaggtctccctggtcatccgccccgggcagcggctcctgctcaccggtcccagcgggtccgggaagagctccctgctggcgctgctgctccgcttcgtcgaacccacggaaggcgccatcctcgtggaacgccccggcgggacggggagtgcgccgctcagccacatccccgccgacctgtggcggcagctcatcgcctgggtgccccagcacccctacctgttcgacaccacggtcctcgagaacatccggctcggcaaacccgaggcgagcgtcgccgaagtgcggcgcgccgcggaactcgcggaagcacacgacttcatctccaccttgccgttgggctacggcacccggctcggagagcgtggcacgcgcctgtccgcgggacaacgccagcggatcgccttggcccgcgctttcctgcgcgacgcgccgatcgtgctgctggacgagcccaccgcccacctcgacccggaccatgccgctgcggtccgccgcgcggtcgcccgcctcctggagggccgcaccggagtcatcgtcgcgcacgacaccggatggtcggaactggtggacgagaccgtgcaccttgctggcggtcggatcggagccccactatgaaccttcccgcaccgaaacctgcctgtcggccactgctgcggatgatcgcgctggcccgcccgcgcaccacccggttcgtgctgggagtgctgctgggggcgctggccaccggtgcgggcgtcggcctgttgagcgtgtccgcgtggctgctggccaccgcggccacgcacccgccgatcaccgcgctcggggtcgccgtggtcgccacccgggccctgggcgtgacccggggggtggcccgctacttggaacgcctcgtcacccacgatgcggcgttccgcacgctcgccgaggtgcgtgtgcgggtctacgagcggctggcccgcagcgaacccgtgcgccgcttccgctccggtgacctggtgtcgcggctcgtcaacgacaccgacgccacccaggacctgctggtgcgcggcctcaccccgccgctgtccgccctcgccgtcggcagcgcagtcgtcctgttgagcactgtgctgttcgtgcccggcggactgctgctcgctgccgggctgctcctcggcgggctggcggtgccgctgttcgcggccgcgctgggccgcacgtcggggcgccaccaggccgcagcgcggggagaactctccagcgccctcgtcgacacgctctacggggccccggacctggtggcctatggggctatggagcaggcggtgcgccgcgtggagcgggccgacgccgaactcacccgcctggcgcggcgggacgccgcggtgctgggcctcggcacgggtgccagcgcgctcgtggcagggctgacagtgtgggccactctgctgctgggcgtcgcagcggtcgcgggaggcaccctggacgcgatcgcgttcgcggtcgtggtgctgaccgcgctggctgctttcgaaatcgtcgcgcccctgcccgcagtcgccgcgaaactcgaggcgatccgcacggcaggcgcccgcctgttcgacgtgctcgacaccgaacccgaagtgaaagccgcggccgctcccgaacagtctgggctgcccgaccaggcggccaccctccgggtgcgggacctgcgcgtccgctacggtcccgacgagccgtgggcactggacggcgtggacctcgaccttgctccgggcaagcggatcgcggtgctggggccgagcggatcaggaaagagcactctggcttcggtgctgttccggttccgcgacccggatgcgggcacggtgaccctcgacggtgccgacatcaccgactaccccgtggacgaggtgcgccgcctcatcagcggggtgccccaggacccgcacattttcgcgagcacgctgcgcgagaacctgcggttggcccggcccggcgcggacgatgcggaactgtgggcggcccttgagcgggcccggctggccgacgacatccgcgcgaccatgcctgacgggttggacaccgaggtcggcgcgcacggggcccggctcagcgggggcatgcggcagcggctggccctggcccgggcactgctggcgcagccccgcatcctggtgctggacgagcccaccgcgcatctggacccggacacccgggatgcggtcctcgacgacctgctggcggcgtccgcgggctatgccacgctcctcatcacccacgacctggcgcggctggaggagatggacgagatctatgtgatcgtcgacggccgggtggtgcagcgcggctcccacgacgaactgctggcggagaaaggctggtaccgcaac

SEQ ID NO: 32005 - DNA, 1125 bp, Thermobifida fusca
ccggtataccgcgcctccacctacgcttttgcgacctcccgcgactatgccgcgagcctgaccggcgatgggcagtacgcctatgcgcgcatcgactcccccaacagcgacgcgttcgccgcggcagtcgccgccctcgaaggagcacacctggagggtgaagtccacgggcaggggttcgcctccggcatggccgcgatcagcatcaccctgctggccctcacccatgccggagcccacgttgtagcctcccgcgccctctacggcaacacctacaaactgctggacgtcgtgttgcgccggttcggggtggccgtggacttcgtggacatcaccgatccggccgcggtgcgcgctgcgttccgccccgagacggtgctcgtctacaccgagacgctggccaatccgaccatgaccgtgtcggacctgcccgtgctcgccgcgctcgcccacgaggcgggggcgctgctcgtggtggactccactttcgcctcccccgtggtgtgccgtcccctggagcacggcgccgacatcgtgctgcattcggccaccaaataccttggcgggcactcggacgcgaccgggggagtggcggtgggccgccccgacctgctggcccgtatccgtgaagcccgcatcgacttggggccgcacctggccgccgatgaggcgttcctgctccaccgcggtttggagaccctgccgctgcgcatggcccgccagtgcgcgaccgcagccgagttcgccgctgctctcgccgagcacccggccgtggcccgcgtcgaccatccgagcctgcccacccaccaggggcacgtactggcccggaaactcttcgacaccgggcctgaaggcccccgctacggcgcggtcgtcacggtcaccccgcgcgggggccgggaagcgggcatcgcgttcgcggaccggctccgcctggcgacgatcgccccctccctgggcgggacccacaccgtcgtcagccacgtcgcctccactacccaccggcagatgagcgacgaggccctgcacgcagccgggatcgacccgggagcagtgcggttctccatcggcgtggaagaccctgccgacctgatcgccgatgcccggcaggccctcgacggactg

SEQ ID NO: 32006 - DNA, 1002 bp, Thermobifida fusca
cgcgaagtgaccaaagtggcggtgctcggcagcggttcgtggggaacagccttcgcgaacgtggtggccgatgcgggaatcgcggagacagtcctgtggggccgacggcccgaaatcgtcgaggcgatcaacacgaaacacgagaaccccgactacctgccagggatcaccctcaacccccggctgaccgctacgaccgacgtggccgaggcgatggcgggcgccgacttcacggtgatcgccgtcccggcgcagacgctccgcacgaacctggccgcctggtctgaggcactggaccccggcacggttgtcgtcagcctgatgaaggggatcgaggtcggcacctgcctccggatgagcgaagtcatcgcggaggtgctggaactccccgaccaccgcatcgcggtgctgtccggccccaacctggcgcgggagatcgcggaacggcagcccgccaccgccgtggtcgcctgcacggacgagcagactgctgtccgtttgcagcacctgtgcaagtccccctacttccgcccctacaccaacaccgacgtcatcggcgtggagctggggggagcggtcaagaacgtcattgcgctggcggtgggcgtggccgtgggcatgggtttcggggacaacgccaaggctgcgctgatcacccggggcctggcggagacggtgcggctcgcggtggcgctcggcgccgacgagcacacgcttgccgggctggccggcctgggggacctggtggccacgtgcagctctccgctgtcccgcaaccgcacattcggggagaagctgggctccgggatgaccgtggacgaggtgatcgcggagacgaagcagaccgcggaaggcgtcaagtcctccacgtcgatcctggagctggcgcgcgcccacggcgtagagatgccgatcaccgaggcggtggtagcgatgatgtaccacggcctgccgcccgctgaggcgctgctggcgttcatgtcccgcagcgccaaaccggaa

SEQ ID NO: 32007 - DNA, 987 bp, Thermobifida fusca
gcccacggagacgacagcatctgcgcggtctccgcccgcggccaccgggtgcgcttcgccgacggacgcgaactgctgtgcggggcgagcgggctgtggaacgccaacctcggctacgggaacccggcgatcgcgcaagcagtagcccaagccctccacgacgcctcctacctgagcgccttccggtacgagaacgtctacgcccgccgcgccgccgccgacctgatcgaggtgagcggacccgagcactactcccgggtcctgttctcctcctccggtggcgccgccaacgacgcggccatgaaagtggcccggcactaccacgccctcctcggccgcacccgccgctccctcgtcgtcagcctgcgaggcagctaccacggcctcaccttcggcggcttcgcgctcaccggcgaagacctggggcagcggctctacggggtcgaccagcggctggtccgccacgtgcggcccaacgacaccgctgaactgaacgccctggtctcccgcgccgccaagcagatcgccgccgtggtcgtcgaaccggtcgtaggcacgggaacgatccccctcactgacgagtacgtggcggaactcctgcggctgcgtgccgagcacggcttcctcctcatcgccgacgaggtggccaccgggttcggccggaccggcagcttctttgcctcccagcgctggccggaacagcctgacctgctgatcacttcgaaagggctcaccaacggcacctgcccggcctcggccgtcatcgtctcccagcgtgtcgcggacgccttcaccgaacacgacgcggtgctctcccacgccgagacccaaggcgccacccccctcacctgtgcggcgatcagcgcaaccatcgctgaaatgcgccgactggacgctgtcgccgcaggccaagcgctcggcgaaaaactgggtgccggtatcgcggagctcatggcagaaatgccgcagatcatcggcaccaccggg

SEQ ID NO: 32008 - DNA, 1422 bp, Thermobifida fusca
gacaaggcacagatcctcgtcgcttccaacaggggacccgtgtccttctcaatcggggacgacggcgccgtgaaatcccggcgcggcggtggcggcctggtttccggactgagttcggtagccaccgagatcgaaaccctgtgggtgtgcgccgcgttgtccgacgctgaccgcaaagccgccgcagcagcccccgaagggcggctggacaaggccggatacgacgtgggcggggcgagtgtacgcatgctcaacattcccgccgacgtcttcaacaatgcctacaactctgtggcgaactccacactgtggtttgttcaccacatgctctacgacacccccaacaagccgtcgttcggctcccgtttccgcgccgagtgggaggactaccgggcctacaactctgctttcgcggaagcactgctgaccggcgcggacgagggggcgaaggtcgccgtccaggactaccacctggcgctggtaccgaaaatgctccgggtacgccgccccgacctgcgcatcgcccacttctcccacaccccttgggctccccccgagtacttccggatgcttcccgcggacatcggccgggaactcctcgaaggcatgctcggcgccgaccacttgggcttcctcagcgtgcgctgggccgacgcgttcctgcggtgctgcgaagtgttcctgcgcgccccggtgaactggggcacccgcacggtcgagcatggcggccgggtcatccgtgtcggagtccacggcctgggcgcagacgcccaagggctgcgggagcgggccgccgccgaagatgtggcgcgctggcgggaacggctgcgggaacgggtcggcgaccgcaagctgatcgtgcgagtggaccgcaccgaactgtccaagaacatcgtgcgcggcctggaagccttcggtgaactgctgcggaagcgccccgaatggcggaaccgggtcacccacttggcgttcgcataccccagccgcagcggtgtcgcggagtaccgcgcctacaccgagtcggtgcgggccacggccgaagcgatcaacgccgagttcggcaccgacgactggacccccgtggtgctggaggtcaacgacgactacccccgctccctcgcctcctaccagatcgctgacgtgctgctggtcaacccgatccgcgacgggatgaacctggtcgcaaaggaagggccggtgctgtcgctcaacggcgtagcgctcgtgctgtccactgaggcgggcgctgccgacgacctgggcgccgacgcgatcctcgtcaacccctacgacgtgtcggagaccgccgaggcgctgcaccgggcgctgaccatggacgaagaggagcgacggcagcgcacggaacgtctggcggaggccgctgccgccctgcccccgcagcggtggttcaccgaccagctg

SEQ ID NO: 32009 - DNA, 1728 bp, Thermobifida fusca
ggtcgtgacatccggcagacgggtgccggatcggcgcgaccatccgtcgcgggcgtcggctcgttccctcgcgtatcagcccggtctcgggaggactagaactctatggcagccaaactgatcgcgtttgacgaggaagcccggcgcggcctcgagcgcggtatgaaccagctcgcggacgctgtcaaggtgacgctcggccccaagggccgcaacgtcgtccttgagaagaagtggggcgcgccgaccattaccaacgacggtgtctccatcgctaaggagatcgagctcgaggacccctacgagaagatcggcgccgagctggtcaaggaggtcgccaagaagaccgacgacgtggccggtgacggtaccaccaccgccaccgtgctggcccaggccctggtccgcgagggtctgcgcaacgtagccgctggtgccaaccccatcggcctgaagcgcggtatcgacgccgccgtggcccgcatcagcgaggagctggcgaacctctccaaggaagtcgagaccaaggagcagatcgcttccaccgcctccatctccgcgggcgacccgcagatcggcgagtacatcgccgaggcgatggacaaggtcggcaaggaaggcgtcatcactgtcgaagagggccagaccttcggcctggagctggagctcgccgagggtatgcgcttcgacaagggctacatctcgccctacttcgccaccgacctggagcgcatggagacggtcctcgaggacccctacatcctcatcgccaaccagaagatctccaacaacaacgagttccttccggtcattgagaaggttctgcaggccggccgcccgctggtcgtcatcgccgaggacgtcgagggcaccgcgctgcagaccctggtggtcaacaagatccgcggtaccttcaagtccgtcgcgatcaaggcccccggcttcggtgaccgccgcaaggccatgctgcaggacatcgcgatcctgaccggcggccaggtcatcaccgaggaagtcggcctcaagctggagaacaccgagctggacatgctcggccgggcccgcaaggtcgtcgtcaccaaggacgagaccacgatcgtcgacggtgctggcgacgccagcgcgatcgctggccgggtcaacgagatccgcgccgagatcgagcgcaccgactccgactacgaccgcgagaagctgcaggagcgcctggcccgcctggcgggcggtgtggctgtcatcaaggccggcgccgccaccgaggtggagctcaaggagcgcaagcaccgcatcgaggacgcggtccgcaacgccaaggccgcggtggaggagggcatcctgcccggcggtggtgtcgcgctgctgcaggccagcatcgctgctttcgagaagcttgagctggagggcgacgaggccatcggtgccagcatcgtccgccgcgctgttgaggagccgctgaagcagatcgcgatcaacgccggctacgagggcggcgttgtcgtggagaaggtgaagagcctggagcccggtatcggcctgaacgcggccaccggcgagtacaccgacctgttcaaggacggtgtcatcgacccgaccaaggtcacccgctccgcgctgcagaacgctgcctccatcgctggtctgttcctgaccaccgaggccgtcatcgccgagaagccggagaagccggccgcgaacaacgctggcggcgacatgggcggaatggacttc

SEQ ID NO: 32010 - DNA, 1107 bp, Thermobifida fusca
atccacattccagagaaccttctgcccggcgacggccgtttcggctgtggcccgtccaaagtccgtcctgaacaggtgaccgccctggcctcctctggtgccacctatctcggcacctcgcaccgccagaagccggtgaagtcgctcgtcggcagggtgcgttccggactggccgaactgttctctctcccggacggctacgaagtggtgctgggtaacggcggcaccaccgccttctgggacatcgccgcgcacaccctggtgcgccgcaaatcccagcacgtgtcgttcggcgagttctcgtccaaattcgccaaggtcactcaaggtgcgccgtggctcgacgagcccaccgtcatcaccgcggagccgggctcctacgccccgccgcgcgcggaagccggcgtggacgtctacgcgctcacccacaacgagacctccaccggtgtggccacgccgatcgagcggatcgcaggcgctgacgaggacgcgctcgtgctggtggacgccaccagcggcgcaggcgggctgcccgtggacatcacccagacggacgtctactacttcgctccgcagaaatgctttgcggcggacggcggactgtggatcgcgatcatgtcgccgcgcgccttggagcggatggccgagatcgcggccaccgaccgctacattccggcgttcttctccctgacgaccgcggtcgacaactcccgtaaggaccagacctacaacactccggccgtgtccacgctgctgctgttcgcggagcagatcgaatggctcaacaagcagggcggcttggagtgggcggcccgccgcaccgcggaatcgtcgtcgatcctgtacagctgggcggagaagtccgagtacgccacgccgttcgtcgctgatcccgcgctccgttcccaggtggtgggtacgatcgacttcagtgacgaggtggacgccgccaaggtcgccgcggtgctccgcgccaacggcgtcgtcgacaccgaaccgtaccgcaagctcggccgcaaccagctgcgtatcggcatgttcccggctgtcgaaccggaggacgtgcgcgcgctgaccgagtgcatcgactacgtggtcggcaagctc

SEQ ID NO: 32011 - DNA, 1134 bp, Thermobifida fusca
gaggcatacatcgtcggagcggtgcgcaccccgatcgggaccaggaagggggcgctcgctgcggtgcacccggccgacctgggcgcccacgtgctcaaagaactggtgaaccggaccgggatcgacccggccgcggtcgaggacgtgatcatgggctgcgtcacccaggtggggccgcaggcactcgacctggcccgcaccgcatggctttctgccggactcccggagagtacgccgggggtcaccatcgaccgccagtgcggttcctcccagcaggccgtgcactttgcggcgcaaggggtcatgtccggcacccaagacctggtgatcgcggcgggtgtggagaacatgggcatggtccccatgggcgccaacgtgcagttcgccgtggacaacgggttgtccgtctacgggcagggctgggtcgaacggtacggcacccaggagatctcccagttccgcggggcccaactgatgtgtgaaaagtgggggtacacccgcgaggacttggagaagtacgcgctggaaagccaccgtcgggctgccgcggcgatcgaagcgggctacttcgacgcggagactgccccgctggccggggtcacccacgacgagggggtgcgccccgacacgtcgctggagaagatggccgagctcgcaccgctccgcgaaggctgggcgttgaccgcggccgtctccagccagatttcggtgggggcgagcgccctgctcatcgcgtcggagcgggccgtggccgagcacgggctcacccccttggcgcggatcgtgcaactggctttggccggggacgacccggtgtacatgctcaccgcgccgatccccgccactcggatcgcgctgcgcaaggccgggctggacatcgacgacatcgacgtggtcgagatcaacgaggcgttcgccccggtccccatggcgtggatcgacgaaatcggcgccgacccggcgaaggtcaaccccaacggcggtgcgatcgccctgggccacccgctgggggccaccggcgccgtgctcatgaccaagctcgtccacgaactgcgccgcacgggcggccgctacgggctgcagaccatgtgcgagggcgggggacaggccaacgtcaccatcatcgaacgggtg

SEQ ID NO: 32012 - DNA, 786 bp, Thermobifida fusca
gtgcgattggcgacgtggaatgtgaacagcgttcgggcgcgtagtgagcggatcgctgcctggctgcgcaggagcgacgtggacgtggtcgctctccaggaaacgaaatgccgggacgatcagttccccaccgcggtcttcaccgagctcggctatgaggtagcccaccacgggctgtcccagtggaacggtgtggcgatcgcctcccgggtggggctcagcgacgtgcagatcggcttccccggccagcccgggtggggggaaccggaggaggcggaggcccgcgcgatcagcgccgtctgcgggggagtgcgggtgtggagcctgtacgtgcccaacggccgggaaatcgaccacccgcactacacctacaaactgcagtggctggcccggctccgcgaagccggggaggcgtggctttccgaggacccgaaagcgcagatcgcgctgtgcggggactggaacatcgccccctacgatgaggacgtgtgggacatggcggagttcgaaggccgcacccatgtcactaagccggagcgggacgctttccacgccgtagtggacgccggtttcaccgacgtggtacggccgcatgcgcccggccccggggtctacacctactgggactacaaaggactggcgttcccgaagcgcaaagggatgcgcatcgacttcatcctggcctcccccgcgctcgccgagcgggccacggacgcgaagatcgaccgcgaggaacgcaaaggcaaaggcgcgtccgatcacgcccctgtcatcgctgattttcag

SEQ ID NO: 32013 - DNA, 855 bp, Thermobifida fusca
atcgcagtcttcggcagcgtcaacatggacctggtggcctacgtggacaccccgcccgcccggggggagaccgtccagggacggcagttcagccaggttcctggcggcaagggcgccaaccaggcgatcgccgcagcacgggccggggcggacgtggtcttcctgggcgcggtgggcgacgacgttttcggccctcaactgcgcgccaccctggtcgacaacggcatcgacgtctccgggctgcgcacagtcgggggcgcttccggaatcgcccacatcgtcgtggaccgggaggggaacaactcgatcatcgtcatcccgggtgctaacggcacggtcaccgggctgcgggagaacgacaccctgctgttggacggcgcccaggcgctgctgctgcagttggagacgccgctgtccggggtgattgcggcggctcgggcgggtcgttcactcggggtgaccacggtactgacgcctgccccggcgcagccgctcccccaggagctgttggagtgcgtcgacgtcctcctgcccaaccagtacgaggcagcgacgatcaccggcgaggacaccccggagcgggcactggccgcgctcttggagaccgtgcccgaggtgatcatcacgttgggcagcaggggtgcgctctacggggcccgggaccgcgaacccctgtgggtcccggtggtccaggtggaggccgtcgacacgaccggggcaggggacacgttctgcggggcgtatgcggtggctcggaccgagggccaggacccggagtcggcgctgcggttcgccgcgaaagcggccgctttgtcggtgcggattcctggggcgagcacgtcgatgcctacccgg

SEQ ID NO: 32014 - DNA, 1350 bp, Thermobifida fusca
gactttcaacaggcggcaaaagaccacctgtggatgcacttcaccgagctcgcggcataccaggacaccgacgtcccggtcatcacgcgaggtgaagggccctacgtctacgacactaacggcaaacggtacctggacggtctcgccggcctgttcgtctctcaagtcggccacggccgcaccgagatcgccgaggcgatcgcggaacagtcccggaaactggcctacttcccgatctggacttacgcccacccgaccgccatcgagctggctgaccgcctcgccgacctggcgccgggagacctcaaccgggtctttttcaccaccagcggttccgaagccgtggagtcggcctggaagctggcccgccagtacttcaaactcatcggccagcccacccggcacaaggtgatcagccgccgtatcgcctaccacggcacgaccatgggcgccctgtcgatcaccggcctccaagcgatcaaaaccccgttcgagccgctggtgccgagcacgatccaggtgcccaacaccaacatctaccgggccccggtccacggcgacgaccccgaagcgttcggccgctgggctgctgaccaggtggaagaagccatcctgcagaacgacccggagagcatcgcagcggtctacgtcgagccggtgcagaactcgggcggctgcttcccgccacctcccggctacttccagcggctccgtgagatctgcgaccgctacggtgtccttctcgtctctgacgaggtcatctgcgcgttcggccgggtcggcgcgtacttcggcgcccagcggttcgactacctgccggacatcatcaccttcgccaagggtgtgacctcgggttatgtgccgatgggcggtcttatcgcccgggagcacctggtggaaccgttccgggaggcgggcaacaccttcctgcacggcagcaccttcgctggccacccggtggcggccgcggccgccctggccaacctggacatcttcgaacgcgaaggcctcatcgaccacgtgcaggccaacgcgccggcgttccgtgcgaccctggagaagctgctcgacctgccgatcgtgggcgacgtgcgcggcgagggctacttctacgggatcgaactggtcaaggacaaggagaccaaggagaccttcaccgacgaggaagcgcaccgcctcctcaagggcttcctctcccccgcactgttcgacgccggcctggtgtgccgcgccgatgaccgcggagagcccgtcgtccagctctccccgcccctgatctgcggccccgagcacttcgctgagatggagagcatcctgcgcgaggtcctcactgaggcctggcagcggatc

SEQ ID NO: 32015 - DNA, 1404 bp, Thermobifida fusca
ttcatcaatggtgagtacgtagactccgtcgacggccgaaccgcaccggtcgtcaacccagccacgggtgaggcctacgccgaagcaccggtgtccacggcagaagacgtggaccgggccttccgtgccgccgccgacgccttcgagaacgggtggcgcgactccacccccgccgaacggcagatcatcctgaacaagatcgccgacgcagtggaggaacgcgccgacgagcttgtcgccgccgaagtcgagaactgcggaaagcctgtcaaggccacgcgcgaggaagagatctggcaggtcaccgacgcgctgcggttcttcgctggtgcggcacgggtgctggagggcaaggcggccggcgagtacatggccgaccacacctcctggatccgccgcgaacccatcggcgtcgtcggccagatcactccctggaactatccgatggcgatggccgcgtggaagatcggaccggcgctcgctgcgggcaacaccatcgtcctcaagccgtccgacaccacgcccgtctccactctgctgctcgccgagatcgccgcagaattcctgccgcccggcgtgttcaacgtcgtcactggtgaccgcgacaccgggcgcgccctcgtcgaccacccgatcccgcggctcgtctcgctcaccgggtccacccgcgccggatacgaggtcgcccagtccgcatcccgcgacctcaagcggctccacctggagctgggcggcaaagccccggtgatcgtcttcgacgacgcggacgtcgagaaggccgccgaaggcatcgccggagccgggtacttcaacgcgggacaggactgcactgctgccacccgcgtgctggccgcccccggcatccacgacgacctggccgcggcacttgctgaacaggcgaagaagaccaagaccgccggcccggacgagaccgacgcttactacggtccgctgaacaaccccaaccagttggaccgggtcagcggcttcttcgagcgcctccccgaccacgccgaagtgctcaccggcggttccgccgtggaccgtcccggctacttcttctcgcccacggtcgtgtccaacctgcgccaaggcgacgagatggtctccgaagagatcttcgggccggtcatcacggtccagcgcttcgacgacgaggacacggcggtcgcgtgggccaactcagtaaagtacggactggcatccagtgtgtggaccaaggaccacgcgcgcgctctgcgggtctcccgtcgcctcgacttcggatgcgtgtggatcaacacgcacatcccgatcatcgcggagatgccgcacggaggcttcaagcactccggatacggtaaggacctgtccctttacagcctggaagagtacacgcgcatcaagcacgtgatgagctacatc

SEQ ID NO: 32016 - DNA, 972 bp, Thermobifida fusca
aaccgcagcgtcgccatccacgtgagcgacctccaccagtcctacggcagtttcgaagctgtccggggcgtctcgttcacggtcgcccccggcgaactgttcgccctcttgggcaccaacggagcagggaaaaccaccacgatcgaaaccctcgaaggcttccgccgccccactcgcgggtcggtgcggatcttcgggatcgacccgttcggccagcctccggagctgcgtccccgggtcaacgcggtcctccagcacagtggactgttcgaagagctcaccgtcacggagagcatcgaactggcccgggacctggcggacgaccccatggacaccgccgaagtgctggaggccgtggtgctggccgacaaagcccggaacacggtccgctcgctgtccggtggagaacggcgccgcctcgacctggggctagcgattctcacccgccccgacgtgctcttcctcgacgagcccaccaccggcatggacccggaaatgcgccgggaaacctggaagatcatcagcagccaggtggcgcgcggcgcagctgtcgtactcaccacgcactacctggaggaagcagaacggctcgccgaccggctcgccatcatgcaccgcggggaaatccgggtctcgggcacggtcagcgaagtggtctcccagtggggcgaccggatcagcttccgtctgccctcccacatccgctcccgggaactgccggagctccccggggctgaactcaccatcgacgtccgcggcgaccaccagtgggcggtgtacacggtcaccaccggcactgaccccgcgacccgcacccaccacgcactcctccccctcctgaagtgggcagaagagcgctctttggaccttgaacggctggagtcccgtcccgcctccctcgaagacgtgttcctcgccgtcgcgcaaggagacgtcaccgacctggtggacctctgacccgaccgtcccatg

SEQ ID NO: 32017 - DNA, 1188 bp, Thermobifida fusca
gtgaagatcgctctgattgccacccatgccaccccgattcccgcacacaagggtgaccccaccgacagcgaaagcctgtacctatgccatctggcccggaacctggccgccctaggccaccgggtgaccatccacacccgatgcactgacccgcagaccagcgaacgcacccgcatgggacgcagcgtcgtcgtggcgcccattgtcgccggaccgcggcgccccctgcgtgaacaggagtacatcgaacacaccgggaccttcgcccgcagactgaccgagcagttgcgcgccgaccctcccgatatcatccacgcgttcgggtggagcagcggattagccgcgctcgccgcggtccgcgacctggaacgcgacatcccggtcgtccaaaccttccactccttgaacgtcagcgagcagcgggtgggcctgcccgccaacccgcagcgggtccgattggaggccgcgctcgcacaccacgccaaagcggttctcgtcaactccgctgaccagcgcttcgaactcgcccggatgggcgtgccgcgcagccgcgtgtgcatcgtccccttcggcgtggacaccgaccagttcaccgtcgaaggtgccgcgcacgggccgtggcagcggcgccgctccgcagctgggcggccgctgcggatcatcgcggtcacccgcctggacccactcggcggcgtggacacgctgatcaggacgatggcgcgcctcccggacggggaactgctcatcgtcggcgaccctgcacccgagcacctcgcgatcgacccgaacgcccaacgcctggaacggcatgccaaggaggcgggcgtcaacgaccaggtcacgctcaccggagcggtcacccgccgggacctggcccggatgctgcggtcggccgacgtgttcgtctccaccgccttctacgacccctacggcagtgccgtcctcgaagccatggcctgcggcctcccggtcgtggcccgcgccgtgggcggcatcaccggggccatgctcgacggcaccaccggggtgctcctccgttccgcccaccccagcaccctcgcccacgtcctgcggcaattggctgccgacaccacccagcgcaccgcctacgggattgccggtgctgaccgcgctgcgtcccgcttcacctgggcccgagttgccgcggagaccgaacggatctaccag

SEQ ID NO: 32018 - DNA, 1272 bp, Thermobifida fusca
ctgaaacggagacaaaggagatccgcgatggaaaccttctcccgactcgagtccgaagtccgcagctactgccggggatggcccaccctcttcacccgggcacgcggcagccgcgtctacgaccacaccggccgcggctacctcgacttcttcgccggagccggagcgctcaactacggccacaacaatccgacactcaaaaccgcgctgctggactacctcggcagcgactcgatcgtccacagcctggacgccgccaccaccgctaaacgcgacttcctcgacaccttcgaggaggtgatcctcaaaccccgcggcctggactacaaagtgcagttccccggaccgacgggcaccaacgcggtcgaggccgccctcaaactcgcccgcaaagtcaccggccgggagacggtgatcagcttcaccaacagcttccacggcatgacgctgggcgcgctcgcggtgactggcaactccatgaagcgcggaggggcgggagtgcccctcaaccacaccgtcaccatgcccttcgacaactacatggacgggcaggtccccgacttcctgtggctccgcagcctgctggaagacagcggcagcggcctggaccggcccgccgccgtcatcgtggagacggtgcagggcgaaggcgggatcaacgtggccagagcggactggctgcgcggcctggcggagctgtgccgggagcacgaactgctgctcatcgtcgacgacatccagatgggctgcggccggaccggtcccttcttcagcttcgaggaagccgggatcgtgccggacatcgtcaccttgtcgaagtcgatcagcggctacggcctgcccatggcgctgaccctgttcaaacgggaactggacgtgtgggagcccggagagcacaacggtacgttccgcgggttcaacccggctttcctcaccgccaccgtggcgctcaacacctactggcgcgacgactccctcgagcgggagaccctggccaaggggcagctcatcaccgagcggctcgaggcgatcgctgccgagcatgcggaggccggggcgagcgtccgcggccgcggcatggcctgcggcctggtgctgccgggtgaaggcgacgcgcggcgggtgtgcgccgaagcgttcgaacgcggtctgctcatggagacgtccgggcccgaggacgaggtggccaaactgctgcctccgctcactacttccgtcgccgaaatggaggaagggctggacatcctcgccgagtcggtgcgtgctgcggtt

SEQ ID NO: 32019 - DNA, 1140 bp, Thermobifida fusca
gaccgctgccccggcgtgctgcgtccccatttcgcagccgacggcgctctgctgcgtattcgtattcccggggggcatattagccgtcgcgggatagccacgcttagccagatcaccgcaaaattcggcgacggtaatctccatttaacttcacgtggaaacgtgcaaatcagagggattcccgtcacagatgatcaacagattcccaacgaattacctcatattgtggcagcatccggattcctgccttcatctacccatgatcgggtacgcaatattgtcgcttctcccctttccggaataatcggtggcagaatggatgttcgccccctcgtctccgctctagaccgggcactgtgcactgatccacgactggcagagctgcccggacggttccttttcggtcttgatgacggccgcggcgatctcgctggaatgcctatcgacttaggaatttacgcgatcgacgaacggtcggcacaaatacgtgtcggcaccttttcagggcctgtgatttcatctacagaaatcgttgatataatccttgatctcgctcaccgttttctcgatataagcgagggaaaatggaatgtcgttcagctaccaaaaaaaggacgagaactactcaacaacgtcgagttttccaattttttacgccatacaaaaagcggcgatcgctggagcgttgaacggtttcgaagaaacatccttcacggaattatcaccatttccaccgctgaatccgctgtggcgggttcagtgccgctaggcgttctcaccccgcccatgcagcgggctctcttggatgcagcggagcacagcgacagcacgatcatcctcaccccgtggcggggagtgatcgtcacccctgtccccaccgaccaggccagcaacgtcgcagctttgctccaggaagccgggctggtcctcgacccggcatcgccgtggagccggatcagcgcctgcatcggctcccccggctgtgctcgcagccgtggcgacacccggtctcaagccgtcaagctcgtccgccgcctatcctcccccgacacatccgacgacggatccccctaccacatcgccgggtgcgaacgcgcctgcggtgccccgcacaccccgcacaccctcgtccttctcggg

SEQ ID NO: 32020 - DNA, 3609 bp, Thermobifida fusca
ccgatgcctcgcatagcactgctttccacctcggacaccgacctgctgtcggcacgtgccagcggcgcaaactacgtctggggcaacccgtcgcgtctcgacgtcaccggaacagatcccggttcgctccacgccctgcttcacggcgctgacctggtaattgtgcgcattctggggtctgcgcgctcgtggcaggagggcctcgaccaggttttaacccatggcgtccccgttgtggtgctgggcggagagcagaccccggacgcggagctgatgagccattccaccgtacccgtcgggatcgctgctgaagcccaccgctatctggcccacggggggcccgacaacctcgctgcgctgcatgccttcctcagcagcaccgtgctgctgaccggtgggagttttgatccgccgacagaactgcccgaatggggcctgcttgagcggtccacgccaccacaggcggaccgggacgggctgccgaggattggcatcctctactaccgcgcccaccaggccagcgggaatactcgtttcgtccacgacctggctgacgcggtcgacgctaccggcgaagcggtcgccgtccccatctactgcacgtcgctgcgcagcgcatccccggaactcctcgcggagctcggcaccctggatgcgctggtcgtcaccgtgctcgccgcgggaggaacccgcccggccacagccagtgctggaggcgacgacgaggcgtgggacgttggtgaactagcgcgactcgacattccgatcctgcaggcgctctgcctgacgtgggggcgtgatcagtggaaggcttccgacgaggggacgtcccccctcgactctgcatcccagatcgccgtccccgaattcgacgggcgcatcatcaccgtgccgttctccttcaaggagttcgacgacgaaggactgccccactacgtcaccgatgcggaacggtgccgccgagtagccgacatcgccgtcgctcatgcccggctgcggcacatcccacccgcccagcgccgggtcgcgatcgtgctgtcggcctaccccaccaagcattcccgagtcggcaacgccgtgggcctggacacccccgtctccgcggtgcggttgctgcgggccatgcgggacgccggatacgacctgggagacgggtttcccggtgtggacctggcggacgagaccgaagcgggtaacaccctcatccacgccctcatcgaagccggtggacaggacgaggagtggctgaccgccgaacagttagcgggaaatccggtgcgcatcccggccgaacgctaccgggagtggatcgccgacctgcccggtgaactgattgacgcggtgaacgagcactggggagagccgcccggcacgcttttcgtcgacaacggcgacatcgtgctcgctaccctccaggcaggcaacgtggtgctcatgatccagccgccgcgtggtttcggagagaacccggtggcgatctaccacgaccccgacctgccgccgtcccaccactacctcgccgcataccggtggctggaatgcggcttcggcgcccacgccatcgtccacctcggcaaacacggctccctggagtggctgcccggcaagaacgccgcactgtccgcggcgtgcgccaccgatgccgcactcggcgcggtgccgctcatctaccccttcctcgtcaacgacccgggtgaaggggcgcaggctaagcggcgggcccacgcgacgatcatcgaccatcttgtgcccccgatggcacgcgccgagtcttacggcgacatcgcccggctggagcagctcctcgacgagcacgccaacatcgccgcgatggatccggcgaagcttcccgcgatccgggcgcagatctggactctcatccaggccgccaaactcgaccgtgacctggggctgtccgagcggccgcatgacgcggaattcgacgacttcctgctgcacgtcgacggctggctgtgcgaagtcaaagactctcaaatccgcgacggactgcacgtgctaggtggggcgcctgtcggcgaggcccgcgtcaacctggtgctggccatcctgcgtgctgtccaagtgtggggtgggcaggccggtgctgtgcctggactgcgccgtgctctcggcctggcgggagacaccggaaaccgggcggaggttgacgccgtcgaagcccgggcccgcgccctggtcgaggccatggaggaagccggctgggatccggaacaggcacaggtcgtggcggaccggctcggcgagaccgctccggacgtggtccgggtgctccggtttgcggccgagcacgtcattccacggctcgcagacacccgtcaagaaatcaccgcggtactccatgccctcaacggcggcttcgttcccgccggaccgtcgggatcgccgctgcgtggcctggttaacgtactgcccaccggccgcaacttttacaccgtcgacccccgggccatcccgagccagctcgcctacgagaccgggaaagcattggctgacgcgcttattgaacgctaccgcgccgaaaccggcgagtatccgcgttcggtggggctatcagtatggggaacctcagctatgcgtacctctggagacgacatcgctgaggtgctcgctctcctcggggtgcgccccgaatgggacgaggtgtcccgccgggtgcgggagctgagcgtcatcccgctgcccgagttgggacgcccacgcatcgacgtcaccgtccgcatctccgggttcttccgagacgccttccctcacgcggtcgccatgctcgacgacgccgtccgcatggtggcggaactcgacgaaccggacgacgctaactacgtgcgggctcacgtccgcagcgacctcgcggaacacggtgaccgtgaacgcgcgctgcggcgcatcttcggttccgcccccggtgcctacggggcaggcctgctccagctgatcgactctggtgactggcgtagcgacgctgatctcgccgaggtctacaccgcgtggggcggtttcgcctacgggcgcaacctgcacggtgagccttctgcggaagacatgcgtgccaactatcggaggatcgcggtagccgcgaagaatacggacacccgcgagcacgacatcgccgactcggacgactacttccaataccacggcggcatggtcgccaccgtgcgcgccctcaccggcgtcgagccgaaggcctacatcggcgattccaccacaccggaccaggtgcgcacccggtcgctgcgggaagagaccgcccgggttttccgtgcccgagtggttaacccccggtggctggcggcgatgcggaaccacggttataagggcgcatttgaactggccgccactgtcgactacctgttcggctacgacgcgaccgcgggggtggtcgacgactggatgtatgagaccctcgcccagacctatgtcctggacaccgagaatcaggagttcctccggcaagcgaacccctgggcgctccagggcattgtggagcggctcaccgaggctgctgatcgtggcctgtggcgggagccccacccacagacaatggaggcgctgcgccgcgtctacctggaagtcgagggagaactggag

SEQ ID NO: 32021 - DNA, 777 bp, Thermobifida fusca
atcctcgcggacgtgcgctggtacctggacgggcgctccggccgccaggcataccgcgacgggcaccttcccggcgcggtgttcgtcgacgtcgacacggacctggccgccccgcccagtcccgcggggggacggcacccacttcccgaccccgctgacttcgccgcggcgctctcccggctgggcattggcgacggcagcgtggtcgtggcctacgacgacgcgggcggctccaccgcggcccgcctcgtgtggatgctgcgcgtcctcggcacgcgtgccgcactgctggacggcggactccaagcgtggccggggccgctcgagacgggtgacgtcaccgccgagccccgcacccgcacccccgtgccgtggcccgcagaccgcgtggtggacaccgacactgtccggcaggaactcggcgaaccgggcaggctcctgctcgacgcgcggaccttcggccggttcaccggggaacagcctgcccccgtggatgcccggcccggccacattcccggggcgcggagcgcaagctggcaggacaacctcgacgacacgggacggttcgccccgcccgacgtcctccaggcccgcttccgcgcgctcggcgtcgacaccgccaccagcgtcaccgtgtactgcggttccggggtaaccgcctgccatgacctgctcgctctggaacacgccggtttccccgacgcccggctctacccagggtcgtggagtgcctggggagctgacgagtccctccccgtgcagaccggcgaatgaccc

SEQ ID NO: 32022 - DNA, 768 bp, Thermobifida fusca
gaccgaaccatcgtcgtcaccggtggcgcgaacgggatcggctacgcgctcgcggaacgcttcctcgccgaaggggcggcccgagtggtcctcgccgacctggacggggagcgcgccgcggccgcagcagccgaactgggggcgcgagcccagggctaccagctcgacgtcaccgacgccgaagcggtagccgcgctcatcgaggaggtcgagcgggacagccctatcgacctgtggtgctctaatgccggggtgaccacgggcggcggcctgggtagcgacgcggactgggaccgcacctggcgggtccacgtcctcgcccacgtgtatgtggcccggctcctgctgccccgcatggtcgagcgcggcggcggacacctgctcatcaccgcatcggccgcgggcctgctcaccaacatcgactcggccccctactcggtgaccaagcacggcgcggtcgccctcgccgaatggctggcgatcctgcacggggacgagggcatcgacatctcgtgcctgtgcccgatgggcgtcaacaccgcgatgaccgccaaagacggcccggacgcggccacccggctcggcggcgactacctcgaacccgaagacgtcgcccagtccgtggtggaagccctcaacgagggccgtttcctcatcctgccgcacccgaaggccgcggtgatggagcagcgccgcgcctccgaccgcgaccgctggctggccggaatgcgccgggccagagccaggctgaagggcggcagcggccgc

SEQ ID NO: 32023 - DNA, 465 bp, Thermobifida fusca
cacaccgttgtggacagtcccctcggcccgctgaccctggtcgccgccgacggcgcactcgtcggcctctaccaggaagaccagcggcaccggcctgccccggactccttcggcgtccccgaccccgcaccgttcaccgaggtcatcgcccaactgacggagtacttctccggtcaacgcaccgtcttcgaccttccgctggccttcaccggcaccccgttccaaaccacggtctggcgtgccctcctggagatcccctacggacagacggtctcctacggcgaactcgcggcccggatcggcaaaccctcggcgtcccgagccgtgggactcgccaacggccgcaacccgatcagcatcatcgtgccctgccaccgggtggtgggctcgtccggctcgctcaccggatacggcggtggcctggcccgcaagcagtggctcctcgcgttagagcagcgccgcgcc

SEQ ID NO: 32024 - DNA, 870 bp, Thermobifida fusca
gtgaccaaagcggtcattcccgtggcaggactggggacgagattcctccccgccactaagtccacgcccaaagagatgctgccgatcgtcgacaagccggcgatccagtacgtagtggaggaggcggtctccgccgggctcaacgacatcctcatgatcaccgggcgcaacaagcgttccatcgaggaccacttcgaccgggcctacgaactggaggaggccctccgcgccaaaggtgacatcgaacggctcaacgcggtgcgccaccccagtgacctcgcccaactgcactacgtgcggcaaggggaaccgcgcggcctggggcacgcggtgctgtgcggcgccgcccacgtgggcaacgagccgttcgcggtcctgctcggcgacgacctcatcggcgcgcgggaaaccctgctgcagcggatgatcgaggtccgccagacctacgggggcagcgtcatcgccctgatggaggtggaacccgaccaggtctcgctgtacgggtgcgccgcgatcgaacccaccgacgagcccgacgtcgtgaccgtcaccgacctcgtcgagaagcctccggcggaccaggcgcccagccgctgggcgatcatcggccgctacatctgcgacccggagatcttcgaagtgctgcgcaagaccccgccgggacgcggcggggagatccagttgaccgacgcgctccgggaactcgcccagcgcagctccaatgggggaggaagggtccacggtgtgcttttccgcggtcaacgcttcgataccgggaacaagcttgactaccttcgcaccgtggtggagttcgcctgtgagagtccggatcttgccaaggagttcgtgccgtggctgcgtgacttcctg

SEQ ID NO: 32025 - DNA, 909 bp, Thermobifida fusca
tccgaactttccgccaactcgacccagcgccgcgctccggagccagagatcctggacgagaagcgctcccgcaccgagcgctacaccatcttcaccttcgtctttgtgccgctcctcgccctagccgccgccgtgcccttcgcctggggatggggactgacctggctcgatgtcgctatcggcgcggtcttctacctcatcggcgggctgggcatcaccgtgggctaccaccgcctgttcacccacggctcgtaccgcgccgcgcggcccctgaagatcgccctggccatcgccggctccctagcgatcgaaggcggggtcatcaagtgggtggccgaccaccgccgccaccacaagtactccgaccacgaaggcgacccccactcgccttggcggttcggcgacgactggcgttccgtggccaaaggcatgttctacgcccacatgggctggctgttcctggacgagcagaagacttcccctaagcggttcgcgcccgacctcctcaaagacaaggacctggtccgtatcgaccgctacttctgggtcttcgtgctcatctcgctgctcaccccgccgctcatcggcggcctggtgaccatgtcgtggtggggcgcgtgcaccgcgttcttctggggaagcctggtccgtatcgcgctcctgcaccacgtcacgtggtcggtcaactcgatctgccacaccattggtgaagaaaacttcacggttcgcgaccggtcccgcaacgtctggtggctggcgatcccgtccttcggcgagtcctggcacaatctgcaccatgccgaaccgacctgcgcccggcacggggtcctcaagggccagatcgacatctcggcacgggtcatctggatcttcgagaaactgggatgggcgaccaaggtgcgctggccc

SEQ ID NO: 32026 - DNA, 942 bp, Thermobifida fusca
caaaaaaaactcatgctcttctcgggacggacccaccccgatctcgcggcggaggtcgcggtggaactgggtatcgaaacggttcccaccaggttccaggacttcgccaacggggagatcttcgtccgctacctggagtcggtccgagggtgtgacgctttcgtcatccagtgccactccgatccgatcaacaagtccatcatggagcagttgatcatggtggacgcgctgaagcgggcgtcagcgaaacgcatcaccgtagtgacgccgttcttcggctacgcgcgccaggacaagaagcaccgggggcgggagccgatctcggcgcggttgatcacggacctgttcaaagccgccggggcggaccggttgatggcggtggacctccacaccgaccagatccagggcttcttcgacggcccggtcgaccacctgttcgcccttcccctcctcgccgactatgtggcggccaacgtggacctgagcaacaccaccgtggtgtcgccggactcggggcgtgtgcgcaccgcagaccggtgggccgaccggctgggtacgccgctggcgatcgtccacaagcggcgcgacccggacgtggcgcacgaggtgcgggtccacgaagtcgtcggtgaggtgcggggccggacctgtgtcctggtggacgacatgatcgacaccgcgggcaccatcgtgaaggccgcggacgccttgttcgagcagggggcagccaaggtgatcgcggtcgcgacgcacggtgtgctgtcggggcccgccgtggaccggctcaaggactcgcggatttccgaggtcgtcatcaccaactcgctgccggtgtcgaaggaccggcagttcgacaagctgacccagctatcgatcgctccactgctggctcgggcgatcaacgaggtgttcagcgacggttcagtgacgagcctgttcgag

SEQ ID NO: 32027 - DNA, 1269 bp, Thermobifida fusca
ttggcgtcgatcgaggcagtacacgcacgggagattctcgactcccgcggtaacccgacggtcgaggtcgaggtcgcactcgacgacgggacgattgcccgggcggctgtccccagtggcgcgtccaccggtcagttcgaagcggtcgaactgcgcgatggtggcgaccgttacggcggtaagggcgtggagaaggccgtcgccgcggtcaacgaggaaatctccgaacagatcgtgggttacgaggccgaggagcagcggctcgtcgacagcgccctgatcaccctggacggtacccccgacaagtcgcgcctgggcgccaacgccatcctgggtgtctccctggcggtggccaaggcggccgcggagagcgcggacctgccgctcttccgctacctgggcggcccgaacgcccacgtgctgccggtgccgatgatgaacatcctcaacgggggtgcgcacgcggacaccaacgtcgacatccaggagttcatgatcgcccccatcggggcggagagcttccgggaggcgctgcgctggggcgcggaggtctaccactcgctcaaggcggtgctcaaagcccacggcctggccaccggtgtcggtgacgagggcgggttcgcgcccaacctggacagcaaccgcgccgcgctcgacctgatcagcgaagccatcacgaaggcgggcttcacgctgggccaggacatcgccctggccttggacgtggccgccaccgagttctacgcggacggcgcctaccagttcgagggctccagccgcagcgcggaggagatggccgcctactacaccgagctggtcgagtcctacccgctggtgtcgatcgaggacccgctcagcgaggaagactgggccgggtggaaggcgctcaccgagtccctcggcgaccggctgcaactggtcggcgacgacctgttcgtcaccaacccggagcggctgcagcgcggtatcgacgagggcgctgccaactcgctgctggtcaaggtgaaccagatcggtacgctcagcgagactttggacgcggtgtcgctggcgcagcgcaaccggtacaccgcgatgatcagccaccggtctggtgagaccgaggacaccacgatcgccgacatcgcggtggcgacgaactcggggcagatcaagacgggtgccccggcgcgcagcgagcgggtcgccaagtacaaccagctgctgcggatcgaagaagagctcgacgacgcagccgtctacgccggagccaacgcgttcccgcgtttc

SEQ ID NO: 32028 - DNA, 1206 bp, Thermobifida fusca
atcgacgcggtctgcgaactcgccgacttctggcggttcaacgtgcacttcgcccgccagatcctcgcagaacagccgctcgtccacgcgccgggcacgtggaaccgcaccgaccaccgccccttggaagggttcgtctacgcgatcaccccgttcaacttcacggcgatcgccggaaacctccccaccgcgcccgcgctcatgggcaacgtcgtggtgtggaaaccgtcccccacccagacgctcgccgcctgcctgaccatggaactgctggaagcagccggactgccgcccggtgtcatcaacctggtcaccggcgacggcgtggcgctctccgaagtcgccctcacccaccccgacctggcgggcatccacttcaccggctccacccggaccttccagtacctgtggcggaccgtcggggagaacattgcccgctaccgcagttacccgcgcatcgtcggagagaccggcggcaaagacttcgtggtcgcgcacgcttccgccgatgtcgacgtgctccgcaccgccctgctgcgcggtgcgttcgaataccaaggccagaagtgctccgctgcctcccgtgccttcatcgcccgctcggtgtgggagcggatgcgtgacgacttcctcgcccaggtcgacgcgctccccatgggcgacgtcaccgacttccgcaacttcctgggcgcagtcatcgaccgccgcgcctacgaccgcctcgcccgcctgctcgaccgggtgcgcacggatccgacgatcgacgtgctcgtcggcggcactgccgacgacagcgtcggctactttgtgcgccccacggtcctcctcggcagcgacccgagccacgaggtgttcaccaccgagtacttcgggccggtcctcgcggtctacgtctacgacgaccacgcctacgaggaggtgctccgcctcgtcgaccgcggcgcaccctacgggctgaccggcgccatcatcgccaccgaccgggctgcgatcctcgcggcgacccggcagctgcggtttgcggcgggcaacttctacatcaacgacaagcccaccgggtcgatcgtgggacagcagccgttcggcggctcccgggccagcggcaccaacgacaaggccgggtcgatggcgaacctcatgcggtggaccagcccgcgggtgatcaaagaaacattcgtcccgcccaccgaccaccgctacccgcac

SEQ ID NO: 32029 - DNA, 1221 bp, Thermobifida fusca
atgcctgaagccgtcatcgtcgctacggcacgctctcccatcggacgggctttcaaggggtccctcaaggacatccgcccggacgacctgaccgcgcagatcatctccgcggcgctcgccaaggtcccgcaactggaccccgccaccatcgacgacctcctcctgggctgcgggctccccggtggcgaacagggcttcaacatggcccgcgtcgtcgcggtgcagctcggtctggactcggtcccgggcaccaccatcacccgctactgctcttcatccctgcagaccacccggatggcgttccacgccatcaaggccggggaaggcgacgtcttcatctccgccggcgtggaaatggtcagccgcttcaccaagggcaacagtgacacgctgcccgacacgaagaacccgctgttcgccgaggctgaggcacgcaccgcccgccgcgccgagggcggtgcagaaccctggcgcgacccgcgggaagagggcaagctccccgacatctacatcgctatggggcagaccgcggagaacgtggcgcagctgcgcggcgtctcccgccagcgccaggacgaattcgcggtgcgttcgcagaacctggcggaaaaggcgctcgacaacggtttctgggagcgggagatcaccccggtgaccctgcctgacggcacggtggtctccaccgacgacggtccgcggcgcggcaccacctacgagaaagtcgccgccctggacccggtgttccgccccgacggcacggtgaccgcggggaactgctgcccgctcaacgacggcgcggccgcactgatcatcatgagcgaccggaaggccgctgaactgggcatcaccccgctggcccggatcgtgtcgaccggggtgagcgcgctgtcacccgagatcatggggctgggaccggtcgaggcctcccggcaggcgctggcccgcgccaacatgtcgatccgcgacatcgacctcgtggagatcaacgaggcgttcgccgcgcaggtgcttccgtccgcggacgacctgggcatcgacatcgactcccagctcaacgtcaacggcggcgccatcgctatcggccacccgttcggtatgacgggggcgcggatcaccaccacgctgatcaacgccctccagttccacgacaagaccttcggcttggagaccatgtgcgtgggcggcgggcagggaatggccgccatcttcgaacggctgagc

SEQ ID NO: 32030 - DNA, 1143 bp, Thermobifida fusca
ggcgccatgagttacgaggggtttgagacactggccatccacgccggtcaggaggcagacgccgagaccggggccgtggtggtccccatctaccagacgagcacctaccgccaagacggggtgggcgggctgcgcggcggctacgagtactcccgcaccgccaacccgacccgcacggcactggaagaatgcctggccgcgctggaaggcggggtgcggggcctggcgttcgcttccggcatggccgcagaggacaccctgctccgcaccatcgcccgacccggcgaccacctcatcatccccaacgacgcctacggcggcacgttccgcctcgtctccaaggtcttcgaacggtggggagtgagctgggacgccgtcgacctgtccaacccggaggcggtgcggaccgcaatccgcccggaaaccgtggcgatctgggtggaaacccccaccaacccgctgctcaacattgcggacatcgccgcgctcgcggacatcgcgcacgccgctgacgcgctgctggtggtcgacaacaccttcgcctccccgtacctgcagcggccgctcagcctcggtgcggacgtggtcgtgcactccaccaccaaatacctgggcggccactccgacgtggtcggcggcgccctcgtggtcgccgacgcggaactgggagagcgcctcgccttccaccagaactcgatgggcgcggtcgcgggaccgttcgacgcctggctgaccctgcgcggcatcaaaaccctcggcgtgcgcatggaccggcactgcgccaacgcggaacgcgtcgtggaagcgctcgtcggccacccggaagtcgccgaagtgctctacccgggcctgtccgaccaccccggccacaaggtggcggtcgaccagatgcgcgccttcggtggcatggtgtcgttccgcatgcgcggcggggaggaagccgcgttgcgggtgtgcgcgaaaacgaaagtgttcaccctcgctgaatccttgggcggggtggagtcgctgatcgaacacccggggaagatgacccacgcctccaccgcgggctccctcctggaagtgcccagcgacctggtccggctctccgtgggtatcgaaaccgtcgacgacctcgtcaacgacctgctccaagcattg

SEQ ID NO: 32031 - DNA, 984 bp, Thermobifida fusca
gtgaccatccgtgtaggtgtaaacggattcggacgaatcggccgtaacttctggcgggcggttcaggccgccggcggcagcgatgtcgaaatcgtggcggtcaacgacctcaccgacaaggccaccctggcgcacctgctcaagtacgacacggtgctgggcaccctgccgggcgaggtcgaggtcggcgaggacagcatcacggtcggcggcaccaccatgaaggcgctcgcccagcgcgacccggctcagctcccgtggggcgacctcggggtggacatcgtcgtggagtccactggcttcttcaccaaggctgaggacgcgaagaagcacctcgacgccggcgccaagaaggtcatcatctccgcccccgccaagggcgaggacctgacggtcgtcatgggcgtcaacgacgacaagtacgacccggccaaccaccacatcctgtccaacgcctcctgcaccaccaactgcgtggcgccgatggcgaagaccctgatggagaacttcggcatcgtcaagggtctgatgaccacggtgcacgcctacaccaacgaccaggtcatcctggactacccgcacaaggacctgcgccgtgcccgggccgccgcgcagaacatcatcccgaccaccaccggtgccgccaaggccaccgctctggtgctgcccgagctgaagggcaagctcgacggcctggcgatgcgggtgccggtgccggacggctcggtgaccgacctggtggtcacgctggagcgcgaagtcaccaaggaagaggtcaacgccgccttcaaggctgcggccgagggcgcgctcaaggacatcctggtctacaccgaggacccgatcgtctcctccgacatcgtcggcaccccggcgtcctgcaccttcgacgccagcctcaccatggccttcggcacccaggtcaaggtcgtcggctggtacgacaacgagtggggctactccaaccgcctggtcgacctggtc

SEQ ID NO: 32032 - DNA, 1956 bp, Thermobifida fusca
acgatcgaggatctcgacgtcgcgggcaagcgcgtcttcgtccgagccgatctcaacgtgccgctcgacggtgaccgcatcaccgacgacggtcgtatccgggccagcctgcccaccatcactgcactgcgcgagcggaacgcgcgcgtgatcatcggcgcccacttgggccgccccaaaggcaaggtcgaccctgcctactcgctgaagccggtcgccgcccgcctgggtgagctgctgggcaccgaggtgcgcttcgcctccgacaccgcaggcgaatccgcccaggccatcagccgcgagctggccgacggcgaggtcgccctcgtggagaacctgcgttttgagccgggcgagaccagcaaggacgacgccgaacgcggtgagttcgccgatcggctcgccgcactggctgagctgtacgtcggcgacggtttcggcgccgtgcaccgcaagcacgccagcgtctacgacctgccgaagcgtctgccgcacgccgccggcggactggtgctggccgaagtcaacgtgctgcgcaagctgaccgagtccccgcagcgcccctacgtggtcgtactgggcggctccaaggtctccgacaaactcggcgtcatcgacaacctgctcaacaccgccgaccgcatcctcatcggcggcggcatggcctacaccttcctcgccgcgcagggctacgaggtgggcgccagcctgctggagcgggaccagatcgacaccgtcaaggggtacctgcgccgggctgaggagcgcggtgtggaactcgtgctcccggtggacgtggtggccgcagagaagttcgctgcggacgccgcccacgacgtggtcgacgtccgggagatccccgcggaccggatggggctggacatcggaccggcctcggctgagctcttcgcgtcgaaactggcggacgccgcgaccgtgttctggaacggcccgatgggcgtgttcgaaatggagccgtacgcgaagggcacccgctccgtggcgcaggccctagccgactcctcggcgttcaccgtggtcggcgggggcgactcggccgcagccgtccgggcactcggcttcgacgagaaggcgttcagccacatctccaccggtggcggtgccagcctggagtacctcgaaggaaagaccctgcccggcatcgcggcattggaggaataggacgacatggcaaccgccaagcgcaagccgctgattgcgggtaactggaagctgaacaacaaccacctcgaggccatcgcgctggtgcagaagatggccttcgccctcaacgacgccgactacgacgccgcagacatcgcggttctgccgccgttcaccgcgatccgcagcgtgcagaccctggtggaaggggacaaactgcggatcacctacggtgcccaggacatctcccagcacgagaagggcgcctacaccggtgaagtgtccggcccgatgctggccaaactcaactgcacgtacgcgctggccgggcactcggagcggcgcgaataccaccacgaggacgacgcggtcgtcaacgcgaaagtcaaagcggccttcgccagcggcatcacgcccatcctgtgcctgggtgaagggttggaggtccgcaaggcgggacgccacgtcgagcacaccctcgcccagttggaaggcgcgctcaagggcgtgaccgaggagcaagtccgcaccctggtcgtggcctacgagccggtgtgggcgatcggtaccggcgaagtcgccacgcccgaggacgcccaggaggtgtgcgcggcgctgcgcaagcggattggtgaactgtactcccctgaggccgcacagcagacccgcatcctctacggcgggtcggtgaagagcggcaacgtcgcagcgatcatggcgcaagcagacgttgacggcgcgctggtcggcggtgcgagcctggacgctgacgagttcgtcaagctgatccgc

SEQ ID NO: 32033 - DNA, 1458 bp, Thermobifida fusca
agtatctggcgcacgaagagcatcgaacagtccatccgggacaccgacgaacccgggtatcggctccgccgggacctcaacggcttcgacctgatcgtcttcggcatcggagtcatcatcggaaccggcatcttcgtcgtcacgggacggcaggccgccgagaacgccggccccgccatcgtcctgtccttcctcgctgccggagctgtatgcgcactggctgccatgtgctacgccgaattcgcctccaccgtgccggtcgccgggagcgcgtacacgttcggctacgccacgctaggggaattcgtcgcctggatcatcggctgggacctcatcttggagttcaccctggcggcctctgtggtctccgtgggctggtcggaatatgccggagacctcctcgccctgccgaccacggtcaccctcgccggtctcccggtgaacctcggcgccgtggccatcgccgtcctcctgggccttgtcggcatgctgggagccaaactgtcgggccgggtcaccgcggtcgtggtggcgatcaaagtcggcatcgtgctcttcatcatcgccgtgggcgcagcctacgtcgaccccgccaactggacgccgttcatcccacccgcgcagcccgcggccgcggacaccaccggggtgagcgatgccacgctcacccacgtcctcttcggcttggaacccacctccttcggcccgtggggagtggtcgccgccgcatcagtggtgttcttctccttcatcggcttcgacatcgtcgccaccaccgctgaagaaacccgcaacccgcggcgggacatccctgtcggcatcttcggctccctgctcatcgtcaccctgctgtacatggcggtggccgcagtcgtcacagggatgcgcccgtacacggaactcaacgtgaccgcacccctctccgacgccttccgctctgtcggcgccgactgggcggcgaccctgatctcgctgggcggggtcatcggcatcaccaccgtcatcctggtgctgatgatgggtcaggcccgggtcgcgttcgccatgtcccgcgacgggctgctgccccgagcgctctcccgtatccacccgcggttcggcaccccgtatgtgaccaccctgctgaccaccgcggccgtggcactgctcggcggcctcgttcccatcagcacgcttgaagagatggtcaatatcggcacgctgttcgcgttcgtcgtagtgtctgtgggcgtggtcgtcctgcgttctctccgccccgacctgccgcgggcattccgcgtgccctggtctccggtactgccgctgctggccgcgctctcctgcctctggctgatgctcaacctgaccgcgctcacctggatccggttcgcggtatggctcgtgatcggggtcgccatctacttcctctacggaatccaccacagcaggctcgccgcgcctcccgcacagcccagcggt

SEQ ID NO: 32034 - DNA, 1536 bp, Thermobifida fusca
gaaccggtgatgccgggagcggtccccaacccgctgcgcagtgtgctggaccggcggttaccgcggattgccggcccgtgtgtgctcgtcctcttcggggtcacgggcgacctgtcccgcaagaagctgcttcccgctatttacgacctggcgaaccgagggctgctaccgcccggtttcggactcgtgggattcgcccgccgggactgggccgaccaggacttcacccaggtcgcctatgacgcggtccgtacgcatgcgcgcaccccgttccgggaagacgtgtggcgccagttgagcgagggggtgcggttcgtccccggcgaggcgcatgacgacgccgcgtttgatgcgctggtgcgcaccgtgcgggaactggacgagagccggggcaccggcggcaattacgcgttctacctttcgcttcccccgaaactgttccccacggtgctcacccagttgaagcggagcggcctggcggagagctcgggggactcgtggcggcgggtggtgatcgagaagccgttcggccacgacctggccagcgcccaggagctcaacgccctcgtcgacgacgtgttcccaccgcactccgtgttccgtatcgaccactacttggggaaggaaaccgtccagaacctgctggcgctgcgtttctccaacaccctgttcgagccgatctggaaccgctcgtatatcgaccacgtccagatcaccatggccgaggacatcggggtggggggacgcgccgggtactacgacggtatcggggcggcgcgcgacgtcatccagaaccacctgctgcagctcctcgccctggtcgcgatggaggaaccgctgtccttcaccgcggacgcgatccgcgcggagaaggtcaaagcgttgtccgcggtccaactccccgacgatcttgcgaccgggaccgcgcgcggccagtacaccgcgggctggcagggcggcgcctgggttcccggctacttggaggaagaaggcatccccccgaactccaccacggagacgtacgcggccatgcggctgggggtgaacacgcggcgctgggcgggcgtcccgttctacctgcgcacggggaaacgcctggggcggcgggtcaccgaggtcgcactggtgttccaccgcaccgccaaccaggtgttcgaccatgttgccaccgccaaccagggcgccaactccttggtgatccggatccagccggatgagggggtgacgttgcggttcggctccaaagtccccgggaccgccatggaggtgcgcgatgtcagcatggacttcagctacggcgcgtccttcaccgaaaccagtccggaagcctacgagcggctgatcctcgacgtgctcatcggcgatcctccgctcttcccccaccaggaagaagtagagctgtcgtggcggatcctcgacccggtcgaggagttctgggccaagaacggccgccccgaaccctacccggcgggtagctggggcccgcccagcggccacgagctgctggcccgcgacaaccgtacgtggcgcagacca

SEQ ID NO: 32035 - DNA, 2073 bp, Thermobifida fusca
accccaaagaccctggactggtctgatctcgatagacgtaccgtagacgtggttcgtgccctggcgatggacgcggtcgaagaagcgggatccgggcaccctggaaccgcgatgagtctggcgcctgtggcctacctgctcttccagaaggtgatgcggcacgatccgacagatccgaagtggatcggccgcgaccgcttcgtcctgtcctgcgggcactccagcctcacgctctacatccagctctacctggctggctacgggctgagcctgaacgacatcaagcggctgcgccagtggggcagcctcaccccgggccaccccgaatacgggcacaccgccggggtggaaaccaccaccggccccttggggcagggcatcggcaacgcggtcggcatggccatggccgcccgccgggagcggggcctgttcgacccggacaccccgatcggggaaagcccgttcgaccactacatctacgtcctgtgctctgacggcgacgtccaggagggcatcagccacgaagtaagtgccctcgccggcacgcagaagctcggcaacctcatcgtcatctgggacgacaaccgcatctccatcgaagacgacacccagatcgcattcaccgaagacgtcgtcgcccgctacgccgcctacggctggcacgtccaagaggtcgagtgggtcggcgaggacggctcctaccacgaagacgtggcggcgctgtacgacgcgatccgggccgcccaggcggagacggaacgtccctctttcatccggctgcgcaccatcatcggctggccgtccccgaacaagcagaacacgggggcgatccacggcgccgcgctgggggctgaagaggtcgccgccaccaagcgggtgctgggcctcaaccctgaggcgcagttcgacgtgcccaacgagctgctggagcacgcccggggcgtggtggcgcggggccgcgccgcccgccaggaatgggaggccttgttcgccaagtggcgggccaacgcgggcgagcgtgccgaactgttcgaccggctgatggcaggctcgctcccggacggttgggagaaggcgatcccgaccttcgagcccagcgctaagggcatggccacccggaaagcgtccggtgaggtgctgagcgcgatcgccccggtgctgccggagctgtggggcggctcggcggacttggccggatccaacaacaccacgcctaagggcgagccgtcgttcatccccgaggagcggtccacgaaggcgttctccggccaccgctacggccgggtgctgcacttcgggatccgtgaacacggcatgggggcgatcctcaacgggatcgcgctgcacggccccacccgcccctacggtggcaccttcctcgtgttcagcgactacatgcggccgtcggtgcggctggctgccctgatgaagctgccggtcacgtacgtgtggacccacgactcgatcggtctgggcgaagacggacccacccaccagccggtggagcacctgtggtcgctgcgcgccatccccggcctggcggtggtgcgtcccgccgacgccaacgagacggcagtggcctggcgcaccatcctggaacgcaatgacggcccggtggcgctcgcgctgacccggcagtcggttccggttctggaccgctccgagctcgcctctgcggagctggtctcccgcggcgggtacatcctggccgaagccagcaacggccgtccggaggcgatcatcatcgccaccggaagtgaggtgcagatcgcgttggaggcgcgttcccgcctggaggagtcgggtactcctacccgtgtggtgtcgatgccgtgcctggagtggttcaacgagcaggacgacgcctaccgccagcaggtgcttccaccgtcggtccgggtccgggtctccgtggaagccggggtcgccttgggctggcgcgagctggtgggcgagtatggcgagtcggtgagtctggaacacttcggcgcttcggctccgtacgcgactctctacgagcagttcgggctcaccgccgaccgggtagtggcagccgtacactccagcgctgcc

SEQ ID NO: 32036 - DNA, 1152 bp, Thermobifida fusca
gtcgatttctcactgaccgaagaacagcgggaaatccgcaactgggtgcgcaccttcgtcgagcgcgaacttatgccgctcgaaccggaggtgctgcgccgggaacggaacggcgaggggcacggtctgaccccccaggagttgcacgacctgagacagctcgccaagaagtccgacttctgggggatccagacccccgtcgagtacggcggcatgggactggatgcggtcaccaccgcactggtggagatcgaactgggccgtaccttcatcccgttcagcttcggcggcggcgccgacaacatcctcttctacgccaacgaagagcagaagaagcgctacctgctgcccaccatcgcgggcgaacgcaagtcctgcttcgccatcaccgagcccggcgccggctccgacgccaaagcgatccgcacccgggcctacaaggacggcgaccactgggtgatcaacggggagaagacgttcatcaccggtgggaacgaagccgacttcgccatggtgttcgcggtcaccgacccggagaagggcgccaacggcggagtgacctgcttcctggtggaccgggaggcgggatggcgctccgagcccatccccaccatgggcgagtggggtccggcctccctggtcttcgacaacgtccgggtgccggaatccaacgtgctcggtgaggtcggcaagggcttcgagctggcgatgaagtggatcggccggggccgctacctgctccccgcgcgtgcgctcggcgcctgcgaacggctgctgagcatggccatcgactacgccaacacgcgtgagaccttcggtaagccgcttgcggaacggcaggccatccagtggatgatcgccgactcccaggtggagatcgaagcgctgcggctgctcgtgctccacgccgcctggcaggtggacaacggccgggactcccggcacgcccagtccatcgccaaactgtacggcggtgtgaaagccaacgagatcgtcgaccgggtgctgcagatccacggcggtatgggctacacccgggagctccccatcgagcgctggtaccgcgagctgcggctgctgcgcatctatgagggaaccgacgagatccagcgccgcaccatcgcccgcgacctgctcaaagggtacgtcaaa

SEQ ID NO: 32037 - DNA, 1497 bp, Thermobifida fusca
ctgtcactcgccacgatcctggccgaggctgcgcgtcgccacccggaacgcaccgcactcatcgctgacggtgagcggatctcctacgccaccctgtggcacgagtccctgcgccacgcggccgccctccgctctctcggcgtctcccccggggaccgggtcgccctgctcgcaggcaacgtcgccgacttcgtccgctgctactacggcatcctcgccgtgggcgggaccgtcgtcaccatccccccgatgctccgcccccaagaggtcgccttcctcctctccgacaccggggcgcgcctcgtcctcgcccaaagcctgttcgctgacctcgcccacgccgcggtcgacggcaacgacgtcaccgtgcgcactgtcggggacccgcagcggcccgacgcgctggccccgctcgtggcggacagcgaaccgctgccctcctacgtgtcccgcgcccccgacgacattgcggtgatcttctacaccagcggcaccacgggcgtccccaaaggcgccatgctcacccacctcaacctggtgatgaacgccaccgtcaacgcgttcgacgtccaccccatgagcggcgaagacgtcgtcatgggctccctgcccctgttccacaccttcggccagtcagtggcgctcaacaccaccttccgggtgggcgccaccctcatcctgcaggagcggttcgaccccgacgaagccatccggatgatgtgcgagtacggcgccaccatcttcgacggcgtccccaccatgttcgtccggctggcagaagccgcagcccaccacaccaaacttccctccctgcgcttctgtgtctccggtggcgcttccctccccgaagtggtactccgccggttcgaagaagcgttctccaccaccatctacgagggctacggcctgtcggagacctcgcccacggccagcaccaaccagacgctctacggcgcccgcgtcggctcggtcggccaccccatctggggtgtggaagtggagatcgcccgcgccgacatcgacgaccggatcgaactcctgccgcgcggcgagcacggcgaaatcgtcatccgcggccacaacgtcttcgtcggatacctcaaccgcccggaggccaccgccgaggcgatcgttgacggctggttccgcaccggagacatcggcttcatcgacgacgacggcttcatccacatcgtggaccgcaagaaggacctgatcatccgcggcggcttcaacgtctacccgcgcgaagtggaagaggtcctgctgaaattccccgggatttcccaggtagcggtgatcggcgtgcccgacgccgaactgggtgaggaggtctgcgcggtggtggtgcccgacaaggagggcgccgtcgaccccgctgaactccaggcctgggcgcaggagcgcctgggcaaacacaagtacccgcgcagagtggagatcgtgaccgagcttccactgggtccgagcctcaaagtactcaagcgcgaactgcgt

SEQ ID NO: 32038 - DNA, 1209 bp, Thermobifida fusca
gtcgactctgagatcggccgtctgcgccaggtcctcgtccaccggcccgacttggaaatccagcgcctgacacccagcaacaagggcaccctgctcttcgacgaagtgctgtgggtggagcgcgcccgcgaggagcacgacctgttcgtccagctcctgcgggaccggggggtgaccgtgcatgaattcggcagcctgctcgcggagactctgcacatccccgaggcgaagaggttcatcctcgacgaggtgctggaggagcgcttctacggtccgatggctctcgacgccatccgtgcctgtcttgacgcgatggaccccggtgagctgcgccgtttcctcaccggcggcatcaccaagcgggagatcctccagcggatctccgagccgaagtcggtgtggttccacgccctggacctggacgcgttcgtgctgccgccgctcccgaacctcatcttcacgcgcgacacctcgagctggatcggcaacggggtgtccatcaacgtgatgcgcaaccgtgcccggatgcgggagaccacgctgtacgaagcggtctaccggtggcacccgctcttcgccgcaaccgatttccccgtgtggaatccgggggtgtcctgggcgcccgccacgatcgagggcggcgatgtcatgccggtcggcaacggctctgtgctggtggggatgagtgagcgcacccgcccgcaggcggtggagctgctggcgcgggagctgttcgcccgcggtggcgcccagcgcattctggggatccagatgcccgaggcccgcgccatcatgcacctggacaccgtgatgaccaacgtggatcacggggttttcacgaagtacgcgggtctgggcatgctgccctcctacaccatcgagccgggggacagcgacaaggagctgaagatcacggaccacgctccagaggacatgcaccgggccatcgccgccgcggtgggggtcgacgacatcacggtcctcactcccacccaggatgtcttctcggctgaacgcgagcagtgggacgacgggtgcaatctcctcgcactagcgccgggcgtggttgtggcctatgaacggaatgtctcgtccaatgcgtatctgcaggccaacgggattgaggtcatcactatcccgggcaatgagctcggccgcggccgaggcgggccgcactgcctgacgtgtccgctggagcgggatccggtg

SEQ ID NO: 32039 - DNA, 996 bp, Thermobifida fusca
atggcgttcaacctgcgtaatcgcagttttgtcaaggaactcgacttcaccccccaggagctgatgttcctgatcacattggcggccgacctgaaggccgccaagtatgcggggaccgagcagccgcagctcagcggcaagaacattgccctgatctttgagaagacctccacccgcacccgctgcgccttcgaggttgccgcccacgaccagggtgctcacgtcacctacctggacccgagcggctcccagatcgggcacaaggagtccatcaaggacacggcccgtgtcctgggccgcatgttcgacgcgattgagtaccgcggcgccagccaggccacggtggaagaactggccgagtatgcgggcgtgccggtgtggaacggcctcaccgacgaatggcaccccacccagatgctcgccgacttcctcaccatcatggagcacaccgacaagccgctgcgcgaggtcaccctggcgtacatgggggatgcccgcaacaacctcggcaactccctcaccgtcaccggagccatgctcggtatcgacgtgcgcatggttgccccccgcgaactgtggcctgacgaggagcgggtcgccgcccccgcccgcgcaatcgccgagaccacgggggcgcgggtcacgttcaccgacgacatcgcggaaggactggccggggcggacttcatctacaccgacgtgtgggtgtcgatgggagaacccagcgaagtgtgggacgagcgcatccgccagctgctgccctaccaggtcaacgctgaggccctcaaagccaccggcaaccctgacgtcaagttcctccactgcctgccggctttccacgacctcggtaccgaggtggcacgggagatccacgcccgcaccggcctgaccgcgctcgaagtcaccgacgaggtgttcgagtcgccggcctccatcgtcttcgaccaggccgagaaccggatgcacacgatcaaggcgctcatggtcgccaccctg

SEQ ID NO: 32040 - DNA, 876 bp, Thermobifida fusca
aagcgctacggtacggtcactgccgtagcgggcctgtcgttcaccgctgcccgcggcgcggtcaccgcgctcctcggccccaacggtgcgggcaagacctcgacgatcgaaatctgtgaagggttccggcacgcagacgcgggccgggtccgtgtcctcggcctcgacccgatccgcgacgcggccgcgcttcggccacgggtcggggtcatgccgcagagcggcggcgtgcccaccggggtgcgcgctggggagtggctgcgtcttctcgctgccttctacgcccatcccctcccccctgaagcgctcctggaccggctgggcctctccgcggtagcccgcaccccgttccgccggctgtccggaggacagcagcagcgcctgtccttggccgctgccatcatcggccgtcccgaactggtgttcctggacgagcccaccaccggcctcgacccgcaggcccgcatggccacctgggagctgatcggcgagctgcgcaccgcaggggtgggcgtcgtgctgaccacccactacatggaagaagcggaacggcttgccgaccacgtggtcatcatcgaccacggccgggtcgtcgccgacggccccacagccgccctcacccgcggcgatcgggagctgcggttccgggctgctcccggactggacgtgtctgacctcgccgctgcccttccaccgggctgcagcgtcaccgagcgcgacgctggacagtacacggtcacctgcgctgaccccgacgaaatagggccgggcctggtagcgaccgtgagcacctggtgtgcgtcccgcggactcctccccgaggacctgcgagtgcaccgccgcaccctcgaagacgtcttccttgaactcaccggc

SEQ ID NO: 32041 - DNA, 1218 bp, Thermobifida fusca
cgcgaagtcgtcgtcaccggccttggagcgagcagtcctctgggaggtgacgtcgccacgacctggtcggcgctgctcgaaggtcgatccggcatcacttccctgcccgaggagtggcatgagaagctcccggtgcacttcgcgggcctcctcgctgaggagccgtccgagaagctggaacgccaccgactgcgccgcctggaccggacccagcagttggcgttgatcaccgcgcgggaagcgtgggacgacgcgggctcccctgaagtagacccgttgcgtctgggtgtcgtgatgtccagcggtatcggtggcatcttgaccaccctccaccagtacgacatcttccgggagaagggctggaagcgggtctccccgttcaccgtgccgatgctcatgcccaacagcccggccgccgctgtggcgctggagttcactgcccgggcgggggctcacgccgcggtcagcgcctgcgcgtccagtgcggaggccatcgctgacggcatcaacatgatccgctccggccgcgccgacgtggtgatcgcgggagggtgcgaggcggcgatccacccgctgaacattgccgcgttcgctgcgatgcgtgccttgtccacccgcaacgacgacccgcagggcgcgtcgcgtccgttcgacgtcaaccgggacggtttcgtcatgggtgagggggcagccactctcatcctggagtcggctgagcacgctgcggcccgcggggcccgcgtgtacgcggtggccgcgggagccggatacacctgcgacgcctacgacattgtgcagcctgacccggtcggtgctggggcttcccgtgcgatctctgccgcgatcgcggacgctgggctgagcccgtccgatatcgcgcacatcaacgcgcacgccacttccacgccggcgggtgacgtgccggagaccgtggcgatccgcagtgccctgggcgactcggctgctgacgctgtcgcggtgacctccaccaagtccatgaccggccacctgctgggtggtgctggtgcgttggagtcggtggccaccgtcttggcgctgtaccacggggtggtgcctgcaaccatcaacgttgaggagatcgaccccggcgtggtggttgacgtggtggtggacaagcctcgggagctgccgtcttccgcggtggctgcgctgaacaactctttcggtttcggcggacacaacatcgccttggcgttc

SEQ ID NO: 32042 - DNA, 927 bp, Thermobifida fusca
ggagcatgtgtcgtcgctttcggcgagtaccagcccgccaacgtcgtcaccaacgacgacttggcgaagcgcgtcgacacttctgatgagtggatccgcagccgggtgggtatcgccgaacgccggatcgcttccccggaggagagcgtcaccgacatggcggtcgctgccggcggcaaggcgctggctgccagcggtttggcgccggacgacatcgacctggtgatcgtggcgacctgcacgcagcgcgaccagatccctaacacgtctgcgagcgtggccgcgcggctcggcatccccgcgccgggggcgttcgacgtcaacgcggcttgtgccgggttctgctacgcgctgtcggtcgccaacgatgcggtgcgcgggggttcggcgcgcaacgcgctggtgatcggcgcggagaagctttccgactgggttgactgggatgaccggtccacctgtgtgattttcgcggacggtgcgggcgcggccgtggtgtcggcgtcggacgagccggggatcggccccgtggtgtgggggagcgccggggaccgggccgacaagatctacctgcgggaccacaagtacatctaccaggagggtcagacggtcttccggtggacgaccaccgagctgtacccggtggcgttggaggccttggaacgggccggggtggcccccgaagagttgactgccttcgtcccgcaccaggcgaacctgcgcattgtggaggccattgcccgtaagctgggcgcgcctcaagcgatcatcgcgcgcgatatcgtcaccgcggggaacacctcgtcggcttccatcccgctcgccttgtcgcgcatgatcggacgcggcgagctcccctcgggcagcaccgtgctcactttgggtttcggagctggtctcacctatgcggcacaggtcctgcgccttccg

SEQ ID NO: 32043 - DNA, 909 bp, Thermobifida fusca
gtgcttgcaatcgtcgctccgggccaaggcgcccaggtacccggtttcctctccgcgtggcttgaactccccggaatggcggagcggttcgctgaatggtcggatgtggtcgggctcgacctcgtccgctacggcaccaccgctgacgctgaagagatccgggacaccgcggtagcccagccgctgctggtgagcgcgggcattgcggcagcgatcgcgttgttcggcgaccttgagtccgccgccgcatcagccgatgtggtggccgggcacagtgtcggcgaattcactgcggccgcggttgccggtgctctgacgccccgggatgcgctgctgctcgttgcggagcggggccgggggatggctgaagcgtccgcggtcaccccgacgggaatgactgcggtgctgggcggcgatcgggacgaagtcctcgccgcgatcaaagcagcgggtctgactcccgctaacgacaacggttcggggcagatcgtggccgccgggactcttgaacagttggaggcgttggcggctgctccccctgcccgggcacggctgcgtcctctcgcggttgccggtgctttccacacccaccacatggctcccgcagtgaagcgcgtggaggccctggcagccaccctcacgcccgctgatcctcgtactcggctgttgtccaaccgtgacggcgcagtggtcacctccggctcggagtacctgtcccgtctcgtgtcgcagatcagctccccggttcggtgggacgcctgtaccgctaccctcgctgatctcggtgtcaccgcactgatggagctgccgcccgcaggcacgctgactaatctcgccaagcgagcgctgcgcggtgtggaactgctcgccatcaagtctcccgaggacctggaccgggcacgcacactc

SEQ ID NO: 32044 - DNA, 2952 bp, Thermobifida fusca
atgagatcgttactgtctccccggcgctggcgcacgctggcctcgggggcgctcgcagcggccctggccgccgctgtactctcccccggcgtcgcgcacgccgccgtcgcctgctcggtggactacgacgactccaacgactggggtagcgggttcgtcgccgaagtcaaggtgaccaacgaaggcagcgaccccatccagaactggcaagtaggctggaccttccccggtaaccagcagatcaccaacggctggaacggcgtgttcagccagagcggcgccaacgtcaccgtccgctacccggactggaaccccaatatcgcccccggagccaccatctccttcggcttccagggcacctacagcggctccaacgacgccccgaccagcttcaccgtcaacggcgtcacctgcagcggatcccagcccgccaacctgccgcccgatgtcaccctgacatccccggccaacaactcgaccttcctggtcaacgacccgatcgagctgaccgcggtcgcctccgaccccgacggctcgatcgaccgggtggaattcgccgccgacaacaccgtcatcggcatcgacaccacctccccctacagcttcacctggacggacgctgccgccggctcctactcggtgaccgcgatcgcctacgacgaccagggagccaggaccgtctccgctcccatcgccatccgagtgctggaccgggccgccgtcatcgcctcaccgcccaccgtccgcgtgccgcagggcggcaccgccgacttcgaggtgcggctgtccaaccagccctccggcaacgtcacggtcaccgtggcgcgcacgtcgggcagctccgacctgaccgtctccagcggctcccaactccagttcacctccagcaactggaaccagccgcagaaggtgaccatcgcctccgctgacaacggcggaaacctggccgaggcggtcttcaccgtcagcgcccccggccacgactcggccgaggtgacggtccgggagatcgacccgaacaccagctcctacgaccaggccttcctggagcagtacgagaagatcaaggaccccgccagcggctacttccgcgaattcaacgggctcctggtcccctaccactcggtggagaccatgatcgtcgaggctccggaccacggccaccagaccacgtccgaggcgttcagctactacctgtggctggaggcgtactacggccgggtcaccggtgactggaagccgctccacgacgcctgggagtcgatggagaccttcatcatccccggcaccaaggaccagccgaccaactccgcctacaacccgaactccccggcgacctacatccccgagcagcccaacgctgacggctacccgtcgcctctcatgaacaacgtcccggtgggtcaagacccgctcgcccaggagctgagctccacctacgggaccaacgagatctacggcatgcactggctgctcgacgtggacaacgtctacggcttcgggttctgcggcgacggcaccgacgacgcccccgcctacatcaacacctaccagcgtggtgcgcgcgagtcggtgtgggagaccattccgcacccgtcctgcgacgacttcacgcacggcggccccaacggctacctggacctgttcaccgacgaccagaactacgccaagcagtggcgctacaccaacgcccccgacgctgacgcgcgggccgtccaggtgatgttctgggcgcacgaatgggccaaggagcagggcaaggagaacgagatcgcgggcctgatggacaaggcgtccaagatgggcgactacctccggtacgcgatgttcgacaagtacttcaagaagatcggcaactgcgtcggcgccacctcctgcccgggtggccaaggcaaggacagcgcgcactacctgctgtcctggtactactcctggggcggctcgctcgacacctcctctgcgtgggcgtggcgtatcggctccagctcctcgcaccagggctaccagaacgtgctcgctgcctacgcgctctcgcaggtgcccgaactgcagcctgactccccgaccggtgtccaggactgggccaccagcttcgaccgccagttggagttcctccagtggctgcagtccgctgaaggtggtatcgccggtggcgccaccaacagctggaagggaagctacgacaccccgccgaccggcctgtcgcagttctacggcatgtactacgactggcagccggtctggaacgacccgccgtccaacaactggttcggcttccaggtctggaacatggagcgcgtcgcccagctctactacgtgaccggcgacgcccgggccgaggccatcctcgacaagtgggtgccgtgggccatccagcacaccgacgtggacgccgacaacggcggccagaacttccaggtcccctccgacctggagtggtcgggccagcctgacacctggaccggcacctacaccggcaacccgaacctgcacgtccaggtcgtctcctacagccaggacgtcggtgtgaccgccgctctggccaagaccctgatgtactacgcgaagcgttcgggcgacaccaccgccctcgccaccgcggagggtctgctggacgccctgctggcccaccgggacagcatcggtatcgccacccccgagcagccgagctgggaccgtctggacgacccgtgggacggctccgagggcctgtacgtgccgccgggctggtcgggcaccatgcccaacggtgaccgcatcgagccgggcgcgaccttcctgtccatccgctcgttctacaagaacgacccgctgtggccgcaggtcgaggcacacctgaacgacccgcagaacgtcccggcgccgatcgtggagcgccaccgcttctgggctcaggtggaaatcgcgaccgcgttcgcagcccacgacgaactgttcggggccggagctccc

SEQ ID NO: 32045 - DNA, 1011 bp, Thermobifida fusca
tatgacgcgtttctgctgatctccttcggtggtccggagaagagggaagacgttatcccgttcctggagaatgtcacccgcggtcggggcatccctcgggaacggttggctgaagtcggggagcactactacctcttcgatggggtcagccccatcaaccagcagtgccgggacctgatcgcagcgttgcgtgacgacttcgccgccaacggggtcgaactgcccatctactggggtaaccgcaactgggacccctacctcgaggacaccgtggccgagatggcgcgcaacggggtgcgccgcgcggtggcgctggcgacgtcggcgtacagcaactactcgagccaccggcagtacttggaggacatcgagcgggctcgcgccgcggtgccggaggctcccgagattgacctgatccgccccttctacgaccaccccgggttcatcgacgctttcgttgaccacacccgccaggcgttggagcggattcctgaggagctgcggccggagacgcggctgctgtactcggcgcactccctgccgatcgcgatggcgaagaagtcaggcgatccccgccgcgactacgggtcgctgaccgcctatgaggcgcagctgctggagacagcccggctgatcacggaacgcctcgaccgcgactacccctacgagatcgtctaccagagccgcagcggcccgccctcccagccgtggctggagcctgacatcaacgatcggctggagcagttggcgaaggaaggcgtgcggtcggtggtcgtggttccgcacgggttcgtctccgaccacatggaggtcaagtacgacctggacgtggaggcccgcgagaccgcggagaagctcggcatccgcctggagcgggcggccgctccgggaacgcacccggcgttcgtcgcgatggtccgcgacctggtggcggagcgggcggaggggcgtccgccgcgcggcctgggcgctatcgaacggtcgtgccacgacgatccagctgactgctgc

SEQ ID NO: 32046 - DNA, 2745 bp, Thermobifida fusca
gtgtcggcgaacagcttcggcagccgcgacacgctccgtgtcggtgacgagtcgtacgaaatcttccgcttggatgccatcgacggcgtccagcggcttccctacagcctgaaggtgctgctggagaacctgctgcgcaccgaggacggcgtgaacgtcaccgccgaccatattcgcgcgctggccaactgggactccaaggcgcagcccagccaggagatccagttcagtcctgcccgcgtgatcatgcaggacttcaccggcgtgccctgcgtggtcgacctggccaccatgcgtgaggcagtccgggacctgggcggcgaccccaccaagatcaacccgctggcccctgccgagctggtcatcgaccactcggtgatcgtcgacgtgttcgggcgccccgacgccttcgaacgcaacgtcgaaatggagtacgagcgcaaccgcgagcgctaccagttcctgcgctggggccagaacgcctttgaagggttcaaggtcgtcccgccgggcaccggcatcgtgcaccaggccaacatcgagcacctggcccgggtcaccatggtccgcaacggccaggcctaccccgacacctgtgtgggcaccgactcccacaccaccatgcagaacggcctgggcatcctgggctggggcgtgggcggtatcgaggccgaggcagccatgctcggccagccgatctccatgctcatcccgcgggtcgtcggcttcaagctcaccggtgagctgccccccggcaccaccgccaccgacctcgtgctcaccatcaccgagatgctgcgggagcacggcgtcgtcggcaagttcgtcgagttctacggcgagggcgtggcctcggtgccgctggccaaccgcgccaccatcggcaacatgagcccggagttcggctcgactgccgcgatgttccccatcgacgacgagacgatccgctacctgaagctgaccggccgcagcgacgagcagaccgccctcgtcgaggcctacaccaaggaacaggggctgtggcacgacccgtcggtggagcccgagtactccgagtacctggagctcgacctctccgaggtggtgccgtcgatcgccggacccaagcgcccgcacgaccgcatcgccctgtccgacgccaagacggcctggcgccgggacgtgcgcgaccacgtcaacaacgacggcatcgtcacccgcgcggacgaggcgtccgccgagtccttcccggcctctgacgcgccggcgatctccagcaacggcgtggtgaccgagcgtccgcgcaagccggtcaaggtcaccctgggggacggcaccgaattcaccatcgaccacgggtccgtggtcatcgcggccatcacctcctgcaccaacacctccaacccgtcggtcatgctgggcgcggccctgctggccaagaaggcggtggagaaggggctgtcccgcaagccgtgggtgaagacctcgctggcccccgggtccaaggtcgtcaccgactactacgagcgttccggcctgaccccgtacctggacaagctgggcttcaacctcgtcggctacggctgcaccacctgcattggcaactccggtccgctgccggaggagatctccaaggcgatcaacgacaacgacctcgcggtcgccgcggtgctgtccggtaaccgcaacttcgaaggccgcatcaaccccgatgtcaagatgaactacctggcctccccgccgctggtggtggcctacgcgctggccgggacgatggacatcgacttcgacaccgagccgctgggcaccgacaccgacggcaacccggtctacctgcgcgacatctggccttcgccggaggagatccaggaggtcatcgactccgcgatcgccgcggagatgtaccagcgggcctactctgacgtgttcgccggcgacgagcggtggcgctcgctgcccactcccaccggggacacgttctcctgggacccgaactccacctacgtgcgcaagccgccctacttcgacggcatgccgctggagcccgaaccggtcagcgacattgtcggcgcccgcgtgctggccaagctcggcgactccgtcaccaccgaccacatttcgcccgccggcgccatcaagccgggcaccccggccgctgaatacctcatggccaacggggtggagcgcaaggacttcaactcctacgggtcgcgtcgcggcaaccacgaggtgatgatccgcggcaccttcgccaacatccggctgcgcaaccagatcgcaccgggcaccgaaggcggctacacgcgcgacttcacccaggaaggtggtcccgtcaccttcatctacgacgccgcgcagaactacgctgcccagaacatcccgctggtggtgctgggcggcaaggagtacggctccggttcttcgcgcgactgggcggccaaggggacccgcctgctgggcgtgcgcgccgtcatcgccgagtctttcgagcgcatccaccgctcgaacctgatcggcatgggcgtgctgccgctgcagttccccgaaggccagtccgcggactctctcggcctgaccggtgaggagaccttctcgatcaccggcgtgaccgagctgaacgagggccgcatccccgagacggtcaaagtcaccacggacaccggggtcgagttcgacgctgtggtgcggatcgacaccccgggtgaggccgactactaccgccacggcggcatcctgcagtacgtgctgcgccagttgatcaacaag

SEQ ID NO: 32047 - DNA, 1833 bp, Thermobifida fusca
aatccagacgacctgaaaaaactccccgactcccagcttccccaattggcggcggaaatccgggagttcctcatttcccaggtcgcccgaaccggtggtcacctcggccccaacctgggtgtcgtcgaactcaccatcgccttgcaccgcgtgtttgactcgccgcgcgatcccatcctgttcgacaccggccaccaggcgtacgtccataagatcctgaccggccggaaagacttctccaaactgcggaaagagggcggcctctccggatatccgtcccgcgccgagtccgagcacgactttattgagaattcgcacgcctccaccgcactgtcctacgctgatgggctcgcccgcgcctacgaactgcaggggatcaccgaccgcaccgtggtcgccctggtcggcgacggcgcgctcaccggcggaatggcgtgggaagcgctcaacaatatcgccgaagggaaaaaccgccggatcgtcatcgtcgtcaacgacaacggccgctcctactcgccgacgatcggcgggctcgccgagcatttcgccaacctgcgtatgacgcgcggctacgagcagatgctggcgaccgcgaagaacgcgatcaaccgggcgccggtggtcggcccgccgctgtacgacgcgctgcacgcgttcaagaaaggcctcaaggacgctattcagccgcagatgatgttcgaagacctggggctgaagtacgtcgggccgatcgacgggcacgacgtggcagcggtggagcgggcgctgcgccgggcccgcgatttcggggcgccggtcatcgtgcacgtcctcacccagaagggcaaggggtacgcgcccgcggagaaccacgacgaagaccagttccacgccctcggcgcgttcgacgtggccacgggacgcccgcagtccacgccgggcctgaagtggacgtcggtgttcagcgacgagatggtgcggatcggcgcggaacgcgaagacgtggtcgcgatcaccgcggccatgctgcaccccaccggcctcgccgccttcgccgaggcctaccccgaccgggtcttcgacgtgggcatcgcggaacagcacgctgcgacgtgcgcagccgggctggccatgggtggcctccacccggtcgtcgcggtctacgccacgttcctcaaccgctgttttgaccaggtcctcatggatgtggcgctgcaccgccagccggtcacgttcgcgctcgaccgggcgggcatcacgggagacgacggtgcgagccacaacgggatgtgggacctgtccatcctgcaagtcgtccccaacctgagcatcgcggtgccgcgcgacgcggtgcggctgcgggaactgctgcgcgaggcgatctccatcgacgacgggcccaccgtggtgcgttaccccaagggcgtggtgccccccgccatccccgcggtcgaccagatcggcgggatggacgtgctgcggcgtcctgcgagcggcaccgaggccccggacttgctgctggtcgcggtcgggcccatggcgcagacgtgctgcgaggtcgccgaccggctggccgaccaggggatcggggtgaccgtcgtggacccgcgctgggtcaaaccgttggacccggcgttggtgtcggaagccgcccggcacagcgtggtcgccgtagtcgaggacaacggccgggtgggcgcggtcggtgacgcggtggcccgcgccctgcgcgacgccgacctcgacattccggtgcgcacgttcgggatcgagcagcgcttcctggagcacgccaaacgcgaccgtatcctcgcccagatggggttggacgcgcagggactagcgcgcaaactc

SEQ ID NO: 32048 - DNA, 1158 bp, Thermobifida fusca
cgcgacgtcgtattcgtcgacggggtgcgcactccgtttggtaaggccaataaaggcctttacaccgagacccgcgcggacgacctcgtcgtccgggtcatccgcgaactgctgcgccgcaaccccgcactgcccccggaacgcatcgacgaagtcgctatcgccgccaccacccagatcggcgaccagggaatgaccatcggccgcagcgccgccatcctcgccggactgccccgcagcgtgcccggctacgccatcgaccgcatgtgcgcgggcgccatgaccgcggtgaccaccaccgcggccggcatcgctttcggcgcctacgacgtcgttatcgccggcggtgtcgaacacatgggccgtcaccccatgggcgaaggcgtggaccccaacccgcgctacctctccgagaaactggtggacccctccgccctgatcatgggcaacaccgccgagaacctgcacgaccgctaccccaccatcaccaaggagcgcgccgacgcctacgcggtgcgcagccaggagaagaccgccaaagcctacgccgaaggcaagatccagcctgacctggtcgaagtagcggtccgcagcagcgagaacggctacggcctggccaccgtcgacgaaccgccgcgacccggcaccaccatggaggcgctggccaccctgaagaccccgttccgcccgcacggccgcgtgaccgcgggcaacgccgcgggcctcaacgacggtgccaccggggcgatcctcgccgccgaagacgtcgccgcggaactcggcctgaccgtcaagatgcgcctggtcgacttcgcgttcgccggagtggaccccgaggtcatgggtgtcggccccatcccggccaccgagaagctgctcgcccgcaacggcctgaccatggacgacatcggcctcatcgagatcaacgaggccttcgccgtccaagtgctggccttcctggagcacttcggcatccccgacgacgacccgcgggtcaacccgtggggcggcgccatcgcgatgggccacccgctggcctcctcgggcgtgcggctgatgatgcagctgtcccgcctcttcgcggaacgccccgatgtccgctacggcctgaccaccatgtgcgtgggcatgggcatgggcggaacggtcctgtgggag

SEQ ID NO: 32049 - DNA, 1011 bp, Thermobifida fusca
gactctgcttttctccgggcctgccgcaggcagcccgtcccgcacaccccggtatggttcatgcgccaggccggacgctccctgccggagtaccggaagctccgcgaaggcgtgcccatgctggaagcctgcgcccggccggacatgatcgtcgagatcaccttgcagccggtgcgccggtacaacgtcgacgccgcgatcttcttcagcgacatcatggtcccgctcaaggccatcggcgtcgacctcgacatcaaacccggcgtcggcccggtcgtcgccgagccgatccgcgaccttgccgccactcggcggctgcgtggcctcgaacccgacgacgtgccgtacgtaaccgaggcgatccgcgaactggtgcgggaactcggcagccgtccactcatcgggtttgccggagggccgttcacgctcgcctcctacctgattgaaggcgggccctcccggcaccacgagcacaccaaggccttgatgtacggcgcgcccgaggtatggactgaactgatgcggcggctgtccgccatcaccttggaattcctgcgggtgcagatcgccgcgggggccagcgccgtgcagctgttcgactcctgggtgggagcgctcagcgcggaggactaccgggccaacgtcctgccctactcctcgtggatcttcgcccagctcgccgagttcgacgtgccccgcatccacttcggggtcggcaccggcgagctgctgggattgcttagcgaggccggtgccgacgtggtgggcgtggactggcgggtgccgctcgaccaggcagcgcgacgggtccgtccccacaccgcactccaggggaacctcgacccggcggtgctgttcgccccgtggagcgtggtcgcggaacgcaccgacgacgtcttggcccgcgccaaggccgccgaaggccacgtgttcaacctcggccacggagtgcttcccaccaccgacccggcagtcctagagcggctggtggagtacgtccacacgcagacc

SEQ ID NO: 32050 - DNA, 1377 bp, Thermobifida fusca
gtgtccggtctggccgtcgcacaccggctcgcccgcagcggacaccgcgtcaccgtgctggaagccgcggcacggcccggcggcaaactcgcggtggagaaagtcgcaggggtctccgccgacgtcggcgcggaagcagtcctggcccgccgtcccgaggcgctctccctcattgacgaactcggtctcaccgagcgggtcacccacccaggaaccgtgacctcgcagatctacagtcgcggcaagctccgggacttcccggaaggccatgtcatgggagtgcccagcgacttcgcggccctagcccgcagcggggtgctctccccgctcggcgtgctgcgcgccgcccgcgacctcgtctggcccgccacccccgtcaaggcggacgtcccggtcgccacctacatcgggatccggatgggccgcgaaaccgtcgaccgtctcgtggaaccgctcttgggcggtgtctacgcgggccgcgccgaccaactgtccctggacgccaccctgccgcagctcgcctcggccgcccgcacccagcggtccctggcagcgatcgcacgcgacacacactcccggaccgcccgcccgaccgcagagccaccgcctccgctcttcgccaccttgcgcggcggcctggccaccctgatcgacgcccttgccgcacagccaggcgtcaccgtccggaccgccaccccggcccgggacctgcgccgcaccgagcaggggtggcaactggccgtgggcgacccgcctgccgaaacggtcgatgccgacgcggtcgtgctggcctgccccgcgccggaggcggcacgcctgctgcgcacgatcgccccgagcgccgcagtggaactgggcggtgtccgctacgcgagcatggccgtggtcaccctcgcctacccgctctccgcgttccccgccccgcctaccgccagcggattcctggtgcccagcgtggaaggccgcaccatcaaagcggtgaccttcagcagtgtgaagtggccgtggctcgccgcggagctgcgcgacgccaacccgggggaagagattgtgctgctgcgctgctcgctcggccggttcggcgacgacgcagtcgtggactacgacgacgacacgctggtggcccgggccaccagcgaccttgcagacctgtgcggggtgtccggaccgccagtggacagccacgtcacccgctggaacgccggactcccccagtacacggtgggccaccgcgatcgggtcgcccggatccggtcggccctggacggtatcgacgggctcgccgtgtgcggcgccgtctacaacggcgtgggtatccccgcgtgcctcagcagtgctgaagaggccgcgcgccgtatcactcacacaaccggagga

SEQ ID NO: 32051 - DNA, 693 bp, Thermobifida fusca
cgcctctccgtagccgactgtctcacactcggcaatgcgctgtgcgggttcatggcggtctgccagctcgtcaccgcacagctcgcgcacaccgcgtccggtgccctgggaccgctgccccgcgaagcggtcacgatgcccatcatcctgctgctgggtgcggcagccttcgacctgttcgacgggagggtggcgcgccggctcggcggcagcgcaatgggcgccgagctcgacaacctggccgacgtgatcagcttcgggttcgccccggcgttcttcgtggtcacctggggtgctttcacccactccgctggttcggtgctggtgcttgtggtcgcggcggcagtcctgctggcggtcgtggtccggttggcccggttctcctgccagtctcccggggaccgccacttcaccggcctgcccagcccgttcggtgcgatgacggtgatcgtcatcgtgctgctgcacccgccggtgtacgtggggagcctcgcgatcctcgtggtggcctggctgatggtcagttcgatccgctaccccaagccccgcggccggtcggcctacaccgttgtggcgtctctcgtgggaggcgcgggatgcctggtggcgtgggcgatggacgctcctggcgggctcctgctgctctactccagcgcgctgttgatgctgctcgtgctggtcttggcaccgatg

SEQ ID NO: 32052 - DNA, 2082 bp, Thermobifida fusca
gtctggcctggtcacgcgtatccgctcggggcgacctacgacgggtccggaaccaacttctcgcttttctccgaagtcgcgaccggggtagaactctgcctgttcgacgacgacggggcggagactcgggttccgctcaccgaacaggacggccacgtctggcacggctacctgccgacggtgggtcccggacagcggtacggataccgcgtccacggaccttacgatccggaacgtggcctccgctgcaaccccaacaagctcctcgtcgacccctacgccaaggccatcgacgggcagattcactggcacgagtccctcttcgactaccactttgccgaccctggccgggtcaacaaccacgacagcgccccctacgtccccacctgcgtcgtcgtcagcccgttcttcgactggggggccgaacagcaccccaacatcccctaccacgagacggtcatctacgaggcccacgtccgcgggatgaccatccgccaccccgacgtgccgccgccgctccgcggcacctacgccggaatggcgcaccccgccatcatcgagcaccttctctccctgggcgtcaccgcggtggagctcatgccgatccaccacttcctgccggagcacgccctggtcgcccgagggctcaccaactattggggctacaacaccctggcgttcttcgcgccgcacagcggatacgccgccaccgggacccggggccatcaagtccaggagttcaaaaccatggtcaaggccctccaccaggcggggatcgaagtcatcctcgacgtggtgtacaaccacaccgcggaaggcgaccacatgggccccgccctgtccctgcgcggcatcgacaacctcgcctactaccgggtgcgggaagacaatccgcgctactacctggactacaccggctgcggcaacagcctcaacgtgcgccacccgcactcgctgcagctcatcatggactcgctgcgctactgggtgctcgacatgcacgtcgacggtttccgctttgacctcgccgccgccctcgcccgggagttccacgacgtggaccggctcagcacattcttcgacattgtccagcaggacccggtcatctcccaggtcaagctcattgccgaaccgtgggacgtgggccccggcggctaccaggtcggtaacttcccgcccctgtggaccgagtggaacgggaaataccgcgacactgtccgcgacttctggcggggctaccccgtactgccggagctcgcctcccgcatctccggctcctccgacctctaccaggccgacgggcgccgccccgtggcttccatcaacttcgtcacctgccacgacggcttcaccttggccgacctcgtctcctacgaccgcaaacacaacgaagccaacggggaggacaaccgggacggcaccgacgacaaccgctcgtggaaccacggcacggaaggccccaccaccgactctgccatcgccacgctgcgccgccgccagatgcgcaacatgctgaccacgctcatgctcagccaaggcgtgcccatgctctcccacggcgacgagatcggccgtacccaacacggcaacaacaacgcctactgccaggacaaccccatctcctgggtggactgggagctcgcccgccgcaacgccgacctgctcgactttgtgcgcaccctgtcccggctgcgccgggagcacccggtgttccggcgtcgccgcttcttccagggggccctccccgggcggggcaagcagcgcgacatcgcctggctgcgcccggacggcacgctcatggaggatgccgactgggggcgggggtggcgcgccctcggcgtgttcctcaacggcgacgcgatcaccgagccggaccggatgggccgccggatccgcgacgactcgttcctcctcctgctcaacgcggggatcaacgacgtgcagttcaccctgcccggtcccagctacagcgcggcgtgggagacggtggtcgacacggccgaccctgaggtggccggccgcccctacttgcccgccggcagcgacgtcaccgtgatcgaccggtcgttcctggtgctcaag

SEQ ID NO: 32053 - DNA, 710 bp, Thermobifida fusca
accggggaggagcagcgttgaacatcacggccgacggcgcggcgttcgccgctgaggctgccgcccgcctggaagaagccagcgccaccgagatcatccagtgggccgccgacacgttcggcgaccggctgtgcctgaccgcgtcgatggcggacgccgtcatggtggacctggtctcgaaagtagtcccgggcatcgacgtgatcttcctggacaccggctaccacttcccggagacgctggggacccgcgacgcggtcgcgcagacctacccgatcaacctgatcacggtcacccccagccggaccgtagcggaacaggatcgcgacctcggtccccggctgtacgcccgcaaccccgacctctgctgctacctgcgcaaagtagagccgctgcagcgggcgttgcagtcctacgacgcctggctgaccgggctgcgccgcgacgaggcggtgacccgccgcaccgtgggggtcgtgcagtgggacgcccgcaagaagaagatcaaagtcaatccgatcgcccgctggacccaagagcaggtggactcctacatcgctgagcacggggtgctcgtcaacccgctgcaggacgacggctacccctcgatcgggtgtgcgccgtgcactcagcgggtgccggaaggcgccgacccccgcagcggtcgctgggcgggaacagggaaagtcgaatgcggtctccacagttga

SEQ ID NO: 32054 - DNA, 1662 bp, Thermobifida fusca
cccgccaggaagacgacgcgcccgcgccgcggcgaggggcagtgggctctcggctaccgcgagccgctcaacaagaacgaagagatcaaaaagaacgatgatgggctcaacgtccgcaagcgcatcatcgacatctactccaaacagggcttcgattccatcgaccctgccgacctgcgcggacgattccgctggtacggactctacacccagcgcgccccggggatcgacggcggtaagacagcggtgctggagcccgaggagctcgacgaccgctacttcatgatgcgggtccgcaccgacggcggacagctcaacgtggcgcagctccgcgtgctcgcggaagtatccaccgcctacggccgggacaccgccgacatcaccgaccggcagaacatccagatgcactgggtgcgtatcgaggacgtccccaccatctgggagcggctggaaagcgtggggctcaccaccaccgaagcctgcggcgacacccctcgcggcctgctcggctgcccgctggccgggatcgccgaagacgagatcatcgacgccaccccgcagctccgccaaatcgtcgccgaccacatcggcagcccgctcttctccaacctgccgcgcaagttcaagaccgcgatcgacgggtgtgccgtgcactgcaccaactacgaggtcaacgacgtggctttcgtcggcgtcatcggacccgacggtacgcccggttacgacctgttcgtcggcggcggcctgtccacgaacccgatgttcgcccagcggctcggcgcgttcgtccgccccgaacaggtcagcgaagtgtgggcgggcgtctgctccgtgttccgcgactacggctaccgccggctccggcaccgcgcccgcatcaagttcctcatcaaagactggggtccgcagaagttccgcgaagtactggagaaggaatacctcggctactcgctgccggacggccccgaaccggtcctcgacccgggcacccgccgcgaccacgtgggcatccaccggcagaaggacggccgcttcttcgtgggcttcgcccctcgggtgggccgggtcagcggcaccatcctgggacggatcgccgacatcgctgaagcgcacggctcgaaccgggtgcgtaccaccgccgaccagaagctggcgatcctggacatcaccgaagaccggctggactcggtcgtggccgcgctcgaagccgaagatctccaggtgaaccccagcgtcttccgccggcagaccatggcctgcaccggcatcgaatactgcaagctcgccatcgtcgaaaccaagaaccgcgcgatggccctcatcgacgagttggagcgccgcctccccgacttcaccgaaccgctcaccatcaacgtcaacggctgcccgaacgcctgcgcccgcacccagatcgcggacatcgggttgaaaggccagctcgtcaccgacgcccacggcaaccaggtggaaggcttccaaatccacttgggcggaggactgggcctgcaagccgggttcggccgcaaggtgcgcgggctgaagacgaccgccgcggaactccccgactacatcgaacgggtagtgcgccggttcgcggagcagcggcaggccgaagagaccttcgcggaatgggtggcacgcgcagacgaggcggacttgaaa

SEQ ID NO: 32055 - DNA, 768 bp, Thermobifida fusca
aaggggatcgcaggatcggtcgccgtcgtcaccggtgcaggaggcgggatcggacgcgctgtcgccacggctctcgccgcgcagggcgccgcggtcgccgcagtcgacgtcaaccccgaaagcactgcccagaccgtcaccggcctggcgcaggccgggcagcgcggaaaaggctacgcgcgcgacgtcaccgacaccgcgggagtggagcgcctcttcgacgagatcgaacacgacctgggccccgtcgacatcctggtcaacgccgccggcatcctgcgcaccggacccgtcgtcgactgccccgaccacgactggcacgacctgatcgcggtcaacgccaccggggtgttcaccgtctcccgcgccgcggcacggcagatggtgccccgccgccgcggctgcatcatcactgtggcatccaacgcggccggcgtcccccgcgccgccatggccgcctacgccgcatccaaagccgccgcagtcgccttcaccaagtcgctcggcctagaactcgcaccgcacggcatccgctgcaacgtggtgtcccccggcaccactgacacccccatgctgtgggcgatgcgcccggaaggctacaccgaagccgacgccgtcgctggagaccccgacctgtaccggatcggcatccccctggggcgcatcgcccgccccgaggacatcgccgacgccgtgtgcttcctcgcctcccccgcagcacggcacatcaccctgcacgacctgtatgtcgacggcggcgcctccctg

SEQ ID NO: 32056 - DNA, 1599 bp, Thermobifida fusca
accccctggcccgcggagttcgccgtccgctaccgcgaggcggggtactggaccggggagactttcagcgacttcgtcaccgaccgcacccgccgtttcgccgaccgcctcgccgtggtcggcgcgggccagcgctggacctatgccgaactgggggagcgctccgcggtcctcgccaccgggctggcccggctcggcattgccgcgggcgaccgcgtcgtcgtccaactccccaacatcccagaactgttcgaagtggtcttcgcgctgttccggctcggcgcgctgccggtgtacgcgctccccgcccaccgggcccacgaaatcacccacctgtgcaccacggcccaggcgaaagcactcatcatccctgaccggcacgccggtttcgactaccggaccatggccgcgcagctgcgccacgccggcactgcccccgaacacgtggtggtcgtcggggagccgggcggcttcaccccgctggccgagctccgtgccgaccggcccgaccccggcgtcttcactcggcccgaggcgagcgacgcggccttcctccaactctccggcggcaccaccgggctgcccaagctcatcccccggacccacgacgactacctgtactcggtgcgggccagcgcggagatctgcgccctcggcaccgacaccgtctaccttgcggcgctgcccgccgtgcacaacttcccgatgagctcccccggcttcctcggcacctttcacgctggaggcaccgtcgtgctcgcccccaacccttcccctgacaccgcgttctccctcatcgaaaccgagcgggtcacgatcaccgcggtcgtccccccgatcgcgctgcagtggctggacgcggtggagcacggctcccagagccaccgggacctctcttcactgcgcgtcctgcaagtcggcggcgccaagttcgccccggaagcggcccgccgggtccgccccgtcctcggctgcaccctccagcaggtgttcggcatggccgaagggctggtcaactacacccggctcgacgaccccgacgacatcatcaccaccacccaggggcggccgatcagcccggacgacgagatccgcatcgtcgacgaggccgaccggccggtgcccgacggcgaagtcggccacctgctcacccgcggcccctacaccatccgcggctactaccgggccgaggagcacaacgccaccgcgttcacccccgacggcttctaccgcaccggggacctggtgcgccgcacccccaccggccacctcgtcgtcgaaggccgcgccaaagaccagatcaaccggggcggcgagaaggtctccgcggaagaagtggagaaccacatcctggcccaccctgccgtccacgacgcggccgtggtcggcatgagcgacccctacctgggggaacgcgtctgcgcctacgtcatcgcgcgcaccgaaccacccagccggagcgaactgctgcgcttcctccgcgaacggggcctggcctcctacaagatccccgaccgggtcgaattcgtggaccgcttccccgtcaccggcgtcggaaagatctcccgcagcgaactccgccgggaactcgcacgtaga

SEQ ID NO: 32057 - DNA, 708 bp, Thermobifida fusca
gccgtcatgtctcgctcggttctggtcaccggtggcagccgcggaatcggtctggccatcgccagggagctcaaggaagcgggcgacgacgtcgcggtgacctaccgcaccgggcagcccccggaaggactgttcggggtccaatgcgacatcaccgacagcgcccaggtggacgccgctttcaagcaggtggaggaggcccacggcccggtcgaggtcctggtcgccaacgcgggcatcaacaaggaccagttgctggccctcatgagcgaagaagacttcaacgcggtgctcgacaccaacctgaccggcgcgttccgggtggccaagcgcgcagtgcgcggcatgatgcgtaaacgcagtggccgcatcatcctcatctcctccgtggtcggcctggccgggtcgccgggacaggcgaactacgccgcatccaaggccgggctcgtgggcttcgcccgctcgctcgcccgggaactcgggtcccgcaacatcaccgtcaacgtggtcgcccccggctacatcgagaccgacatgaccgcggcgctgcccgagaaacgccaggaggagatcaagaagaacgtgccgctgggccggtacggcaccaccgccgacgtggcgaaagccgtgcggttcctcgccagcgaggacgccggctacatcacgggtgcggtcatccccgtcgacggcggcctcggcatgggccac

SEQ ID NO: 32058 - DNA, 759 bp, Thermobifida fusca
ggaattctcgaaggcaaacgcatcctggtcacaggcgtcctgaccgactcctccatcgccttccacgtggcacggctgtgccaggagcagggggccaccgtggtcctcacgggatacggtcggctcactctcgtggagcggatcgctaagcggctgcccgaacccccgccggttctcgaactggacgtcaccaacgacgagcacctcgacaccctcgccgaccgggtcgccgagcacgtcgacgggctcgacggcatcgtccactccatcggctacaccccgcaggaggcgctcggcggcaacttcctcaacacccgctgggagcacgtcgctaccgcgctccacacgtccacgttctccctcaaatccctcacaaccgcgctgctgccgctgatgaagaacggcggctcggtggtggcgctggacttcgacaacagcgtctcctaccccatctacgactggatgggcgtggccaaggccggactggcctccaccgcccgctaccttgcccgctacctcggtgagcagaagatccgggtcaacctggtctcggccgggccgctgaacaccatggcagcccgcagcatccccggcttcgaggagctggccgcggaatggccgaagcgcgccccgctgggctgggacatcaccgacccggaacccgcggcccgcgcggtcgtggccctgctgtcggactggttccccgccacaaccggggagatcgtgcacgtcgacggaggattccactccaccggcgca

SEQ ID NO: 32059 - DNA, 726 bp, Thermobifida fusca
ctgcgtggtgccgcggtgctggtcaccggagcaagccgggggatcggccgggcgatcgcccaagtcttcgctgaagaaggcgccaacctggcgatctgcgcccgcacccgggcaccgctggaagtcgcggcacgacagttgcgcgagaccggcgcgatcgtcatggcccgggaagtggacgtcgccgacgccccggcgctgcgcgcgttcgtcgacgaggcagcagccgaactcggcggcctcgacgtggtcgtctccaacgtctccggcggcggcgccgtgggatgggaaggagccctgcgcaccgacatcctgccgttcacggtcctcaccgaccaagcacaagaacacctcgcctcctcccaacgcggcggcgcagtcatcctcatctccagcacttctgcgctgcacgtcaccgcaccgtccggtcccaagccctacggcgcggtcaaagcagccctcaaccaccacgccaccgccttggcccgggcgctggcaccccggggcgtgcgggtcaacatcgtctctcccggccccatcgagttcgaaggcggcagctgggcccggcggcgggacaccgaccccgactactacgcgagtgtgcgggcccgcatcccgttcggtcggctcggccgccccgaggaagtcgcccgggcggtcgcgttcctcgccagcccggccgcgagcttcatcaccggcgccaacctggtggtcgacggcggtttc

SEQ ID NO: 32060 - DNA, 2322 bp, Thermobifida fusca
ggattgacctctgcgcaggccgcgcagcggctggctgccggactaggcaacgatgttccggtgcgggccagccgcaccgtcgggcagatcatccgggccaacgtcttcacgcggatcaacgcgatggtggcggtgctgttcggagtgatcgcggtcatcgggccggtccaagacgggctgtttgccctcgtcatcgtgatcaacaccctggtcggcatcgtccaggagctgcgcgcgaaaaagaccctggactcgttggcgatcatcaatgcggcccggccgcgggtggtccgcgacggggtagcggtggaggtgcgcccccaggaggtggtgctcgacgatgtgatcgagctggggtccggggaccaggccgtggtggacggggttgtggtgtccgcctccggtctggaagtggacgagtcgctgctgaccggggaagcggacccggtcctcaaacagcccggcgacccgatcctgtcaggcagtttcgttgtggcgggcagcggccggttccgggccactcgggtgggccgtgacgcatacgcggcccggatcacggaggaggcgtcccggttctccctggtccgttcggagctccgctccggggtggaccggatcctgcggttcatcacctggctgctgttccctatcggcggtctgctgctgtacagccagttgttcttggatgcgcacgtcaccgcggaagtctcggcgggcggcactatttccgggccgttcgcggatgcgttgcgcggcacggtggccgcgctggtgtcgatggtcccggaagggctggtgctgctgatcagcatcgctttcgcggtgggggtgatccggctgggacggcggcgctgcctggtgcaggagctgcccgcgatcgaagggctggcccgggtggacgtcgtctgcaccgacaagaccggcacgctcaccgaggcggggatgcggctggcggaagtacggccgttggacgctgccgcggacgcggacgcgttgaccgaggtgctcgccgcgcttgccgcggccgacccgcaccccaatccgagcatggccgcgatccgcgactcctgcggcacgcccccggactggccggtggccgcggtacggccgttctcctcggcacgccggtggagcggggcgagtttcacgacgccgcaagggaagcagcattgggtgctgggtgcgcctgaagtgctggcggacgccgactcgccagcggtggcggccgctgcccggacggcggcgcagggcctgcgagtgctgctgctgggacgggccgacgcagccgtagacggccctcaccaggtgaccccgatggccctggtcgtgctcgagcagcgggtgcggcccgactcggcgccgaccctcgactacttcgcccgccaggatgtggcggtcaaagtggtctccggggacaacgcggcctccgtggccgcggtcgcccacactctggggttgcccggcgcagaccagccggtggacgcccgcgacctcgccccgcaggacgcagatttcgcggagaaggtggagaaagcgaccgtgttcggccgggtgtccccggagcagaagcggtccatggtggcggcgctccagcagcatggccacaccgtggccatgaccggggacggggtcaacgacgtgctcgcgctcaaagaagccgacatcggggtggccatggggtcggggagtcccgcggctcggtcggtcgcgcagatcgtgctgctggacgaccggtttgcgaccctgccgcacgtggtcgcggaagggcggcgggtgatcgggaacattgaacgggtcgccaacctgttcctcaccaaaaccgtgtattcgatgacgatggcgaccgtggtgagcctgctggcggtcgcctacccgttcttcccccgccacgccacgctcatcaacgccgtcacgttcggaatcccctcgttcttcctcgcgctggcgcccaccacggagcgggcccggccggggtttgtggcgcgaacgctgcggctggccgtgcccgcagggctcgtcagtggactcgccgcgatgaccacctacttcctggtgttggacggggcggacactcccacgctggccgaccgtacggcggtactgatcacgctgtgtgccaccacgctgtgggtgctgctgctcgtggcccgcccttatgtgtggtggaaggcggtgctggtcgctgccatggtggggctgctgctggcagcgctgctcacccccgtggggcaggcgttcttcgcgttggatatgagcgaccccgctgcggtgggcaccgcgttggcggtggcgggggtagcggccgcgatcatcaccgtgatc

SEQ ID NO: 32061 - DNA, 609 bp, Thermobifida fusca
gcggtgctgttcgatatggacggcacgctgatcgacaccgagccgctgtggatcgccacggaggccgaggtcgccgccgaactcggctgtaccacgtggacggtcgaggaccagcggcgctgcttggggagctccgcggcgatggtggcctcctacatcgctgagcgctcggggacgtcggttccgcagagtgagatcgtcaccatgctgtacacgtcggtggcgcggcggatggccgacagtccccccgtgcagccgggcgctaaggagctgctcagcgaactggatgccctgggggtgccgatggcgctggtcacttccacgtaccggtcgctgctgggcacggcactgcgcggtctgggggagcactatttcgcggcgacggtggccggggacgaagtgtcccaggccaagccgcacccggagccttatctcacggcggcacgcctgctgggtgtggatccgcgccgctgtgtggcggtggaggattcgcccgctggcgtggctgcggcccaagccgcagggtgtgtcgtggtcgcggtgccgcatgtggctccgatcgaggaggcggagcggcggtatgtggtctcttccctgacggagatcagc

SEQ ID NO: 32062 - DNA, 207 bp, Thermobifida fusca
gacaccaacgagtacgcggcaacgttcaacctggtcgacagcgacggagaccagcgcatctccgcgcgggaactggggcggctcatggaagtgctgggctcgccgatcaccctcgaccaggccgaagaggccgtgcgcagcatcgactccgacggcgacgggctgatctcgctcgaagagttcgctgcctacctggagtccgcccgc

SEQ ID NO: 32063 - DNA, 747 bp, Thermobifida fusca
gtgtcgatgccgttctacgtctcgcccgaacagatcatgaaggacaaggcggactacgcgcgaaaagggatcgcgcggggccgcagcgccgtcgtactgcaatacgagggcggcatcctgttcgtggcggacaacgtgtcccggacgctgcacaagatcagcgaactctacgaccgggtggcgtttgccgcggtcggccgctacaacgagttcgagaatctgcgccttgccggtgtccgcttcgccgacatgcacggctacacctacgaccgcagcgacgtcacaggccagatgctggccaacgcgtacgcccagaccctcggcgcggtcttcacggagagcagcaagccctgggaagtcgagattgtcgtcgcggaagtcggtgactcccccgactccgaccagatctaccggattactttcgacggttccgtggtcgacgaacgcgacttcctggcgatgggcggctccgccgagcgggtgactgcggcgctgcgggaacggtacgtcaagaacatgtccctgaccgacgcgctgcgggtcgcggtgcacggtctggcgcacgaaaacggtgaacgacgcgagctgaaagccagcagcctggaggtggcgatgctggaacgttcgcggccgcaccgtaagttccgtcgcatccagggggaacggttggcccggatgctccaggaggcgcgcgaggccgaggaggcggctgaagcgcagtcctctgaagacggcggcgccactgac

SEQ ID NO: 32064 - DNA, 726 bp, Thermobifida fusca
cgcttcaccgaccgcgtcgccctcgtcaccggggccgcaggcggcatcggggccgcaaccgcacagcggctagccgccgaaggcgccgccgtggtcctcaccgacatcgacacggaacgcggagaacgcgtcgccgcccgcctccgcgaccaaggccaccgggcggtcttccagtactgcgatgtctccgacgaagactcctgggcccacgccgtccgcaccgccaacgacacgttcggccccgtcgacgccctcgtgagcaacgcctaccgcgtcaccatcgcccccgcccacgccacctcgcttgccgactggaacgaccagatcgcggtgaccctcaccgctactttcctcggggtacgcgcctgcctcactgacctcctggcccgcaacggcagtgtggtcgcggtgtcctctgtgcacgccatggtgggcctgcccggccgccccgcctatgccgcggccaaagccgggctgactggactggcccggcagctcgccgtggaatacgggccgcagatccgggtcaacagcgtcctccccggcccgatccgcacccgggcttgggacaacgtcagcgaagacgacgtgcgccgcagcgtggagcagaccgtggcaggccgcctcggcgaacccgacgaagtcgccgccgcgatcgccttcctcctctcctccgacgcctcctacatcaccggcaccacactgctggtcgacggcggctggacc

SEQ ID NO: 32065 - DNA, 1146 bp, Thermobifida fusca
atggatttcaccctcaccgaggaacagaccgcgctgcgcgccatggcagcggaattcgtcgaccgcgagatcaccccccacgtcgtagagtgggaccgcgccgagagcgtcccccgggacctggtaccgcgcctcggtgaactcggcttcctcggcatgaccatccccgaagagtacggcggcgtgggcggcgaccacgtctcctatgccctggtcatggaagaactcggccgcggcgactcctccgtccgcggcctggtctcggtctccctgggcctcgtcgccaagtccatcgccacctacggcaccgaagagcagcggcaacgctggctgcccggcctgtgctccggggagctcctcggctgcttcggcctcaccgaacccgacaccgggtccgacgccgcctccctgtccctgaaggccgtccgcgacggggacgactacgtgctcaccggctccaaaatgttcatcaccaacggcacctgggccgacgtcgccatcatcttcgcccgcaccggcggacccggccccaaaggcatcaccgccttcctggtgcccaccgacaccccgggactgacccgcaccaccatccacggcaaactcggcctgcgggggcagcccaccgcccagctcttcctcgacgaggtgcgggtcggccccgacgccatcctcggtgaggagaaccaaggcttccgcatcgccatggcagccctggacaagggacgcgtctccgtggcggccggagccgtaggcgccgcccgcggcgccctggaaagcgccctcgcccacgccaaggaacgcgtccaattcggccgtcccatcgccggattccagctcgtccaagaaatgctcgccgacatggcggtggaaaccgacgccgcccgcctcctcgtgtggcgggccgccgacctcatcgaccggggagaacccttctccacggccgcatccatggccaagctgtacgccaccgaaaccgcggtgcgtgccgccaacaacgccatgcaggtcttcggcggctacggctacatcgacgaatacccgcccggcaagtacctccgcgacgcccgcgtcaccaccctgtacgagggcaccagccagatccagaaactcatcatcggccgcgccctcaccggcatcagcgccttc

SEQ ID NO: 32066 - DNA, 1389 bp, Thermobifida fusca
atctacatcgacggccagtggatcgccccccagaccagcgaccgcatggcggtggaaaacccctacacctgccaggacatcgccaccatcccgctgtgcgggaccgaggaggtcgaccacgccgtccacgctgcccgccgcgccttccccgcctggtccaccaccgacctggaagagcgcctcgcccacctggacgccctgcgccgcgaactcgccgtgcgcgccaccgagatgtccgccctcatcacctcggagatgggcgcgcccaaggtgatcgccgaccgcatccaggtaggactccccctcactgttctcggggacaccgtcgccaccgcccgggacttcgcctggaccgagaagatcggcaactccctcatcctccgcgaacccatcggcgtcgtcggcgccatcaccccgtggaactatccgctgcaccagatcgtcgcgaagatcgcccccgccctcgccgcgggctgcaccgtcgtcctcaaacccagcgagatcgccccgctctcggcgctcctcctcgccgagatcatcgactccgtcggcttcccacccggcgtgttcaacctcgtcaccggcaccggccccgtagtcggcgaagcactggcggcccacccggacgtggacatgatctccttcaccggctccacccgtgccggaagccgcgtctccgaagtggcctccgccaccgtcaagaaggtcgccctggagctcggcggcaaatccgccggagttgtcctcgacgacgccgacctgcctaccgcggtgaaagccgtcgtctccgactgcctgctcaactccggccagacctgcaccgccctgacccgcctgctcgtgccgcacgaccgctacgaggaagcggtcgccctcgccgtggacgcggcccgcagcaaacccatgggcgaccccgctgaccctgccacccgtatcgggccgctggcctcggccgacgcccaccgccgcgtcctggggcacctggagcaggcccgcaaggacggcgcggtcttcgccaccggtggacccgacgccgacgtgcccgaacagggatacttcgtggcccccaccgtactggcgggactggaccgcgacgccgcagccgcgcgcgaagaaatcttcggacccgtgctcaccgtgctcggctaccgcgacgtcgacgacgcagtggaactggccaacgccaccgactacggcctctccggcgcggtctggtcggccgacaccgaccgggccctcgccgtggcccgccggatgcggaccggtcaagtcgccatcaacggcggccggttcaacccctccgcgcccttcggcggctaccgcaagtccggcaacggacgtgaactgggccgcttcggcttggaggagttctgcgaagtcaaggcagtc

SEQ ID NO: 32067 - DNA, 2856 bp, Thermobifida fusca
tctaggctgaccagtatgagcacttatgccgcccgctacgccgagttccgcaggcgacaaaaggagtccagccccaccatcgaggagttccagaatctctacgggttcgacttcgacgacttccagatccgggcctgcaaagccttggagacggggcatggggtgctggtcgccgcacccaccggttccggaaagaccgtcgtgggagagttcgctgtccacctggcgctgcgtgacggtcgcaagtgcttctacaccaccccgatcaaggcgctgtccaaccagaagtacaccgacctggtgcgccggtacggctccgacaaggtggggctgctcaccggggacaacagcatcaacggtgaggcgcctgtcgtggtgatgaccaccgaggtgctgcgcaacatgctgtacgcgggctccgccacactgtcgggcctggcgtacgtggtcatggacgaggtgcactacctggctgaccggttccgcggcgcggtgtgggaagaagtcatcattcacctgcccgaatccgtgcagatcgcggcgttgagcgccacggtcagcaacgccgaggagttcggccagtggctccagcaggtgcgcggcgacacgtcggtgatcgtggacgagaaacgccccgtgccgctgtggcagcacatgatggtgggcacccgcatccacgacctgttcgtggaaccggagggcaccgacaccgggcaggaagaggagaagaacggacgcggctcccggaaacgccgccggtcccggcatgcccggcagcgcaccgtggagatcgaggtcggcggggaacggctccacgtcaacccgaaactcatccggttcgccgaagaggacgcccgcctcacccaactggcctaccagcgccgccacccgcaggcgcgggcccgcggcggtgctccccggccgcggagcaggttcgcgccgcccactcgggcacagatcgtcgaacagctcgaccgcgaaggcctgctgcccgccatcacgttcatcttcagccgggcgggctgcgatgaggcggtgcgccagtgcgtggccagcgggctggtgctgaccaccccggaggaagcagcagagatccgcgagtacgcggaacggcagtgcgccgagatccctccggcggatctcaacgtgctcggctactccgagtggctgcaggcattggagtgcgggatcgccgcccaccacgccgggatgctgcccaccttcaaagaagtggtggaagtgttgttctcccgcggcctgatccgcgccgtgttcgccacggagacactggcgctgggcatcaacatgcccgcccgcactgtcgtcatcgaaaagctcgacaagtggaacggggagacgcacgtcgccctcacccctggcgagtacacccagctcaccggccgtgcgggacgccggggcatcgacgtggaggggcatgcggtcgtggtgtggcagccaggcaccgacccggagatggtcgccgggctggcgggcacccgcacctatccgctcaactccagcttccagccgtcctacaacatggcggtcaacctggtcgcgcaggtcggtcgggaacgcggccgggccatgctggagtcctccttcgcccaattccaggcggaccgttccgtggtgggtctggtgcggaagctccgcgcccagcaggaggcgctggaaggctacgccaaagccgcctacgacccgcgcggcgacttcatggagtacgcggcgatgcgccgccggctctccgacttggagagcgccgcgcaacgcaaccggcgcacggcacgccgcaaggaagcggaacgcagcctgcgtgcgctccgcaccggcgacatcatccgtatcccgtcgggacgccacgccggctacgccgtcgtgctggacccggggctggacaagggcccgctgcctgtcccgctcgtgctgaccgtgaaccgccaggtgaaacgggtcagcgccaacgacttcccgatcccggtggagccgacagggcggctgcggataccgaagtcgttctctgcgcgttccgcgcaggcgcgccgcgacctggcgtcagcgctccgcagcaaactggagactcttcccacggctccgatccggcaccgggtgcgcgacggggccccagaggacccggagatcgcggagttgcgtgctcgcatccgagagcacccttgccaccacagcgaaggccgggaggaccgggcccgctgggcggaacgctacttccggttgaagaaggagaccgaggaactggagcgccgtatcgaaagccgctcccacgtcatcgcccgcacgttcgaccgggtctgcggagtgctgcaggaactggactacttggagggcgacaccgtcaccgaggacgggcggctgctcagccgcatctactcggagctggacctgctggcagccgagtcgctgcggcgcggcgtgtgggatgcgctggggccggaggagctggccgcctgcgtgtccgcgctggtgtacgagtcgcggcggcctgacgaggtgttcgcccgcgtgccgtccggccctgtcgaggaggcgctgaacgccatgatgcggctgtggggcgagctgagcgatatcgaacaccggcaccgcgtgtccttcctgcgggaaccggatctgggcttcgtctggcccacctaccggtgggcgcgcggcgaccagttggatcacatcctcaacgaggcggggatgccggcgggcgacttcgtacgctccacgaagcagctcatcgacctgctggggcagatcgcccaggccgtgccggaggccagcggggtgcgcaccacggcgcggcaggccgccgacaagctgatgcgcggcgtggtcgcctacacctcggtgggc

SEQ ID NO: 32068 - DNA, 1486 bp, Thermobifida fusca
ccccggaacccagcaggaccgcggcgcgaagaaggacgcgcaaccgcagttcaaggggcgcaagaacggtccttataaagacgtctcccctgagcttgccgcctggatgcgcaccggctgggctgataccgaacggcgcgacctggagcccatcgaacaagccgcctacaccgcgaagcggcgcgccacggtgagcgcccggttccccggtgaacggctagtgatccccgccggaaacctgaagacccggtccaatgacaccgactatcccttccgggcggccagcgactacgtgtacctgaccggtgaccagtccgaggacggctgcctggtgttcgagccgcgggaggacggcggtcacgacgtcgtgctctacctgcggccccgctccagccgggagaacggcgaattctggctcgacgcctacggggagctgtgggtgggccgccgcaacagcctcgctgaggcagccaccctctacgggctgcccacccgcgacgtgcgcaccctgcctgaggtgctgcgcgaagcccctgaggcacccacccggatcctgcggggccacgattcgaccctggaagcggtggtcacgctgcgccgctcctcggaaggcactaccgcggaagaggacaagaagcgcgacgaagagctcgcgatcttcctgcacgacacgcgtctcgtcaaagacgactgggagatcgcccagctccagcgggccgtcgactccacggtccgcggcttcgaagacgtcgtccgggcgctgccgcaggcccaggccacctcggaacgctacgttgaaggcaccttcttcctgcgggcccgcgtggaaggcaacgatgtcggctacggcacgatcgctgcgtccgggccgaacgccaccacgctgcactgggtgcgcaacgacggaccggtgcgccccggtgacctgctgctgctcgacgcgggtgtggagaccaccacgctctacaccgcggacgtcacccggactcttccggtcagcggccggttcaccgacgtgcagcgccgcgtctacgacctggtctacgccgcccaagaggcgggtatcgccgaagtgcgtcccggccgcccgttccgcgcctaccacgacaccgcgcagcgggtcctcgccgaagggctcatcgaatgggggctgctggaagggcccgtggaacgcgtgctggaactcggcctgcagcgccgctacaccctgcacggcactgggcacatgctcggcttggacgtgcacgactgcgcggtggcgcgcaccgaagcctatgtggacggcatcctgcagcccggcatggtgctcaccgtggagccgggcctgtacttccagcccgacgacctgaccgtgcccgaggaactgcgcgggatcggggtgcgcatcgaagacgacatcctcgtcaccccggagggtaaccgcaacctgtccgcggccctgccgcgcacttccgcggacgtcgaagcgtggatggcggaactcctg

SEQ ID NO: 32069 - DNA, 606 bp, Ralstonia metallidurans
gaagtcgtactcgggctcggcggcggatcgtcgatggacgtcgccaagctgattgccgtgctgcttcctgccgcgcagtcgctcaaggacatgtacggcgtgaagaaggtcacgggcacgcggctgccgctcgtgcagatgccgaccaccgccggcaccggctcggaagtgactgcagtgtcgatcgtcaccacgggagagaccaccaagatgggggtggtggcgccgcagcttctggccgacctcgccattctcgacgccgaactcacgcttggcctgccacgtgcggcgaccgcggccaccggtatcgacgcgatggtgcacgcgatcgaggcctatacgagcgcgcatctgaagaacccgatctcggacatgctggccgtgcgcgcgctggaactgctgtcgcagaacctgatgctcgcctgcgacaacggccacgaccacggcgcgcgcgaagccatgctgctcggcgcgatgttcgccggccaggccttcgccaattcgccggtggcggccgtgcacgcgctggcctatccgatcggcggcatcttccatgtcgcgcacgggctctccaacgcgctcgtgctgccgcacgtcatgaagttc

SEQ ID NO: 32070 - DNA, 868 bp, Ralstonia metallidurans
  unsure (1)..(868): unsure at all n locations
atgccactgtcccaccgccagaccctgacccgctacctgatcgaggaacgacgccgctgtnccccgagggccacgcggcgaactcaacgcgctgatcctcgatgtggcgctggcatgcaaggcgctggcccgcgttctgtgtcgtctcgcgagaannctcgggcgactgcgttgagcgacggttccgctgcgcccacgggggggggcatcaacgtgcagggcgaggtgcagaaaccgctggacgtgcagtccaacgagatgttcatccgcatgaacgagtggaacgggcaactcgccggcatggccagcgaggagatggaggagccgtacctgatcccgagctcttacccgcgcggcaagtacctgctcgtgttcgacccactggacggcagcagcaacatcgacgtcaacgtctccatcggcagcatcttctcgatcctgcgcgccccggccgacgtggtagccagcggccgcgacgtgaccgaagcggacttcctgcagcccggcgccgcacaggtcgccgccggctacacgatctacgggccgacgacgcaactggtgctgaccgtcggcaatggtgtcgcggccttcacgctggaccccaacctcggcgagttcttgctgacgcgcagcgacatccgcgtacccgagcagacgcaggagttcgcaatcaactccagcaacagccggttctgggagccgccggtcaagcgctacgtcgacgaatgcctggccggcaagaccgggccgcgcggcaaggacttcaacatgcgctgggtcgcgagtatggtcgccgaggcgcatcgcatcctcatgcgcggcggtgtcttcatgtacccgcgcgacaccaaggatcccgccaagcccg

SEQ ID NO: 32071 - DNA, 663 bp, Ralstonia metallidurans
cgacgactgctggtggccggcaactggaagatgaacggcagtctggccggcgtacaggcgctggcggcggcgatcgccgacggtgccgtggcacgcctggaccgtgtgcaactggtactgttcccaccctttacctacctgcccgaggcgcagcgccgcctgggcgccagcggcatggcctggggcgcacagaacgtctcggggcatgaagacggtgccttcaccggcgaagtatcggcccagatgttgcgggagttcggctgcgcctgtgtgctggtcggccactccgagcggcgcacgctgttcggcgagaacgacgccgtcgtggcgcgcaagttccttgcggtccgccaagccggaatgacgccggtgctgtgcgtcggcgagtcgctgccggagcgcgagcaaggtgcgaccgaggatgtggtggcgcgccagctccaggcggtgcttgatctggccggggcgagtgcgtttgccgatgcggtcgtggcctacgagcccgtgtgggcgatcggcacgggcaaaacggccacacccgcccaggcgcaggacgttcacgccttcatccgtggccgactggccgaggcggacccggccatcgcagcgtcgctgcacgtcctttacggcggcagcatgaagcgagcgaacgcacgcgagctg

SEQ ID NO: 32072 - DNA, 1181 bp, Ralstonia metallidurans
gttgatcgaattcaggtcccggaaatcgccgatttcgccccgtggaaatgatcgagtcctggtcaaggctgcgaacacgttcgaggaagaccagtcgctgatcgtgctggagtccgacaaggccagcatggaagtgccgtcgtcggccgccggcaaggtcgtggacgtcaaggtcaaggtgggcgacaaggtcgcgaagggcacgctgatctgcaccgtcgaaggtggcgcggcggcggctcctgccccggcgccggcggcggcgcccaagcccgcggctgcgcctgctccggcgccggcagcggctccggcggccgccacgcatgccggtggcgccgacatccagtgcgaaatgctggtgctgggcgcaggccccgggggttactcggcggctttccgctcggcggacctcggcatgaacaccgttctggtcgagcgctatggcaccctgggcggcgtttgcctgaacgtgggctgcatcccgtcgaaggcgctgctgcacaacgcggcggtgatcgacgaggccaaggcactggccgcgcacggcatcctgttcggcgaagccaagatcgatctggatggcctgcggcactacaaggaaagcgtggtcggcaagctgaccggcggtctgtcgggaatggcgaaggcccgcaaggtgcaggtggtgcgcggcatcggcacgttcctggatccgcatcatctggaagtgcaggaaacggaaggcgacagcaaggccaccaatggcaagaagaccgtgatccgcttcgaaaaggcgatcatcgcggctggcagccaggccgtgaagctgccgttcgtccctgaggatccgcgcattttcgattcgacgggcgcgctggaactgcgcgacatcccgaacaagatgctcgtgattggcggcggcatcatcggcctggaaatggccactgtctacagcacgctcggcgcgcgactcgatgtcgtggaaatgctcgacggcctgatgcagggcgctgaccgcgatctggtcaaggtctgggacaaggtgaacaagcatcgcttcgataacgtgatgctgaagaccaagactgtcggcgtggaagcgaagccggatggcatctacgtgaagttcgagggcgagtccgcgccggccgagccgcagcgttacgacgccgtgctggtgtcggtgggccgttccccgaacg

SEQ ID NO: 32073 - DNA, 1022 bp, Ralstonia metallidurans
cccaatcagatgcgctggagtgcgccggccatgccgaccgttcccaccgactttgtcgatggcatcgtcacgatggctggtaacggcggtccggaagcgctgtccgggtgcgggatccatctgtatctggccaacgcgtcgatgcgggaccgcttcttctacaacgccgatggcgaaatgctgatcgtgccgcaggagggccgtctgctgatcgtcaccgagatggggcgcctggcggtggagccgcaggagatcgtggtgatcccgcgcggcgtgcgtttccgcgtggaactgcccgacggcgcggcgcgtggctatatctgcgaaaactacggcgcgatgttcaagctgcccgacctcggcgtaatcggctccaacgggctggccaacccgcgtgatttcctgacgccggtcgccagctacgaggatcgcgaaggcgacttcgaactggtcgcccgtttccagggcaatctgtggcgtgccgacattggccactcgccgctcgatgtggtggcgtggcacggcaactatgtgccgtacaagtacgatctgcgcctcttcaacacgatcggctcgatcagctacgaccatccggacccgtcgattttcctggtgctgcaatcgccgtcggatacgccgggcgtggacacgatcgacttcgtgatcttcggcccgcgctggctggctgcggaagacacgttccgtccgccctggttccaccgcaatatcgccagcgaattcatgggtttgatcgcgggcgagtatgacgccaaggccgaaggctttgtgccgggcggggcgagcctgcacaactgcatgatcggtcacggtccccgatgcggagaccttcgagcgtgcgtccgcctctgacaccagcaagccgcaccacatcacggacacgatggcattcatgttcgaaaccccgggcgtgatccgtccgacgcggcacgctgccgagtcggcgctgctccagcacgattactacacctgcctggcaaggcctgaagaagcatttcaatgcc

SEQ ID NO: 32074 - DNA, 852 bp, Ralstonia metallidurans
atcaacggcttcggtcgcatcggccgcatggtgtttcgcgccgccgtgcaggacttcaagaacgacatcgaggtggtcgcgatcaacgacctgctcgaacccgactatctcgcgtacatgctgcggtacgacagcgtgcacggccgcttcaagggcgaagtggtcgtcgatggcggcacgctggtcgtcaacggccgcaagatccggctcaccgcggtaaaggatcccgccgcgctcgcctggggcgatgtcggcgtcgacgtggtcgtcgagtcgacgggcctgttcctgacgcacgacacctgccagaagcacctcgacgctggcgccaggaaggtgatccagagcgcacccagcaaggacgacacgccgatgttcgtctatggcgtcaaccacacccagtacgccggtgagaagatcgtcagcaacgcgagctgcaccacgaactgcctggcgccggtggccaaggtgctcaacgacagtttcggcatcaagcgcggcatgatgaccaccgtgcacgccgccaccgccacgcagaagaccgtggacggcccgagcaacaaggactggcgcggcggccgcggcatcctcgagaacatcatcccctcgtccaccggcgccgccaaggcgatgggccgggtgatcccggcgctgaacaacaagctcaccggcatggcgcttcgcgtgccgaccagcgatgtgtcggtggtcgacctgaccgtcgaactcgcccaggagacgagctacgaaaagatctgcgcggcgatgaaggcggcgagccagggcgccatgaaaggcgtgctcgggtacacgcaggacaaggtggtttcgaccgacttccgcggcgaggcc

SEQ ID NO: 32075 - DNA, 753 bp, Ralstonia metallidurans
cagctgtcgttgtcgatcgatcacggtgaactgcgctgcgtgatcggcccgaatggcgccggcaagaccacgatgatggatgtcatcaccggcaagaccgggccgcgcaacgccaacgtgaccgggcgtgtgtttctggggcagaccatcgacctgatgcggctgaccgaaccgcgcatcgcgcagaccggcattggccgcaaattccagaagccgaccgtgttcgagcagcacgcggtctgggagaacctggaactggcgatgaaggccgacaagcgctggtgggcgtcgctgcgtgcccggctgacgctggaggggcatcgtcgcatcgaggaaacgctggcgctgaccgggctcgaggacgaagcctatcgccctgcgggcttgctgtcacatggccagaagcagcggctcgagatcggcatgttgctgacgcagcagcctcagctcctgctgctcgacgaaccggtggccggcatgaccgacgaggaaaccatgcaactggccgcgctgctcaacagtctgcgcggtagctgctcgatgatggtggtcgagcacgacatggaattcgtcgccgcgctggccggtgacgctggcacggtgaccgtgctggcggaaggcagcctgctggccgaaggcacgctcgacgccgtgaagcgcgacgaacgcgtgatcgaatcctacctgggaagataacgatgctgcaggtcaacgcaatcaatcagttctacggcggcagccatatcctgcgcg

SEQ ID NO: 32076 - DNA, 2092 bp, Ralstonia metallidurans
ggcagtggcagacccgtggctgaccaccggatcgctggctgatccagaacgcccggtgtcccggccggcatcctggcggtgaccttcacgaacaagtccgccaaggagatgcagacccggctgtcgtcgatgttgccgatcaacacccggggcatgtggatcggcacgttccatggcctctgcaaccggatgctgcgtgcgcatttccgtgacgccggcttgccccagacatttgccatcctggactcccaggaccagctttcggcgatcaagcggctgctcaaggggctgaatgtcgacgacgaaaagtacccacccaagaatctccagtacttcatcaacaacgccaaggagcagggcctgcgcccggccgacgtcgaagccaatgacgatttcaatcgtcgcttcgtcgacctgtacgcggcctacgacgagcagtgccagcgcgagggcgtggtcgacttcgccgaactgttgctgcgctgctacgaactgctgcgttacaacgacgcgatccgccagcactaccagcaccgtttccgccatgtgctcgtcgacgagttccaggacaccaacgtgctgcagtaccagtggctcaagctgcttgccggctacggctcgggcaatgccgcggcagtgttcgccgtgggcgacgatgaccagagcatctacgcgttccgtggcgccaacgtcggcaatatgcgcgacttcgagcaggaattccgcgttcgccacctgatcaagctcgagcagaactaccgctcgcacgggcatattctcgattcggccaaccacctgatctcgcacaatgcgcgccgactgggcaagaacctgcgcaccgacgccgggcacggcgagccggtgcgcgtgttccaggcaggttcggacggccaggaagcctcgtggatcgtcgaggaaatccgcgaccagatcgcgcagggcatgtcgcgctcggagatcgcgatcctctatcgcagcaatgcgcagtcgcgggtcatcgaacacgcgctgttctcgtcgggtatcccgtaccgggtgtacggcggcctgcgcttcttcgagcgcgccgaagtgaagcacgcgctggcctacctgcagttgatcgagaaccctcgcaatgacgccgcattcgggcgggtggtcaatttccccacgcgcggcatcggcgcgaagtcgctcgaagtgctgcaggacgcagcgcggcagtacaactgttcactggccgaagccgtggcctacgtgcctggcaaggccggcagctcgttgggcgcctttatccggctgatcgagcagatgcgtgccgagaccagccggatgacgctggcgcaaacggtcgagtacgtgaccaacaccagcggcctgatgacgcattaccagaccgagaaggaaggccaggaccgcatcgagaacttgcaggaactggtgacggccgcgcaggcattcgtggtcgaggaaggctacgggctcgaggcgctgggccgcatgctgccggcgaaccgcgatgccatgccggcgctggcgcagggcgaacaggaccagcaggtgctggaccccgaacagttgccggtggtgatgacgccgctggtggcgttcctgacccatgcatcactggaggcgggggacaaccaggcgcaggccggccaggatgcggtgcaaatgatgaccgtgcacgcggccaaggggctcgagttcaatgtggtgtttatcaccgggctcgaggaaggcctgttcccgcacgagaacagcgcgatggaagccgacggtctggaggaagaacgccgcctgatgtatgtggccatcacgcgcgcgcgggcacggctctatctgtcgttcgcccaaagccgcgtgctgcacggccagatgcgctatcacgtgcggtcgcgcttcttcgaggagcttcccgaggcttcgctgaagtggatcactccgcaggggcaggcctatcgtgcctatcgctcaggtagcggacgccagtcatctgagcgcgaaagcgcttggggccgtgactggtcaagcgtgccgaggacgtgccctataccggggtgagccgaacgggggcatgaacacgggcagaactagccgaagagaagcg

SEQ ID NO: 32077 - DNA, 1209 bp, Ralstonia metallidurans
  unsure (1)..(1209): unsure at all n locations
cgctaagctgcgctgatctgaggncacggcgtaccatcatcggtacgagcccggacatgatcatgccgcggaagaccgcgagcgtttccagaagctggtgcaggacctgggcctgcgccagccgccgaacncgtaccgctgcgcgctganaacgaggcactgcgcctggccgaggaaatcggttatccgctggtggtgcgtccgtcgtacgtgctgggtggccgcgcgatggaaatcgtgcacgagccgcgcgacctcgagcgctacatgcgcgaggccgtgaaggtgtcgaacgactcgccggtgctgctggaccgcttcctgaacgacgccatcgagtgcgacgtcgacgccctgtgcgacggcactcgcgtgttcatcggcggcgtgatggagcacatcgaacaggctggcgtccactcgggcgactcggcctgctcgctgccaccgtactcgctgtcgcaggcaaccgtcgacgaactgaagcgccagaccgccgcgatggccaaggcgctgaacgtggtgggtctgatgaacgtgcagttcgcgatccagcagcggaatggcgaggatatcgtctacgtgctggaagtgaatccgcgcgcgtcgcgtacggtgccgtacgtgtcgaaggccaccggcctgtcgctggccaagatcgccgcgcgttgcatggccggtcagtcgctcgattcgcaaggtatcggcgaagaggtggtgccgccgtactacagcgtcaaggaagccgtgttcccgttcaacaagttcccgggcgtggatccggtcctcggacctgaaatgcgttcgaccggcgaagtgatgggcgtgggcaaggtgttcggcgaagcgctgttcaagagccagctggccgcgggttcgcgcctgcccgagaagggcaccgtgctgatcaccgtcaaggacagcgacaagcctcgcgccgtgaccgtggcccgcatgctgcacgacctcggttacccgatcgtcgccacgcgtggcacggcatcggccattgaagctgccggcatcccggtccgggttgtcaacaaggtgaaggacggccgtccgcacatcgtggacatgatcaagaacggtgaactggcgctggtcttcacgacggtcgacgaaacgcgcacggccatcgccgattcgcgttcgatccgtatcgccgcgctggccgcccgcgtgccgtactacaccaccatcgccggc

SEQ ID NO: 32078 - DNA, 623 bp, Ralstonia metallidurans
atcaccctgacccagttcatcatccagtcccagcgcgcccacccggcggccaccggggagtttccggactgctcaacgtgatcgccaccgcctgcaaggtgatcgccaccgcggccagccgcggcgccctggcgggcgtgctcggctcggcggagcacgagaacgttcagggcgaggtgcagaagaagctcgacgtgatcagcaacgcgatcctcgtccacgccaccgagaggggtggccacctagtcgccctcgcctccgaggagatggacacgatctacccgatccccgcggccttcccgcgaggcaagtacctgctggtcttcgatcccctggacggctcttccaacatcgacgccaacatctcggtgggcgccatcttctcggtgctgcgctcgcccgatccggaggtgccgccgaccctcgaacacttcctgcaggcgggcgccgggcaggtctgcgccggttacgccctctacgggccggcgaccatgctggtgctcaccaccggtcagggcacccacggcttcaccctcgaccgggatgtcggcgagttcatcctcacccatccaatgctgcgcatccccgcggcgacccaggagttcgccatcaacacctccagg

SEQ ID NO: 32079 - DNA, 726 bp, Ralstonia metallidurans
cgcattgcatatgtgaccggcggcatgggcggcatcgggaccgcgatttgccagcgactggcgcgggatggttacaaggtggtggcgggctgcggcccgaattcgccacgtcgtgagaagtggctcgaacagcaacgcgcgctcgggtttgaattcgtggcgtccgaaggcaacgtcgccgactgggactccaccaaggcagccttcgataaggtcaagtccgaagtgggcgaggtcgatgtgctgatcaacaacgccggcatcacgcgagacgtagtgttccgcaagatgacccgcgcggactgggatgcggtgatcgacacgaatctgacgtcgctgttcaacgtgaccaagcaggtcatcgacggcatggctgaccgcggctggggtcgaatcgtcaatatttcgtcggtgaacggccagaagggtcagttcggtcagaccaactactcgaccgccaaggcaggcctgcacggcttcacgatggcgctggcgcaggaagtggccaccaagggcgtgaccgtgaacacggtgtcgccgggctacatcgccacggacatggtcaaatcgattcgccaggatgtgctcgacaagatcgtcggcacgattccggtcaagcgtctgggcacgcccgaagaaatcgcctcgatctgcgcttggctgtcgtcggacgagtcgggtttctccaccggtgccgacttctcgctgaatggcggcctgcacatg

SEQ ID NO: 32080 - DNA, 576 bp, Ralstonia metallidurans
cgctttttcgatccgaccgagggtcacatcttgctcgacggtcagccgatcgaccgtttcgcgctggccgacctgcgtcgccagatcgccttcgtcagccaggatgtggtgctgttcaacgacaccgtggccgccaatgtggcctatggcgtgcatccgcgcgagaaaatcgatatggcccgcgtggaacgcgcgctggcggctgcctacctgaccgacgtggtcaaggggctgccggaagggctcgaaacgaacatcggcgacaacggcatgaagctgtctggcggccagcgccagcgtctggccatcgcgcgcgcgatctacaaggatgcgccgatcctgatcctcgatgaggcgacttcggcgcttgactcagagtcggagcgtcaggtgcaggccgcgctggaatcgctgatggtcggtcgcaccacgctggtgatcgcgcaccgcctgtcgacgatcgagaacgccgacaggatcgtggtgctggagcagggtcgtgtagccgaacagggcagccacgccgagctgatcggcaagaacggcctgtacgcgggcctgcatcgcatccagttc

SEQ ID NO: 32081 - DNA, 741 bp, Ralstonia metallidurans
atgtccggccgcgtcgcggtcgtcacggggtccaccaagggaatgggtctggaaatggcgcgagcgctcggcgcatccggggcccgggtggtggtgtctgggcgcaacgcggcgatcagcgaaaaagttgccgccgcactgaagtcggagggcatcgacgccactggcctcgcctgcgacatcgccgataccgccagcgtgcgggcctttgccgaccgggtgctggagacgttcggccgcgtggacgcattagtcctgaatgccgcgggcagtggtgtggccggttcaatcctggagcaggggcctgaggacttcgacgcggtgatggcgggcaacgtgcgcggcaatctcgtgctcgtcaacgcactggcgccgcagatgatttcccgcaacgacggctcgatcatcttcatgtcgagcatcgcggcacgtcggggatccgcgctgttgccgctgtacagcatctcgaagggggccgtcgatctggcgatgcgcagcctcgctcatacgctcggaccgcacaacatcaatgtgaacagcatcaatccggggccggtccgcaccgatttctcgcgtgatgcgctatggggcaaccccgaccgcgagaaggcgttgtctgcctccatcccgatgcggcgcattgccgaggcgcgcgacgtggcggggttggccgtgctgctggcatcgcccgctggacgctatatctccgggcagacgatcgggctcgacggcggcgctacg

SEQ ID NO: 32082 - DNA, 1473 bp, Ralstonia metallidurans
tactgggcaactgtaccgaagttccatatcgtgttctacgcgattctcaagcttggcgccgtctacgtgcccgtgaatccactgttcaaggaacacgaactggcctacgagctgaacgatgccggtgcgaccatggtgatcgcgctcgacacgctcgtgccgatgctgatgacggtgaagccgcaaaccagcgtggaaacggtcttcagcacatcggccggcgaattcctgcccgcgcatcccacgctgcccgttccggctggactcgacgccgcgccagtggcgcacgcgggcacgatcgacctgatggcggccatccagacatgcacgggcaacgtgcgcgacgtgagcgtggatctcgatgcattggccgcgctgaactacacgggtggtaccaccggtatgcccaagggctgcatgcatacccagcgcgacatgatctacacggcggccgccacgctggcggtcaccagcgggcgcgaagaccgggatgcaacgctgccgtcgtccgacgtgatgctgaacttcctgccgatgttctggatcgccggcgagaacctcggattgatctatccgatcttcagcggcgccacgctggtgctgctggcgcgctgggacccactcgccgtcatgtctgccgtggaccgctaccgcgtcaatcgcacgttcatggtggtcgacaaccttgtggaactgctgcagcaccccgaacttgcgcggcacgacatgcgctcgctgcaacatacgcgcgtggcatcgttcatccgcaagctgaccgtggacctgcgccgccagtggcacgcgctgaccggcagcgtcgtggccgaaggcgcctggggcatgacggagacgcacacgagcgacaccttcaccacggggatgcagacagacgacatggacctgcacggccggccagtcttcgtcggtctgccagtgccgggcacgcgtatcaagatctgcgacttcgaaaccggcgtgacgctgcccgttggcgaggagggcgagattgtcgtcaccacgccttcgctgctcaagggctattggggccgccccgacgccaatgcggaggtgttccgggacggctggttcaggacaggcgatatcggcgcctatgacgatgcgggctacctgcacttccttggacggcgcaaggagatgatcaaggtgcgcggcatgagcgtattcccgtcagagctggaagtcctgctcggacgtcatgccgccgtactcgggtccgccgtggtcgcacgtcccgatcgggacaagggccaggtgccggtggcattcatccgcctgcgccccgggcatgacgatgtgtcggccgaggcgctgacggcatggtgccgcgagcatatggcgacctacaaggtgcccgagatccgcgtggtggacgagttgccgatgacggcaacgggcaaggtcaagaagggggaactgcagaaacagttcgagcaggacgaacaagaggtgggc

SEQ ID NO: 32083 - DNA, 792 bp, Ralstonia metallidurans
ttgaaagtggagccgatccccgcctttcaggacaactatatctgggcaatccacgacgggcatagcgcggccgtggtggacccaggcgaggccgcaccggtcgagcagtttctggcgcaacgcgggctggcactgggcgctattgtaatcacccatcaccatggggatcaccaaggtggtgtatcagacctcctcgcgcgtcatccgagtgggccgaacggcgagccgctgccggtgatcggtccgcaaggcgagcgaattggccaccgcacgcaggccgtgcgcgaaggcgacacggtcacgctgcgtcatccggcagtgacgttccgggtactggatgttccgggtcacaccgcaggccatgtggcctatgtcggcgacctgcctggcgccggccccgtggtgttctgtggcgacacgctgttcgccagcggctgcgggcgcctgttcgaaggcacgccggcccagatgctggcatccctggacaagctcgcggcactgcccggcgacacgcgcgtctactgcgcccacgagtacacgcgcagcaacgtccgctttgcccaggccgtcgagccggccaacccggatctggcggcgtgggcggcgcgggtggatatcctgcgcgaggccggcacgcctaccgtgccaacgaccgtggcgcacgagcgcgcggtcaatccgttcttgcggtcccgcgagtccacggtccgccaggctgtgcgggcgcagggcggtgacgtgagcggtgacgccgcggcttttggtgcgctgcgaggctggaaggacggcttt

SEQ ID NO: 32084 - DNA, 663 bp, Ralstonia metallidurans
accaacggcacgcaggccgactggatctgcctgctttgcaacacgtcggacgggccggtccacaagaacaagtcgctgatcatcgtgccgttgagggaaaacggccgactcgtgcgtggcgtggaagtgcagaagatccgcaagatgggcatgtggtgctcggacaccgcccagatcttcttcgatgacgtacgcgtgccggcgcgcaaccgtattggcgatgagggcatggggttcatctatcagatgaaacaattccaggaggagcgcctgaacggcgcggcccgtcggctggcgtgcagtgcgctgatcgaggagaccgccgactacctccgccagcgcgtggcgttcggcaagccactgctcgacaaccagtacatccagttcaagctcgccgaactgaagaccgaactcgaatcgctgcgcgcgctggttcacgtggcgacgcgagcctatatccagggcgaggatgtggtggaactggcgtcgatggccaagctgaaggcaggccgcctgtcgcgcgaaatagccgactggtgcatccagttccagggcggcatgggttacacgtgggacaaccacgccaatcgcgcctatcgggatttccggcttggatcgatcggtggtggcgccgacgaggtgatgctgcaagttatcgccaag

SEQ ID NO: 32085 - DNA, 1974 bp, Ralstonia metallidurans
agagagcattccatgtcagcttcctgccgacccttccataccgtgctcgtggccaaccggggcgagatcgccatccgcatcatgcggacggcccgccgacttgggcttggcaccgttgccgtctactccgaggccgaccgccacagcccgcacgtggccagcgcggatcgggccgtgtgcatcggtgctgccgcgccgcgtgagtcctacctcaacattgcagccatcatcgctgccgcgcgaaacgctggtgccgatgccgtccatccgggctatggcttcctggccgagaacgccgagttcgccgatgctgtgaccgacgccgggctggtcttcgtcggtccgccggccagcgccatccgtgccatgggcaacaaggccgaggccaagcgcctgatgctggccgcggacatgccgtgcgtgcccggctatcagggcgaggcgcaggacgacaagaccttgctggcagaagccgggcgcatcggctttccgctcatggtcaaagctgcagcaggcggcggcggacgcggcatgcgattggtgcccgatgccgctgcattgcccgcggcgctcgccagtgcgcggtcggaagccgcgacggcgttcggcaacgacgaactgatcctggaacgcgcggtcatccaaccacgccacgtcgagattcaggtctttgccgacgcgcatggcaatgtgatccaccttggagagcgcgattgctcggtgcagcgccgccaccagaaggtgatcgaggaagccccatcgccggcggtatcgcccgcgctgcgcggcaggatgggcgaggcagccgtgcgggcggcacgggccattggctacgtgggagccggcacgatggagtttctgctcgatgccgacgccaacttctactttatggagatgaacacccggttgcaggtggaacacgccgtgaccgaggctatcaccgggttcgacctcgtggcatggcaactgcaagttgccgcgggcgaaacgctgccagcgacgcaggatcaggtgacgttcgacggccacgcgatcgaagtgcgcctgacggccgaggacgtgcctgcaggatttcttccccagggcggtccggtgctgcgctggcgcgccccggagtcgggccacgacgtgcgtgtcgaccatgcgctggaaaccgggggcactatccccacgcactatgactcgatgatcgccaagctcgtggcccatgggcgcacacgcgaggaagcgcgtcagaagctgttgcgagcggtgcaggactgcgtgctgctcggcgtgccatcgaaccagccgttcctggcgtcgtgccttgccagtgcggcgttcgctggcaatgacgtgcacacgggcttcgtcgacgcgcatatgcaggcgtcgttgcaacccaccgaaccatccagtcatgtggttgccattgccgcactgacggcatctggtcagttgtcgcggagcgagcccgtcgcgctattgcgaatgacaacgtcggtgagactgcacgcggaaggaagaccgtgggactcggcagtgcaggcgacagaagaaggctggcgcgttaccgtcagcgcgcgcggagagacgggcgcgcagccagtccacgtgcggatgctccgcgaccatgcggctgacggggcggcatggatcgagtgcgacggtatggctcggcctgttctccatgctgacgacgatctggcaatacatctgtttgccgacggtcgggcctggcgcttcacccgacacgacccgcgccgtcgaaatacggaaggggagtcatcaggcgcgctcaccgcgccgctgacggcccggatcgtggccgtcaacgtggcggaaggtgatcgtgtggaggcgggccagtcgctggttgtgctggaagcgatgaaaatggaacacacgctcgtcgccccgttcgccggcgtcgtctcggaattgtcggcacgcgctggcggacaggccagcgccggcaccctgctggtgcgc

SEQ ID NO: 32086 - DNA, 2013 bp, Ralstonia metallidurans
aacgagatgctcagcagcatcgaaggcctgtcgacgccgctggtacggcagatcgatcgttttggacgcgggctggcggtagccatcctgctgctctccgccgtggtgttcgtggccggcattctctggcgtggccactccgcagccgacatgttcatgatggccgtagcgctggcggcctccgccatccccgaagggctgccggcgatcatgaccgtcacgcttgcgctcggcgtgcagcgcatggcccggcgccatgccatcgtgcggcgcctgccggcggtggagacgctgggatcggtgacggtaatctgctccgacaagaccggcacgctgacgcgcaacgagatgaccgtgcagcgcatggtctgcgcgggccatgtattcgatgtcgggggcgtcggttatgcgccggtgggagacttcagcatcgacggacacgtcgtcgatcccatgcattgcgcgccgttggccatggccctgcgcaccggcgtactctgcaacgacgccaacatgcgcaatgacgacggcatgtggcacgtcgagggcgaccccaccgaaggtgcattgctggtggctggcgccaaggcgggcttggaacaccagaatcctgaatccagctggcatcggctcgattccatccccttcgaatccgagcaccgcttcatggccacctaccaccacgatgccgatcatgcgccgtggatcctggtaaagggtgcgcctgagcgcatcctcgacatgtgcgcgcggcaatggaatctcgatggggagcgcccgctggacgtggactactggcgccgcatggcgaccgacaccgcggcgcagggcctacgcctgctcgccctggcctgcaagcgcgcagcgcccgcgggcgacaagctcgcgttctccgatgtggaaaccggctacacgatgctggcgctggtcggcatcatcgatcctccgcgcgaggaagccatccgtgccgtcaacgagtgccaccacgccggcatccgggtcaagatgattaccggcgaccacgtcgaaacggcacgcgcgatcggcgcgcaactggcgatcggcgtgggcaagcccgccttgaccggcagcgaggtggcactgatggacgatgccgcactgcgccgggtggcgatggaagtggacgtattcgcgcgcgccagtccggagcacaagctgcgcctggtccgcgcgcttcaggacggtggccaggtcgtgtcgatgaccggagacggcgtcaacgacgcgcctgcgctcaagcgggccgacgttggcgtcgcgatggggctcaagggcaccgaggcagccaaggaggcttccgacgtggtgctcgccgacgacaacttcgcgtcgatcgcccacgcggtgcgcgagggccgcgcggtctacgacaacctgaagaagttcatcctcttcatgttgccgacgaacggcggcgaggcgctgatcgtgattgccgcgatcctgttcgacctgccattgcccgtcacccctgcccaggtactctggatcaatatggtcacgtccagcacgctgggactggcgctggccttcgagcccgccgaggacggcatcatggcgaagcctccgcgcccggttggagaaacgctgctgtcgggcttctttgtctggcgcgtaacgatggtatccatcctgatgatggcgggggcgctcagtctgttcctgtgggaactatccgacggcaccagcctggaaaccgcgcgcacgatggccgtcaacgccgtggtggccgccgagatgttctacttgctcaacagtcggcataccctgaagaccgtgctcaaccgcgaggggctgttcggcaacccgtatgtgctgctggccattgccgcctgcgtgccgctgcagctagcctacacacacctgccgctgatgcaggcagtgtttgattccaccgacctgtccgcgctggaatggtgcaaggtgatcggcgccggcctgctggtgttctgcgtcgccgaactcgaaaagatcctgatccgacgcaaaccg

SEQ ID NO: 32087 - DNA, 708 bp, Ralstonia metallidurans
gcatcaaagaaaaaaacaggagacaaagtcatgcccacccaacaactacggggcgtgttcacccccgtcgtcaccccgtttcatgaagacctgtcgatcaacctgcccgctttcgtcgcgcactgcaagcggttgatcgccgatggcgccggtatcgccatctcgggcaccaacagcgaagcctgctcggaaacgttcgaggaacgcatcgcgctcgtcgacgccgccatcgatgcgggaatccccggcgagcgcgtgctggtgggaaccggttgttgcgcgatcgacgatgccgtggtgctgacgcgccacgccatcgaacgtggttgcgcgggtgtgctggtgctgccaccgttcttcttcaagaacgtgagcgaagacggtgtcttcgcctactacagcgaactgatcgcgcgcgtcaacgatcccgccctgcgcatcgtgctgtaccacatccctgcgatgtctggcgtgcccatctcgctgtcgctgatcgagcgcctcgtgcaggcattcccaacgcatatcgtgggcatcaaggacagcagcggcaactgggacaacctcgtggccatgctcgagcgtttcccgtcgctctccatttttccggcctcggaactgctgatgctgcgcagtctgtcgctgggtgccgccggctgcatctccgccaccaacaacatcaatgcgcgcgccatcgcacaggcattc

SEQ ID NO: 32088 - DNA, 1242 bp, Ralstonia metallidurans
aggagaatcgtgatggctcagagattcgacgcgatcatcatcggcaccggacaggccggccccgcactcgcggcgaggctggccggcgcgggcatgaagctggcggttatcgagcgcgggcggtttggcggtacctgcgtgaacaccggctgcatccccaccaaggcgttgatcgcgagtgcgtacgccgcccaactggcgcggcgggctgccgagtacggcgtgaccatcggtgggccggtcgcggtcgacatgaggcaggtaaaggcacgcaaggacgaaatctcgggcaggtccagccagggcgtggagcagtggatgcgcgggctggacaacgtcaccgtccatcaggggcatgcccgcttcgagcacgcgcgcggcgtgcgggtcaacggggagttgctggaggccgaccagatcttcattaacgttggcggccgggcgctgattccaccgatgccagggctggatcaggtgtcatacctgaccaattcaagcatgatggaagtcgatttcctgccggagcatctgatcatcgttggcggcagctatatcggccttgaattcggccagatgtaccggcggttcggggccagggtgaccatcgtcgagaaaggcccgagactgattcagcgggaagacgaggacgtgtcgcaagccgtgcgggagattctcgaacgcgagggcatcgaggttcggctcgacgccaactgtctgagcgcgcgcaaggacggtgaccatattgccgtcgggctcgattgcgcgggcggggcgcctgaagttcacggctcgcacctgttgatggccgtcgggcgcgtgcccaatacggacgatctggggctcgacaaggcaggtatcgagacggatgcccggggctacatcaaggtggacgatcaactgcgcaccagcgtccccggcatctgggcgcttggcgactgcaatggccggggcgctttcacacatacgtcctacaacgactacgagatcgtcgcggccaatctgctcgataacgatccgcgcgcggtgacggatcgcatcccggcctatgccttgtttaccgacccgccgttgggccgcatcggcatgacggagcgggaagcgcggcagtcagggcgcaaggtgctggttggcacgcggcccatgagccgtgtcgggcgggccgtggagaagggcgaaagccagggctttatgaagatactcgtcgacgctgacacgcggctgttgctgggcgctgcgatcctc

SEQ ID NO: 32089 - DNA, 897 bp, Ralstonia metallidurans
attggcgcgcgtccggtggaccagcacatcaagggcctgcaagcgatgggcgccgagatcaccatcgagcacggcttcattcatgcccgcgccaatcgtctgaagggcgctcgcgtggtcacggacatgatcaccgtgaccggcaccgagaatctgctgatggcagccacgctggccgaaggcgagaccgtgcttgaaaacgccgcgcgcgagcccgaggtcaccgacctggccgaactgctggtgaagatgggcgccaagatcgaaggcatcggtactgaccgcctggtggtgcagggcgtggatcgcctgcacggcgccgagcacaaggtagtggccgaccgcatcgaggcgggcacgttcctgtgcgccgcagcggccacgcttggcgacatcgtgctgcgcggcatcccgccgctgattctcgacgctgtgctgatcaagctgcgcgaagccggcgctaccgtggaaaccggtgatgactggattcgcctggccatgccgcagcgcgcgcaggccgtgagcttccgcacctccgaatacccggcgttcccgaccgacatgcaggcgcaattcatggcgctcaatgccgtcgccgagggtaccgcgcgtatcaccgagacgatcttcgagaaccgcttcatgcacgtgcaggaactgaaccgcctgggcgccaacatcaccgccgaaggcaatacggccgtggtgaccggtgtgccgcgactgtccggcgccagcgtgatggccaccgacctgcgcgcgtcggccagtctcgtgatcgcgggtctggtggcggatggcgagacggtgatcgaccgcatctaccacctggatcgtgggtacgaccgcatggaaaacaagctgtccgcggtcggcgcgaagatcctccgcatcagc

SEQ ID NO: 32090 - DNA, 1218 bp, Ralstonia metallidurans
gacgaggcgatcgaccgcgctgctgccgatatcctggccgatgtgcgccgccgtggcgacgaggccgtgctcgagtacacgcgccgcttcgatcgcatggaggcctcgtcgatgtcggcactggcattgtcgcaatccgaactggaagccgcgctggaggacctcgagccgaagcgccgcgccgcgctggaagccgccgctgcccgcgtgcgtgcgtaccacgagaagcagaaaatcgaatgcggcagccatagctgggaatacaccgaggccgatggcacgatgctgggccagaaggtgaccccgctcgaccgcgtgggcctctacgtgccgggtggcaaggccgcctacccgtcgtcggtgctgatgaatgcaattccggcgcgcgtggctggcgtcaaggaagtcatcatggtcgtcccgacgccgggcggcgtgcgtaacgaactggtgctggccgccgcgcagatcgccggcgtcgatcgcgtgtacacgattggtggcgcgcaggccgtgggcgcgctcgcgtacggcaccgccacgctgccgcaggtcgacaagatcgtcggcccgggcaatgcctacgtggccgctgccaagcgccgcgtgttcggcacggtcggtatcgacatgatcgccggcccgtcggaaatcctcgtgatctgcgatggcaccaccgaccccgactgggtggcgatggacctgttctcgcaggccgagcacgacgaactcgcgcaatcgatcctgctgtgcccggatgccgagtacctgaaccgcgtgctggaaagtatccagcgccagttgccgacgatgccccgccgcgaggtcatcgccgcgtcgctgtcgggccgtggcgcactggtcaaggtgcgcgacatggaggaagcctgcgagattgccaacgcgatcgcgccggagcacctcgagatctccgccgagaatccgcgccagtggagcgagaagattcgccatgccggcgccatcttcctgggccgttacacgagcgagtcgctcggcgactactgtgccggcccgaaccacgtgctccccacttcgcgcaccgcccgtttttcgtcgccgctgggtgtctatgacttccagaagcgttcgagcctgatcgaggtgagcgagaacggtgcgcagatgctgggccagatcgctgccgagcttgcctatggcgaaggcctgcaggcccacgcgcgcagtgccgagtaccgc

SEQ ID NO: 32091 - DNA, 1439 bp, Ralstonia metallidurans
cggaactacgtggatgcccgcttcgaggaagcggccaatctttttcccaatctctcaccggtcgacggcagccatcgtcggccacgtctgcggaagccgacgccagccaggtggatcgcgcggtgcaagccgcacgcgccgcaatggagggcccctggggcaacaccagcgccgccgagcgcgcccgggtgttgcatgccgttgccgacggcatcgaacggcgcttcgatgaattcgtcgccgccgaggtggccgataccgggcgtaccgagcaacaggcgcgcgcgctcgacatccgccgcggcgtgctgaacttccgcacgttcgcggacctggccagccaggcgggcggcgactacttcgacatgaggacggccgaaggcgacgtcttcagctacaccgtacgcaaaccccacggcgtcgtcggcatcatctctccgtggaacctgcccatgctgctgatgacgtggaaggttgcccccgcgctggcctgcggcaacgccgtcgtcgtcaagccatcggaggagacccccggtagcgccacgttgctggccgaggtcatgcatgaggccggcgtgccggcgggtgtattcaatctcgtacacggcttcggcggcggctcggcaggcgagttcctgtcgcggcatccgggcatcgacgccctcacctttacgggtgaatctcgcaccggcagcaccatcatgaaagcggtggctgacggcgtgaaggaaatctccttcgaactgggcggcaagaacgccgccgtggtcttcgccgactgcgatttcgacaaggccgtggcgggcgtgatgcggtccagcttcaccaacaccgggcaggtatgcctgtgctccgagcgcgtctacgtggagcggccaatcttcgaacgctttgtggcggcgatgaaggcgcgcgcggaagccttgcgcatcggctacccaacggtggagggcgtggagatgggttcactgatctcccgcaatcaccgcgacaaggtgctgtcctattacgcgctggcgcgggaggaaggcgcgactgtcgtcaccggtggcggcgtgccgcattttggcgacgcacgcgacaacggcgcctatgtgcagcccaccatctggaccggcttgcctgactcggcacgctgcattcaggaggagatcttcggaccggtctgccatatcgcgccgttcgacaccgacgccgaggtggtgaagcgcgtcaacgattcgcgctatggactcgccgcctcggtgtggacccgggacctcgcgcgcgcgcaccgcgtcacacggcagttcgacgtcggcatcgtctgggtcaacacctggttcctgcgcgatctgcgcacgccatttggcggcacccggctgtccggtatcggccgcgagggtggacgccattcgctcgacttctattcctccctgaccaccatctgcgtcaatccc

SEQ ID NO: 32092 - DNA, 784 bp, Ralstonia metallidurans
ctggccagcggcgacaagacgatgtgcttcgggctttccgaaccggatgccggctcggacgtctttggcatgcgcacacgcgctacgcgcgatggcgaccactgggtgctcaacggcaccaagcaatggatcaccaacgcgccctatgcggactacgcgatggtcttcgccgtcaccgacgaagagaaagcccgcgcccacaagggcggcatcaccggcttcttcctgcccacccgcacaccggggttctcggtaccgagcgtgattccgacgatgggacacctgggcgccgacatcggcatcatctcgctggaaaacgtgcgcgtgccggacacccaccgcctcgggccggtcgaccgtggcctgtccgtggcgctcgacggcgtcaacgccggtcgcctgagcatggccgccagttgcctcggcctggccgagtgggcgctggaacaggccgtggcctacgccaaggtccgcaagacctttgggcagcctatcggcgaccaccaggccgtgcagatcatgctagccgaatgcgcgatggacatctacgccaccaaatcgatggtccgccactgcgcctggctggtggacaacgatctgcccgccacaaaggaggtctccatcatcaaggcatcgtccacggagatggccgggcgtgtcttcgaccgggcaatgcagattcacggcggcatgggtctgaccaacgaactgcgactcgaggccggctaccgcttcgtgcgcacgatgcgcattcccgatggcacctccggagatccagcggacg

SEQ ID NO: 32093 - DNA, 981 bp, Ralstonia metallidurans
atggctaaagccccaatgcgcgtcgcagtcaccggcgccgctggccagatcggctattccctgctgttccgcatcgccaacggcgacatgctcggcaaagaccagccggtcatcctccaactgctcgatctcccgcaagcccaggccgccgtcaagggcgtggtgatggaactggaagactgcgcgttcccgctgctggccggcgtggtcattaccgacgaccccaaggtcgccttcaaggatgccgacgttgccctgctggtgggcgcgcgtccgcgtagcaagggtatggaacgcaaggacctgctcgaagccaacgcccagatcttcacggtgcaaggcaaggccctggacgaagtggccagccgcgacgtcaaggtgctggtggtcggcaacccggccaacaccaacgcctacatcgccatgaagtcggcgccgaacctgaagcgcgagaacttcactgccatgctgcgcctggaccacaaccgtgccctgtcgcaaatcgccgccaagaccggcaagccggtgtcgtcgatcgagaagatgttcgtctggggcaaccacagcccgacgatgtacgccgactaccgctacgccaccgtcgacggcaagagcgtcaaggacatgatcaacgatccggtgtggaacaacgacgtgttcctgccgaccgttggcaagcgcggcgctgccatcatcgaagcccgtggcctgtcgtcggccgcttcggctgccaacgccgccatcgaccacgtgcacgactgggtgctgggctcgaacggcaaggtcgttacgatgggcatcccgtcgaacggtgaatacggtattccgaacgatgtgatgttcggctacccggtcaccacggccaacggcaagtacgaaatcgtcaagggtctggaaattgacgcgtacagccaggagaagatcaacatcacgctcaaggaactggaagaagagcgtgccggcgtgcaacacctgctgggc

SEQ ID NO: 32094 - DNA, 598 bp, Ralstonia metallidurans
gatcacaacatccaggttgtccagtcgacacgccggcccagatcttccacctgctgcgtcgccagatgatccgtctgttccgcaagccgttggtgatcatgacgccgaagtcgctgctgcgtagcaggatgccgtgtcgccgctgtccgatctggccaagggtcatttcgagaccgtgatccccgatcacgaggaactgaacgccagcaaggtcaagcgcgtgatcatgtgctcgggcaaggtctactacgacctggtcaacacccgccgtgagcgtggtgccaccgacacggcgatcatccgcatggaacagctgtatccgttcccgcacaaggccgttgccgcggaactcaagaagtatccgggcgcgaccgaaatcctgtggtgccaggacgagccgcagaaccagggtgcctggttcttcgtgcagcactacatcatggaaaacatgacggaaggccagaagctcggttatgccggtcgtcccgcctcggcttcgccggcggtgggctactacgcaaagcacaacgagcaacagaaggcgctgctggacgctgcgttctccaagctcaagggctttgttctgaccaagtaattc

SEQ ID NO: 32095 - DNA, 1257 bp, Ralstonia metallidurans
atggctattgttgacgtcaaggttccccaattgtcggaatcggtcgccgaagcgaccatgctgaactggaagaagaagccgggcgaagctgttgctcaggacgagatcctgatcgaaatcgaaaccgacaaggttgtgctggaagtgccggcaccgtcggctggcgttctgtcgcagatcatcaagaacgacggcgataccgtcgtggccgatgaagtgatcgccaagattgacacggcagccaccgcaggcgctgtggcaccggccgccgccgctccggctcccgccgcagcagcaccggccccggcagctgctgcccccgcagccgctgccagcgctggcgccatcgccatgccgtcggctgccaagctgatggccgaaggtggcctgtcggcttcgcaagtggctggcaccggcaaggacggccgcatcaccaagggtgacgtgctggccgccggctcggctcccgctccggccgccaaggctgctccggctccggccgccgccaagccggccctgccgcaagtgtcggcccaggttgacttcgccgcgctgggcgatcgcccggaagagcgcgtgccgatgagccgcctgcgcgcgcgtatcgccgagcgtctgatccagtcgcaatcgaccaacgccattctcaccaccttcaacgaagtgaacatgaagccggtgatggatctgcgcgccaagtacaaggatcgcttcgagaaggaacatggtgtgaagctgggcttcatgtcgttcttcgtgaaggccgccgtgcacgcgctgaagaagtacccggtcatcaacgcctcggtggacggcaacgacatcgtctaccacggctacttcgacatcggtatcgccgtgggctcgccgcgtggtctggtggtgccgatcctgcgcaacgccgaccagatgagcctggccgacatcgagaagaagatcgccgagttcggcaccaaggcgcgtgacggcaagctgtcgctggaagaactgaccggcggtacgttctcgatctcgaacggcggtacgttcggctcgatgctgtcgaccccgatcatcaacccgccgcagtcggccatcctgggcgtgcacgccaccaaggaccgtgccgtggtggaagacggccagatcgtgatccgtccgatgaactacctggcgatgtcctacgaccaccgtatcatcgacggccgcgaagccgttctgggtctggtggccatgaaggaagcgctggaagatccggctcgtctgctgctggacctg

SEQ ID NO: 32096 - DNA, 789 bp, Ralstonia metallidurans
atgagcaaacaattcgacgtgctggtgatcggcgccggccccggcggctatatcgccgccatccgcgctgcccagttgggcctgaacgtggcttgcctggaaggcaacgcctatgacgatccgaagggcgaagcacgcctgggcggtacctgcctgaacgtgggctgcattccgtccaaggcactgctggcttcctcggaagagttcgagaacgcctcgcatcacctggccgaccatggcatcaccgtgggcgacgtcaaggtcgacgtggccaagatgctcaagcgcaaggacgacatcgtcagcaagatgacgaagggcatcgagttcctgttccgcaagaacaaggtgaccctgttcaagggctacggcaagttcaccggcaaggctgcagaaggcttccaggtggaagtgaatggcgagacgctgaccgccaagcaggtcatcatcgccacgggctcgaaggctcgccatctgccaggcgtcgctgtcgacaacaacctgatcagcgataacgaaggcgcgctgaagttcggtaccgtgccgaagaagctgggcgtgatcggcgccggcgtgatcggcctggagctgggctcggtgtggcgccgtctgggtgccgaagtgaccgtgctggaagcgctgcccgcattcctgggcgccgccgacgaaggcgtggccaaggaagcgcagaagctgctgaccaagcaggggctgcagttccacctgagcgtcaaggtcgacgaagtgaagaccggcaaggacaacgtcacgacaactacaccggaccgg

SEQ ID NO: 32097 - DNA, 1536 bp, Ralstonia metallidurans
ggcgagatgatcgttcacgccatcgaccggtatccggatcgcgtggcattcatcgacggcgatgcccgcatgacctaccgcgcgctcggcgatcgcatcagccaggccatttccgcgtttcgcgcgctaggtctcgtgcgtggcgattgcgtggtacaactgtcgggcaatcggcccgaggtgttcatcgtgatggcggccgcctacctgatggggttgcgatcggtgacgcttcacgcaatggggggtgttgacgatcacgcctatatcgtcgacgacgccgaagcacgagtgttcatggccgatcccgtctatgccgagcgcgcgctggcattgcgcgagcgctgcgcgggtgtggcgcactggttcggtcatgccgacgtgccgggattgccatcgttctgggaccaggcgacatcgttcgcgccggcacggctggtgccggaagcgctgaccacggacgtgatccggctggcctataccggcggcaccaccggcaagccgaagggtgtcatgctcgccaatcgttgcgtgtggatgcaggcggtgttgctgctggctgcgcggagcctgcccgatgatctgcggctgctgtgtcccacgcctatttcacacggtgctggcgcgatgatcgtgcccacgctgtggcgcggcggcaccatcatcctgcagcacgggttcgacgctgagcgtttcatcgatgccgtggaaacccatcgtgccagcatgacgttcctggtgccgaccatgatctacacgctgctcgatcacccacgtgcgcgcacggccgatttctcttcgctgcagacgctttcctatggcgcctcgccgatggcgcccgcgcggatccgcgaggccatcgacaggttcggcccgatcctggcgcaaagctatggccagaccgagtgcccgagcaacatcctgcaactgacgcaggaggatcacatgcgcaccgacgtggacacgtcgacgtccgcggggatgccatatccgggtgtgacggtggccctgctggatgacaacgatgaaccggtggcgccgggcagcgttggcgaactctgcgtgcgcagcccgctcgtgatggacggctactggaagcagccgcagctgacagcattggcactgcgcaacggctgggctgcacacgggggacatggcctaccgtgaccagttcggctactactacctggtcgatcgcaagaaggacatgatcatctcgggcggattcaacgtctatccgaaggaggtcgaggacgtcctgactggtcatccagcgcgtagcggactgctgcggtgatcggcgtgcccgacgcgaaatggggcgaggcggtcaaggccgtcgtggtgccgaggccgggcgcccagctcgacgtggaggcgctgcgcgcgctggtgcgccatgccaagggcgccgtcaatacgcccaagacaatcgatttcgtcgatgcgttgccactgaccgcgcttggcaagcccgacaagaagcaactgcgcgaacgctactggggcggcatgggccgcgccgtcaactgataa

SEQ ID NO: 32098 - DNA, 783 bp, Ralstonia metallidurans
ccacaaccggccagccggtccctgaagggccgcgtggcgatcgtgaccggcgcggggtctcgcgcggatggcatcggcaatggccgcgccgctgccattctgctggcgcgcgatggcgcccgcgtggcgctgatcgacagcgtgcgcgaatgggctgaggtgacgcaccggatgatcgtggaggagggcggcgaggccgaggtcatcgcctgcgacgtgagtcgtgatgaagattgccggagcgccgtggcgcgcgcggtggaactctgggggcgcgtcgatatcctggtcaacaacgtcggcatcggcggaccgcaaggcactgccgaggacgtcgatctcgaagcgtgggatcaggcgctgcgcatcaacgtgacctcgatgatgctgatggcacgtcatgcgattccgcacatgcgcgcgcaaggcaagggtgcgatcgtcaacgtggcgtcggtggcggggctgatcggcgggcatccgagtctgctgtatccgacctcgaagggcgcggtggtcaacatgacacgtgccatggccgcgcatcacggcgaacagggcatccgcgtcaactgcgtggcgccgggaatggtctacacacccatggtttatgccaaggggatgtcgccagagaagcgcgaggcacgccgcaatcgctcgtttctgcgcaccgagggcagcggctgggatgtcgggcaggccatccggtatttggtcagcgacgagtctggctgggtgaccggggcggtgttgccggtggacgcaggcgccacggcgggccgg

SEQ ID NO: 32099 - DNA, 924 bp, Ralstonia metallidurans
tgcaccgtcgtgctcaagccgtccgaagtggcgccgctcaatgccttcgtgctggctgaagtgatcgaggccgcggggctgccgccgggcgtgttcaacctggtgaccggttatggtcccgtggtcggcgaggtgctggccagccatcccgaagtcgacatggtgtcgttcacgggttcgacccgtgccggcaagcgcgtctcggaactggccgcgcaatccgtcaagcgcgtggcgctcgaactcggcggcaagtcggcgtcggtgatcctcgacgatgcggacctgccgacggccgtcaagggcaccatcggtgcctgctacctgaactcggggcagacctgctcggcgcacacgcgcatgcttgtgccgcgcagccgctacgaggaagtcaaggccatcgccgcgaaggtggtggaaggcttcaccgttggcgatccgctggccgacacgacgaagctgggaccgctgatctccgcggtgcagaaggagcgcgtcaccggatatatccgtcgcgggctggacgagggcgcggaactggtggcgggaggacccgatacgccggctggtctggaccgtggcttcttcgtcaagcctaccgtcctcggcaatgtcgatccgaaggccaccgtggcgcaggaggagatcttcgggccggtactgtccgttatctgctacgacacggaagacgaggccatccgcatcgccaacgacagcatctacggtctgggcggcggtgtctggtcgggtgacgagtcgcgcgcgatccgcgtggcgcgccgtatccgtaccggccaggtggacatcaatggcggcccgttcaacatgaacgcgccgttcggtggcttcaagcagtccggcaacgggcgtgaaggcggcaagttcgggttggaggaattcctcgagtacaagtcgctgcaactc

SEQ ID NO: 32100 - DNA, 414 bp, Ralstonia metallidurans
atcgatatccgcaagatcctgaagctgctgccgcatcggtatccgatcctgctggtcgaccgtgtgctcgagttcgaaccgcagaagcggatcaagacgctgaagaacgtgacgatcaacgagccgtacttcatgggccacttcccggaccaaccggtgatgccgggcgtcatgatcctcgaggcactggctcagtccgccggtcttctgacgttcggcgccgatatggagcgcaaggaaggtgcgttgtattacttcgtcgggatcgacggcgcgcgcttcaagcgcgtggtgtatccgggcgatcagcttcacctgaacgtgaccgtggagcgctatatccgcggaatctggaagttcaaggccagcgcgaccgtggacggtgaggtggcctgcgaggccgaactgatgtgc

SEQ ID NO: 32101 - DNA, 801 bp, Ralstonia metallidurans
atgagcattccttcgtttggcgttggcaccttccgcctgactggccaggtcgttgtggactcggtgcgcaatgcgctggacgttggctaccgcgccatcgacaccgcgcagatctatggcaacgaggccgatgtgggccaggccatcgcggaaagcggtgtggagcgcggcgaactgttcgtgaccaccaagatctggacggcgaactacgccgccgacaagctggtgccgagcctgcgtgaaagcctggacaagctgcgcaccgactacgtcgacctgacgctgattcactggccggcgccgggcaacggcgtggcgctgtccgagtacatggccgcgcttgccgaagccaaggcgctcgggctgacgcgccagatcggcgtgtccaacttcaatatcgaactgacccgccaggcgatcgaggccgttggcaagggcgagatcgccaccaaccagattgaactgagcccctatctgcagagccgcaagctcaccgcgttcctgaaagaacagggcatcgccgtcacgtcgtacatgacgctggcctacggcaaggtgctgaaggacccggtgctggggcagattgccgcgaagcaccacgccaccgtggcgcaggtggcgctggcatgggcgctgcaactcggctacgcggtgattccgtcgtcgaccaagcgcgagaacctggccagcaacctgctggcgcgcgacctgaagctcgacgccgacgacatggcgctgatcgcctcgctggaacgcaacggccgtgaagtcagccctgagggcctggctccggtttgggac

SEQ ID NO: 32102 - DNA, 1656 bp, Ralstonia metallidurans
atgtatcagtacgatcaatatgaccagcgtatcgtccaggagcgcgttgcccagttccgtgaccaggtgcgtcgccgcctgtccgatgagctgaccgaggaagaattcctgccgctgcgcctgcagaacggcctgtacatgcagcgtcacgcctacatgctgcgcgtggcgattccgtacggcctgctggcctcgaagcagatgcgcatgctggcccatatcgcccgcacctacgaccgcgactacggccatttctccacgcgccagaacatccagtacaactggatggatctggagcgcgtgcccgacgtgctggacgacctcgccagcgtcgaaatgcacggcatccagacctccggcaactgcgtgcgcaacatcaccaccgaccagttcgccggcgtggcgccggacgagacggtggacccgcgcgtgctggccgaactgctgcgccagtggagcacgttccagcccgaattcgcgttcctgccgcgcaagttcaagatcgccatctcgtcgtcggccgatgaccgcgccgtggtgcagatgcacgatatcggcatctatgcgtacaagaacgccgctggcgagacgcgcctgcgcatccttgctggtggaggtctgggccgcacgccgattctgggcacgatcatcaaggaagatctgccgtggcagcacatgctgacctatgtggagtccgcgatccgcgtgtacaaccgctacggccgccgcgacaacaagtacaaggcccgcatcaagatcttggtgaaggccatcggcgccgagaagttcgccgccgaagtggaagaagagtggaagttcagcaaggacggcccgggcacgctgacgcaggccgagttcgatcgcgtggcgcagtacttccagccgcccgcctacgaaaagctgcccgacaccgacgcatcgttcgaaaagcacctgctcgagaacaaggcgttcgcacgctgggtcaaccgcaacgtgcacgcgcacaaggtgccgggctatgcatccgtgacgctgtcgaccaagccgggtccggtgtcgcccccgggcgatgccacgtccgcgcaaatggacacggttgccgatttcgctgatcgctatggctatggcgaactgcgcgtggcgcatgagcagaacctggtgctgcccgatgtgaaaaagcgtgacctgttcgcgctgtgggaagacgcgaagaaggccggtctggccacggccaacatcggcctgctgaccgacatcatcgcttgcccgggcggcgacttctgctcgctggccaacgccaagtcgattccgatcgcgctggcgatccaggagcgcttcgacaacctcgactacgtctacgacctcggcgacatctcgctgaacatctcgggttgcatcaacgcctgcggccaccaccacgtcggcaacatcggcgtgctgggcgtcgacaaggatggcgccgagtggtaccaggtcacgatcggcggcgcccagggcaatgacacggcgctgggcaaggtgatcggcccgtcgttcagcgcccacgagatgcccgatgtggtgtcgcgcatcatcgagacattcgtggccaaccgtgttggcgacgagcgctttatcgaaaccgttggccggattggcatcgcgccgttcaaggaacgggtgtacgcggacaag

SEQ ID NO: 32103 - DNA, 1251 bp, Ralstonia metallidurans
aaagtactggttggcggcgtggggatgattcccttcagcaagccgggcgccagccccagctataccgacatgggtgcggaggcagtccggcgggcgctggccgacgccggcatcggctacgagcaggtgcagcaggcctacgtcggctatgtgtacggtgactccacctgcggccagacggcgttgtacgaagtcggcctgaccggcattcctgtggtcaacgtcaacaacaactgttcgacgggttccaccgcgctctacctggcccgccaggccgtggcgctgggcgacgccgactgtgtgctggcactcggcttcgagcagatgcaggccggcgcgctgaagtcgcactgggacgaccgccccaaaacacgcgcccgctttgcgcacgtgctgcaggatctgaccgccgacgtggctgacctgccgcaggcactgcgcacgttcggcggcgcgggccgcgagcatatgcagaagtacggcacgaagatggaaacctttgccgccatccgcgccaaggccagccgccacgccgccaacaacccgctggcactgttccggaacgtggtcaccaccgaagaggtcatgaacgacaaggtgatgtggcccggcgtcatgactcgcctgatggcctgcccgccgacctgcggcgccgccgccgcgctgatcgtctcggagaagttcgcgaagaagcacggtctacgcaccgacgtgcaaatcctggcccaggccatggccacggatccagtcgaatcgttcgatccgccctccatgatcagctatgccggcttccacatggcgcaagccgctgccaacaaggtctacgagaaagcaggcgtgaacccgaaggacatccgagtcgcggagttgcatgactgcttcgcccataacgagttgctgagctacgaggcgctgggcctgtgcggcattggcgaaggcgagaagttcgtgatggacggcgacaacacctacggcggccgcgttgtgaccaattcctccggtggcctgctgtcgaagggccacccgctcggcgcgacgggcctcgcccagtgctacgaactgacccaccagttgcgcggcaccgcggacaagcgccaggtggaaggcgcgaagctcgcgctgcagcacaacatcggcctgggcggcgcctgcgtggtgacgctctacggcaaggcctgaccaacggtcacgaatgcggcggcttcgtgtcgccgcccctcgaaatcttgaaatcccacagcgggaaacatc

SEQ ID NO: 32104 - DNA, 811 bp, Ralstonia metallidurans
aaactggaaggcaaggttgccatcgtcactggtgcagggcgtggtatcggccgctgcatcgccctgaagttcgccagcgaaggcgccggcgtggttgtcaacgatcttgatgccgcaccggccaatgatgtggtggaggagatccgccgcagcggcggcaaggcactggcctttgcctgcaaatgtcaccgagccggacttcggcgaacgcctggtcaaggccacactggaggcgttcggcggcatcgacatcatcgtcaacaatgctggctatacctgggacaacgtcattcagaagatgagcgacgaacagtgggacgccgtcatcgactgccacctgaaggcgcccttcaacctgctacgggcggcccagccctacttccgcgaagtcagcaaggccgaggccgccgagggccgcgaggtcttccgcaaggtggtcaatatctcgtcgatctccggtacgcagggtaacgccgggcaggtcaactactccgccgccaaggcgggcgtgatgggcatgaccaagacgctggccaaggaatggggccggatgaaggtcaacgtcaactgcgtggccttcggcttcatctccacccgcctgaccgaggccaccaccgaagagaagaccgtgagcatcgaaggccgcgacatcaaggtcggcgtcaatccggagcgcatcgcgcaggccagcaaggagatggcgctcggccgccccggcacggcggaagaagccgccggctcggtctacatgttctgcattcccgaatcgaactacgtgaccggccagaccatcatttgcggcggcggtcgc

SEQ ID NO: 32105 - DNA, 1579 bp, Ralstonia metallidurans
atgatgcagcagtatcaaagcaattcgtacctcttcggcggcaacgccccctatgtggaagagctgtacgaggcctacctccagaatcccagctcggttcccgacaactggcgcgcgtatttcgacgcgatgcagaatgtcccggctgcggatggttccaacgcccgcgatatcccccacgcaccgatcgtcgcctcgttcgccgagcgcgccaagcagggccccatcaagaccattgttgcctcggccgattccgatatgggtcgcaagcgcgtcgctgccacgcagctgatcgccgcttaccgcaacatcggctcgcactgggctgacctcgatccgctcaagcgccaggagcgtccgcccctgcctgacctggatccggcgttctacggcttctccgaggctgacctcgatatcgtcttcaatgccagcaacacgtacttcggcaaggagtcgatgagcctgcgcgagctgctcaacaacctgcgagaaacgtactgcggcaccatcggcgccgagttcatgtacgtgagcgaccaggcgcagaagcgctggtggcaggagcgtctggaaaccacgcgttccaagcccgtgttcacgctggagaaaaagaagcacatcctcgaccgcctgaccgcggccgaaggcctggagcgattcctccacaccaagtacgtcggccagaagcgcttctcgctcgaaggtggcgagagcttcatcgccgcgatggacgaactgatccagcacgccggcaccaagggcgtgcaggaaatcgtgatcggcatggctcaccgtggccgtctgaacgtgctggtcaatacgctgggcaagatgccggccgacctgttcgctgaattcgaaggcaagcacgtcgacgacctgccggccggtgacgtgaagtaccacaagggcttctcgagcgatgtctcgacggaaggcggcccggttcacctgtcgctcgcgttcaacccgtcgcacctggaaatcgtcaacccggtggtcgaaggctcgtccaaggctcgccaggaacgccgcggcgacgtcggccacaaggaagtgctgccggtgcaggtgcacggcgacgcggcctttgccggccagggcgtggtgatggaaacgctgaacctcgcgcagacccgcggctacggcacgggtggcacgatgcatctggttatcaacaaccagatcggtttcaccacgtcggacccgagcgacgcccgttcgacgctgtattgcacggacgtggtcaagatgatcgaggcgccggtgctgcacgtgaacggcgacgatcccgaagccgcgctgtacgccatgcagatggccgacgatatccgcatggaattcacccacgccctcgctggtcgacctcatctgtttacgcaagctgggacacaaagagccacgacacgccggctatgacgcagacgatgatgtacaagaagatcggcacaatccgggtacgcgcaagctgtacgctgacaaactggttgcgcacagactgccccagacgactccgacacgcgctgctcaagactacgagccacatggacgcggaaccacaggggatccgtcctatgaa

SEQ ID NO: 32106 - DNA, 707 bp, Ralstonia metallidurans
cgtgacgatggcgtgatcacgcgtgtttaccgacatccccggggtgccggccgataccgacctcgtcgtgcgcgcggcccgcgcaatgcaggcggccagcggcacgcgtattcggcgtggacatcgccatcgacaagatcctgcccatgggtggcggcatcggcggcgggtcgtccgacgccgccaccacgctgctggcgctgaaccgcctgtggggcgtgaacctgccgcgcgaagaactgatgcgtatcggcctttcgctcggcgcggacgtgcccgtattcgtgttcggccagaacgcgttcgccgagggcgtgggcgaggaattgacgcccgtggcgctgccggacagctggttcgtggtcatccatccacggcaacatgtgccgaccgcagcaatattttcggacgaacgcttgacaaggaattcgccaatctctatagttgcggacttcgctgcttgcacaaacaaattcgctttcggtcgcaacgatctggaaacgatagcaacagcgaagttcggcgaagttgcccgagcccttgagtggctgaaaaattacagtccacatgcaaggatgaccggttccggagcctgcgtatttgcccgctttgaagacgagcagactgcgcagagagtgatggaaaggttgccatccgagtgggatggcaggtgtgtgaaaagtttgtcacatcacccgctcgcaacg

SEQ ID NO: 32107 - DNA, 927 bp, Ralstonia metallidurans
ttgatggtatttaccggcaatgccaaccctaaactcgcggaggctgtcgtacagcacctcggcattccgctcggcaaggctctggtcggccgtttctccgacggtgaagtccaggtagaaatccaggaaaacgttcgcggcaagcacgtcatcgtgctgcagtcgacctgcgcgccgaccaacgacaacctgatggaactgatggtgatggtcgacgcgctcaagcgcgcttcggcacgcagcatcaccgcagccatgccctacttcggctatgcccgccaagatcgccgcccgcgttcggcgcgcgtggccatctcggccaagatcgtggccaacatgctggaagtggccggcgtggaacgcgtgctgacgatggacctgcacgctgaccagatccagggcttcttcgatatccccgtcgacaacatctacgcatccccggtcctgcttggcgatctgcgcgagaagaactacggcaatctgctggtagtgtctccggacgtcggcggcgtggtgcgcgcccgtgcgctggccaagcagctcgactgcgacctggccatcatcgacaagcgtcgcccgaaggccaacgtgtccgaggtgatgaacatcatcggtgaagtcgccggccgcaactgcgtgatcatggacgacatgatcgacaccggcggcacgctgtgcaaggctgcgcaggtgctgaaggagcgtggcgcccagaaggtattcgcgtactgcacgcacccggtgctgtcgggtggcgcggttgcccgcatcgccgcgtccgcgctggacgaagtggtggtgtgcgacacgattccgctgtctgacgaagcccgtcagaccggcaagatccgtcaggtcacgaccgccccgctgctggccgagaccttcacccggatcgtccggggcgattcgatcatgtcgctgttc

SEQ ID NO: 32108 - DNA, 987 bp, Ralstonia metallidurans
accaacgccacccttcccctccacgagcttgcccgcgaatcacgcatgggcgcccatggctccgaaaccgacacgcgcgagatccgctgcatcgacctgtcggacttcgacacccgcaagccagagattaccgatcagctctggcgtgccgccaccgacatcggcttcttccaactgcggcaccacggtatcgacctgcccgccatacggcaggcatttgccatggccgaacaattcttcgcattgccggagacggtaaaagcccggtatccattgcagaaagccaacaacgcgggctgggaatcgcgcgcgcaggtaaggccatccaccggcacgccggaccagaaggagtcctatcagatcacgcgcccacacatggcgccactctggccttcggagaccgaattgcccgggttccggcagacgatgctcgaattcgaggcgcaatgctggaacgtgggaatgaaggtgctgtcctgcttcgccgacagactcggcttcgacaccgacttcttctcgcgcgcgcatgacccggccgcgccggattaccagagcacgctacggctgctgcattactacgcgattccacccgaggcgcaggacaagctcgacctgtggcgcgccggcgcccataccgatttcgactgcctgacgctactgttccagcgcgaaggccagggtggtctgcaggtgtgtcccggcaaggagatggatgcccaggcctggaccccgatcgcgccgatcgaggacgtggtcacctgcaacatcggggacatgctgatgcgttggagcgacgaccatctgccgtcgaacttccatcgcgtccggaatcccgcgccgggagagtacatgggcccgcgctacagccttgcgttcttctgccaggccaaccgcgatgcggtgatcgaagggccgtcgaagcggtatccggcgattacggcaggtgatttcctgcggcaaagagtcgcggcgaacttcaaggcctac

SEQ ID NO: 32109 - DNA, 681 bp, Ralstonia metallidurans
atggcacgcacacatatcctcggatttccgcgcattggcgcgcgtcgtgagctgaaattcgcgcaggaagcgttctggcgcggcgaaacgcccgaagccgccttgcgcgaaaccggcaccacgctgcgacgtcgtcactggcagctgcaggccgatgccggcctggcgaccgtggctgccggcgacttcgcctggtatgaccagatgctcggactgaccgcactgctgggcgcgctgccgaagcgtttcggctttgacgccgcatcgctgacgctggcccagtattacgaactggcacgcggcaatgccgcccagccggccatggaaatgaccaagtggttcgatacgaactaccactacctcgtccccgaactcgatgcggacagcacgttcgatggcggccccacatggttcctcgatgaagtcgatgaagccctggcactgggcctggctacgcgccccgtcctgatcggcccggtcacttacctgtacctgtcgaagtcgcacgtccccgggttcgatcgcctcaccttgctgcccaaggtcgtgcaggcctaccgccgcatcctggcgcaactgcgcgagcgcggtatcgaatgggtgcagatcgacgagccggtactgtgcctcgatatcgacgccgagtggctcgacgccattgatcgcgcttatgtcgatctg

SEQ ID NO: 32110 - DNA, 1971 bp, Ralstonia metallidurans
gaaacgctgaccaccagcgcccgtcgccctgcccagccggccctgcccgatccgctcgatgccggcatcgcccatgtcgtcgaatccctgctggcgcaacagcagtccgatggccactgggtctacgaactcgaagccgacgccacgattccggccgagtacatcctgatggtccactacctcggcgagacgccggatctggtactggaaggcaagatcgccaactacctgcgccgcatccagaacgccgatggcggctggccgctgttccacgccggcgcctcggacatcagtgccagcgtgaagggctacttcgcgctgaagatggccggcgacaacccggaagccgaacacatgcgccgcgcgcgcgccgcgatccacgcgatgggcggcgccgaggccagcaacgtattcacgcgcacgctgctcgcgctgtacggcgtgatgccgtggcaggcggtgccgatgatgccggtggagatcatgctgctgcccgagtggtttccgttccatctgtcgaaggtgtcgtactgggcccgcacggtcatcgtgccgctgctggtgctcaacagcctgcgtccgcaggcgcgcaatccgcgcaagatcggcatcgacgaattgttcgtacgcccgtgccaggccacccgcctgccgcgccgcgcgccgcaccagagcccgctatgggtcggcgtgttccgcacgctcgacgccgtggtgcgcatggccgagccactgttcccgcgtggcctgcgccagcgggccatcgagcgcgcgcgtgaattcacggtcgaacggctgaacggcgaagacggcctcggcgcgatcttcccggcgatggtcaactcagtgctgatgttcgacgtcctcggcgtgcccgagagcgacccgaaccgggccatcgcccgccgctcgatcgacaagctgctcgtgatcaaggatgacgaggcttactgccagccatgcctgtcgccggtctgggatacgtcgctggccgcccatgccttgctggaagtcggcgagccgcgcacgatcgcggctgcggcacgcgggctggactggctgctgccgctgcaggaactcgaactgcgcggcgactggacggtgcgccgtcccaacgtccgcccgggcggctgggctttccagtacgccaaccctcactaccccgacgtggacgacaccgccgtggtggctgccgcgatggaccgggtggacaagggcgaccgctccaaccgttatgacgaggccgtatcccgcgcctgcgagtggatcgtcggcatgcaaagcagcaacggtggctggggcgcgttcgaacccgagaacacgcacctttacctgaacaacatcccgttcgccgatcacggcgcgctgctcgatccgcccacggccgacgtgtccgcgcgttgtctggcgatgctgtgccagctaggccagatgccggccaacagcgagccggccgcgcgcgcgctgcgctacctgctcgacgaacaggaagccgacggaagctggttcggccgctggggcaccaactatatctatggcacgtggagcgcgctgtgcgggctgaacgccgccggcatcggcacggacgcgcccgagatgacgcgcgcggcccaatggctgctgtcgatccagaacgaggatggcggctggggcgagtcgggcgacagctacaagctcgagtatcggggctatgaaaaggcgccgagcacggcatcgcaaaccgcctgggccatgctcggcctgatggccgccggcgcaggcgaccaccccgccctggtgcgcggcgtcgagtacctgctgcgcacgcaggccagccatggtttctgggacgagccgtacttcacggcggtgggtttccctcgcgtgttctatctgcgctaccacggctattcgcgcttcttcccgctctgggcactggcgcgcttccgcaacctgctgcgcgatggcaatcgcgccatctcctgggggctc

SEQ ID NO: 32111 - DNA, 1191 bp, Ralstonia metallidurans
atgagtttgttttctgccgtcgagatggccccgcgcgacccgatcctgggcctgaatgaagcgttcaatgccgatacccgcgccagcaaggtgaacctgggcgttggcgtgtacttcaccgacgaagggaaaattccgctgctgcgcgccgtgcaggaggccgaaaaggcccgcctgacgaccgccacgccgcgcggctacctgccgatcgaaggcatcgccgcctatgaccaggccgtgcaaaccttgctgttcggcaaggaatcgcccctgatcaccgaaggccgcgtggtgacggctcaggcactcggcggcactggcgccctgaagatcggcgccgacttcctgaagcgcctgtacccgaacgcgtcggtcgcgatcagcgatccgagctgggaaaaccaccgcgcgctgttcgaagctgccggcttccctgtggtcaactacgcctactacgacgctgccagccacggcctgaacttcgccggcatggtggaatcgctgaagtcgtacccggccaacacgatcgtcgtgctgcacgcctgctgccacaacccgaccggcgtggacctggacgaagcccagtggaagcaggtcgtggaactggtcaaggaacgtaacctgatcccgttcctggacatggcctaccaaggctttgccgagggtatcgagccggacggcgccgctgtgcgcctgttcgcggagtcgggcctgccgttcttcgtttccagctcgttctcgaagagcttctcgctgtacggcgagcgcgttggcgccctgtcgatcgtgaccacgggcaaggaagaagcccagcgcgtgatgtcgcagatcaagcgcgtcatccgcacgaactactcgaacccgccgacccacggcggcactgtggtggccaccgtgctgaacagcccggaactgcgcgccatgtgggagcaggaactggccgaaatgcgcgaccgcatcaagctgatgcgccatgcgctggtcgacaagctggccgccaagggcgtgccgggcgacttctcgttcgtgaaggcccagcgcggcatgttctcgtactcgggcctgacctcggcccaggttgaccgcctgcgcaccgaacacggcatctacgccgtgggcacgggccgcatctgcgtggcagcgttgaacagccgcaacatcgacgccgtggtgaacgcgatcgccgccgtc

SEQ ID NO: 32112 - DNA, 1122 bp, Ralstonia metallidurans
aagcccaagaagtccgttgccctgtcaggtatcgccgccggcaataccgcactgtgcaccgtgggacgcagcggcaatgacctgcactatcgtggctacgacatcctcgacatcgccgacacctgcgaattcgaggaaatcgctcaccttctggtccacggcaagctgccgaccaagtccgaactggccgcctacaaggtcaagctgaaggcactgcgcggcctgcccgccaacgtaaaggccgccctggaatgggtgccggccagcgcccacccgatggacgtgatgcgcactggcgtgtcggtgctgggcaccgtgctgccggaaaaggacgaccacaacaccccgggcgcgcgtgacatcgccgaccgcctgatggccagcctcggctctatgctgctgtactggtaccactacagccacaacggccgccgcatcgaagtggaaaccgatgacgactcgatcgccgcccacttcctgcacctgctgcacggcgaagccccgtcgaagctgtgggaacgcgcgatgcagacttcgctgatcctgtatgcagagcacgagttcaacgcctcgacgttcgcctgccgcgtggtggctggcacgggctccgacatgtactcggccatctgcggcggcatcggcgcgctgcgtggtccgaagcacggcggcgccaacgaagtggccttcgagatccagaagcgctacgacacgccggacgaggcagaggccgacatccgtcgccgcgtggagaacaaggaagtggtgatcggtttcggtcaccccgtgtacacgatctccgacccgcgtaacgtggtgatcaaggaagtggcgcgcaagctgtcgaaggacgccggttcgatgaagatgttcaacatcgccgagcgcctggaaacggtgatggccgacgccaagaagatgttcccgaacctggactggttcagcgcggtgagctaccacatgatgggtgtgccgaccgcgatgttcacgccgctgttcgtgatcgcccgtacctcgggctgggccgcgcacgtgatcgagcaacgggtcgacaacaagatcatccgcccgaccgccaactacaccggcccggaaaacctgaagttcgtgccgatcgaaaaacgc

SEQ ID NO: 32113 - DNA, 1461 bp, Ralstonia metallidurans
aagctgccctacacgtcgcgcgtgctggccgagaacctcgtgcgccgctgcgaccccgccacgctgaccgcatcgctcaagcaactgatcgaacgcaagcgtgagctcgatttcccgtggttcccggcccgcgtggtctgccacgacatcctgggccagaccgcgctggtggacctggccggcctgcgcgacgccatcgccgatcagggcggcgaccccgccaaggtcaatccggtggtgccggtgcaactgatcgtcgaccactcgctggccgttgaatgcggtggtttcgaccccgatgcgttcacgaagaaccgcgccatcgaggatcgccgtaacgaagaccgcttcgatttcatcaactggaccaagaaggcgttccgcaacgtcgacgtgatcccgccgggcaacggcatcatgcaccagatcaatctggagaagatgtcgcccgtgatccacgccgaccacggcgtagcctaccccgacacctgcgtcggcaccgacagccacacgccgcacgtcgacgcgctcggcgtgatcgcgattggcgtgggcggcctggaagccgaaaacgtgatgctcggccgcgcctcgtggatgcgcctgccggacatcgtcggcgtggagctgaccggccgtcgccagcctggcatcaccgccaccgacatcgtgctggccctgaccgaattcctgcgcaaggaaaaggtggtcggcgcgtacctggaattccgtggcgaaggcgcttcgtcgctgacgctcggcgaccgcgcgacgatctcgaacatggcccccgagtacggcgccaccgccgccatgttcttcatcgacaaccagaccaccgaatacctgcgactgaccggccgcgacgaggcacaggtccagctcgtggaaacctacgccaagaccgccggcctgtgggccgacgcgctgacgaaggccgagtacgagcgcgtgctccacttcgacctgtccacggtcgtgcgcaacatggccggcccgtcgaacccgcacaagcgtctgccgacctccgacctggctgcccgcggcatcgccggcaagtgggaagaagtgccgggccagatgcccgacggcgccgtgatcatcgccgccatcaccagctgcacgaacaccagcaacccgcgcaacgtgattgccgccgccctgctggcgcgcaacgccaacgcacgcggcctgacgcgcaagccttgggtcaagtcgtcgctggcaccgggatcgaaggcagtggagctttatctggaagaagccaacctgctgcccgacctggaaaagctcggcttcggcatcgtggcgttcgcctgcacgacctgcaacggcatgtccggcgcgctcgatccgaagatccagcaggaaatcatcgaccgtgacctctactccacggccgtgctctccggcaaccgcaacttcgatggccgtatccacccgtacgcgaaacaggccttc

SEQ ID NO: 32114 - DNA, 876 bp, Ralstonia metallidurans
gcggtggaccacgtgcagttcaagattcggcggggcgagatcttcggatttctcggatccaatggctgcggcaagtccacgacgatgaagatgctgaccggtctgctgcccgccagcgacggacgcgcgtggctgttcggtcaggaagtggatccgcgcgatatcgacacccgccgccgcgtgggctacatgtcacaggcgttctcgctttacaccgaactgacggtgcgccagaacctggtgcttcacgcccagctctttcacgtgcctagggaggacatcgaagtccgtgtggaggaaatggcccagcgcttcgggctgcaggacgtgatggagagcctgcctgacggattgccgcttggtatgcgccagaggctttcgctggccgtggcaatggtgcacaagcccgaactgctgatcctcgacgagccgacctccggcgtcgatcccgtggcgcgtgacaatttctggcggctgttggttgcgctgtcccgcgaggaccatgtcacgatcttcatctccacgcacttcatgaacgaggcggcccgctgcgaccgcatctcgctgatgcacgcgggcaaggtgctggtcagcgatccgcccgagaagatcgtcagcgattgcggcgcggatacgctggaagccgcgtttatcgactacctcgtggcagccggcggcggcacgcaggcagcctcggaaggcgcggaggccccggcgtccccggtagaggccggagccgaagccgaggcaaaaagcaagcatcagtctttctcgctcggccggatgtacagctacctgtggcgcgagtcgctggagcttcaacgcgatccggtgcgcctgaccctggccttgctgggctccgtgatcctgatgctt

SEQ ID NO: 32115 - DNA, 723 bp, Ralstonia metallidurans
gtcacgctgcgctatggcaagacggttgctctcgacgacatctcgctggagtttcccgcgggctgcatgatcggcgtgatcggtcccgatggtgttggcaagtcgagcctgctgtcgctggtggccggcgcacgggccgtgcaggaaggcacggtcaccgcgctcggcggcgacatgtcgcgcaaggaccatcgcgacgccgtctgcccgcgcatcgcctatatgccgcaggggctgggcaagaacctctacccgactttgtcggtcgaggaaaacctgcagttctttgccagactgttcggccacggtgcggccgaacggcgtcatcgcatcgacgacctcacgcgcagcaccggtctgcaaccgttcctggatcgcccggccggcaaactctccggcggcatgaagcagaagcttggcctttgctgcgcgctgatccacgaccccgacctgctgattctggacgagccaaccaccggcgtggatcccctggcacgcgcccagttctgggacctgatcgcccgcatccgccaggatcgtccgggcatgagcgtgatcgtcgccaccgcctatatggatgaagcccagcgcttcgactggctggtggcgatggacagcggcaagatcctcgataccgggacgccggcagaactgctggcccgcaccagcgccgccgatctcgaaggcgcgttcatcgggctgctgcccgaggagaagaagcgt

SEQ ID NO: 32116 - DNA, 1749 bp, Ralstonia metallidurans
cgcctgtggcgcttcgcgcggccctaccgctgggaactgctgggcggcttcgtcctgctactgctgggtaccgccgccacgctcgtaccgccgtacctgaccatgccgctgatggacaaggtgctgattccctaccagaacggtgtgccgatcgatatcggccttgtcaaactctacctggccggcctgctgggcgccgccctggtcgcctgggtgctgggctgggcacgtacctacctgctggcccgggtgtcggagcggatcagcgccgacctgcgcaccaccacctacgaacatctgctcaagctgtcgctcgagtatttcggcggcaagcgcaccggcgacctgatggcgcgcatcggctcggagagcgaccgcatcagcgtattcctgtccttgcacctgctggacttcgccaccgacgtgctgatgatcgcgatgacgtccatcatcctcgtgtcgatcaatccgtggctggcgctggttacgctggtgcccctgccgttcatcgcgtggatgatccatctggtgcgcgaccgcctgcgccatggcttcgagaagatcgaccggatctggtcggagatcaccaacgtgctggccgatacgattccaggtatccgggtggtgaaggccttcgcgcaggaaaagcgcgaagtgacgcgctttcgcgaggcgaacaagcacaacctggccatcaatgaccgggtcaacgcggtgtggtcgctgttcacgccgacggtcacattcctgaccgaggtgggtctgctggtggtctggatcttcggcatctggcaggtcagccacgatgcgatcaccgtgggtgtgctggtggcgttcctgacctatatcagccgcttctacacgcgtctggattcgatgagccgcatcgtctcggtgacgcagaaggctgccgccggcgccaagcggatcttcgatattctcgatcacgtgtcgagcgtgccggagccgcagaagccggtgcacatcgacaacgtccagggcgccatcgaattgcgcgacctcgggttccgctacgggaaccgtgccgtgatccgcgggttgaacctgtcgatccagccgggcgagatgatcggcctggtggggcatagcggctcgggcaagagcacgctggtcaacctgatctgccgtttctatgacgtgtccgaaggtgcgatccgcgtggacggtgtcgatatccgctcgctgccggtttcggagttccgccgccatatcggcctggtcctgcaggagccgttcctgttctttggcacgatcgccgacaatatcgcctacggcaagcccgacgcgacccgagaggagatcatcgcggccgcccgtgccgcccacgcccacgagttcattctgcgcctgccgcacggctacgattcgctggtgggagaacgtggtcaggcgttgtccggcggcgagcgccagcgcatctcgatcgcccgcgcgctgctgatcaatccgcgcatcctgattctggacgaagccacctcgtcggtggatacgacgacggagaaggaaattcagaaggcgctggacaatctcgtgcagggccgtaccacgatcgccatcgcgcaccgcctctccacgctgcgcaaggccgaccgtctggtggtgatggatcgtggccagatcgtcgaagtggggaatcacgacgaactgatggcgcgtgaaggcgcgtactacaagctgtaccaggcacaggcgcgcaacgtggataccgacgccgatacgatcagcgac

SEQ ID NO: 32117 - DNA, 1788 bp, Ralstonia metallidurans
ccgatcaagtcgttgttgattgccaaccgttccgagatcgcgattcgcgtgatgcgggccgccgccgagatgagcatccgcacagtcgctatctactcgaaggaggaccggctcgcgcttcatcgcttcaaggccgatgagagctatctggttggcgacggcaagaagccgctggcggcttacctcgatatcgaagacgttctgcggatcgcccggcaggcaaaggtcgacgcgattcacccggggtatggttttctgtccgagaacccggacttcgcccaggcggtcatcgacgctggcattcgctggatcgggccatcgcctgaagtcatgcggatgctcggcaacaaggtggcggcgcgtaatgcggccattgcggcgggtgtgcccgtcatgccggcgaccgatccgctgccgctcgatctggccgagtgcaagcgcctggcggccggcattggctatccgttgatgctcaaggcgagctggggtggtggtggccgtggcatgcgggtactggagagcgaacaggacctggagccttcgctggcggcggcccgtcgcgaggcgctggccgcgtttggcaacgacgaggtgtacctggagaagctggtgcgcaacgcgcgccacgtcgaggtgcagatcctgggcgacacgcacggcaatctcgtgcatctgcacgagcgtgactgcacggtgcagcggcgcaaccagaaggttatcgaacgcgcgcctgcgccatacatggatgcggccggtcgcgcgtcactgtgcgacgcggcgctgcgcctgatgggcgcggtcggctattcgcacgccggcacggtggaattcctgatggatgcggacacgaacaagttctacttcatcgaggtcaatccacgtatccaggtggaacacacggtcaccgaaatgatcacggggatcgacatcgtcaaggcacagatccgcgtcacggaaggcggccggatcggcatgaccgaagacacgctcgacgagaacggcgatatcaccacgcgcgcggcgggcgtgccgccgcaggcccagattccgctcaatggccacgcgctgcaatgccggatcacgtccgaggaccctgagaatggcttcctgccggactatggccgtctcaccgcgtatcgcagcgcggccggcttcggggtgcgcctggatgccggcaccgcctatggcggcgcggtgatcacgccgtactacgattcgctgctggtcaaggtcaccacctgggcgccgacggccgccgagtcgatccgccgcatggatcgcgccctgcgcgagttccgcattcgcggggtgtcctccaacctgcagttcctggagaacgtcatcaaccatcccgcgtttgggagcggtgacgtcaccacgcgctttatcgacctgacgccggaactgctggccttcaccaaacggcgtgataccgccaccaagctgttgagctatctgggcgacgtcagcatcaacggtcatcaggaaatgacgggccgcgcggtgccgcagttgccgcttccgaggccagtcctgccggtggttgacaccaccagaccgcttcccctcggcacgcgcgatcgactgcgtgaactgggcgcggagaaattcgcaagctggatgctggatcagaagcaggtgctgctgaccgacaccaccatgcgcgatgcgcaccagtcgttgtttgccacacggatgcgtacggcagacatgctgccgatcgcgccgttctacgccagcgagctgtcgcaactgttttcgatggagtgctggggcggcgccacgttc

SEQ ID NO: 32118 - DNA, 483 bp, Ralstonia metallidurans
gacttctatatcgccgcggcgctggcgcccgccgcgtacatcttcgatgtgctcgacggacgcattgcccgctggcgccacgcgcattccgcgcttggccgcgagctcgactcgctctccgacatcatctcgttcggcgtcggcccggccacgctggcgtttgcggccggcatgcgcggcggttgggatctggcggcgctgatctacttcgtctgctgcggtgtgagccgccttgcccgattcaatgtcactgccgagtcgatggccgagggtaccggcaaagtcaaatacttcgagggcacaccgattccgaccagcgttgtgctgaccggtgtgctggcctggtgcgcgtcccagggccggatcggcgatgcgctggtcggcggcgcgtgggagattggtcccggcacgctgcatccgatggcgttgctattcgtgctgtcgggctcgctgatgatctcgaagaccctccgcattcccaag

SEQ ID NO: 32119 - DNA, 801 bp, Ralstonia metallidurans
aaggtggcactggtcaccggttccggccgtggcatcggccacgccatcgcacaacgcctggcacgcgaaggcgcgcgcctggtcatcaatgatctggatgcggagcccgcccacgccaccgtggaagcgttgcgcaagatgggcgtggaagccgtggcctgcgtaggcaacgtgacggcacccgactttgccgaccgctttatcggcacggcgatgtccgagttcaagggcatcgacatcatcgtcaacaacgccgggttcacctgggacgacgtggtgcagaagatgagcgacgagcagtggcacgcgattctcgactgccacatgacggccccgttccgcatcctgcgggccgcgtatccgcacatcaaggcgctgcacgctgctgacaaggaagcgggccgcgaggtctatcgcaagatcgtcaacatctcgtcgacgtcggcgctgaacggcaatgccgggcagatcaactactcgggcgccaaggccggcgtgattggcatgacgcgcgccatcgcacgcgagtggggccgcttcaacgtcaacgtgaacgccgtggcattcggcctgatccatacgcgcatgacctcggccgacgcgaatgcgggcgccaccgtgaacattgaaggccgcgagattcgcgtcgggctgaatccggagatgctcaagtcgcacgctcagcgcaatccgctcggccggggcggcacgccggaagaagccgctggcggcgtctacctgttctgctcgccggattcgaactacatcacgggccagaccatcgccgtggccggtaacctg

SEQ ID NO: 32120 - DNA, 1437 bp, Ralstonia metallidurans
cgcatcgcgcaacggatcatgcagaccggctactcgctgcgcgactcggccgtgcaggccgtggatgcgctctggcacgtgatcgtctacgcggtcagttcgctggcgctgttcgccgaggccgactggcggctgacaattccgctgctcatctggatcgtcgggtatatcgccgcgctggcgtggttcacgccccgggtcaagcaacgctccgtggtggccaccgacgcgcgctcgcgcctgatgggccgcatcgtcgacggctatacgaacatcaccacgctcaagctgttcgcccactcgcagcatgaggagacctacgcgcgcgatgcgatggccgaccagaccgacaaggtccgacaggctggccggatggtcagcgcgatggacgtcacggtgaccacgctgaacggcctgctgatcgctggcaccacgggcatcgcgctgtggctgtggaaccaggggctggtcaccacgggcgccattgcgttgtccacggggctggtcatccggatcaacaacatgtccggctggatcatgtgggtggtcaacggcatcttcgagaacgtgggccaggtgcaggacggcatgaagaccatcgccgtgccgcgtcgcgtgctcgaccggcccgatgcgcagccgctcgacatccgccagggcgaggtcaggttcgaccatgtcggcttccactatggcaagggcagcggcgtcatcgacaacgtgaacctcgtggtgcggcctggcgagaagatcggactggtcgggccgtcgggcgcgggcaagtcgacgctcgtcaacctgctgctacggctctacgacgtggagaccggccacatcctgatcgacggccaggacattgctggcgtgacgcaggagagcctgcgcgcgcagatcggcatggtcacgcaggacacatcactgctacaccgctcgattcgcgacaacctgcgctacggcaagcccgacagcacggaggccgagttgcacgaggctctgcgtcaggcccgcgccgacgacttcatggacctgctggtcgactcgcacggcaatcacgggctggatgcgctggtcggggagcgcggcgtgaagctctcgggcgggcagcggcagcgcatcgccatcgcgcgggtgctgctgaaaaacgcaccgatcctgatcctcgatgaagcaacgtccgcgctggactcggaagtggaatccgcgattcaggaaagcctggaggcgctgatgcatggcaagaccgtaatcgccatcgcgcaccggctatcgacgattgcccgaatggatcgtctggtagtactcgacggcggccgcatcgtcgaaagcggcacgcacgccgaattgctggcggatggtggactgtatgcgcggctttgggcgcaccagaccgggggcttcgtcggcgtcgattgatcccgccgtcagacgagccccaga

SEQ ID NO: 32121 - DNA, 2370 bp, Ralstonia metallidurans
  unsure (1)..(2370): unsure at all n locations
gaggtccatgtgggccgcgacgtgaacaacctgctgaatgccacagaaaaggaagcgatcaagcgcaacgaccagttcatcgccagtgaactgttcctgctcgccgtgtctgacgacaagggcgagacggggcggatcgcccgcgagaacggcttgtcgcgcaagtcgctcgaggccgcgatcacggccgtgcgcggcggtgataccgtcaatagcgccgacgccgagtcgcagcgcgaggcgctcaagaaatacacggtcgacctgaccgagcgagcgcgtgccggcaagctggaccccgtgattggccgcgacgacgaaatccgccgcgcgatccagatcctgcagcgccgcaccaagaacaaccccgtgctgatcggtgagcccggcgtgggcaagaccgccattgtcgaagggctggcacagcgcatcgtcaacggcgaagtgccggagacgctcaaaaacaagcgcgtgctcgtgctcgacatggccgggctgctggccggcgccaagtatcgcggcgagttcgaggaacgcctgaaggccgtgctcaacgacgtggccaaggacgaaggccagaccatcgtcttcatcgacgagattcacacgatggtgggcgnccgggngngncanaagngncnncgannangngncngncngantncaganncngnncnggngnngccanaaccaantggctacaagccggcgctggcgcgcggcgaactgcactgcatcggcgcgaccacgctgaacgaataccgcaagtacatcgagaaggatgccgcgctggagcgccgcttccagaaggtgcttgtggatgagcccagcgtcgaggcaacgatcgccattctgcgtggcctgcaggagaagtacgaactgcaccacaaggtggagatcaccgacccggccatcgtggctgcggccgagctgtcgcaccgctacatcaccgaccggttcctgccggacaaggccatcgacctgatcgacgaggctgccgcgcggatcaagatggaaatcgactcgaagcccgaggcgatggacaagcttgagcgtcgcacgatccagctcaagatcgagcgtgaggcggtcaagaaggaaaccgacgaggcatcgcgcaagcgtctggaactgatcgagcaggaaatcatccggctcgagaaggaatacgctgacctggatgagatctggcgcgccgagaagggcgccgcccagggtgcggccgcgctgaaggaggagatcgagaagatcaagctcgatatcacccgactgcagcgcgaaggcaagctcgacaaggtggctgaactccagtatggcaagctgccggaactcgagggcaagctgcaggcggcaaccaaggccgaggccagcgagcagaagcagcagaacaagctgctgcgcacgcaggtcggcgccgaggaaatcgccgaggtcgtcagccgcgccacgggtattccggtggccaagatgatgcagggcgagcgcgagaagctgctcaagatggaagatcgtctgcaccagcgtgtggtgggtcaggacgaggccgtgcggctggtgtctgatgcgatccgccgttcgcgtgccggtctgtcggatgagaacaagccgtatggctcgttcctgttccttgggccgacgggcgtgggcaagaccgagttgtgcaaggcgctgtccgagttcctgttcgattcggaggaacacctgatccgcatcgacatgagcgagttcatggagaagcacagcgtgagccggctgatcggcgcgcctccgggctacgtgggctatgacgaaggtggttacctgaccgaggcggtgcgtcgcaagccgtacgcggtgatcctgctcgacgaagtcgagaaggcgcacccggacgtgttcaacgtgctgctgcaggtgctggacgatggtcgtctgaccgacggtcagggccgtaccgtcgacttcaagaacacggtgatcgtgatgacgtcgaacctgggctcacacatcatccagtcgatggctggcgaaccgcaggaggcggtgaagggcgcggtatggcaggaggtgcgcacgcatttccggcccgagttcctgaaccggatcgacgaagtcgtggtgttccatgcgctcgaccagaagaatatcgagtcgatcgccaagattcagctcaagcgcctgcaggtccgtctggcccgcatggacatgacgctggacgtgagcgagcgcgcgctggagaagatcgccagcgcgggctacgacccggtgttcggagcccggccgctcaagcgcgcgatccagcagcagatcgagaatccggtggccaaggccatcctggaaggccggtttgccgcgaaggatgtcgtgccggtggactatgtggatggcgag

SEQ ID NO: 32122 - DNA, 1168 bp, Ralstonia metallidurans
atgtcgttcgtcaacgcaggcattccggtcatgctgatcgaacgcgagcaggccgcgctggaccgcggcatggcactgatccgccgcaactacgagatcaccgccgcgaaaggcaagctggcgccgcagcagattgacgcgtgcatggggcgcataacgccgacgctggcgttcgaggccgtggccgatgccgatctggtggtcgaagccgtgttcgaggacatggccgtgaagcaggccatcttcgagcgtctggacgcgctgtgcaagccgtcggccatcctggcgacgaatacgtcgcggttgaacatcgacacgatcgcggcgtcgaccaaacgcccgggcgacgtgatcggcctgcattttttcagcccggcgaacgtgatgaagctgctggaagtcgtgcgtggacaggcgacccgcgccgacgtcatcgcgtcgtgcatggcgatggcgcagcgcatccgaaagattccggtgctggtgcgggtgtgcgaagggtttgtcggcaaccggatgctgacgccttactggcgggaggccggcttcctgttggaagagggcgcatcgccactgcaggtcgatcgcgcattgacgcagttcggcatggcgatgggcccgctgacgatggcggatttggcccggcatggacatcaactgggccacgcggaagcggctggcgccgacgcggccggcgcacctgcggtattcggcggtggccgatcgaatctgcgaactgggccggttcgggcagaagaccaacggtggctactaccgctacgaacccggcagtcgcacgccgatccccgacccgcagatcgacgcgttgatcgaagagtgcgcgcgcgaggcaggcattacgcggcgaccggttgccgacgaggagatcgtcgagcgctgcatgctggcgctgatcaatgaaggcgcgcgcatcctggacgagggcatcgcgcagcgcgcttccgatatcgacgtggtgtacgtgcatggctacggctttccggcgtggcgtggcggccccatgttctatgcggaaacgctcggtctggcgcacgtgctggcccgtatccgcgcgttgcaggacgtgcacggtgcccattgggagcctgcgccactgctcgagcggttggtcgcagaaggccggcagactttcgacggtccacgttga

SEQ ID NO: 32123 - DNA, 1083 bp, Ralstonia metallidurans
ctggttttcaccgaaggcaagggctcttggctgacggaccataacggcaagcgctatctcgatttcgtgcagggttgggcggtcaacgcactgggccattcgaacgaaggcatgatccaggcgctggaaaaacaggcgcgcaagctgctcaacccgagcccggcgttctacaacgagccgatgctgaagctggcgcagcagctcaccgataacagctgcttcgacaaggtcttcttcgccaacagcggcgcggaagccaacgaaggcgcgatcaagctcgcacgcaagtggggccgcaagcacaagaacggcgcgtacgagatcatcacgatggaccacagcttccatggccgcacgttggcgaccatgagcgcgtcgggcaaggccggctgggacacgatcttcgcgccgcaggtgccgggcttcccgaaggccgagctgaacgacctggcttcggtggaaaagctgatcaccgacaagaccgttggcatcatgctcgagccggtgcagggcgaaggcggcgtgattcccgccacgcgcgaattcatgcagggcctgcgcgcgctggccgacaagcacaagctgctgttcatcgtcgatgaagtgcagaccggctgcggccgctgcggcacgctgttcgcgtatgagctgtcgggtgtggagccggacatcatgacgctcggcaagggcattggtggcggcgtgccgctgtccgcgctgctgtgcaaggccgatgtcgccagcttcgaagccggcgaccagggcggcacgtacaacggcaatccgctgatgacggccgtgggcagctcggtcatggaacaactgaccgcgccgggcttcctggacgacgtgaaggccaagggcgagtacctgcgcgagcaactgctggtgctgacgaaggaattcggcctgggtggcgaacgtggtgaaggcctgctgcgcgcgctggtgctgggcaaggacatcggcccgcaactggtggaagaagcacgcgaaatgtcgccggtgggcctgctgctgaacgcgccgcgcccgaacctgctgcgcttcatgcccgcgctgaacgtgacccgcgaagagatc

SEQ ID NO: 32124 - DNA, 1650 bp, Ralstonia metallidurans
tcggaactcgatgctgcgatcgtccgcgcacgcgacgcattgctggaccgccagcaccccgacggccactggtgtttcgaactcgaatgcgatgccaccatcacggccgagtacatcctgatgatgcacttcgtcgacgagatcgacaccgcgctgcaggcccgcatggcgaagtacctgcgcgcggtgcaacggctcgacggccatggcgcatgggacctctacttcggcggcgatctcgatatctcctgcagcgtcaaggcctacttcgcgttgaaggcggcgggcgatccgccggatgcgccgcatatggtcagggcgcgcgaagccatcctggcgcgcggcggcgcggcgaagtcgaacgtgttcacgcgcatcctgctggcgaccttcggcgagatcccttggcgcggcacgccgttcatgccggtggaattcgtgctgtttccgcgctgggcgccgatccacatggacaaggtggcctactgggcgcgtaccacgatggtgccgctgctggtgctgtgctcgatacgcgccgccgcgaagaatccgcttggcgtgcatgtgcaggaactgttcgtcacgccgcccgaactggagcgcgaatacttcccgcgcaagcgtgggctgcagcaagcgtttctggtcgcggaccgcgtggttcgccatctcgaaccgctgattccgcgtgcattgcgccgccgggccatccagcgcgcggtggaatggtccgaagcccgcatgaacggtgaagacggcttcggcggcatcttcccgccgatggtgtacagctacgagatgatggtgctgctcgactacccggaggatcatccgttgcgggtggagtgcaaggccgcgctgaagaagctcgtggtccatcgcgacgatggttcgtcgtattgtcagccctgcctgtcgccggtgtgggacacagcctggagcgtgatggcgctcgaacaggcaccctctgacgcacgcaccgaaaccgccatcgcccgcgcctacgactggctcaccgatcgtcaggtgctggacctgcgcggcgactgggaaaacaatgctgcgcccagcacgccgcctggcggctgggcattccagtacgagaacccgtactacccggacatcgacgattcggccgtcgtcctggcgatgcttcacgcgcgtggcaagcgcaccggccagcccgggcgctacgagatgcccgtcgcgcgttgtctggactggatcatcgggctgcagtcgcgcaacggcggctttggcgcgttcgatgcgaactgcgatcgcgactttctcaatgcgatcccgttcgccgatcacggcgctctgctcgatcctccaaccgaggacgtctccggccgcgtgctgctggcacttggcatcaccgagcgtccgcaggacgctaccgcacgcgagcgctgcatccagtacctgcgcgacacgcaacagcccgatggcagttggtggggacgctggggcaccaactacatctacggcacctggagcgtgctggcgggcctggggctcgccggtgtcgatcgcaagctgccgatggtgcgcaacggcctgcaatggctgcgcggcaagcagaacgccgacggcggctggggcgagacgaacgacagctatgcccgcccggaactggccggcaag

SEQ ID NO: 32125 - DNA, 1563 bp, Ralstonia metallidurans
atgacgattaccggcgaaatgctgatcggcgcgagcgccgtgcgcggcacagaagagacgttttacggaatcaacccggccaccggcgagcaactcgaaccggcattccacagcggcaatgccaacgacgtcgagcgcgcctgcgtgctggcggaggcggcgttcgatgcctatcgcgccaccacgcccgaacaacgtgcccagttcctggagtcgattgccgacgccatcgaagccattggcgacgaactgatccagcgcgcgcacgccgaaacggcgctgccgctcgcccgcctccagggcgagcgcggccgaaccaccggccaattgcgcctgttcgcccgggtgctgcgcgacggccgctggcaggatgccacgctcgacagcgccctgcccgagcgcaccccgccgcgccccgacctgcggatgcagaagatcgcggtcggtcccgtggccgtgttcggcgccagcaacttcccgctggcgttctcggtggccggcggcgacacggcgtccgcgctggccgccggttgtccggtggttgccaaggctcaccccgctcaccccggcacttccgaactggttggccgcgccatccagaaggccgtggccgacagcggtctgcctgaaggcgtgttctcgctcataatgggtgtcggtaatgcgatcggcacggcgctggttgcccaccctgccatccaggcggtcgggttcaccggatcacgcaccggtgggctggccctgatgaacgtggccaacacgcgcccgcagccgatcccggtctatgccgagatgagcagcatcaaccccgtatacctgctgcccgaagccttggccgcgcgcggcgaacagattgcccgcgacctgatcgactcgctggtgctcggcgtcggccagttctgcacgaaccccggcctgctgctggccatcgaaggtccggccctcgaggcattccgcgcgacggccctggccgcgctgacgggcaaacccgccgccaccatgctgacgccgggcatccaccaggcgttcgaacgtggcgtcacgcaactctccgatatcgccgggctctcgcgtgcggcctgcggactggatgcgacgggcccgaaccaggcgcgcccggtattcttcgagacctcggcggagcagttcattgccgaccaccgcatgcacgtcgaagtcttcggcccgtccacggtactggtcacctgcaaggatgccgagacgctgctagccgtgacgcgcatcctggaaggccagctcaccgccacggtgcaggcagatgccggcgaccacgcactggcggcccgcttgctccccgcgctggagcgcaaggtcggtcgtgtgctgttcaatggcttcccgaccggcgtggaagtgtcgttcgcgatggtccacggtggcccgttcccggccacgtcggacacgcgcacaacctcggtaggcgctagcgcgatcgaccggttcctgcgtccggtgtgctaccagaacgtgccggcggacctgctgccgcaagcggtgcgggacagcaacccgctaaacctgtggcgactgaaggacggcgaa

SEQ ID NO: 32126 - DNA, 1362 bp, Ralstonia metallidurans
acctatcgtgcaccgctcaaggacatgcagttcgtcatgaacgagctggcgggcctggaaagcatcagccagttgcctggctacgaagacgccacgcccgatacggcacaggccgtgctggaagaggccgcgaagttcaacgaacaggtcgtggcaccgctgaaccgcgcgggcgatctgaacccgagcagctggaaggacggcgtggtgaccacgacgccgggtttcagcgacgcatttcgccagtttggtgaaggcggctggcagggcgtgctgcatccgtccgatttcggcggccagggtctgccgaagctggtggccacgccgtgcaacgagatgctgaatgcggcgaacctgtcgttcgcgctctgcccgttgctgaccgacggcgcgatcgaggcgctgctgaccgccggatcggatgcccagaaggaaaccttcctgccgaagctgatctcgggagagtggaccggcacgatgaacctgactgagccgcaggccggttcggatctggccgccgtgcggacccgcgcggagccgcagggcgatggcacgttcaaggtcttcggcaccaagatcttcatcacgtatggcgagcacgacatggcggagaacatcgtccatctcgtgctggcacgcaccccgaacgcgcccgaaggcgtcaagggcatttcgctgttcatcgtgccgaagttcctgctcaatgcggacggttcgctgggcgagcgcaacgatgtgcattgcgtgtcgatcgaacacaagctcggtatcaaggccagccccaccgccgtgctgcagttcggcgatcacggtggcgccattggcacgctggttggcgaggagaaccgcgggcttgagtacatgttcatcatgatgaactcggcacgcttctcggtgggcatgcaaggcatcgccgtgtccgagcgtgcttaccagcaggccgtggcgttcgcgaaggagcgcgtgcaaagccgtccggtcgatggctcggcccgcgaggccgtgacgatcatccatcatccggacgtcaagcggatgctgatgacgatgcgcgcgctgatcgaaggcgcacgctcggtggcctatgtggccgccgccgcgagcgacatcgcgcaccagcatccggatgagggcgtgcgtcgtcagaacatggcgctgtacgagttcctggtgccggtggtgaaggggtggagcaccgagctgtcgatcgacgtgaccagcctgggcgtgcaagttcacggtggcatgggattcatcgaggaaaccggcgcggcacaacattatcgcgacgcgcgcatcctgccgatctatgaaggcacgaccgcgatccaggcgaacgatctgattggccgcaagaccgtg

SEQ ID NO: 32127 - DNA, 1065 bp, Ralstonia metallidurans
atggaaccgttcgtttatcaggccacgccgtcgcgggtggtcttcggcgcgggccggttggaggcgttgcccgaggaggtgctgcggctaggcgcgcggcgggctctggtgctgaccacgcccgggcatcgggcactcggcgagcgggtggccgcgttgctgggggagtgctccgcgggcgtttacagcgaggcggtgatgcatgtgccggtggaggtggctcacgccgcacgcgatgaggccgcgcggctgggtgctgactgctacgtggcggttggcggtgggtccaccatcgggcttggcaaggccatcgccctcgtttcggggcaacccatcatcgcggtaccgaccacctacgcgggatcggaggtaacaccgatctacggcctgaccgaaggacgcctgaaacagaccggccgcgacccgcgcgtgctgccgcgcacggtcctctacgatcccgaactgacgctgacgttgccggtggagatttccgccgcctctggcatgaatgcgatggcgcacgcggtggaggcgatatacgccgaggacgcgaacccgatcatcagcctgatggccgaggcgtcgatccgcgcgctggccggggccttgcccaccgtggtgcggcggccggacgatatcgacgcccgtggcgacgcgctgtacggcgcgtggctggcgggtgcctgccttggctcggttggcatggcgatccatcacaagctatgccacacgctgggcgggaccttcaacctgccccatgcgcagacccatgccatcttgctaccgcataccgcgcactacaaccacgccgccgcgccacttgcgctggcacgcgtggcgcgggcgctgggtggcgaacgcgcgcaggataccggcccgctgctgttccggctgaaccagacgctgggtatcgccacggcgttgtcggccatcggtatgcccgaggatgggttggacgaggcggccacgctggcctgcgccaatccctactacaacccgaggctggtcgagcgcgagccgatccgggcgttgctggaacgcgcctggcgcggcgagagcccggcc

SEQ ID NO: 32128 - DNA, 1053 bp, Ralstonia metallidurans
gacgcagttgtggcgtatttccacaccggagggacgaccgggctgcccaaacttgtcgcgcatagcagcaggaatcagcttgccgcggcgctgggggctgcaagcctgcttggcatgcgcaaggatgaccgggtgaccaacggcatgccgttgttccacgttggcgggacgatcgtgagtaccttgtcggtcctgctgtcgggcggccatatcatcatgctctcggcccaaggactccggaatcccgccatggtgacggggatctggaagatcgtcgaacggttcggcatcacgatttttggcgctgtgccgacggctctcggcgccctcctcaacgtcccggtcgatgccgatatttcatcgattcgatacggcctgaccggggcggcaccgtgtccattcagcgtgacaaagcgctttgccgaggtaactggtgttgagcttcacgagctgcttggcatgacggaaaccggcggtgcgacggcggcggatgcggcaggccagcgcccgacagtgggttccgtgggatatcggctcccgttcacgagactgcgtgtgcgacgccaagacgccgagcaaggtctgggggacgattgcgatccgcatgaagtcggtgtcctgtttgtcgaggggccgcatgtttcgcacggctatcgtgatccgagccagaatgccggggtctttatcgaaggtgggctgaacacaggagacctcgcctacttcgacgatgcgggcaagcttttcatcgctggacgcgcaaaggacctcatcatccgcagcggccacaacatcgatccggggatgatcgaacaggcgatgatgatgcacccttccgtcgtcctggcagcggccgtttcgctgccggacaagtacgctggcgaattgccggtcgtctttgtcgtggcaaagcctggcgtcggcatcaatcttgaagaactcgatgcctttgtcaaagagcgaattgcggagcggccggcctggccgaaggcgatccacgtgctggaccagttgcccactacggccgttggcaagctgttcaagcctgccttgcgg

SEQ ID NO: 32129 - DNA, 771 bp, Ralstonia metallidurans
ctcaaaggcaagacggcactggtcactggatcgaccagcggtatcggactcggcatcgcccaagcgctagccgcgcaaggtgcgaacatcattgtcaacggattcggtgacgtggacggcgcaaaggcggagatcgccaaatccggcagcggcattcaggttggctaccacggcgccgacatgagcaaggctgccgagatcgaggacatgatgcgctatgccgagaaggacttcggcggcgtggacatcctggtcaataacgcaggcatccagttcgtggcgaagatcgaggaatttccggtcgatcgctgggacgcgatcatcgccatcaatctcacctccgcattccacaccacccgcctggccctgccctcgatgaaggcgaagaactgggggcgggtcatcaatatcgcctcgacccacggtctcgtggcatcggcggaaaagtcggcctacgtggccgcgaaacacggcatcgtcggcttcaccaaggtcaccgcgctcgaaacggcgcagaccggcgtcacggccaatgccatctgcccgggctgggtgctgacgccactggtacagaagcaggtggaagcccgcgcccagaaggaagggattccggtcgagcaagccaagcgcgaactggtgatcgagaagcagccttccggccagttcgtcacgcccgaggaactcggcgcgctggcggtgttcctgtcgagcgaagccgcgcgtcaggtgcgcggcgcgatctggaacatggacggcggctgggtggcccaa

SEQ ID NO: 32130 - DNA, 774 bp, Ralstonia metallidurans
aatctggaaggcaaggtcgcgctggtgaccggcgcgtcaagcggcctgggcacgcgtttttccaatgttctggcggccgccggggccaaggtggtactggcttcgcgccgagtggaacggctcaaggagctacgtgcctcgatcgaggcagacggcggcagcgcgcacgtggtgcagctcgacgtgaccgatccggacagtatccgggcggccgtggcgcacgccgaaaccgaggctggcgcgatcgacatcctggtcaacaattcgggcgtttccaccacgcagaagttgaccgacgtcaccgctgacgacttcgatttcgtcttcgataccaatacgcggggcgcgttctttgtcgcccaggaagtggccaagcgcatgatcgcgcgggccaagggcgccgaaaaactgggcaatccgctgccccaggcgcgaatcgtcaatattgcgtctgtggccggtctcaaggtactgtcgcagatcggtgtctactgcatgagcaaggctgccgtggtccatatgaccaaggcgatggcgctggaatgggcgcggcatggaatcaataccaacgcgatctgcccgggctatatcgacaccgagatcaaccaccatcactgggacaccgacgcggggcagaagctgatccagatgctgccgcgcaagcgcctgggccaacccgaagacctcgatggcctgttgctgctgctggcgtccgatgcctcgcgctttatcaatggcgcggtggttacggccgacgatggcatggtctgatcc

SEQ ID NO: 32131 - DNA, 762 bp, Ralstonia metallidurans
atgcaaggaatcatggaaggcaaggtagcgctggtcacgggcgcgggtggtggtatcggacgcggtatcgcgctggccctcggggccgctggcgcccgggtagtcgtcaacgacctcggggtgtcgatgagcggcgaaggcggcgatgccggccccgcgcagcgcgtggccgaggaaatccgcgcggccggcggccaggcggtggcgaatactgacagcgtgtctacgtggaacggcgctcacaacatcatccagtgcgcgctagacaacttcggccgcatcgacgccgtggtcaacaacgctggcaacctgcgtgaccgcatgttcttcaaaatgaacgaggaagaatggcgctcggtgatcgacgtgcatctgcacggcacgttcttcgtcagccgcgctgccgccaaccatttcaaggaccaggaaggcggcgcgtatgtgcacatgacgtcgacctccggcctgatcggcaactttggccaggccaactacgccgcggccaagctcggcatcgtcgcactgtccaagtcgatcgcgctggacatgcaacgcttcaacgtgcgctcgaactgcatcgcgccgtttgcctggagccgcatgaccagctcgatcccggccgagacgcccgaggagaaagcccgcgtggccaagctgcaaaggatggaggccggcaagatcgcgccgatggccgtattcctggcgagcgacgcggcgcgcgatgtcagcggccagatcttcgccgtgcgcgccaacgagatc

SEQ ID NO: 32132 - DNA, 1542 bp, Ralstonia metallidurans
tactacgtcgacacgccgctccccatcggcacggcccccgcgctgccggtgcatgcttccatgtcgatgtgtgtgcgcgcgcccgagcaactggaacctggctgcaggtgctggcccgccaacgcggtgctgtcggcaggtgtgatcgacggccgcaacatctggcgcgcggacctgcgtgccgtgctggcgacgctcgccccgcttcacgcacaactcggcgaccgtctctggatcgccccgtcctgctcgctgctgcacgtgcccgtatcgctcgatgccgaacaacgcctcgatcccgaactgaaatcgtggctggccttcgctacagaaaagctcgaggaactgcgcacgctggccgtggcgctgaatcagggcaaagccgcagcggcgacgcagctcgcggcatcagacgcagcacgcgaatcgcgccgcacgtcgcgccgcgtggtcaaccagcgggtacaaggtcgcctggccgctgtcaccgccgacatggccgatcgcgccagcgccttcgatatccgcatcgaacgccagcgcgaggcgctgcaactgcccgcgctgcccaccaccacgatcggttcgttcccgcagaccacggcgatccggcaaacccgcgcggcatacaagcgtggcgagatcggcgcgctggactacctgcagcgcatccgtggcgagatcgaactggcggtgcgcaagcaggaagcacttggcatcgacgtgctggtgcatggcgaggccgagcgtaacgacatggtcgagtacttcggtgaacaactctgcggctacgcattcaccgagaacggctgggtgcaaagctatggctcgcgttgcgtcaagccgccggtgatctatggcgatgtgtatcgccccgagccgatgaccgtggacacggcacgctacgcacagtcgctgaccgacaagccgatgaagggcatgttgaccggcccggtgacaatgctgcaatggtcattcgtgcgcgacgaccagccgcgtgccaccacggcgcgtcaactggccctggcgatccgcgacgaggtacgcgatctggaagcggccggcatccgcatcatccagatcgacgaaccggcactgcgcgaaggcctgcccctgcgccgcgacgactggaccgcgtacctcgagtgggccgtcaatgccttccggctgtcggccgccggcgtatcggaccagacccagatccacacccatatgtgctacgcggagttcaacgacatcctgccggccatcgcagccatggatgccgacgtgatcacgatcgagacctcgcgctcggcgatggaattgctggaaggcttcggggagttcgactacccgaatgaaatcggaccgggcgtctacgacatccactcgccgcgcgtgccgacggtggaagccatcacccggctgctcgagcgggcgtgcgaagtgattccgccagagcggctgtgggtgaacccggactgcggtctcaagacgcgcggctggccggaaacggaagcggcgctggcgaacatgatcacggcaacgcgccagttgcgc

SEQ ID NO: 32133 - DNA, 1410 bp, Ralstonia metallidurans
ctgctgatcgacggcaagcggctgccccccggcagcggtgagtattccaccgacatcaaccccgccaccgaagaacccatcgcgctggtggcgcaaggcagcgccgccgacgtcgacaccgccgtgctggccgcccgcgcggcactcaagagctgggcgggcatgcgcgccgccgatcgcggccgcatcctcaaccggttcgctgacctgctggaagcccacgccgaggaactgatcacgctggagagcctggatgccggcaagccgctggcggctgtacgtcgacaggatctgccggccgttgtcgacactgtgcggtattacgcgggctggtgcgacaagatccacggcgcggtgattccaacgcggccggacgcgctgacctacacggtgcgcgagcctgtcggcgtcgtcgccgccatcatcccgtggaatttcccgctgatgatcggcatgtggaagatcgcccccgcgctggcctgcggttgcacgctgatcgtgaagcccgccgagattacgccactgacggccctgcgcgtggccgaattggcgctggaggccggcgtgccgccgggcgtcttcaacgtcgtcaccggcaagggcagcgtggtgggcaatgcgctggttgcccacccgggaatcgacaaggtgacgttcacgggatcgcccggggtcggacgcggcatcatgcagggcgcggccagcaacttcaagcgcgtcacactggaactgggcggtaagtccgccaacgtgatctttgccgatgccgacatcgatgcggccacgcgtgccgcggcatccggaatctttttcaactcggggcaggtctgctcggccgggtcacgcatcctcgcgcagcgcaaggtgtacgacgaagtggtggaaaggctgactacccgcgcccgcgcgatacgggtcggcgatccggcctcgccggacacgacgatgggccccgtggtctcggcggcgcagatgaaaaccgtgctcgactatgtggaaatcggcaagcgcgaaggcgccagcgcggtgaccggcggcgcgcgcatcggccagcgcggcttcttcgtcgagccaaccgtgttcgcgaacgtcgagcacgaaatgcggatctcgcaggaagagatctttggcccggtggccagcgtgattccgttcgaagacgaggccgaggccgtgcgcatcgccaatggcaccgcgttcagcctggccgcaggggtatggagcgcggacatcgcgcgcgtgcacaaggtagccggagaattacgggcgggaacagtgtggatcaacacgtacggctataccgacgtgcgtctgccctggggcggcgccggcgattccggactcggccgtgagcacggtgacgccgccatcgagaacttcacggaaccgaaggcgatctggctttcgctg

SEQ ID NO: 32134 - DNA, 1125 bp, Ralstonia metallidurans
attgcggagctgcgcggcaaggtgcggcagttcgtcgaacagcacgcgatcccgagcgaagaccctgtactggcgcatgacgtgcagcgccttgacgtcgtggtccggcggctgcagggtctggcccgggaggcgggcatctacgccccccatctgccgcccgagcacggcgggctcgggctcgactggcaggcgcgtgccgagattctggaggaagccggccgcagcttccttggcgctccggcgctgaattgcgcgccgcccgaccagccgaacatgatcaacctgatgcgccacggcaacgccgcgcagcaggcgcgctacctgcagccgctggtgcagggccggatccgttcgtgcttcgccatgaccgaaccggcgcccggcgcgggctccgatccgtcgatgctgcgtaccaccgccacgcgtcaggacggcaaatgggtcatcaacggccataagtggttcatcagcggggccgtggatgcggcgttcgcgatcgtgctggcgcgcaccgatgaggcggccggtaccggcgccacgatgttcatcgtcgataccgacaaccctggctaccgcctcgtgcggaacatcgcggggatggacggctatcaggtgggcggccacggcgagatcgtattcgagcaatgcgtggtcgatgacgacgcggtgcttggccaggtcgggcagggctttgcctatgcccaggcgcggctggagcccgcccggctgtcgcactgcatgcgtttcatcggccgcgcgtcgcgtgcgatggagatcgcgcagcagtacgccgcgcagcgcgagtcattcgggcaacggctggccgatctgcagcaggtgcaggcgatggtggccgattcgcatatcgacctgcatgccagccggctgatggtgcgcgattgcgcgcgcaagatggacgccggggaatcggtcaagcacgactccgcgatgaccaagatcttcgtgtccgaagcggtctggcgcgtggctgaccgcgcggtgcagatcatgggcgcgctcggcatttccgatgacaccccggtctcgatgatccagcgcgaactacgcccgttccggatctacgacggtgcgtccgaactgcatcgtgccacgctggcacgt

SEQ ID NO: 32135 - DNA, 1350 bp, Ralstonia metallidurans
gtcgagcgggagcaggggctgcatcgggggctgtccacgggacagctctccatgatcgccatcggcggcgcgatcggtaccggcctgttcctggggagcgggtttgccatcggcttcgccggcccgagcgtgctggtgagctacgccatcggggcgttgattgccttgctgctgatgggctgcctggccgagatgacggtggcgcatccgacttccggctcgttcggcgccaatgcggagcattacatcgggccgctggccggattcctggtgcgctatgcctactggtcgtcgatcgtattcgcggtcggcacggaagtcacggccatcgcggtctacatgaagtactggttcccgatggtgcccgggtggtactggatcgtcggcttctctgctgcgctgatcggcatcaacgccaccagtgtcaaagtgttcggcgcggtcgaatatgtgttctcgatgctgaaaattgtcgccatcgtcggctttatcctgctcggcgcctatgtggtgacacgcgcgccgaccgggtccggcatcgggctggccaactacaccgcacatggtggcttcttcccgaaagggatgtggggtacttgggtggcggtgatcgtgtccatcttcagctacctgagcatcgagatgattgccgtggcggcaggcgaggcacgcgacccggagaccgccatcacgcgcgcatttcgcgcgaccatggtgcgtctggtgttcttctacctgctgacgctcgcgctgatgctgatgatcgtgccgtggacggcggccggcgccggcgaaagtccgttcgtcagggtgatggcggccacgcgcgtaccgggtgccgcagcggtgttcaacttcgtgattctggtggcggcgttgtctgccatgaacagccagctctatatcaccacacggatgatgttcagcctgtcccgcgcgggttacgcgccaaaggcgctggggcaggtcaacggtcgcggcgtgcccatgacggcgttgttgttgtccaccgttggcatcgccttcgcggtggtgctcaacgtggtgtatccggatgcctcgttcatgctgatgatggcgatctcgatgttcggtgcgatgttcacctggctgatgatcttcattacacatctgttctttcggcggcaacaccgggggcggccgctcgccttcaggatgtggggctttccggtgacaacgctgctcggcgcggggctgatgttcgccaccctggtgacaacgtggttcacgccggagttcaggatgaccctggtggcgggcgtgcctttcatgctggcgctgtcggcggcctactggctctggtaccggaagcgcggcggtgcagcacaa

SEQ ID NO: 32136 - DNA, 1446 bp, Ralstonia metallidurans
atgcaactcaaggacccttcgctgttcaagcaactggcctatgtcgacggtcaatggatcagcgccgattcgggcgccacgttcgacgtcacggacccggccactggcgaggtcatcgcccgggtggccgacctgggtgctgccgagaccacgcgcgccgttgctgccgcggaagtcgcccagaaagcctgggcggcaaagaccggcaaggagcgcgccaatatcctgcgccgctggttcgacctgatgttggccaataccgacgacctggcctacctgatgacgcgcgagcaaggcaagccgctggccgaggccaagggcgagatcgcctacgccgccagcttcatcgagtggttcgccgaggaagccaagcgcgtggacggtgaagtgctggccacgcctgccgccgacaagcggctggtcacgctgcgccagccggtaggtgtgtgcgccgcgatcaccccgtggaacttcccggccgcgatgattacgcgcaaggtggcgccggcgctggccgctggctgcgcgatcgtgatcaagccggccgaactgacgccgctgtccgcattcgcgctggccgaactcgcgcatcgcgccggcgtgccggcaggcgtgctgcaagttgtcaccggtgacgcccggaacattggtggcgtgctgacggccagcccgatcgtgcgcaagctgtcgttcacgggctcgacggaagtgggccgcatcctgatggctcagtcggcgccgaccatcaagcgcctgtcgctcgaactcggtggcaatgcgccgttcatcgtctttgacgatgccgacgtcgatgcggccgtggaaggcgcgatcgtcgccaagtaccgcaacggcggccagacctgcgtgtgcgcgaaccgcttctacatccaggacggcatttacgatgcgttcgccgctaagtttgccgagcgcaccgctcagctgcgtgtcggcaacgggctcgaggcaggcgtggtgatcggcccgctgatcgaggacgccgcgatcgagaaggtgaattcgctggtcgaggatgccacgtcaaagggcggcaaggtactggccggtggcggcaagcacccgctcggcggaacgtattacacgccgaccgtgatcggcaatgccaccgccgacatgcgcatggcgcgcgaagaaatcttcgggccggtggcaccgctgttccgcttcaagcaggacgacgaagccgttgccgccgccaacgccaccgagtatggcctggccgcctatctctacacccgcgacatctcgcgcgcatggcgcaccgccgaggcgctggagtacggcatggtcggcctgaacacgggcctgatctccaacgaggtggcaccgttcggcggcatcaagcaatccggcgtcggccgcgaaggctcgcgccacggcatcgaggaatacctcgagatcaagtatctttgcctgcagatg

SEQ ID NO: 32137 - DNA, 1134 bp, Ralstonia metallidurans
atggcaaaacgtgactactacgaagtgctcgggttaggcaagaacgcgagcgacgacgagatcaagaaggcttatcgcaagctcgcgatgaagcaccatccggaccgcaatccggataacaaggaagccgaggagaaattcaaggaggtcaaggaggcctacgagatgctctccgaccccgagaagaaggcggcttacgatcaatacggccacgctggcgtggacccgaacatggccggtggattcggcggcggcgggtttggcggcggtggcttcgcggaagcgttcggcgatatcttcggcgacatcttcggccaggcagccggcggcggacgtcgtggcggcggcccgcaggcctaccgtggcgccgacctgcgctacagcatggagatctcgctggagcaggccgcgcatggccacgaggcgcagatccgcgtgccgcactgggacgattgcgaacactgccacggcaatggcgccgagccgggttcgtcggtcgaaacctgcccgacctgtaatggcgtgggccaggtgcgtgtgtcgcagggcttcttcacgatgcagcagacctgcccgaagtgccacggcagcggcaagttcatcccgaagccgtgcaccaagtgccacggtcagggcaagctcaagtcgcagaagacgctcgaggtcaagattccggccggtatcgatgaagggatgcgtatccgttcgtcgggcaacggcgagccgggcatcaacggtggcccgccgggcgatctctacgtcgaggtgcatatcaagcagcacccggtgttcgagcgcgacggcgacgacctgcactgccagatgccgatctcgttcgctacggcggcgctgggcggcgatatcgaagtgccgacgctgggcggccgggccagtttcccggtgccggaaggcacccaggccggcaagacgttccgcctgcgcggcaagggcatcaagggtgtgcgctcgggatatccgggcgacctctatgtgcatgtgaacgtggagacgccggtcaagctgaccgaggcccagaaggacatactgcgtcagttcgaccgctcggtgcacgagggcggttcgcgtcacagcccgcaggagcagtcctggctcgacaaggtgaagagcttcttt

SEQ ID NO: 32138 - DNA, 1329 bp, Ralstonia metallidurans
gcgtcgacggtcatcaataccgacgagggattgctggatcgctcgcaggcgccgcgagtggcgggcggcattgccacggtgctggccaatggcgacaagcccggcggccaacgaccgtcgacggtgattactttcgagccgctgatgattcaggccgcaggtcaggaagtcacgctgatccatgccggccgctcgagccaggacatgcttgcgacggtgcgcgcggcgatgttgcgcgacgaagtcttgtcgctggccgaccagctcaacaagacctccgccaccatcgtcaagctggcgcggcagcatgccgaaaccatcgtgccgaactacacgaacggcgttgctgcgcagcccaatagttatggccactacctgctcggcatcaatgcgggtctggaacgcgatgcccagcgcctgcgggaagcctatcagcgcatcgatcgctcgccgatgggaacgacggtgctgaacggcacgggctggccgctgaaccgcacgcgaatggcgagctacctcggattctccgcgctggtggataacgcttatgatgcgtcgcagatcagcgccgtggacctgccggtggaagtgggcgcgatcgtgaccagcatcgccctgcacaccgggagcttcatcgaggatgtgatgacgcagtatgcgcagccgcgcccctggatcctgctgcaggagggcggcggcaatacctatgtgtccagtgcgatgccgcagaagcgcaatccggggctgctcaactccacgcgcgagaaggcctccacagcgatcacgttggccatggggccggtgattcgtgcgcacaacctgccgccgggcatgtctgatgccaaggatgccgttaccaatggccagatggtgcagagcgcgatcacgacattgaaggggctggaccgcatcatgacagccctggtgatcgatcggccgcgcgcgctggatgaactggacagcgactggacggcatcacaggaactggccgacgaattgatgcgcaagtacaagctgccgttccgcgtcggccatcacttcgcgtcgaacctggtggactatgcgaaggcgcacgacataaagccaagcgccttcccctatgccgaggcgaagcgcatctatgccgaagccgtgcgcgactacggtggtggggagtttccgatgagcgaggcggagtttcgcgcggcgctcgatccggtggccatcgtcaagcgtcgcgtgacggtgggcggaccgcagccagcagagatggaacgcatgctgaaggcgtccgagggacaactggcacaacaggatgcgtggatccgcgcgcggcgggcggcgatcgat

SEQ ID NO: 32139 - DNA, 1005 bp, Ralstonia metallidurans
cccaccatgacacgcatcagcctcacccgctatctggtcgaggagcagcgcaagcacaacacgatcgagccggaactccggctgctgatcgaagtggtcgcgcgcgcctgcaaggccatttccaacgccgtcagcaagggcgccctcgcgggtgtgctcggctcggccggcaccggcaacgttcagggcgaaacgcagcagaagctcgatgtgatcgccaatgaggtgctgctcgacgccaatgaatggggtggccatctggctgccatggcgtccgaggaaatggactcgttctacgagatcccgaaccgctacccgaagggcgaatacctgctgctgttcgatccgctcgacggctcgtcgaacatcgacgtgaacgtgtcgatcggcacgatcttctcggtcctgcacatgcacaagcccggtcagaccgtgaccgagcatgacttcatgcagccgggcacccagcaggtggcagccggctatgccgtgtatggcccgcagaccacgctggtgctgaccgtcggcaatggcgtgcacatgttcacgctggaccgcgaggcaggcagcttcgtgctaacccagtccgatgtgatgatcccggaagacaccaaggaattcgcgatcaacatgtccaacatgcgccactgggctccgcccgtgcgccgctacatcgacgagtgcctggccggcgacgaaggtccgcgcggcaagaacttcaacatgcgctggatcgcctcgatggtggccgacgtgcaccgcatcctgacacgcggcggcgtcttcatgtatccgtgggacaagcgcgagcccgagaaaccgggcaagctgcgcctgatgtatgaagccaatccgatggcgttcctggtcgagcaggcgggcggcgcggctaccaatggccagcagcgcattctggacgtggagccgaccaagctccaccagcgcgtatcggtcatcctcggttcgaagaatgaagtcgagcgcgtcacgcggtatcaccaggaa

SEQ ID NO: 32140 - DNA, 1446 bp, Ralstonia metallidurans
ccccatcaacacccggtcgtcgagcacgacgacctgcaccgcaagctcaaggcccgccacctgacgatgatcgccctgggtggtgccatcggcaccggactgtttgtcgcctcgggcgcatccatcgcacagtccggccccggcggcgccctgctggcctactgcctgatcggcctgatggtgtactgcctgatgaccagccttggcgagctcgcggtgcacatgcccgtggcaggatcattcgtaacctacagcgccctctacgtcgacgagggctttggcttcgcacttggctggaactactggttcagcctggccgtgacaattgccgtcgaactgaccgcagcccagttggtcatgcagtattggttcccggaggtaccgggcatctactggagcgcgggctttctggcactgatgttcgcgctcaatgcgttctcggtgaagggcttcggcgaggccgagtactggttcgccatgatcaaggttgtaaccgtcgtcgttttcctgtgcgtgggcgtgctgatgatcctcggcatcctcaagggtgggccacaatcgggctggcacaacttcacgaccggcgaagccccattcgtcggtggcctccccgggctgttcgcggtggcgatgattgccggcttctcatttcaaggaaccgagacggtcggcgtggcggctggtgaagccgcggaccccggacgcacgattccgcgcgcgatccgacagacgttctggcgcatcctgctgttctatgtcgttgccatcctgatcattggcgtgctcattccgtataccgacccgaacctgcttcgcaatgacgtgaccgacgttggcgtcagcccgtttgcactggtattccagcacgctggcctggcttttgccgcggcgctgatgaacgccgtggtgctgaccgcgctgctctcggcggggacatcgagcatgtatgtttcgactcggattctctatggcttggcggtcagccagcgcgccccaagggctctagccaagctcaccccgaacggcgtgccattcaacgcgctgctggtgaccacgggcatcggcgcgctgtgcttcttcagttcgctgttcggcgacaaggccgtgtacctgtggctgctcaacacatcggcaatgaccggcttcttcgcgtggctcggtatcgccgtcagccactatcgtttccgcaagggtctgctgtaccagggctacaaggtcagcgatcttgcctaccgctctccgctctatccgttcggcccgatcttcgctggcgtgctgtgtctcgtcatcgtgggcggccagaactatcaggcattcactgacatccccggccgttggcaagagatcgtctcgacctacattggcgtgccagtcttcctggcgctatggctcggctaccgcatcgtacgcggcacgcgcatgatcgactacgaagacatgccgttt

SEQ ID NO: 32141 - DNA, 891 bp, Ralstonia metallidurans
ctccagatgcgcaatgtgcgcaaactctatggcgaccacgtcgtggtcgacaacctggacctggaagtccagcccggccagtgcttcggcctgctcggcccgaatggcgccggcaagaccaccacgctgcggatgttgctgggcctgactacgccagcatccggcacgctgatgctttgcggtgaaccgattccgcaacgcgccccacaggcgcggatgcgcgtgggcgtagtgccgcaattcgacaatctcgatcccgacttctccgtcatcgagaacctgcgcatcttcgggcgctactttggcctgtcctccgcccagatcgcggagcgagtgccgaagctgctcgagttcgcgcgactggaaagccgtgccgacgcgcaggtacgcgatctctctggcggcatgcggcggcggctgaccgtggcgcgagcgctgatcaacgatcctgacctgctgatcatggacgagccgaccacgggcctcgacccgcaggcccgacacctgatctgggagcgactcaaatcactgctctcggccggcaagacgattctgctgaccacccacttcatggaggaagccgaacggctctgcaaccacctgtgcgtcatcgacgcgggtcgcaagatcgctgaaggcaagccacatgaactgatcgacagcgagatcggctgcgatgtggtggaagtctacggcgatgagctcgaaccgctgcgcgacacgctgacgcccctggctgaacggaccgaaatgcgcggcgaaacgctgttcttctacgtgcgcgagccggctccgctgctggccgccctgcatggcaagggcggcgtgcgctacctgcatcggcccgccaacctcgaggacgtgttcctcaagttgaccggccgcgagatg

SEQ ID NO: 32142 - DNA, 1164 bp, Ralstonia metallidurans
gataccctcggcgtgcgcgccggcacgctgcgcactggcgaattcatggagcactccgaggcgatgtacctgacctcgagcttctgcttcaacagtgcagccgaagccgccgcacgcttcgccaactcggaagagggttacacctactcgcgcttcacgaatccgaccgtgtcgatgttccagtcgcgcctggccgcgctggaaggcgcggaggcctgcatggccacggcttcgggcatgagcgcgattctgtcggtggcgctcgccacgctgcaggccggcgatcacctggtcagctcgcgttcgatcttcggctcgacgatgacgctgttcaactcgatcctggccaagttcggtgtggagacgacctacgtcgacggcaccgatctggctgcctggcgtgccgctgtgaagccgaacacgaagctgttcttcctggagacgccgtcgaacccgctgaccgaggtgtccgatatcgcggcagttgccgatattgcgcacaatgccggcgcgctgttcgtggtcgacaactgcttctgctcaccggctttgcagcagccgatcaagttcggtgccgatgtggtggtgcattcggccaccaagcacatcgatggccagggccgcgtgcttggcggcgcggtggtcggcaagcacgatttcatcatgggcaaggtgttcccgttcgtgcgtacggcgggcccgacgctgtcggcgttcaacgcgtgggtgatgctcaagggcatggaaacgctggcgatccgcatggagcgtcactcgcagagcgcgttggcgattgccgagttcctcgagtcacatccggccgtgaatcgtgtgttccacccggcgctgaagtcgcatccgcagtacgagatcgcccaacgccagcagagcgggggcggcgcgatcgtgtcgttcgagttgaagggcgatagccccgaagccatgcgtgctgctgcgtggcgcgtgatcgacagcacgaagctgtgctcgatcaccggcaatctcggcgacacgcgcacgacgatcacccatccgtacaccaccacccacggtcgcgtggcgcctgaagccaaggccgccgccggcatcagcgaagggctgatccgactggccgttggcctggagtccgtggaggatctcaaggccgatctgctgcgcggcctg

SEQ ID NO: 32143 - DNA, 1956 bp, Ralstonia metallidurans
atcgtccgcgccgcctgcccccacgattgccccgatacctgtgcactgctcgtcaccgtcgaagacggccgggcgatcaaggtcgccggagaccccgagcatccgggcacccagggtgtgctctgcaccaaggtttcgcgctataccgaacgcacctatcacccggaccggctgttgaccccgctgcggcgagtgggcaagaagggcgagggcaggttcgagccaatttcgtgggacgaggcgctcgacgaaattgccgagcggctgtcatcgatcgccgcccggaatcccgaggcgatcgttccctacagctacgccggcacgatgggcctggtacagggcgagagcatggccgcgcgcttcttccacaagctcggcgcctcgctgctcgatcgcacgatctgcgccagtgcgggcgccacggccctgcgccatacctacggcgctagcgtcggcatggacatggagcaggtggtcgacgcgaagctgatcattatctggggcagcaatccgattacgtcgaacctgcatttctggacgcgcgcccaggaagccaagcgccgtggcgcgacgctggtggcgatcgacccgtaccgctcgctgacggcggagaaatgccatcgtcatatcgcgccgatgccgggcaccgacgccgcgctggcgctggcgatgatgcacgtgctgattcgcgacgacctgatcgaccacgactacgtcgcccgcaataccgttggcttcgacgcgctgcgcgaacgggcgatgcagttttcgccggaaacggcggcgcggatctgcgggattccggtcgatgacatcgagtggctcgccgggctgtacggcaaactcgccgtgcgcgagcgccagccggtggcgatccgcctgaattacgggatgcagcgcgtgcacggtggcggccaggcagtgcgtgccgtggcgtgcctgccttcgctggtcggtgcatggcgcgaggccgcaggcggcctgctgttgtcgacgtcgggcttcttcccggtcgacaacgcggcgctgcaacgacccgacctgctgcctggctggccgaacttgccgcgcacgatcaacatgagcacgatcggcgacgcgctgctggacgacggcaccaccggcaacggcccgaagatcgaagccgtggtggtctacaacagcaaccccgtggcagtggcgccggaatcggggaaggtggcagccgggtttggacgcgacgacctgttcacggttgtactggaacacttccggaccgatacggccgattacgccgatatcgtgctgccggccacgacgcagctcgagcacattgatgtgcacaaggcctacggccacacttacttcctggcgaacaaccaggcggtggagccgctcgggcaggcgctgccgaacaccgagatcttccgccggctggccgcgcgcatgggattcacggagtcctgctttgccgacagcgacgaggcgatcgcatcgcaggccgtcctgcgtgaagacaagcgcgcggcgggtattagctgggattccctcaaggcccggggctggcagaagctgaatatcgccaaggcgccgttcgccgagggcggcttcccgtcggcatcgggcaagtgcgagttctattcggagacaatggcgcgagaggggcttgatcccgttcccgcctacgtgccgccttacgaagcgccttcctcggcccccgaactgttcgcgcgttacccgctggcgatgatctcgccgccggcacgtaacttcctcaacagcacgttcgtcaatgtcgacagcctgcgcgccaccgaaggcgagccgcatctcgacatccatccgctcgacgccgcggcgcgtggcattgccaatggtgtgcaggtccgcgccttcaacgatcgcggcagcatgctggcgcgcgcccgcgtgaccgaccgcgcccggcagggcctggtcgtcggcctgtcgatctgg

SEQ ID NO: 32144 - DNA, 1665 bp, Ralstonia metallidurans
tggctgaaaaactatccggcaggcgtgccagcagagatcgacgccagccagttccgttcactggcccagttgctcgaggaatcgttccgtacctatgccgatcgccgggcattcatctgcatggaccatgcgataacctacggcgaactcgatcagctttcccacgcctttgccgcgtggctgcagtcgcggggcctgcgccccggcgcgcgcattgcgatcatgatgccgaacgtgctgcagtatccggtggtgctggcggctgtgttgcgtgccggctacgtggtggtcaacgtcaatccgctctacacgccgcgtgaactcgagcaccagctcaaggacagcggcgccgaggcgatcgttatcctcgagaactttgcatcgacgctgcaggccgtgctgtcagccacaccggtcaagcacgtcgtggtggccagcatgggcgatctgctcggtacggtgaagggcgcaatcgtcaatttcgtggtccgtaacgtcaagaagatggtgccggcctgggaactgccccactgcgtgcgcttcaaggacgtgctggccgaaggccggaagatgacgctgaagccggtcaataccggtccggatgacgtggcgttcctgcagtacacgggcgggaccaccggcgtgtcgaagggcgccacgctgctgcatcggaacatcgtggccaacgtgctgcagtccgaagcgtggatgcagccggcgctggccaagggtgcgcctatcgaccaggtggtcaccatcaccgcgctgccgctgtaccacatcttcgcgctgaccgtctgctgcctgctgggtatgcgcagcggtggcctgagcatcctgatcccgaatccgcgcgatatcccgggcttcatcaaggaactgcagaagtacaagttccacatgttcccggccgtgaacacgctctacaacgcgctgctgaatcatccagacttcgccaagatcgatttctcgggcctgcgcgtggccaatggcggcggcatggccgtgcaggaagccgtggccaagaactggctggcgaagacgggctgcccgatcatcgaaggttacggcctgtccgaaacctcgccgtcggccacctgcaatccgaccgataccgatgcgttctccggcacgattggtctgccgttgccgtcgaccgacgtgtcgatccgcgacgacgacggcaacgaactgcctctcggccagccgggcgaaatctgcctgcgcgggccgcaggtgatggccggctactggaaccgccccgacgagaccgccaaggtcatgaccgcggacggcttcttcaagacaggcgacatcggcgtgatggacgagcgcggctataccaagatcgtcgatcgcaagaaggacatgatcctggtgtcgggcttcaatgtgtatccgaacgaagtggaaggcgtggtcgcggaatgcccgggcgtgctggaggtcgccgccgtgggcgtgccggaccagcattcgggcgaggtggtgaagctgttcgtggtcaagaaggacccggcgttgtccgaggccgacgtgatcgcgttctgcaaggatcgcctgaccggctacaagcgccccaagtacgtcgagttccgtaccgaactgccgaagaccaacgtcggcaagatcctgcgccgcgaactgcgcgatagccgcaaggca

SEQ ID NO: 32145 - DNA, 1866 bp, Ralstonia metallidurans
ctgcacgcgcgctccctttccgacccggcaggattctgggccgaacaagccgcacgtatcgattgggagacccccttcgaacgcgtgctcgacgacagtcgcccacctttcgcccgctggttcgtcggcgggcgcaccaacatctgccataacgccatcgaccggcacttgtccgcgcgtgccgaccagcgggcgctggtctatgtctcgaccgagaccgataccgaacgcacctacacttaccgcgagttgcatgacgaagtcacgcgcatggcggcgacgctgcaggggctgggcgtgcagcgcggcgaccgggtgctgatctacatgccgatgattccggaggcgatgttcgcgatgctggcctgcacgcgcatcggcgccgtgcattcggtggtgttcggtgggtttgcctcggtcagcctggcggcccgtatcgacgacgccaagccacgagtgatcgtgagcgccgatgccggttcgcgcgcgggcaaggtggtgccgtacaagccgctgcttgatgaggcgatccggctggctggccatcatcccgaaaaggtgctgctggtggaccgcaagctggcagagatgccgctggtcagcggccgcgaccaggactacgcggcctggcgcgacaaggtggccggacaagcggtgccatgcgtctggatggaatcgagcgagccatcctacgtgctctacacgtcgggcaccacgggcaagccaaagggcgtgcagcgagacaccggtggctacgcggtggcactggccacgtcgatggagaacatcttctgtggcaagccgggcgacacgatgttcaccgcgtccgatatcggatgggtggtgggccatagctacatcgtctacgggccgctgctggccggcatgaccacggtcatgtacgagggcacgccgattcgtcctgatggcgcgatcctgtggaagatcgtcgagcagtacggcgtcaacatcatgttcagcgcgcctacggcgatccgtgtactcaagaagcaggacccggcgctgctcaagcgtcacgacctgtccagcctgcggctgttgttcctggcgggcgagccactggacgaacctaccgcgcgctggattcagggcggcatcggcaagcccgtggtcgacaactactggcagaccgaatcgggctggccgattatcgctatccagcgcggcgtggaagcgctgccacccaaactgggatctcccggggtgccggcctacggttacgacctgcgcatcgtcgatgaggtcaccggcgaggagtgtccgccaaacaccaagggcgtggtggcgatcgactatccgctgccaccgggctgcatgtcgacggtctggggcgacgacgaccgcttcattcgcacgtactggtcggcggtgccgaatcgtcagtgctattccacattcgactggggtatccgcgacgaggatggctacgtcttcatcctcggccgcaccgacgatgtgatcaacgtggcaggccaccgactgggcacccgagagatcgaggaaagcctgtcgtcgcacccgggcgtggccgaggtggccgtggtcggcgtgcaggatgcgctgaagggccaggtcgccatgggcttctgcattgcgcgtgacgccgggcgcacggcaactgaagcggaccgtatggcattcgagggggagttgatgaagacggtggagcagcagctcggcgcggtggcgcggccggcgcgcgtgttcttcgtcaatgcgctgcccaagacacgctcgggcaaattgctgcgccgcgccattcaggcggtggcggaaggccgtgatccgggtgacctgaccacgatcgaggacccgacggcgctggagcaggtgaaggagtcgctg

SEQ ID NO: 32146 - DNA, 1313 bp, Ralstonia metallidurans
ggacgcaatgtcgtcgtgatcggaacccaatggggtgacgaaggcaaagggaaaatcgtcgattggcttaccgatcatgctaaaggtgtggtgcggttccagggcggccacaacgctggccatacgctcatcatcggcggcaagaagaccattctgcgactgatcccgtcggggatcatgcgcgaaagcaccgtctgctatatcggcaacggtgtggtgctgtcgcctgaggcgctgttccgcgaaatcgaagagctcgagtctgccggcctgcaggtgcagaatcgcctgcgcatttccgaagccgctacgctgatcctgccgtaccacgtggccatcgacaaggcacgtgaagcccgccgcggcgccgccaagatcggcacgacgggacgcggcatcggcccggcatacgaagacaggtggctcgccgcgcgctgcgcgtgcaggacctgttcgatccgaagcacttcgctgagcgtctgcgcgagaacgtcgaattccataacttcatgctgactcagtacctcggcgccgaagccgtcgactatcagcagatcctggacgaatcgctggcattcgcgccgcgcctgaagccgatggtggccgatgtgtcggccgagttgtacgctgtgaatgcggcaggcaataacctgatgttcgaaggcgcgcaaggcacgctgctcgacgtggatcacggcacctatccgttcgtgacctcgagcaactgcgtggccggcgccgcagcggctggtgcgggcgtgggcccgggtcgcctgaactacatccttggcatcaccaaggcgtactgcacgcgcgttggcgctggtccgttcccgagcgaactgtacgacaacgacaaccctgcccgtcaggatgccgtgggcgtgcgcctggccaacgtcggcaaggaattcggttccgtgaccggccgtccgcgccgcactggctggctcgatgccgccgcgctgaagcgctcggtgcagatcaacggtgtgtccggtctgtgcatgaccaagctggacgtgctcgatggtctggaaacgatcaagctgtgcgtaggctacgagctcgacggcaagcgcgtcgatatcctgccgcgtggctcggatgccgtggccgcttgcgtgccggtgtacgaagagtttccgggctggaacgaatcgacctttggcgtgaagacctgggatgcgctgcccgaagcggcacgcgtttacctgaagcgaatcgaggaagtggtcggcattccgatcgacatggtgtcgaccggtccggaccgcgacgagacgattctgctgcgccatccgtaccaggtc

SEQ ID NO: 32147 - DNA, 931 bp, Ralstonia metallidurans
gcggaacgcgatgcccagtcgctgacgcgccgtcgccgcattgctcacacggcctgcgcgccgcaccagtcggtgggcgggatcgacgccacgcccacgccgctgctcacgttctgcagcaacgactacctgggcctggccaatcacggctcgatcgcgcacgcgctggccgaaggcgcgcatcgctacggtgcgggcagcggggcatcgcacctggtcagcggacattcgctggcgcatgcgcagctcgagcgtgaactggcgcgctggctggcaccttacatcccacaggcgcaggcgctgtatttctgcactggctacatggcaaacctggcggtgctgacgtcgctcggcgcgactggtgcgacgctgttctgcgaatcgctcaaccatgcctcgctgatcgacggcgcgcgtctggcgcgtgccgatgtccagcgctaccctcatggtgatgcaggggcgcttgacgcgctgctggcggccagcacgaccgcgctgaagctgatcgtgaccgatagcgtcttcagcatggatggcgatatcgcaccgctggcggcgctgctggaagtcgccgaacgccacgatgcatggatcatcgtcgacgacgcgcacggctttggcgtgctcggcgagaacggccatggtgtgctcgaacacctgggcctgcgttcagagcggctgatctacatcggcacgctcggcaaggccgctggcgtggcgggcgcgttcgtcgcggcgcacgagacgatcgtcgaacacctgatcaacacggcgcgcccgtacatctacaccacggcagcacccgccggcggttgcccacgcgctgctgacgagtctggaaatcatcgctggcgaggaggggcgctcccggcgggggcatctgaccgggctgatcgcggaactgggcgccgggctccaggtgctggtg

SEQ ID NO: 32148 - DNA, 1350 bp, Ralstonia metallidurans
acgtcgctcgcggcacgcagccagcgcgccgtgtggcatccgtgcacgcgcctgcgtcccgacgccagcgccaacgagccgccgctcgccattgtgcgtggcgaagggccctggttgatcgacgctggcgacaagcgctacttcgatgccatcagctcctggtgggtcaatctgttcggccatgccaacccggccatcaacgccgccatcggcgaacaactgcagacactggaacacgtgatgctggccggctgcacgcacgcaccggccgtggaactggccgagcggctgacggcgcttaccggtggcgcgctcggcaacgcgttctatgcgtccgatggtgcctctgccgtcgagatcgcgctcaagatgagcttccactactggcgcaacaccggcctcacggccaagcgcgagttcatctgcctgcgccatggctatcacggcgaaaccgtgggtgcactggccgtgaccgacgtggagatcttccgcgatgcctacgatccgctgacgcgccgcgcccacgtggtgatgtctcccgatgcacgccaggccgcgcgtagcgaatccgccgccgatgtggccacccgggcgctggctgaactcgaagcactgctgcgcgagcgtgccggccagatcgcggcgctgatcgtcgagccgctggtgcagggcgcggccggcatggcgatgtacgacccgtcgtatctcgaaggcgcgcgcgcgttgtgcgatcgctatcgcgtgcacctgatcgccgacgagatcgctgtgggctgtggccgcaccggcacgttcttcgcctgggagcaggcacgcggcggcgacgcggtgcccgcacatgcctggccggacttcctgtgtctgtcgaagggcattaccggcggctacctgccgctgtcgctggtgctgtcgcgtcccgagatccagcgtgcgttcgtggccgacgatatcgcgcgcagcttcctgcattcgcattcgtacacgggcaatccgctggcctgccgggccgcgctggccacgctggacctgttcgaatccgaagatgtgctcgcccgcaaccgcgagcgcgcgcaatggcttggcacggcgatggccggtattgccgccgacccgcgcgtcagccacgtgcgccagcgcggcatgatctgggccgccgacatcgacccgcaggcagcgggggcgaactttgccggacgcttccatctggccgcgcgcgaacgcggcgtgctggcgcgcccgatcgggcacacgctctacgtgatgccgccgtatgttttcgatgccgagctggccaactggctcggtgaacaattgctggacacgctgcaggcagtgctcgatccggcggag

SEQ ID NO: 32149 - DNA, 2055 bp, Ralstonia metallidurans
agcaaccctctgcttgatttctccgacctgccgcgcttcgcggagatccggcccgagcacattggcccggcgctggacgtgctgctcgcccaggcgcaggcagccgtcgcccgcgccgaggacccggccacccccgccacctgggccagcgccgttgaggcactggaggtcgccacggagccgctcggccgcgcctggggcgtggtcgggcatctcagcgccgtagccgacacccccgagttgcgcaaggcacacgccgacaacctgccccgcatgaccgaattctggtcatcgctgggccagagtctggccctgtacgagaagtacaaggccgtcgccgccggccccgagttcgcaggcctttcgccagcgcgcaagcaactgctcgagaacgagctgcgcggattccgcctgggcggcgccgaactggccgaggacaagaagccgcgctttgccgagatccaggaacagcaggcgcaactgtcgaaggcgttctccgaccacgtgctcgatgccaccaatggctacgccctatatatcgaggacgaggcacgcctgtccggtattccggccgacgcaaaggaagccgcggcgctggccgcccagaaggatggcaaggcaggctggaagttcacgctgcactttccgtcgtacttcccggtgctgcagtatgcggacgaccgcgcgctgcgccagaccatgtacgaggccagcgtcacgcgcgcctcggaactgggcccgcagcacggcaatggtcaggccgactgggacaacacggccaatatgcgcgagcaactgacgctacgccgtgaagaggcgcatatgctgggctacgccaactatggcgaagtctcgctggtgccgaaaatggccgagtcgccagccgaagtgctcaagttcctcgacgaactggccgtcaaggcccgcccgttcgctgaacacgactggaccgaactgcgcgagttcgccgcggccgaactcggcctgaacgacgtcgcgccgtgggatgtcgcctacgcgtccgaaaagctgcgccagaagcgctattcgttctccgacgacgaggtcaagcagtacttccaggaaccgaaggtgctcgaagggctgttcggcgtcgccgagaagctgttctcggtccgcatccagccggacacgacgcagacctggcacaaggacgtgcgcttcttccgcgtggtgtcgccccagggcgcactgctcgcccagttctacattgacctgtacgcgcgcgaaggcaagcgcggcggcgcctggatggacgatgcgcgtggccgcaaggaacgcggcaacggcaccgtgcaaacgccggtggcctacctgacctgcaatttcaccgcgccggtcggcgacaagcccgccctgttcacgcatgatgaagtgatcacgatgttccacgagttcggccacgggctgcaccatatgctgacgcaggtgggcgacctcggcgtgtccggcatcaacggcgtggaatgggatgccgtggagctgccgtcacagttcatggagaacttctgctgggaatacgaggtgctgtcgacgatgacggcccacgtggaaaccggcgcgccgctgccgcgcgcgctgttcgatcgcatgctggccgcgaagaacttccagaacggcatgatgacgctgcgccagatcgtgttctcgtcgttcgacatgcacctgcataccgactacgacccgcagggcgcggtatcggtgctcgagctgtcgcgccagatcaacgacgcgaagcatgtggtgccccagtcgccgctgtcgcgctggccgaacacgttcagccacatcttcgcgggtggctatgccgccggttactacagctacaagtgggccgaagtgttgtccgccgatgtttacgcagcattcgaggaagccgcgcagctctccggcagcgtgctcgacagcgccaccggcgagcgttatcgccgcgagatcctgtcggtgggcggtagccgcccggcgatggaatcgttcgtggcgttccgcggccgcgcgccgcagatcgacgcactgctgcggcacggtggcatg

SEQ ID NO: 32150 - DNA, 786 bp, Ralstonia metallidurans
atgagaatcgcaagctggaacgtcaactccctcaaggtacgtctgccgcaggtgctgcaatggctaggcgcgcaggatgccgcgggcacgccgatcgatgcgctgtgcctgcaggaactaaagctgcccgacgacaagtacccgctggccgaactccaagcggccggcttccatagcatcttcacaggtcagaaaacctacaacggtgtggcgatcctggcacgcaacgcggccatgcccgtgccgactgacgtggtgcgcaacattcccggctatgaggatgcgcagcaacgcgtgatcgccggcacgtacggcgacgtacgtctgattagcgcgtacttcccgaatggccaggcgctggactcggacaagttcgtctacaagctcgactggctcaaggccatgatcgagtggctgcgcgccgaaatgacccggtatccgaaactcgcgctgctgggagacttcaacatcgccccggaagaccgcgacgtccacgacccggccaagtgggagggccagaacctggtctcgccgcaggagcgcgacgcgttccagacattgatcggcctgggtctggttgactccttccgcatgttcgaacagcccgagaaaatgttctcgtggtgggattaccgaatgatgggtttccgccgcaatgccgggttgcgtatcgaccatatcctgctttcggccgacctggcgcggcagtgcgcgacgtgtgtcatcgacaaggagccgcgccgctgggagcagccgtctgaccacacccctgtcgtggccacgctc

SEQ ID NO: 32151 - DNA, 1257 bp, Ralstonia metallidurans
atgagcaaggtggctgagatccgggggctggaggtgctcgatagtcgggggaatccgacggtggaggtggaggtcgtgctcgacgacggtgcggtaggccgtgccattgtgccgtcgggggcatcgaccggcgcgcgcgaggccgtggagttgcgcgatgccgatccgcgacgctatttggggcgaggcgtgttgcgggcggttcaggccgtcaacaccgagttgtgtgaggcactgctcgggcgtgatgccggtgaccaacccgagatcgacacgatcatgatcgacctcgacggcaccccggataagcgtcggcttggcgccaatgcgttgctcggcgtgtccctggccgtggctcacgcggctgcgatgtcgaatggtctgccgctgttcgcctatcttggcggagagcgcgcttcgttgctgcccgtgccgctgatcaacgtgatcaatggtggagcccatgccgacaatgcgctcgattttcaggaattcatgatcgtgcctgccggggcaccgacctttaccgaggcggtacgtgccagcgcggaggttttccatacgctacgcgccatgctgaaggctgccggctacaccaccaacgtgggcgacgagggtggcttcgcgcccgaatttcacgctgccgaggaggcgttggacattctggtcgcagccatcgccaaggcaggctatcgccccggcgaggacatcgcgctggccatcgaccctgccgccagcgagctatatgtcaatggcagctatgtctatcagggcgagggcgtcgagcgctcgcgcgaggagcaggtggcctatctggtacgcctcgcggaccgctatccgattgtttcgatcgaggatggcatggcggaagacgatgcgatgggctggcaattgctgacgcggcagctcggcaagcggtgccagcttgttggcgacgatgtgttctgcacacatccgaccttgctgaggcagggggtagagcagggcatggccaacgccatcctggtcaaggccaaccagatcggcacgctgagcgagatgcgcgagacggttcgcgtggcccatggttacgcgtattcggccgtgatgtcgcatcgttcgggtgaaaccgaggatgtgacgatcgccgaccttgctgtggcgctgcgatgcgggcagatcaagacggggtcgatgtcgcgcgcggatcgcactgccaagtacaaccgcctgctgcgcatcgagcgcgagcttgggtcgcgtgccgagtacgcgggc

SEQ ID NO: 32152 - DNA, 900 bp, Ralstonia metallidurans
gattcccaggcagtccgtgactatctgctcggcctgcaagaccgcatcaccgacgccatcgccgctgtcgacggccaggcgttcctgaccgataactgggagaagccccccaccgagcgcctgcgcggcagtggccgcacgcgcatcctggagggcggcgccgtgatggagcgggctggcgtggggttctcgcacgtgcgcggtgacacgctgccgccgtcggccagcgccaaccggcctgaactggccggccgcagcttcgaggcgatgggcgtctcgctggtattccatccgcgcaacccgtacgtgcccaccgtgcacatgaacgtgcgctgcttcatcgccgtgaagcccgacgcggaaccggtctggtggttcgggggtggcatggatctgacgccgtactacggcaacgccgacgactgcgcgcacttccaccgcacctgcaaggattcgctggccccgttcggcgacgacctgtatccgcgcttcaagcagtggtgcgacgagtattttttcctccgccatcgtggcgaggcacgcggcatcggcggcatcttcttcgatgatttctcggcgctcggcttcgaccgcagcttcgagatgctgcgctcggtcggcgatgcgttcctcgccgcctacctgccgatcctcaccgcacgcaaggacgccgcctatggcgagcgcgagcgcgatttccaggcctatcgccgcggccgctacgtcgaattcaatctggtgttcgaccgtggcacgctgttcggcctgcagtcgggcggtcgcacggagtcgatcctgatgtcgatgccaccgcaggtatcgtggcgctacgactggcagcccgagccgggcaccccggaagccgcgctctataccgatttcctgccggcgcgggactgg

SEQ ID NO: 32153 - DNA, 729 bp, Ralstonia metallidurans
caacggacggcgctcgtgacgggaggcaaccgggggttgggcgctgcgatcgcccgtgccctgcacgatgccggccaccgcgtgatcgtcacgcatacccccggcaacaccacgattggccagtggcagcaagcgcaagcgacacagggctactcatttgccgcctacggggtggatgtatcggactacgaatcaacgcaggaactggcgcggcgcatccacgccgacggtcatcggatcgacatcctggtgaacaacgccggcatcacccgcgatgcaacgctgcgcaagctcgacaaggccggttgggatgccgtactgcgcaccaacctggactccatgttcaacgtcaccaagccgttcatcgacccgatggccgagcgcggctggggccgcatcgtcaacatctcttcgatcaacggcagcaagggccagttcgggcagaccaattattcggcggccaaggccggggtacatggattcaccaaggcgctcgcacaggaggtggcgcgcaagggcgtgacggtcaacaccgtctcgccgggctatctggccaccgagatggtgatggcggtgcgagaggacatgcgccagaagatcatcgatgcgattccggttggccgtctcggccagccggccgagattgcagctcttgtcgccttcatcgccagcgaagccgccgccttcatgaccggcagcaacgtggcgatgaacggcggtcagcacatg

SEQ ID NO: 32154 - DNA, 1988 bp, Ralstonia metallidurans
caacccatgtccgccatcgagtcggtgatgcaggagcatcgcgttttcaatccccctgcgtcgttcgccaagaccgccgcgatccccagcatggaggcctaccaggccctgtgcgacgaggctgcaaaggattacgagggcttctgggcccgccacgcacgcgagctgctgcattggcacaagccgttcacgaaggtgctcgacgagagcaacgcgccgttctacaagtggttcgaggatggcgagatcaatgcctcgtacaactgcctcgaccgcaatgtcgagaagggcctcggcgacaagacggccatcgtcttcgaggccgacgacggcacggtgacgcgcgtcagctaccaggaattgctggcgaaggtcagccgcttcgccaacggcatgaaggcccttggcatcaagaagggcgaccgcgtcgtgatctacatgccaatgtctgtcgaaggcgtcgtggccatgcaggcctgcgcgcgcatcggcgccacgcactcggtggtgttcggcggcttctcggcgaagtccctgcaggaacgtctggtggacgtgggcgccgtggcgctgatcacggccgatgagcagatgcgtggtggcaaggcgctgccgctgaaggccatcgctgacgaggcgctgacgctgggcggctgcgaggccgtcaagaacgtgatcgtctatcgccgcacgggcggcaacgttgcctggaccgaaggccgtgatcgttcgatggaagacgtcgccgccggtcagtccgataactgccccgccgagcccgttggcgccgagcacccgctgttcgtgctctacacgtcgggctccaccggcaagccgaagggcgtgcagcacagcacgggcggttacctgctgtgggcgctgatgacgatgcgctggaccttcgatatcaagcccgatgacatgttctggtgcacggccgatatcggctgggtcaccggccacacctatatcacctacggcccgctggccgcaggcgccacgcagatcgtgttcgaaggcgtgccgacgttcccgaacgccggccggttctgggacatgatccagcgccacaaggtctcgatcttctacaccgcgccgacggcgatccgctcgctgatcaaggccgccgaggccgacgagaagatccatccgaagcagtacgacctctcgagcctgcgcctgctgggcaccgtgggcgagccgatcaatccagaggcatggatgtggtactacaagaatatcggccgcgagcgttgcccgatcgtcgatacgttctggcagaccgaaactggcggccacatgatcacgccgctgccgggcgccacgccgctggtgccgggctcgtgcacgctgccgctgccgggcatcatggcggccatcgtcgacgaaaccgggcaggacgtgccgaacggcaatggtggcatcctggtcgtcaagcgtccgtggccgtcgatgatccgcacgatctggggcgacccggagcgcttcaagaagagctactaccccgaggaactcggcggcaaactgtacctggctggcgacggttcgatccgtgacaaggaaaccgggtacttcacgatcatgggccgtatcgatgacgtgctgaacgtgtcgggccatcgcatgggcacgatggaaatcgagtcagcgctggtctcgaacccgatcgtggccgaggccgccgtggtgggtcgtcccgatgacaccaccggcgaggcgatctgcgcgttcgtggtgctcaagcgttcgcggccgacggctgaagaagccgtgaagatcgcggccgagctgcgcaactgggtgggcaaggaaatcggcccgatcgccaagccgaaggacatccgcttcggcgacaatctgcccaagacgcgttcgggcaagatcatgcgccgcctgctgcgttcgctggccaagggcgaggacatcacgcaggacacctcgacgctggagaacccggccattctcgatcagctcaagcaagcccagta

SEQ ID NO: 32155 - DNA, 1668 bp, Ralstonia metallidurans
atgagtcaagcgattgaaatcaaggtgccggatatcggcgactacgacgccgttcccgtcatcgaagtgcacgtgaagccgggcgacacgatcaacgcggaagacgcgctggtgacgctggaatccgacaaggccaccatggacgtgccgtcgccgcaggccggcacggtcaaggaagtccggatcaaggtgggcgatagcgtttccgaaggctccgtgctggtgatgctcgagcccgcaggcgcctctgccgccgctccggctcccgcagccgctgctgctccgtcagctccggcccctgccgccgcggcacccgcgccggcggctcccgctgccccggctccggccgctgcccctgctggtgctggcacggtcgaggtcaaggtgcccgatatcggcgactacgacgccgtgccggtcatcgaaatccacgtcaaggtgggtgaccagatcaacgccgaagacgcgttggtgacgctggagtccgacaaggccaccatggatgtgccgtcgccgcaggccggcacggtcaaggaaatcaaggtcaaggtcggtgataacgtcgcccaaggcacgctgatcctgatcctggaagctgctggcggcgctgccgcagcagctccggccccggcagccgccccggcgcctgccgcagccgctcccgcgcccgcaccggcggccgcggcgccggcacctgttgccgcgccggccgtcgcgccagcggtgcagggtacgaccggcaaggccgctcacgccagcccgaccgtgcgcaagttcgcgcgcgagctgggtgtcgacgtgtcgcgtgtgccgggcaccgctcccaagggccgcatcacgcaggaagacgtgcagaactacgtcaagagcgtcatgagcggccagactgccacgccgtccgcaccggctgccgccgccggcaccggcgtgggcctggacctgctgccgtggccgaaggtggacttcacgcgctttggcgaagtggagtcgaagccgctgtcgcgcatcaagaagatctctggcgccaacctgcatcgcaactgggtcatgatccctcacgtcacgaactgtgacgaagcggacatcaccgagctcgaggcattccgcgtgcagctcaacaaggaaaacgagaaggctggcatcaaggtgacgatgcttgcgttcatgatcaaggccaccgttgcggcgctcaagaagttcccgaacttcaacgcctcgctggacggcgacaacctggtgctgaagaagtacttcaacatcggtttcgcggccgacaccccgaacggtctggtcgtgccggtgatcaaggacgccgacaagaagggcgtgctcgagatcagccaggaaatgagcgatctggccaagctggcgcgcgacggcaagctgaagcctgaccagatgcaaggcggctgcttctcgatctcgtcgctcggcggcctcggtggcacgtacttcacgccgatcatcaatgcgccggaagtggccatcatgggcgtgtgcaagtcgtatatgaagccggtgtgggacggcaagcagttcgccccgcgcctgacgctgccgctgtcgctgtcgtgggatcaccgcgtgatcgacggtgccgaggccgcacgcttcaacacgtacttcgcggcgctgctggcggatttccgccggattctgctgtaagca

SEQ ID NO: 32156 - DNA, 752 bp, Ralstonia metallidurans
ctgcgcggtaagcatgcgctggtgtgtggcgccagcaaggggctcgggtttgcgtgtgccgatgcgctcgcggcggaaggcgtggatgtggtgatcgtggcgccgaggcgctggagaaggctgcagccgatctgcgcgcccgtcacggccgccgcgtgctggcggtggctaccgacattaccacggcggaaggccgcaagcttgccctcgacgcagccacgaagctgggcgatctcgacatcctggtcaacaatgccggcggcccgcctccgggcaacttccgcgattggggccgcgacgaatggctcaaggcgctcgacgccaacatgctgaccccgatcgagctgatcaaggccacggtcgatggcatgatcgcgcgccgctggggccgcatcatcaacatcacgagtggcgcggtgaaggcgccgatcgacgtgctgggcctgtccaacggcgcccgctcggggctgaccggtttcgtcgccggcctggcgcgcgaagtggcgcagcatggcgtgaccgtcaacaacctgctgcccggaccgttcaacaccgatcgtctctacaagacgatggaaggcggcgcgcagaaggccggcatcagcgtcgatgaaatggcgcagcgccgcgcggcgtccaacccgacgcgccgctttggcgacccggctgagttcggcgctacctgcgcgttcctgtgcagccgccaggccgcatacatgaccggccagaatgtgctgctcgacggcggtgcg

SEQ ID NO: 32157 - DNA, 1009 bp, Ralstonia metallidurans
ctgccaatcggcacgctgctggccaactaccgtattgtaaagaagttggccagtggggggttcagtttcgtctacctcgccacggacgaaacgggcgccccggtggccatcaaggaatacctgccgtcgtcactggcccgccgcagtcccggcgagctgatcccggtcgttccggacgagaacgtggcctcatttcgcctcggcctgaagtatttcttcgaggaaggacggtcgctggcccgtatttcgcaccccagcgtggtccgcgtggtgaatttcttccgcgagaattccacggtctacatggtcatgaactacgagctgggcaagacgctgcaggagcatatcctgcaggcccggcagcagggcaaggccaaagtcctccgcgaacggttcatccgcaaggtattccacgacctgatgagcggcctgcgggaagtgcatatccacaagttgctgcatctggacatcaagccgggaaatatttacctgcgcgaggacgaatcgccgatcctgcttgatttcggcgcggcccgccagatcctgaccatggaagcatcacgtttccagccgatgtacaccccggggttcgcggcacccgagctctacggcaagcatacggacctcggcccgtggaccgacatctacagcctgggcgccacgctctatgcctgcatggccggaatgccgccgcaggaggccaaccagcgtgagaaggaagaccgcatgaccgagtcgttcggtcggctgcgcgccacctacacgaacggactggtcgatctggttgagtggtgcctgcgcctgacacccgccgagcgcccgcaaagcgtgttccggctgcagaaggagctgcgcgaccaatcgaacgcgctgggcgagcagtcggccgcggccatggccgccaatcccgcaggccccgtcaccgagcgcctgaacgccaccagccgtttcatgaccttgctgcgccgccgcgaagagaaggccctgcccgccaccgaggcaggccacg

SEQ ID NO: 32158 - DNA, 1422 bp, Ralstonia metallidurans
acccgcgctctttgggtcgacggcgtcagtgttttcacccccgcacgcactttcgattccgtcaatccggccacgggcgaggtcaactggcaggtcgcctttgccacggccgagcatgtggcggctgccgtcgcgtccgccaagcgggcggtcaatgatccggcgtggcgcaagatgctgccccacgtgcgggccggcatcctgatgcggattgccgatgccatgacagcgcgcgccgacgagttcgcgcggctgcagatgcttgagaacggcaaggtctggtcggagtgccgggcccaggccctttccgcggcctcgaccttccgcttctatgccagtgcctgcgaaaccctcgggtcggaagtgacgccgtcgcgcggcaactatctgtcgatgacggcctatgaaccctatggcgtcgtcgccgcgatcacgccgtggaattccccgttgacgatggaagcgcaaaaggtggccccggccctggccgccggcaacgcggtgattctgaaaccctctgaagtcacgccgtcgggcgcgttgctgctggcgcaggtggcgttcgaggcgggcttgcccaagggcctgctcaacgtcgtcaccggcgacggcagggagaccggtacggcgctcgtcgagcatcctgatgtccgcatggtgtcgttcacgggcggcacggccaccgggcgcagcatcgccggcatcgccgcgcagcggctcatccccgtagcgctcgaacttggtggcaagtctccgcacatcattttcgaggacgcgaacatcgacgccgcgatcaatggcgtggtcgatggcattttcgaaggcagcggccagtcgtgcgtcgcagggtcgcggctcttcgtgcagcgttcgatctacgacaaggccgtgggtttgctggtcgaacgcgcccgcgcgttgcgtgttggcctgccagacgtcgcgggctcgcaactgggcccgctcgcgggcttcgcgcatcgggatcgcgtcgagcgcttcgtcagcatcgcgcgcgaggaaggcggccagattctcgcaggcggccgtcggccgcccgaggcggcgctgcaggctggcgcgttcttcgagccgaccgtgatcggtgggttgtccaatagcgcgactgcggtgcagcaggaaatcttcgggccagtgctttgcgtcctgcctttcggcgacgaggatgacctgatcgcgcaggccaacgactcagccttcggtcttgcctccggcatctggacggcaaactaccagcgtgcatggcgcgtggcgcgggcgctggagaccggactggtctggatcaatacgtacaaacagttgtcgatcgccacgccgttcggcggcttcaaggacagcggcatcgggcgggagaaaggcgtcaacggtgtgcgcctctaccagcaaagcaaaggcatctac

SEQ ID NO: 32159 - DNA, 1599 bp, Ralstonia metallidurans
actgacctccaagcctggaacgcccttcgccaacaccatgacgtcgtccgcgagacgccgatgcagcagtggttcgccgaagccggggctgcccaacgggtcgatgccttctcgctggaagcctctggcctgtatctggattactcgaagaaccgcatcaccggcgagacccttgcgctgctgatgaagcttgccgaggaagccggcgtgccggcgcgccgcgacgccatgttcgctggcgaacatatcaacgccaccgaagatcgtgccgcgttgcacgtcgcgctacgcgccctgcccgacgcgccgttcaaggtcgacggcgcatcggtcatgcccgccatccacgatgtactccgccggatgcgcgagtttgccggccgcgtgcgcagtggcgtttggaccggctccacgggccaggggatcaccgacattgtcaacatcggcatcggcggctctgacctgggcccgcgcatggtatgccgcgccctggcgcatctggccgacccgcgcggaccgcgtgtgcacttcgtttcgaatgtggatggcaccgagcttgccgaaacgctccagcgcctggatccagcacgcacgctagcgatcgtctgttcgaagacgttcaccacgctcgaaaccatggccaacgcctgcagcatgcgggactggttcctgcgccacggcgtggccgagaatcagctcgcgcggcacttcgtcgccgtgtcgaccaatcgcgacgcggtggtcgatttcggcatcgacccgaacaacatgttcgagttctgggattggatcggtggccggttctcgctgtggtcgtcggtcggcctgtcgattgcgctggccgtcggcttcgacgccttcgaggacctgctgctcggggcccgcgcgatggacgatcatttccgcactgcaccgctcgcccaaaacatgccggtggtgatggcgatgctgggcatctggtatcgcaatttccacgacatgccgacgagctgcatggcgccctattcgacctcgctcgaactgtttccggcgttcctccagcaactcgagatggagagcaacggcaagtcggtccagctcgatggccgtccggtggacgcggataccgcgccagtggtctggggcacggctggcaccaacggccagcacgcctacttccagatgatccaccagggctcacagatcgtgccggtcgatttcgtcgcgccgctggtgccgccgcgcgaactgccgggacatcacgtcaagctgctggccaactgctttgcacaggccgaggcattgatgcgcggacgcagtgcggaagaactccaagcggccggcgtcgacgcagcacgcattccgcatatggtgttcgagggcaaccgccccagcaacatgctgctgatggaaaacctgacgccgcacgtgctgggcgcgctgatcgcgctctatgagcaccgcaccttcgtgcagggcatcgtctggaacatcaattcgttcgatcagtggggcgtggagctcggcaagatcctggcgcgcccgatcgaggccgaactcagtggcaatgccacggaagcccacgatgcatcgaccgccgcgctgatcgcgcgggcacgc

SEQ ID NO: 32160 - DNA, 1021 bp, Ralstonia metallidurans
gtgcgccagcttgggcaggcgggatggctccgctactgcgtgccggcggcgttcggcggcgcgctacccgcgctcgattcgcgcgcgctttgcctgctgcgcgagacactggcgcgccatgacggtctggctgactttgctttcgcgatgcagggccttggctcgggcgcgatcacgctggccggcagcgacgcggtgcgcgagcgctatcttccgcgcgtggcgaatggcgaggccattgcggcattcgcgctgtccgagcccgaggcgggttctgacgtggcggcgatgcaatgcagcgcgaagctgtccgatgacggcacgcactacgtgctgaacggcgccaagacgtggatatctaatggcggcatcgccgacttctattgcgtgttcgcgcgcactggggaggcagcccgcgcgcgcggcatcaccgcgttcgtggtggatgccaatactccgggcctgtccattgcagagcgcatcgacgtgatcgcgccacatcctctggcaacactgcgtttcgatgactgccgcgtacccgttggcaaccgcctgggcgagccggggcaggggcttcaaggtggcgatgatgacactcgacatcttccgggcctcggtggccgccgccgcgcttggcttcggtcgcgcggcgctggacgatgcgctggcacgcgccacgtcgcgcccgatgttcggcggcgtgctggcggatctgcaactcacgcaggcggcgatcggtgacatggctacggccattgatgccgccgcgctgctgacttatcgcgccgcctggctgcgcgatgtgaggcagcagcgcacgacgcgcgaggcggcgatggccaagatggtcgccaccgagaacgcgcagcaggtcatcgaccgggccgtgcagatgttcggcggcctcggcgtcaaggttggcacgcgtgtggaaagcctctaccgcgagattcgctcgctgcggatctacgaaggcgccactgaagtgcagaagctgatcattgcgcgcgagacgctggca

SEQ ID NO: 32161 - DNA, 1581 bp, Ralstonia metallidurans
ccgccgcagacgtggccggtgttccagttcaatgacgacacgcgctaccccgatcgcctcaatgcggcagtggagcttgtggaccgacacgtggcggccggcaacggtggccgcgtggcggtgcgccatgagcgcgcgggccgtatcgagaccgtgacctatgccgagctggcggcgcttgtggatcgcatcgcgcatgtgttggtcgaggacatggggctggtgccgggcaatcgcgtgctgctgcgcggcccgaacaacctgatgatggcggcgagctggcttgccacgctcaaggcaggactgatcgccgtgccgacgatgccgctgctgcgcgccaaggagctcaagcagatcatcgacaaggcgcaggtgacggctgcactctgcgatgcacgtctgcgcgacgagctggacgcgaaccggcgtgccgacggcgaatacttttgtccgacgctcgaacgcgtgcgctacttccacggcgagggtgccgatgcgctcgaaaccgcgatggcgggcaagcccgacacgttcaccgcgtgcgacacggccgctgatgacatctgcctgatcgcgttcacgagtggtaccacggggcaacccaagggcacgatgcatttccaccgcgatgtgctggcgatgtgcgacctgttctcgcgccacgtgctcaagcccacgccggacgacgtcttctgtggcacgccgccaatcgcattcacattcgggctgggcgggatgctctgcttcccgctgcgcattggcgccagtaccgcgctgtcggaaaggcttacgccggaactactgctcaagctgatccaggaccatcgcgcgacgatcgttttcaccgcgccgacgttctatcggcagatggcggcgctggtaaagaacttcgatttgtcgagcctgaagaagagcgtgtctgctggcgaggcgctgcccgatgccacgcggcaggcctggaaggcagccactggcatcgagatgaccgacggcctcggcggcacggagatgatgcatatcttcgtttccagtgctggagccgacgtgcgcccgggcgcagtgggtcgcgtggtaccggggtacgaagcccgtatcgtcgacgagaacatgcagccggtgccgccgggcacggtaggcaagctcgcggtgcgcgggcccacgggctgccgctatctggacgatccgcgccaggaggcatatgtgcgcgacgggtggaatctgcccggcgacacattcatggccgacgccgatggctactatttctatcaggcgcgctcggacgacatgatcatctcggccgggtacaacatcgccgggcccgaggtcgagggatcgctgatgcggcatgagtgggtggctgaatgcggggtggtcggcgcgccggacgcggagcgtggccaggtcgtgacggcgtacgtggtcctgcgtcccggcgtggagccctccgacgccacgcgggcggcgctacaagactatgtcaagcgcgagatcgccccgtacaagtatccgcgtcgcatcgagttcgtggcggcgctgccgcgtaccgagacgggcaagctgcagcgcttccgcctgcggcag

SEQ ID NO: 32162 - DNA, 1110 bp, Ralstonia metallidurans
gccatcctcgcgcttgcagacggcacggtctttcgtggctattccatcggcgcttccggccatacgatcggcgaagtggtgttcaacaccgctatcaccggttatcaggaaatcctcaccgacccgagctattcccggcagatcgtcacgctgacgtatccgcatatcggcaattacggcgtcaaccctgaggatgtagaagccacgaaagtccatgccgccggcctgatcatcaaagatctgccgattctggcctcgaacttccgcaaggaacatacccttgcccactacctgaagcaggaaaaggtcgtggcgatcgcgggcatcgacacccgcaagctgacccgtatcctgcgcgagaagggcgcccagaacggctgcatcctggctggcgaggacaatgtccagaaggccatcgacctggcgcgctcgttcccgggcctggcaggcatggacctggccaaggtcgtctccgtcaaggagccgtatgagtggacccagaccgagtggaagctcggcgaaggctacggcaagcaggacaagccgcagttccacgtggtcgctttcgacttcggcgtcaagttcaacatcctccgcatgctggccgaacgcggctgcaaggtgaccgtgctgccggcgcaagccagtgcggccgacgccctggcgctgaatccggacggtatcttcctgtcgaacggccctggcgacccggagccgtgcgactacgcgatcgccgccacgcgtgagttcattgctcgcggtatcccgaccttcggcatctgcctgggccaccagatcatggccctggccgtcggtgccaagacgctcaagatgagcacgggccaccatggcgccaaccatccggtcaaggaccatgatgatggtcgtgtggtgattacgtcgcagaaccacggcttcgcagtcgatgcatcgacgctgccggccaacgcccgcgtcacgcacacgtctctgttcgacggcacgctgcaaggctttgcgctgacggacaagccggccttctgcttccagggtcacccggaagcgtcgccgggcccgcacgacatcgcgtacctgttcgaccgcttcaccaagctgatgcaggacgcccgc

SEQ ID NO: 32163 - DNA, 2150 bp, Ralstonia metallidurans
atgccaaagcgcacagatatcaagagcatcctaatcatcggcgcgggcccgatcatcatcggtcaggcgtgcgaattcgactactccggcgcgcaggcctgcaaggcgctgcgtgaagagggcttcaaggtcatcctggtcaactcgaacccggcgaccatcatgacggacccgaacacggccgacgtgacctacatcgaacccatcacctgggaagtggtcgagcgcatcatcgagaaggagcgcccggacgcgatcctgccgaccatgggtggccagaccgcgctgaactgcgcgctggacctgcaccgccatggcgtgctggacaagtacaaggtcgagctgatcggcgcgtcgccggaagccatcgacaaggccgaggaccgccagaagttcaaggacgcgatgaccaagatcggtctcggttcggccaagtctggcatcgcccactcgatggacgaggccgtggccgtgcaatcgcgcatcgcccaggaaaccggcaccgccggctacccgatcgtgatccgcccgtcattcacgctgggcggcaccggtggcggtatcgcctacaaccgcgaagagttcgaggaaatctgcaagcgtggcctggacctgtcgccgacgcgcgagctgctgatcgaagaatccctgctgggctggaaggaatacgagatggaagttgttcgcgacaaggcggacaactgcatcatcatctgctcgatcgaaaacctggacccgatgggcatccacaccggtgactcgatcacggtggccccggcccagacgctgaccgacaaggaataccagatcctgcgtaacgcctcgctggccgtgctgcgcgagatcggcgtggacaccggcggttcgaacgtgcagttctcgatcaatccgacggatggccggatgatcgtgatcgagatgaacccgcgcgtgtcgcgttcgtcggccctggcctcgaaggccaccggcttcccgattgcgaaggttgccgccaagctggccgtcggctacacgctcgacgaactcaagaacgaaatcaccggcggccagaccccggcctcgttcgaaccgtcgatcgactacgtggtcaccaaggtgccgcgtttcgcgttcgaaaaattcccggccgccgacagccacctgaccacccagatgaagtcggtgggcgaggtgatggccatgggccgtacgttccaggaatcgttccagaaggcactgcgtggtctggaagtgggcgtggacggcctggacgaaaagtcgaccgatcgcgacgaagtgatcgaggaaatcggcgaagccggcccggaccgcatctggtacgtgggcgacgcattccgcctcggcatgtcgctggaggaagtgcagagcgagaccgatatcgatccgtggttcctggcccagatcgaagacatcgtgaagaccgaaggcctggtgcgtaatcgcacgctggaaagcctgtcgaccgccgaactgcgtcacctgaagcagaagggcttctcggatcgccgcctggccaagctgctgaagaccgacgcgaaggccgtgcgtctggcgcgtgtggcgcagaatgtgcgcccggtctacaagcgcgtggacacctgcgcggccgagttcgccacgaacaccgcgtacatgtacggcacctacgaggccgagcatggcgagtgcgaggccgacccgaccagcaacaagaagatcatggtgctgggcggtggcccgaaccggatcggtcagggtatcgagttcgactactgctgcgtgcacgccgcgctggcgctgcgcgaagacgggtacgagaccatcatggtcaactgcaaccccgaaaccgtgtcgaccgactacgacacctctgaccgcctgtacttcgagccgctgacgctggaagacgtgctggaaatcgtcgacaaggaaaagccggttggcgtgatcgtccagtacggcggccagaccccgctgaagctggcgctggatctggaggccaacggcgtacccatcatcggtacgagcccggacatgatcgatgccgcggaagaccgcgagcgtttccagaagctgctgcaggacctgggcctgcgccagccgccgaaccgtaccgcgcgcgctgaagacgagcactgcgcctggcacgagaaatcggtaccggcttcatc

SEQ ID NO: 32164 - DNA, 2664 bp, Ralstonia metallidurans
acgacctgcccctactgcggcgtaggctgcggcgtgcgcgccaccgtgcgtgccgatggtctggtcgacattgccggcgatgccgatcatgcttccaacgccgggcggctctgcgtcaagggctctgcgctgggcgaaacgctcgacctgaacgggcggctgctgcatccgcaagtgcgcgatgccgatggctcgctgcgccgcgtggactgggacgaagccctcgacaaggtcgcccgtggcttcacggagatcatcgccaggcacggccccgacgccgttgcgctctacgtgtcgggccagcttctgaccgaggactactacgtcgccaacaagctgatgaagggcttcatcggcacggcgaacatcgacaccaactcgcgcctgtgcatgtcgtcggcggtcgctggccacaaacgcgcgtttggcgaggaccttgtcccgtgcagctacgaggacctcgaactggccgatctcgtaatcctggtgggctccaataccgcgtggtgccacccgatcctgttccagcgcctgacccgcgccaaggaagcgcgccccgagatgaaaatcgtcgcgatcgacccgcgtcgaaccgccacctgcgaactggcggacctgcacctgccgctgcgcgccggtaccgatgtgcggctgttcaatgggttgttgagctacctcgcgcgtcacggtcatggcgatgacgtcttcgtggcggaccataccgctggccttaacgatgcgctggccgtggccgacgccgacggtgccgatatcgccgccgtggcacgcgcgtgcaagcttgctccgcaggatgtgcaggcgttctacgaactgttcgccgccacgacgaaggtcgtcaccgcgttctcgatgggcgtgaaccaatcgtcggccggcacggacaaggtcaacagcatcatcaattgccacctgctgaccggccggatcggccgtcccggcatggggcccttctcgctcacgggccagcccaacgccatgggcggacgcgaagtcggcggactggcgaatatgctcgcggctcacatggaactgggcgacccgcgccatcgcgacatcgtgcaggacttctggcactcgccagccatggcggacaaacccggcctgaaggcggtggacctgttccaggccatcgaacaaggcaaggtcaaggccgtgtgggtgatcgccaccaatccggtggtcagcctgccggatgccgatcaggcccggcgcgcgctggcccgctgcgaactcgtggtgacgtcggacatcgtcacccgcacggacaccaacgacgccgcgcatatcctgctgcccgcgctgggctggggcgagaaagacggcacggtcaccaactccgagcgccgcatctcgcgccagcgtgcgttcctgcccgctcccggcgaagcccgcgcggactgggacatcctctgcgacgtggcgcgccgcatgggattcgccggcttcgactacgccggccagcatgaaatcttcgacgagcacgcgcgtctcagcgcctggcgcaatggtgacgatagcggcgacgatgcggcgcacgcaccgcgcatgttcgacatcggcggcctcgccggcatggaccaggccgcgtacgacgccatgttgcccgtgcaatggccgctgcccgtcatggcttcgtcaggcaagcaacgcctgttcgagaatgcccgctttgccttcgccgatggccgggcacgcttcgtcgccacggcggcgcgcgcgcccgtccatgccaccgacgatgagttcccgctgatcctgaacaccggtcgcgtgcgcgatcaatggcacacaatgacccggacgggcaaagccgcccgcctgtcggaccacctgcccgagccatttgtcgacatgcatccgcaggacgcactgctctgtggtgtgggcgaaggcaagctcgcacgcgtgaccagccgttggggcatgatgatcggccgagtccgttttggcgggggcattccgcgcggcagcgtcttcgtgccaatccactggaacgaccagttcagctccgacgcgcgcgttggcgcggtggtcaatccggccgtcgatccagtgtcaggcgagcccgagttcaagcacacgcccgtgcgagtggaggaattccgcgtgtcgtggcacggcttcgtgctgagccgcaaggtgcttcccgctgacgcgctgacctggtggacccgcatccagggcaagcatttccatcgccacgagttcgcgggccgcgatgtcatcacggatcgtgccgcgtgggcacgtgagcgactgggagcgcaggcgcccgacgcggattggctcgaattcgaggatcgcgccgcgggcgtctatcacgctggctatatcgtcgatgaccggcttgaggcttgcgtctatctctcgacccgccccgacctgccgtcgcgcgcctggctatctcagcttttcggccaggcacgcctggaagacagcgatcgcatcggcctgctactgggccagccactcgaaaagacagccgatgcgggccccacggtctgctcgtgcttcggcgtgggccgcaacacgatctgcgacgcggtgcgccaacacgacctcaagacaccagcggagatcacggcttgcgtgaaggccggcggcaattgcggctcctgcgtgccggagttgcgcaagctgctg

SEQ ID NO: 32165 - DNA, 1212 bp, Ralstonia metallidurans
tacggcggcacttcgatgggttccacggaacgcatcaagaatgtcgccaagcgcgtggccaagtggcaccgcgccggtcaccgcgttgtcgtggtgccttcggccatgtcgggcgaaaccaatcgcctgctgggccttgccaaggaaatctccgcgcagccggacccgcgtgaactcgatatgctggcgtcgaccggcgagcaggccagcgtggccctgctggccatcgcgctgcacggcgaaggcatcgacgcggtcagctacacgggctggcaggtgccggtgaagacggactcgtcctataccaaggcccgcatcgaatcgatcgatgacgagcgcatcctgggtgacctcgacgccggcaaggtggtcgtggtcacgggtttccagggcatcgacggcgacggcaacatcacgacactgggtcgcggcggttcagatacctcggccgtggccattgccgcggcgattgaagccgacgagtgcctgatctataccgacgtggatggcgtgtacacgaccgatccgcgcgtggtcgaggacgcccgccgcctggaccaaatcaccttcgaggaaatgctggaaatggccagcctgggttcgaaggttctgcagatccgttcggtggagtttgccggcaaatatcgcgtgaagacgcgcgtgctgtcgtcgctgaccgaccccctgatgccgctcgaacaggaaatgcattcgggcacgctgattacttttgaggaagagtctgaaatggaagcagccgtcatctccggcatcgcctttgcccgtgacgaagccaagatcactgtccttggcgtgccggacaagccgggcatcgcctaccagatcctgggcccgatcgccgacgccaacatcgacgtcgacatgatcatccagaaccagtccgtggacggcaagaccgacttcacgttcaccgtgccgcgcggtgactaccagcgtgcgctgacgatcctgaacgacaacgtgaagggccatattggcgccgagagcgtgtcgggcgatccgaaggtgtcgaaggtctcggtggtgggcgtgggtatgcgctcgcacgtgggcatcgccagcaagatgttccgcacgctgtcggaagagggcatcaacatccagatgatctccacgtcggaaatcaagatctcggtgctgatcgacgagaagtacatggagctcgccgtgcgcgcgctgcacaaggtgttc

SEQ ID NO: 32166 - DNA, 669 bp, Ralstonia metallidurans
atggcatcggatcgggctcgggcggcattggcagcccgcctgcgcgccggcggcattcgcgacgagcgggtgcttggcgccattgccacggtgccgcgccacctgttcatggagccgggcctggcttcccaggcgtacgaagacgccgcgttgccgattggacatcagcaaaccatttcgaagccgtccgtggtggcgcgcatgattgagttgctgcgcgaagggatgccatccgatcacgcgctggcgcgcgtgctggagatcggcaccggctgcggttatcaggcggccgtgctgagtctggtggcgcaggaagtgttctccatagagcggattcgtccgctgcacgaacaagccaaggcgaacctgcggccgttacgcgtgccaaacatccggttgcattacggcgacgggatgcttggcctgccgcaggccgcgccgttttcgtcgatcatcctggccgccgctggcatggaggttccgcaggcgttgctggaacaactggccatcggcgggcggctgatcgccccggtggtcgcgcccagctctggcgcgcccgggcagaccgtgacgcagcagttgctgctgatcgagcgcctcaaccggcatcgttttcacagaactgcgcttgaagcggttttctttgtgcccttaaaatcgggcaccatc

SEQ ID NO: 32167 - DNA, 1086 bp, Ralstonia metallidurans
atcatgtctggcaataccctcggcctgcttttcacagttaccacgttcggcgaatcgcacgggcccgccatcggcgcggtagtggatggctgcccgccggggatgtcgctgaccgaagccgacatccagatcgacctggaccgccgcaagcccggcacgtcgcgccacgtgacacagcgccaggaagcggatcaggtggagatcctgtccggcgtattcgaaggtaagaccacgggcacgccgatctgcctgctgatccgcaacaccgaccagcgcagcaaggactacggcaacatcgtcgagacgttccgcccgggccatgccgactacacctactggcacaagtacggtatccgtgactatcgcggtggtggccgctcgtcggcgcgcctgaccgcacccgtggtggccgccgcggcaatcgcgaagaaatggctgaatgagcagtacggcaccgagattcgtggctacatgtcgcagctcggtgaggtcgaagtgccgttcaccgactggaaacacgtgccggagaacccgttcttcgcggcgaatgccgatatcgttcccgagttggaaacctacatggatgcgctgcgccgcgacggcgactccgtcggcgcgcgtatcgaagtggtggccagccatgtgccggtgggtctgggcgagccgctgttcgacaagctcgacgccgatatcgcgcacgcaatgatgggcatcaacgcggtcaagggcgtcgagatcggcgctggcttcgacagcgtgtcccagcgcggcaccgtgcatggcgacgaactgacgccggaggggttccgcacgaataactcgggtggcgtgctcggcgggatttccaccgggcaggacatcaaggtatcgctggcaatcaagccgacgtcgagcatccgtaccgcgcgcgaatcgatcgacaaggctggcagcccggccagcgtggaaacgttcggtcgccacgacccgtgcgtcggcatccgcgccacgccgatcgccgaagccatgcttgcgctggtgctgatggaccacgcattgcggcatcgcgcccaatgcggtgacgtccgcgtcgacaccccgcgcatc

SEQ ID NO: 32168 - DNA, 978 bp, Ralstonia metallidurans
ctctcgctcgcggaggtacgcgagctttcgctcaacgttctgcaaacgaacggctactccgaggcgcacagcaaggcgatcacggacgtgatcgtcgcgggccagcgcgacgagtgccagtctcatggcctgtatcgcttgctggtctgcgttcataccattcgcaacgggaaggtggatggccacgcggtgccggaagtcgtcgatcaggcgaaagcgatcgtccgggtcgatgcccgctttggtaactcgctgctggcgtttcagaccggcctgccgcatttcatccggaaagcccgggaatgcggtttggcggccatggccatcaatcgctgctttcacttctccgcgctctggcccgaagtggaatcgctggcgagcgaaggactggtcgcaatggccatgacgcccagccacgcgtgggtggcccctgccggcggaaccaaaccggtattcggaacgaatcccctggcgttcgcctggccgcgtccgggcagaacgccatttgtcttcgactttgcgaccagcgcgatcgccagaggcgatatcgagcttcatcgccggcaaggcaaggcgctgccggaggggtgggccatcgatgcggacgggaacccgacgaccgacccgctggcggccctgaaaggcgccatgctgacgttcggcgggcacaaggggtctgcgttgtccgcgatgatcgaactgatggccggcccgctgatcggcgacatgaccagcgccgaatccatggcgttcgatgcgagcgcgggggccacgccttgtcatggcgaactgctgctggcattcgatcccaccgtctttctgggcgatcgggccagcgagtaccttgagaaagccgagagcctgttcgaggcaatcacgagccagggcgcgcgcttgccgtcgcaacgccgctacgccgcgcgagccaggagcgatgaggcgggcgtgacggtgccacgggcgctgtacgaggatctg

SEQ ID NO: 32169 - DNA, 1566 bp, Ralstonia metallidurans
ctaatgtgcgtggaccgcctgtcggtcaccttcggggagggcgagcacgccacgcgcgcggtgcgcgaagtgagtttcgaccttcgggccggcgagcgctacgcgctggtcggcgaatcgggctcgggcaagaccgtgaccgcgctggcgatgcttcgactggtcgaggatgcgcactatcagggctcgatccgtttcgagggcgaagatctgctgcaggtgtccgatcgcgagatgcgccgcattcgcgggtcggaaatcgccatgatcttccaggagcccatgacggcgcttaacccgctctacacgattggtaaccagatcgtggagacgctggcgctgcacgaagggctggaccgccgggctgcccgcgatcgcgcgattgcgctgctcgagcgcaccggcatcaccgacgcgcccaaccgtttcaatagcttcccgcaccagttgtcgggtggccagcgtcagcgcgcgatgatcgccatggcgctcgcgtgccgccccaagctgttgctggccgacgagccgaccacagcgctggacgtgaccatccgggcccagatcctggatctgttgcgcgacctgcaggccgagttcggcatggcggtgatgctgatcacgcacgatctgaacatggtcagggcgttcgcccagcgcgtgggcgtgatggaaaagggcgtcctggtcgagacgggcgagaccgccgaggtcttctccaatccgcaccatccctacacacgcaagctgatcgacagtcggccccggcgcgaggtgttgccgctggtgccgctggccccggtgctgctggagaccgatgcgctgtgcgtcaactacatgaagaagcgtcctggcatggcgggctggttcctcaaggaagcattcccggctgtgaaggaggtgaacctgcagttgcgcgaaggggaaacggtcgggatcgtaggtgagtcgggctcaggcaagacgacgctggctcacgccgtgctcgcgctccagcgcaagagtagcggctcgatccagttcctgggccggagcttcgatacctgcacgggcaaggagcgcagcgcgttacgctcacggatgcaggtggtatttcaggacccgttcgggtcgctgtctccccggatgacgatcgagcagatcgtggaggaggggctcgcgctgcaccagccgggcctgtcgcgcgaggcaacgcgtgagcgcgtgatcgaggcactgcgcgaagtggggctcgaccgcacggcgctggggcgctacccgcacgagttctcgggtggccagcggcaacgtatcgccattgcccgtgtgctgatcctgaaaccgcaggtgctggtgctggatgagccgacttctgcacttgacgtgtcgattcagcagcaggtgctggctctgctgtcacagctccagcacaagtacaacctcagctatctctttatcagtcacgacttggcggtgattcgcgccatggcgcaccgggtcgtggtgatgaagaacggcgaggtcgtggagtcgggcgagaccgaaacggtgctcggcgcaccgcaacattcgtatacacgcaagctgatg

SEQ ID NO: 32170 - DNA, 759 bp, Ralstonia metallidurans
atgggatttctggcaggtaagcggatcctgattaccggtttgctttcgaaccgttcgatcgcctacggcattgcagcagcgtgcaagcgtgaaggcgcggaactggcgttcacttatgtcggcgaacgattcaaggaccgcatcacggacttcgccaaggaattcggctccgacatgatctatgagtgcgacgtaggtagcgatgaacagatcgacgccacgtttgccgcactggggcagcgctgggaaaaattcgacggtctggtgcactcgatcggcttcgcgccgcgcgaagccatcgccggcaacttcctggacgggctgtcgcgtgaaggcttccggatcgcacacgatatctcggcctacagcttcccggcactggccaaggccgcgatgccgctgctcaatgacaaggcatcgctgctgacgctgacctacctgggcgccgagcgtgtggtaccgaactacaacacgatgggcctggccaaggcttcgctcgaagccagcgtgcgctacctggcgtcggcggtcggcccgcgcgggatgcgtgccaacggcatttcggccggtccgatcaagaccctggccgcctcgggcatcaaggacttcagccgcctgctcaagcatttcgaagacgtggcaccgatccgtcgcaacgtgacgatcgaagaagtcggcaacgtcgcggccttcctgctgtcggatctggccagcggcgtgaccggcgagatcacgtatgtcgacggcggctacaacatc

SEQ ID NO: 32171 - DNA, 1755 bp, Ralstonia metallidurans
ttgccgcgtcgcaaatttgacgtggtcatcgtcggggcgggcggcgccgggatgcgcgcatccctccagctcgcggaagccggcctgaacgtggccgtgctgtcgaaggttttcccgacgcgctcgcacaccgtggcggcgcagggcggtatcggtgcttcgcttggcaacatgagcgaagacaactggcactatcacttctacgacaccatcaagggctcggactggctgggcgaccaggacgccatcgagttcatgtgtcgtgaagcaccgaaggtcgtgtacgaactcgaacacttcggcatgccgttcgaccgtaacgccgatggcacgatttaccagcgtccgttcggcggccacaccgccaactacggcgaaaagccggtgcaacgcgcttgcgcggccgctgaccgtaccggtcacgcgctgctgcacacgctgtaccagcgcaacgttcgcgccaagacccacttcttcgtcgaatggatggcgctggatctgatccgcgacgaggacggcgacgtgctgggcgtgaccgcgctggaaatggaaaccggcgaagtctatatcctcgaagccaagaccacgctgttcgcgaccggcggtgccggccgtatctacgcggcttccaccaatgccttcatcaacaccggtgatggcctgggcatggcggcacgtgccggcgtcccgctggaagacatggagttctggcagttccacccgaccggcgtggccggcgcgggcgtgctgatcacggaaggcgtgcgcggcgagggcggtatcctgcgtaacaaggatggcgagcgcttcatggagcgctatgccccgacgctgaaggatctggctccgcgtgacttcgtgtcgcgttcgatggaccaggaaatcaaggaaggccgcggctgcggtccgaatggcgactacgtgttgctcgacctgacgcacgtcggcgccgagacgatcatgaagcgtctgccgtcgatccgcgaaatcggcatgaagttcgccaacgtcgacgcgatcaaggaaccgatccccgtggtgccgaccatccactaccagatgggtggcattccgacgaacttccacggtcaggtcgtggtgccgaagaacggcaacccgaacgaagtggtcaacggcttctacgccatcggcgaatgctcgtgcgtgtcggtgcacggcgccaaccgtctgggcacgaactcgctgctcgacctcgtggtgttcggccgtgcggccggtaaccacatcgtcgccaacgcgatgaagcagaaggaacacaagccgctgccggcagatgccgccgaccgcgccatggcccgtctggccaagctgcagggcacgacctcgggtgaatacacccaggacgtggccaacgatatccgccgcaacatgcaatcgcacgccggcgtgttccgtacgcagaagctgatggacgaaggcgtcgagcgcatcctggaagtggccgagcgcgccaacaacatccacctgaaggacaagtcgaaggtctttaacaccgcgctggtggaagccctggaagtgtcgaacctggtggaagtggccaaggcaacgatgatctcggccgcagcccgcaaggaatcgcgtggcgcccacgcccatagcgacttcccgaatcgcgacgacgagaactggctcaagcacacgctgttctacagcgaaggcaaccgcctcgactacaagccggtgaagatgcaaccgctgacggtggaatcagttccgccgaaggcccgtacgttc

SEQ ID NO: 32172 - DNA, 696 bp, Ralstonia metallidurans
aagcgtattttcgaagtctaccgctacgatccggacaaggacgccgcgccccgcatgcagacctacgaggtggaactcgacggtcacgagcgcatgctgctggatgcgctggtcaagctgaagaagctcgatgagacgatctcgttccgtcgctcgtgccgtgaaggcgtgtgcggctcggacgcgatgaacatcaacggcaagaacggcctggcctgcctgacgaacatgcgcgaactgccggaccgcatcgtgctgcgtccgctgcccggcctgcccgtggtgcgcgacctgatcgtcgacatgacgaacttcttcaagcagtacaactcgatcaagccgttcctgatcaacgacgagccgccgcccgagaaggagcgtctgcaatcgccgcaggaacgtgacgagctggacggcctgtacgagtgcatcttgtgcgcaagctgctcgacgtcgtgcccgtcgttctggtggaacccggacaagttcgttggcccggccggtctgctgcaggcctaccgctttatcgcggacagccgtgaccaggccaccagcgagcgtctggacaacctgaacgacccgtaccgtctgttccgttgccatagcatcatgaactgcgtcgatgtgtgcccgaagggcctcaacccgacgaaggcgattggcaagatcaaggaattgatggttcgccgcgctgtt

SEQ ID NO: 32173 - DNA, 1257 bp, Ralstonia metallidurans
ggttcccccagcgttgagctgccgatctacaagggcaccgttggcccggatgtgatcgacattcgcaagctgtacggacaaaccggcaagttcacctatgacccggggttcatgtcgaccgcttcgtgcaactccaagatcacctacattgacggtgacaagggcgaactgctgtaccgtggctacccgatcgagcaactggcacagaagtgcgatcacctcgagacctgctacctgctgctgaagggcgagctgccgaacgccaagcagaaggaagagttcgtgaactcggtgatgaaccacacgatggtccacgagcagctccagttcttcctgcgcggcttccgccgtgacgcgcacccgatggccgtcctgacgggcctggttggcgcgatgagcgcgttctaccacgacgcgatggacatcgatgatccgcatcagcgcgagatctcggccatccgcctgatcgccaagatgccgaccctggttgccatggcgtacaagtacaccatgggtcagccgtacatctacccgcagaacgacctgtcctactcgggcaacttcatgcgcatgatgttcgccacgccgtgcgccccgtacaccgtgaacccggtgctcgagcgcgcgctggaccgcatcttcatcctgcacgccgaccacgagcagaacgcgtcgacctcgaccgtgcgtctggccggttcgtcgggcacgaacccgttcgcagccatcgccgctggcgtggcctgcctgtggggtccggctcacggcggcgcgaacgaagccgcgctgaagatgctggaagaaatcggcagcgtcgacaacattggcgagttcatcaagcaggtcaaggacaagaactcgggcgtgcgcctgatgggctttggccaccgcgtgtacaagaactacgacccgcgcgccaagctgatgcgcgagacctgctatgaagtgctgaacgaactgggcctgcacaacgacccgctgttcaagctggccatggagctcgagaagatcgcgctggaagacgagtacttcgtcagccgcaagctgtacccgaacgtggacttctactcgggtatcgtgcagcgcgcgctgggcatcccgacctcgctgttcacctgcatcttcgccctggcacgcacgccgggctggatctcgcagtgggaagagatgatcaccgatccggaatacaagatcggtcgtccgcgccagctgttcaacggcgccgccgcacgcgaagtgccggatctggccaagcgc

SEQ ID NO: 32174 - DNA, 1780 bp, Ralstonia metallidurans
gtgggtatcgaccttggcaccaccaactcgctggtggccgccgtgcgcaacagcattcccgaagtcctgcccgacgagcacggccgcgcgctgctgccgtccgtggtgcgttatttgccgaatggcaacgcgcatatcggctacaaggcccaggacgaggccgtgcgcgaccccaagaacacgatcatttcggtcaagcgcttcatgggccgtggcgtgcgcgacgtggccaatatcgagcacagcctgtacgactttgtcgatgcgccgggcatggtccagctgaagaccgccgccggcatcaagagcccggtggaagtctcggccgagatcctggccacgctgcgccaacgcgcggaagactcgcttggtgatgaactggtcggtgccgtgatcactgtgccggcgtacttcgacgatgcgcagcgtcaagccaccaaggatgccgctcaactggcgggcctcgaggtgctgcgcctgctcaacgagccgaccgccgccgcgattgcctacggtctcgacaacgccgcggaaggcatctacgccgtatatgacctgggcggcggcacctttgacatctcggtgctcaagctgaccaagggtgtgttcgaagtgatgtcgacgggcggagattcggcgctcggtggcgacgacttcgaccagcgcctgctgtgctggatcgtcgagcaggtcggtctgcaacccttgtctgccgaagactcgcgtctgctgatggtgcgcgcccgcgcggcgaaggaagcgctgtcgtccagtgacagcacggtgattgacgccgtgctgacgagcggcgagatcgtgcatctcacgctggatgccgataccttcatacagatcaccgccaatctggtgcagaagacgctgacgccggtacgcaaggcgctgcgtgacgccggtgtcggtcccgaggacgtgaagggcgtggtcctggtgggcggcgccacgagaatgccggcaatccgcaagggcggtgggtgactacttcggtcagcagccgctgaccaacctcgatccggaccgggttgtggcgctgggcgcggccatgcaggccaacctgctggccggcaaccatgcgccgggcgaggattggctgctgctcgacgtgatcccgctctcgctgggcgtggaaacgatgggtgggctggtcgagaagatcgtcccgcgcaacagcacgattcccgtggcgcgcgcgcaggagttcaccacgttcaaggacggccagaccgcaatggcgattcacgtgctgcaaggcgagcgcgagctggccagcgactgccgttcgctggcgcgcttcgaactgcgcggcattccgccgatggtggccggcgcggcgcgtatccgcgtgacctaccaggtggatgctgacggcctgctgtcagtgtcggcccgcgagaccggttccggggtggaagcatcggtgtcggtcaagccttcgtatggcctggccgatgacgatatcgcccgcatgttgcaggagagcttccaggaagccgagcacgacatgaagaaccgcgcgctggccgaggaacgcgtggaagccgcgcgtctggtggaagccaccacgcgtgcgctcgaaaccgacggcaacctgctgtccgccgacgagcgtgccgcagtcgacgagttgatggccaatgtgagcgaaatcgccaagggcgaggaccatcgcgcgatcaaggcggcggtcgaacgcctctcgcaaggcaccgacgagtttgccgcacgccgcatggaccgctcgatcaagagcgcgctggccggc

SEQ ID NO: 32175 - DNA, 996 bp, Ralstonia metallidurans
taccccctgctgcgccccgccctgttttccatggatgcggaggacgcccaccatttcacgctcaataacctgatgcgcgccaagcgcatggggctggccggatgcatcggcaacagcatcgccgacgacccgcgcacggtcatgggcgttcgctttccgaatccagtcggcctggcggccggcctggataaggatggcgcctatatcgatggcctggcggcattcggcttcggcttcatcgaagtcggtacggtcacacctcgggcgcagccgggcaacccgcgcccgcgcatgttccgactgccgcaggccgacgcgctaatcaaccgcatgggcttcaacaacgggggcgtcgatgcattcatccgaaatgtccaggcatcccgctggaaggccgaaggcggtgtgctggggctcaatattggcaagaacgccgatacgccgatcgagcgcgcggcagacgattacctgtactgtcttgagcgcgtctatccgcacgcaagctatgtcacggtgaatatctcatcgcctaacacgaagaacctgcgccagctccagggtgccagcgaactcgatagcctgctgtccacactcaaggctgcccagcagcgcctggccgaccagcacaagcgctacgtgcccgtggcgctcaagatcgctcccgatctcgacgatgaccaggttcgcaacatcggcgatgcgctggtgcgccacaagattgacggcgtgatcgccacaaacacgacgatctcgcgcgacgccgtgaagggcctgcctcatgccgaggaagctggcggcctgtccggccggccggtgttcgaagcctccacgcgggtggtgcgcgcgttgcgtgaagtcattggcgacgcgctgccgatcatcggcgtgggcggcatcttcagcggcgccgatgcgcgcgccaagatcgacgccggcgcgcagctcgtgcaggtctacagcggcctgatctatcgcgggccgacgctggtgcgcgaa

SEQ ID NO: 32176 - DNA, 768 bp, Ralstonia metallidurans
tcgatcatgaccaccgacacgcagccgaaggcagcctcgcgcacggtgcagatcgacggcaagaccgtgacgctctccggcatcagcaagggcgccggcatgatccgcccgaacatggcgacgatgctcggctttatcgccaccgatgccgccgtggcgcagccggtgctgcagaagctggtgtcgcacgccgccgatcactcgttcaacagcatcacgatcgacggcgatacgtcgaccaacgactcgttcgtgctgatcgcctcaggcaaggccggcgtgacgatcgatcgtgccgagggtgccgcgttcgaggcgctgcgtgatgccgtgacggcgctggctcaggaactcgcgcaggcgatcgtgcgcgatggcgaaggcgccaccaagctgatgacgatccgtgtggaagggggcaagaatgtggccgagtgccgccagatcgcctacgccgtggcccattcgccgctggtgaaaacggcgttctatgcctcggaccccaacctcggccgtatcctcgccgctatcggctacgccggcgtcaacgacctcgacgtcgatcgcgtgaacctgtggctcgatgacgtgtgggtcgcgcgtgacggcggccgcaaccccgagtatcgcgaggaagacggccagcgcgtgatgaagcaggcggagatcacggtgcgcatcgcgctgggccgcggcgacgccgaagcgaccgtgtggacctgcgacctgtcgcatgactacgtgtcgatcaacgccgactatcgttcg

SEQ ID NO: 32177 - DNA, 2139 bp, Ralstonia metallidurans
atgaactccagcagccgacgcaatttcctgaagatggccggcagcagtgccgccgccaccgccgcgcttgccgcattcccgccggccatccgccgcgcgctggccattccggccaacaacgctaccaaatcgatccgcgacgtcgaatacgttgtgatcctgacgcaggagaatcgctcgttcgatcactacttcggcaccatgaacggcgtgcgcggcttcagcgaccgcttcccgattccactgccgggcggccgcaacgcattccagcagacctacgccagcaacaacatcaaccgcgtggttctgccgtatcacctggaccagaccgccggcaacgcccagcgcgtgagcggcacgcctcacagccagcccgacgcgcaggccgcgtgggacctcggccgcatgagcgcgtggcccaccgccaagaagacccagtcgatgggctactacaccgagcaggaactgggcttccagtacgcgctggccaatgccttcacgctgtgcgacgcctaccactgcggcttccacggtggcaccaatacgaaccggctgttccagtggaccggcaccaatgatccgtttggcaagaacggcggcccggtgatcgacaacagcggcgactcgctcgacgccaccggcgtcaactacacctggaccacctatccggaacgcctgcaggccgccggcgtgacctggaaggtctaccagaacatgccggacaacttcaccgacaatccgctggctggcttcaagcagtaccgcgcggccaacgcggcgctgggcaatgccgccaacggctcgccgtacacgccgtatacgccggccaacgacacggtgaacccgctcttcaagggcatcggcaacaccatgcccgatggcggcttcctgcaggcactgcgcgatgacatcgccgccggcacgctgccgcaggtatcgtggatcgtcgcacctgcgacatactcggaacacccggggccgtcgagcccggtgcagggcgcgtggtacacgcagcagttgctcgacgcgctgacggccaaccccgcgatctggagccgcacggtcctgctgatcaacttcgacgagaacgacggcttcttcgaccacgtgccgccgccgtgcgcccccgcgctcgacgctacgggcaaccccgtcggctacacgacgatggatgcatcgaccgagtactacagcgtcgacaagacgccgtttggtcccggcccgcgcgtgccgatgtacgttgtgtcgccgtggagccgaggtggctgggtcaactcgcaggccttcgatcacacctcgatcctgcgtttcatcgagcagcgcttcggcgtggcggaaaccaacatcagtgcctaccgccgcgcgatcatgggcgatctgatgtcggcgttcgacttcatcaacccgaacagcaacacggccctggccttcacgccgttgcagaagacggacgccgacacgctgcgcgccgcgcaggatgccaaggcgcagattcctgcgccgacggttgccgcccagtcgatgcccacccagaagaacggcacacgcccgtcgcgcgcgctgccctacacgctgcataccagcggcttcgaggacccgtccacgaacacggtctggctgcgtttcaagaacgacggcacccaggccgcggtattccacgtgtacgaccgcctgcatctgggcgatgtgccgcgccgctatgcgatcgaggcgggcaagtcctacgacgcgaagctcgacgtgagccgcgacagtggccgctacgacctctgggtgcttggcccgaatggctatcaccgcgcgttcgtcggcgatatcagcgcgcagaaggctgccggcggcggtgccgcgcccgagatccgtgtgtgctacgacgaggccaacgcccaggtctggctcacgctgatcaaccgcggcagcgcgacgtgcacgttcacggtcaagccgaacgcctatcggaacgacggcccctggacgttcgaggtcccggccggcaaggaggtcgaccagcactggcccgtggggtcgcaaggcaactggtacgacttcacggtcaccacacagcagggtggtttcatgcgccgcttcgccggccggctggagaacggcacgcatacggtctccgacccggccatgggc

SEQ ID NO: 32178 - DNA, 1268 bp, Ralstonia metallidurans
ggtgtcggcaagtttcagtatcgcctcttcgtcatcttcggcctggtctggctcgccgatgccatgcaggtgctgtcgatcggcttcagcgcgccgtccatcgcgaagacgtttggcatcacgatgccccaggcgctacagaccggcacgctcttcttcgtcgggatgctggtaggcgcgattgtcttcggccgcctggccgaccgcattggccgccgccccgtgctgatgatcgccatcgtcatcgacgcgctctccggcatcgcatcggccttcgcgccagaactgtcctggctgctcgtgttgcgcttcctgacgggcgtcggtgtcggcggcacgctgccggttgactacaccatgatggccgaattcctgcccagcgaccgtcgcggccgctggctggtcctgctcgaatcgttctgggcgatcggcacgatctgcttggcggtactggcgctcgtggcgctgtcccatggcgatcaggcctggcgcgtcattttcctggtcacaggcattcccgcgctgattggcgttgtcctgcgcttctacattccggaatcgccgatgtacctgaaccgtagcgggcgatcggacgaggcccgcaaggtactgcaacgggtggcgaaaacaaacggccgaaacgtcgaaatcccggccctgcaatccgacatcgtcgcgccgaaatcggtcttgacgctgttctccggaacgttccgccgccgcagcttcgcgctgtttgccgcgtgggcgctgatctcgatcgcgtactacggtgtgttcgtctacctgccaatcaagctcggcgcggagggcttcgccttcatgcgcgggcaggtcttcctggtcgtcctcgccatcgtccagctccccggcttcgctttgtcagcgtacggcgtcgagcgctggggccgcaaacccacgctgatcggattcctgctgctcagcgcggtcggctgcatgctgtatagcctcggcacgtctcccacggtcgtcgtcggctccacgttgctgatgagcttcgcgctgctgggtacctggggcgcgctgtatgcgttcacaccagaggtctacccgaccgacctgagagccactggaatgggcgcggccggcgcggtggcgcgtttcggcggcctgttcgcacccgcgatcatcgcgccagtgatggccacgcatttcacctggccctcgcgttgatctccagcatgttgctggccggcgccttcgccatcggcatggtcaacgtggaatcgaaggaccgcgcactcgat

SEQ ID NO: 32179 - DNA, 585 bp, Ralstonia metallidurans
catggcgagacggcctggaaccgcgaacggcggctgcagggccagctcgacatcccactgaatgacacgggccgcgcccaggcgcgcgcgctggccgaggcgctggccggcgagccgatcgacgcggtctattcgagtgacctgggccgtgccatgcagacggcggcgccgttggccgagacgctgggtttgcaagtgcggcccgagcgtcgactgcgggagcgttgctatggcgatctggaggggatgacctacgctgaagtggcggagaagcgccctgaggatttcgcgcgctggcaggcgcgcgtgcccgactacgcgccgcccgagggcgaatcgctgcgcgagtttcacgatcgggcggtcgaggtggcgctgtatctgtcgcggcgccatcctggcgagcggatcgcgctggtggcacacggaggcgtcctcgactgcctctaccgcgaggctgccggcatgaccctcgaagcgccgcgcgagcacgaactgctcaatgccagcgtcaaccgcctgcggtgcgacaccgcccacctcacgctgctgcagtgggccgacgtcagccacctcgaggcgctg

SEQ ID NO: 32180 - DNA, 1599 bp, Ralstonia metallidurans
gccacgatgcaccgcatcgcggtctacacggagcacgaggacggccgacgcgcctcgcatacctatgcgcatatccaggccgaggcgaaccgtctttcgcgcgccctgcgcgaactcggcgtgcagcgtggcgaccgcgtggccatcgtcatgccccagcgcatcgagaccgtgatcgccggcatggccgtctaccagctcggcgcggtagccatgccgctgtcgatgctgttcggcccagaggccctgtcctatcggatcgaccacagcgagacccgcgtggccatcgccgacgagacctcgatcgacaacatgctcgccgcccgccccgactgcccgacgctgcggacagtcatcggcgtgggtgacgcaaccgggcgcggcgatctggactgggacacgctgctggccgcgcagatccccgagttcaccgccgagcagaccaaggccgaggaagccgcggtgctgatctacaccagcggcaccaccggccccccgaaaggcgcggtcatcccgcatcgcgcactgatcggcaatttgaccggcttcgtgtgttcgcagaactggtatccgcaggacgacgacgtgttctggagcccggcggactgggcctggacaggtggcttgtgggatgcgctgatgccggcgctctacttcggccgtccgatcgtcggatatcaggggcgattttctgcggagcgcgcgtttgaactgctcgagcgctacggtgtcaccaacacgttcctgttcccgaccgcgctcaagcagatgatgaaggcctgcccgaccccgtcggaccactaccagctcaagctgcgggccatcatgagcgccggcgaggccgtcggcgaaacggttttcacctggtgccgcgatgcgctgggcgtgatcgtcaacgagatgttcggccagaccgaaatcaactacatcgtcggcaactgcaccgcgcagtacgacgaaagccgccttggctggcctgcgcgacctgggtcgatgggacgcccctaccccggccatcgcgtggccgtgatcgacgaggacggccgcccctgcccgccgggcgaggatggcgaagtcgcagtctgcgcgaccgatatccacggccatcccgatccggtgttcttcctgggctactggaagaacgaagcggccaccgcggccaagtattcggaatatgacggcctgcgctggtgtcgcaccggtgacctcgcgcgaatcgacgcggatggctacctctggtaccagggccgcgcggacgacgtgttcaagtcatccggctaccgcatcgggccgagcgagatcgagaactgcctgctcaagcatccggcggtgtcgaactgcgccgtggtgccgtcgccggaccccgagcgcggctcgatcgtcaaggcgttcatcgtgctgacgccgtcggtgacgcgttccttcgataacgatgcggcgctgatcgccgaactccagcagcatgtgcgaggccagcttgcgccgtacgagtacccgaaagcgatcgaattcatcgaccagttgccgatgaccactaccggcaagatccaacgccgcgtgttgcggctgcaggaacaggagcgcgccgaaaagccagcc

SEQ ID NO: 32181 - DNA, 1287 bp, Ralstonia metallidurans
atgagtgcaatcgtagatatcatcggtcgcgaggttctcgactcgcgcggcaatcccaccgtcgagtgcgacgtgctgctggagtcgggcgtgatgggccgtgctgccgtaccgtcgggtgcatcgaccggttcgcgcgaagccatcgaactgcgtgatggcgacaagtcgcgctacctgggcaagggcgtgctgaaggctgtcgagcacatcaacaccgagatctccgaagcgatcatgggcctggatgcctccgagcaggctttcctggaccgcacgctgatcgaactggacggcaccgagaacaagggccgcctgggcgccaacgccatgctggctgtgtcgatggccgtggccaaggcagccgccgaggaagccggcctgccgctgtaccgctacttcggcggttcgggcgcgatgcagatgccggtgccgatgatgaacatcgtcaacggtggcgcgcacgccaacaacagcctggacatccaggaattcatgatcatgcccgtgtcgcagaccagcttccgtgaagctctgcgttgcggcgccgaagtgttccacgcgctgaagaagatcctgtccgacaagggcatgtccaccgccgtgggcgacgagggcggcttcgccccgaacttctcgtcgaacgaggagtgcctgaacacggttgtgcaggccatcgaaaaggctggctacaaggctggcgaggacgtgctgctggcgctggactgcgccgccagcgagttctaccacgaagccgaaggcgtgtactcgctggaaggcgaaggcctgaagctgacgtcgacccagttcgccgactacctggccaacctgtgcgacaagttcccgatcgtgtcgatcgaggacggcatggccgaaggcgactgggaaggctggaagacgctgaccgacaagctgggcaagcgcgtccaactggtgggtgacgacctgttcgtgaccaacacgaagatcctgaaggaaggcatcgagaagggcatcggcaactcgattctcatcaagatcaaccagatcggcacgctgaccgagacgttcgctgctatcgagatggccaagcgcgccggttacaccgccgtgatctcgcaccgttcgggtgagaccgaagacagcacgatcgccgatatcgccgtcggcacgaacgccggccagatcaagaccggttcgctgtcgcgctcggaccgcatctcgaagtacaaccagctgctgcgtatcgaggaagacctgggcgacatcgccacgtacccgggcaagagcacgttctacaacctgcgc

SEQ ID NO: 32182 - DNA, 1172 bp, Ralstonia metallidurans
cacgaaacgatgagcttccaggcggaagtgaagcagctactgcacctgatgatccactcgctgtacagcaacaaggagatcttcctgcgcgagctggtatcgaatgcttccgacgccaccgacaagctgcgcttcgaggcgatcgcgaatcccgcgttgctcgagaacgatgccgacctggcgatccggatcgaagccgatcccgccgcccgcaccctgaagatcaccgacaacggcatcggcatgagccgtgacgaggcgatccgcaatctcggcaccatcgcgcggtcgggcaccaaggagttcttccagcagctttccggcgaccagcagaaggacgccgcgctgattggccagtttggcgtgggcttctactcggcattcatcgtggccgacaaggtcaccgtggaaacgcgtcgcgcgggtcttgccgccgacgaggccgtgcgctgggaaagcgccggcgacggcgagttcagcatcgatgcgatcaaccgtgccgagcgcggcagcacgatcacgctgcatctgcgcgagggcgaggacgatttcctgtcgtcgtaccgcctgcagaacatcatccgcaagtactcggaccacatttcgctgccgatccggatgcccaaggaggaatgggatgccgaggcgcagcagcagaaggtcacgggcgagtgggaaagcgtgaaccaggccagcgcgctctggactcgcagcaagtcggatatcacggacgagcaataccaggcgttctatcagcacatcgcgcacgatcacgaggcgccgctggcctggacccacaatcgcgtggaaggccgcagcgagtacacgcagctgctgtacatcccggcgcgcgcgccgttcgacctgtgggaccgtaatcacaaggccggcctgaagctgtacgtgaagcgcgtgttcatcatggatgacgcggaccagctcctgccggcgtacctacgctgggtcaagggcgtggtcgattcggcggacctgccgctgaacgtgtcgcgtgaactgctgcaggagagccgcgatgtgaaggcgatccgcgagggctgcgccaagcgcgtgctgtcgatgctggaagcgatggccgatagcgaagacgaagccgaacgcgccaagtacaagacttctgggaacagctcggtcaggtgctcacggaaggcgtg

SEQ ID NO: 32183 - DNA, 642 bp, Ralstonia metallidurans
aacatgcttcgcatctggggcaggctgtcgtcaatcaatgtccagaaggtggtctggtgcgcgcgcgagctgcatctggaccacgagcgcatcgacatcggcaatcagaagggcgagctcgataccgaggcgtacgtgcgtctcaacccgaaccgcctgattccggtgatcgaggatttccgcgacaccgacgtggccggcgagccgttcgtgctgtgggagtcgaacgcgatcgtgcgctacctgtgcgcgcgctatggcgaggacacgctgtggccttcggacgtcaaggcgcgcgcctcggcagaccgctggatggactggcagaccacgacgttcagcccggcgatggtccaggcgttcctgcaactggttcgtacaccggcggacaagcgtgacgaggccgtcatcgagaaatcgtgcgagcgcaccgagccgctggcgaagatgctcgacgacgcgctggaaggccgcgagttcatcggtggcgatcgcttcacgatggccgacgtctcgctggcctgcgcggcgcaccgctggatgggcatgccaaaggcccacacggcccggcctaacctcgagcgctggctcgcggccatgcgggcgcgtccggcggccactggcatcctcgaactgccgctg

SEQ ID NO: 32184 - DNA, 2163 bp, Ralstonia metallidurans
gcaaagtgcccttttctacatcccgccggcgctggccgggcgctccaggaatggtggcccgagcgcctgaatctgcatatcctgcgccagaacgctccgttgtccgatccgatgggagaggctttcgattatgcgaaggcgtttaacagtctcgacctcgcggcggtcaagaaggatctggaagcgctgatgaccgattcgcagtcctggtggccggcggatttcgggcactacggcccgttgttcgtccggatggcctggcacgcggcaggtacctaccgcatcggcgatgggcgtggcggtgccggcgctggccagcagcgtttcgcgcccaccaacagctggccggacaacgtcagtctggacaaggcacgcaggctcatctggccgatcaagcagaaatacggccgcaagatctcgtgggccgacctgatcgttctgacgggcaatgttgccctggagtcgatggggttcaagaccttcggattcggcggaggacgcgaggatgtctatgagccggacgagtccgtctactggggcaatgaagccgagtggctggcggacaagcgttacagcggtaaccggaacctcgagaatccgctggctgcggtgcagatgggcctgatctatgtaaatccggaaggccccaatggcaacccggacccggttgccgccgccatcgacatccgcgagacgttccgccgcatggccatgaacgacgaagaaaccgtcgcgctgatcgcgggcggtcatgccttcggcaagacgcatggcgccggccccgcatcgcacgtggggcccgagcctgaagccgcgggcctcgaggagcagggccttggctggcgcagcagctttggcaccggcaagggcggtgatgccatcggcagtggcctggaggtcatctggaccaccacgccgacgaagtggagcaacgacttcttcaagcacctgttcgagtacgaatgggaattgacgaagagccccgcgggcgcacatcaatggaagccaaagggcaatgccggcgccggcaccgtgcccgaccctgccgacccgtcgaagcgccgttcgccctcgatgctgacgaccgatctgtcgctgcgcttcgattcgatctacggcaagatttcgcgccggtactacgatcatcccgatgagctggccgacgcattcgcacgggcgtggttcaagctgacccatcgcgacatggggccgcgcgcgcgctaccttggcccggaagtcccgaaggaggaactcctgtggcaagaccccatcccgccggttgatcatccgctgatcgacgcgaaggatgtcgccgcgctcaaggccaaggtgcaggcttcggggctgaccgtgccgcaactggtttcgacggcgtgggcgtcggcttcgacgttccgtggctcggacaagcgcggtggcgccaacggcgcgcgcatccgcctggccccgcagaaggactgggacgtcaatcagcctgccgaactggcgaaggtgctggtcaagctggagagcatccagagcgagttcaacaaggcgcagagcggtggcaagaaggtctcgatggctgacctgatcgtgctggccggatgcgcgggcgtcgagcaggcggcaaagagcgccgggcaggatgtgacggtgccgttctcgccgggacgcatggacactacgcaggagaaaacggacctggatgcgatggtggtgctggaacccatcgcagatggtttccgcaactacctgcagggcaagttctcggtccgggccgaggccttgctggtggacaaggcgcaactgctgaagctgaccgtgccggagatgacggcgcttgtcggtggactgcgggtgctgggcgccaacttcggcaactcgcagcacggcgtcttcacgaaacgccctggcacgctgaccaacgacttcttcgtgaacctgctcgacatgggcacggagtggaagccagtgtcggaggaaagagaggtgttcgagggcagcgaccgggcgacgggcacgccaagatggaccggcacgcgcgtcgatctggtcttcggctcgaactccgagctgcgggcggttgccgaggtctatggtgcggcggacgcgcaggagaagttcgtgcaggacttcgtggcggcgtggagcaaggtgatgaacctggaccgcttcgatctc

SEQ ID NO: 32185 - DNA, 678 bp, Ralstonia metallidurans
ctcggcacggccctggttaccggcgcatcctcgggcatcggcgccatctacgcagaccgtctggcacgccgcggctatgacctgatcctcgtcgcccgcaatcgcgacaagctcgacaccctggcccggcgcatcactgacgatacgcagcgcgtggtcgaagtcttcccggctgatctcaacgaccgccaatcgctcgcacgggtggaggaaaagctgcggcaggacgccagcatcacgctgctggtcaacaacgcaggcgtcggcacgcacacgccactgctcgacagcgatgtcgatgccatgaaccggatgatcgacctcaacgtcaccgcgctgacgcgcctgacctatgccgccgtgccgggattcgtcgcgcgcggccgtggcgcgatcatcaatatttcgtcgatcgtcggcatcgcgcccgaaatcctgaacggggtgtacggcggcagcaaggcgttcgtgctggcattcagccagtcgctgcatcacgaactcgcggccaaggggctgcgcgtgcaggcggtactgccgggggcgaccgccacggacttctgggaaaccggtggcctgccgatcgaacatctcgacaaggcgatcgtcatgccggctgaagcgatggtcgatgcggcgctggtaggcttcgatcgtggcgagctggtgacgattcca

SEQ ID NO: 32186 - DNA, 1413 bp, Ralstonia metallidurans
tttgtcgccaaccgcctgatcgccccggactccggcctgcgcatcaaggtgttcgacccgtccagcggccaacccttcgccgagatcgcccgcggcaacgccacggacatcaacgtggccgtccacgcggcccgccgggcgttcgacggcgcctggggcgcgatgtcccccgccgatcgcgtgcgtctgctgaaccgcgtggcgctcaccttgatcgagcatgaggacgaactggccgcgctggaagcacgcgacaccggcaagccgctgcgccaggcccgtgccgacgcacgggcggtggcacgctacttcgagttctacgcgggcgccgcggacaagctgcatggtcagacgatcccctatcaggccggctataccgtcctgaccgtgcgcgaaccgcatggcgtaaccggccacatcatcccgtggaactacccgctgcagatcttcggccgcagcgtgggcgcggccctggccgccggcaacgcgtgcgtggtcaagccggccgaggatgcctgcctgtcgctgctgcgcgtggccgaactggccgccgaggccggcctgcccgaaggcgccctgaacatcgtcaccggttacggccacgaggcgggcgcggcactggcccgccaccccgacatcaaccatatttcgttcacgggatcgcccgaaaccggcaagctcgtatcccagctggcggccgaaaaccacgtgccggtgacactggaactcggcggcaagtcgccgcagatcgtctttgccgatgccgacctcgacgcgctgctgcccgtggtggtcaacggcatcgtgcagaatgcgggccagacctgctcggcgggcagccgcctgctggtggaacggccggtctacgaggagttgctcgaccgcgtcgccagcgtcttcgaatcgctgcgcgtgggcccctcggaactcgatctcgaatgcggcccgctgatcagccgcaagcagcagcagcgtgtctgggacttcgtctccgacgcgcagcacgccggcatctccgtgatggcgcagggccagatcgtggcggaggcgcctgaatccggctactaccaggtgccgatgctgttccgcgacgtgccggccacgcaccggctggcgcaggaggaagtcttcggcccgctgctggcggccatgccgttcgataccgaggacgaagcgctgcaactggccaacggcaccgcgtacggcctcgtggccggggtctggacgcgcgacggcggtcggcagttgcgcctggcgcgcaagctgcgggcgggccaggttttcatcaacaactatggcgccggcggcggcgtcgagctgccgttcggcggcaccggtcagtcaggctacggccgcgagaagggcttcgaggccctgtacggattcaccactctgaaaaccattgccattcaa

SEQ ID NO: 32187 - DNA, 750 bp, Ralstonia metallidurans
ctgtctggaaaggtagcggtagtcacgggtggtggttcgggctttggcgagggcatcgcgcacacgttcgcgcgcgaaggcgccagcgtgatggtggccgacctgaacctggaagccgccgaacgtgtggcggtggccatccgcgaggcaggcggccaggcgcgcgcggtgcgtgccgacgtgtcgcaaggcgatgacgtggccgcgatgcgcgatgcgacgctggccgcgttcggcgacgtccactgcgtggtcaacaacgccggcacgacccatcgcaacaagccgatcctggaagtcaccgaagccgagttcgatcgcgtctacgcggtcaacgtcaagagcatctactggtccgcgcatcacttcatcccgcatttccgcaagcgcggcggcggcaatttcgtcaacgtggcctccaccgccggcattcgcccccgccccgggctggtctggtacaacggcagcaagggcgcggtcatcgtcgccagcaaggccatggccgccgaacttggccccgacaatatccgcgtcaactgcgtcaaccccgtcattggcgccaccggcctgctcgaacagttcatgggcctgcctgacacccccgagaaccgcgcgaagttcctggccacgatcccgatgggtcgcatgtccacaccgcaggacgtggccaacgcctgcctgtacctggcatcagacgaagccgcgttcatcaccggcacctgcatcgaagtcgatggagggcgctgcgtc

SEQ ID NO: 32188 - DNA, 1251 bp, Ralstonia metallidurans
atgtccagcactacccagtcacaacacggattccgcaccgtgttccgcgttgtcagcggcaacttcctggaaatgtacgacttcatggtctatggcttttacgctgcagccatcgcccgtacgttctttccttcggataatgaattcgcatcgctgatgctctcgctggccacgttcggcgcgggcttcctgatgcgaccattgggcgccatcatcctgggcgcctatatcgatcaccacgggcgtcgcaaaggcctgatcctcacgctgatcctgatggcggccggcacgctgctcattgcggtagtgccagggtacgcggcgatcggcgtggccgcgccgctgctagtcctgttcggacgactgctgcagggcttctccgcaggcgtggaactgggcggtgtatcggtgtatctgtccgagatcgccaagcccggcaagaagggcttctacgtggcatggcaatcggccagccagcaggtagccgtgatcttcgcgggcctgctcggcgtgatcctgcacgccacactggcgccggcgcagatggatagctggggctggcgtgtgccgttcctgatcggctgcctgatcgtgccgttcctgttcatcatccgccgctcgctcgaggagaccgaggagttccgcacgcgcaagcatcgtccgagcgtgaacgagatctatcgttcgatgctcgacaactggggcatcatcatcgccggctgcatgatggtggtgatgaccacggtgtcgttctacatgatcaccgcctacacgccgaccttcggcaagaccgtgctgaagctcgacgacgtggacaacctgatcgtcacgatgtgcgtcggcctgtcgaactttatctggctgccgctgatgggcgcggtgtccgaccgcattggccgcaagccgctgctggtgttcttcacgatcgccacgctggtgaccgcctaccccgccgtttcgtggctggtggccgccccgtcgttcgaacgcctgctgatggtggagctgtggctctccttcctgtacggcagctataacggcgcaatggtcgtcacgctgaccgaagtcatgccgcccgccgtgcgcaccgccggcttctcgctggcatacagcctggccacggcactgttcggcggctttacgccagcgatctcgacctacctgatccacgccacgggcaacaaggccgcgccgggtctgtggctgatgttcgccgccgcatgcggtctggttgccacgatcatcatcttc

SEQ ID NO: 32189 - DNA, 618 bp, Ralstonia metallidurans
atgatcgacgcctacacctggcccacaccgaacggccataaagtccacatcatgcttgaggagtgcggcctcgagtacagggtccatccgatcaacatcggcgccggcgaccagttcggcgaggactttctcaagatcagcccgaacaacaagatcccggcgatcgtcgacaccgacggcccggacggccagccgatctcgctgttcgaatcgggtgcgatcctgctgtacctggcgggcaagaccggcaagttcctgcccgaggacgtgcgcggcaagtacgaggcgctgcagtggctgatgttccagatgggcggtgtcggcccgatgctgggtcaggcgcaccacttccgcatctacgcgccggagaagatcgagtacgccgtcaatcgctataccaacgaggccaagcgcctctacggcgtgatcgacaagcagttgtcgacgcacaagtatctggcaggcgacacctacaccgtggccgatatcgcaacgttcccgtggctgcgcagctggcagaaccagggcgtggaattggacgactatccgcacctgaagcgctggttcaacgacatcgcggaacgtccagcggtcaagcgcggcgtcgaggtcctggcc

SEQ ID NO: 32190 - DNA, 515 bp, Ralstonia metallidurans
atgacgacgcaaatcgaaaccgcaatcctcgccggcggctgcttctgggggatgcaggacctgctgcggcggtaccccggcgtgctgtcgacccgggtgggctacaccggcggcgacgtgccgaatgccacttatcgccaccacggcacacacgccgagggcatcgagatcgccttcgatccgagccagatcagctatcgccagatcctggagttcttcttccagatccacgacccaaccaccaagaatcgccagggcaacgatgtggggacgagctatcgctcggcgatcttttacctgaacgacgaacaaaagcagacggcggaagacaccgtggccgacgtgaatgcgtccggactatggcctggcaaggtcgtgactgaaatcgcaccggccggaccgttctgggatgccgagccggaacaccaggactacctggagcggtatccgaacggctatacctgccacttcatccggccgggctggaagctgccgaagcgaggttgaggcagggc

SEQ ID NO: 32191 - DNA, 2874 bp, Ralstonia metallidurans
gaccgtcgcagcttcctcaagcgttcgggcatcggcgtgggcgcggggctggccgccacgcaactgacgatgatgcgtcgcgccgatgccgacgacggcaagggcggcgcaggcggcaagggcgatattgtcgtgcgccgcactgtctgcggccattgctcggtgggttgcgcggtcgacgcggtggtgcagaacggcgtgtgggtgcggcaggagcctgtgttcgattcgccgatcaacctgggcgcgcattgcgccaagggcgccgcgctgcgcgagcatggtcacggcgaataccggctgaagtacccgatgaagctggtcaacggcaagtaccagcgcatctcctgggatcaggcgctcgacgagatcagcgcgaagctcaagcagatccgccaggaaaccggaccggattcgttgttcttcatcggctcgtccaagcacagcaacgagcagtcctacctgctgcgcaagtgggtctcgttcttcggcaccaacaataccgaccaccaggcgcgcatctgccactcgaccaccgtggccggcgtggcgaacacctggggctacggtgcgatgaccaattcgtacaacgacatgcagaacgccaaggcggcgctgtatatcggttcgaatgcggccgaggcgcatccggtgtcgatgctccacctgctccacgccaaggagagcggctgcaaggtgatcgtggtcgacccgcgctatacgcgcacggcggccaagtccgatcactacgtccgtatccgctcgggcaccgatatcgcgttcctgttcggcgtgctgtaccacatcttccagaacggctgggaagacaagaagtacctgtccgaccgcgtctacggcatggacaaggtcaaggaggaagtgctggccaagtggacgccggacaaggtcgaggaagtctgcggcgtgcccgaggccgaagtccggtacgtggccgagacgatggcgaagaaccgtccgtccacgctggtctggtgcatgggccagacgcagcacacgatcggcaacgccatcgtgcgtgcgtcgtgtatcgtgcaactggcgctcggcaacatcggtgtgtcgggcggcggcgccaacatcttccgtggtcacgacaacgtgcagggcgccaccgacgtggggccgaacccggattcgctgccgggctactacggcctggctgccggcgcgtggaagcacttcgcggcggtctggggcgtggactacgaatggatcaagaagcagttcgcctcgcaggcgatgatggagaagtccggcaccacggtgtcgcgctggatcgacatcgtcaccgagaagccggaactgatcgaccaggaccacaacgtgcgtggcgtgttcttctggggccatgcgccgaactcgcagacgcgcggcctggagatgaagcgcgcgctcgacaagctcgacctgctggtcgtgatcgacccgtatccgtcggccacggccgccatggccaacatgccggcgaccgaaggcgatacccccaacccgaaccgtgccgtgtacctgctgccggcctgcacccagttcgagacctcgggttcgtgcacggcgtcgaaccgttcgctgcaatggcgtgagaaggtgatcgagccgctgttcgagtcgatgcccgaccacgcgatcatgcaggcgttcgccgagaagctgggctttgccaacgaactgtcgaagaactacaagctggttgaggtcaagcgcgccgggcgcacgtggcgggagcccgagaccgaatcgatcctgcgcgagatcaacgccggcaactggaccatcggctacacgggccagtcacccgagcggctgaaggcccacatgcgcaacatgcacatgttcgatgtgcgctcgttgcgctgcaaggggggcaaggacccggtcaccggctatgacatcaccggtgattacttcggcctgccatggccgtgctacggcacgccggagctgaagcacccgggctcgcccaacctctacgacaccagcaggaacgtgatggacggcggcggcaatttccgcgccaacttcggtgtggagcgtgacggcgtgagcctgctggcggccgacggatcgcactcgctgggcgcggacatcactaccgggtatccggaattcgacgcggtgctgctcaagaagctcgggtggtgggacgaactgaccgacgccgaaaagaaggcggccgatggcaagaactggaagaccgacctgtcgggcggcatccagcgcgtggtgatgaagaaccacggctgccacccgttcggcaacgcccgcgcgcgggccgtggtctggaacttcccggacccgatcccgcaacaccgcgagccgctgtactcgacgcgcccggacatggtcgccaagtacccgacccacgacgacaagatggccttctggcgcctgcccacgctctacaagaccgtgcagcagcgcaacatcgagaacaaggtctacgagaaattcccgatcatcctgacctccggccgtctggtcgagtacgagggcggtggcgaggaaacgcgctcgaacccgtggctggccgaattgcagcaggagaacttcgtcgagatcaacccgaaggcggcatcggaacgcggcatccgcaacggtgactactgctgggtcaagacgccgaccggcgccaggatcaaggtgcgcgcgctggtgaccgagcgcgtgggcgtggatacggcgttcatcccgttccatttctctggctggtggcagggcaaggatctcaagccctactacccggagggcgccatgccgatcgtgcgcggggaggcggtgaacaccgccaccacctacggctatgactcggtgacgatgatgcaggaaaccaagaccaccgtttgccagatcgagcgg

SEQ ID NO: 32192 - DNA, 849 bp, Ralstonia metallidurans
ccgactccgctgatcaccgccaccgaactcgaccaactgcgcgccgccggcaagccgcgcgtagtcgtcttcgactgctcgttcgacctgaccaaccccgccgccggccgcgatagctatcaacaaggccatatccccggcgcgtattacctccacctcgacaacgaactctccggaccgaagacgggcctcagcggtcgccacccgctgcctgatgccgaactgttcgcagcgcgcctgcgcgtgctgggcgtcgatgacgatacgctggtcgtggcctatgacggacaaggcagcatgtatgccgcacggctctggtggatgctgcgctggatcggccatgccgcggcgctcgtgctcgatggcggacgcaatgcgtgggtggcggccgggttgccgctggagcatggcgcaacggccgagccggagatcggcggtaacctgatgcgccgtgcgtcgctggtgaagaccgtggatgccgacgcgctggtggcgaacctgagccagccttcgctgctggtcgtcgatgcccgcgccgcggaccgcttccgcggcgaaaacgaaacgctcgacccggtgggcggccatattcccggcgccgccaatcgtttcttcaaggacaacctgacggctgacggctacttcaagccggccgatcaattgcgcgccgacttcggacaggtgttcacgggcaaggccccggcgcagacggtgatgcagtgcggctcgggcgtcacggcctgccacaatcttctggcattggaagtcgccggcctgaccggcgcggcgctctatccgggctcatggagcgagtggtgcgctgacccgaagcggccagtcgccaccggc

SEQ ID NO: 32193 - DNA, 873 bp, Ralstonia metallidurans
agcgatttcgccacttggatgcgggcgcagggcgcccgcaccgaagccgctttggaagcggccctaccttccacggacacaattccatacaccctccatgaggcgatgcgctatgctgtgctcggcggtggcaagcgtgtgcgccccctgttagtgcacgctgcgggcgaggtggtcggtgcgacacccgaggcctgcgacgccgcagcatgcgccgtcgagatgattcacgcctattcgctggtccacgacgacatgccctgcatggacgacgacgatctgcgccgcggacgccccacggtccacaaggcctatgacgaggccacggccctgctggtcggtgacgcgctgcagagccaggcgtttatcgtgctggcccagaccccggctctggctgcggaagcgcgcctgaaagtggtggcggaactggccgtggcatcgggctcgataggcatgtgcggtggacaagccatcgacctccagaacgttggcaaggccatgacccgcgaggcgctcgaaggcatgcaccgcatgaagaccggcgccctgttgcgcgccagcgtgcgcatgggtgcgttgtgcggaaacatcgaccaggccggccttgtggcgcttgatcgatatgccgcggccgtgggattggcgttccaggtcgtggacgatattctcgacgtcactgccgacacggcaacgcttggcaagacggcgggcaaggatgccgcgaacgacaagccgacctacgtatcgctgcttggcctggatgccgcacgcgagctggctgcccagcttcgcaccgacgcccacgaggcgctggagggattcggcacacgcgctggccggctcgccgaactggccgacctgatcgtgctgcgc

SEQ ID NO: 32194 - DNA, 1854 bp, Ralstonia metallidurans
tacacgctgctcaataaaatcgacgaccccgcggacctgcgcaagctggaccgtcgccagctcgacacgctggccgaggaactccgcgcctacgtgctcgaatcggtctcgcaaaccggcgggcacctgtcgtccaacctcggcacggtggagctgacgatcgcgctgcactatgtcttcgacacaccgaacgatcgcgtggtctgggacgtgggtcaccagagctatccccacaagatcctgactggccgccgcgaccgcatgtcgacgctgcgccagtacggtggcatctccggcttcccgcgccgtgccgagagcgagtacgacactttcggtactgcgcattcgtcgacgtcgatttccgcggcgctgggcatggcgctcggtgcccgtacccggggcgagaagcgcgtgggtattgccgtgatcggcgatggcgcgatgaccgccggcatggctttcgaagccatgaacaatgcgggcgtctacaaggacctgccgatgctggtggtgctgaacgacaacgacatgtcgatctccccgccggtgggcatgttgaacaagcacctggcgcgcctgatgtcgggccagttctacgcggccaccaagaagggcatcgagaaggtgctgtcggtggcgccgccggtgctcgaattcgccaagcgcctggaagaacatgccaagggcatggtcgtgccggccacgctgttcgaagaattcggtttcgactacgtcggcccgatcgacggccacgacctcgagtcgctggtcccgacgctgcagaacatccgccagcgcgcgctggaaggccacggcccgcagttcctgcacgtggtgaccaagaagggccagggctacaagctggccgaggccgatccgatcctctaccacggcccgggcaagttcaatccggccgagggtatccgtccgtcggccaagccgtcgcgcaagacctacacgcaggtgtttggcgagtggctgtgcgacatggccgccgccgacaagcgtctgatcggcgtgacgccggccatgcgcgaaggctcgggcatggtcgagttcgaaaagcgcttcccggaccgctactacgacgtcggtatcgcagagcagcacgcggtgaccttcgccggcggcctggcctgtgagggcctgaagccggttgtggcgatctactcgacgttcctgcaacgtggttacgaccagcttattcacgacgtggcgctgcagaacctgccagtggtgttcgcgctggaccgcgctggtctggtgggcgccgatggtgccacgcacgccggtgtgtacgacatcccgttcctgcgctgcatcccgaacatgatggtgatggtgccggcagacgagaacgagtgccgtcagttgctgacgaccgcgttccagcaggactgcccgaccgccgtgcgctatccgcgcggcgccggcgtcggcgtggccacgcagcccgaactgaccgcgctgccggtgggcaagggcgagatccgccgcgaaggccatgcccgcgcaggtcagcgtgtggcgatcatggcgttcggttcgatggtgcatccggccctgaccgcggctgagcaactcgatgccacggtggccaacatgcgtttcgtgaagccgctcgatgtggagctggtcaaacaactggccgccaatcacgacttcctggtcacggtggaagagggcgccacgatgggcggtgccggtagcgccgtgctcgaggcgctggccgaggcgggtatcgaactgccgacgttggtgctgggcctgcccgacaagttcatcgaccatggcgatccggcgcatctgctgtcgctgtgcggcctcgatgcggccggcatcgagcgttcggtg

SEQ ID NO: 32195 - DNA, 738 bp, Ralstonia metallidurans
aagctcgttctcatccgccacggcgaatccacgtggaacctcgaaaaccgcttcaccggctgggtcgacgtcgacctgaccgatacgggcgccgcgcaggccaaacaggccggcacgctgctcaaggaagccggcttcgcctttgacgtggcctacacctccgtgctcaagcgcgccatccgcacgctctggcacgtgcaagacgaaatggacctgatgtggattccggtgcgcaatgaatggcgcctgaacgaacgtcactacggcgcgctggccggcctgaacaaggcggaaacggccaagaagtacggcgacgagcaggtgctggtgtggcgccgcagctacgacacgccgccgcccgcgctggagccgaccgacgaacgtgcctctttcggcgacccgcgctacgccaatgtgccgcgcgcggagatcccgctgaccgagtgcctgaaggacacggtggcccgcgtgatgccgctgtggaacgaatccattgctcccgacatcaaatccggcaagcgcgtggtgatcgccgcccatggcaacagcattcgcgccctcgtaaagtatctggaccagatttcggatgacgatatcgtcggcctcaatatccccaatggcaccccgctcgtctacgagctggatgccgacctgcgccccctgcgccactactacctgggcgaccaggaagccatcgcggcgtccctggccgccgtggccagccagggcaaggcccgc

SEQ ID NO: 32196 - DNA, 1191 bp, Ralstonia metallidurans
atggatctgctgttgacacccgaacttgtcgagtttcgggacaccgtacgcgctttcctgcgcgagcatctgcctgcggaactgcgtcgggggcagcaactcacgacggcgatgtatccggagccggaaatctcgggcccgtggcaggcacgtctgcgtgagcgtggatggctcgtcccactgtggcccagggagtggggcggcacgggatggagcagtatcgaacgattcatcttcgaaacggaatgcgcactcgctggcgcgccgcttgtccatccgatgggggtgaggctggtcgggccggtgatactgcgatacggcaccgaggcgcaaaagcagacatatctgtcgcgcatcctttccgggcaggactactggtgccagggattctcggagcccggcgccggttctgatctggcatcgctgcgaacccgtgccgtacgcgatggtgaccactacgtcatcaacggcagcaagttgtggacgacccacgcccaccacgcgaatcgcatgttcgcactcgtgcgcaccagcaccgaagggcggcggcaggagggcatcagcttcattcttatcgacatggaaacgcccgggatctcggttcgcccgattccaaccataggtggcgaccatgacgtcaacgaagtgttcttcgacaacgtgcgcgtgcccgtcgccaaccgcatcggcgcggagaacgaaggctggcagtgcgcgcgctatctgctggagttcgagcgcggggccggcatcttcagtcctcgcctgcgctcgcaactcaagcggatcggcgacgtgctggcgagagaggcacagtgtgatggcgataccactgtcactgccttgcggcggctccggttcggagaggtgcgcgccgatctcgacgccttcgagatgctcgaattgaagacgatgtgttcggtggcgccgggtgagagccccggtccggtggcgtcggtcctgaagctccgcgccagcaggctgcggcaggcaatcagcgaaatggggacgacggttgttggcgccgagagcttgcgatggcgcgcggacgacgcccacgatgaggagccttccgaagacgaggtgttgcgcgcgtgtttgctgcctgacttcctcaatgcgcgggcctacacgatcttcggcggtgcggccgaggtccagttgggcattatcgcgaagtcctgcctgggg

SEQ ID NO: 32197 - DNA, 867 bp, Ralstonia metallidurans
accggcagcatcgtggccatcgtcaccccgatgcacgaggatggcagcctggactttcccgcgctgcgcgccctcatcgactggcacgcggcggaaggcaccgatggcatcgtgatcgtgggtaccacgggcgaatcgccgaccgtcaacgtcgacgagcattgcgaactgattcgcgtggccgtcgagcaatccgcgggccgtgtaccgatcatcgcgggcacgggcggcaactccaccagcgaggcgattgagctgaccgccttcgccaagaaggtgggcgccaacgcatcgctgcaggtcgtgccctactacaacaagccgacgcaagaaggcatgtaccgccatttccgcacgatcgcggaagcggtggatctgccggtggtgctctacaacgtgcccggccgtaccgtggcggacatgaacaacgatacgatcctgcgcctggcgcaggtacccggtatcgtcggcgtaaaggaagcgactggtaatatcgaccgtgccgcgcaactgatcaatggcgcgccggaaggcttcgccatctacagtggcgacgatcccacggccgtggcgctgatcctgctgggcggccatggaaatatctcggtgaccgctaacgtggcaccgcgcaagatgcatgagatgtgtgttgccgcgctcaagggcgatgtggtgacggcgcgtcgtctgcatatggagctgattgacctcaatcgcgcaatgttcgtggaggccaatccgatccccgtgaagtgggcgctccagcaaatgggcaagatggaaggcggtatccgcctgccgctgaccccgctggccgaaggtcagcatgaaaccgtgcgccgcgcgctcgccgccgccggcctgctt

SEQ ID NO: 32198 - DNA, 1704 bp, Ralstonia metallidurans
cagttcgacaaaccgcgtgcccaggacagtgtcacctattcgcagttcatggatgacgccaagaacggcaaggtagtctgcgtgtcgacgatgcagggccgcaacctcgtggtttcgcccaaggaaggctccaagtacacgatcatttcgccgggcgatatctggatggtcggcgacctgatgaagtatggcgtccaggtgaccggcaaggctgacgatgagcccaacgtgctggtccaggcgctgtactacctcgggccgacgctcctgatcatcgttttctggttctacatgatgcggcagatgcagggcggggggaaaggcggagccttctccttcggtaaatcccgcgcgcgcctgatcgacgagaaccagaacgccgttaccttcgctgacgtcgcgggttgcgacgagtcgaaggaagaagtggtcgaactggtcgacttcctgaaggacccgcagaaattccagaagctgggcggacgtattccgcgcggcgtgctgctggtcgggcctccgggtaccggcaagacgctgctggcgcgtgccatcgccggtgaggccaaggtgccgttcttcagcatctcgggttcggactttgtggaaatgttcgtcggcgtgggtgcggctcgtgtgcgcgacatgttcgagaacgccaagaagcaggccccctgcatcgtgttcatcgacgaaatcgacgcggtcggccgccatcgtggcgccggcatgggcggcggtaacgacgagcgcgagcagaccctgaaccagatgctggtcgagatggatggcttcgaggccaactctggcgtgatcgtgatcgccgcgaccaaccgtgccgacgtgctggacaaggcactgctgcgtccgggccgtttcgaccgtcaggtctatgtgggcctgccggacatccgcggccgcgagcagatcctgaaggtccatatgcgcaaggtgccgatcggcaacgacgtggatgcatcgatcatcgctcgtggtacgcctggcttctcgggtgcggacttggccaacctggtcaacgaggctgcgctgttcgccgcccgccgcagcaagcgcgtggtggacatgcaggacttcgaggacgccaaggacaagatttatatgggtccggagcgcaagtcgacggtcatgcgcgaggaagagcgcaaggccacggcttaccacgagtctggccatgccgtggttgccaagctgctgccgaaggccgatccggtccacaaggtcacgatcatgccgcgtggttgggcgctgggcgtaacctggcagttgccggagcatgacaagtactcaaagtacaaggacaacatgcttgaggaaattgccatcctgttcggcggccgcgctgccgaagaggtgttcctcaatgccatgagcaccggtgcttcgaacgacttcgagcgtgccaccaagatcgcccgcgatatggtgacccgctttggcatgagcgattcgctcggcgcgatggtctacgtggacacagagcaggacggcatgttcggcaagctgtcgtcgaagaccgtgtccgaagcgacgcagcagaaggttgacgcagagatccgccgcatcattgacgatcaatacgcgctggccaagcgcttgctcgaagagaaccgcgacaaggtcgaagcgatgaccaacgcgctgatggagtgggaaacgatcgacgccgaacaggtgaacgacatcatg

SEQ ID NO: 32199 - DNA, 1335 bp, Ralstonia metallidurans
cgcaagtatttcgggacagacggcgtgcggggtcgggtcggcgacgcgccgatcacgccggattttgtgatgcgacttggccatgcggccggcaaggtgctggcgctggggcagaagacttcgcagggcaagcccaccgtcctgatcggcaaggatacgcggatctcgggctatatgctggaagcggcacttgaggccggctttacagcggcgggcgtcaatgtgctgctgactggcccgttgcccacgccgggcattgcctatctcacgcgaacgctccggttggcggcgggcgtggtgatttccgcaagccacaacccgtactacgacaacggtatcaagttcttttcggcatcgggtgacaagctgcccgatgacgtggaatcgcagatcgaggcgatggtcgaagagccgatgacctgcgtgcactcggatgaactcggccgcgcccgccggatcgacgacgctgcgggtcgctacatcgagttctgcaagagcacgttcccgtatgagcatgacctgcatggtctgaagatcgtagtcgattgcgctaatggtgccgcttatcacattgccccgcatgtgttccacgagttgggcgccgaggtgatctcgatcggcaaccagcccaatggccgcaacatcaacgccggatatggtgccaccgcccccgagaagctgatcgaagcagtgaaggctaacggcgcggatcttggcctggcattcgacggcgatgccgaccgcctgcaggtggtggacgccgatggccggttgtacaacggcgatgagttgctctatctgatcgtgcgcgatcgtcaggcgtctggccagcgggtagaaggcgcggtcggcacgctgatgacgaacatggcggtcgaactggcgctcaagcgccttggcgtgtcgttcgtgcgcgccaaggttggcgaccgttacgtgctcgaggaactcaatcggcaccactggcaactcggtggcgagggctccgggcatctgctgtgcctggaccggcataccacgggcgatggcatcgtgtccgcgctgcaggtgctggccgcgctacgccgcagtggcaagactctgccgcaactgctggatggcgtgagcctgttcccgcagacgcttatcaatgtgcgcgtcgagaagggttttgactggcagaaccacgctggactcaaggctgtccgggaccgcgtggagcccgagctggaaggacggggacgggtgctgatccgcgcctcgggaacggagcccgtggtccgtgtgatggtggaggccgagcaggtggaaaccgctgagcgtgccgcgcaggagcttgccgccgcattgcgcgcc

SEQ ID NO: 32200 - DNA, 1042 bp, Ralstonia metallidurans
accggctgcacgatggtggtggagaagtcgaccgtggcggttggaacgggctgatcgcgtcagcgccgtgatacgcgaggaactggtcgagcgcggtctggaagagctgcagttctcgagtggtatcgaacccacgagttcctgaaggaaggcgcggccgtggaagacttcatgcgtccggaccgtatcgtgctgggctgcgcgcccgacgttgcgggccgccatgcgcaggcgatcatgcgtcagctctactcgccgttcaatcgtaaccacgagcgcacgttctatatggatgtccgttcggccgagttcaccaagctacgccgcgaactcgatgctggccacgcgtatctcctttatgaacgagctggccaatttggccgacgaggtcggtgcggacatcgaactcgtgcgcctcggcatcggttcggatccgcgtattggctatagcttcctgtacgccggcgcaggctatggcggttcgtgcttcccgaaggacgtgcaggcgctgatgcgcacggctagcgcccatggcaagccgatgcgcgtgctggaggccgtggaggccgtcaacgattcccagaagcaggtgcttggcgacaagatcatcaagcgatttggcgaggatctgacaggcaagacgtttggcgtctggggtctggcattcaagccgaataccgacgatatgcgcgaggcgccgtcccgtgtgctggcgcgtgagatgatttcgcgcggcgcgtcgttgcgcgtacacgatccggtggcgatggacgaggcgcgtcgcgtgctcgagctcgatctggccgatattccggacgccatggcgcgcatccagttctgcaacgcccagatggacgtgctcaaggatgccgacgcactcgtgatcgtgaccgaatggaaggtgttccgcagcccggatttctcgcaaattcgcaacatgctcaaaacgcctgtcattattgatggtcgtaatctctacgaacccgatgccatggccgaggccggcatcgagtaccacgcgatcgggcgctcgagctcggcg

SEQ ID NO: 32201 - DNA, 1215 bp, Ralstonia metallidurans
aagcgggtggtggtcacgggagcgggcgcggtcagcgcgatcggcaacgactgggcgacggtgcgcgagcgcctggccgccggtcgcaatgcgatagtggtcatgccagactggcgcgagatccgtggcctcaacacgcacatcgcggcgccggtgccgccgttcacgctgccgccgcactacacgcgcaaactcatgcggaccatgggccgcgtgtcgcagatggccgtgctggcgaccgaatcggcgctggccggtgccgggctggccggacatccgctggtgaccggcggacagatggggatcgcgtacgggtcctcgaccggcacgccgtccgccgcgcaggacttcgcgcggatgatgagcgaccgcaccaccgagggcgtcaatgccaccacgtacatccgcatgatgtcgcatacggccgccgtaaacatcggcgtgttcttcggcatcaagggccgcatcctgaccacgtcgagcgcctgcacgtcaggcagccacggcattggctacgcatacgagacgatccgcatgggccgtcaggtggcgatggtggccggcggcgccgaagagcttgacgccacggaggcggccgtcttcgatacgctgttcgccaccagcacgcgcaacgatgcgcccacggcgacgccacgaccgttcgatgccgcgcgcgatggcctggtgctgggcgagggcgcttgcacgctggtactggaggaactggagcacgcgcgccagcgcggcgccccgatcctggccgagatcgtcggctatggcaccaacagcgatggcgtgcatgtgacccaggccgacgccggcacgatggccctggccatgcggatggcgctcgacgatgccggcgtctcgccggatcgaatcggctacgtgaacgcgcatggcacggctaccgatcagggcgatatcgccgaatcacaggccacgcacgccgtgtttggcgcccgaatgccaatcagttcgctcaagagctacgtcggccatacgctgggcgcgtgtggtgcgctcgaggcgtggatgacgatcgagatgatgcgcgatggctggtttgcgccgacgatcaatctggagaaccccgatccccgctgcgcgcaacttgactacatcgtgggcgaggggcgtgctatcgacaccgagtacgtgatgagcaacaatttcgcgttcggcggcatcaatacgtcgctggtcttgcgccgc

SEQ ID NO: 32202 - DNA, 714 bp, Ralstonia metallidurans
cagaccgtgctcgtcacgggatcatcgcgcggcatcggccgcgccattgcgctgcgtcttgcgcgcgatggctatgacgtggtgatccactgccgcgcgcgtcgcaacgaagccgaatcggtggccgacgccgtgcgcgcgttcggccgaaatgcgcgcgtgctgtgtttcgatgtcgggcaacgcgaggccgcggccagcgcattgctggccgatatcgaccatcacggctgctactacggagtggtctgcaacgccgggctggcccgcgatgcagcgtttccggccatgagcggcgaggagtgggacgaggtgattcacaccaacctcgatgcgttcttcaacgtgctcaatcccgtggtgctgccaatggtgcagcggcgtcggccgggccggatcgtcacgctgtcgtcggcgtccgggatcgtgggcaatcgcgggcagaccaactacagcgctgccaaggctggggtgatcggcgccaccaaggcactggcgatcgaactggccaaacgccagatcacggtcaactgcgtggcgccggggctgatcgacacggaaatgatcgaggaacacgtgcgcgaggaagccatgaagatgattcccgcccgccgcatgggcaccccggacgaggtggcggccacggtggcgttcctgctttcgcccgatgccgggtacattacgcgccaggtgatttcggtgaacggaggcatg

SEQ ID NO: 32203 - DNA, 945 bp, Ralstonia metallidurans
atgtccagcctgatctgcggctccgtcgcatacgacaccatcatgacgttcgacggacgtttccgcgaacacatcctgccggaccagatccacatgctgaacgtctcgttcctggtgccgggtatgcgccgcgagtttggcggctgcgcgggcaatatcgcctacacgctcaaaatgctgggcggcgacccgatcgtgatggccacggtgggccaggacgccgaaccgtatctgcagtacctgcgcaacctcgagatccgcaccgaccatatccgcgtgctgcccgagacattcaccgcgcaggcgatgatcacgaccgatctggacaacaaccagatcacggccttccaccctggcgccatgggtcagtcgcaactgaaccgggtgcaggacgcgctggccacgggcaaccgcccggcagtcggcatcgtcgcgccggacagccgtgaaggcatgcttcaccatgcccagcagttcgccgccgagggcatccccttcatcttcgacctgggtcaggccatgccgctgttcaacggcgaggacctgcggcagttcattgaacttgccagctacgtgacggtcaatgactacgaagcgcaggtcctgctgtcacgcaccgcatggaccagcgcagaggtagccgccaaggtccgcgcgttcatcgtgacgcacggcgagcgcggcgccagcgtctttgccgacggcaagcagtacgccattcccgccgtgcccgccgaacgtgtggtcgaccccaccggatgcggcgatgcgttcaggggtggcctgctccacggcatcgagaacgggatggattgggaaaccaccggccgcctcgcttcgctgatgggctctctcaagatcgcccagcagggtccccagaaccactggatgtcctgcgacgaaatcggcagccgcttccagtccgtctttggttaccgttacgct

SEQ ID NO: 32204 - DNA, 1332 bp, Ralstonia metallidurans
atgtttgataaaattctgatcgcgaaccgcggtgaaatcgcccttcgcatccagcgcgcctgccgcgagctgggcatcaagaccgtggtggtgtactcggaagccgacaaggacgccaagtacgtcaagctggccgatgaagccgtctgtatcggcccggccccgtcgccgctgtcatacctgaacatgccggccatcatctcggccgccgaagtgaccgacgcccaggcgatccacccgggctatggcttcctgtccgagaacgcggacttcgccgagcgcgtggagaaatccggcttcgtgttcatcggcccgacctccgaaaacatccgcctgatgggtgacaaggtgtcggccaagcaggccatgatcaagtccggcgtgccgtgcgtgcccggctccgatggcgcactgcccgacgacccgaaggaaatcctggcaacggcccgtcgcgtgggctaccccgtgatcatcaaggccgctggcggcggcggtggccgcggcatgcgcgtggtgcacaccgaagccgccctgctcaacgccgtcaacatgacgcgcgaggaagccggccgcgccttcggcaatcccgaggtctacatggagaagttcctcgagaacccgcgccatgtggaaatccagatcctggccgaccagcatcggcaggccatctggctgggcgaacgcgactgctcgatgcagcgccgccaccagaaggtgatcgaggaagcgccggcaccgcacattccgcgccgcctgatcgagcgcatcggcgaccgttgcgccgaggcctgcaagaagatcggctaccgtggcgccggcacgttcgagttcctgtacgagaacaacgagttctacttcatcgagatgaacacgcgtgtgcaggtcgagcacccggtcaccgagatgatcacgggcatcgacatcgtgcaggagcagatccgcatcgccttcggcgagaagctgcgcctccgccagaaggacgtggaactgcgcggccacgcgatcgagtgccggatcaacgccgaggacccgttcaagttcacgccgtcgccgggccgcatcaccgcctggcacatgcccggtggccccggcgtgcgcgtagactcccatgcgtacgacggctacttcgtgccgcccaactacgattcgatgatcggcaagatcatcacgtatggcgcgacgcgtgaccaggccatcgcccgcatgcgcatcgcgctgtcggaaatggtggtggacggcatcctgaccaacgtgccgctgcaccgcgacctgatgctcgacgccaacttcgtggaaggcggcaccagcattcactatctcgaacaccgtctg

SEQ ID NO: 32205 - DNA, 426 bp, Ralstonia metallidurans
gtgctggttctgcatggtccgaacctcaatttgctcgggacgcgcgagccgcagacgtacggacacacgacgctggacgatatcaacgaagcgctggccaagcgcgcggccgaagcgggcatcgagttggatacgttccagtcgaatcacgagggagccctcgtggaccgcattcaggcagcgcgtggcgagggggtggacttcatcatcatcaatccggcggcctatacccatacgagtgtggccatgcgcgatgcgctcgctggcgtggccattcccttcgtcgaggtgcatctgtccaatgtgcatcgccgcgagccgttccgtcatcactcctatttctctgatcaggcgatcggggtgatatgcggcctgggctggcagggttatctgctggcgctggattacgcgcttgcacaggaacag

SEQ ID NO: 32206 - DNA, 774 bp, Ralstonia metallidurans
tccttctcggtcctgctgcaacgcctcgccccgctacacctgctgacccgtatcgcaggtcaactggcggattgccgccagccctggctcgcccagtacctgatccgcacgttcgtgcgccggcacaagatcgacctcgatgaggcattggtcagcgacctcgccacctatccgacgttcaacgagttctttatccgcgcgctgcgccccggcgcgcgcccgatcgccgcagcagactggaccagcccggtggacggcacgatcagccagattgggcgcgtcgaagctggccagatgatccatgccaagcaacatgcctatagcgccaccgcgttgctgggggatgccgccctcgcgaaacagctggagggcgggtgcttttccacggtgtacctgagcccccgtaactaccaccggattcacatgccgtgcgaggggcgcctgctgggcatgcgtcatgtgcccggcaagctgtactccgtcaggcccgatatcgttgaaggcatcgacggactgctcgccatcaatgagcgtctggtttgctggttcgagcatccgcagcacggcgtctttgcgctggtgctcgtgggtgctgccatcgtcgggcgcatcgccacggtctggcatggcctggtggagcccaagcgatccgggcaagtctcggagtggcactacgccgacggcgcttccgcacctcaactgaaggatctgcttcagggtgtggagatggggcacttccagctcggctcgacgattgtgctgctgatgccggga

SEQ ID NO: 32207 - DNA, 423 bp, Ralstonia metallidurans
atggcgatcgaacgcaccctgtcgattatcaagccggatgccgtggccaagaacgttatcggccagatctacgcccgtttcgaggccgctggcctgaaagtcgttgcagccaagatggttcacctgtcgcgcggtgaagccgagcagttctacgctgttcacaaggcgcgcccgttcttcaaggacctggtggacttcatggtttcgggcccggtcatgatccaggctctggaaggcgaaagcgctatcgccaagaaccgcgacctgatgggtgccaccgacccgaagaaggctgaaaagggcacgatccgcgccgattttgccgacagcatcgacgctaacgccgtgcacggttcggacgctccggaaacggctgccgtggaagtggctttcttcttcccgggcatgaacgtttacagccgc

SEQ ID NO: 32208 - DNA, 1230 bp, Ralstonia metallidurans
gtgagccgtcgtcgcgtcgtcgtcactgggcttggccttgtgtctcccgtcggaaacacggttgccgaaggctgggccaatctggttgccggcaagtccggcatcgccaccatcaccaagttcgatcactctccctttgctgtgcactttgcgggcgaagtgaagggcttcaatgccgaggattacatcccggccaaggaagcccggaacatggataccttcatccatttcggcatcgccgccggttcgcaggcgctcaaggacagcggcctggaagtgaccgaggccaacgccgagcgcatcggtgtgctggtgggctcgggtattggcgggctgccgatgatcgaagatacgcagatgacgctggccgaacgcggcccgcgccggatctcgccgttcttcgtgccaggttcgatcatcaacatgatctccggccacctgtcgattatccacggcctcaagggcccgaacctggctgcggtgacggcctgcacgaccgggctgcacagcatcggcctggcggcgcgtctgattcaggcgggcgactgcgatgcgatgctggctggcggagcggagtcgacggtgtcgccgctcggcatcggcggttttgcggcagcacgcgcgctttccactcgcaacgatgaccctgctgcggcgtcgcgtccgtgggacaaggaccgcgatggcttcgtgctgggcgagggtgccggcgtgatgatgctcgaggagtatgagtcggccaaggcgcgcggcgcgcgaatctatgctgaactcatcggcttcggcatgagcggtgacgcgttccacatgacggcgccgaacaccgacggtccgcgccgctgcatggtcgctgcgatcaaggatgccggaatcaatccggacgaagtgcagtacctcaacgcgcatggcacctcgacgccgctgggtgacaagaatgagaccgatgccgtcaagctggcattcggtgatcacgcctacaagatggtggtcaactcgacgaagtcgatgaccggtcacttgctgggtggcgctgggggcctggagtcggtgttcacggttctggcgattcacaatcagatctcgccgccgaccatcaacatcttcaatcaagatcccgagtgtgatctcgattacgtcgccaatacggcacgtgacatgaagattgatgtcgccgtgaagaacaacttcggcttcggcggtaccaacggtacgcttgtcttccgccgcgtc

SEQ ID NO: 32209 - DNA, 225 bp, Ralstonia metallidurans
atggacaatatcgaacaacgcgtcaagaaaatcgttgctgagcagcttggcgtggccgaggcagacatcaagaacgaatcgtcgttcgtgaacgatctcggtgcggactcgctggacacggttgaactcgtgatggcgttggaagatgaattcggcatggaaattcccgatgaggaagccgaaaagatcacgaccgtgcaacaagctattgactacgctaccgcg

SEQ ID NO: 32210 - DNA, 732 bp, Ralstonia metallidurans
ctggagaatcaggtcgcactggtgaccggcgcatcgcgcgggatcggccgtgccatcgcgctggagctcgcacggcagggcgcaacggtgatcggtaccgccacgagtgagtcgggcgctgctggcatcagcgagtacctggctggcgaaggcctgaagggcggcggtgtggtgctgaacgtcaacgacgcggcgcgctgcgaggcagtgatcgacgagatcatcaaggcgaacggcggtctgaacgtgttggtcaacaacgccggcattacgcaggatcagttggccatgcgcatgaaagacgaggattggagcgccgtcatcgacacgaacctgacggccgtgttccgtctggcccgtgccgtactgcgcccgatgatgaaggctcgtggcggccgcatcatcaacatcacctcggtggtcggctccaccggtaaccccggtcagatgaactacgctgcggcgaaggctggtgtcgagggcatgacgcgcgcgctggccgccgaaatcggcagccgcaacgtcaccgtcaactgcgtggcccccggattcatcgataccgacatgaccaaggtactgtcggaagagcagcatgcggcgctgaagacccggattcctctgggtcgtcttggccagccggaagacatcgccaatgcggtggcgttcctggctggtccgcaggccgcctacatcacgggcactacgctgcacgtgaacggcgggatgtacatg

SEQ ID NO: 32211 - DNA, 918 bp, Ralstonia metallidurans
aaattcgcatttgttttccccggacagggttcgcagtcggtcggcatgctcaatgcctttgccgataacccagtggtgcgtgccacgcttgaagaagcttcgacggcgctgggtcaggacatcggcaagctgattgcggaaggtccggccgaagagctgaacctgacgaccaacacgcagcccgtgatgctgacggccgcagtggccgtgtaccgcgcatggctcgacgccggtggtccggctccggcgctggttgcaggccatagcctgggcgagtactcggcgctggtggccgcaggggtgatcccgtttgccgaggcggtgccgctggttcgcttccgtgcccaggcgatgcaggaagcggtgccggtgggtgagggcggcatggccgcgatccttggcctgtcggacgatgacgtgcgcgccgcgtgcgccgaggctgcggcggcaggcgctggcgtggtcgaggctgtcaacttcaatgccccgtcgcaggtggtgatcgccggcaacaagggcgccgtggaaaaggcctgcgagattgccaaggcgaagggcgccaagcgcgcgctgccgctgccggtgtccgccccgttccactcgtcgctgctcaagcctgcctccgatcgcctgcgcgagcgcatggctggcctgtcgttctcggcaccggccattccgctggtgaacaatgtcgacgtggcaatcatcagtgacccggctcagatcaaggacgcgcttgttcgtcaggcagccgctccggtacgctgggtcgagtgcgtgcagaagattgccgccgagggcgtgacacacgtgatcgagtgcggtccgggtaaagtgctggccggtatgaccaagcgcatcgacggcaacctcgttggtggtgcaatctttgatccggcgtcgctgcaggaaacgctg

SEQ ID NO: 32212 - DNA, 1002 bp, Ralstonia metallidurans
ttctcccgggatctctggcgccaggccgccgaattgggattcaccggcgtgctgatcgacgaagcctatggcggcagtggcctcggcgtggtcgaggccggcatcatcgccgaagctatcggggccacgcttgcgccgttgccgttcctttccacctcggtgcttggcgcctcactgctggggctgttcggcagcgacacgcagcgaagcgcgctgctgccggagatggcatcgggccgccacctgacggcgctcgcgctggacgaggggagcaaacaccggccagagcgcatcaccctgctggcgcgacgccatggcgacgggtacatgctcgacggcagcaaggtgttcgtcgtcgacggccatgtggccgacacgttgatcgtcgcagcgaaagacgcgcaggcggggcccgatggcgacatctcgctgttcctcgtgccgcgcgacaacgccggcgtccgcgtcgaacgctgcgtgatcgccgatgccaccaatgcggcacgcgtcaccttcgagggcgtccgagttccggcctatgcgctgctgggccgcgccggcaacggcgccgcgatgctcgacaaggtactcgacatcgcccgcgcggtgctgtcgtccgaactggtcggtattgcagatgccacgttcgcgcgcacgctcgcctacctgaaggagcgcagccagttcggcaagcagatcggcgagttccaggccctgcagcatcgtgccgcacatctgttcgcggagatcgaactcgcgcgtgccgcggtgctgcagtgccagcagcggctggacgctggccgttcggatgggccggagccgctagtttgcgtcgccaaggccaaggccggcaccaccgccaccctggcagtgcaggagggcgtgcagatgcacggcggtatcggcatgaccgacgaactggacatcgggttctacatgaagcgcgcacgcacagcccaggagtggttgggcgacgccaactggcagctcaaccgctgggca

SEQ ID NO: 32213 - DNA, 1404 bp, Ralstonia metallidurans
ctcgatctttgccgcgcagccatcggttcgcagaacgtgctgaccgacccggccgacaaggcaccctacctgaccgactggcgccgccgctacaccggcgacgcgctggccgtgctgcgtcccggctcgaccgaggaagtcgcggcggtgatgcgtgcctgccatgcgcacaagctggccgtggtgccccagggtggcaacacaggcctgtgcggcggcgccacccccgaacccggcgatgctgccgcgcgtggcacggtggtgctgtccctgcagcgcatgaaccgcgtgcggcaggtcgacccgctcaataacacgatcaccgtcgaggccggcgtgatcctgcagcaactgcaggaggccgcgcagacacacggccggctgttcccgctctcgctggcggccgaaggcagctgcacgatcggcggcaacctgtcgacgaacgccggcggcaccgccgtgctgcgctacggcaacacgcgcgaactctgcctggggctcgaggtcgtgaacatcaagggcgaggtctgggatggcctgcgcggcctgcgcaaggacaataccggctatgacctgcgcgacctgttcatcggcgccgaaggcacgctcggcatcatcaccgccgcggtcatgaagctgtttccggcgccgcgcgcgcgggtcaccgcgctggccgccgttgaaagcccacgcgccgcgctggcgctgctggccatcgcgcaatcgcacgcgggcgccatgctgaccggtttcgagttgatgtccgcgatgtgcatggatctggtgacgaagcactacccgcagttgcgctacccgttcaccgcccatcatccgcaactcgttctgctggaactgtccgacagcgagagcgaagaacacgcgcggacgatcttcgaaaaaatgatggaggtagcgttcgaagccggcgtggtcaaggatgccgtggtggccgaatcggtacagcagtcacgcgatttctggaacctgcgcgaacacattccgctggcgcaggtcgaggaaggcaagaacatcaagcacgatatcgccgtgccgatctcgcgcgtggcggacttcatcgagaccaccgacacgctgctgcaagacgccttccccggcgcgcgcatggtcacgttcggccatcttggcgatggcaacttgcactacaacgtgtcgccgccggtcggcgtggatcatgatcagttcctgtcgcaccaggatgcgatcaacctgatcgtccacaacagcgtgcatgtccacaacggctcgatctcggccgaacacggccttggccaactcaagcgcgaggagaaccgccgctacaagagcgaggtggaactggcgatgatgcgggccatcaagcaggcgctggatccgcaagggttgatgaaccccggaaaggtggtt

SEQ ID NO: 32214 - DNA, 1266 bp, Ralstonia metallidurans
tttgacacgctggccctgcacgccggcgccgcgcccgaccccaccaccggggcccgcgccacaccgatccatctgaccacatccttcgtattccgcgacagcgagcacgccgcatcgctgttcaatatggaacgcgccggacacgtctattcgcgcatcagcaaccccacggtcgccgtgttcgaggagcgcgtggccgctctggagaacggcgcgggcgccatcgccacggcctcgggccaggccgccctgcacctggccgtggccacgctgatgggcgccggctcccatatcgtggcgtccaccgcgctctatggcgggtctcacaacctgctgcactacacgctgcgccgcttcggcatcgagaccaccttcgtcaatccgcgcgacatcgacgcctggcgcgccgcgatccgccccgagacgaagctgctcttcggtgaaacactgggcaaccccggcctggacgtgctcgacatcgccaccgtggcccagatcggccaggaacacggcattccgctgctggtggattcgacgttcaccacgccctacctgctgcgcccgttcgaccacggcgccgggctgctctaccactcggccaccaagttcctgggcggccatggcacgacgatcggcggcgtgctttcagaaggcggcacgttcgatttccaggcctcgggccgcttcccggaactgtccgagccgtacgagggcttccacaacatggtgttcaccgaggaaagcacggtagcgccatttctgctgcgcgcgcggcgcgagggcctgcgcgacttcggcgcctgcatgaatccgatggctgcctggcagttgctgcagggcatcgagacgctgccgctgcgcatgagccgccacgtcgacaacacgcggcgcgtggtgcagttcctggccagccacccgatggtcgagtcggtggcgtatccggagctcgaatctcacccggactacgaactggccaagcgcctgctgccgcgcggctgcggcgcggtgttcagcttcaacctcaaggccgaccgcaccgccggccagcgcttcatcgaaagcctgtcgctgttctcgcacctggccaacgtgggcgatgcgcgctccctggtgatccatccggcgtccaccacccacttccgcatggacgccgcggcgctgcgcgcggccggcatcggcgaaggcacgatccgcctgtcgatcggcctggaggatccggacgacctgatcgacgacctgaaacgcggcctcaaggccgccgagaag

SEQ ID NO: 32215 - DNA, 2661 bp, Ralstonia metallidurans
ctcggcactggcggccgcggtcagtactattccctgccccagctgggcaaggccctgggcgtgaagatcgaacgcctgccggtgtcgattcgtgtggtcctggaatccgtgctgcgcaactgcgacggcaagaaggtgaccgaggaacacgtccgccaactggctaactggaagccgaacgccgagcgcgtggatgaaatcccgttcgtcgtggcccgcgtggtgctgcaggacttcacgggcgtgccgctgctggccgacctggctgccatgcgcaacgtggccgagaagatgggcaagaacccgaagaagatcgagccactggttcccgtggacctggtggtcgaccactcggtgcagatcgaccacttccgcgaaaagaacgccctggacctgaacatgcaactggagttcaagcgcaataacgagcgctaccagttcatgaagtgggggatgcaggcattcgacacctttggcgtggtgcagcccggcttcggcatcgtgcaccaggtcaacctggaatatctggcgcgcggcgtgcacaagaaggatggcgtctattatccggacaccctcgtcggcaccgattcccacaccacgatgatcaacggcattggcgtggtcggctggggcgtgggcggtatcgaagccgaagccggcatgctgggccagccggtctacttcctgaccccggacgtggtgggcgtggaactgaagggccggttgcgcgaaggcgtgaccgccaccgatctggtgctgaccatcaccgagatgctgcgtcgcgaaaaggtcgtcggcaagttcgtggaattcttcggcgaaggcacggccagcctgaccacgccggaccgcgccactatcggcaacatggcgcccgagtacggcgcgacgatgggcttcttcccggtcgacgagaagacgatcgactatttccgtggcacaggccgcaccgacgaggaaatcgccgcgttcgagggctacttccgcgcccagggaatgttcggcgttccgcgcgctggcgagatcgactacagcaagacgttgacgctggacctgggcaccgtggccccgtcactggccggcccgaagcgcccgcaggaccgtatcgagatcggtcacgtcaaggaaacgttcaagtcgctgtttgccaagccagtggccgagaacggcttcaacaaggacgtcgccgacctggaccgcgagtacacgaacgccgacggcgtgaaggtgcacaacggcgatgtgctgattgccgcgatcacgtcgtgcacgaacacgtcgaaccccagcgtgctgctggccgccggcctgctggccaagaaggccgtggaagccggcctgaaggtcgcgccccacatcaagacgtcgctggcccctggcagccgcgtggtcacggaatacctgaaggccgccggcctgctgccgtacctggacaagctcggcttcggcgtcaccgcgtacggctgcaccacctgtatcggtaacgccggcgacctgacccaggcgctcaacgacacgatcgtgcagaacgacatcgtggccgccgccgtactgtcgggcaaccgcaacttcgaagcccggatccacccgaacatccgcgccaacttcctggcatcgccgccgctggtggtggcttacgccatcgccggcaacgtcacgcgcgacctgatgaccgagccggtgggcaagggcaagggtggcaaggacatctggctgggcgacatctggccgacgtcggaagaaatccatgcgctgctgaagtacgcgatggacgccaagacgttcaagggcaactacgagcaggtcaggaagccgagcaagctgtgggcagcgatcaagggcacgaagggccaggtctacgactggccgaaatcgacctacatcgccgagccgccgttcttccaggacttcgcgctcgagccgagcggcgaggccgtgaccgtccgtggcgcccgcgccctgggtgtgttcggcgactccgtgacgaccgaccatatctccccggccggttcgatcaaggacacctcccctgccggcaagtacctgctgtcgcatggcgtgctcaaggccgacttcaacagctacggctcgcgccgcggcaaccatgaggtgatgatgcgcggcacgttcgccaacgtgcgcatcaagaacctgatgatcccggccaaggccgacggctcccgcgtggaaggtggcatcacgctgcaccagcccaccggtgaagaattgtcgatctatgacgccgcgatgaagtacatcgccgaaggcacgcccacagtggtgttcggtggcgaagagtacggcacgggctcgtcgcgcgactgggcggccaagggcacccagctgctgggcgtgaaggccgtgatcgcacgcagcttcgagcgtatccaccgttcgaacctggtgggcatgggcgtgctgccgctgcagttcaagggcaacgacagcgtgcagtcgctcggcatcgtcggcaacgaaaccttcgacgtggaaggcatcgaaggcgacctgaagccgcagcaggacgtgacgctggtcatccaccgcgccaacggcgacacgcaacgcgtaccggtgctgctccgcatcgacacgccgatcgaggtcgactactacaaccacggcggcatcctgccgttcgtgctgcgtcaactgctggcc

SEQ ID NO: 32216 - DNA, 1050 bp, Ralstonia metallidurans
gacgatgcgcgcgtggaggacatcatcccgctgcccccgcccgagcacttgatccgtttcttccccatccgtggcacccccgttgaatcgctggtcacccagacgcgccagcgcatctcccgcattctgcatggcagtgatgaccggctgctcgtgatcatgggcccctgctcgatccacgacccgcaggccgcgctcgactacgcacggcgtctggcggccgaacgcgagcgctacgcggactcgctggaaatcgtgatgcgggtgtatttcgagaagccccgcaccacggtcggctggaagggcctgatcaacgacccctacctggacgagagctatcgcatcgacgaaggcctgcgcatcgcgcgcagcctgctggtggatatcaaccgcctcgggttgccggcggccggcgagttcctggacgtcatttcgccccagtacatcggcgatctgatctgctggggcgcgattggcgcccgcacgaccgagagccaggtacaccgggaactggcttcgggcgtctccgcgcccattggcttcaagaatggcaccgacggaaacatcaagatcgcgatcgacgcgatccaggccgcatcgcgcccgcaccacttccttggcgtgcacaagaacggccaggtcgcgacggtccataccaagggcaacccggactgccacgtcattcttcgcggcggcaaggcgcccaactacgacgcggaggttgtcgccgcagcgtgcaaggaactggaagcggcgcggctgcgcaattcgttgatggtcgattgcagccatgccaacagcaacaagcagcaccaacgccagatcgacgtcgcacgcgacgtggcgcagcagatcagcggcggcagccagtcgatcttcggcctgatggtcgagagccatctggtacccggcgcgcagaagttcaccccaggagaacacaacccatcgggtctcacttatggtcagagcatcacggacgcctgcatcgggtgggaggactccgtgacggtgctggaactgctgagcgaggcggtaaatgtacggcgtggg

SEQ ID NO: 32217 - DNA, 1104 bp, Ralstonia metallidurans
atgaaaaccaaagccgccatcgcctggaaagccggtgcaccactcaccatcgaagaggtggacctcgacggtccgcgcgcgggcgaagtcctcgtggagatcaaggccaccggcatctgccatacggactactacacgctgtccggcgcggaccccgaaggcattttccccgccatcctgggccatgaaggcgcgggcatcgtcaccgacgttggtccgggcgtcacgtcgctcaagccgggcgatcacgtgattccgctctacacgccggaatgccgtcagtgcaagttctgcctgtcgcgcaagaccaacctgtgccaggccatccgcgccacgcagggcaagggcctcatgccggatggcacctcgcgcttctcgatcgatggcaagccgatcttccactacatgggcacgtcgacgttcgccaaccatatcgtggtgcccgaaatcgcgctggcgaagatccgccccgacgcaccgttcgacaaggtctgctacatcggctgcggcgtgaccacgggcgtgggcgcggtgatcttcacggccaaggtggaagccggcgcgaacgtggtggtgttcggcctgggcggcatcggcctgaacgtgatccagggtgcaaagatggtgggcgcggacaagatcatcggcgtggacctcaatcccgcgcgcgaggcgatggcacgcaagttcggcatgacccacttcgtgaatccgaaggatgtcgacaacgtggtggaccacatcgtccaactgaccgacggcggcgccgactactcgttcgagtgcatcggcaacacgcaggtcatgcgtcaggcgctggagtgctgccacaagggctggggcaagtcgatcatcatcggcgtggccgaagcgggcgctgaaatctccacccgtccgttccagctcgtcacgggccgcgaatggaagggctcggccttcggcggcgcgcgcgggcgcaccgatgtgcccaagatcgtcgactggtacatggacggcaagctgaacatcgacgacctgatcacgcatacgctgccgctcgaccgcatcaacgagggcttcgacctgatgaagcgcggcgaatcgatccgctcggtggtcctgtac

SEQ ID NO: 32218 - DNA, 1566 bp, Ralstonia metallidurans
tacgacgtcgcgatcgtcggcagcgggctggccggccttaccgtcgctttgcagcttgccgatacccaccgggttgtcatcctcagcaaacgcgccatgacaacgggggctagcgattgggcccagggcggaatcgccgcggtgctcgactcgggcgatagtcacgacgaacacacgcaggacacgctggttgcaggtgcaggactttgcgacgaggatgcgacgcgcttcatcgtggagcatggccgcgaagcgatccaatggctgatcgaccgcggggtgccgttcacgcgcgacgaacaggccgaactcggcttccacctcacccgcgaaggcgggcatagccgtcgccgcatcatccacgttgccgacgccacgggccatgcggtggtgaccacgctggccgagcaggcccgccagcatccgaacatcacgatcctcgaagaccagttcgcagtcgacctgatcacgtccgccaagctcggcttgcccggcaaccgttgctatggcctgtacgtgctcgatgcggaaacgggcgaagtgcgcacgctcacagccacgcatacggtactggccgccggcggcgcgggcaaggtctacctctatacgaccaaccccgatacggctacgggcgacggcatcgccatggcctggcgcgcgggctgccgggtgtcgaacatggaattcatccagttccacccgacctgcctctatcacccctacgcgaagtcgttcctgatctcggaagccgtgcgcggcgaaggcggcctgctgaggctgccggatggcacgcgcttcatgcccgagcatgatgcccgcgccgaactggcgccgcgtgacgtggtagcccgcgccatcgacttcgaaatgaagaagcgcggcctggattgcgtgtatctcgacatcacgcaccagcccgtgtcgttcctcaaggaacacttcccgacgatctacgcccgctgcctggaactcggcatcgatatcgcacgcgagccgattcccgtggtgccggccgcgcactacacctgtggtggcgtggtcaccgatacggcgggccgcaccgatctcggcaatctctacgcagttggcgagacgggctgcacgggcctgcacggcgccaaccgcctggcctcgaactcgctgctcgaatgcatggtgatcggccgtgccgcggctgcggacattgcctcgcaaggcaaggccgacgcgccggacatcacgctgccggcctgggacgagagccgcgtatcggatgccgacgaggaagtcgtcgtctcgcacaactgggatgagctgcgccgcctgatgtggaactacgtcggcatcgtgcgcaccgacaagcggctggagcgcgcgcagcaccggatcggcatgctgcgcgaggagattgccgagtactacgcgaatttccgcgttactcgcgatctgttggaattgcgcaacctggtggaagtggcgtcgctgatcgtcgacagcgcctactcgcgccacgaaagccgtggcctgcactacagccgtgactatccggaaacgctgccgaaggcgctgcctaccgtgctgcaaccg

SEQ ID NO: 32219 - DNA, 1032 bp, Ralstonia metallidurans
aacggcctcgccaactggtcctggtgggagatcgtgatctacacgctcgtgatgacgcacatcacgatcgccggcgtgactattttcctgcaccgctgcatggcgcaccggtcgctggacctgcatccgatcgcccagcatttcttccgtttctggctgtggatgaccacgggcatggtgaccaaggagtggaccgcgattcaccgcaagcaccacgccaagtgcgaaaccgaagacgatccgcacagcccgcagacccgcggcatccgcaaggtgctgctggaaggcgccgagctgtatcgcgccgaggccaagaataaggaaaccatcaccaagttcggccacggcacgcccgatgactggatcgagcgcaatttgtactcgcgcttctcctggcaaggcgtagcgctgatgctgatcatcgacctggccctgttcggcctggtcggcatgtccgtgtgggcagtgcagatgctctggatcccgatccatgccgccggcatcatcaacggcctgggccactactggggctatcgcaactacgactgcgaggacgcatcgaccaacgtgtcgccgtggggcttcatcatcggcggtgaagagctgcacaacaaccaccacacgtacccgacgtcggccaagttctcgatcaagtggtatgagatcgacgtgggttggtggtacatccgcgcgatgcagtcggtgggcctggccaaggtcaagaagatcccgcccaaggctcgcctggtggaggctcgtccggtggatcacaacacgctggaagcgatcatcgctaaccgctacgacgtgatggcccgctatgccaagacgctgaagtccgcctacaaggatgaactgcgcaagcacaaggaaggcaatacgcccgagtactcgagcttcaagccggcccgcaagtggttccaccgcgaggaaaccaagctggctgcgccgcaacgtcagcaattggcgaccatcgtcgagcaaaacaagatgctgagcacgttcgtggaaatgcgccgcgaactggctgtg

SEQ ID NO: 32220 - DNA, 666 bp, Ralstonia metallidurans
atgagcgaaccgctgcccgccatcgaaattgaaaccgcgccgaacccggcgttctccgtgatctggatgcacgggctgggcgccgatggcagcgacttcgttccagtcgtcccggaactcggattgcccgaaaccctcgccgtccggttcatcttcccgaacgccccggcgatacccgtgacctgcaacggcggctacgtcatgccggcctggtatgacatctactcgctcgatgaagcgggccgccgtgccgacgaacgaggcatcctgcaatcccgcgatgccatccgcacgctgatcgcacgcgaaaacgcgcgcggcgtgccaaccaatcgcatcgtcctggcagggttctcgcaaggtggcgcgatcgcgtacaccacggccctgacccatcccgaaacgctcgccggggtgattgcgctgtcgacatacatcccctcgaccgacctgatcgcatccgaggctgcaccggccaacgccgccacgccgatccttgccgcccacggcaccgaggacggtgtcgtgccgctgatgctcggcacccgcgcgcgcgactgggtggccgccgctggccatccggtcacatggctgacctaccggatgccgcattcggtctgcatcgaggaaattgtcgatatcggccagtggttgcaggagcgcttt

SEQ ID NO: 32221 - DNA, 2043 bp, Ralstonia metallidurans
tcggcgtgttccgcatgtaaggggaaaacaataatgttcacgaagatcctgattgcgaaccgtggcgagatcgcctgccgtgtggcggccacctgccgccgcctcggcatccgcaccgtggccgtctactccgacgccgacgccaacgcgcgacacgtcgccttctgcgacgaggccgtgcatattggtggcgccgccgcgcgagacagctacctgcgcgcggaccacatcatcgaaatggcgaaggagaccggcgcccaggcgatccaccctggctacggcttcctgtccgagaacgaggacttcgcgcgcgcctgcgccgaagccggcctcgtgttcatcggcccgcctgcctctgcaatccacgcaatgggcagcaagagcgcggccaagcaactgatggaaaaggccgcggtaccgctggtgcccggctatcacggcgaagaccaggacgccaccctgctgcggcgcgaggccgaccgtatcggctatccggtgctgctcaaggccagcgcgggcggtggcggcaagggcatgcgcgtggtggaagctggggatggcttcgacgccgcgctggcctcggtgaagcgcgaggcgtcggccagcttcggcgacgacaaggtgctggtggagaaatacctgacccggccgcgccatatcgagatccaggtctttgccgattcgcacggcaactgcgtctacctgttcgagcgtgactgctcggtgcaacgtcgccaccagaaggtgctggaagaagcgccggcgccgggcatgaccgaggaacgccgccgcgcgatgggcgaggcggcggtggccgcggcgcgcgcagtgggttacgtcggcgcgggcacggtcgagttcatcgccaaccaggatggctcgttctacttcatggagatgaacacgcgcctgcaggtggagcatccggtcaccgagatgatcactggccaggacctggtggaatggcaactgcgcgtcgcggccggcgaggcgctgccgctggcgcaggagcaactggccatccacggccattcgctggaagcgcgcatctacgccgagaacccagacaagcagttcctgccgtcaacgggcacgctgcgcttcctgcgcacgccgcccgcggtgcagttcatgcgcggcggcgatgccaacgcgccggctgcggtccgcattgacgcgggcgtgcgcgaaggcgatacgatcagcccgtactacgacccgatgatcgccaagctgatcgtctggggccgcgatcgcgaccaggcactggcgcgcatggcccaggcactggccgggtatcacgtggtggggctgtcgaccaacgtcgccttcctgcagcggctggtgaaatcggaggctttccgtaccgccgacctcgacaccggcctgatcgaacgcaaccagacagtactgttcccgccgcagaagacggctggcatcgaagcgatcgcgctggcgatggcggcactgctcgaacgcgagacgcgcacacgccgcatcgacgaggcggaccgccactcgccgtggacccacgcgggcggctggcgactgaacggccgcgacgtgcgcacgttgcacttccaaggcggcggccacaagctcgaggccgtgctgaagggcaacgccagcgacaccagcaagaacacgctgatctacgccgaccaggccgcgccgttcgcgtacacgttcaatgccgacgatatccgcgtcgaccttggcacgcgccgcacgcacggccaggtgcacgtggaaggcgacacgttccacgtcttccacgacggccgccatacggtgctggagtggctcgacccgcttgcgcacgccagcgagagtgaaggcgaaggcggcaagctgaccgcgccgatgccgggcaaggtgatcgccgtgatggtcgaggccggcagcaaggtcacgcgcggcacgccgctgctggtgatggaagcgatgaagatggaacacacgatcgccgcgccggccgatggcgtggtgagcgaggtgctctacggcgtgggcgaacaggtgagcgagggcgcgcaactgctg

SEQ ID NO: 32222 - DNA, 1335 bp, Ralstonia metallidurans
gctgcagccgcatccaccgcgcggcgcaccaatgtccgttactggattctcgcgctgattttcatcgtgaccacggtcaactacgcggatcgtgccacgctgtcgattaccgggcccgcgatgcgcgaggaattcggtttctcggccgtccagatgggctatatcttctcggccttcagttggtcgtacgtgatggcgcagattcctggcggctggctactcgatcgctttggcgcccggcgcatctatgccgtgagcatcttcctctggtcattcttcacgctgctgcaggggtgggtcggcatcttcgcctcgatgggagcaacgatgacggcgctcttcatgctgcgtttcgccgtgggcctggccgagtccccggcattcccggccaatgcaaaggtggtggcaagctggttcccgaccgccgagcgcggcaccgcgtcggccatcttcaacgccgcgcagtacttcgccgccgtggtgttcacgccgctgatggcatggatcgttcacagcatgggctggcatcacgtctacctgtggatgggcatcatgggcatgctgctggcgatgctctggctcaaggtcatgcgcagcccggtcacgcatccggctgtgaatcgcgcggaacttgagcacatcgagcagggcggtggcctgattcacatgaatgaaggggcaggcaagtcaaagcagggcgctaatcccgctggctggttctatgcccggcagttgctgtcgaaccggatgctggccggggtctatctgggccagtactgcatcaacgtgctgacgtacttcttcctcacgtggtttccggtgtacctggtgcaagcgcgcggcatgtcgatcctgaaggcgggtttcgtcgcgtccctgccggccatctgcggttttctcggcggcgtgctgggcggcgtgatctccgaccacttgctgcgccgcggctactcactgaccatcgcccgcaaggtgccgatcgtggcgggcatgttgctgtcggtgtccatgatcgcctgcaactacgtggatgccgaatggctggtggtgggcatcatggcgctcgcgttcttcggcaagggcatcggcgcgctgggctgggccgtggtggctgacactgcgcccaaggaagtgatcggcctggcgggcagcatcttcaacacgttcggcaatatcgccggcattgtgacgccgatcgtgatcggctatatcctgagcgcgacaggctcgttcaacggcgcgctggtgttcgtgggtatcaatgccctggtcaccgtgctgagctatctggtgatcgtcaaggacattcgccgcgtcgagctgaagcacccccaa

SEQ ID NO: 32223 - DNA, 903 bp, Ralstonia metallidurans
ccgcaagaactcaagcagatcatctcggaaggcctgctctctttccctatcaccgatttcgacgcgcaaggcaacttccgccccgatacctatatcgagcgcctggaatggctggcgccctacggtgcgtcggcgctgtttgccgccggcggcacgggtgagttcttctcgctgacgcagcaggactattcgaacgtgattcgcaccgcggtggagacctgccggggcaaggtacccattcttgccggcgccggtggcgcgactcgcgtggcgatcgaatacgcgaaggaagccgagcgcctgggcgcccacggcgtgctgctgatgccgcactacctgaccgaagccagcgaagaaggcatcgccaaccacatcgaagaggtttgcaaggcgctgaaaatcggcgtgatcgtctacaaccgcgcgaactcccgtatcggcgccgacctgctggaacgcgtggtcgaccgctgccccaacctgatcggcttcaaggacggcgtgggcgagatcgaggcgatggtgcgcgttcgccgcaagcttggtgaccggctcgcatacctgggcggcctgcctaccgccgaagtctatgccgccgcctacaaggcgctgggcgtgcccgtctactcgtcggccgtgttcaacttcatcccgaagaccgcgatggagttttaccgcgcgattgccgctgacgaccacgccacggtgggtcgcctgatcgacgatttcttcctgccgtacctggacatccgcaaccgcaaacaaggctacgcggtgtcgatcgtcaaggctggcgccaagctggttggccacgatgccggtccggtgcgcgcgccgctgaccgatctgaccgaagacgaaatggcacggctggatgcgctgatccgcaagctcggaccgcag

SEQ ID NO: 32224 - DNA, 1248 bp, Ralstonia metallidurans
acccgctccctgttcggtcaggtgctgatcgcgctggtgatcggcaccctgctcgggctgtttttccccgagttcgccgccaagctcaagccgctgggcgatgccttcatcaagctgatcaagatgctgatcggccccatcgtgttctgcgtggtcgtggcgggcatctgcggcgccggggagctgaagaaggtcgggcgcgtcggcatcaaggccgtggtctatttcgaggtggtcacgaccatcgcgctggcgctgggcgtggtgctggcctacgtgttccatccgggcaccggcatgaacgtgaatccgcgttcgctggatatctcagccatgtcggcctacatcgaatccgccgacaaggtgaagagcgcgggcatggtcgatttcctgctcaagctgattccgaacacgatcatgggcgcattctccagtggagacgtgctgcaggtgctgctggtctcaatcctgttcggctgcgcgctgtccgtcgtgggcgaatccggccggccgctggtcaagctgatcgacacgttctcgcacacgctgttcaagatgatgggcttcatcatcaagctggcgccgctgggcgtgctgggcgcggtggcgttcaccgtgggcaagtacggcatcggctcgctcaagcagctcgggttcctggtgatcctgttctacggcgcggtggtgatcttcgtggtcggcgtgctggggctgatcatgcggctgtgcggcttctcggtgctgaagctgattcgttacctgcgtgccgaattgctggtggtgctcggcacagcgtcgtccgacagcgtgctgccgcaggtgatgaagaagctcgagtacatgggcatccgcaagtcggtggtcggcctggtgattcccaccggctactcattcaacctcgatgcattctcgatctacctgacgcttgccgcggtgttcatcgcgcaggccaccaacacgccgctggcgctgggcgacctgctcggcatcctggccgtggcactggtcacgtcgaagggcgcgcatggcattcccggttcggcgatcgtgatcctggccgcgacactctccgcccatccggcgatccccgccatcggcctggtgctggtgctgtcggtggattggttcatcggtatcgcccgcgcggtgggcaacctgattggcaactgcgtagccacggtagtggtggccgcctgggagcacgacatcgaccgcgaacgggcccacggcgtgctcaatggcacgatc

SEQ ID NO: 32225 - DNA, 945 bp, Ralstonia metallidurans
actgtcatgcaagttcaacgtaacgtttaccgcgaagatcacgagatgttccgcgaaaccgcccgccgcttcctggagcgcgagtgcctgcccaagcagggggcatgggacaaggccggcaaggtggatcgcgaaacctggctcaaggccggtcgcgaaggtctgctgtgcgtgacgctgcccacagagtacggtggtggtggcggtgacttcggccactcggccgtgttcaacgaagaactggcgcgcgtcggtgtcagcggcctgggcttcggcgtgcattcggacatcatcgccccgtacatcgcacgcatcgccaacgaagagcagaagcaacgctggctgccgaaggtgtgttcgggcgaggccattctcgccatcggcatgaccgaaccgggcaccggcagcgacctgaaggccgtacgcaccaccgccattcgcgacggcgacgagtacgtgatcaacggcagcaagaccttcatctcgaacggcctgaactgcgacctgatcatcatggtctgcaagaccgatccggcggccggttcgcgcggtgtgagcctgatcatggtggaagccgaccgagagggtttccgccgtgggcgcaagctggagaaagtcggccagcacgcccaggacacggccgagctgttcttcgacaacgtgcgggtgccggtgtcgaacctgctgggagaggaaggcaagggcttcgcctacctgatgggcgaactgccgcaggagcgcctgtcgatcgccgtcagcgctgccgccaagctcgaggcgtgcctcgatcacacgatcgcctacgtgaaggagcgcaaggccttcaaccagaccgtctgggatttccagaacaccaagttcaagctcgcagacatcaaggcacaggccgttgccgtgcgcgtgatggtggactactacctcagcgaacatatccgccgtcgcctc

SEQ ID NO: 32226 - DNA, 1443 bp, Ralstonia metallidurans
ccaacacccgacaacgacaaggagacacgcgtgaagacactcgacaggttctacatcgacggccaatgggtcacgccagccgccgcagcccgcagcatgcccatcgtcaacccggccacggaagaggttgccggtcacgtcacgctgggcagcgcggaagacgtcaaccgcgccgtggccgcggcacgtgcagcgttcccggcatggtccgagaccagccgtgaagaacgtctggcgctgctggaacggatcaccgcgttgtacaaggcacgcctgggcgacttcgctgaggcggtgcgcaccgagatcggcgcgccggtcagcctctgcaatacgctgcaggccccgatcggactcgcccatctgggcgccgccaccgaaacgctgcgcgccttccagttcgaaaccgcccacggcaacaactacgtgcgccatgaaccgatcggcgtggctgcgctgatcacggcctggaactggccgctgagcctgatctgcgccaaggtggccgccgcgctggccgccggctgcaccatcgtcctcaagccatccgaaatcgcgccgctcgacgcggccctgttcgccgaggtgatgcacgaggcaggcacccctgccggcgtattcaacatggtgttcggcgatggtcaggaagtgggcgcgcggcttgccgcccaccccgacgtggatgtgatctcgatcaccggctccacccgcgcgggtattgccgtggcgcaggccgcagccgccacggtcaagcgcgtgcaccaggagcttggcggcaagtcgccgctgctgattctggacgacgccgacctgcaggccgccgttgcccaaggcgtcggccacgtcatgctgaactccgggcagacctgcatcgcgcccacccggatgctggtgccgcgcgatcgctatgacgaagccgtgcgcgtggcggccgccaccgccaatgcgttgcaggtcggcgaccccgccgagccgggcacgcgcatcggtcccatctccaacaaggcgcagtacgaaaaggtccagcgcatgatcggcaccggcatcgaggaaggcgcccgcgtcgtggcgggtggaccgggccggccggacgggttgacccgtggtttctatgcgcggccgaccatcttcgccgacgtcgacaacagcatgacgatcgcgcgcgaggagatcttcggaccggtgctggtcatgattccgtacgacgacgaagcacagggggtcgacatcgccaatgacacgccatacgggctcgccgcgtatgtggcatcgggcgaccctgcccgcgcgcggcgcgtagcggcgcgtcttcgtgccggttcggtccgcatcaacggcggccaggtcgacctgtcgatgccgttcggtgggtaccgcgcatccggcaatggccgtgagaacggcgcgcacgggctggccgagtatctcgaagtcaaggccgtg

SEQ ID NO: 32227 - DNA, 1612 bp, Ralstonia metallidurans
atcgtcgtcggcgcaggatcgccggtgcgccgtcgcggcgcggctggcagaggatgccggcgtgaccgtggcctgcttgaagctggccgagcgacctcacttcgcgtctggacgccggtgcctcgccgcggtcgtcccgaaagccgtccgcgcactacgcctatcgctccgtgccgcagccggggctcacggccggcgctcctaccagccgcgcgggccgcggtttgggcggcagctcgtcgatcaatggcatggtctatatccgtggccaccgcaaggactacgacacctgggcgcaactgggctgccaggctggggctatgaggatgtgctcccctacttccgtcgcagcgaaaccaaccatgcgctcgatgaccggcaccacggcaaggacggcccgctgcacgtcaacgagctgcgcacgcccaacccgttttccgcgcgcttcatcgaggccgcgatgcaggccggcatcccgttcaaccgcgacttcaacggcgccgaacaggacggcgccggctattaccaggtaacacagcgcaacggcgagcgctggaacagcgcgcgcgcctacctgcaccatggcgatgccaacgatggcaccttcagcggcggccgccgcaacctgacggtctggacggacacgcaggtgcagcgcatcgtgttcgagggtcgccgcgcggtcggcgtcagcatcacgcgcgccggcgtcacacaggtgctacgcgcgcgccgcgaagtgatcgtcagcggcggcgccttcaactcgccgcagcttctgctcgcgtccggtatcggccctgctgcccatctgcgcgatctcggcatcgacgtcgtacacgacctgcccggcgtgggcgaaaacctgcaggaccaccttgacatcgctgtgtgccatcaggtgccgtcgccgcagcttttcggatactcgctgcgcggcgcggccaagatgctgggccagtggcgccagtatcgacgcgaccgcaccggcatgttcagctccaatcttgccgaagcaggcgccttcctgcgcagccggcgggaactggccgagcccgacctgcagttccacttcgtgccggggctttcctcgacgcataccggcatgcgacgccgcgacctcaagcatggcttcaccggcctggcctgcctgctgcgccccgaaagccgcggccacgtgcggctgaacagtgccgatacccgcgacgcgccgctgatcgatccgcgcttcctttccgccgaatcggacatggcaggcatggtcgcctgcttccgcctgatgcgccgcatcctggcgcagccggcactggcttccgcgcaaggccgtgaactgctcaccgaggagatcggccccggcgacggcgacgaagccgccatccgcgcctatgtgcgccgtcatgcggattcggtcttccacgctatcggaacttgcaagatgggcgtggatgcaatggccgtggtcgacccgtccctgcgtgtgcacggcgtggaaggcttgcgcgtggtcgacgcctcgatcatgccgacgctgatcggcggcaacaccaacgcacctgccatgatgatcggcgagaaggccgcggacctgatccgctcgggcgcctgatgacca

SEQ ID NO: 32228 - DNA, 1275 bp, Ralstonia metallidurans
caacatcaaggcctgctgcgtttcatcaccgcgggctccgtggacgacggcaagagcacgctgatcggccgtctgttgtttgacagcaaggcagtgctgtccgaccagctcaccgcgctggccaacgccaagaacaagcgcaccgctggcgagcagatcgacttctcgctgctgaccgacggcctcgaggccgagcgagagcagggcatcacgatcgacgtggcttaccgctatttctcgaccgcgcgccgcaagttcatcattgccgatacgccgggccacgagcagtacacgcgcaacatggtgacgggcgcctcgactgcgcacgccgccatcgtgctggtggatgccacccgcgtcacggtcaaggacggccgcgccgagctgctggcccagaccaagcgtcactcggcaatcctgaagttgctggaactgcagcacgtgatcgtcgccgtgaacaagatggacctggttgactacagcgagcagcgcttcaacgagatccgcgccgactacatcgaactggccgcgcaactgggcctgcaggatgtgacctacgtgccggtgtcggcactgcgtggcgacaacatcgtccatgccagcgacgccatgccgtggtaacagagcgagccgctgctgccgctgctggaatcgctgccggtggaagatgtggcgccggtaggcgatgccgcgctgcgcttcccggtgcaactggtggttcgccaggacggttccgccgccgacgacttccgtggctacgctggccgtgtggaagccggcaccgtgcgcgtgggccagaagctgcgcgtgctgcccgccaatcgcgaagccgtggtggccgaagtgctgacgccgaatggatcggccgattccgccagcgccggcgacaccgtcacggtgcgtctggccgaagacgttgatgtatcgcgtggtgacatgttcgtgtcggccgataccgccgccgaatcggcgaagaagctgactgccgacctgtgctggttcgacgatgagtcgctgaatccgtcgcgcaagtacgtgctcaagcacactacggccagcgtgttcgcgcgcgtgtcggcggtggatcgcgtgctggatgtgcatacgctgtcgcacgaaaccggccgccatgagatcaacctgaacgacatcggttcggtgcagatctcgctgcagaagccgatcgtctgcgatacatacggcgacaatccggcgacgggcgcgttcgtgctgatcgacgaagccaccaaccacacggtggcggcgggcatgatc

SEQ ID NO: 32229 - DNA, 891 bp, Ralstonia metallidurans
aagcattacctccagttcagcgatctcagtgccgacgagtacgagtacctgctggaccgcgcgcggatcctcaaggcgaagttcaagaactacgaaacgtggcacccgttgcatgaccgcacgctggccatgatcttcgagaagaattccacgcgcacgcgcctgtcgttcgaagccggcatccaccagctcggcggtcacgcggtgttcctgaacacccgcgattcgcaactgggccgtggcgagccgatcgaggatgccgcccaggtgatctcgcgcatggtcgacatcatcatgatccgcacgttcggacaggaaatcatcgaccgcttcgccaagcactcgcgcgtgccggtgatcaacgggctcaccaacgaataccacccgtgccaggtactggccgacgtgttcacgtacatcgaacagcgcggcaccatcgccggcaagaccgtggcgtggatcggcgatgccaacaacatggcctacacctggatccaggccgccgagcgccttgatttcacgttccatttctcggcgcctccgggctatcagctcgatccggcgatggtgccggactgggccgcatcgcgcgtgaaggtgttcgataatccgctcgacgcctgccagggcgcgcatctggtcaccaccgatgtgtggaccagcatgggcttcgaggccgagaacgatgcgcgcaagcgtgcattcaaggattggatggtgacgaccgcgatgatggatcgcgccgcggacgacgccctgttcatgcactgcctgcccgcgcaccgtggcgaggaagtggaagcggcggtgatcgacggcccgcgtagcgtggtgtgggaagaagccgagaaccgtctgcacgtgcagaaggcgctgatggaatacctgctc

SEQ ID NO: 32230 - DNA, 1899 bp, Ralstonia metallidurans
attcgcccgctgccggaccagctgatcagccagatcgccgccggtgaagtggtggaacggcccgcgtcggtcgtcaaggaactgctcgagaacgcactcgacgccggcgccacgcaactgggtatccggctcgaggaaggcggcgtgagacgcatcgtcatcaccgacaacggctgcggcatccccgccgacgaactacccgtcgcgctgatgcgccacgccaccagcaagatcgcctcgctggacgaactcgaatcggtcctgacactgggcttccgcggcgaggcgctggcctcgattgcctcggtctcccatctcgtgctgaccagccgcacggccaccgccacgcacgccacccagatcagcgcggacaccggccatctgcaacccgcttcaggcggagttggcacgatgatcgacgtgcagcacctgtacttcaacacgccagcccgtagaaagttcctgaaatcggaacaaaccgagctggggcattgcctggagatgatccgccgcgccgcgctggcacggcccgacgtcacgatttcggtgcatcacaacggcaagccgctggagcactggaatgccggcgacgtggccacgcgcacggcgcaggtgctcggcagcgacttcgcacgcgcccgcctgccgctcgacgaacaggccgacgcgctgcacctctatggctttgccgggctacccactgcatcgcgaggccggcctgaccagcagtatttcttcgtcaatggccgtttcgtgcgcgacaagctgctcaaccatgccgtgcgcagcgcctatcaggacgtgctgcatggggaccgattcccatcgtatgtgatctgcctggacctgccgcccgaactggtcgacgtgaacgttcacccgtccaagatcgaggttcgcttccgcgaatcgcgtgcggtgcaccagttcgtctatcacgcagtgcagcgatgccttgcacgccaggccggcgagcaaggcgacagcctgcattcggagatcgccgatgaggcaggacggccttcgatgcctgcggcccgcccagtcggcgcgccgggtgcgccgggagccgcgccgcagtgggtcaattattcggcaggccgccagaccgagcttggtatcgcacagccgcgccaagcctatctgggcatggtccgcgacgccgccgggcaaggtagcgcgcggccctggcaaccgtcgccgcagccgcccgcatggctggccgacgcacaggcggcacgcgcagacgaaccgccgggcctgctcgaccgattaccgcagcaaccgctgcagccttccaccctgcccgcggcaggcgaaggcgacgatgatcatccgctcggttacgcagtggcgcagttgcacggcatctatgtgctagcgcagaacgcccgggggctggtgctggtcgatatgcacgcggcgcacgagcgcatcctgtacgaacagatcaagaccgcccttgaggcgcgcgaactggcggtgcagccgctactgattccggtcacgctgccggccagtccggtggaaatcggcgcggccgaagaacaccaggaaacgctgcaactgctcggcttcgacatcaagcccgtatcccccacgacgctcgccgtgcgcgcgattcccgcgctgctcaagcaggccgataccgaagccttggcacgcgacgtgctgcgcgacctgcaggcctacggaggctcgcgcgtgctggccgagcgccagaatgaattgctggccacgttggcttgccacagcgccgtgcgcgccaatcgcaagctgaccgtagaagagatgaacgccttgctgcgccagatggagcagaccgagcgcgccgaccagtgcaaccacggccgcccgacatgggtgcagttgacggttgcggaactcgaccgcctgttc

SEQ ID NO: 32231 - DNA, 495 bp, Ralstonia metallidurans
cctgcttgccgcccgccccagatgaccacgttcaccatccgccccgccgcccccgccgatagcgagaccctgtacaacctgatttcggcgctggccgaatacgagaagctcacgcatctggtggaagccacgccgcagaagctctgcgatgcgctgttcggcgcgcatccgggcgccgaggttgtgattctcgaagtggatacggaaagcggcaagctgccggtcggcttcgcgcttttcttccacaacttctcgacattcctggccaagccggggctctacctggaagacctgttcgtcgacccggcatggcgcgggcacgggctgggcaaggccctgctcaagcacttggcggcgctggccgtggagcgcggctgcggccgcttcgaatggtcggtgctcgactggaaccagccgtcgatcgatttctaccgcgcgatgggtgccgacgtgatgccggactggcgcatctgccgcgtgacgggcgatgcgctg

SEQ ID NO: 32232 - DNA, 1014 bp, Ralstonia metallidurans
ctttcctaccgcgatgccggtgttgacatcgaagccggcgacgcgctggttgatcgaatcaagccgtttgccaagcgcaccatgcgcgaaggcgtgatggccggcatcggcggtttcggcgcgctgttcgagctgtcgaagaagtaccaagaaccggtcctggtttctggcaccgacggcgtgggcaccaagctcaagctggcgttccagctcaaccgccatgacacggtgggccaggatctggtggcaatgagcgtcaacgacatcctcgtgcagggtgccgagccgctgttcttcctcgactactttgcctgcggcaagctggatgtggaaaccgcggccaccgtgatcaagggcatcgcccacggctgcgaactggctggctgcgcgctgatcggcggcgaaaccgctgaaatgccgagcatgtacccggacggcgaatacgacctggccggtttcgcggtcggcgccgtggaaaagaagaagatcatcgacggcagcacgatcaccccgggtgacgtggtgctgggcctggcttcgtcgggcgcgcattcgaacggctactcgctggtgcgcaagatcattgacgtggcccgcccgaacctggacgcggacttccacggccagcgcctgcaggacgccatcatggcgccgacgcgcatctacgtgaagccgctgctgtcgctgatcgaaacgctgccggtcaagggcatggcccacatcactggtggcggcctgaccgagaacgtgccgcgcgtgctggccgacaacgtcaccgccgtgatccagcgcgacgcctggacgctgccgccgctgttccagtggctgcaggcagaaggccgcgtggccgacgccgaaatgcaccgcgtgttcaactgcggtatcggcatggtcgtgattgtggcgaaggaagacgctgaacgcgccatccgccacctgcaggcggccggtgaggccgtgtggcagatcggtgagatccgcgagcgtgccgaaggccaggcgcagaccgtggtg

SEQ ID NO: 32233 - DNA, 747 bp, Ralstonia metallidurans
attcagggcaacgtattcattgtcacgggcggcgcatccgggctcggcgcgggcacggcgcgcatgctggcggctgcgggcggcaaggtcgtgattgccgacctcaacgaagccgcgggcacggcgctggccacggagctcggcgggcagttcgtcaaatgcgacgtggcgtcggaggccgacggtcaggcggccgtggatgccgcgcggaagcttggccggctctccgggctggtcaactgcgcgggtatcgccgtggccgccaagacggtcggcaagaacggaccgcatccgctcgatgcgttcgagaagaccatccgcgtcaacctgatcggcaccttcaacatgattcgcctcgccgccgcggagatggtccagaacactcccgatgccgaaggcgaacgcggcgtgatcatcaatacggcctcggtggccgcgttcgatggccagatcggccaggctgcgtatgcggcatcgaagggcggcgtggtgggcatgacgctggccatcgcgcgcgatctttcccgcgacggcgtgcgctgcctgaccatcgccccggggttgttcgaaacaccgatgctgctcgggatgccgccagaggtgcaagaggcgctcggcaagatggtgccgttcccgccgcgcctgggccgccccgcggagtacgccaagctggtccagtcgatcatcggcaatacgatgttgaatggcgaagtgatccgcctggatggtgcaatccgcatgcagccg

SEQ ID NO: 32234 - DNA, 975 bp, Ralstonia metallidurans
atggcaaaagtcgtgcgcatgtatgagaccggcggacccgaggtccttcgctacgaagacatggaagtgggtgatccgggcccgggacaggtgcgcattcgccacgtggcggttggcctgaactacgcggatacatacttccgcaatggtacctatccggtaccgcttcccgcgggcatgggcgtggaagcctccggtgtggtgcaggccatcggcccggacgtgaccaacgtcgctgtcggcgatcgcgtgacgtacaccggcttcctgaacacgctgggcgcctacagcaccgagcgtctggtgccggccgcgccgctgatccgcctgccggagaacatcggcttcgagaccgccgccgcaatgacgatgcgcggcctgacctccgcctacctgatgcgccgcatctacgcgttcaagcgcggcgatacgattctgctgcacgctgcggcaggcggcgtcggtctgatcgtgtcccagtgggccaagctgcagggccttaacgtgatcggcaccgtgtcgtccgaggccaaggccgaggtggcacgcgcgcatggttgcgatcacatcatcaactacagccacgaggacgtggccaagcgcgtgcgcgaactgaccgatggcgtgggcgccacggtggtgttcgatagcgtcggcaagaacacgttcatggcgtcgctcgattcgctcaagcgccgtgggctgctggtctgcgtgggcaccgcgtcgggcccgatcccgccgttcgatcccgtactgctggccatgaagggctcggtctacgtgacgcgtccggcattggccgactacatcgcggacccgggcgaaaaggcggaactggccggagaactgttcgaccacgtgggtgccggccgcatccgtatcgagatcaaccagcgctacgcactggaagacgccgtgcaggctcaccgcgacctggaatcgcgcaagaccaccggttcgtcgattttcgtc

SEQ ID NO: 32235 - DNA, 1590 bp, Ralstonia metallidurans
tacccgttgctgatcaagcagctcctgatcaacgccatgagcctgtatggcgaccaggagatcagctaccgcggcgagctgcgctacacctatcgcgaattccgcgagcgcgtgggaaagctggccaattcgctttcggctctcggtgtgcatcacggctccacagtggccgtgatggactgggacagccaccgctacctggagtgctatttcggcgtgccgatgatgggcgctacgctcttcacggtcaacgttcgcctgtcgccgcagcagatcctgtacacgctgaatgacgcgggcgctgacgtcgtgctggtgcatccggacttcgtgcccgtgatcgaccagatccgggacaagctcacgtgcaagccacgcttcgtgctgatggcagacggacagaccgtgcccgacacggctatcccgttcgccggcgagtacgaggcactggtcggcgccgcctcgccggagttcgagtttccggagtttgacgagcgcacgaaggccgccacgttctatacgacaggcaccacgggcgaccccaagggcgtgtgctacagccatcgcgacatcgtgctgcatacgctgaccgcgacggccagcctgtgctcgccgcgcgaaggccagcgtatgcatcgcgaggatgtgtatatgccgatcacgccgatgttccatgtgatggcgtggggcatcccgtatgttgcgatcacgctgggcctgcgcacggtcctgccgggccgctacgcgcccgaaatgctgctgaagctgcgcgcccaggaaaaggtgtcgttctcgcactgcgtgccgacaatcctgcagatgctgctgcacgccgcagaggcaggcggacaggacctgagcggctggaagatcatcatcggcggttcggcgctgccaccgtccttgtgcgaggccgcgctggagcggggcatcgacatctttgccggctacggcatgtccgaaaccgggccgatcgtggcgctggcgcagttgccgccgggataccagccggccagccgcgaggaagaagtccgcctgcgctgctcgacgggccggccggtgccgctggcagacttccgcgtcgtggggacggacatgcgggaactgccgcgcgacggccaaagccagggcgagatcgtgctgcgcgcgccatacctgacccgcagttacttccgcaagccgagtgcgtcggaagaactctgggccgacgggtacctgcacacgcaggacgtcgcggtcgtgcacgagaacggcttcgtgcagatcgtggatcgcctcaaggacgtcatcaagaccggtggcgagtgggtctcgtcgatcgagatcgagaacctggtcacgcgcgtgccaggcgtgcgggagtgcgccgtgattggcgtgcccgacgcgcgctggggcgagcggccgatggccttcgtggtgcggcaaccggattcggaagtgggcgccgaggacattcgcgcggagctgatgaaccatgtctcggcccagcgcctgagcaagttcgcggtacctgaagccgatcggatcgcctttgtggccgagattccgaagaccagcgttggcaaaattgacaagaagctgctacgg

SEQ ID NO: 32236 - DNA, 399 bp, Ralstonia metallidurans
atctatatcctgatgggcgtttccggcagcggcaagagcacggtcggccagatgctggcggaccgtcttcattgcggtttccacgacgcggacagcttccacagcgacgccaacaaggccaagatgcacgccggcatcccattgaccgatgacgaccgctggccctggctggacgcgatgcgggccgccatcgacgccgcccgcgccgagggccgcacccacgtgttcacatgttcggcgctgcgccaggtctatcgggaccgcctgctgccggccgacggcggcgtgaccttcgtgttcatgaagggcgacgcctcgacgatcggcagccgcctgtccgcgcgcaccgaccattttttcaatcccgcgctgctccagagccagttcgagaccctgagg

SEQ ID NO: 32237 - DNA, 489 bp, Ralstonia metallidurans
atcgtcagcgccgaggaagtccagaactcgctggaccgcatggcccacgacatcacggaaaagatgggcgacgcgtttccgctggtgctgtccgtgatgggcggcgccgtcgtcttcaccggcatgttgctgcccaagctgcagttcccgctggagttcgactacatccacctctcgcgctacaacaacaagacggttggcggcgagatgcaatggcgcgtggcgccgcgcgaatcggtcaaaggccgcgtggtgctggtgctcgacgacatcctcgacgaaggcgagacgatggctgccatccgccagcgcatcatggacatgggcgccaaggaatgccacgctgccgtactgtgcgaaaagacgctgaccaagatcaagccgatgcacccggacttctgtggcttccaggtacccgaccgctacgtctttggttgcggcatggacgtgaagggctactggcgtaacctgggcgcgatccgcgcgttg

SEQ ID NO: 32238 - DNA, 1398 bp, Ralstonia metallidurans
catatctatatcaacggagaattcgtcacgccgcacggcgacgaatggttcgatctctacaacccgagcaccgaggaagtcatcggccaggtgcggctgggtgatgcgcaggacgcgcggcgcgccatcgcggcggcccaggcggcgttccccgcctggtcgcgcaccacacgcgaggagcgcatcgcagccctgcaccgtatgcaccgggccgtggcagcgcgtgaagacgagttgatggaagccatcctgctggagtacggcgcaccgcaggtgcgtggacgctggatggcaacctacccggccgatgtcattgctcaggcaatcgacacactggagtccttcgccttcgaagagcatgtaggctcggccaaggtgatccaggtacctgtcggcgttgccggcctgatcacaccatggaacagcaatgcgggcttcatctgcaacaagctggccaccgcgctagcggcaggctgcacggcggtcatcaagcccagcgagatgagcgcaatgcaaacccagatcgtggcccaggcgctacacgaagccagcctgcccccgggggtgttcaatatcgtcaacggccgaggcgagatcgtcggcgaggagattgcgcgcaatcctggcgtcgccaagatctcgtttaccggctcatccgcagtcggccagcatctggtggtcaccggtgcggagaccatgaagcgcgtgaccctggaactgggtggcaagtcgcccacgatcgtgctgcccgacgcagactttgccaccgtcatgccgctggtactgcaggccggttttgccaatagcggccaggcttgcattgccgggacgcgtatcctcgtgccgcgcaaccgcctgaccgaattcgagcacatcgcaaaggaggcggtatcgcatgtccgatccggagatccacgcgataccgacaccgacatcggcccaatggtgagccagaagcaatgggaacgggtgcagaactacatccgtatcggacagcaggaaggtgcgacgctgctggccggtggcgaaggccggcccgatggcatgcatgccggatggttcgtgaagcccaccctcttcacgcatgccaacaatcagatgcgcatcgcgcgtgaggagatcttcggccccgtgctcacaatcatcccctacgacgatgaggccgatgcgatcgccattgccaacgacacgcgctatggcctgagtgccctggtgctgggcacgaatcttgaaagctgcgaacgtgtggcgcgccagatcgattcaggccgcgtgcttgtcaacaccttggcccacgagccgcgcgcaccgtttggcggcttcaagcattccgggctcgggcgagagatgggccgatggggcatgagcgcgtacctggagcccaagacgttgcttacc

SEQ ID NO: 32239 - DNA, 1356 bp, Ralstonia metallidurans
actgatgtggccatcatcggcgcgggcactgccggcctggccgcctaccgcgcggccattgccgccggcaagcgcgccgtgatcatcgagggcggggcgtatggcacgacctgcgcccgcgtgggctgcatgccgtcgaagctgctgattgccgcggcggaagccgcgcacgaagcgcgtcacactgctgcatttggcgtgcacgtggatggcccggtccgtatcgacggcagggaagtcatgcagcgcgtgcggagcgaacgcgaccgctttgtcggcttcgtggtgcgcggcgtggagagcattccccaggacgaccgcctgatcggccgggcgcggttcatcgacaacacgatcctccaggttgacgaccacaccgtcgtgcgcgcaagccgcgtggtaatcgccacgggctcgcgccccgccgtaccgccgtcctttggcgtgttcggcgatcgcctgatcgtcaatgacgatgtgttctcgtgggaagacctgccccaaagcgtggccgtgttcggcccgggcgtgattggtttggaactggggcaagcactgtcgcggcttggcgtgcgggtgcgcgtgtttggtgtcggtggcggcgtcggtccgttgtcggaccccgagattcgtgcttacgctgccaagtccttcaaccaggaattctcgctgttggcggatgcgcgcgtgcttgagatgcgccgcgagggcgacgacgccgttatcacgttcgaagacgccgacggccagaccgtgacggagcgctttgcctacgtgctggccgccacgggtcgccggcccaatgtcgatacgcttgcgctgggcaacaccgcgctggaactcgatgggcggggcgtaccgacgttcgacccggtgacgctccagtgcggtgaatcgccgatcttcatcgctggcgatgccaataacgtcctgccgctgctgcatgaggcggccgacgaaggcaagattgctggcgaaaacgctgcgctctggccgaaggtcgggccgctgacgcggcgcgcgccgatcgcggtggtgttctccgatccgcagatcgcgatggtcggcaagcgttttgccgaactgacaccgggcagcttcgtgactggcgaggtcagcttcgaggatcagggccgcagccgtgtgatgctcaagaaccgtgggctgatgcacgtctacgcggatcgcgccacaggccgctttattggcgctgagtggattggcccgcgcgccgagaatatcgcgcatctgctggcgtggtcgtaccaacaggggctgacgatcgccgcgatgctggccatgcctttctaccatcccgttgtggaagagggcttgcgcacggcgctgcgtgatgcg

SEQ ID NO: 32240 - DNA, 228 bp, Ralstonia metallidurans
ttcgaccaggcccagattgacgtcaagacgctgagcgagcgtcccaacaacatgacgctgctgcgtctgtacgcgttgtacaagcaaggcgctgaaggcgatgcccacggcgacaagccgggcatgaccgacttcgtgggccgctacaagttcgaggcctgggaagccctcaaaggcaccggccgcgaggaagcgatgcagaagtacattgaactcgtgaccgacctg

SEQ ID NO: 32241 - DNA, 804 bp, Ralstonia metallidurans
cagcagcagttcgtcgactggctgcgatcggtcgcgccctatatccatgccttccgcggcaagacgttcgtaatcgccttcagcggcgaactggtcaaggccggggtgctcaacggactggtcaatgacgtggcgctgctgcacgcgatgggcatgcagatcgtgctggtgttcggatcccgaccgcaggtggaagaacagctcgcgctgcgcaatgtccagtcgcagtacgcggaaggcatccgaatcaccgacaatgccgcgctggaatgcgccaaggaagccgccggcgagttgcgcctcgacattgaggccgcgttcagccagggactgccgaacacgccgatggctggcgcccagctttccgtggtgtcgggcaacttcatcaccgcgcgcccggtgggcatcgtcaatggcgtggactatcagcacaccggtctggtccgcaagatcgacggcgactcgatgcgcatgtcgctatcgcacggcaaggtggtgctgctgtcgccgctcggcttctcgccgaccggccaggcattcaacctgtcaatggaggacgtggccagcgccacggccagcgcgctcaaggcggacaagctgatcttcatcaccgaggtacccggcgtgcccgaccaggtgggcaagctgatgaaggaaatgtcgctgcgcaccgccgtggaacggctgcagaacaaccacctgccacccgacgtcgcgtactacctccagcatctggtcaaagcgctcaagggcggcgtgccgcgcgcgcacctgatcccgttctcgctggacggttcggtgctg

SEQ ID NO: 32242 - DNA, 1319 bp, Ralstonia metallidurans
cacgtattccaccgcaatccgaagcaaaccttgccggtcgccgttggcggccagggtatcgaactgatcgacagcaatggccggcgctacctcgacgcttcgggcggcgcggcggtttcctgtctcggtcatggccacccgcgcgtgatcgaagcgatcaaggcgcaggtggacaccattgcctacgcgcatacgtcgttctttaccaccgaggtgtccgagacgctggcccagacgctggccgatgcggcccccggagatctcgatcatgtgtacttcgtgtccggcggctccgaggcggtggaagccgcgctgaagctggcgcgccagtacttcgtggagatcggccagacgcagcgccgccacttcatcgcgcggcgccagagctatcacggcaatacgctcggcgcgctggcgatcggcggcaacgcgtggcggcgcgagccgttcctgccgctgctggtgccggcgcaccatgtgtcgccgtgctatgcctaccgagatcaggcggccggcgaagccgacacgcagtacgcgcagcgtctggccgacgaacttgaagcaaagatcctcgaactcggccccgactcggtggccggcttcgtcgccgagacggtggtcggcgctaccgcaggggcggtgccgccggtggccgattacctgaagcgtatccgcgctgtgtgcgacaagtacggcgtgctgctgatcctcgatgaagtgatgtcgggcatgggccggacgggttacctgttcgcgtgcgaagaggacggcgtggtgcccgacatcgtgacgatcgcgaagggcctcggcgctggttaccagccgatcggcgcaatgctctcgacgtcgcgcatctatgacgcgatcatcggtggcagcggtttcttccagcacggccacacctatatcggtcatgcgacggcctgcgcggcagcgctggccgtgcagcgcacgattgtcgaggacaagttgctggacaacgtgctggcgcgtggcgaacagttgcgcgcgcgcctgcgcgaatcgctcggcgaccatccgaacctggcgacgtgcggggccgtggactgttcgtcggcgtggagttcgtggccgatcgcgccaccaaggccacgctcgacccggcgaagaagacgcacgccgtgctcaagcgcacctgcatggagcatggcgtgctggtttatccgatgggcggcacggtcgatggcatccacggtgaccacgtgctgtttgcgccgccgtttatctgcacgcccaccgacatcgacaacatcgtagaccgcttcacgcaggccgtgaaaacggtactgccggcttga

SEQ ID NO: 32243 - DNA, 735 bp, Ralstonia metallidurans
tcgcagggggaatcacaaaaggccgccatcgttaccggcgcatcacgcggcatcggcgccgccatttcggcgcggctggcccgcgacggcttcgcggtcgtcatcaactatgcgaacggcgcggacaccgccggggatctgcgtcgcaagctcgaagcaagtggcggccgggccatgaccttccaggccgatgtcagcgatgccagcgcggtggcccgcatgttcgatgcagccgaggcaacgttcgacggcgtcgacgttgtcgtcaacaacgcgggcgtgatggtgctcgacacaattgcagcgtctgacgacgcagcattcgagcgcgtgatgaacatcaatctgaaaggggctttccacaccatgcgcgaggctgcccgccgcctgcgccatggcggccggatcatcaatctctcgtccagcgtcattggtttgcgcatggagcgctatggcatctacgcggcctcgaaggcggccgtggaagcgatgaccgccgtattgagcaaggagatgcgcggccgcgccattaccgtcaatgcggtggcacccgggccgaccgccaccgacctgttcctcgacggcaaatcacctgaaacgatcgaacggctcgcgaagctcaatccgctcgaacgactgggcacacctgaagatatagcggcagcggtggcattcctggccagacccgatggagcctggatcaatggccaggtgttacgcgcgaatgccggaatg

SEQ ID NO: 32244 - DNA, 708 bp, Ralstonia metallidurans
atcctcgtcgtcggcgccggcgacgccaccgggggcgccatcgcccgccgctttgcccacgagggttatgtcgcctgcgtcacccgacgcgatgtcgacaaactcgcgccactggtcgagcagattcgggccgaaggtggcgaagcccatgcctttggctgcgacgcgcgcaaggaagaagagacggttgccatgatcgagcgcatcgagcgcgatatcgggcaactggaagtcgcggtgttcaacatcggcgcgaacgtgaatttcccgattctggagaccacctcgcgcgtctacttcaaggtctgggagatggcctgcttcgcgggattcctgatgggccgcgaagccgcgcgcgtcatggtgccccggcagcgcgggtcgatcttcttcaccggcgccaccgcaagcacgcgcggccgcgagggcatgtcggcattctcgggcgcgaagcacgcgctgcgcgcgctggcgcaaagcatggcacgcgaacttggcccgaagaacctccacgtcgcccacctgatcatcgacgccgccatcgacaccgccttcatccgcgacaatttcccggaccgctacgccaccaggacacaggatggcatcgtcaatccggagcacatcgcggacacttactggatgctgcatcaacagccacgcgatgcctggacccacgaactcgatctgcgtccctggatcgaacactgg

SEQ ID NO: 32245 - DNA, 1206 bp, Ralstonia metallidurans
atgactgccgattccggcaagcgccgctttgcgcgcatcgatcgtcttcccccgtacgttttcaatatcaccgccgagctcaagatggccgcccgccgccgtggcgaggacatcatcgacatgagcatgggcaaccccgatggcgccacgccgccgcatatcgtggccaagctcgtcgacgccgcgcagcggccggacacgcacgggtattcggcgtcgaagggcatcccgcgcctgcgtcgcgcgatctcgcactggtaccgcgaacgctatgacgtcgatatcgatccggacaaggaggcgattgtcacgatcggctcgaaggaaggccttgcgcacctgatgctggccacgctggaccgtggcgacaccgtgctggtgcccgaccccagctacccgatccacatctatggcgcggtgatcgcgggggcagacatccgctcagtgccgctgacgccgggcatcgacttcttcgccgaactggaacgcgcgattcgtggcagctacccgaagccgaagatgatcgtgctgggtttcccgtccaatccgacggcggcctgcgtggagctcgatttcttcgaacgcgtgattgcgctggcgcgcaagcacgacatcttcgtggtgcacgacctggcttatgccgatatcgttttcgatggctggaaggcgccgtcgatcatgcaggtgccgggcgcgaaggacatcgcggtggagttcttcacgctgtccaagagctacaacatggcgggatggcggatcggcttcatggtcggcaatcccgaccttgtggccgcgctgacgcgtatcaagagctatcacgactatggcacgttcacaccgctgcaggtggcggcgatcgccgcgctcgagggcgaccaacagtgcgtgaaggaaattgccgcccagtatcagtcgcgccgcgacgtgctggcacgcgggctgatcgagtcgggctggccagtcgatattccaaaggcttcgatgtacatctgggcccgtatcccggaaccctatcgcgcgctcggctcgctagagtttgccaagcaactgttggccaaggccaaggtatcggtttcccccggtatcgggtttggtgactacggcgatgagtatgtgcgattcgcgctgatcgagaacgaatcgcgtatccgtcaggcggtgcgcgggatcaaggcgatgttccgcgcggatgggctggtgacggcg

SEQ ID NO: 32246 - DNA, 588 bp, Ralstonia metallidurans
cgcggaaaattcatcaccttcgagggcatcgatggcgcgggcaagagcacccatatcgagtgggtggccgagcgcctgcgcgcgcgcgcaaatgtcgtcactacccgggagccgggcggcacgccgctgggcgaagacctgcgccagttgctgctgcaccggaagatgcatcttgaaaccgaggcgctgctgatgttcgcggcgcgccgcgagcacatcgccgaagtcatcgagcccgcgctggcgcgcggcgactgggtcatctcggatcgtttcaccgatgccacgtttgcctatcagggcggtggccgcgggctggcgctcgatcggctggccacgctcgagcagtgggtgcagagcggtcttcagcccgacctgacgctgctgtttgacgttccgctggaaaccgcgagcgcacgtctggccggggcccgtgagcccgacaagtttgaggccgagtcccgcgccttcttcgaacgcacccgcactgagtatctgcgccgtgcggcggaagcgccacagcgctttcgggtcatcgacgcaacgcgctcgatcgacgagattcgtgtggcgcttgaagaaattatt

SEQ ID NO: 32247 - DNA, 1179 bp, Ralstonia metallidurans
cttggaacgcccctctccccgtccgccaccaaagtcatgctgctaggctcaggtgagctgggcaaggaagtgctgatcgcgctgcagcgcctgggcgtggagacgatcgccgtcgaccgctacgagaacgcgccgggccagcaggtggcccaccatgcgcgcacgatcacgatgagcgacggcgaacagctcaaggcactgatcgaagccgagcggccggatctggtggtgccagagatcgaagccatcgccacgccaatgctcgaagccctggaagcggccggcgtggttcgcgtgatccccacggctcgcgccgcccgcctgacgatggaccgcgaaggtatccgccgcctggccgccgagaccctgggcctgcccaccagcccgtacaaattctgcgattcgctcgaggaactgcaagccgcgatcgacggcggcatcggctacccgtgcgtggtcaagcccgtgatgagcagttccggcaagggccagagcaagatcgacggtcccgcggacgtcaaggccgcgtgggactatgccatggccggcggccgcgtcagccacggccgcgtgatcgtcgaaggctttatcgacttcgactacgaaatcacgctgctgaccgtgcgcgccgtgggcgccaatggcgaagtggaaacgcatttctgcgagccgatcggccacgtgcaggtcgcgggtgactacgtggaaagctggcaaccgcacccgatgcacccgaaggcactggaaacctcgcagcatatcgcgcgtgccgtgaccgccgatctgggcggccagggcctgttcggcgtggaactgttcgtcaagggcgagcaggtctggttcagcgaagtcagcccgcgtccgcacgacaccggcatggtgacgatgattacgcagtggcagaacgagttcgaactccacgcccgcgccatcctcggcctgcccgtcagcaccgcgctgcgcgcgcccggcgcgagcgccgtgatctacggcggcgttgaagccgaaggcattgttttcgatggcgtggacgaggcgctgcgcgtgccgcagacggaactgcgcctgttcggcaagccggagtcgttcacgaagcgccgcatgggcgtggcgctggcctacgccgaagacgtggatacggcacgcgagcgcgccaaggaagcggcgggcaaggtcaag

SEQ ID NO: 32248 - DNA, 879 bp, Ralstonia metallidurans
cccgaagctttcgatgcctttctgcagaccctgcggcgcttcgtgcgcgagaagctcgtgccgcgcgaggccgaggtggccgaacatgacgaggtggcgcaggatctggtcgacgccatggccgcgcagggcatgttcggctactcgattcccgaacagtacggcggcgccggcatgaccaccgaggagttggtgctggcggcgatggagttgtcgcagtgctcggtggcgtttcgggcgcgggtcggcaccaataccggcatcggctcagaagcgctggtggctgatggcacgcccgcgcagaagcagcactatctgccgctgctggccagcgggcagctcaccggatcgtttgcgctgaccgagcccgaggccggctccgacgccaccgcgctgcagaccacggccgtgcgcgacggcgatgcctacatcctcaacggcaccaagtgcttcattaccaatgcgccgattgctggcctgttcacggtcatggcacgtaccgatcccgccaatctgggcgcaggcggtatctcggccttcatcgtgccgcgcgagacaccggggctaagcacgggccggccgtaccagaagatgggccaggccggatcgccggtgtccgaggtgcatttcgacaactgccgcgtgccggcggtcaacctgatcggcggcgaggaaggcaagggcttccgcaccgcgatgaaggtgctcaacaagcagcgtatccatctggccgcgctgtgcaccgggcccgcgatccggatgctcgaagacgcggtgcgcttcgtcaccgagcgcaagcagttcgggcaggtgctggccgatttccagttggtgcaggccatgatcgccgactgccagaccgatatccacgcggcgcgg

SEQ ID NO: 32249 - DNA, 1104 bp, Ralstonia metallidurans
ctgcagcaaacctcggtctatgtcatcggcgtcggcctgcatccgtaccagttcgcgtcggataccccttatgtcagcctcggtctgcgtgcgatgcgcgaggcgctgtcggacgccggcatcgcctggcccgaggtgcagagcgcctacgtgggcacctcggcaatcggcatggcaacgggacgcgtgatgttccgccacctgggctctaccggcctggccgtgacacaggtggaaagcgcctcggcatcgggctgctcggcgttccgccaggcgtgcctggaagtggcaagcggcgtctcggacgtggtggtggcaatcggcgtcgacaagttcggcgatggccgcaaggcggccgacaaggacggcctgccgcaccttgcgcccaccgcgaccatgccgcccgtgaagttcgcgctgatggcgcatgaatacctgcgccagcacgggctgaagcccgaagcgatggcgcgcgtcgcggtaaagaaccatggcaacgctgcgctcaacccatatgcgcagttccgcaaggctcgtacgctcgagcaggtcatggcttcgcccaaggtggtgggtgacctgacggtgcagcagtgctgcccgcgtggcgatggcgccgcagccgtgatcgtggtgtccgaggccgcgatcaagcggctcggcctggacaagcgccgcgccgtgcgcgtgctggcatcggtggcgaacagcgaagaactggaacacggcgattcgtctgcagccgtcgacatggtgcgcaagtccaccgcgatggcgtacgagcaggccggcgtcggcccccgcgacctgaacctggtggagttgcacgaggccttttcgatcgaggaattggtctacaccgaagcgatggacctgtgcgcgcccggagaaggcgcggcatggctcgaacgcggcgcttccgccattggcggcgaatgcgcggtcaatgcttcgggtggcctgctcggcatgggccacccgaccggcccgaccggcatcgggcagatcgccgaaatcacgcgccagattcgcggcgaggcacacggacggcagcaccccggcgcacgcctggggctcgcccacatgatcgggctcggctcggtg

SEQ ID NO: 32250 - DNA, 1164 bp, Ralstonia metallidurans
atgcatttcccaaccggactattacaggagacatccatgtttttcgaagccacgccagagcagcgactgctgcgcgacaacattcgccgattcatgcaggcggaggttgctccgctgatcagccggcatgatcaggagaagacctttccgttcgagatcttgaaggggctggcgcagttcggctacatcggcgggcgcctgtcagaggaacagggcgggatggggctggaccagctcacttgggcgatgatgatggaagaggccggctatgcctggctttcgctgcgcaccatcctgaacatcactaacggcccgatcgccaagcttgccgcagtcggcacgccggaccagaagacccgtttcctcgatccgttgctggcctgcgagcgcaaggtgttcacagcgatcagcgagcctggcaccggttccaatatcgcgcagatccagacgcgcgccgacctgaagggcgaccactacgtgctcaacggccgcaagctctggatcaccaacggcgcgtttgccgacttcggcatcgtggtggcgcgcacctatagcgacaactgcgaaggccagctgtcgacgttcctggtggagcgcgaggtcagcccctacgaggtgcgtcgcgtggacaccatggtgctgcgcagtaccggcaccgccgagctcggtttcgacaacgtgcgtgtgccgcgcgagaacctgctcggcgaggaaggcggcgcgctcaagcgtatgctgcagggcctggatggcgcgcgcgtcaatatcgcgatgggcgctgtgggcgcggcgcagtgcgcgctcgatctggctacggactacgccaagacgcgcacgcagttcggtcgtgccatcggcagctttcagctcgtgcagaagatgatcgtggacatgacgatccgggtggaagccgctcgcgcgctcgggtatcgcgccgcgatggcactcgaccgtggcgaggacacgcgtgtctcagcgtcgatcgccaagctgtatgcgaccgaggccgcgcacgaagtagccagcatggcgctgcaggtgcatggcggtctgggttacgccaccgattatccgatcgaacgcatcttccgcgacacgcgcggcggcaccattcccgaggggaccacggaggtgcagaccttgatcgtcggtcgcgagattctg

SEQ ID NO: 32251 - DNA, 1149 bp, Ralstonia metallidurans
gtcctcgtgtgcggtgggctgctcgtgacgctctcgatgggcatccggcatggctttggcctgttcaacctgccgatcacacaaacccatggctggagccgggagaccttcgcctttgccctggcgctgcagaacctgatgtggggcgccagccagccgatcaccggtgcgctggccgacaagttcggcgccctgcgcatcatgatcatcggcgtggcgctctatgtggccgggctgatcgtcatgggactggccaccagcggcaccgcctttgccacgggcgccggggtgctgatcggcatcgcgcagtccggcaccacgtacagcgtggtctatggcgtgatcggccgcgtggccagcgcggagaagcgcgtctgggccatgggcatcgcagcagcggctgggtctttcggtcagttcctgatgattccggtggaacagacactgatttccaccatgggctggcaaaacgcgctattcatcctggcattcctcgcgtgcttcatgctgcctctggcactgacgctgcgggaaccgaaaatggtcgcgacgaccaccggccatcaccagaccatcggcgaagcgacgcgcgaggcgttcggcaaccgcaatttccagttgctgacgctcggctacttcgtctgcggcttccaggtggtgttcatcggcgtgcatctggccccttacctcaaggaccggggcttcaccgatcccaaggtcgccacggtggcgctggcgctgatcggcctgttcaatgtgttcggcacctatacggccgggtcgatgggccagcggatgcccaagcgctacctgctgtcgttcatctatatcgcgcgctcggtggtgatcgccggctacctgctgatgccgctgacggcggccagcacctgggtgttcgcggcgctgatgggcttcttgtggctgtcgaccgtaccgctgaccaacgggatcatcgcccaggtgtttggcgtgaagtacctgtcgatgctgtcgggtgtggtgttcttctcgcaccagatcggcagcttcctgggcgcatggctgggtggctacctgttcgacaagaccggcagttacagcaccgtatggatgatcgcgatcgcgctgggcttgatggccgcggtagtcaacctgccgatccgcgagcag

SEQ ID NO: 32252 - DNA, 1524 bp, Ralstonia metallidurans
ctgcaccgctcgatgcagcagcgaccagacaaggtcgcagtacgttttaacggccgtgcgctgacctacgccgaaatcggggatcgcgtcgcgcggctggccggtgcgctgcgcaagctgggcgtggccgaaggcgaacgtgtagcaatgttctcgcttaactcggcgcgctacatcgagtattacatggcggtaccgtgggcaggcgccgtgctcaaccctgtcaacttccgctggagtgcggcagagatcgcgtattcgttcaaggactccggcactgcggtgctgattgtcgacgacccgttcaccgaggttgcgcagaaggtcgcggccgagtgcacgaccgtgcgccacgtcatctatgccggtgacggagagaccccggcaggcatgctgaactatgaaaccctgattgcggacagcgctccgatggaagacgcctaccgtcacggcgacgacctggcggggattttctacaccggaggcaccaccggcttcccgaagggggtgatgctcagccatgcgaacctgatctcgtcggcatgcaaccagccgatgtcgggcacggtggatgaatccatcgtgatgatgcatgtgatgccgatgttccacctggcatgcttcgcgtcgatcaacgctgtgttcctcgtcggtggcacgcatgtggcgatatccgccttcgatcctggccgcatgatggaggggattgcgcaggacagggtgacggccgtcctgctggcgccgaccatgatccagatggggctggactggatggaccggcatccggggcgcgcggccgagctggacctgtcgtcgctgaacagcctgcgctatggcgcctcgccgatgacccctgcgctgctggagcgcaccaggcagaccttcccagcggtgcgcttttcgcagggctatggcatgaccgagctggcaccggtggccacaatgcttggcccggagtatcacgacgcggcggcgcaggcgagcggcaagatgtattcagtcggccgcccggcgcataccgttgaggtcaaggtggtcgactccaggggcaacgaggtcccgcgcggtaccgtgggcgagatcatcgtacgtggcccgaatgtgatgctcggctactggaaccagccgcaggctaccgcggaggcgatccgcaatggctggatgcataccggcgacggtgggtacatggacaaggacggcttcctgttcctggtcgaccgcctgaaggacatgatcatcagcggtggcgagaacgtctattccgccgaggtggagaaggcgctggcgagtcatccggccgtcgcgcagtcgtctgtgatcggtgtgccccacgagaagtggggtgagtccgtgcatgcggtggtggttctccggcagggcgagagcgctacgctcgagtcgatccagtcccattgccgtgagcggattgccggctacaagatcccacgcagcgtcgagttcgtcgatgcgctgccgttgtcgagcgtcggcaaggtgctcaagaacgagctgcgcaagcgccat

SEQ ID NO: 32253 - DNA, 816 bp, Ralstonia metallidurans
atgagcaagctcgcaggaaagtccgccatcgtcaccggctcgggccgtggcatcggccgtgaagtcgcaatgaaactggcggcagaaggcgcccgtgtggtcgtgaacgacctggacgccgatccggcgcaagaagtggtggagctgatccgtgcaaacggcggcgaagccgtggcctgcgtcggcagcgtgaccgcgcctgattttgccgaccgcctcatcaagaccacggtcgacagtttcaagggcatcgacatcatcgtcaacaacgccggctacacctgggacaacgtgatccagaagatgaccgacgagcagtggtacgccatactcgactgccacttgaccgcaccgttccgcatcctgcgtgccgcacagcccgtcatcagcgctgcggccaaggccgaagccgccgaaggccgcgaagtcttccgcaaggtcgtcaacatttcctcgggtgcggccggtggcaatgccgggcagtcgaactactccgccgccaaggccggcatcctgggcatgaccaagacgctggccaaggagtggggccgcctgaaggtcaacgtcaacgccgtggcgttcggtctgatcgaaacgcgcctcacccaggcgctggcggcggaccagagcaagagcgtcagtatcgaaggccgtgagatcaaggtcggcgtgcagcaggcaatgctcgacggcgccagccgcatgattccggtcggccgcgcgggcagggccgaagaggcagctggcgctgtctatctgctttgcacgccggagtcgaacttcctgtccggccaggttctgtactgtggcggtggc

SEQ ID NO: 32254 - DNA, 1176 bp, Ralstonia metallidurans
aagcatgtggtggtagccggggtcggcatgatcccgttcaagaaaccgggtcagagcgattcctacagcgtcatgggcgccacggcgaccaggctcgcgctggaggatgcgggcctgccatatgacaggatccagcaggcctatgtcggctatgtgtacggtgactccacctgcggccagaccgcgctgtacaaggtcggggtgaccggcattcccattgtcaacgtcaataacaactgctccacgggttccagcgctctgttcctggctcgccaggcggtggaaagcggcgcggtggaatgcgcgctggcgctgggcttcgagttcatgcagccgggcgcactgacgagcgtctggaccgaccgtgagcgtgcaatggcgcgcttcacggaaatctcggcgccgatggtgcaggatgcgctggatgccggtgtgcccagtgcactgacgatgttcggcggcgccggtcgcgagcatatgcaaaggtacggcacgaagctggagaccttcgcgaagatccgcgccaaggcgagccgccatgccgccaacaacccgctggccgtgttccgcaccgtggtgacggaggaagacgtgatgaacgagaaggttatgtggcctggcgtcatgacccgctcgatggcctgcccacccaccagcggcgccgcggccgcgatcgtctgcacggaagctttcgcgaagaagcacaacctccgcaccgatgtgcgcatcctggcccagtcattgaccaccgatgtggcgcagagcttcgatccaccgtcgatgatcggcctggtcggcttccatatggccgagcgcggcgcgaaggccgtgtacgaggcggctggagtaagcccatcggatatccaggtctgcgaattgcacgactgtttcgcgcagaacgaactgctgacctacgagtcgctgggcttcgcgaagatcggcgaggccgagaagatggtgcaagacggcgacaacacctacggcggaaaggtcgtgatcaacccgtcgggcggtctgctgagcaagggccatccgctgggcgccaccggcctggcgcagtgctacgaactgacccgccagatccggggcacggcggaggcgacgcaggtggagcgcgtgcagcttgcattgcagcacaaccttggcctcggcggcgcctgcgtggtgacgctgtac

SEQ ID NO: 32255 - DNA, 1224 bp, Ralstonia metallidurans
tggggctcgcggcgcatcatccgttcaccgagagccggccggatcgtttgacctgccggctacgccaatacctgacagggaggagacgtcgtggaagtcgttcgcagtgtctatcgtgaagatcatgagcagttccgcaccaccgtgcgccgtttcctggagcgcgaatgcgtaccgcgccaggaacaatggctggccgacggcatcgtcgaccgcgaaacctggctcaaggccgggcgcgaagggcttctttgcacggcactgccgaccgagtatggcggcggcggtggcgacttcggccacgcggccatcatcgccgaggaaatggcctatgccggtgtcagcgtgtcgttcgggctgcactcggatatcgtggcgccctacattgcccgcttgggcacggaggaacagaagcagcgctggctgcccgacatctgcgcgggcaagaccatcctcgccgttgccatcaccgagccgggaggcggctcggacgtcaaggcctgccggactacggcggtgcgcgacggcgacgaatgggtcatcaatggcagcaagaccttcatcagcaacggcttctgctcggacatggtgatggtggtctgcaagaccgaccccgcggccggcgccaggggcgtgagcctgatcctggtcgagaccaaccgagaaggcttccgccgcggccgcaagctgcacaaggtgggcatgcactcgcaggataccgccgagctgttcttcgacaacgtgcgcgtgccggcgggcaacctgctgggcgaagtgaacaagggctttggctacctgatgcacgacctggcacaggagcggttcatcatcgctgtgacggctgccgccaagatcgaacgcctgctggaacagaccatcgagtatgtgaaggaccgcaaggcctttggcggcaccgtctgggacttccagaacaccaagttcaagctggccgatgtcaaggccaatgccgtggcgctgcgcaccatggtggactactacctgggcgagcacatgcgccgccggctgtcgggcgaagaagccgccattgccaagctgcacgccaccgaagtgcagtggaaatgcattgacgacatggtccagctgcatggcggctacggctacatgctcgagtatccgatcgcccgcgcctttgtcgacatgcgcgtggcgcgcgtctacggcgggtccaatgaagtgatgcgcgacatcatcacgcgcaagatg

SEQ ID NO: 32256 - DNA, 717 bp, Ralstonia metallidurans
gtgagacaaaagctggtcatcggcaattggaagatgcatggcagcctggccgccaacgcggcgctgcttgagggtatcaaggctgcgcctgcgcgcgcgaagctggcggtctgcgcgccgttcccctatcttgcccagtgccagacgctgttgtccggttcccaggttgcctggggtgctcaggatgtgtcgtccgaggcccgtggtgccttcaccggtgaagtagctgcctcgatgctgggtgagtttggttgcggctatgcgctcgtcggccattcagagcgtcgtacctaccatggtgaaaccgacgcggtagtggctgccaaggcactgcgcgcgctggaattcgacattgttccggtggtctgtgttggagagacgctggccgagcgcgaagccggtcagaccgaagccgtggttggtcgtcagttgcaggctgtactcgatgcgttgtctatcgagcaactgggtcgcattgttctggcctatgagcccgtctgggcgatcggtacgggcaagacggccacgagcgcgcaggcccaggaagttcatgcggcgctacgtgcgcgggtcacggcgaaggatgccggtgttgcagcacgcatggccattctgtatggcggtagcgtcaagcccgacaatgcagctgaattgttttccatgtccgatattgacggggggcttattggtggcgcctccctgaaggcggatgatttc

SEQ ID NO: 32257 - DNA, 2037 bp, Ralstonia metallidurans
cagcagggttttctcctgacccgtcactggcgcgacacgcccgcaggcacggaagtcgagttctggctcgccaccgatgagggcccgcgccgactgcgcctgccccggcagccatccacggcgttcataccggccgcgcaacgcgagacggccgaggcgctgctgcgtggcgagcgcgatgtcgagttccgcccgctgaacttgcaggacttccagcgacgcccggtgacagggatctactgcgaccagcaccgtcagctcatgcggattgaaaaggcgctccgcgacgcgggcgtcagcgtctacgaggccgacgtccgcccgccagagcgctatctgatggagcggttcatcaccgccccggtctggttcgacggccagcccggggcggacggcgtgctgcgcgacgcccagatgaagccggcggccggctaccggcccaagctgcgcctggtctcgctcgacatcgaaactaatgcgttcggcgaactctattccatcgcgctggagggctgtggcgagcggcaggtctacatgctgggccccacccccgcgcaaccggcggcggatatcgacttcgcgctcgagtaccacgcaacccgtcctctgctgctggaggccctcaacgactggttggcccgccacgatcccgacgcgatcatcggctggaatctggtgcaattcgacctgcgtgtgctgcgcgaacacgcgcgccagcaccagattccgctgcgcctgggtcgtggcggcgcggaactggagtggcgcgagcacaaccagcagcagcactacttcgcggcagcggcgggccggctgatcatcgacggcatcgaggcccttcgctcggccacctggaacttcccgtcgttcagtctcgaatccgtggcccggacgctgctgggcgaaggcaaggctatcgacaacccgtacgaccgcatggatgcgatcgaccggatgttcgccgaagacaagccggcactggcccgctacaacctccgcgactgcgaactggtcacgcgcattttcgagaaagcggagctgcttcccttcctgttggaacgcgcgacggtgaccggcctgccggcggatcgtagtggcggttcggtcgcggctttcacgcatctctacatgccgctgatgcatcggcaaggctacgtcgcgcctagtcttggcgagaaggcgccggaagccagccctggtggctttgtcatggattcccgccccggactctatgaatcggtgctcgtgctcgactacaagagcctgtatccgtcgatcatccgcacgttcctgattgacccgatcggactggtcgagggcctggcccaccctgacgatgccgaatcggtgcccggcttccggggcgcgcggttctcacgcacgaagcactgcctgccggccatcgtcgcgcgcgtgtggcagggccgcgaagccgccaagcgagacaagaacaagccgctctcgcaggcgctcaagatcatcatgaacgcgttctacggcgtgctgggttccagcggctgccgcttcttcgacccacgactggcgtcgtcgatcacgatgcgcggccacgagatcatgcgccagacgcgcgcgcttatcgaggcgcggggctacgaggtgatctacggcgacaccgattcgacgttcgtgtggctgcgtcgcgcgaggtctgaggccgacgccgcgcagatcggccgcagcctggtggcgtacgtgaacgactggtggcgagatcatctgtggcagacctacggcctggagtccgcgctcgagctgcagttcgagacccatttccggcgcttcctgatgccgaccatccgtggcgccgatctcggcagcaagaagcgctacgcgggccaggtgatgcgcgccgacggcacggccgagatggtgttcaagggcctggaaaccgtgcgcaccgactggtcaccgctggcgcagcagttccagcagacgctctacgcgaagatcttcaaccgcgagccctatcgggactatgtgcgcgacaccgtccaccggacgctcgccgggaaactc

SEQ ID NO: 32258 - DNA, 789 bp, Ralstonia metallidurans
atgaacatcgatctgtcgggcaagaccgccctcgtcaccggttccaccgccggcatcggctttgccacggcgcgcggtctggccgagtccggcgcccacgtgatcgtcaacggccgtagccaggcctcggtcgataacgcgctggcgtcgctgaagaaatcctatcccaccgcccaggccaccggattcgcaggcgacctgaccgacgctgccgtctgcgacaccctcgtcaagacccacccggctgtcgacatcctcgtcaacaacctcggcatcttcgagccgaaggatttcttcgatattccggacagcgactggacacgctttttcgacgtcaacgtgctgtccggcgtacgcctctcgcgcgcctatgccaaaggcatggccgagcgcaaatggggccgcatcgtgtttatcgcgtctgagtctggcatcaacattccggtcgagatgatccactacggcttcaccaagaccgcgcagttggcggtctcgcgcggtctggccaagcggatggcgggcaccggcgtcacggtgaacgccgtgctgcccggcccgacgctatccgaaggcgtgacggccatgctcaaggatgaaatcgcgaaatccggcaaaagcgccgaggaagtggcggccgagttcgtcaaggcacaccgcagcacgtcgatcatccagcgcgcggccagtgtcgaggaagtggccaacatgatcgtctacgtctgctcgccacaggcgtccgccaccaccggggcggccctgcgcgttgacggcggtgtggtcgacacgatc

SEQ ID NO: 32259 - DNA, 1704 bp, Ralstonia metallidurans
cacggaatcgagccagtgaaaaagcttctgattgccaaccgcggcgaaatcgcgctgcgggttcaacgcgccgcgcaggatctcggcattgccactgtcgcggtgtacgccaccgacgacgctcaatcgcgccatcgccagcttgccgatgaagccatcgcgctgcccggcaatggtccggctacctatctcgacatcgacgccattctcggcgcggcgcgcgccgctggctgcgatgcaatccatcccggctacggcttcctgagcgagcgtgccgacttcgcgcaggcatgcgcggcagcaggtatcacgttcgtcggccccacgcccgagcagcttgccctgttcggcgacaagggccgcgcgctcgagctggccgcgcagtgcgatgtcccggtgatgccggccacccccggtggcgcttcgctcgacgacgtccgcgcattcttcgcggcgcagcaaggcaatggcatcgtgctgaaggccgtgggcggcggcggtgggcgcgggatgcgcgtcgtccgcgatgccgaagcgctggccgaagcctacgcgcgctgccagtcggaggcccgcagcgccttcggcatcgaagcgatctatgccgagcgactggtcgaacgcgcgcgccatattgaagtacagatcatcggcgatgggactgagacaatcgcgctcggcgaacgcgattgcacgctacagcggcgcttccagaaactggtggaaatcgcgccgagcccggtgctgacacccgccctgcgcgaccgcatcgtgcaggccgccagcaggatcgcaaagcacaccggctaccgcagcctgggcacgttcgagttcctggtggagaccgacgacgccggcacgccccacggcttcgtgttcatcgaagccaatccccgtctgcaggtagagcacaccatcacggaacaggtgacgggtctcgatctcgttgccctccagcttggccttgctgatggccggagcctgcgcgacctgggtctcgaccccgccgcgccgcccacggcgcgcgggttctccgttcagctacgcatcaatgccgaggccaccgatgcgcagggccaggcgcgcccggcgctcggaaggctcgaacgtttcgatccgcccaccgggcccgatgttcgcgtcgacacgcacggctataccggctacgcgccgccagctggctatgactcgctgctggccaaactgatcgtaagcacttcttcaccccgtttcgaggacgtggtgcggcgcgtgcggcgtgcgctcggtgaatgccgtgttgacggcgtgccaagcaacctcgacctgctgcgcgccctggtggcacgcgaagacttcgcgacacagcatgtccatacacgtcacttcgaggcgatcctgccggaactgctgaccgccgcgcaacgcgtggcggccagtgacgccgcgcgacaggcttccatcggcatcgcgcagaccgcccccgtgcctgtaccgaccgctactgccgaggccatcgacgaaggactggttgcagtgcgcgcgccaatgaacgggcgcgtggtcgagatgcgcgtccaggaagacgacatcgtgcaaccgggccagatcgtggcgatcctcgacgcgatgaagatggagcacaccatcgcggccgagtgcgcggggcgtgtgatcgacgtgcgcgtcggtgccaccgggcagactgtcgaagggcaaatcctg

SEQ ID NO: 32260 - DNA, 1296 bp, Ralstonia metallidurans
ttccgcaaggactggtacgcgccgctgggtaacccgccgctggccgtcgtgcggccgcgtacgacggcggacgtcgcggccatccttgccgcatgccacaggcatggccagccagtcgttccccaaggaggcctgacaggcctggcgtctgccgcgacgcccgggcaaggcgaggtcgtgctatccctcgaacggatgcgtggcgtcgaagagatcgacgagcaggctggcacgatgacggtctgggcgggcaccacgctgcaggccgcgcaggaagccgcgcgcgcggccggatggttgctggcggtggatctcggcgcacgcggcagttgccagatcggcggcaatatcgccaccaatgcgggcggcaatcgcgtgattcggtacggcatgatgcgcgaccaggtactcgggattgaagtcgtgctggccgatggcaccgtgctgacatcactgaacaagatgctcaagaacaacgctggctacgacctgcgccaggttttcgtgggcagcgaaggcacgctcggcgtgatcacgcgcgcggtcctgcggctcgcaccactgccgtcagccacgcaaacggcgctctgcgcgctgaagagtttcgacgatgtggttcgcctgctgcgccacgcgcagcgcgcgctttccggccgtgtctctgccttcgaagcgatgtgggccgactactacacgctagtgaccacgcgtgttccgggcgtacgcgcaccgcttgcggcagggcatccattctatgtgctggtcgacctgcaaggcagcgacgctgatgccgatgccgccgcgttcgaacggatgctggaaggcgcgatggaaagcggcctgattgtcgatgccgcggtggccgcgagtggtaaggaggcggagagcttttggaagctgcgcgatgcggtggccgagtttccgcaaatgtgggcaccgaacgcggctttcgacgtcagcctgccgattggcagcattggccgattcgccgacgcgttgcgtagcgccatcctggaacgatggccgagcgccgaactggtgaacttcggacacgtcggcgacagcaatctgcacttcagcgtgcacctgcccggggtagacgcggcggcgttcccagaagccgagatcgacgcggtagcctatgccatcgttcgcgagttcgccgggagcgtgtcggcggagcacggcatcggcatccacaagaagccctacctcggcaactcgcgcactcctgaggagctggcgctgatgcgcacaatcaaggcagccctcgacccgaaggggattctgaacccc

SEQ ID NO: 32261 - DNA, 1245 bp, Ralstonia metallidurans
tatcagcacatcaaggtgccggcaggcgagaagatcaaggtcaacgccgatctttcgctgaacgtgccggataatccgatcattccctacatcgaaggtgacggcacgggtgtcgatatcaccccggtgatgctgaaagtggtggatgccgccgtggccaaggcgtatggcggcaagcgcaagatctcgtggatggagatctacgcgggcgagaagtcgaccaaggtctatggcccggatgtgtggctgccggaagagaccatggaagtggtcaaggaatacgtggtgtcgatcaagggcccgctgaccacgccggtcggtggtggcatccgctcgctgaacgtggcactgcgtcagcagctcgatctctatgtctgcttgcgcccggtgcgttatttcaaaggcgtgccgtccccggtgcgcgagcccgagaagaccgacatggtgatcttccgcgagaactcggaagacatctatgccggcatcgagtgggaagccgaaagcgaaggcgcgaagaagctgatcgccttcctgcagaacgaaatgggcgtgaagaagatccgcttcccggaaacgtccggcatcggcatcaagcccgtctcgaaggaaggcacgcagcgcctggtgcgcaaggcgctccagtacgcgatcgacaacgacaagccgtcggtgacgctcgtgcacaagggcaacatcatgaagttcaccgaaggcggcttccgcgactggggctatgaactcgcgcagcaggaatttggcgcggaactggtcgatggcggcccgtggtgcaagttcaagaatccgaagactggccgcgatatcgtcgtcaaggacgctatcgccgacgcattcctgcagcagattctgctgcgtccagctgaatattcggtgatcgccacgctgaacctgaacggtgactacatctccgacgccctggccgcccaggtgggtggcatcggcatcgcaccgggcgcgaacatgtccgattcggtcgccatgttcgaagccacgcacggcaccgcgccgaagtatgcaggcaaggactacgtgaatccaggttcggaaatcctctccgcggaaatgatgctgcgccacatgggctggaccgaagcggccgacctgatcatccgctcgatggagaagtcgatccagtcgaagaaggtcacgtacgacttcgcccggctgctagaaggtgcgacgcaggtgtcgtgctcggggtttggtcaggtgatgatcgacaatatg

SEQ ID NO: 32262 - DNA, 2268 bp, Ralstonia metallidurans
atgattgcgcaagaattggaagtgagcctgcacatggccttcgtcgaggctcgccaggcgcgccacgagttcatcaccgtggaacacctgctgctggcgttgctcgacaaccccacggcggccgaggtgctgcgcgcgtgcgcagccaacatcgaggacttgcgcactagtctgaagaacttcatcgccgacaacacgccggtcgtgcccggcaccgatgaagtggacacacagccgacactcggtttccagcgagtgatccagcgcgccatcatgcatgtgcagtcgacctccaacggcaagaaggaggtgactggcgcaaacgtgctggtggcgatcttcggcgagaaggattcccacgcggtctactacctgcagcagcagggcgtcacgcgcctggacgtggtgaatttcatcagccacggcatccgcaaggatcaggccgagcccgccaagcatggcgacggcaacgccgaaggcgagggcggtgacggcaaggaaagcccgctcgagcaatacacccagaacctgaacacgctggccaaggccggcaagatcgatccgctgatcggccgcgaaagcgaagtcgagcgcgttgtccaggtgctgtgccgccgccgcaagaacaacccgctgctgaccggcgaggccggcgtgggcaagacggcgatcgccgaaggtctggcctggcgcatcaccaagggcgaggtgccggatatcctggaaaaggccgtggtgtactcgctcgacatgggcgcgctgctggccggcaccaagtaccgtggcgacttcgagcagcgcctcaagggtgtgctgaagtcgctcaaggacaatccgaacgcgatcctgttcatcgacgagatccacacgctgatcggcgcgggcgccgcatcgggcggcacgctggacgccagcaacctgctgaaaccggcgctgtcgtcggggcagctcaagtgcatcggcgcgaccacgttcaccgagtaccgtggcatcttcgagaaggatgcggcgttatcgcgtcgattccagaagatcgacgtggtcgagccttcggtagaccagaccgtgcagattctgcgtggcctgaagtcgcgcttcgaggagcatcacggcgtcaaatacgcggcctcggcgctgaccgcggcggccgaactgtcggcacgcttcatcacggaccgtcatctgccggacaaggcgatcgatgtgatcgatgaagcgggtgcggcacagcgcatcctgccgaagtcgaagcagaagaagacgatcggcaaggccgagatcgaggacatcgtgtcgcgcatcgcgcgtatcccgccgcaaagcgtgaaccaggacgaccgcagcaagttgcagacgctggaacgcgacctgaagtcggtggtgttcggtcaggacccggccatcgaggcgctggcttcggcgatcaagatgtcgcgtgctggcctgggcaagaccgacaagccgatcggctcgttcctgttctcgggcccgaccggcgtcggcaagaccgaagtggccaagcagctcgcgttcatcatgggcattgagttgctgcgcttcgacatgtccgaatacatggagcgccacgcggtgagccgcctgatcggcgcgcccccgggctatgtcggtttcgaccagggcggcctgctgaccgaggccgtcacgaagaagccgcactgcgtgctcctgctcgacgagatcgaaaaggcacatccggatatcttcaacatcctgctgcaggtcatggaccacggttcgctcaccgacaacaacggtcgccgtgccgacttccgcaacgtgatcatcatcatgaccaccaatgcgggcgccgagacgatgaaccgtgccacgatcggcttcaccaccgcccgcgagcagggcgacgaaatggccgatatcaagcggatgttcacgcccgagttccgtaaccggctcgatgcaatgatcagcttccgctcgctggatgaggaaatcattctgcgcgtggtggacaagttcctgatgcagctggaagagcaactgcacgagaagaaggtggatgccagcttctcggagaagctgcgcaagtatctggcgaagaagggcttcgatccactgatgggtgcccgtccgatgcagcgtctgatccaggacatgatccgcaaggcgctggccgacgagctgctgtttggcaagcttgtcagcggcggcaaggtcgcggtggacctggacgatgacgaccagatcaagctgacgttctccgaagcggatccggagccgcccgaggcg

SEQ ID NO: 32263 - DNA, 654 bp, Ralstonia metallidurans
ccccgcacgcgcatcaagatctgcggcctgacgcgcgaagaggacgtgcgcgccgccgtggacgccggtgccgatgcgatcggtctggtcttctacgccaggagcccacgccacgtggatgtggcccacgccgcggccctggccgaactggtgccgccgttcgtgtccgtggttggcctgttcgtcaatgcagatgccgaagaggtggcccatgtggccgagcgtgtgccgttgacgttgcttcagttccacggcgacgagacgccccagcagtgcaccgagatcgcccggcgctgccggctgccattcatgcgtgccgcacgtgtccgcccggggctcgatttggtagaattcgcaaatcaatatcgtgacgcttccggcctgctgctcgatgccttcgtggaaggctatggcggtggcggccacgttttcgactggaccctgattcctgcccaatggcttccgcccaatcctgccaatccccgcgcaaacgacgctcctcgcatcgttttgagtggtggattgaacgcgcaaaacgtcgctggagcgattgagcgcgtgcggccctacgctgtggatgtcagcagcggcgtggaggccagcaagggtgtgaaagaccacgcccgtattgccgcattcgtgcgcgccgttcga

SEQ ID NO: 32264 - DNA, 1116 bp, Ralstonia metallidurans
gtaggtctcgtcggttggcgaggaatggtcggcagcgtcctgatgcagcgcatgcaggaagaaggtgatttcgaccacttcgaacccattttcttcagcacgtccaacgcgggtggcaaggctccggccatggccaagaatgaaaccacgctgaaggacgcgaatgacatcgaagcgctgaagaagtgcgacgtggtgctcaccgcccagggcggcgactacaccaacgacgtcttcccgcgactgcgcgcagccggctggaatggctactggatcgacgccgcatcgtcgcttcgcatgaaggacgacgcgatcatcgtgctcgatccggtgaacatgggtgtgatcaaggacgcgctgaagaagggcgtcaagaatttcatcggtggcaattgcaccgtgagttgcatgctgatgggtctgggtggcctgttcgagcatgacttggtcgagtggatgacctcgatgacgtaccaggccgcttcgggcggtggcgcccagcatatgcgcgagctgctgacccagttcggcacgctgaacgccgcggtcaagccgctgctggacaacccggcctcggccatcctggagatcgaccgtcagatcctgtcgacccagcacggcctgtctgccgacgaaaccaagcagttcggcgtgccgctggccgggaacctgatcccctggatcgacaaggacctcggtaacggcgtgtcgcgcgaggaatggaagggcggcgccgagaccaacaagattctgggtcgtggcgaaggcttcctgggcgccaccggcgccagcccgatcgccgtggatggcctgtgcgtgcggatcggcgcgatgcgctgccactcgcaggcactgacgatcaagctccgcaaggacgtgccgctggacgagatcgaaggcatgctggccgccaacaaccaatgggccaaggtggtgccgaatacgcgtgaggccagcatgaaggacctgacgccggccgccgtgaccggcacgctgacgattccggtcggtcgcctgcgcaagatgcagatgggcggcgaatacctctcggcgttcaccgttggcgaccagttgctctggggcgccgccgagccgctgcgtcgtatgctgcgcatt

SEQ ID NO: 32265 - DNA, 1524 bp, Ralstonia metallidurans
tgggatgtgatcgtcatcggcggcggcgccaccgggctgggcaccgcgctcgacgctgcttcgcgtggctaccgcacgctgctgctcgaagccgccgacttcgccaagggcacgtcgagcaaggccaccaagctcgtgcacggcggcgttcgctacctggcgcaaggcaacatcagcctggtgcgcgaggccctgcacgaacgcggcctgctcgcgcgcaacgcaccgcacgtggtgtggccgcttggcttcgtcgtgccggcctaccagatgttcgaccagccgttctacgggatcggcctgaagctctatgacatgctggcaggcggcctgaacctttccggcagccgctggctcagccatcacgaaacgctcgaggccgcgccaaccctggccgagcacgtgggcgggcgtccgctgcgcggtggcaatctgtatttcgacggccagttcgatgacgcgcggctggcgatggcgttgatgcgcacgctgttcgatgtgggcggcaccgcggtcaactacatgcgcgtgagcggactctcgcagtccaacggcgtcatcaccggcgtcacggcacaagatgtgatcggtggggagacgttccacctgcgcgcggattgcgtgatcaacgccaccggcgtgtgggtcgatgccgtgcgccagatggaagacggccaggcccggcggatggtggcgccgagccagggcgttcacttgacgattccgcgcagcttcctgcccggcgatcgcgcagtcctgattccgaaaaccgacgatggccgcgtgctgttcctggtgccctggaacggacacacgatcgtcggcaccaccgacaccccgcgccaggatctaccgctggagccccgggcagcgagcgacgacgtcgacttcatcctggaaacggccgcgcgttacctggcccgcgacccgacccgcgatgacgtgaccagcgtctgggcggggctgcgtccgctggtgaaggccaccggagaagcctccaccgcgtcgttgtcgcgcgagcatacgatcctggtatccaaagccggactgatcacggtcacgggcggcaaatggaccacgtatcgcaagatggccgaggacgtgatggaaaccgcgatccagcggcagttgctgcgcgccgcgccctgccgcacggccgacctgccgctgcacggcgcgaccaacatgcccaatgacctgccgccctcgggcaccggatcgcccgaccgctactacggcgccgacctccccctggttcaggcgatgcctggcgcggacaacgtgctcgtgcccgcctccggcctgaccgaggcccacgtccgctttgcggcgcgctacgagctggcccgccgcgttgaggacgtgctggcgcggcgcaatcgggcgctgttcctggacgcccgcgctgcgctggacggcgccccccgggtggcggcgatcctggcggaggaactcgcgcacgactcggcctggcaggcacgcgaactcgaggacttcggcaagctcgccaggggctatatgctc

SEQ ID NO: 32266 - DNA, 1491 bp, Ralstonia metallidurans
cagtacgtgctggccctggatcagggcaccagcagttcgcgcgccatcctgttcgatcacctgggcaatgtcgtacgcatcgcccagcgtgagtttcggcaatattatccgcatcccggccacgtcgagcacgacccctatgagatctggcagtcgcaactggccgtggcgcacgaggtactgggcgacgcgggcgtcagcggcacgcagatttctgccatcggcatcacgaaccagcgcgaaaccacggtgctgtgggatcgcaagaccggtgaaccggtgggccgcgcgctggtctggcaagaccgccgcaccgcaccgatgtgcgaggacctgcaggcagcgggccacgcggagacatttcagcgcaagaccggactgatcgtcgacgcctatttctccggcaccaaactgcgctggatgctcgacaactacgagggcgcccgcgcacgcgccgagcgcggcgagttggcctttggcaccgtcgatagctggctgatctggcagttgaccgatggtgcgcggcacgtcaccgacgtttccaatgcttcgcgcacgatgctgttcaacatccacgatttccgctgggacgatgaactcctgggcctgctggatattccgcgcaacctgctgccggaagtggtgccgtcgagcggcgaggtcgcgcgcgcatcggcacggctgttcggcgtggagattccgattgccggcatcgccggcgaccagcaggccgccacgtttggccaagcttgcctgcggccgggcatggccaagaacacctatggcaccggctgcttcatcctgatgaacaccggcgacaaacccgtaacatcgcacaaccggctgatcacgaccatcggctggcagatcggcggcaatacccagtactgtctggaaggcggcgtattcatgggcggcgcgacgatccagtggctgcgcgacggcctcaagctgatccacagcgcccccgaggtagagcctctggcccgccagtgcaccgacaccggcggcgtggtgctggtgccggcattcgccggcctcggcgcgccgcactgggatccgttcgcacgcggcacgttggtcggcatcacgcgcggtaccggcgggccgcacatcgcccgggccgcgctcgaatccatcgcgctgcagagcgtggatgtgctcgacgccatgcagaaggacgccggcatctcgctggccgaactccgggtcgatggcggtgcctcgcgcagcgacctgctgatgcagatgcaggccgacctgctcggcaccgtcgtggtccggccgcgcgtgaccgaaaccaccgcgctaggcgcggcatatctcgccgggctggcaactggttactggaccgaccccgaagaaatcacgcggcagtggcaggtggagcagcgcttcgagccgaagctgtccgccgacgaacgcgaacgccgcattgcgcgttggcaccgcgccgtcgaccgcgcccgcgactgggcgcgcgagtccgat

SEQ ID NO: 32267 - DNA, 1191 bp, Ralstonia metallidurans
atcttcgtcgcgatgctgctaggcgtgctcgtcggcgctgccgtgcacaacatgtcgccggacgccgcaaccgcgaagtcgatcgccgatcacctgtcgatcctgaccgacgtgttcctgcggatgatcaagatgatcatcggcccgctggtgttcgccacactggtttccggcattgccagcatgggcgacggcaagaccgtcggccgcatcggcctgaaggcgatggcctggttcatggccgcgtcgatcacgtcgctgctgctgggcttgctgatggccaacctgctggccccgggccacggcatgaacctgccgctgccggccgccgacgccgcgtcgaacctgaagaccggtgcgctgaacctgcgcgacttcatcgcccacatgttcccgaagagcttcgtggaagcgatggccaccaacgaagtgctgcagatcgtggtgttctcgctgttcttcggcttcgcgctgggtaccctcaaggacggcgtgggcaagcccgtgctggccggtatcgatggcctgggccacatcatgctcaaggtcaccaactacgtgatggccttcgcgccgctgggcgtgttcggcgccgtctccgccgtgatctcggcgcagggcctgggcgtgctggtggtctacgccaagctgctgggcagcgtgtacgcggcgctggcactgctgtggctggcactgatcgcgggtggctacttcttcctgggtcgtgacgtcttccgcctgatgcgcacgctgcgcacgccgctgatgatcggcttcgccacggccagcagcgaatcggcctacccgaaggtgatcgaccaactcacgcgcttcggcgtcaagccgcgcatcacgaacttcgtgctgccgctgggctactcgttcaaccttgacggctcgatcatgtacacctcctttgccgccctgttcgtggcgcaggtgtacgggatccagctttcgctgacccagcagatcaccatgctgctggtgctgctggtcaccagcaagggcatcgccggcgtgccgcgcgcctcgctggtggtggtagccgccgttctgccgatgttcggtctgcccgaagccggcatcctgctcgtcctcggtatcgaccatatcctcgatatgggccggaccgtgaccaatgtgcttggcaatgccattgccacgaccgtcgtcgccaaaagcgaaggc

SEQ ID NO: 32268 - DNA, 1992 bp, Ralstonia metallidurans
tgcttcgttcccgacctgaccaggttgaccgcgccgccatgcgaggaggcccgtccgaccggcattgtaacgcaaccttgagaggctttccaattttgtattcttgccaaggactttggctggttgtttgatctgaagcggggttggcgtcctgccatgctggcagcatggcggacggcaaattcgggccggaaagctctcaactgacaggctggggacatgaacgcaaacgaccagatcctccgcggcgcgcttgcgccgcaagacatctccatcgaagtactccaggaaaaatacgccaagggcgaggagcagaccattgacgatgtgcgtcgccgtgtggcgcgcgcgctcgcggaggtggaacctgccgacaaacgcgaggcctgggcctcgcgctttctttgggcgctggaaggcggcttcgtgccggccgggcgtatcaactcggcggctggcacaggcattcaagctacgctgatcaactgcttcgtccagcctgtgggcgactcggtttcccaggtgcgtggcggtaagccgagcatctataccgccgtggcccaggctgcggagacgatgcggcgcggcggcggtgtcggctatgacttttcctcgatcaggccgggtggcgcgctggtgcgtgccacgcactcgcgcgcatcggggccggtgtcgttcatgaaggtgttcgatgcatcgtgtgccaccgtggaatcggccggcgcacggcgcggcgcgcagatgggcgtgctgcgctgcgaccaccccgatatcgagagctttatccacgccaaggaccgtggcgacctgaccaacttcaatatctcgattggcgtcaccgacgagttcatgcaagcggtggcggctgatggggaaatcgaactgatccacgaggccgagcctggcgcggacggtatcgcggcgggcgcctatcgccgcgacgacggccagtgggtgtatcggcgtgtgccggcccgtcggctgtgggaccaggtcatgcaggccacctatgaccacgcagagcctggcatcctgttcctgtcgcgcatcaacgccgacaacaatctctattactgcgagacgatcgaggccaccaacccgtgcgccgagcagccgttgccgtcgtatggctgctgctgcctgggctcgatcaacctgacgcgcttcgtacgccgcccgtttaccgatcaggccagcttcgatttcgaggcgtttgccgaggtcgtgcgcgtttcgacgcggatgctcgacaacgtgctcgacatcacctactggccgttgcccgagcagcaggccgaggcgcaagccaagcgtcgtatcggcctggggttcctggggcttggtagcgcactggtgatgctgggtcatcgctatgacaccgatgcggcgcgcgcgcttgcggggcggatctccgagaccatgcgcgatcacgcctatctggcatcggtcgaactcgccgaggagaagggccgcttcccgttgttcgatgccgacgcctatctgagtggcggcttcgtgagccgcctgcccgagcccatccgcgatgccatccgcgaacacggcctgcgcaactcgcacctgctttcgatcgcgccaactggcacgatcacgcttgcctttgccgataacgcgtcaaatgggatcgagccggccttctcgtggacctacaaccggcgcaagcggatgcccgacgacagctatcgcacgttcgaggtggccgaccatgcatggcggctctatcgccatatgggcggcgacgtcgagcagttgccggagagcttcgtcacggcgctccagatgtctgccattgaccatatgcggatgctggaggcggtccagccctatatcgacacgagcatcagcaagactgtgaacgtgccggaggactatccgtacgaagccttccgcaatctctacctcgaagcgtggaaggccgggctcaaggggctcgccacgtatcggccgaaccaggtgcttggcgcggtgctgtcg

SEQ ID NO: 32269 - DNA, 1098 bp, Ralstonia metallidurans
cgcgtgttcaatttctcgcctggtccggccgcactgccgactgaagtcctgcatcaggccgccgaggaaatgctgtcgtggcgcggcacgggtgtatctgtgatggagatgagccaccgcagccgtgagttcgaaggaattcacaacgaggcgctggctgacctgcgcgaactgctgcaggtgcccaagaatttccgcatcctgttcctgcaaggtggtgcgatcggcgagaacggcatcgtaccgctgaatcttgccagccgcatcaacgcagcaaagccgaagaccgatttcgtcgtcaccggcacgtggtccgtcaagaccgagcaggaagcgcgtcgctacagcgaagtcaacatcgtggcttcgagccaggaccaaaagtggcacaagatcccggatgtggcatcgtggaagctgtcggacgatgccgcgtacgtgcacctgtgcaccaatgagacgatcgttggcacggagttccaggaaatccccgacattggccagaccggcacgcacgacaagggccgcatcgtcgtggccgatgcgtcgagccacatcctttcgcgcccgatcgactggtcgcgcgtgcaggtggtctatggtggcgcccagaagaacatcggcccggccggtgtgacgatcgtcatcgtgcgcgaagacctgatcggtttcgcgcatccgctgtgcccgtcggcgttcaactggcgcctcgtggccgaatatgattcgatgtacaacacgccgcccacctatgcgatctacatcgccgggctcgtgttcaagtggctcaaggctcagggtggtgtgcccgcgatcgagcagcgcaatatcgccaaggcgcgcgcgctgtacgacttcctggaccagagcgacttctaccgtaacgaaatcgaccccagctgccgctcgcgcatgaacgtaccgttcttcctgcgcgacgaatcgcgcaacgaagcgttcctgacccaggcgcgtgcgaacggcctggtacagctcaagggccacaagtccgtgggcggaatgcgtgcaagcatctacaacgcgatgccgctcgagggtgttaccgcgctgatcgaattcatgcgcgaattcgagcgt

SEQ ID NO: 32270 - DNA, 1101 bp, Ralstonia metallidurans
tttggtccgtcctatgtgcgcaagatctcgccgtatatcgcgggcaagccgatctcggaagtggctcgcgagttcggactcgacgaggcaagaatcgtcaagctggcgtcgaacgagaacccgctcggcatgcccgcctcggcaaaagcggctatcgccgccgcgacggaggatctggggcgctatccggacagcaacggcttcgaactgaaggcgaaactgtcagaaaaatacgatgtgccggccgagtggctgacgcttggcaacggtagcaacgacattctggaactggccgcgcatgcattggtgcgcaatggcgagtcgatcgtctacgccgagtactcgtttgcggtctacgcgctggctacgcaggaagttggcgcgcgcgccatcgaggtcaagtcgcgcgcgtatggtcatgatctcgatgcgatggctgcggcgattgcgcccgacaccaagctcgtcttcatcgccaacccgaacaatccgactggcacattcgtgtccgccgccgagatcgaggctttcttggccaaggtgccgccgcatgtggtggttgtgctggacgaggcctacaacgagtatctcgatgcgggccagcagtacgaatcggttgcctgggtgcgcaagtatccgaacctgatggtgtcgcggacgttctcgaaggcctatgggctggcggggctgcgggtcggctatggcgtggcacagccccagcttaccgatttgctgaatcgcgtgcgccagccgttcaacgtcaacagcctggcgcaggctgcagccgtggcagcgctcgacgatacggcatttctgcaacgcagcgccgaactgaatcgtcagggcaaggcgcggctggtggaagcgttcgagcgaagtgggctcgaatacgtgaagtcgtccggcaactttgtcatggttcgcgtgggtggcgacgatggcgctggcgcgcgggtcaatctggcgctgctgaagcaaggtgtgatcgtgcgccccgtggccaactacggcctgccgcagtggctgcgcgtgacgatcggcctgccagaagagaacgacgcgttcatcgcggcgctggaacaggccctgaagtgaaactca

SEQ ID NO: 32271 - DNA, 1305 bp, Ralstonia metallidurans
atggaacaactgaccctcggccccctgacccgtgcttccggcacggtgcgcctgcccggctccaagagcatctccaaccgcgtgctgctgctgtccgcgctcgccaccggcgaaacgcgcgtccgcgacctgctcgattccgacgacacgcgtgtcatgctcgaagcgctcaaggtgctcggcgtggcatggcggcgcgagggcaacgactgcatcgtgtccggcgtgggcggaaatttcccgagcaaggcggcagacctgttcatgggtaatgccggcacggcaatccggccattgaccgcggcactggcgctgcaaggcggtacgtacaagctgagcggcgtgcagcggatgcatgaacggccgatcggcgatctggtcgatggcctgcggcaggtcggcgcatcggtggattacctgggcacgcccggctacccgcctttgcagatcaacccagcgcagattcgcattgatgcaccgatccgtgtgcgcggcgatgtatcgagccagttcctgaccgcgctgttgatgacgttgccaatggcccaggcacaatcgggtcgcattgagatcgaagtggtcggcgaattgatttcgaagccgtatatcgagatcacgctgaacttgctgtcgcgcttcggtattgccgtcgagagacagggctgggagcgctttatcctgccggccggcgcgcggtaccgttcgccgggcgagatctacgtcgaaggcgatgcgtccacggcatcgtacttcctggcggcgggcgccatcggtggtggcccggtacgcgtggagggtgtgggcatggcgagtatccagggcgatgttcggtttgccgatgcgctgaaccggatgggcgccaacgtgatggctggtgacaactggattgaagtgcgcggcacagagcgtgacgacggccgactcaacggcatcgagctcgactgcaatcacattcctgatgcggcgatgacgctggccgtggccgcgctgttcgcggagggcaccaccacgctgaccaacatcgccagctggcgggtcaaggaaacggaccgcatctcagcgatggcgacggagctgcgcaagctcggcgcggaggtggaggagggggctgattacctgaaagtgacgccgccgacctccccggcaacgtggcagaccccggatgctggaattggcacctatgatgaccatcggatggccatgtgtttctcgttggccgcattcggcccgttgcccgtgaagatcaacgaccccggctgcgtggcaaagacgttccccgagtacttcgaggtatttgccggagtg

SEQ ID NO: 32272 - DNA, 1380 bp, Ralstonia metallidurans
gccccgctgaagtgcgtggatgccgtggcggcttcgctgaagccgttcgaggctggcctgaaggacgagcgtgatggcttcatgtacctcgtcggcacgccggaatcgcgcgcgctgcgtcacgccttctttggcgagcgcgccgccagcaagatccccgatgtgcccgaaggcaccccggtgcgcaagatcgaacgcgttgccgtgatcggcgccggcacgatgggtggcggcattacgatgaacttcctgaacgccggcatccccgtgacgatgctggaaatgaagcaggaagcgctggagcgcggcgtggccacgatccgccgcaactacgagaacagcgccaagaagggcaagctgacgcaggagaaggtcgagcagcgcatgggcctgctgaccaccacgatgtcctatgacgacatcaagaacgccgacctcgtgatcgaggccgtgttcgaagaaatgggcgtcaaggaaaccgtcttcaagaagctggacgaagtgatgaaggacggcgcgatcctggcctccaatacctccacgctggacgtcaacaagattgcctcgttcacgcgtcgtccgcaggacgtggtcggcatgcacttcttcagcccggccaacgtgatgaagttgctggaagtcgtgcgcggcgagaagaccggcaaggacgtgctggccaccgtcatgcagatcggcaagaagatcaagaagacggccgtggtgtcgggcgtttgcgacggcttcatcggcaaccgcatgatcgagcagtacagccgccaggccggctacctgctggacgaaggcgcgctgcccgagcaggtggacaaggccatcgagaagttcggtttcgcgatgggcccgttccgtatgggcgatctggctggcaacgacatcggctgggcgatccgcaagcgccgcgccgtggacaagccggacatccagtactcgaagacggcggacaagctctgcgagatgggccgcttcggtcagaagaccggcgcaggctggtacgactacaaggctggtgatcgcaagccgtacccgaacaagcaggtcaacgacatgatcgtcgagcactcgaaggagctcggcatcacgcgccgcaagatctcggatgaggaaatcgtcgaacgtctggtgtttgcactggtgaacgaaggcgccaagatcctggaggagggcattgcctcgaaggcgtcggacatcgacatggtctatctgaccggctacggcttcccgctgttccgtggtggcccgatgctgtacgcggaccaggtcggcttgtacaacgtggcccagtccatgaagcgctatgccaagggttaccacggcgaagcgtgggtggtggcgccgctgctgcagaagctggcagacgagggc

SEQ ID NO: 32273 - DNA, 1177 bp, Ralstonia metallidurans
atgaacgaggcagtcatcgtatccaccgcccgcaccgggctggccaagagctggaagggcgctttcaacatgacccacggcgcgaccctgggcggtcatgccgtacagcacgccatcgcccgcgccgaagatcgaagccggtgaagtggaagacgtgctgatgggttgtgccaaccccgagggcgccaccggcgccaacatcgcgcgccagatcgccctgcgagctggttgcccggtgaccgtgccaggcgccaccgtgaaccgtttctgctcgtccggcctgcagaccattgccatggccgcgcagcgcgtgatcgcagatgagggcgacatcttcgtcgctggcggcgtggagtcgatctcgtgcgttcagcaggacatgaaccgccacatgattcaggaaagctggctgaacaagaacaagccggaaatctactggagcatgctgcagaccgccgagaacgtggccaagcgctacaacatcggtaaggatcgccaggacgagtacggcgtgcagagccaactgcgtgccgccgctgccctggaagccggcaagttcaaggacgaaatcgtgccgatgacggtgctggcaggcgtggccgacaaggccaccggccagctgatgacgaaggaagtcacgatcgacgccgacgaaggtatccgtgccgacaccacgctggaagccgtgtcgaagatccgcacggccatgccgggtggcgtgatcaccgccggcaatgcctcgcagttctcggatggcgcctcggcagccgtcgtgatgaacgcacgcgtggccgccgccaagggcctgcagccgttgggcgtcttccgtggttttgccgtggcgggttgcgagcctgacgaaatgggtatcggcccggtgtttgcggtgccgaagctgctgaagaaggctggcctgaaggttgacgacatcggtctgtgggaactgaacgaagcgttcgccgtgcaggtgctgtactgcgccgacaagctgggcatcccgatggatcgcctgaacgtcaacggcggcgcgatcgccgtgggtcacccgtacggtgtgtcgggcgcgcgtctggtcggccatgcgctgatcgaaggcaagcgccgtggcgtcaagtacgtcgtggtgacgatgtgcatcggcggtggtcagggtgccgccggcctgttcgaagtgctg

SEQ ID NO: 32274 - DNA, 756 bp, Ralstonia metallidurans
ttgttcgacctcaagggccgtacagcgctgattactggcggatcgcgcggcctggggctgcagattgccgaagcacttggtgaacagggcgcccgcgtggtgctgtcggcccgcaaggccgatgagctccagaccgcgcaggaacacctgaagtcgcgtggcattgcggcggagtggatcgccgcggatggttcgcgcgatgccgaaatcgcccggctggccgatgaggcgctggcgaagctcggacacgtcgatatcctcgtcaacaacgccggggccacctggggcgcgccggccgaggatcatccggtcgaggcctgggacaaggtgatgaacctgaacatccgtggcctgttcctgctgacgcagcggattggcaagctgtcgatgattccgcgtcgcagtggccgggttatcaacgtcgcgtcgatcgcgggcctggccgggaacccgccgggttcgatggagaccattgcctacaacacttcgaagggcgccgtggtcaacttcacgcgcacgctggcgggcgagtggggcgagcacaacatcaccgtcaacgcgctggctccgggcttcttcccgtcgaagatgacgcaggggtcgctggaccgcatgggcgtggacaaaatgtgcgaaggggttccgctgcatcgcctgggtgatgacgacgatctgaagggcgcggcactgttgtttgcctcggatgccggcaagcacatcaccggccagatcctggcggtagatgggggcgtcagc

SEQ ID NO: 32275 - DNA, 1449 bp, Ralstonia metallidurans
aaagaaatccacaacttcatcaacggcgaatatgtgccgggtcagcgttggttcgagaagcgctcgccgttgaacaacgcggtcattgccaaggtggccgaagccggccgtgccgaagtcgacgcggcggtggctgcggcgcaggccgcgctcaagggagcgtgggggcgcatgagcttggcccagcgcgtggaagtgctgtacgcggtggccgacggcatcaaccgtcgttttgacgacttcctggccgctgaggtagaggacacgggcaagcctatgagcctggcgcggcatgtggacattccgcgtggggcggccaatttcaagatcttcgccgacgtggtgaagaacgtgcccactgagttttttgaaatgcctacaccggatggtgtcggggcgatcaactacgccatgcgtcgaccggtcggggtggtcggggtgatctgtccatggaacctgccactgctgctgatgacctggaaagtcggcccagcgctggcctgtggcaacaccgttgtggtcaagccctccgaagagacgccgcagaccgctgcattgctgggcgaggtgatgaacgcggcgggcgtgccgcgaggggtctacaacgtcgtgcacggcttcggccccaactccaccggcgaattcctcaccacccaccgcggcatcaacgccatcaccttcaccggtgaaacccgcacgggtgcggccatcatgaaggccgcggctgacggtgcgcgccccgtgagtctggagatgggcggcaagaacgctgccatcgtgtttgccgactgcgacttcgacgccgccattgaaggcacgctgcgctcgtgcttcgccaactgtggccaggtctgcctgggtaccgagcgggtatatgtcgagcgccccatctttgatcgttttgtctccgcgctcaaaaaaggcgctgaaggcatgcagctcggccgcccggaagatccggccaccggcatgggcccgttgatttcgcaagagcatcgtgacaaggtgctgtcgtattacaagaaggcggttgaagcgggcgcgacggtggtggcgggcggcggtgtacccgatatgccggacgcgctcaaaggcggcgcgtgggtacagcccaccatctggacgggcttgggcgacgactcggtaattgcccgcgaggagatcttcggcccttgcgtgctggtcatgccattcgacagcgaagaagaggtgatccgccgtgccaacgataacgactacggcctggccacggcgatctggaccaccaatctgtcgcgtgcgcaccgcgtggcgggggccatcgaggtcggcattgcgtgggtgaactcctggttcctgcgcgatttgcgcacgccgttcggcggggccaagcagtcgggtatcgggcgcgagggcggagtccactcgctggagttctacacggaactcaaaaacgtttgcatcaaactg

SEQ ID NO: 32276 - DNA, 607 bp, Ralstonia metallidurans
atgaaactgtactacagtcctggcgcttgttcgctttcaccgcacatcgtattgcgtgaaatgggcttgacattcgagctcgaaaaagtggatctgcaaagcaaaaaagaccgagagcggttctgactttcgcagcgtcaaccccaatggttatgtgccgctgctggttctcgacgatgggcaggtgctcacggaaggtccggcgatcgtacagtacttggccgatcgggctcccgaagcgcggcttgcgcctgaagccgggacgatggagcgctatcgtttggtggaatggctaaactttatttcgaccgagcttcacaaggcttttgcaccgcttttcaatcctaaaacgccggaagaatggaaagccatcgtaaatgatttgatcgcggcgcgtctggcttatgttgaaaaaaagctcggtggtcaggtctatctgatgggagataacttcacggttgctgatgcttatctgttcaccgtgctgtcttggggcaagtgggtcggcgtagatatcggacgctggccgactttgcagagctatacgaatcgaatttcttctcgcccgaccgtgcaggccgcgctcaaagccgagggtctgatctaa

SEQ ID NO: 32277 - DNA, 1650 bp, Ralstonia metallidurans
ggcctgcctggcacgctgcatgtgccgcagaccagcctgttccacaacctggaagtggccgcgcggcgctatcccggcaagacggcgatccagtatttcggcaccgcgatcacctatgcggaactgctggatgacgtcgaacggatggccggctatctgcagcaaagctgcggcattcagcccggggatagggtagtgctttacagccagaacgccccgcagttcatcgtggcgtactacgccatcctgcgtgccgaggcggtggtcgtgccagccaatccgatgtggctggaagccgaactggagcatgtggttgccgatagcggggcggtggccgcgttctgcggcagcgaattgtatgagcgcgtcgcgtcgctgcatggcaaggcgctgcgtcatgtgatcacgtaccactacgcggggatgctgcgcgacgatggtggcctgccggttccggcctggctgcgcgagcctgctcccgcgtcgcgcgcggccccaggtggcgccatgccagtggactgggacaccgcgcgcaatgctggccagcgtccgcgcgcgcacgaggctggctacaacacgctttgcatgctggcatatacctccggcaccacgggcaatcccaagggctgcatgcatacccacggcaccatgatgagttccgcggtgggctcgcaagtctggcgcagcagttcgccggaatcggtggtgctcgcggtggcgccgatgttccacctgctgggcatgcagaactgcatgcattcgccgatctacctgggtgccaccgtggtgctgatgccgcgctgggaccgcgcgcttgccgccgatctgatcgagcgctaccgcgtctcggcctggggcgcgccgccggccatgctggtggactttttcgcgcagcccgatgtggcccggcgtgacctttccagcttggcttttctgggtggcggtggcgcggccatgcccgacgcggtggccaatatgttgcaggaacgcttcggcctgccgtacgtcgaggcctatggcatgaccgagaccgcgtcgttcctgctgtccaacccgcgccagaagcccaagcgtgagtgcctgggcattgccaccttcggcgtggacgcccgcgtggtggaccccgaatcgctcgccgaactgccgcagggcgagatcggcgagatcgtcgtccacggcggtcaggtgatgcagggctactggaacaacccgcaggccaatgcggaatccttcatcgaaatcgccggcaagcgctttctacgcaccggcgacctcggtttcatggatgaagaaggctatttcttcatgcgcgaccgcctcaagcgcatgatcaacgcgtccggcttcaaggtctggccggccgaggtggaaaacctgctctacggccacccggccatccacgaggcctgcgtgatcgccgcgcgcgatgagcatcgcggcgaaacggtcaaggccgtggtggcgctgcgccccgaatcgcgcggcacgccggaggccgatgcggaacgcatcatggcctggtgccgcgagcgtctggcggcctacaaggtgccgcgcatcgtcgagttcgtggacgcgctgcccaaatcggccaccggcaagatcctgtggcgcgcgctgcaggaagacgccatgcgggcataggggggg

SEQ ID NO: 32278 - DNA, 819 bp, Ralstonia metallidurans
atgagctacatcaccgctgaggacggcacgcagatcttctacaaggactggggctccggccggccggtcgtgttctcgcacggctggccgctcaatgccgacgcgtgggatgcccagatgctgttcctggtgcagaagggctttcgtgtgatcgcgcatgaccgccgcggccacggccgctcggaccagcccgcgcggggcaacgacatggacacgtatgccgacgatctggctgcgctgctcgtggcgctggacatcaagggcgccacgctggtcggccactccaccggcggcggcgaagtggcgcgctacattggccggcacggcacgcagcgcgtggccaaggccgtgctgatcggcgcggtgccgccgattatggccaagaccgcgtccaatcccaacgggttgccgatcgacgtgttcgacggtatccgcaaaggcgtagccgacaaccgttcgcagttctacaaggacctggccgtgccgttcttcggcttcaatcgtcccggcgccaaggtctcgcaaggcaccatcgacacattctgggcccagggcatggcgggcggcatcgtcggccagtacgcctgcatccacgagttctcggaagtggactacaccgaggatctgaagaagatcgacgtgcccacgctggtcctgcacggtgacgacgaccagatcgtgccgatcgacaacgccggccgcctctctgccaagctggtgaagaacgccacgctcaaggtgtacccgggcgcgtcgcacggcatgtgcgtggtcaatgccgacgcggtcaatgcggatctgctggccttcctgaatact

SEQ ID NO: 32279 - DNA, 1230 bp, Ralstonia metallidurans
atcttcctgatgatgctgctcctcgtggcgatcaactacatcgaccgcgcatcgctgtcggtggccatgcccctgatcgcgaaggaattcgacctgagtcccgccatgcaggggctgatcctgagttcgttcttctggacctatgccgtcatgcaggtgccgggcggcatgctggccgacaagtacaagccgcgcatcgtgatcgctacggctaccgtgttctggggtgcattccaggcgctggcggcggtctgcaccaatgccacctcgctgctgctgacgcggctggggctcggcgctgcggaagcgccgatctacccggccggcggcaagctcaatgccatctggatgacgaagaacgaacgtggccgtggcgccacgctgctcgacggcggcgcgccgctgggcgcggcacttggctcgctcatcattgccgggctgatcagcgaactgggctcgtggcgcctgtcgttcgtcgtggccggcgttggcacggtgctggccggcttcgtggcatggtggtacatccgcaactcgccgcgcgaacacctgggcgtgaatgaacaggaagcccgtcatatcgaggacgcgcttgccctggagcacagcgaggagccgaccaacctgagcggccgttcactggacttcttcaagtaccgctcggtctggtgcatggccatcagctggatgtgcttcaacgccgtgttctacggcttgctaacctggatgcccacctacctgagcaaggcccgcggcttcgacctgaagcagatgggcggcgcgagcttcatcatcttttttgccggattcgtcggcgaactgatcggcggctggatcgccgacaagtggaaggaagccggcggacgcccgaacgtggtgatgcgcacactgttcggcatcgccgcggtggtggctacggtgtcgatcttctcggtcgcctacgtcaccgaccccgtagcggtcgtggtactgctgtcctccaccctgttcttcctgcgctggtgcggcctgttctggtccgtgccgtcgatgctgggcacccgcaacaaggtgggcttcctcggcggcgtgatgaacctgggcggcaacatcgccggcatcagcgtgccaatcatcgtcggcctgatcgtccaggccaccggctcgtacttcctggcgctgatgttctttgccgcctgcggcatcggcctgctgctggcgtcgaccaacatcgactacgaaaagaagatt

SEQ ID NO: 32280 - DNA, 699 bp, Ralstonia metallidurans
gtcaccggcggatcgcgcggcatcggcgccgcggtagtgcggcgcctggcacgcgaaggcgccgccgtggccttcacctaccagagctccggcgcggttgcgcaagcgctggctgaatcgatccaggccgcaggcggccgtgcccgtgcctatcacgccgacgcggccgatgccgcggccgtcacacgtgcgatcgacgcggccgccgctgacttcggcaagatcgacatcctcgtgaacaacgccggcgtgctattcctcggtccggtcgacacgttcccgctggaagacttcgacaagacgctggccgtgaatgtacgcgcggtatttgtcgccgcgaaggcagcgctggcgcacatgggccagggtggccgcatcatcaacatcggcagcaccaatgcggaccggatgccgttcccgggcggcgccgcctacgcgatgagcaagtccgccctgaaagggctggtgcaaggcatggcacgcgacctgggaccgaagggcatcacggtcaataacgtgcagcctggcccggtcaacaccgacatgaaccccgaggacagcgaattcgccgcatcgctgcacggcctgatggcgctgcaacgtcatgcccaccccgacgagatcgccagcatggtggcgtatctggccggccctgaggctggattcgtgacgggtgccagcctcaacgtggatggcgga

SEQ ID NO: 32281 - DNA, 1808 bp, Ralstonia metallidurans
gccgtggacgacgtgtcgttcacggttggccgtggcgagatcatgggcctggtcggtgaatcgggctcgggcaagtcgatgaccggctattcgatcatggggctgatcgatccgccgggcaaagtggtggaaggccgcatcgcgctgaccagccgggacggcgtgactcgcgacctgcgcgcgctgacgcccgcgcagcaacgcgacgtgcgcggcaaccggatcgcgatgatctttcaggacccgatgatgacgctgaacccggtcctgcgcatcgacacccagatgatcgaagccgtgcgcgcgcacgacgatgtcagcaaggccgccgcgcgtgagcgcgcgcgcaatgcgctggcacgcgtcggcatcccgtcgccagacgagcggctgcaggcctatccgcatcagttttccggcggcatgcgccagcgcgtggcgattgcgatcgccctgctcaacaagcccgacctgatcatcgccgatgagccgacgaccgcgctcgacgtcacgatccaggggcagatcctgtatgaaatgcagacgctgtgccgcgaatccggcaccgcgctaatctggatcactcatgacctttccgttgtggcggggctggccgacaaggtctgcgtgatgtacgcgggcaagatcgttgaatcgggcgacgtgcggcaggtgctagaagctccccggcatccttatacccatgggctgatcgactcggcgccgtcgcgcaatccgcgtggtgtgccgctgcggcagattccgggcatgacgccatcgctgctgaatcttccgagcggctgcgcgtttcgcgagcgctgcccctatgccacggagatctgtgccaccgagccgccgcttgaactgtcgccagatgggaggcagttgcgctgcttccatccggtacacgcccagcaggaggccgcatgagcgcgaatgtgatggataccccgggcgcattggcctccggcgtggcggcggagacggccatgccgccggcaccgctgctggaactgcgaggcgtctccaagcgcttcgtcaagtcgctcgacatcgcggcgaaagtcgccaatgtattcggcgcgaagcagcgcgtggagatcgttcatgcggtggatcgtgtcgacctctctatccgcgctggcgaggttgttggtctcgtgggggaatcgggctgcggcaagtccacgctgggccgcatggccgtgggcctgcacacgctgactgaaggggagcgattctggcgcggtacggatctcgaccggctgccgccagaccggaaacgcgagaagcagcttgcgatccagatgatcttccaggacccgtacgcgtcgctgaatcctcggatgcgcgtgctcgacatcgtcggcgaggcgcctgtcgttcacggcatggtggagaagggcgcgcagaaggcgtatgtggaagacatgctcgtgcgcgtggggatggatccgaccgtgctgcgccgcttcccgcatcagttctcgggcggtcagcgcgcgcggatcggcattgcgcgcgcgttggcggtcaagccggaattcctggtctgcgatgaatcggtggcggcgctcgacgtatcgatccaggcccaggtgctgaacctgttcatgcgcctgcgcgaagaactgaacctcacgtacctgtttatcagccatgatctgggcgtggtcaagcacattagcgaccgcgtggtgatcatgtatctgggacgtgtggtggagtccgcgccgaccgaggaggtgttcgccgcgccgaatcatccctatacgcaggcgttgctggccgaggcgccgaagcttgag

SEQ ID NO: 32282 - DNA, 1353 bp, Ralstonia metallidurans
gggatggagcgtctgttccaagcgcagcggtcagcctttgccgccgcgccctacccggcgctggccgacagaaagcagggcctgcggcgcttgcgcgatgcagttcgcaagcacgccgacagcctggcgcaggcggcggaccgggacttcggcggacgcgcccatgccgagacgatgatggtcgacgtgctgccgtccgtgctgcacatcaaccacctgcttggcgggctacgccggtggatgcgaccgtcgcgcaggagtgtcgaactgttgttcctcgggaacagcgccaaggtggtgtatcaacccaagggcgtggttggcatcgtggtgccctggaacttccccgtctatctggcgctcgggccactggccaccgcgctggcggcaggcaaccgatgcctgatcaagacctcggagttcgcgccccggacctctgccgcgctgcgcgccttgcttgctgaggcgttcaccgaggacgaagtcgccatcgtcgaaggcgacgccgacgtggcacgccagttcaccggcctaccgttcgatcatctggtgttcacgggttcgcccgaggtcggccgccacgtgatgcgtgccgccgccgaacacctgacgcccgtcacgctcgaactcggtggcaaatcgcctgccatcgtgtcgtccagcgcgaacctggcaaccgcggcacggcgcatcgcccacggcaaaacggtcaacgccggtcagatctgcgtggcgccggactacgccctggtgccagaggcgctcgccgcccgttttgccacggaagtgctgaacgcatccgcagcgctgttcccggcggatcgcgacgactacgcaagcatcattcatgaccgcgcccaccagcgcatgaacgatctgctcgatgacgcgcgtgcccacggcgcgcaggtcatgcgctcggccatgcccgaggatggacgccgcgtgccactgcacgtggtactcggcgtaacgccccggatgcgcatcgcgcgcgaagaaatcttcggcccgatcctgccggtcttcacctatcgcgcattcgaggacgtcgtgacgcacatacgcggcggcacgcgcccgctcgccatgtactacttcggcgacgacaaggccgaatccaccaccctgctgcaacgcacgcacgcgggcggcgtcacgctgaacgactggggctggcacgtgctgaatcacgacctgccgttcggtggcaccggcacgtccggcatgggcaactatcacggcgccgagggcttccgcgagctatcgcacgccaaggccgtgttctccgagcggaagtggttcccgatcgaattgtttcatccgccctacggcacgttcatccagcgcctg

SEQ ID NO: 32283 - DNA, 1575 bp, Ralstonia metallidurans
ttcgactacgtcatcattggcgcgggttcggctggctgcgtgctggccaaccgcctgagcgccgacccctccgtgcgcgtctgtctggtcgaagccggcccggtcgatcgctctccgctgatccacacgccggctggcatcgtcggcatcctgccgacccgacacgtcaactgggcattcgagacagttccgcagccagggctgaagggccgtctcggctaccagccgcgcggcaagacgcttggcggcagcagcgccatcaacgcgatgatctacatccgcggccaccgcaccgattacgacgactgggctgcgctgggtaatcccgactggtcctacgacggtgtgctgccctggttccgacgatccgaggattacttcggcggcgccgacgcttatcacggcgccggcggcgagctgaccgtgagcgcgctcgacgcccatccggccacgcatgcgtttatcgaagccggccgcaagagcggccacgccgtcaatgcggatttcaacggcgccgaccaggaaggcgttggccactatcatgtgaccattcgcaacggccagcgctgcagcgcatcggtggcgttcctgcatcccctccgcgacaagcgcccgaatctcaccgtgctgacgggcggccatgccacccggctgatcctgcgcggcaacacggcggaaggcgtcacggtccgcgtgaaaggccgtgacgtggaactgcacgcgcgccgcgagaccatcgtggcagccggcgcgttcggcacaccccaactgctccagctttcgggcatcggcgacgaagcagacctgcgtccccatggcatcgccgtccagcacgcgctgcccggcgtcggcaaggggctgatcgaccatcccgactacatcctgcccttcaagagccccgacaaatcgctgatgggcgtgtcgctgcaaggcgcggcggccatgacgaaggcgttcttcgagtaccgcaagtcgcgcacaggtctgctggccagcaacttcggcgaggccggcgcgttcctgcgcaccgatccgtcgctgtcgcgtcccgacgtgcaactgcactgggtcaccggcatcgtggacaaccacaaccgcacgctccacacgggacacggcatgagctgccacgtctgcgtgctgcgtccgaagagccgcggcacggtcggcctgaactccgccaatccgctggcgccgccgcgtatcgacccgaacttcctcagcaacgacgacgacgtgacgacgctgctcaagggctacaagctctcgcgcgagatcatgcacgcccagccgctggcccgctacgccgggcgcgaactgtacgtgaagggtgtgagcagcgacgaccagctcgtcgacctgctgcgccgccgcaccgacaccatctaccacccggtgggcacctgccgcatgggtagcgacgacatggccgtggtcgaccagcgcctgcgcgtgcgcggcatggaacgactgcgcgtggtcgatgcctcgatcatgccgacgctgatcggcggcaacacgaatgccccctcgatcatgatcggagagaagggtgccgcgatgatcgcggaagac

SEQ ID NO: 32284 - DNA, 894 bp, Ralstonia metallidurans
gccatcgaaattaccgatgtccgcaagcgctaccgcaatctgcaggcgctcaagggggtcagtttcagcgtcgagcgcggcgagtttttcggcctgctcgggcccaacggcgcgggcaagaccacgctgatctcgatcctcgcgggcctgaaccgcgccaattcgggacgcgtcagcgtgcttggccacgacgtcgtggacgactaccgcatggcgcgccgcatgctgggcgtggtgccgcaggaactggtcttcgacccgttcttcacggtgcgcgagaccctgcgcctgcaatcgggctacttcgggctgacgcgcaacgacgactggatcgacgagatcatggccaatctcgatctcacgaacaaggcggacagcaacatgcgccagctctcgggcggcatgaagcgccgcgtgctggtggcgcaggcgctggtgcaccggccgcccgtgatcgtgctggacgagccgaccgccggcgtggacgtggaactgcgccagacgctctggaagttcatctcgcgcctgaaccgcgagggccacacgatcatcctgaccacccactacctggaagaagccgaggcgctgtgcgatcgcatcgccatgctcaagttcggggaagtggtggcgctggaccgcaccagcaacctgctgacccagttcgccgggctgcaactggtgctcacgctgtcacggggcacgctgccgccggcgctggaagcgctgcgcacgccgtccaacccgggggagcgcgcgcatcgcctgcgcctgtccggatacgaagccgtggagccgattcttgctgcgctgcgggaagccggttgcgaaatcgaagacatggaaatcagcaaggccgacctcgaggacgtgttcgtccagatcatgcgccgcgaa

SEQ ID NO: 32285 - DNA, 750 bp, Ralstonia metallidurans
tacgcggctggcgacaagccaatcctctccggcctttccatgcgctttccgcgcgggaaggtggtggccgtcatgggtggctccggctgtggcaagaccacggtcatgcgccttatcggcggcatggtgcgcccgcagcgcggcagcgtcactttcaacggtgccgacatcgacgccatggaccagaagggcctgtatgcggtccggcgacagatgggaatgttgttccagtttggcgcgctgttcactgacttgtcggtattcgacaacgttgcatttccgctgcgcgaacacaccgatctgccggagtcgatgatccgggatctggtgctgatgaagctcaacgcagtagggctgcgcggcgcacgcgacctcatgcccgcgcagatttcgggcggcatggcgcgacgcgtggcgctagcccgcgccatagcgctggaccccgcgctactgatgtacgacgagccgttcgccggcctcgacccgatctcgctcggcctgaccgcaagcctgatccggaatctcaacgacgcgctcggcgcgaccacgatcatcgtctcgcatgacgtgaacgagacattcctgatcgccgattacgtctatttcatcgccaacggccgtatcgcggcggaaggcacgcccgacgcgatgcgcggctcggatgatccattcgtgcgccagttcgttcacgccgaggtggacggtccggtgccgttccactatgccggtccggcactggccgatgatttc

SEQ ID NO: 32286 - DNA, 1521 bp, Ralstonia metallidurans
ctgcatctgcaacccggtgagctcacgctcgcgcaactgcgtgccgtgcatcagcagcccgtcaagatcacgctcgacgagcgcgccttccccgccatcgaccgcagcgtggcgtgtgtcgaaaacatcatcgccgagggccgcacggcctacggcatcaacaccggattcggcctgctggcacagacccgcattgcccgcgaggacctggagaacctgcagcgttcgctggtgctttcccacgcggcaggtgtgggcgagccgatcgacgacgcgctggtgcgcctgatcatggtgctcaagatcaacagcctggcgcgtggcctgtctggcatccgccgcaaggtgatcagcgcgctgatcgcgctggtgaacgccgaggtgtacccgtgcattccgctgaagggctccgttggcgcgtcgggcgatctggcgccgctggcccatatgtcgttgctgctgctgggcgaaggccgggcacgccatcgcggcgaatggctgtcggctcgcgaagcgctggccattgccgatttgcagccgctgacgctcgccgccaaggaagggctggcgctgctgaatggcacgcaggtttccaccgcgtatgcgctgcagggtttgttccaggcggaagacctgtacgcggcggccagcgtttgcggcgcgctgaccgtcgaggcgacgctcggctcgcgcgctccgttcgatccgcgcattcacgccgcccgtggccagcgcggccagatcgacgcggcggcggtctatcgtcacctgctgggggagaccagccagctcggccaatcgcacgcgcattgcgacaaggtgcaggacccgtactcgctgcgctgccagccccaggtcatgggcgcctgcctgacgcagatccgcaatgcggcggatgtgctgggcgtcgaagcgaactcggtttccgacaatccgctggtattcgcgcaggaaggcgatatcatctcgggcggcaatttccacgcggaaccggtggcaatggccgcggacaacctcgcgctggcgctggccgagatcggctcgctctccgagcggcgtgtgtcgctgatgatggaccagcacctgtcgcagttgccgccgttcctggtcgccaatggcggcgtgaactccggcttcatgatcgcgcaggtcacggccgccgcgctggcatcggacaacaaagcgcttgcgcatccggccagtgtcgatagcctgcctacctcggcgaaccaggaagaccatgtgtcgatggcgcccaacgctggcaagcgtctctgggagatggccagcaacgtcaagggcatcgtggcgatcgaatggctggcggcctgccagggcatggacttccgtgaaggcggcaagaccaccgaagcgctggagcgcgcgcgcggcctgctgcgtcagtcggtgccgttctacgacaaggaccggtacttcgcgccggatatcgaagacgccagcgtgctgatcgccgagcgtcacctgacggccctgctgcctgcaggcatcctgccgagcgtc

SEQ ID NO: 32287 - DNA, 1344 bp, Ralstonia metallidurans
gacagcttgaaaaacctgcaacgcaatctgagcgcgcggcatatccgctttctcgcgctcggctcggccatcggcacgggcctgttctacggttcggcatcggcgatccagctggccggcccggccgttatcctggcgtacatcgtgggcggcgcggcggtctacatggttatgcgcgcgctgggcgagatggctgtgcgcgagccggtgaccggctcgttcggccgctacgccagcgagtacctggggccgctcgcgggctttcttaccggatggacctacatcctcgagatgatcatcgtctgtctggcggacgtgaccgcattcggtatctacatgggattctggttccccgaagtgccgcaatggatatgggtgctcggcatcgtcatgctgatctgcgggctgaacctgtgcaatgtgaaggtgttcggcgagctcgagttctggctggcgttggtgaagatcctggccatcgcggcgatgatcatcggcggcacgctgatcctgttcctcggcgtgaagatgaatggcgagcattcgccgggcttgaccaatctgtgggcgcatggcggcttcctgccgcacggcgcgggcgggttgatcgcgtcactggcggtggtgatgtttgcctacggcggcatcgagatcatcggcatcactggcggtgaagcccagaatccggagaaggtgattccgcgcgccatcaacgccgtgcccgcccgcatcctgctgttctacgtgctgacgatgaccgtgctgatggccatcttcccgtggaccggcatcggtagccagggcagcccgttcgtgcaaatcttctccgggctggggatcaaatcggctgcggcggtgctcaacctgatcgtcatctcggccgccatctcggcgatcaacagcaatatctttggcgcaggccgcatgatgtatggcatggcggagcagggccaggcgccgcgcctgttcgccaccacctcgcgtcatggcgtgccctgggtgacagtgctggcgatggctgctgccttgctcggcggtgtggtgctgaactacctgatccccgagcaggtgtttgtgatcatcgcgtcgattgcgaccttcgccaccgtgtgggtctggctgatgatcctgctgtcgcaggttgccatgcgacgccgcctgtcggccgaagaggttcgcgccctcaagttcaaggtgccgctgtggccggtcggtccggcgctggcgatcgccttcatgctgttcgtgatcggcgtgctggggtatgtcgaggacacgcgcgtggctctgtacgttggcgcgggctgggtcgtgctgctgtcgctggcctggttcctgcgggccaag

SEQ ID NO: 32288 - DNA, 660 bp, Ralstonia metallidurans
gagggcgatgcgcttgaagttacgcagcgggcgctcagtgaagtcgtcagggcgcaactggaccgtggcgcgctgccaatcgtgctcggtggcgggcacgaagtggcctggggcacctggcagggtctcagggcacatctggatacggcgggcgacgcgggccgcgtcctgatcctcaacctcgatgcgcatttcgatttgcgcactgcgcggcccggcagttccggcacaccgtttgaccagattgcggaggcgtgccgtgccgcagggcagccgtttgactatgcgtgtctcggcgtcagccggctcggcaacactgcatcgctgtttgcccacgcgcaggcgctgggcgtgcgctacgttgaagacaccgagatgcaggaacgccatctcgaccacaggctggccgagatcgacgcgatgctggcgcaggccgcacatgtctacctgacgatcgatctcgacgtgcttccggcagccgtcatgcccggtgtctccgcgcctgccgcgtatggcgtgccgatcagcgtgatcgaggccatcgtcacgcacgtgcggggtagcggcaagctgcgcgcggcagaccttgcggagttcaatccgcagttcgaccgtgacggccagagcgcccgcgttgccgcgcggctggtgtatcggctg

SEQ ID NO: 32289 - DNA, 1683 bp, Ralstonia metallidurans
gccgttccactttccggagacaccatgacgccctatgaccgcaagccctggctgtcgagctacgagccgggcaagccccacgcgatcacgcccgagttcaccgacgcgctgagcctgttccgtgccgcggtagcgcgcgcgccgtcgctgccagccattctctacttcgacggcagcctgagctacgccgaactcgacacgcaatccgacgcgctcgcctgcgcgtggcaagaccgcggcatcacgcgcggagaacgcgtggccatttacctgcagaacatcccgcagttcgtcatcgctctggtggcgacgtggaagctgggcgccattgccgtgcccgtcaacccgatgaaccgcgcgcgcgaactgcgcgtgatcctggcggattcgggcgctcgcctgctggtttgctccgagactctgtacgtcgatatcgtccgccccctgcttgccgaagaagccaatgcggaaaacggcgtgctgcctctggtgatgacgacatccgaactggagtaccaacggcgccacgacccacggctgttcgccaatacgagccgacaggagacaccgggcgcggaatccctgtcggcagtgatcgcagccaacgccggccgccatcctccgccagcggcgctggggccgaacgacatcgccatgctggtgtacacctccggcaccaccggcgtgcccaagggcgcgatgaacacccacggcaacgtagccttcaacgcccaggtctaccgcgactggatcacgctgggcgaaggcgagcccatcctcggcgtcgcgcccctgtttcatatcaccgggctgatcggccatatcggcgccgccttcatgtgcgccgccccgctggtgctggcctgtcgcttcgaaccgggcgtgatgctcgacacgctgcgcgaacatcgccccgccttcaccatcggcgccatcaccgtgttcatcgcgctgatgaaccacccgaacgccacgcgcgattgcttcgcgtcgctgaccaagatctactccggcggcgcgccgattccgcccagcgtggtggaggcctttcgcgagcgcttcggtcactacatccacaacggctacggcctgaccgagaccaactcgccaacgcacgtggtgccgcgcggggtcgaggcgcctgtggacccggcctccggcacccttgccgtgggcgtgccggcctacaacgtcgagtcctatattggcgacgacgaaggcaagccgatggcggttggcgaagtcggcgagatcatttcgcgtgggccgatgatcgtgccgggatactggaacaagccgcaggagagcgccaaggccatcgtcgatggttacttccgcacgggggatgtcgggttcatggacgaacgcggctggttctacctcgtggaccgcaagaaggacatgatcaacgccagcggctacaaggtctggccacgcgaggtggaggacgtgctgtacacccatcccgccgtgcgggaggccgccgtggttggcgtacctgatgcctaccgtggcgagacggtgaaagccgtggtcagcctcaagcccgggacgaacgtcacgccggaagaactggcggagtactgcaaggcccggatggcggcgtacaagtatccccgcgtggtgatgatcatggacgagcttcccaagaccgttaccgggaagatcttgcgacgggagttg

SEQ ID NO: 32290 - DNA, 1176 bp, Ralstonia metallidurans
ttcgaaaggacacctgagcagaacgcgatctgtcgagccgtgacgcagctttgcagcgatttaggagccgagtactgggctgaactcgaccgcgagacacaagtttcccgaggctttccatcgggcgatggccgacgcgggttgtgctgggcatctgccatgcccgaacggttcggcggcgcggggctggggatcaccgaagcggcgctgatcatgcagacggtctcggcgtcgggtgcaggcttctccggggcatcgtcgatccatatgaacgtgttcggcctgaatccggtggtggtgttcggcaccgaggcccagcaggccgccgcgttgccgccgctgatcgcggggcgcgacaaggcatgttttgccgtgaccgagcctgacgccgggctggataccacgcacctgaagacgcaggccgtgcgcaccgccgacggcagcgcctatcgcgtggacggccgcaagatctggatttcgacggcgcaggtggcatcgcgcatgctgctgctggcgcgtaccacgccgctagatgcggtggccaagccgacccagggtttgagcctgttctacacgacgctggaccggaaccacatcgaggtacgcgagatcgacaagatggggcggggcgcggtcgattcgaacatgctgttcatcgacggcctgatggtgcccgcggaggatcgtatcggcgaggagggccgtggctttgagtacatcctgcatggcctgaaccccgaacgcattctgatcgccgcggaatcggtaggccttggccgcgccgcgctggaggcggccacgcgctacgcgcgcgagcgcacggtgttcgggcggccgatcggccagaaccaggggattcagcatccgctggcccaggcgtggatggcgctggaagcggccgacatgatggtgtggaaggccgcctggctctacgacaatggaaagccgtgcggcgccgaggcgaatgcggcgaagtatctggccgccgaggccgcgcaccaggcctgtcagaccgccgtgctgacgctgggtggcatgggctatgcccgggaataccacgtcgagcgctatctgcgcgaatcctatatcccgcgtatcgcaccggtcagcgcacagctgatcatgtgccatatcgccgagcgggtgctgggattgccgaagtcctactgagcttga

SEQ ID NO: 32291 - DNA, 609 bp, Ralstonia metallidurans
atgaaactctatgtgcacccgctttccggccacgcccaccgcgcacagctgctcctgtccctgctcggccagccggcagaactgatcgaagtggacctgatgaccggcgcgcacaaatcgcccgagttcctgaagctgaatccgttcggccagatcccggtgctggtcgatggcgaaacggtcgtgcccgattcgaacgcgatcctggtctacctgagcaagaagcttggccgcaccgactggctgcccgaagcaccggcgacggcagcggctgtgcaacgctggctgtcggtcgccgcaggcgacattgccttcggacctgcccgcgctcgcatcgccacgctgttcaacgcgccgtacgatctggatgatgctgtcgcgcgggcccacgtcgtgctcaagcgcatggacgatgcgctggccgatcgtccatggatcgccgccgatcatccaacgattgcagacgtggcgctctacagctacaccgcgcgggcgccggagggctttgtcgatctgcgggactacggcaaagtgcgccaatggctggctcgcgtggaggccctgccgggcttcgtgccgattgtgaaaagcccggtcggactcgaagcc

SEQ ID NO: 32292 - DNA, 1525 bp, Ralstonia metallidurans
actccaactgatacgtcgagattcgcgaagtcgtgtcgaatacgatgctgactacgtcagcaagctctccggcgtgcccaagaagcagctcgagcaactggccgagctttatgccgacccgaatctcaaggtcatgtcgctgtggaccatgggtttcaaccagcacacgcgcggcacgtgggtcaacaacatggcctacaacgtccacctgctgacgggcaagatcgccacgccgggcaacagtccgttctcgctgacagggcagccatccgcctgcggcacggcacgggaggtaggcacgttctcgcaccggctgccggccgacatggtcgtcaccaatcccaagcaccgcgaggaagccgaacgtatctggaagctgccgccggggactatccccgacaagcccggctaccacgccgtcctgcagaaccggatgctcagggacggcaagctcaacgcgtactgggtgcaggtcaacaacaacatgcaggcggcagccaacatgatggaggagaccctgcccggctaccgcaatccgacgaacttcatcgtcgtctccgacgcctacccgacggtcaccgcgctgtcggccgacctgatcctgcccaccgcgatgtgggtcgaaaaggaaggcgcgtacggtaacgcggaacgccgcacgcagttctggcaccagctcgtagacgccccgggcgaggcgcgctccgatctctggcagttgatggaattctcgaagcgcttcaaggtcgaggacgtctggccggcggaactgatcgcgaagaaacccgagtacaagggcaagacgctcttcgacgtgctgtatcgcaacggccaggtcgacaagttcccgctcaaggaaaccgcctccgactacaacaactacgagtccaaggctttcggcttctacgtccagaagggcctgttcgaggaatacgcgaccttcggccgtggccacggccacgacctggcgccgttcgacatgtaccacgaggcacgcggcttgcgctggccggtggtcaacggcaaggaaacgcgctggcgctatcgcgaaggctcggacccgtacgtgaaggcgggtaccggcttccagttctacggcaacccggacggcaaggccgtgatctacgccctgccctacgagccgccggccgagtccccggacaaggaatacccgttctggctggccacgggccgcgtgctcgaacactggcactccggctcgatgacgcggcgcgtgccggagctgtaccgcgccttcccgaacgcggtgtgcttcatgcatccggaagacgccaaggcactggggctgcggcgcggggtggaagtggaagtggtctcgcgtcgcggccgtatgcgcacgcgcatcgaaacccgcggacgcgacgcgccgccgcgcggtctggtattcgtgccctggttcgatgccagccagctgatcaacaaggtcacgctcgacgccacctgcccgatctcgctgcagaccgacttcaagaagtgcgcggtcaagatcgtcaaggtatgagta

SEQ ID NO: 32293 - DNA, 1935 bp, Ralstonia metallidurans
atggttgaactcgagatcgacggcaagaaggtagaggttgcggaaggcagcctcgtgatggaagcggcccagaagctgggcacgtacatcccgcacttctgctaccaccgcaaactgtccatcgcggcgaactgccgcatgtgcctggttgaagtggagaaagcgcccaaggcgctgcccgcctgcgccaccccggtgacgccaggcatgaaggttttcaccaattctgagaaggctgtgaaggctcagaaatcggtgatggaattcctgctgatcaaccacccgctcgactgcccgatctgcgatcagggcggcgaatgccaactccaggatctggcggtgggctacggtggttcggagtcgcgctacaaggaagagaagcgtgtggtgttccacaagaatgtgggcccgctgatctccatggaagagatgacccgctgcatccactgcactcgctgcgtgcgcttcggccaggaagtggccggcgtgatggagctgggcatgctgggccgcggcgagcactcggaaatcacgacgttcgtcggccagaccgtggattcggaactgtccggcaacatgatcgacctgtgcccggtcggcgcgctgaccagcaagccgttccgctactcggcccgtacgtgggaattggcacgccgcaagtcggtgtcgccgcacgacggcctgggtgccaacctcgtggtccagaccaagaaccagcgcgtgatgcgtgtggtgccgctggagaacgaggacatcaacgaatgctggatctccgataaggaccgcttcgcctacgaaggcctgaacagcgccgaccgtctgacccgcccgatgctcaagcagggtggcgaatggatggaaacggactggcagaccgcgctcgaatacgtggccaatggtctggcaagcatcaagcgcgatcacggcgccgaccagattgctgcgctggccagcccgcacagcacgctggaagagctgttcctgctgggcaagctcgtccgtggcctgggcagcgacaacgtcgacttccgcctgcgtcaatccgatttctcggccgcactgaagggcgcgccgtggctcggcatgccggtggccgacgtcagcacgctgcaacgcgcgctggtgatcggttcgtcgctgcgcaaggatcatccgctgctggcgtcgcgtctgcgtcaagccgtgaaaaagggcacacgtgtggccgtgatcggcgcgggcggtgaagacctgctgatgccggtcgccgcgcgtatcaatgctgccccgtcgggctggaccgccgcactggccggcgtggcccgtgccgtggccgccgccaagggcgtgaccgctccggccggtaccgaaggattcgacggtggcgatgccgcgaaggccgtggccgatatgctgctgtcgggcgaacgccgtgcggtgttcctcggcaacgaagccgtccgccacccgcagttctcgtcgctgcacgctctggcgcagtggatcgcctcggaaacgggcgcgacgctgggcttcctgaccgaggccgccaacacggtcggtggttatgttgctggcgccctgccacagcaaggcggtgccaacgcacaggccatgctcgatgcgccgcgccgcgcgtacatcgtgctgaacgccgagcccgagttcgacgccgccgatggccgcaaggcactggccgcgctgaaccaggccggcacggtcgtggtgctgtcgccgttccgttcggaagccgcgttgcaatacgcagacgtgatcctgccggtcgcgccgttcaccgaaaccgcaggtacgttcgtcaatgccgaaggcaaggcgcagagcttcaacggcgtggtacgcgcgctgggtgagtcgcgtccgggctggaaggtgctgcgcgtgctgggcaacctgctggaagtaccgggcttcgacttcgacacggctgaagccgtg

SEQ ID NO: 32294 - DNA, 1230 bp, Ralstonia metallidurans
atggatctcaattactcggcggccgacatcgccttccgtcaggaagtgcgtagctggctcgaagccaacctgccggcggaaatccgcgaaaaggtactcaaccaccgccgccccaaccgcgacgatctggtgcgctggcacaagatcctggctggcaagggctggtccgcgccgcactggccggtcgagttcggtggcacgggctggaacgccacgcaacgccacatctgggacgaggaaaatgcccgcgtcggcgcgcctggcgtgctgccgttcggcgtggcgatggtcgcgcccgtgatcatgaagtacggcaatgcagagcagaagtcgtactacctgccgcgtatcctcgactgcaccgactggtggtgccagggctattcggagccgggttcgggttcggatctggcttcgctgaagacccgtgccgagctgacgtcggatggcaagcactacatcgtcaacggccagaagacctggaccacgctcggccagcacgccgacatgatcttctgcctggtgcgcaccgaccccgaggccaagaagcaagagggcatttcgttcctgctgatcgacatgaagacgccgggcattaccgtgcgcccgatcatcatgctcgacgaagagcatgaagtgaacgaagtcttcttcgacaacgtcaaggtgccggtcgaaaaccgcgtcggcgaggaaaaccgtggctggacctatgccaagtacctgcttggccatgagcgtaccggcattgcgcgcgtgggtaactccaagcgcgaactgggcttcctgaagcgcgttgcccgccagcagcagaagaacggcaagccgctgctcgaggatccggtgtttggcgccaaggttgccgcgctggaaatcgaactgatggcgctggagatcaccgtgctgcgcgtggtgtcgagcgaagccgctggcaagggccccggccccgaggcatcgatgctcaagatcaagggcaccgagatccagcagatgctgaccgaactgatggtcgaagcggtcggcccgtacgcccagccgttcgatccggcgtacctggagtgcgaacacgagcacgccgtgaccggctatgacgacgccgccccgctggccgcgtactacttcaactatcgcaagacctccatctacggcggttcgaacgaaatccaaaagaacatcatcagccagatgattctggggctgtgaggagacacgcaacatgaacttcaatct

SEQ ID NO: 32295 - DNA, 1014 bp, Ralstonia metallidurans
gacgaacagaagcaactggccgacgcgattcgccgttttgtcgagaagagctacgacttcgaatcgcgcaagaagaacatcaagggcgcgaatggctacggcgagcaagcctggggcggactggtcgaactcggcctgaccgcgctgccggtgcccgaagcgcaaggtggcttctccggtacggctgtcgacatgatggtggtgcagcaggaactgggccgcggcctggtggtggagccgtacttcgcgacggtggtggccgcgcaggcgctcaagctggccggtggccaggaagcgctgctcgagcaggtggctggtggcgaactgaagctggccacggcattcaacgagcagcaggcacgccatgaactgaacaacgtgaccgtgacggccaagggcggcaagctcaacggtcgcaaggtcgtggtgacccacggtgcccaggccgacaagctcgtggtgtcggcacgcaccagtggcgcccagtcggaccgtgacggcatctcgctgttcctggtcgacaccaagggtgctggcgtcagcgtcaaggactaccgcacgatcgacaacctccacgcggccgacgtgacgttccaggatgcaccggccacgctgatcggcacggaaggcaagggctgggatgtgctcgaggccaccgccgactacgccgcggtgctgctgtgcgccgaagccgttggtgtcatggatacgctcaacgccgccacgctcgagtacgcgaagacccgccagcagttcggcgtggccatcgcgcgcttccaggcgctgcagcaccgcatggtcgaaatgatgatccatgcggagcagtcgcgttcgatcacgctgctggccgcggcgcgcttcgacgaggccagccccgaggagcgccgccgctacgtgtccgccgccaaggcgcgcgtcggcgtggcagcccgctcggtgggccaggaagccgtgcagattcacggcggcatgggtgtgaccgacgagctgccggccgcgcatatgttcaagcgc

SEQ ID NO: 32296 - DNA, 1551 bp, Ralstonia metallidurans
atgaacgccaacctgttcgccctgttcgaatcccgctttcccgccgaccgcaccgcatgctgcatcgaaacgcatgacgggctctactactcgtgggacgacctcgatcgcgccaccgccaagctggccaacctgctgaccgcgctgaagctgcccgccggctcgcgcgtggcggtgcaggtcgagaagtcgccggaagcactgttcctgtacctggccacgttgcgcgccggctatgtgtatctgccgctgaacaccgcgtaccaggaggccgaaatcgactactttgtcggcaacgccgagcctgccgtggtggtctgcagcagcaacaacttcggctgggtgtcgaaagtggcgttccggcacggcaccgcccatgttttcacgctcgacgataaccgcaccggttcgctgctgcaacgcgcggcagtgcagcctgacacgttcgagacggtcgaatgcgcggacgacgatctggccgcgattctctacacgtcgggcaccaccggccgcagcaagggcgcgatgctgacgcatcgaaacctggcatcgaacgcgcaaacgctgaatgagtattggggctggcgcagcgatgatgtgctgctgcacatgctgccgatcttccacgtgcatggcctgttcgtggcctcgcatggcgcgctgctcgcgggcgccaagatgatctgggcgccgaagctcgacatgggccagatcctgaagtacctgccgcgtaccaccgtgatgatgggcgtgcctacgtactacgtgcgaatgctgcaggagccccgtttcgacaaggaactgtgcagcaacatgcgcctgttcgtctcgggctcggcgccgctgctgctggagacgttcgacgcattccgcgagcgcaccggccacacgatcctggagcgctacggcatgagcgagaccgtgatgctggtatcgaatccgtatgacccggcactgggtgagcggatcggtggcaccgtgggcaggccgctgccgggcgtgtcggtgcgcgtgacgggcagcgaaggcaagtcgtgcgagccgggtgtgatcggtaacgttgaggtcaaggggccgaacgtgttcaagggctactggcggatgcccgagaagacggcggaggaatttacggccgatggctggttcaagactggggatgtgggccgccttggtggcgcgatcgtcagccaggcaggcgaacgcatcgtgccggacaactacctgacgatcgtaggtcgcagtaaggacctgatcatctcgggcggctacaacgtgtatccgaaggaaatcgagagctttatcgacgagatgccgggcgtggtggagtcagccgtgatcggcgtgccgcatgttgacttcggcgaggccgtcgttgccgtggtcgtacgcaagccgggcatggagattgatgaggctggcatgatcggcacgctgaagggccgcatcgccaatttcaaggtacccaagcgtgtgcacgtggtcgatgagttgccgcgcaatacgatgggcaaggtgcagaagaacgtgctgcgccagcagttcggggcgctg

SEQ ID NO: 32297 - DNA, 2838 bp, Ralstonia metallidurans
acctatcaggactacaagctgatccgccgtaacggcgccgtggtgtcgttcgagccgaacaagattgccgtggccatgaccaaggcattcctggccgtcaacggcggccagggcgcgggatccgcgcgcgtgcgcgagatcgtcgagcaactgacccagaatgtggtgcgcgcgctggtgcgcagccgtccgaacggcggcacgttccatatcgaagacgtgcaggatcacgtggaactggcgctgatgcgctcgggcgaacatgaggtggcccgcgcctacgtgctgtaccgcgaaaagcgcacgcaggaacgtgcccaggccaacgcgcaggcggtggcccgcgtgcaggaagccggcgtgtcgttcaacgtgaccgataacggtgtgacgtaccagctggacttggtggcgctgcacgcgctgatcgacaacgcctgcagcggcctcggcaaggccgtcagcgcagagccgatcctgaaggaaacgctcaagaacctgtacgacggcgtgccgatgacgcaggtctacgactccgccatcctggccgcgcgcacgctgatcgagaaggacccggcctacagccaggtgaccgcccgtatcctgctgcacacgatccgcaaggaaatcctgggcgccgaagtgacccagaccgagatggcgacgaagtacgccgagtacttcccgaagttcatcgcccgcggtatcgaagccgaactgctcgacgaaaagctggccacgtacgacctggcccgcctgggcgccgcgctggacgcctcgcgcgacttccagttcaactacctgggcctgcagacgctgtacgaccgctacttcctgcacgtggacgaagtgcgcatcgaaatgccgcaggcgttcttcatgcgcgtggccatgggcctggcgctggaagagaaggaccgtgaagcgcgcgcgatcgagttctaccagctgctgtcgtcgttcgacttcatgtcgtcgaccccgacgctgttcaactcgggcacgcgccgctcgcagctgtcgtcgtgctacctgaccacggtctcggacgacctggagggcatctacgaggcgctcaaggaaaacgcgctgctgtcgaagttcgctggcggactgggcaacgactggaccaacgtgcgcgcgctgggctcgcacatcaagggcaccaacggcaagtcgcagggcgtggtgccgttcctgaaggtggtcaacgacacggccgtggccgtgaaccagggcggcaagcgcaagggcgcggtctgcgcgtacctggaaacgtggcacctggacatcgaggaattcctcgaactgcgcaagaacaccggcgatgaccgccgccgcacgcacgacatgaacacggccaactggattccggacctgttcatgaagcgtgtgatggaaaatggcgaatggacgctgttctcgccggccagctgcccggacctgcatgacaaggtcggcaaggcattcgagcaggcctacctgggctacgaagccaaggccgccaacggcgaactgaagctgttcaagaaagtgccggccatgcagctgtggcgcaagatgctgggcatgctgttcgaaaccggccatccgtggatcacgttcaaggacccgtgcaacatccgcagcccgcagcagcacgtgggtgtggtgcatagctcgaacctgtgcacggaaatcacgctgaacacgaacgagagcgaaatcgccgtgtgcaacctgggttccgtgaacctggtggcccacctgatgcaacaggccgatggcacgtacgtgctggatcacgccaagctgcagaagacgatccgcaccgcgatgcgcatgctcgacaacgtgatcgacatcaactactacgcggtggagaaggcgcgcaactcgaacctgcgccaccgtccggtgggcatgggcatcatgggcttccaggactgcctgcacgtgctgcgcacgccgtacgccagcgacgccgcggtgaagttcgccgatacgtcgatggaagccgtgtgctactacgcctaccaggcgtcgaccgagctggccgaagagcgtggccgttacagcacctacgagggttcgctgtgggatcgtggcatcctgccgcaggattcgctgaagctgctggccgaagaacgtggcggctacctggacgtcgacctgtcgtcgacgatggactgggacagcctgcgcggtcgcatcaagcagcacggcatgcgcaactcgaactgcatcgcgatcgccccgaccgcgaccatttcgaacatcatcggcgtgtccgcctgcatcgagccgacgttccagaacctgtacgtgaagtcgaacctctcgggcgagttcacggtagtgaacgactacctcgtgcgcgacctgaaggaacgcggcctgtgggatgaagtgatggtcgccgacctgaagtacttcgacggctcgctggcccgcatcgaccgcattccgcaggacctgcgggacatttacgccacggcgttcgaagtggaaccgacctggctcgtggaagccgccagccgccgtcagaagtggatcgaccaggcccaatcgctgaacatctacatggccggcgcttcgggcaagaagctggacgacacctacaagctggcctggctgcgtggtctgaagaccacgtactacctgcgcacgatggctgccacgcacgtggagaagtccaccgtgcagcgcggttcgctgaacgcggtgtcgtcgggcgccgacggccagtcgggcatcgatgctgccgcgtcggctgcaccggcgatgccggaggccgagggcgcggtctgcacgatgcgtccgggcgatcctggcttcgaagagtgcgaagcctgccag

SEQ ID NO: 32298 - DNA, 1011 bp, Ralstonia metallidurans
cgccgcgtgaacgccgccgacaagcgcgtgatcaacggcgccacggacgtgaaccagctcgtgccgttcaagtacaagtgggcatgggaaaagtatctggccggttgcgcgaaccactggatgccgcaggaaatcaacatgtcgcgcgacatcgccctgtggaaggacccgaacggcctgaccgaggacgagcgccgcatcatcaagcgcaacctgggcttcttcgtgacggccgattcgctggccgccaacaatatcgtgctgggcacgtaccgccagatcacggcgccggaatgccgccagtacctgttacgccaggccttcgaagaggccatccacacgcacgcgtaccagtacatcgtggaatcgctcggtctgaacgaagccgagatcttcaacgcgtaccatgaagtgcagtcgatccgcgacaaggacgagttcctgatcccgttcatcgacacgctgaccgacccgtcgttcaagaccggcacgccggagaacgaccagaagctgctgaagtcgctgatcgtgttcgcctgcattatggaaggcctgttcttctacgtgggcttcacgcagatcctggcgatgggccgccagaacaagatgaccggcgctgccgagcagtaccagtacatcctgcgcgacgaatccctgcactgcaatttcggcatcgacctgatcaaccagatcaagctcgagaacccgcacctgtggacggccgagttcaaggccgagatcaccgagctgttcaagaaggccgtggacctggaataccgctacgccgaggacaccatgccgcgcggcgtgctgggcctgaacgcaccgatgttcaagggctacctgcgcttcatctgcaaccgccgttgccagcagatcggcctggaccagctcttcccgaacgaggaaaacccgttcccgtggatgagcgaaatgatcgacctgaagaaagagcgtaacttcttcgagacgcgcgtcatcgagtaccagacgggcggcgcgctgtcgtgg

SEQ ID NO: 32299 - DNA, 828 bp, Ralstonia metallidurans
aaacaagtcacactgcccggcggcgaacgcgtgcccgcgctgggcatgggtacctggaacattggcgatcatcgccagacacgtgccgacgaaatcgccacgttgcagctgggtctggatcttggactgcggctgatcgacaccgccgagatgtatggcgaaggcttgtcggagtcactggtcggcgaggcgatccgggggcgtcgcgaccagacgttcctggtcagcaaggtgtatccgcacaatgccagtcgcaagggcgcggcggccgcgtgcgagcgcagcctgaaacgcctgggtaccgaccatattgatctctacctgctccactggcgcggcgacgtgccgttcgaggaaacgatcgaggcgtttctggcgttgcggcaagccggcaaggtccgccatttcggcgtcagcaatctcgacctctccgacatggaagaactatgggatgtgccgggtggcgatgaagtggccgtgaatcagttgctctataacctgagccgccgtggcatcgaattcgacctgctgccctggctgcgcgagcgggaggttcccgtcatggcctattccccgatcgagcaggcgcgattgctgcgcagcccgggcctgaagcgttttgcgcaatcgattggaaagtctccggcgcaggttgcgctggcgtggctgctcagccgcgacgacattatcgccatcccaaagactggcaaccgcgagcgtctgcgcgagaacgtcggcgcgctggacctgacgctgagcgcggaacagcttgccgcgctggacgaactgtttccgcccccgcgccacgtgcagccgctggcgatgctc

SEQ ID NO: 32300 - DNA, 972 bp, Ralstonia metallidurans
cgcaccgcgatcctgctgatcaacctcggcaccccggacgcgcccacgcctaaggcggtggggcgctacctgaaggcgttcctgtccgacccgcgcgtggtagagatcccgcgcctggcctggctgccgatcctgcacggcctgatcctgccgttccgctcgcgggcgtcggccatgaagtacgagtcgatctggctgcgcgaggcgcatatgaccgggtcgccgctacttgtgtatacagagcgccaagctcatgcgctgcaactgttgatgcagcagcagggtcacgacgtaacggtggcctgtgcgatgcgctatggcaatccgtcgatcgaatcggtcatggaagcgctgcgccggcagggtaccgaacagatcctgttgctgccgctgtatccgcagttctccggcacgaccacggccaccgctttcgacgaggcatttcgtgtcctgtcgacatggcgcaaccagcccgagttacggctggtcaagcatttccacgatcacccggcgtatatctctgcgctgcacaagcaggtgggcggctattgggcccagcatggcaagccggacttcgcgcgcggtgacaagctgattctgtcgttccacggccttccgcgccggttgctggacctgggtgatccctatcactgcgagtgtctgaagaccggtcgtctgctcggcgaggcgctgggcttgcagcccggccagtttcaggtgacgtttcagtctcgctttggcaaggcggagtggttacagccctacacggcgccgacgctggccgaactgggcaaggtcgggacacagcgcgtggacgtgttctgtcccggctttccggccgactgcatcgagacgctcgaggagatcgcgatggaggggcagtcggaattccgcttggccggcggccaggatttccatttcatcccgtgcctcaacgatgccgaggcgtggatcgccggattggcggatatt

SEQ ID NO: 32301 - DNA, 906 bp, Ralstonia metallidurans
agtatcgatatccttgcctatggcgaaccgctgatcgagttcaaccagcagcccgacgatccgtcgcgttacctgcagggctttggcggcgatacctccaatttctgcattgccgccgcgcgccagggcgcgaccacgggctatatcaccgcagtaggggccgacagtttcggtgagcggttgctggcgttgtggacacgggaacgtgtcgatacccgacacgtggtggtcaatgcctctgcgcccaccggggtttatttcgtctcccacgacaaccacggccatcgcttcgactatctgcgcgagcgttccgcggccagccgctatcaccatgagcagttgccgctggcaaccatcgcgcaggcgcgctttctgcatctctccggtatcagcctggcaattagcaccagcgcctgtgatgcaggactggcggcgatggaacatgcgcgcaaggccggggcgaaagtatcgctcgacacgaatctgcgattgcggctctggtcgctggcccgcgcgcgcggcatcatgcgcgaggcattctccctgaccgacatatgcctgccgagctgggacgacatcacgatcctgaccgggctcgatgaccgcgacgcgatcgtcgactatctgctgggttgcggtgtggaactggttgcgctgaagctcggagaagagggcagttacatcgccacgcaggagtcgcgcgcgctggtggcgccgttccccgtacgtccggtcgatgccaccggcgcgggcgactgcttcggcggcagtttcatcgcacggctggctgcggacgctgatccgttcgatgcggctcgctatgccaacattgccgccgcgctgtcgaccacgggttatggggccgtggcgcctatcccccatgccgaaaccgtgcgggcccggctg

SEQ ID NO: 32302 - DNA, 1302 bp, Ralstonia metallidurans
cgccgcgcccgtgtgctgaaacatctgcgcgccaacggcggcggcgtggccatcgtgccaaccgcgccggaggccatgcgcaatcgcgacagcgactatccgtaccggcacgacagctatttctattacctgaccggattcaccgagccagaagcagtgctcgtgctggtggcgggcggcccgggcgacgacaccaacagcagcatcctgttctgccgacccaagcacgaagaacgcgagatctgggatggcttccgctatggcccagaaggcgcgcgcgcgatgttcggcttcgacgaggcgcattcggtcgaagacatcgacaagctgctgccgccgatgctggccaatcgcgccacgctggcctacccgctggccgccaccgcagacttcgacgcccgcgtgcgtggctggctggacgcggtacggatgcagggccgcgccggggtgtcctccccgtcggccgcgctcgacgttcgcgcactactcgacgagatgcgcctgttcaaggatgcgggcgaactggtcacgatgcgccgtgccgccgagatctcggcccaggcgcatgttcgtgcgatgcgcacgtcgcgccacggcttgcgcgagtaccacctcgaagccgaactgctctacgaattccgccgccacggcgcccagagcgtggcctacaactcgatcgtcgccacgggccccaacgcttgcgtgctgcactaccgggctggtccggccgaactgcgcgacggcgacctgtgcctgatcgacgcgggttgcgaactcgacggctacgcgtcggacattacgcgcacattcccggtcaacggccgattcacgccggcgcagcgcgagctctatgacctcgtgcaggccgcgcaggacgccgccatcgccgagacacgcgcgggcgtgccatacaacgtcccgcacgacgcggcggtgcgtgtgctggcgcaaggcatgctggacaccggcctgctcgaccgcaacaaggaaggcacgctcgacgacgtgctggccagcggcagctatcgccgcttctacatgcaccgcacgggccactggctcggcatggacgtgcacgacgtgggtgaataccgcgtgcccggcccgctgccggcaggccacgagggcgagcgggcatggcgtccgcttgaggcgggcatggtggtaaccatcgagccgggcatctacgtgcgcccggccgaagacgtacccgaacgctactggcacatcggcatccgcatcgaggacgacgccgtggtgacttcgggagattgcgaactgatcacgcgggggatccttaga

SEQ ID NO: 32303 - DNA, 2045 bp, Ralstonia metallidurans
ccagccagcctgctcgacaagctgtgggccagccacgtgattcacgagcagtccgacggaccttcgctgatctatatcgaccggcacctggtcaatgaggtaaccagcccacaggccttcgaggggctgcgcctgcatggccgtgaggtatggcgtcctgcatcggtgctggccacggccgaccacaacgtgccaactaccgaacgggcggcgggcattgccgacccgatcagccgcgcgcaggtcgacgcactcgagcgcaactgcgctgcgactggaatcgtgaacttcggcatgaacgacccgcgccagggcattctgcacgtggtgggtcccgagcgtggcgcgacgctgcccggtatgaccattgtctgcggcgactcacatacatccacacatggcgccttcggagccttcgctttcggtatcggtacctcggaagtcgaacaggtgctcagcgcgcagtgtctgtggatgaaaaagccgcgctcgatgctggtccgggtagaaggtgagttggcggcaggtgtttcagccaaggacatcgcgctggcgctgatcggacgcattggtacggcgggagcgaccgggtacgtgatcgagttcgccggcagcaccatccgtggcctcagtatggaagggcgcatgaccgtctgcaacatggcgatcgaggcgggggctcgcgctggcatggtggccgtggacgaaaccacgttggcatacttggcccatcgcccgcaggcgccgcaaggtgaagcatgggaaagtgccagcgcctactggcgcacgctgcgcagcgatccggacgcagtgttcgacgcggtcgtggacattggtgttgcgacgatccggccgcatgtgacatggggcacgtccccggaaatggtggtggcgatcgacgagcgcattcccgatccgcgacaggaagccgatccggtcaggcgccgtggcatggaacgggcactaacctacatggggctggagcccggcatcaaagtggcatctatcgcgctcgataaggttttcatcgggtcgtgcaccaatgcacggctcgaggacttgcgagccgccgccgacgtgctgcgcggccgccacgtggcgtcgaacattcgtcaggcgctagtggtgcccggctccgggctggtgaagtcccaagcggaagcggaaggccttgacagggttttcatcgacgctggcttcgagtggcgtgagcctggatgctcaatgtgcctgggcatgaatgacgatcgtcttgctcctggtgagcgctgcgcatccacctcaaatcgcaacttcgaaggcaggcaggggcccggtggtcgcacccacctggtcagcccgcaaatggccgcggcagcggcggttgccgggcactttgtcgacgtaagcaccgtgctgcaggagaagtcagcgtgaaggccttcacagtactcgatgggctggtggcgcctattgaccgtgccaatgtggatacggacgccatcttgccgaagcaattcttgaaatccatccagcgcagcggattcggtccgtatctgttcgacgagtggcgctatctcgaccctggcgagccagggcaggactgttcgcagcggccgcgcaatcctgatttcgtgcttaaccagccgcgataccaaggcgcttcggtgctgttggtgcgcgaaaatttcggttgcggatcgtcgcgcgagcatgcgccatgggcccttgaagacttcgggctacgcgcgctgatcgcccccagctttgcggacatcttctgcaacaactgcatgaagaatggcctgctgccgatcgtgctggaggctaacgtcgttgacaggcttttcgctgaggtcgacgccacgccgggataccgcctgcatgtcgatctggcaacacaactggtgacgacaccctcgggcgacgccatttctttctcgatggatccattcaagaagcactgcgtgctgaatggcttggatgacatcgggctggcgctgcagcacgaggaggcgatccgtcgctacgagctgaacagaatcaggcacgagccctggctgttc

SEQ ID NO: 32304 - DNA, 1929 bp, Ralstonia metallidurans
atgggtaagatcatcggtatcgacctcggtaccaccaacagctgcgtgtccattctggaaggcaacacgccgaaagtcatcgagaactccgaaggcgcacgcaccacgccgtcgatcatcgcctacatggaagatggcgagatcctggttggtgcgcctgccaagcgccaggccgtcaccaacccgcgtaacacgctgtacgcggtgaagcgcctgatcggccgcaagttcgaagagaaggaagtccagaaggacatcggcctgatgccgtacgcgatcgtcaaggccgacaacggcgacgcctgggttggcgtgcgcgaccagaagctggccccgccgcaggtttcggccgaagtgctgcgcaagatgaagaagaccgccgaggactacctgggcgagcccgtgaccgaagccgtgatcacggtgccggcgtacttcaacgactcgcagcgccaggcaaccaaggatgccggccgcatcgccgggctggacgtcaagcgcatcatcaacgaaccgaccgctgcagcgctggcgttcggcatggacaagaacgagaagggcgaccgcaagattgccgtgtatgacctcggcggcggcacgttcgacatctcgattatcgaaatcgccgacgtggatggcgaaaagcagttcgaagtgctgtcgaccaacggcgacacgttcctcggtggcgaggacttcgaccagcgcatcatcgactacatcatcggcgagttcaagaaggaacagggcgtcgatctgtcgaaggacgtgctggcgctgcaacgcctgaaggaagccgctgaaaaggccaagatcgaactgtcgagctcgcagcagaccgagatcaacctgccgtacatcacggccgatgcctcgggtccgaagcacttgaacctgaagatcacgcgcgccaagctcgaagcgctggtggaagaactgatcacccgcacgatcgaaccgtgccgtaccgcgatcaaggatgcaggcgtcaaggtcagcgacattgatgacgtgatcctggtcggcggcatgacccgtatgccgaaggtgcaggaacaggtgcgcgagttcttcggcaaggaagcccgcaaggacgtgaacccggacgaagccgtggccgtgggtgccgccatccagggttcggtgctgtcgggcgaccgtaccgacgtgctgctgctggacgtgacgccgctgtcgctgggcatcgaaacgctgggtggcgtgatgaccaagatgatcaacaagaacacgaccatcccgaccaagcacgcacaggttttctcgaccgctgacgacaatcagccggccgtgacgatcaaggtgtaccagggcgagcgcgagatggccaccggcaacaagatgctgggcgagttcaacctggaaggcattgcgccggcaccgcgtggcacgccgcagatcgaggtctcgttcgacatcgacgccaacggcattctgcatgtgggcgccaaggacaaggccaccggcaaggaaaaccgcatcacgatcaaggcgaactcgggtctgtcggaagacgagatccagcgcatggtgaaggatgccgaagccaatgccgaggaagacaagcgcgcccgtgagctggccgatgcccgcaaccaggccgacgcgctgatccactcgacgcgcaaggcgctgggcgagtacggcgagaagctcgaagctggcgagaaggaaaagatcgaagccgcgatcaaggacctggaagacgccgcccgcggcggtgacaaggccgagatcgatgccaaggtcaacgcgctgtccgaagccagccagaagctgggcgagaaggtctacgccgacatgcaggcccaggccggtgaaggtgcggcggcaggtgccggcgcagccggcggcgctcagcagcaggcccagccgcaggacgacaacgtcgtggatgccgagttacaggag

SEQ ID NO: 32305 - DNA, 1308 bp, Ralstonia metallidurans
acctcggtcggcgtgcgcgagcatcatgggcgcgacgaatccccgttcccgcccgaactgccggacgccgtggtctttgcccatagcaccgaggaagtggccgaactggcgaagctctgcaacacgcatggcgtgccgctgatcccctacggcgccggctcctcgctcgagggccacctgctggccgtggccggcggtatcagcctcgacctgtcgcagatgaaccgggtgctggccgtgcaccccgaggatctgaccgtcaccgtccagcccggcgtcacgcgcaaacagctcaaccaggagatcaaggacacgggcctgttcttcccgatcgacccaggcgccgatgcatcgctgggtggcatgtgcgccacgcgcgcctcgggcaccaacgcggtccgctacggcaccatgcgcgagaacgtgctggcgctgaccgtggtcacggccgacggccgggtcatccgcaccggcaccaatgcgcgcaagtcgtcggcgggctatgacctgacgcgcctgtttgtcggcagcgaaggcacgctcggcatcatcaccgaagttacggtgcggctctatccgcagccggaagcgatctccgcggccgtctgcgccttcccgagcatgggcgacgccgtgcgtgccaccatccagacgatccagcttggcgtgcccgtggcccgcgtggagttcgtcgacgccctggcaatccgtgcgatcaaccgccatgacaatctgaccttgccggaaacgccccacctgttcttcgagttccatggcactgaggccggcgtgcgcgaacaggccgagaccgtgcaggacatcgccgccgagcacggcggccagggcttcgaatgggccacacggcccgaggaccggtcgcggctctggaatgctcgccacaccgcctatttcgcgatgctccagctgaagccgggctgcaaatcggtcaccaccgacgtctgcgtgccgatctctcggctggccgactgcgtgaccgaaaccgagcgcgatctgaatgcgtcgtcgctgccctgcccgatcgtcggtcacgtcggggatggcaacttccacgtggcgatcctggtggacccggacaagcccgaggaaatggccgaggccgaggacatcaaccgccgcatcgtgcagcgcgcgctggcgatgggcggcacctgcaccggcgagcacggcgtgggcctgcacaagatgggatttctggtgcaggagcatggcgaggatgcgctcgacctgatgcgcgcgatcaaggatgcgctcgacccgaaccacatcctgaatccgggcaagatcttc

SEQ ID NO: 32306 - DNA, 1467 bp, Ralstonia metallidurans
ggtgaatccgcggagacgcgacgcgccacgctgctggccggcctcgcccgcatcctgcccgacacggccgtgctgtggaaggccgaggacaccgtgccgtacgaatgcgacggcctggccgcctatcgccaggttccagacgccgtggtgctgcccgataccgaggagcaggtctgcgcggtgctgcgcctgtgccacgagctcggcgtgccggtggtgccgcgcggctccggcaccagcctgtctggcggcgcgatgccgatcgccggcggactggttctgtcgctggccaagttcaagcgcatcctgtcgctcgatccgtattcccgcacggcggtggttcagcccggcgtgcgcaacctggcaatctccgacgctgccgccccgcacaacctctactacgcgcccgatccatcctcgcagatcgcctgttccatcggcggcaacgtggccgagaactcgggtggcgtgcattgcctcaagtacggcctgacggtccacaacgtgctgcgcgtgcgcgcggtgacgatggaaggcgaggtggtcgtgttcgggtccgaggcgcccgacgcgccgggcctcgacctcctggccgcgatgatcggctccgagggcatgctggccgtggtcacggaagtcaccgtgaggctcattcccaaaccgcaactcgcgcaggtcatcatggccagcttcgatgatgtggaaaaaggcggcaatgccgtggccgacgtgatcgccgctggcattatcccggccgggctggagatgatggacaagcccgccacggccgccgtggaggagttcgtcaaggccggctacgacctcgacgccgccgcgatcctgctgtgcgagtcggatggcacgcccgaggaagtggccgaggaaatcgcccgcatgagcgaggtgctgcgcgcatcaggcgcgacgcgcatcacggtgtcgcaaagcgaagccgagcgcctgcgcttctggagcggccgcaagaacgccttcccggccgcgggccgcatctcgcccgactactactgcatggacggcacgattccccgcaagcacatcggcacgctgctcaagcgcatcgagcagatggagcacaaatacgggttgcgctgcatcaacgttttccatgcgggcgatggcaatatgcaccccctgatcctgttcgatggcgccgatcacgacgagtggcagcgcgcggagctgttcgggtcggacatcctggaggcctgcgtggaactcggcggcaccgtgaccggcgagcacggtgtgggcgtggaaaaactcaactcgatgtgcgtgcagttctccccgtccgagcgcgacgcgttcttcggggtcaaggccgcattcgatcccgcccggctgctgaacccggacaaggcaatccccacgcttgcgcgctgcgccgaatacggcaagatgcacgtcaagcgcggcctgctgccgcatccggacctgccgcgtttc

SEQ ID NO: 32307 - DNA, 792 bp, Ralstonia metallidurans
ttcctcggcggcggcaatatggcctcggccctgatcggtggcctggtagcccgtggcgtgccagccaacgcgattcgcgtggtcgatccgttcgaagacgcccgccaacgcctggccacgacgcttggcgtacagacactggctgcaccggacgccgcgtttggcgccagcaacgtgatcgtgctggcggtcaagccgcagcagttcaaggacgccgtgggcgccctggctccacagttgaagaacagcctgatcatcagcgtggcggctggcatccggcttcaggacatgcagcgctggctgggcaccaaccgccttgtccgcgcgatgcccaatacgcccgcgctggccggcatggggatgaccggactggccgccgccccgggtctgtccgacgaagaccgcgccatcgccaaggccgtggccgaggccgtcggccagtgcgtgtgggtcgagggcgacgaccagatcgacgccgtgacggcgatttccggcagcggcccggcctacgtgttctatttcgtcgaggcgatggagcgtgccgccatcgagatgggtctgtccgccgagcagggtcgcaagctggccgtcgaaacgttccgcggggccgccgcgctggcagcggagtcgtccgaaccagtatcgacgctgcgtgagcgtgtcacctcgaaaggcggcacgacctatgccgcgctgacctcgatggacgccagcggcatccaggacgccttcgttcgcgccatgctggccgccgccgcgcggggccgcgagatgggagcggagttcgggaag

SEQ ID NO: 32308 - DNA, 750 bp, Ralstonia metallidurans
atggaaggcaaggtagtggtggtaacgggcgccggtggcggtatcggacgaggcattgccctgggcatggcggcggctggcgctcgtgtggtggtcaatgacctgggcgtgtcgatgagcggcgaaggcggcgatgccggccccgcgcagcgcgtggtcgaggaaatccgcgcggccggcggccaggccgtggccaataccgattccgtttcgacctgggctggcggcaacgccatcgtgcaatgcgcgctcgacaccttcggtcgcatcgacgctgtggtcaacaacgccggcaacctgcgcgatcgcatgtttttcaagatgaacgaggaagaatggcgctcggtgatcgacgtgcacctgcacggcaccttcttcgtcagccgtgcggcagccaactatttcaaggatcaggagagcggcgcctacgtcaacatgacgtcgacgtcggggctgatcggcaacctgggtcaggctaactactccgcggccaagctgggcatcgccgcgctgtccaaatcgatcgcgctggacatggcccgtttcaatgtgcgctcgaattgcatcgcgccgttcgcctggagccgcatgaccagctcgatcccggccgagacgcctgcggagaaggagcgcgtggcccgcctgcagaagatggaagccggcaagatcgctccggtggccgtgttcctggccagcgacgcggccaaggacgtgaatgcccagatcttcgcggtgcgtgccaacgagatc

SEQ ID NO: 32309 - DNA, 1128 bp, Ralstonia metallidurans
atccgcgaggccgtacgcgacctctgcaagcaattcgattcggcctattggcaacgcatcgaggaacacagcgcatttccggaggagttcgtccaggcgctgacccacgccggctggctgtccgcgctgattcccgaggcatacggtggctccggcctgccgctgaccgcagcctccgtgatcatggaagagatcaaccgcaacggcggcaactcgggggcgtgccacggtcagatgtacgtgatgggctgcctgctgcgccacggctcagaggcgcagaagcagcgctggctgcccggcatcgcttcgggcgagttgcgcatgcagtcgatggccgtgaccgaaccgaccaccggtaccgataccaccaagctcaagaccacggcagtgcggcgcggcgacaagtacgtgatcaacggccagaaggtctggatctcgcgcgtccagcattccgacctgatgctgctgctggcacgcaccacgccgctggaccaggtgaagaagaagtccgaaggtctgtcggtgttcgtcgtcgacttgcgcgaagcgattggcaacggcctgacggtccagccgatccgcaacatggtcaaccacgaaaccaatgagctgttcttcgataacctcgaaatcccggccgaaaacctgattggcgaggaaggcaagggactcaagtacatcctcgacggcctgaatgccgaacgtatcctgattgccgccgagtgcatcggcgatggctactggttcgtcgaacgcgccagcagctacgcccgcgagcggatcgtgttcgatcgcccgatcggccagaaccagggcgtgcagttcccgatcgcgcgttcgttcgtcaatgtggaagccgccagtctgatgcgttacaaggccgcccagctgttcgacgcaggcaagccctgcggcaaggaagccaacatggcgaagctgctggccgccgatgcttcatgggaagcggccaacgtctgcctgcagacgcacggtggattcggctttgccgccgagtacgacatcgaacgcaagttccgtgaaacgcgcctgtaccaggtggcgccgatctcgaccaacctgatcctgtcgttcgtcgccgaacacgttctcgaactgccccgctcgttc

SEQ ID NO: 32310 - DNA, 1707 bp, Ralstonia metallidurans
tccaacttcctgcggagcatcatcgaccaggacctcgccaccggcacctacgccggccgcgcggacaagcaaggcgacccgctgccgacagtcatcacgcgcttcccgccggagccgaacggctacctgcacattggtcacgccaagagcatctgcgtgaacttcgggctggcccgcgactatgccggccgctgccatctgcgcttcgatgacacgaacccggtgaaggaagacaccgagtacgtcgactcgatcatcgatgccgtgcactggctcggcttctcctgggatagcgcccaggcgggcagcacgccgcacctgtacttcgcgagcgactacttcgaccagctctacaagtttgccgagacgctgatcgagcgcggcgtggcctatgtggacagccagagcgccgagcagatcgccgccatgcgcggcaacttttccgagccgggcaagccgtcgccgttccgcgaccgctcggtcgaggagaacctgaagctgttccgcgagatgcgcgacggcaagtacgccgacggcgagcacgtgctgcgcgcgaagatcgacatgaccgccccgaacatcgtgatgcgcgatccggtgctctaccgcatccgccacgcccatcaccaccgtaccggcgacaagtggtgcatctacccgatgtacgacttcacgcattgcatctcggacgcgatcgagaacatcacgcattcgctgtgcacgctcgagttcgaaaacaaccgcccgctctatgactgggtgctcgagcacctgcgcgacgctggcgtgttcgccaatccgctgccgcatcaatacgaattcgcgcgcctgaacctgacctacgcgatcaccagcaagcgacgcctgaagcagctcgtggacgagcagcgcgtgaccggctgggacgatccgcggatgcccaccatcgtcggtatccgccgccgcggctacacgcccgagtcgatccagctcttctgcgatcgcgtgggtgtgtcaaaggccgatagctggatcgacatgagcacgctcgaaggcgcggtccgtgatgacctcgacgcgcgggcaccgcgcagcgttgccgtgctggacccgctcaagctgatcctggacaactacccggaaggccagagcgaggaatgctcggcgccggtgcacccgaagcagcctgaaatgggccgccgcgtgttcccgctgtcgcgtgagctgtggatcgagcgcgaagacttcaacgagaacccgccgaagggctacttccgtctgttcccaggcaacaaggtgcgcctgcgctacggttatgtgatcgaatgcaccggcgtcgacaaggatgccgacggcaacgtgattgccgtgcacgcgaactacctgccggaaaccaagagcggcacgcctggcgcggacagcgtaaaggtcaagggcaacatccactgggtcagcgcgcctcacgcgtgtgaagccgaagtccgcctgtacgaccgtctgttcaacgatccgaacccggatgccggtggcaagaacttcctggacgcgctgaatccggaatcgaagaaggtcgtgaccgcctatctggagccgggcctacgcgatgccaaaccagaggaccgtttccagttcgagcggcacggttacttcgtggcggaccgagtggattcgcagccgggcaagccggtgttcaaccgcacggttggactcaaggacagctggggcaag

SEQ ID NO: 32311 - DNA, 1167 bp, Ralstonia metallidurans
cgttacatcaagaccattgccgtccagccagaactggacatcgcgccgggcttcgattcgttctccacgccgacctaccgcggctccactgtcgtcttccgcaaccttgccgaactgcgcgcctatggcgaccgcagcaagacctactggcgctatggcctgcacgccacgccgaccagcgaggcgctttgccagcaactggcgcagatcgaaggtggccgtcacacgctgctgttcccgtcgggcctgggcgccatttcgctggtctatttcggcctgctgcgtaccggtgacgatgtcctcgtcccagaaaacgtctacggacccaatcgcgatcatggcgactggatggcgcgggagttcggtattaccgtgcgcccgtatcatccgtcggtcggcgctggaatcgcctcgatgatccagccgaacacgcgtctgatctggatggaatcgccgggctcggtcacgatggaagtgcctgacaccgaggcgatcgtggccgccgcgaaggcacgtggtgtgctgaccgcgatcgacaacacctggtctgccggcgtctactatcggccgttcgagaagggcatcgatatctccgtgcaggcgctgaccaagtaccaatccggtggcagcgatgtactgatgggcgccgtgatcacgcgggatgaccatctccacgaccgcctcaagcgcacccgcatgctgatgggctggggtgtctccgccgacgattgctacctggtcctgcgtgggctggcgagcatgccggtgcgcctggccgctcacgaccgcgcagcgcgcgaggtggccgaatggctgacgaaacgtccggaggtcgcgcgtgtgctgcatccggcattgcccgattgccccggccatgccgaatggctgcgggatttcagcggggcgagtggtctgttctcgatcattctgcacagccgctatacgcgcgagcaggtcgatgcgttcgtcgaggcgctaaagctgttcgcgattggctggtcgtggggcggtgcgcacagtctggctgtgccctatcacgtcgacacaatgcgcccggctggcacgtggccgcccgctggatgggagaacgccggcgaactggtgcggctgtatattggtctggaagacacccgcgacctgatcgccgatctgaagcaggcgctggag

SEQ ID NO: 32312 - DNA, 1182 bp, Ralstonia metallidurans
atggcacgtgaagtggtggttgtcagcggtgtgcgcaccgcaatcggtaccttcggcggcagcctgaaggatcaggccccgacggatatgggcgctctggtcgtgcgcgaagcactggcccgcgccggcgtttcgggcgatgacgtgggtcatgtggtgttcggcaacgtgatccagaccgagccgaaggacatgtatctgggccgcgtggcggctgtgaatggtggtgtgtcgatcaacgcgccggcactgaccgtcaatcgcctgtgcggctccggcctgcaggcaatcgtcagcgcagcccagacgattctgctgggcgatgccgacgtggcaatcggcggcggcgcggaaagcatgagccgcgcgccgtacctggcgccgatggcccgctggggtgcgcgcatgggtgatgccaagctggtcgacatgatgcttggtgcactgcacgatccgttccacgcgatccacatgggcgtgacggcggaaaacgtcgccaaggaatatgacatttcgcgccagcagcaggacgaagccgcgctcgaatcgcatcgtcgtgcttccgccgccatcaaggcaggctatttcaaggatcagatcgttccggttacgctgaaatcgcgcaagggcgacgtggtgttcgataccgacgagcacgtgcgtcacgatgcgacgatggacgacatgaccaagctcaagccggtgttcgtcaaggagaatggcacggtcacggccggtaacgcctcgggcctgaacgacgccgccgccgccgtggtgctgatggagcgtgccgaggccgagcgccgcggcctgaagccgctggctcggctggtgtcctacggccacgccggtgtcgatcccaagacgatgggtatcggtccggtgccggctacgaagatcgcgctggaacgtgccggcctgacggtcaaggatctcgatgtgatcgaggccaacgaggcattcgcggcgcaggcctgcgcggtgaccaaggctttgggtctcgacccggcgaaggtcaaccccaatggctccggtatctcgcttggccacccgatcggcgccaccggtgcgctcatcacggtcaaggcgctgtacgagctgcagcgtgtacagggtcgctacgcgctggtgacgatgtgcatcggtggtggccagggcattgccgcgatcttcgagcgcgtt

SEQ ID NO: 32313 - DNA, 1074 bp, Ralstonia metallidurans
aaagccgcagtgatggaaaaagcaggcgcgccgctcgtgatccatgacgttgccattgccgaaccgggtccgcgcgaggtgcgggtgcgaacggcggccgtggggttgtgccatagtgatcttcacatgatgcagggcacctatccgctaccactgcccgccgtgcttgggcacgaggtgtcgggcgtggtggaggccgttggcacgcaggtatccggactgaaggcgggcgatcatgtggtgggctgcctgtcggtctattgcggccactgctcggtatgcgcgtcgggccatcaggtgctgtgccagaacccggaggtgaagcttccgcccggcaaggccaaccgtctgcgcctggcggggaatccgctcagccaggtgttcaatctctccggtttcgccgaagagatcctcgtgcacgagaacgcgctggtgaagattcgcgacgatatgccgctcgatcgcgcggcgctgctcggctgcgcggtcatcaccggcactggcgcggtcttccatagcgcgaaggtgccgccgggcagcaccgtggtggtggtcggctgcggcggtgtcgggctgtccgtgatcaacggcgcggtgattgccggcgcgtcgcgtgtgatcgccgtggacatgctgcctgccaagctggaactggctcgcaagttcggggcgaccgacgttgtcaatgcgggcgatggggatccggtcgcgcaggtgatgcaactgaccggcggcggtgccgaattcgctttcgaatgcatcggcttgaagcagaccgccgagcagtgctacgcgatgctggcccccggtggcacggcgacggtgatcggcctgttccgtccggatgcgaggatcgaactgcccgcactcgacttcctgaaagagaagcgcatccagggctcgttcatgggttcgaaccgcctgagtctggatatccctcgactggtcgagttgtacatgcagggcaagctgctgctcgacgatctgatttcgcagcggatctcgctggaggatatcaatgaggggttcatcgccatgcagtcgggaagcgtggcgcgaagcgtgatcacattc

SEQ ID NO: 32314 - DNA, 756 bp, Ralstonia metallidurans
aagaccgcgctggtcaccggctccaccagcggcatcggactgggtatcgccgaagcgttgggccgcgctggcgcgaacatcgtgctgaacggcttcggcgatgtcgacgcggcgctcgccacaatcgcggcaactggcgcgcaatcggcccatcacccggcggacatgcgcaagcccgatgagatcgaagcgatgatcgccatggcacgggaacgctttggcaccgtggacgtgctggtcaacaacgctggtatccagcatgtggcgcaggtggaggactttcccgcgcagaagtgggacgacatcctggccatcaacctgacgtcgagcttccacacgacgcggcacgtgattcccgcgatgcgggcccgtaactggggtcgtatcgtcaatatcgcgtcggtgcacgggcttgtcggctcggccggcaagtccgcctacgtggcagccaagcatggtctcgtcgggctgaccaaggtcaccgcgctggaaacggccggtaccggcatcacctgcaacgcgatctgtcccggcttcgtgctgacgccgctggtagcggcgcaaatcgatgcgatcgcgaagcgagacggtatttcgatggaagcggcccgggcacggctgctgtcggacaagcagccctcggggcagttcgtcacgccggagcagttgggcaatctggtgctgatgctctgttcgccgttcggcgatcaggtgcgcggcgcggcctgggccatggacggcggctggaccgcgcaa

SEQ ID NO: 32315 - DNA, 2198 bp, Ralstonia metallidurans
agagcggaccgtagttccggtggggatttcgactatgagcaggcccgtgtggcgggccggatggtgtttttcgtagacgggctttggtgcgtgagctgtgcgatggccttgcagcgcgtcctgcagcgtgtgcccggcgtggtctcggcgacggtgaatttcacctccggttcggcgctggtgacctgggtcccggagtcgatcgacttccccttgctgctgcgaaaggccgagggtctgggctacgcactgtccccgttgaaaggcagcgacgagctggaagcggccctgcagcggcaggccaggaagatccgcttgcagttgaccgtcgcggtcgtcttcgggatgtggagcatgctgggctcatgggtgctttacctgaacgccgacgaggcggcggcgctcgtcatcgcctgggccagcgtcgtagcaagccttcccgtcgtcggatattcggcgtgggatttctaccgcgccgccgcccgttcgctgcgcgccgggatcgcagggatggacgtctttgcctctgttgctgtccttggctccctctttgtgtcggtcgggtccctggccatggggtccgtggcgatttacaccgacgccgccaccatgttgatcacttttctgctgatcggaagattgatcgaaatccatgcccggcaggagagcggacttgccgtacaagcattgcgcagccttgcgccggaaaccgcgacgaagctgacttctgccggcggcgaaaaggccgagagcaccgtcctgctggcagagctcgcgcccggtgataccgttttgatacgcgccaacgagcgcatcgcggtcgatggcatcgtcgtagcgggacagtcggccgtcgatctctcgctgctgcaaggcgagtccgcgcctcgcagcgttcagcctggcgaacgggtcttcgccgggtccgtgaacctgcgcggacctctgacggtccacgtgaccgccggtgcgggggaccgacgattggacgtgctcggcctgcgcatgcttgagctgtttggcgctcgttcgtcgttgtccgagacggccgagcgcttcgtccggatactgctcccggtcgtggtgacggcatctctgctcgccttcgtccattacctgtggaacggctcaagcgcagaccaggcgttgctcggtgcgctgagccttctggtcgcagcctgcccttgcgcggtcggtctggcgatgccgctggcctacgcctttacctgccgcgaggccgcgcggcgcggcgtcctcctgagagactccgcgagcgtcgaagcgctcgccagggcaaggatcatggcgttcgacaagaccggcacattgacgtgcggtcagatgcgtatcgtcagcatccagacgcggcacgggggggccgaacaggacctcatcgaccttgcggcaagggccgaggccggcgtcgcgcaccccattgcacacgcggtggtcctcgcggcccggcagtctggaatgagcagcgcgtgcgagcccgacggatgccaggtgacggcgtgcgcgaaaggcgtgacgatgcatgtccccggcggcgagaccgtgtgggtgggtgaaaggcattggctgctcgccgcgggagtcgagggcatgccgccggaagatggcctgccagggctggtacacgtagccaatgccgggattggctcggctccttgcgtctgcaggatgcccctcgcgacgacgcccgttcgtcactgcagcggttacgtgcgcagggattgaaactctggttgctgaccggggattccagcgcagcgtccgaacgcctgacggctgacctgggcatagacttcgaccgggtcgaggccgattgctctccggaagaaaaagccgacatcgtggcaaagagcccagcgcctgtcgcattcgtgggcgacggcgccaacgatggcctggtcctggcccaggcagcctgcggaatcgccatcccaggatcgagttccgtggctgtttccgcagccggggtggtgatcgcgcacggcagcgtgggcgctgtcgtcgagacccgtgagttggctcgcaagtttgatcgcatcgtccggcagaatctcgcattttccgtcgtgtacaacctcgccgtgattgtcgtgctgttcgaagcaggcgtgacgccctttgccgccgcgctcgccatgctggccagcagcgcgtcggtgctcctgaacacctgcaggctgctg

SEQ ID NO: 32316 - DNA, 768 bp, Ralstonia metallidurans
ccacccgccccggagccgagaatgcttgagatccgcaacctgaccaagaaatttggcggcctgaccgcggtacacgatgtgtccgtaaagttcgagaccggccatatcaacgcgatcatcggtcccaatggtgccggcaagacgacgttcttcaatctgatcgctggcacccacgcgccgacatcaggccagatcctgctcaaggggcaggacgtcgccggattacgcgcggaccagatcgcccgcctgggcgtggcgcgcacgttccaggcaacctcgctgttcgaccgggcgaccgtgctcgacaatctgatcgtcggccatcggctgcgcacaaaatccgggctggccgacgtgctgttcaacacgagccgcctgcgcgaggaagagaagctgtgccgggaaaaggccgaggccgcactcgatttcgtcgggctgtcacacctcgcgcatgaactggctgccgatatcacccaggaggcgcgcaagcgcgtggcgttcgcgctggcgctggccaccgaccccgatctgctgctgctcgacgaacctgccggtggcgtgaaccctgaggagacggtcggccttgccgaactgatccgcaagatggtccggcacggcaaaaccgtctgcctgatcgaacacaaaatggacatgatcatgcgactggccgacaagatcatggtgctcaactacggcgaaaagatcgccgaaggcacgccggcgcagatccagcaagatccgcacgtcatcgaggcctacctgggagcc

SEQ ID NO: 32317 - DNA, 2133 bp, Ralstonia metallidurans
ggaagatccgggttggtgctggtgcagccattgcgccaggagtttggctccctcgtctatttcctgtcctatggcaagctattcagttcgatctactacgaactgatagccattggctccctgagcatgatgttgatcatcgcaatcgtgatatccgcgcgctattgggacattcatctgctgcggcacggccaggccgaagctactcgcgcgcttgaaaacgaaacgatcaaccatatcctcgtcaatgccaccccgatcgggctttgcatcgtcggccagcaagaccacgtcatcgtgacctcgaacttggttgccgacacgttgcttggattcagtcagggagcaaccatgcccgcccggatcatcgacgccctgcgccaacgcccctcgcaggctttcagtgacgcgttcgggccaattgcacagatcagggtgcccgggtgcgccaatgccgacgcagcccagcagtgcaattccacgacggaagccgcacctgcttcgaagccacagtttttgcagattacatcagcccccgccaagtaccgcggagagtgcgtgctcttctgtgccattcaggacgtaacagcacaacaacaactcgaacagaagcttcgctcggcccagcaagctacggaagccatgatgcgtgcccgatcaaacttctttgccgcgatgagccatgagatacgcacaccactgaatgcgcttctgggcaatctcgaactgcttgggcgtagcgccggcctcgaggcacacgcaacccggctgcgcgcattgcagtcgtcctccgaagggctgcgccgcatcgtcaacgatattcttgatttctcgaagatagatgctggcgagatgaagctcgtctccgcgcctttcaatccgctcgacgaacttgagagtctgtccctttcctacgcgcccatggtgacggatcgaccgatccgcttctacgcccacctttcgcctaccctgagtacgcttctgaggggcgatcgtatgaggctggcgcagatcgtcaacaatctgcttggcaatgcgttcaagttcacggcgagcgggaaaatttcgcttagtgcggaaatctctcgagatgcgcaaggactggcgacgctggtctgccgggtgcgagacaccggagacggcatgtctcaggcgctggcttcccgtgtgttccaaccctttgtgcaaggcgagaccagcaccacggctcaatacagcggcactggactcggcctctccatctgcgcccgacttagcgagctgatgggcggacacatcagcgttgaaagcgtcgagggcgtgggcagtgccttcacggtagtcattccgtttgccgagcccgcggcaacggcccctccacatggactgacgatgctcggtggcatggtcatggtgctgtgccaggaaacggaatccggcgccacgctggaagcgtggctgacaagggtaggctgccaggtgcatgtactgcctgccagttgcgccgcccacgcgtggctgtgtaccagccacccccagattatggttgtgaccggagagtatggactcgacacaatcagatcacttcgaaccgtttgcccgacaaacgccgtgtggatcacgcgcaatgggccggatcgcccagcagagctggaatcggggatcttcgaggtttccgcatacagccacaccgccatcctggcgggcgtcaaggccgcattggtcgctcctccgcgactggtcgagacaacgaaccgaaccgccagcgccagtgaaaacgcgcggcccgaagcggcttcccactcgccccatcagcacggcacggttctggtcgccgaagacaacccactgaatcgcatgctgattgccgagcaactcgagacgatcggctgggcgtcaatcgtggtcaacgatgggcgccaggcactcgcggtgctcgatcaacgagttgtcgacatcgtgctgaccgacattcagatgccggtaatgaacggatatgaactgctatctgcaatcaagaccaaaaggccgccgctgccggttttcgcattcagcgcagtcacgcacgccggtcaggcctctgactggcaagcgcgcggatttgacggctacattgccaagcccgtgtcgctggcggagctagagcacgccctg

SEQ ID NO: 32318 - DNA, 540 bp, Ralstonia metallidurans
gaagcccgcatggaagacgtattacgcacgctggtgatcgacgtcgaccaggatcacaacacacgcgagaccgctcgccgcgtagccaagatgtatctcaaggagatcttcgcgggacgctacgcgaaggcgccggatgtgaccgagtttccgaacgtggaacagctcaacgagctgatgatcgtcgggcccatccgcgtgcgcagcgcctgctctcatcacctgtgcccgatcatcggcagcttgtgggtgggggtgatgccgaaccgccactccaatctgatcggcctgtccaagtatgcgcgactggcggaatggatcatgtgccggccgcagatccaggaagaagccgtggcacaggtcgccgatctgctgcaggagaagatgaatccagacggcctggcaatcgtcatggaagccgagcacttctgcatgcactggcgtggcgtgcgcgataccgacgccaagatgaccaacagcgtcatgcgcggctcgttcctcaaggacgacaagctgcgccgtgaatttctcaccctgctg

SEQ ID NO: 32319 - DNA, 918 bp, Ralstonia metallidurans
atgagctctcctattgttttcatcgacggcgaccaaggcaccactgggttgctcatccacgaacggctgcgtaaccggaccgatatcagactgatcacgcttgctgccgcggagcgcaaggatttgcagcgtcgcgcggaagccatcaacgcctgcgacatcgccatcctctgcttgccggatgccgccgcgcgcgaggctgtggccacgattgtcaatcctgcggttcgcgtcatcgacgcaagctccgcgcaccgtacacagccggactggacttacgggtttcctgagatggcgccggggcaggctgagaaaattgcaaacgcgcgccgggtcaccaatcccggttgctatccgaccggtgcgattggcctgctgcgtccgttggtgcaggctgggctcatcccgggcgattaccccatcagcattcatgcggtatccggctactccggacggggacgcgccggcgtggaggaatacgagggaccgggagccgccagcgcgccttcctaccaggtatatggcctggaactcgcgcacaagcacacgccggagatccagcagcacgccgggctcgcgcaaccgcctattttcgtccccgcatacggcgcgttccgccagggcatcgtgctgactgtgccgctggcgttgcggctgctggcacccggcgtggatggcgccacgttacacgcctgcctcgcgcgccactatgccgaggcagaccacgtgcaggtcttgccgctgtcagaatcgtccgccgtgaagcacctggacccgcaattgctgaatggcacgaacgacatgcgcctgagcgtatttcctggcacggaacacgggcacgttctcctgtcagccgttttcgacaacctcggcaagggcgcatccggcgctgcgattcaaaacctgaacctgatgctc

SEQ ID NO: 32320 - DNA, 1404 bp, Ralstonia metallidurans
gatacgaacttcgcgcaacgcctgaccgaaaccctgggccccgacgtcgtgaccaccgcacccgacgacgtggcaccctggctctccgactggcgtggcctctacaagggccaggcgcaggcggtaatccgtccgcgcacaaccgaacaggtggcgcaggcgctggcgctgtgccagcaggctggtgtgcccgtggtgccgcgcggtggcaataccggcctgtgtggcggcgccgctccggacggcaaccagaccaacgtcgtgctcagcctcgatcgcatggacaagatccgctcgatcgacacgatcgccaacacaatggtggtcgaggctggctgcattctcggcaacctgcgccgtgccgccgaggacgccgaccgcctgttcccgctgtcgctggccgccgaggactcctgccagatcggtggcaacctggccaccaacgccggcggcgtcaacgtggtgcgctatggcatgacgcgcgaactggtgctcggcgttgaagccgtgctgccgaacggcgagatctttcacggcctgcgcacgctgcgcaaggacaacaccggatacgacctcaagcagttgctgatcggctcggaaggcacgctcggcatcatcaccgccgccgcgctgcgcctgctgccgcgcgccgattcccgcgccgtggtgctggccgcggtggaatcgcccaagcaagcgctggaactgttctcgctgctgttcgcgcgctgcggcgcacggttgcaggcctatgagttctttaccggcgcctgcctggatctggtgctgacccatgtcgagggcattcatgccccgtttgcagaacgttatccggcctacgtgctggtcgagatcgcggacacagcgcccgaggatgtgctcaacgccctgctcgaatcggtcatcggcgatgcgctcgaacagggcctgtgcctggatgccgccgtctcggcctcactggcgcagttgcagagcctgtggcgtctgcgcgaggaaatctccgaggcccagcgtgccgacgggctgcacctgaagcacgacgtatccctgccgatcgaagccattccggacttcatgacctcgatggaaacccgtctggccgcgcgtcacccgggcgtccgcccctttatcttcggccacttcggcgatggcaacctgcactacaacctgtcccgtccgcttggcgccgatccgaaatgggcgctcaatgaaggcaaggccgtcagcgaggacgtgctggaagaggtggcccgctacgacggcagcatcagcgccgagcacggcatcggccagctcaagcgggagtcgttcctggcgctcaaggacccgctcgaattgcgcctgatgcgagccatcaagcaggtattcgatccgagcgggatcatgaatccgggcaagctgctc

SEQ ID NO: 32321 - DNA, 975 bp, Ralstonia metallidurans
aatggcccctccctccgacggaacccaatcatgaacgagcttgaacaactgaggcagttcaccacggtagtggccgacaccggcgacttccagttgatgaagcaatacaagccacaggacgcgactaccaatccgtcgctgattttcaaggcggtacagaagccggaataccgcccgctgctggaacaggctgtgcgcgatcaccacggcaattcggggctcgatggcgtcatggaccagctcctgatcgcattcggctgcgagatcctggccatcgtgcccggccgcgtgtcgaccgaggtcgacgcccgtctgtcgttcgataccgaggccaccgttgccaaggcgcgccacctgatcggcctgtacgagcaacgtggcgtggcacgcgagcgcgtgctgatcaagatcgcctcgacatgggaaggcatccgcgctgccgaggtcctgcaacgcgagaacatccgctgcaacatgacgctgctgttctcgctggcgcaggcagtggcttgtgccgaggccggcgcgcagctgatctccccgttcgtgggccgcattctcgattggtacaagaagcaggctggcgagaaatgggaccccgtggcgaacggcggcgaaaacgatcccggcgtgcgttccgtgcgccagatctatgactattacaagaagttcggctacgcgaccgaggtcatgggtgccagtttccgcggcaccgatcagatcctgtcgctggcaggctgcgacctgctgacgatcagtccggaactgctcgagcagcttgcaggcggacagagtgccgttgcgctcaagctgtccgtggaacaggcacaggccggcaacgtcgcgcgaatcgccgcagatgaacccgccttccgctggcaactcaacgaagatgcgatggcaacggagaagctctccgaaggtatccgcctgtttgcagccgatgcggtgaaattggaaaaactcgtcggcgaa

SEQ ID NO: 32322 - DNA, 672 bp, Ralstonia metallidurans
gtccatcaatttatcttcgggatctatccctacatcgcagccgccatcttcctgttcggcagcctggcgcgcttcgagcgcgagcagtacacctggaagtcggacagttcgcagatgctctatcgcggtaacctgcgcaccggcaacatcctgttccacgtgggcatccttggcctgttcttcggccatctcgtcggcctgctgacgccggtcgtggtgtgggacacgcttggcgtgtcgcatggcctcaagcaggccatcgccatgagcgccggcggcgtcatgggcacgatgtgcctggccggcctgctgatcctgctgcatcgtcgcctgaccaacgcacgcgtgtccgccgtcacgcgcttcggtgacaaggtcctgctgctgtggctgctggtcacgctgctactgggtctgtcgacgatcttcgagtcggccagccatatggacggccacatgatggtgcaactgatgacctgggcgcagcacgtcgtcacgctgcgcgcggatgccgccagctatgtggccgaggccccgctgctcttcaaggcgcacctgttcatgggcatctcgctgttcgcgatcttcccgttcacgcgactggtgcacgtctggagcggctttgcctcggtgacctacctgggacgcgcctggcaactcgtccggggccgg

SEQ ID NO: 32323 - DNA, 591 bp, Ralstonia metallidurans
atgcccattcatcaggtgctcagcaccctgctctgctaccccgaacaggaatggctcgacagcctcgaggaagccaacctcgcgctggtcgaatggccgcaggcgcgggacatgctggcgccgctgctcgacgagctgcgcagccggccgctgatcgagctgcaggaaaactacgtcgccacgttcgatcgcagcccgtcccactcgctgcatctgttcgagcatgtgcatggcgaaagccgcgaccgcggccaggccatggtcgacctgatcgacgagtaccgtcgtgacggcttcgagccgctggagaccgaacttcccgactacgtgccgctgttcctggagtatctcggcgcgttgtcgctcgatggcaaggaggagcgcgcggagcagttgctcggtgacgcgatccacgtgctggccgccatcggcgaccgcctggcccgcaaggaaagtccatatgccgccgtcttcagggtgctgcgcacgctgaccgatgtgcagcccgtcgcgcagcaggatcctccggtgcgtgacatggatgaagccatggaaacgttcggccccggcgccgatggcgtggaaccgctg

SEQ ID NO: 32324 - DNA, 1488 bp, Ralstonia metallidurans
atgaagattcgtgcccaggtagccatggtgctgaacctcgacaagtgcatcggctgccatacctgctccgtgacgtgcaagaacgtatggaccagccgtgaaggtgtcgagtacgcatggttcaacaacgtcgagaccaagcccggtgtcggcttcccgaaggaatgggagaaccaggacaaatggcaaggcggctggaagcgcaatgccgacggtagcctcacgccccgtcagggcggcaagacaaagatcctggcgaacatcttcgccaacccgaacctgccgcagatcgacgactactacgagccgttcaccttcgactacgagcatctccagaatgccccgctgatgcagacgccgcccacggcgcgtcccgtatcggcaatcaccggcaagaagatggagaagatcgaatggggtccgaactgggaagacgacctcgggggcgagttcgaccagcgcagccgcgacaagctttttgaggacattcagaaggacatgtactcgaccttcgagaacaccttcatgatgtatttgccgcgcctgtgcgagcactgcctgaaccctacctgcgtggcgtcctgcccctccggctcggtctacaagcgcgaggaagacggcatcgtcctggtcgaccaggacaagtgccgcggctggcgcatgtgcgtgtcgggctgcccgtacaagaagatctacttcaactggcagaccggcaaggccgaaaagtgcgtgttctgctatccgcgtatcgaggccgggcaaccgacggtctgttcggaaacctgcgtgggccgcatccgctatctcggcgtgatgctctatgacgccgaccgcatcgaacaagccgcgtccgtggccgacgagcgcgatctgtaccagtcgcaactcgacgtcttcctcgatccgcacgatcctaagatccaggccgaggcgctgcgtcagggcatcccgcaaagctggctggacgccgcggtcaagtcgccggtctacaagatggcctgcgagtggaaggtggccttcccgctgcacccggaataccgcacgctgccgatggtctggtacatcccgccgctctcgccgatccagtcggccgcggaatcgggcttcatgggcatgaacggcgtgatcccggacgtgaagagcctgcgcattccggtcaagtacctcgcaaacctgctgaccgcaggcgatgtgaatccggtgctgtccgcgctggaacgcatgctggcgatgcgcgcatacaagcgctctgaatcggtggacggcctgcaggacctggccgtgctcgaacaggtggggctgacgcccgcgcaggtcgaggacatgtaccagatcatggccatcgccaactacgaggaccgcttcgtcgtgccgtcgtcccacaaggaaatggcggaagacagcttcgacgagaagggaagctgcggtttcagcttcggcaacggctgctcgggtggcacgtcggacggctcgctgttcggcacgaag

SEQ ID NO: 32325 - DNA, 3654 bp, Ralstonia metallidurans
aagtccacctactcggacggacacggcgctgtggtcaacgaggaccgcaagtgggagaacacgtaccgcagccgctggcagcacgacaagatcgtgcgctcgacgcacggcgtcaactgcaccggctcctgctcgtggaaggtctacgtcaagaacggcctgattacctgggaaacccagcagaccgactatccgcgcacgcgccccgatctgcccaaccatgaaccgcgcggctgcccgcgtggcgcgtcgtacagctggtacgtctactccgcgcagcgggtgaagtaccccatgattcgcggccgcctgatggaaatgtggcgcgaggcccgcaagacgatggatccgatttccgcctgggaatcgatcagccagaacccggagaaggcccgccgctacaagagcgtgcgcggccagggcggcttcgtccgcgcggactggcagactgccaccgagatcatcgcggcggccaatgcctacacgatcaagcagtacggccccgaccgcgtgatcggcttctcgccgattccagccatgtcgatggtgtcgtacgccgctggcgcgcgctacctgagcctgatcggcggcgcctgcctgtccttctacgactggtactgcgatctgccgccggccagcccgcagatctggggcgagcagacggacgtgccggaatcggccgactggtacaacagcacctacctgatggtgtggggctcgaacgtgccgcagacgcgcacgcctgacgcccacttctacaccgaggtgcggtacaagggcaccaagaccgtggccgtgtcttcggacttcggcgaaatggtcaagtttggtgacatctggctcgcgccgaagcaaggtaccgatgccgccctggcaatggccatgggccacgtggtgctcaaggagttccacgccaccggcaagtcggcctacttccgcgactatgtgaagcagtacaccgacatgccgctgctggtgctgctgcgcgagcaggacggcacgctggtgcccgatcacttcctccgcgcttcgcatctggacggcaatctcgaccaggcgaaccatcccgaatggaaaacgctggccattgacgacgccacgggcgaaatcgtcgcgccgaatggctcgatcggcttccgctggggcgaagccgcccacgacaacggcgcgaaggtcggccgctggaacctcgagatgaaggatggcggcagcggccgcgagatcgaccagcgtctgtcactgatcggtcatgaggatgaagtggtcgaagtcggcttcccgtacttcggcggcgagcacgatgccctgctcaagcgccgcgtgcccacgcgccgcctgacgctggccgacggcaccacggtccacgtggccaccgtctatgacctgcagatggccaactacggcgtcgaccagggccttggtggcccgaacgtcgccacgtcgtacgacgacgatgtgccctacacccctgcctggcaggaaaagcacacgtccgtgccgcgtaacctcgtcatccaggtcgcccgcgagttcgccgacaacgccgaccgcacgcagggcaagagcatggtcatcgttggcgccgcgctgaatcactggtaccacaacgacatgatttaccgcggcatcatcaacctgttgatgatgtgcggctgcatcggcaagagcggtggcggctgggcgcactacgtcggccaggaaaagctgcggccgcagttcggctgggcgccgctggcgttcgggctggactggtcgcgcccgccgcgccatatgaacggcacgtcgttcttctacaaccacaccagccagtggcgtcacgagaagctcggtgtcgacgaaatcctcgcgccgaccgccgaccgcgcgcgctacgacaagctgtcgctgctcgacctcaacgccaagtccgaacggatgggctggttaccatccgcgccgcaactgggccggaacccgctcgacgtggtggccgaggcccgcgccgccggcaaggacccgatcgcggataccgtggagcaactaaagtccggcaagctgcagttcgcctgcgacgaccccgacaatcccgccaacttcccgcgcaacatgttcgtgtggcgctcgaacattctcggcagctccggcaagggccacgagtacttcctcaagtacctgctcggcacgcagaacgccgtgttcggcgatgagaacgatgcgatcaagcccagcgaagtcacggttcggccagccgccgaaggcaagctcgacctgctgaccgtgctcgacttccgcatgagcaccacctgcctctacggcgacatcgtgctgccgacggccacgtggtacgaaaaggacgatctgaacacgtccgacatgcacccgttcatccacccgctctcggaagccgtgcagccgctctgggaaagcaagacggactgggaaatctacaaggcgatcgcgaagacgttcagcgagattgccggcccgtaccttggcacacgcgaggacctggtctgcaccccgctgctgcacgacaccccgggtgaactgggccagccgttcgagccgaaggactggaagcacggcgagtgcgacctgatcccgggcaagaccgcgccgtcgatgaccgtggtggaacgcaactatcacgacatctacaagaagttcacgtcgatcggcccgctgctcgacaagcttggcaacggcggcaagggcatcaactggaacaccgagcacgaagtgcacgagatcggccacctgagcaagacggtgaccgagcctggcgtcagccagggccgtccgcgcctggaaaccgcgatcgacgccgcggagatgatcctgacgttcgcgcccgaaaccaacggccacgtggccgtcaaggcctgggacgcgctgtcgaagatcaccggccgcgaccacacgcatctggccgtcggccgcgagcacgacaagatccgcttccgcgacgtgcaggcccagccgcgcaagatcatctcggcgccgacgtggtcaggactcgagtccgaggaagtcagctacaacgccggctacaccaacgtgcacgagctgattccatggcgcacgctgacgggccgtcagcagttctaccaggatcaccgctggatgctcgacttcggcgaaggcgcgtgcgtgtacaaaccggcgatcgacaccaagacgatcagcccgatgctcggcaagaagccgaacggcaaccccgaactggtgctgaactggatcaccccgcaccagaagtggggcatccactccacgtactccgacaacctgcggatgctgacgctgtcccgcggcggcccgcacgtatggatctcggaagtggaagccaaggccaacggcattcgcgacaacgactgggtcgaggtcttcaacgtcaacggcacgctgacggcgcgggtggtcgtatcgcagcgcgttccgcaagggatgtgcctgatgtaccacgcccaggaaaagattgtgaacgtgcctggggccgagaccagcggtatgcgcggcggcatccataactcggtcacccgcgcggtgaccaagcccacgcacatgatcggcggctatgcgcaactggcctacggcttcaactactacggcaccgtcggtagcaaccgcgacgagttcgtgatcctgcgcaagatgaacaaggtggactggctcgac

SEQ ID NO: 32326 - DNA, 1192 bp, Ralstonia metallidurans
cgaatggcagcagacgtacggcgacgtcgtgcatctgcggatgtggccggaacatgcggtcgtcgtcaccgacccgcagctcgtccgcgaacttctggtgacccatcacgactcgttgatccgctgggaacgtggcacgcgtgtgttctcccgcgtgcatgggcatagcgtgctgaccgcagagggtgacgcatggtcgcgcaagcggcaggcgttgcagccgggcttcatgccgaaggccgtgcatggtttcgttccgggcatcgtggagatcgtcgacaaggggctcgccacatggcccacgcgagtggcggactggcccgtggaaagcgcgctgacgtcgctgaccatggatgtgatcgttcggatgatgttctcggatgagatcggtgaggacgcgcgcgttgccgaatgcgccgtgcgcgcgatcagcgaggcggccaacgccgatttctactggccggcgagcctgcccgactgggtgccatggaagcgcgcaagacggcgggcactccacacgttgcgggacctgatcgagcgacatctgcaggcgcgtctgcggatgcgcacggatacctggccggacgacctgctttcgcgcctgctgtgcctgcatcgggatgacgcgacggcatggccgctacaggcggtgcgcgacgaatgcatgacgacgtttctggccggacacgagaccaccgcggcgacgctgacttggtgggcctggtgcatggcatcgaacccgtccgcgcaggacgccgcacgcgccgaggtcacgcatgtactgcgcggccaggcgccgacggcggatagtcgccaggcgctgcgtcaggtggtgcagacgatcacggagtcgatgcgcctctacccggtggccccggtgctcatcagccgtcgcgcggtccgccccatcaccttgggcccgtggcggctaccggcgcgcacgctgttcatgctgcccttgcagttgatgcaccacgatccgcgcttgttcccggagccggagcgctttcagcccgatcgcttctcgacaggttcgccgcaggccccgcgcggcgcctacatgccatttggcaccggcccgcgggtttgtctggggcagcatctggcaacggctgagatgacggtcatcgcggcgatgctgctgcagcggtacaagctgtcggtgccggaaggcgcggcacatccgcggccg

SEQ ID NO: 32327 - DNA, 1320 bp, Ralstonia metallidurans
atgaatcccatcaaagtcggccttctcggcatcggtaccgtcggtagcggcacgttcaacgtgctcaagcgcaatcaggaggaaattcgtcgccgtgcaggccgcggcatcgagattgcggtggtggctgacctgaacaccgagcgcgcccgcgagctgaccggtgggacggtggacgtcgtcagcgatgcgaacgacgtggtgacgcgtccggacatcgacatcgtcatcgagctgatcggcggctatggcatcgcccgcgagttggtgctcaaggcgatcgagaatggcaagcacgtggtcaccgccaacaaggcgctgctggccgtgcatggcaacgagattttcgaggccgcgcgcaagaagggcgtgatcgtcgccttcgaggcggcagtggcgggtggcatccccatcatcaaggcgctgcgcgaaggcctgaccgcgaaccgcatccagtggatcgccggcatcatcaacggcacgacgaacttcatcctgtccgagatgcgcgacaagggtctggatttcgataccgtgctcaaggaagcgcagcaactgggctatgccgaggccgatccgaccttcgacatcgaaggcgtcgacgccgcgcacaaggtcacgctgatgagcgcgatcgcattcggtatgccggtgcagttcgaccgcgcccacgtggaaggcatcaccaagctgtcggccatcgatatcaaatacgccgaggaactgggttatcgcatcaagctgctcggcatcacccgccgccgcgaggaaggcgtggaactgcgcgtgcacccgacgctggtgccggcctcgcgcctgatcgccaacgtggaaggcgcgatgaacgccgtgctggtgcagggcgatgccgtgggcgccactctgtactacggcaagggcgccggcgccgagccgaccgcctcggccgtgattgccgatctggtcgacgtgacccgcctgcacaccgccgatccgaaccaccgcgtaccgcacctggcattccagccggacgagctgtcgaacgtgcccgtgctgccgatcgacgaagtcactagctcgtactacctgcgtatgcgtgtgtcggacgaaactggcgtgctggcagagatcacgcgcatcctggcggaagccggcatcagcatcgacgcgatgctgcagaaggaatcgcgcgaaggcgagccgcagaccgacatcatcatcctgacgcacctgacgcgcgagaagcacgtcaatgccgcgattcgcagcatcgaagcgctccagaccgtgctgtcgccggtcacgcgcctgcgcatggaagaactgaactgatagctgaca

SEQ ID NO: 32328 - DNA, 1452 bp, Ralstonia metallidurans
ctgacgctgaaccccggccacgtgtcgctggatgacctgcgccgcatccatcgtggcgaagtgcgactggcgatggcggagtcggcgtgggccggcgtgcgtgccgcgcaggccaccgtgcaggacatcatcgacgccgacgcggtggtctatggcatcaataccggcttcggcaagcttgcccagtcgcgcatcgcgcacgacaagctcgccgaactgcaacgcaatctggtgctctcgcacagcgtgggtacgggctccgacctgtccgtcgataccgtgcggctgatcctggccatcaaggctgtcagcctcgcgcgtgggcattcgggcgtgcgccccgaactgatcgaagcgctgctggcgctggccaaccacggcgtgacgccgtgcatccccgccaagggctcggtcggcgcatcgggcgatctggcgccgctggcccatatgtcctgcacgctgatcggcgtgggcgatgtgtatgtcgacggccagcgcgtgccggctgcgcagggtctggtccatgcggggctcgccgccttcacgctgggcccgaaggaaggtctggcgctgctcaacggcacgcaggtttccaccgctctggccctggccggcctgttcgccgcggaggacgccttcgcggccggactggtggcgggcgcgctgtcgctcgaagcgatcaagggatcggtcaagccgttcgatgctcgcattcacgcggcacgcggccaggcgggccagatcgccgtggccggcgcggcacgcgcgatgcttgatggcagcgagatcgtcgactcgcacaagatgtgcggccgggtgcaggacccgtactcgatccgctgccagccgcaggtgatgggcgcgtgcctggacaacctgacccatgccgcccgcatcctgcgcatcgaagccaacgcggcatccgacaatccgctggtgttctccgaacagggtgatgtggtctccggcggcaacttccacgcggagtcggtggcctttgccgccgacatcatcgcactggcgatcgccgagatcggcgcaatctcggaacgccgccttgcgctgctgctcgacaccggcctgtcgggcctgccgccgttcctggtgcgcgatggcggcctgaactccggattcatgatcgcgcaggtcacggccgcggcgttggcgtccgagaacaagtcgctggcccatccgtccagcgtggacagcctgcccacttcggccaaccaggaggaccatgtgtcgatggccacctacggcgcgcgccgcctgggcgagatggcggccaacaccgctgtgatcgtcggcatcgaggcgatggccgccgcgcagggtatcgaatttcatcgaccgctcaagtcgtcgccgctggtggagcaggaactggcgcgtatccgcgcgcgcgtggcgttcgtcgaagccgatcgctatctcgcgccggacatcgaggcc

SEQ ID NO: 32329 - DNA, 1179 bp, Ralstonia metallidurans
ttttatgcatccatccgcgcggagctggattcgatccgcgccgcgggcctgtacaagcgcgagcgcgtcatcgccacgccgcagggcgccaagatccgcacggcggacggtcgcgaggtgatcaacctgtgcgccaacaactaccttgggctgtcgtcgcaccccaaggtcatcgaagccgcgcacgaggcgctgcgcacgcatggctatgggctgtcgtcggtacgctttatctgcggcacgcaggatctgcacaaggaactggaggggcgtctggcccggttcctgggcaccgaggacaccatcctctatggctcggccttcgatgcgaacggtgggctgttcgagaccatcctcggccccgaagacgccgtgatcagtgatgaactgaaccacgcgtcgatcatcgacggcatccgcctgtccaaggcgcgacgccttcgctaccggcacaacgatctggacgacctgcgcgcccaattgcggcaggccgatgcggatggcgcacgcttcaagctcgtctttagcgatggcgtgttctcgatggacggcaccgttgcgcggctggacgagatccggaagatctgcgacgagcatggcgcgctgctcggcattgacgaatgccacgccacgggcttcatgggcgcgcgtgggcgaggcacgcacgaggcgcgcggggtgttcggcaagatcgacatcatcacgggcacgctgggcaaggcgctcggtggcgcatcgggcggctttacctccgggcgcaaggaagtcgtcgagctcttgcgccagcgttcccgaccctatcttttttcgaataccgtggcgccggccatcgttggcggcagcattgccgtgctcgatatcctggaaggcagtaccgagctgcgggaccggctggagcagaacacccagttcttccgcgaaggcatcgcgaagcttggcttcgacatcaagcccggcgaccatccgatcgtgccgattatggtctatgacgccgaaaaggcgcagcagctggctgacagactgctggaactcggtgtgtacgtagtcggtttcttctatcccgtggtcccgaagggacaggcacgtatccgcgtgcagatgagcgctgtgcacgatgcggtgacgctgcagtccgctcttgatgccttcggccaggcaggccgtgaattggggctgatt

SEQ ID NO: 32330 - DNA, 1104 bp, Ralstonia metallidurans
caaccgctgttgtcgatccgcgatctttccatcgcgctgccggcgggcggcgaccgcgcgcacgcggtcaaggacatctcgtatgacctgcacgctggtgaaatcctctgcatcgtaggggaatccggctcgggaaaatcgatgagcgccaacgcgatcatgggcctgctgccgagctacctgaagcctgagcgcggcgagatcctgttccaggggcgcgacctgctgaaactggacgaaaccacgctgctcggcatgcgtggcaaggacatggcaatggtgttccaggagccgttgtccgcgctgaatcccgtgatgaccgttggtgaccagatcgccgaagtcatgcgtgtgcaccgcgcctatccgggcgaagcctgccagcggcgcgtgctggaactgctcgagttcgtcgggttgcccgatccagccacgctggtgcacagctatccgttccggctgtccggcgggcagcgtcagcgggtggtgatcgcgatggcgctggcactggagccgacgctgttgatcgcggacgagcccaccacggcgctggacgtgaccacccaggcgcagattctggccctgatccggcgcatccaggccgagaaaggcatgggcgtgatgttcgttacccacgacttcggcgtcgtggccgagatcgccgaccgcgtggccgtaatggaaaagggcgtgctggtcgagatcggcacggcgcagcaggtgctcaatcacccgcagcatccctatacccggcggctgatcagcgccgtgccacatggccgcgcgcgcgacggcggccatgcggacgaccgcaccgtgctcgacgtgcgaaacctgcgcaagacctacgtttccggtggcgggctgttctcgaagaagcgcgtgactcacgccgtggatgacgtgtcgttcagcgtcaagcgcggcgagacgctcggtatcgtgggcgaatcgggctcgggcaagtcgaccatcggcaaatgcctgctgcgcctgaccggcgtcgacggtggccagatgctgttcgacggccaggacattgcgcgcctctccgagcgccagttccgcccgatgcggcgcgacgtgcagatgatctttcaggac

SEQ ID NO: 32331 - DNA, 1173 bp, Ralstonia metallidurans
cgcgccgagaacagcgaaatctgggatgtcgagggcaagcggtacatcgacttcgctgccggcatcgccgtgctcaacacgggccatcgtcacccgcgcctggtggccgcgctgcaggcgcaactgaatcgcttcacccatacggcgtaccagatcgtgccgtacgccagctatgtggagctggccgagaagatcaaccagcgcgcgccgggccgctcagctcgcaagacggccttcttcacgaccggcgcggaagcggtggagaacgccgtcaagatcgcgcgcgccgccaccggccggcccggcgtgatcgcgttctcaggcgggttccatggccgcacgatgatgggcatggcgctgactggcaaggtggccccgtacaagaccggcttcgggccgttccccggcgaggtcttccacgcgccttacccgtctgcattgcatggcgtgacggtggaggattcgcgccgcgcgctcgaacacctgttcaaggccgatatcgacccgcgccgcgtggcagccatcatcttcgaaccggtgcagggcgaaggcggcttcaacgtggcgccgccggagttcgtgcggatgctgcgcgctgtgtgcgacgagcacggcatcctgctggtggccgatgaggtccagaccggtttcggccgcacgggcaagctgttcgcgatggagcactacgacgtcgcgccggacctgaccacgatggccaagagcctggccggcgggatgccgctttccgccgtgtgtggccgtgccgaaatcatggatgcgcccgcgccgggcggcctcggcgggacctacgccggcaatccgctggcggtggcgtccgcgctggccgtgctcgacgtgctcgagtccgagaacctgatcgcgcgaggcgcggagcttggcgaacgactgacggcccgcctgaacagcctcaagccgcgcgtgccgcaaatcgccgaagtccgtggcatcggcgcaatggtggccgtggagttccgtcgcgccgatggcagcccggatgcggagttcacccgcgaagtgcagaaccgcgcgctggagaggggcctgttgctgctgtcgtgcggcgtgtacggcaacgtgattcgcttcctgttcccgctgaccatccaggacgccgtgatgaacgagggcctcgacatcctggcagacgtgctg

SEQ ID NO: 32332 - DNA, 1563 bp, Ralstonia metallidurans
aatggcggccagattctggtcgaacagctgcgcatccagggcacgaagcgcgtgttcctggtgccgggcgagagctatctgccgtgcatcgacgcgctctacgaccatcaggatgcgatcacgccgatcgtctgccggcaggagagcggcgccggatacatggcggaggcctacggcaagctgaccggcgagcccggcgtctgttttgtcacgcgcggcccgggggcgaccaatgcgagcatcgcggtgcatacggcgtttcaggactccacaccgatgatcctgttcgtcggtcaggttggaaacgacttctacgagcgcgaggcattccaggagatcgactaccgtcgcatgttcggccagatggccaagtgggtggcccagatcgatcgcacggaccggatccccgagttcgtggcgcgagcctacgcggtcgcaaccagcgggcgtcccggtccggtggtgctggcgttgcccgaggacacgctctggggccgcgccacggtcgccgacatgccgcgttatgagcgcgtccacggcgccccgacgccggtggcgctcgacaagctctccaccttgctggctggcgcgaagcggccgttcctgctggtcgggggctcgggctggacgcccacggccatgcggcagatcgaaggctttgccgaacgcttcggcctgcccgtgggtgtggcatggcgacgtctggaatgcttcgacaacggacatccgaacttcgccggccacgtcggttgggggatggtcgatgcgctgcgccagcggattcacgaagcggatctggtgatcgccgtgggcacgcgcatgggcgaggccaccacggaaggctacacgctggtggaaagcccgcagccacggcagaagctggtgcacgtgtatcccgatccggacgaactcggccgggtattccgcccgacgttgccgattgccgccgatgtggtgtcgttcgcggcggccgtggcgcagctatctccggcgcagacggtatcccgagaggcgatgacggcggtgacggcggccaatgccaacttcctggcggagcaggagcccaaggacgcccccggcgcgttgaacctgaaccgggtggcctgccacgtgcgcgaccacgtgccggacgatgcctgcatcactgtcggcgcaggcaactatgcgttgttcgcgcacgcctatcaccgcttccatggcgtgggcacgagcctggcgccgacggtagggtcgatgggttacggcttgccggccgcaatctcggccaagctcgagaatccgtcgcgtaccgtggtctgctacgcgggcgatggctgcttccagatgaacctgcaggaactcggcgtggccatgcagtatcggctgggcatcgtgatccttgttttcaacaacggcatgtggggcacgatccgcgcgcatcaggaacgcgagttcccgggccgcacgattgcgctcggcttcgacaatcccgagttcagccagctggtcaaggcgtatcacggccacggcgaagtggtggatcgcgatgaggatttcgcccccgcctttgcccgggcgctggaa

SEQ ID NO: 32333 - DNA, 1407 bp, Ralstonia metallidurans
tatatcgacggccagtggaccagcgcggccgatggcgcgacgttcgactgcatcaacccggccacgggcgaacaactggcgcgtgtggcggcctgcggcgcagcggacgtcgaccgtgccgtggctgcggcccggcgcgcgttcgaggccggagtctggtcggcgatgccccggcgcgagcgcaaggccgtgctattgcgtctggcggccctgatcgagacgcaccgggaagaactggcgctgctggagacgctggacatgggcaagccgatcggcgacaccatgctttatgacatccccgaagcggctcgcacctatgcgtggtatgccgaggcgatcgacaaggtctatgacgagatcgcgccgaccgatgcgggcgtgctggccacgatcacgcgcgagccgcttggcgtcgtggcggccgtggtgccgtggaactatccgctgctgatggcgagctggaaggtggcgccggcgctggccgcgggcaacagcgtggtgctgaagccggccgagcaatcgccgctgaccgcgatccgcctggccgcgctggcggaagaggctggcgtgccgcccggcgtcttcaacgtggtgcccgggttaggcgcagaggcagggcaggcgttgggccgccatcccgatgtcgactgcctggcgttcacgggttccacggctaccggcaagcggtttatggaatatagcggccagtcgaatctcaagcgcgtctggctcgaatgcggtggcaagtcaccgcatatcgtgttcgacgactgcccggacctcgaccgcgccgcgctggccgccgccatcggcatcttcaacaaccagggggagatttgcatcgcgggctcgcggctctacgtgcagcgcggcatctacgacacgttcatggcgaagctggaggcgcatgcggcggccatgcagccgggggatccgctcgacccgcgctccgcgatgggcgcgatcgtcgacgggcggcagttcgaccgtgtgatgtcgtatgtggaagccggccagagggagggggcaaggctgcgtgcgggcggtcaggccgcgcgcgccgattccgggggctggtttgtgcagccgacgatcttcgagtgcccgacgcagtcgctgtcgatcgtcaaggaggagattttcggcccggtgctggccgtgaccgtgttcgacaccgaggccgaagccgtggcgatggccaacgactcggcgtacgggctaggcgcggggctgtggacgtcggacctgtcgcgcgcgcatcgtgtctcgcgccggctgcgtagcgggctggtctgggtcaactgctacatggacggcgacatcaccgtgccgttcggcggcgtcaagcagtcggggttcgggcgcgacaagtcgttgcacgcgctggagaagtaccaggacctgaag

SEQ ID NO: 32334 - DNA, 1038 bp, Ralstonia metallidurans
agtgaacaccgtattccgaccgccggcctgcatcagtgggtggtcgatctctggctggcggcaggctccgatgcccgcgaggcccggctgaccgccgatcacctcgtgggcgccaacctgtcgggccacgactctcacggcgtggggatgatcccgaagtatgtgatgtcgtggcaaggcgatcagctccagctcaaccagaaggtcagcgtggtgcacgaatcgggcggcatcctgagcctggacggcaatcgcggcatgggccaggcggtgaccgaacaggccatggggatgggcatcgaacgcgcccgcgagcatggtgtctgcgtgcttggcctgcgccgctcgcaccatctgggccgggtcggccactgggccgagcaggccacggcagccggcatgatctcgatccatttcgtcaacgtcctctccaagccgatcgtcgcgccacacggcggctacgacgcgcgcttcggcaccaatccgttcacgatcggcgtgccgctacccgcgcagccgcctctggtgctcgacttcgccaccagcgccatcgcgcttggcaaggtgcgcgtggcccacaacaagggcgtggcggtaccgccgggctccttgatggacccgaacggtcaccccaccgacgatccctcggtcatgttcccgggcgctggcggcccgcagggcgcgctgcgcacgttcggcgagcacaagggctacgtgctggccgtgatgtgcgaactgctcggcgcggcggtgaccggtggccatacgatccgtccggagacgctcacgcacgaacatgcggtgtggaacaacatgctggcgatcatcttcgatccggcacgactgggcagcagcaccaccttcggccacgaggtcgaggcgtttgtcgaatgggtcaaggcgtcacggctgcagccgggcaatgaccagatccgcctgcccggcgacacggaacgcgaatggcgccgcgcccgcgccgatttcatccccgtggacagcagcacgctggcccagctagacgatgccgccgctcgcgtg

SEQ ID NO: 32335 - DNA, 1113 bp, Ralstonia metallidurans
atcgtgggtgcttacgagcacccaacacgcaaggcaccggataagacggttgcgcagttgcacgcagagtgcgcgaagggggcactggaggacgcaggactgacgctgcaggatgttgacggctacttttgcgcaggagacgctcctggccttggcgcgaacagcatggccgattacctcggcctcacgaacttgcggcatgtcgacacgacggacaccggaggctccgcatatctaatccacgtctctcacgcagcgcaagcgattgcggcgggcaagtgcaacgttgcgctcattacgctcgcggggcggccccgcacggaaggcgccagcggtgttggcgtcggcgcgcgactggtgacagctgcgacgcccgatgcatcttgggagatgccctatagcccggtcacggtgaacatgtacgcccttgcagcggcaaggcatatgtacgagttcggcactacttccgaacaactcgcatggatcaaggtggcggctgccacccatgcgcagcacaacccgaatgcgatgctccgcgacctcgttagcgtcgaggatgtgctcggctcagctctgatctctgacccgctgcataaacttgactgctgcgttgtcagtgacggtggcggcgcgcttgtcgtagcgcgacccgaaatcgcccgaaagctcaaccgtcccatcgtgaaagtactgggtgcgggcgagacgatcaaaggccaactgggcgggaacgtcgacctcacctattccggggcagcggtgtcgggaccggtcgcctttgaagaagccggaatcaagccgtctgacatccagtacgcatcaatctacgacagcttcaccatcaccgttctgatgcagttggaagaccttggcttctgcaagaaaggcgaaggtggcaagttcgtcgctgatggaaatctgatctccggcgtaggcaagctgcccttcaacacggatggcggtggcctttgcaacaaccacccggcaaaccgcggtggcatcaccaaagtcatcgaggcagtccgtcagttgcgcggggaggcacatcccaaggtgcaagttcccaactgcactctcgcgcttgctcaaggtaccggcggcctcctcggttcg

SEQ ID NO: 32336 - DNA, 1219 bp, Ralstonia metallidurans
agattgattggcgcaggatgcaggagcgcgccaacatgccagaagaacgggctagctgagaagacaaggaacaaccatgcagaacgcaccatggatgaatcccgagctggagactctgcgcgacagcgcaaggcgattctacgaggcggaacttcttccgcatgaagagcggtgggcccaacagcaatgtgttgaccgggacgtttggtacaaggcagcggaggccggccttctttgcgtcggcattcccgaagagtacggcggcgggggaggtaacttcctgcatgaggccgtcatcttcgctgagcaaggtcgcatgctatgccctgggctgggcaattcactccatagtggaatcgtcgcacattacatccacaacttcgcttctgagcagcaaaagcaggagtggttgccgaagatggccaagggagagttagtcggagggcttgccattactgagcccggcgcggggtctgacgtgcagagcattcgtacggcggctcggaaggagggcggtgattacgtcatcaacggcgcgaagacctacatcactaacggcagcacagcaaacctcatttgcgtcgtagttaagacggatcctaacttgggagcgaagggcatttcgatcatcgttgtcgaaacagacaaggtagagggtttccggcgcggacgaaccctatcgaaagtgggacttcattcgcaggacacagcagagctgttttttgacgatgtgagagttccccaagccaaccttctcggcaacgtagaaggacaaggattcaagcaactcatgaaagagttgagtcgagaacgcgtgattaccgccttcatgtcgatggcatgtatggagcgagccatcgaagagaccttgaaatttgctgcggacagaaaagtattcggtcagaccttgctgtccatgcagaatacgcggttcaaactagccgagtgtgaaacgaagttgacgctcgcgaaggcgatgctcagccattgcagtgccagtctcctggaaggccaactgagcagcgagatagcggccatggccaagtggtggatcaccgatgcttgcggccaggtcgtcgacgagtgcgtgcagctccacggtggagcaggattcatgctcgagtatccgattgctcggctgtatcaaaacgtgagaatccaccgcatccttgcagggaccaacgagattatgaaggaagtgatagcccgagagcttgaa

SEQ ID NO: 32337 - DNA, 1554 bp, Ralstonia metallidurans
acgctgccgcaatgtctggaagtagcagctcttcggtttgcccagaagccggcatacgtgatttacgggcatgtcgtgacctacgagaagctgttgaatgacgtgcggagcttagcggggtggctgcagcaacgcaccggcgtgcggcagggagaccgagtccttttaagtgcacagacttccactcagtttgtgacggcctaccatgcgattctcagggcggatgcagtcccggttctggccaacccgatgtgtcggagcgcggagctcgaacacctgatgaacgacagcggggcaaaggtggcgattgcggcgcaggaattgtggccgcaaatggagccgcttcttgccaaaggccttgaagacgtgatgctgttttcctatcagtcaggcttagagggcatcggggatgcagatgtgccagactggtttagcgtgccaattgcgcttcccgaaaacgagaaagtttgtggttggggaaaagcgctttctgccaacctgatcccctggcctgctcaagcccgtgcagacgatctttgcctcatcgcttacacctcgggcaccacggcgcatccgaagggctgcacgcatactcactattcgctgatgacagctgctgtaacggcggcaaactggcgcggggacacgaccgagaccgtcttccttggtgcagccccgatgtttcatatgcttgggctccagtcgctcgtcaacactgcgatccaccttggcgcgacctctgtgcttcttccacgctgggatgcacgcaaagcggccgaactcatcgcccggtacagagtgaatcgatggggcgctgctcccccaatgctgttggacctgctcggtctgccgaacttgccggatagtgcgctcgaaagtctcgccctcatcaacggcggtggtgcagcgctgccggaggccgttaacaagcggttatcggaggagctaaggattcattacatggaaggttacgggatgacagaaactgcggccatggttatggccacgccgctacaacgcccaaagcgccaatgcttaggtatcccgacctttggtgtaagtgctgcgctggtcgaccctgcgacgttggagttctacccggacgggcccacgacggagagcggagagttgtggatttcgggcgaccaagtaagccctcacggctactggaataacgagcctgctaaccgcgagtcgtacgtggagcggggtggaaaacgatggctgcgaacgggtgatcttgccgtgcgtgatgaggacggctattacttcctggtggaccgcctcaagcgaatgatcaacgtcgggggctacaaggtctggcctgccgaggtcgaatcactactgcatagtcacccagctatccaggaggcctgcgtcattgcggtcacagacgagcgccgcggcgagcgagtccgggcgctcgtggtcgtgcgcaacggcgcatcgctcaccgaggaagaactgactgaatggtcgcgatcgaatatggcggcctacaaatgcccgcgagagatcatctttaccgaccgattgctacggtcgccgacaggg

SEQ ID NO: 32338 - DNA, 793 bp, Ralstonia metallidurans
ttttcgccccgtccactggaaggccgcgttgccctcatcgccggcggctctagcggcatcaaccttggtatcgcgcagcgctttgcatccgcaggtgcaaaggtcgtcattctgagtagagacgaagaacgcatcaccgcagcagcaagaacaatcacagacgccggccatgtggcctatggacgggcagccgacgtacgcaactttgaagcggtggcatccgtgtttaaggaggcatccgaaagattcggtctgattgatgttgtcgtctctggcgctgcgggaaacttccacgcacccgctgcctcgctctccgccaacggctttaagacggtcgtcgacatagacctgattggtaacttcaatgtcttgcgggccagcttcccgtttctcaggacgcctggtgcatcgctgatgtccattacagcaccaggcggtacgcacccttccgtttttcaggtgcatgcgaactccgccaaggcgggcatcaacatgacggtgaagtgcctggcgatggaatggggtcccgctggaattcgcgtgaacgcaatctcccctggaccaatttccggaacaaccggcatggcgaagctcgccgcctcgcccgaacgggagcaacaaatcaaggcgcgcctgcccctgcgcgagtacgggtcaattcgagacatcgccgacaccgcactgttccttgccagcgacaacgcaaagtacatcactggcgccatcatcgattgcgacgggggaagcggcctaggggacgcctccgcagatgcgcttcttaaagcaactcaac

SEQ ID NO: 32339 - DNA, 1200 bp, Ralstonia metallidurans
atgaacgaggcctacatctttgatgcattgcgcaccccccgcggcagaggacgtgccgatggtagtctctacgaagtcaacccagtcgacctcctcgctggacttatgaccgagctccagcagcgacatgatctcgacactgcccaagttgaggatgcgctcatcggctgtgtaatgcccaacggtgagcaaagcggatgtatcgccaaaacggcggctttgcgtgctaactgggattggcaggtaccaggcgtacagcttgaccgatactgcggctctggcttggagacagtgaatatcgctgccgcaaaggtccgctctggctgggagaatcttcttgtcgctggcggcgtcgagtccatgtcgcgtatcacgatgggtggtgcgcctggtcctcgggacacaaaacctgacatggtctttcagcttaaaccagtgccgactggcgtggctgcggacctcatggctactttggacggacacacgcgcgaagctgtcgatcgttacgctttgcaatcccagcagcgtgccggccatgcccgtgccagcggatacttcgaccgctctgttgtacctgtcaaggatgccaacggtctcactattctgaaacaggatgagctaatccgcgaagacactactctcgagaagcttggcgcactcaaggcctccttccaggcgatgggcgaactcggaggttttgacgcgctggcacagatgaagtacccggaagtcgaaaaggtgcgtcacatccataccggcgggaactcctcgggcattgtcgatggcgcctcactgttgctcgtcgggtcagagcaaaaggggcgcgagttgggcctcacgccacgagcgcgcgtggtttctgttgcagcagtcggcgccgagccgaccatcatgcttgccggcccggcgccggcgagtcgcctggcattgaaaaaggccggccttagcatcgacgacatcgaccttatcgaggtgaatgaagcgttcgcgtcagtcgttctgcggttcatgactgaaatgcaggttgacccagccaaggtcaacgtgaatggtggcgcgattgctatgggacaccccctcggtgcgaccggcggcatgctgctcggcacactccttgacgaactcgaacgccgcaacctcaagcgcggcttgatcacactgtgcgtcgccggcggtatgggaatcgccaccatcatcgaa

SEQ ID NO: 32340 - DNA, 972 bp, Ralstonia metallidurans
atcaagatcggcatcaacggctttggccgcatcgggcgcatggtgttccgcgccgccgccgcgaacttcaaggacattgaagtcgtcgccatcaacgacctgctggaaccggactacctggcgtacatgctgaagtacgactcggtccacggccgcttcgacggcgaagtgtcggtggaaggcaacacgctcgtggtcaacggcaagaagatccgcctgaccgccgtcaaggatccgtccgagctgaagtggggcgaagtcggcgccgacgtggtgatcgagtcgaccggcatcttcctgacgaaggaaggcgcgcagaagcacatcgacgcgggcgccaagaaggtgatcatgtcggccccgtcgaaggacgacaccccgatgttcgtgttcggcgtgaaccacgagacgtacaagggcgaagcgatcatctcgaacgcaagctgcacgaccaactgcctggccccggtggcaaaggtcctgaacgacaagtggggcatcaagcgcggcctgatgacgaccgtgcacgctgccaccgccacgcagaagaccgtggatggtccgtcgaacaaggactggcgcggtggccgtggcatcctggaaaacatcatcccgtcgtcgactggcgccgccaaggccgttggcgtggtgattccgcagctgaacaagaagctgaccggtatgtcgttccgcgtgccgacctcggacgtttcggtggtcgacctgaccgtcgaactggaaaacccggccaagtacgaagaaatctgcgccgagatgaaggcccagagccagggcgcgctgaagggcgtgctgggctacaccgaagacaaggttgtggccacggacttccgcggtgatgcccgcacctcgattttcgatgctgaagccggtatcgcgctggacggcacgttcatcaaggtcgtgagctggtacgacaacgagtggggctattcgaacaagtgcctggaaatg

SEQ ID NO: 32341 - DNA, 1374 bp, Ralstonia metallidurans
atgggaagactagtagccgtatcgaaccgggttgccgacccgcggaatcatgcggcgggcggacttgccgtcgcgctgtccgacacgttgaacaagaccggtggattgtggttcggctggagcggcaaggtagtggacgccagccgcggcggcacgcccggagagggcgagctgcaccagatccaggccggcaatgtcacgctggccacggtggatctgagccgggaggacttcgagtcctactacctgggctacagcaatggcgtgctgtggccggtattccactatcgggtggacctggccgacttcgattccggcggcaacctgaatgcctaccgccgcgtgaaccagcttttcgcgcgcaagctggcgccgctgctcaagcccgacgatgtgatctggatccacgactatcacctgattccgctggctgcggaattgcgggcgatcggttgcggccagcgcattggcttcttcctgcatatcccgctgccgccacggctgatcctggctaccattccgcagcacgagtggctgatgcgcgcgctgtttgcctatgacctgctcggcttccagagccacgacgatgtcgagcacttctcccgctatgtgcagggcgaggccggcgccgaaccgatgggcgaataccgcttccgtgcattccatcgcaccgtgcgtgcgcaggcgtttccgatcggtatcgatgtcgacgagttcatcgaactgggccgcgccgacgaagcgcgcgagacctacgagatgatgcgcggccagtacgcgcgacgcaggctgctgcttggcatcgaccgcctcgattactcgaagggcctgccccagcggctcaaggctttccagacgctgctggccgagtaccccgagaaccgttcaagcgccacgctgatccagatcgccgcgccgtcacgggaatcggtcgacgcctatgcggacctgcggcgcgacatggaaggcatcaccggcgcgatcaacggcgagtatggcgagctggactggatgccggtgcgctacatccaccgctccaccgcgcgtcgccgcctgccgggcctgtgccgtgcgtgcaacgtggcgctggtgacgccattgcgcgacggcatgaacctcgtcgccaaggaatacatcgcggcccaggacccggaggatcccggggtgctggtgctgtcccgcttcgcgggcgcggcggaacagctcaaggaagcgctgctggtcaatccatacgacacgcgtgccaccgcgcaggcgatccagcaggcactgcatatgtcgctgtcagagcgccaggcgcgtcaccagaagctgctggagcggattcgccagcaggatgtgcactggtggagcggggaatatctgcgggcgcta

SEQ ID NO: 32342 - DNA, 735 bp, Ralstonia metallidurans
atgtcttcgctacctctcatcgaacccgataccgcgctgtttctggatttcgacggcacgctggctgacctcgcgccacgccccgagctggtgcaggtcgagccggaactggttggcacgctgcgcgcgctgcacacctgcctggacggcgccctggccattatctcgggccggcccgttgccgagctcgatggcttcctgcagccgctgaggctccccgcggcaggcgtgcacggcgccgaactgcgccatgacggcgaagcgctgttcatgccaccggccccgggcatcacggcattgatgccgaggctcgaagccttcgtcgcgcgccatcccggcctacgcatcgagcggaaatccgtggcagtcgccattcactatcgacaggctccggaactcgaggcacaggtgcgagcgatggtggccgacaccctgcacgacgtggatgggctggaaggcttgcccggaaaaatggttgtcgagatcaagcctgccggcgtcgacaaggggggcgcgatcgccgcgttcatgcgcatggcccccttcgaaggacgcaagccgctgttcgcgggtgacgatgtcaccgacgaagccggtttcgttgtggcgcgtgaactcggcggggtgggcgtgctggttggcgagcgcgccaccgccgccacggtcagcgtgaccgggcccgctgcgttgcgttgctggcttcatcgatccgcccatgctcttctggcgctcagg

SEQ ID NO: 32343 - DNA, 771 bp, Ralstonia metallidurans
ctcaagatcgcgacgttcaatatcaacggcatccacgcgcggctgccgtcgctgctggcatggctggagcgcgagcagcccgacgtagcctgtctgcaggaactcaaggccgtggacgaatcatttccggtggcagagctccacgcggcaggctacggcgcagtctggcaggggcagaaatcatggaatggtgtggcgatcctcgcaaaagggtcggatccggtcgaagtgcggcgcggtctgccaggcgatgctgctgatacgcagagccgctatatcgaggcggccgttgcaggcgtgctggtggcgtgcctctacctgccgaacggcaatccccagccagggccgaagttcgaatacaagctggcttggttcgaacggttgattcgacacgcaagcacgctctacgccagcggccacccggtggtactggccggcgatttcaacgtggtgccgaccgacgacgacatctacaatccgcgctcgtggctcaaggacgcactgttgcagccggcgtctcgcgaatgctatcgacagttgcttgagcagggatggaccgatgcgctacgcacacgctatcccgacacccggatctatacgttctgggactactttcgtcagcactggcagaaggactcgggtttgcgcatcgatcatctgctgctgagccgaagtctggcgcagcacatgcgtgacgctggcgtcgacaaatgggtgcgtggcgagccgcacgcgagcgatcatgcgccggcgtgggtggaaatagaaatg

SEQ ID NO: 32344 - DNA, 891 bp, Ralstonia metallidurans
atcgcgctgcgtggcgtttgcaaggactatggcgctgtccgggccgtcgacgacgtcgatctggaaatcggttacggcgaactgttcgggttgatcggccacaacggcgcgggcaagagcaccttgttcaggatgatgctgggcctgatcgctgccagcgaaggcgatattcgcgtcgccggggcatccgtgggtggggccgcgttcagggccgcgcgccgccagatcggctatctgccggagaatctggtgctctacgacaacctgagcggactcgagacgctgcgtttcttcggccggatgaaaggggcgccattggcggattgcgagctgctgctcgcgcgcgtagggctggctggcgcggcggagaagccggtgcgggcctattcgaagggcatgcggcagcggctcggcttcgcgcaggcgctgctggggtcgccgcgcgtcgtttttctcgacgagcccaccaatgggctggatccggcggccattcacgacttctacgccatgctccaggcgctgcgcgagcagggcgtcaccatcgtgatcacttcccacattctggcggagttgcagcaacggatcgatcgccttgccatcatgggcaacggacgcatcctggccgtgggcagcgtggccgagttgcgccggcagcttgatctgccggtgacgctggcattgcgcgtcgagcgcggcgcgcgtgccgcgttgtggcagcactttgcgccactgcgcgcgcagggcatcgaactcgagaacgggcgcgccgagtatgagctgatcctgcgttgcaggcggtctctcaagatgcaggtcctgggggcgctgcatcccatgggcgggcgtctgctcgatctgcagattcaggagccgacgctggaagacgtgttc

SEQ ID NO: 32345 - DNA, 1353 bp, Ralstonia metallidurans
ctcatgcacgctcccgacaatcaaggcacgctcaagcgtggcctgaagaatcgtcacatccagctcatcgcgctgggcggcgccatcggcaccggcctgttcctgggcatcgcccagaccatcaagctggccggcccctcggtgctgctgggctacgcgctggccggcgtggtcgccttcttcatcatgcgccagctcggcgaaatggtcgtggacgagcccgtcgccggctcgttcagctacttcgccaacaagtactgcggacacttcgccggcttcatgtccggctggaactactgggtgctctacatcctcgtcagcatggccgagctatcggccgtcggcatctacgtccagtactggtggcccggcattccgacctggatttccgcgctggccttcttcctgatcatcaacgcgatcaaccttgccagcgtgaagtcgttcggcgagatggaattctggttctcgatcatcaaggtggcggccatcgtcggcatgatcggtttcggcggctacctgctggccaccggcaccgcgggccccgacgccagcatcgccaacctgtggcaacacggcggcttcttcccgaacggcttcagcggcctggtgatggccatggctgtgatcatgttctcgtttggcggcctcgaactcgtgggcatcaccgctgcggaagcagacagccccgagaagagcatcccgaaggcgaccaaccaggtcatctaccgcatcctgatcttctacgtcggcgcgctggccgtgctgctgtcgctgtatccgtgggaaaaggtcgtgaccggtggcagcccgttcgtgctgatcttccacgcaatgaacagcaacgtggtagccaccgtgctcaatatcgtggtgctgaccgccgccctgtcggtctacaacagcggcgtctattgcaacagccgcatgctgctgggcctggcgcagcaaggcaacgccccgcgctcgctgatgcgcgtgaaccgccgcggcattccgctgaccgcgctggccgtctcggccatcgccaccggcatctgcgtggtgatcaactacttcatgcccggcgaggccttcgaactgctgatgggcctggtggtctcggccctgatcatcaactgggcgatgatcagcatcatccacctgatgttccgtcgcgccaaggcagccgccggcaagaccacgcgcttccagagcctgggctacccgctgaccaactacgtgacgctggccttcctggcaggcatcctcgtggtgatgttcctgacgcctggcctgcgcatctcggtctacctgattccggtatggcttggcgtacttggcgtaagctatcgcctccggcagaaaaaggcc

SEQ ID NO: 32346 - DNA, 1188 bp, Ralstonia metallidurans
atgttcgaacatatagaagcctttccgggtgacccgatcctctcgctcaacgaggacttccagcaggacccgcgtaccaacaaggtcaatctgagcatcggcatctacttcgacgacgaaggccgcctgccggtgatgaaggccgtggcggaagccgaggccgcgctgctgtcggacatgggtccgcgcccgtacctgccgatgtccggcatggccgcgtatcgtcaggccgtgcaggcgctggtgttcggcgaggattgcgccgcccgcgccgaaggccgcgtcgccacgctgcagacgctgggcggctcgggcgcgctgcgcgtcggcgccgatttcctgaagcgctacttcccgaaggcggagatgtggatcagcgatccgagctgggagaatcaccgcgtggtcttcgagcgtgccggcttcaaggtcaacacttacccgtactacgatccggccaccggcggcctgaaattcgacgcgatgcttgccgcgatcgaagcgatcccgcaaggcgacatcgtgctgctgcacgcgtgctgccacaacccgaccggcgtcgacctgaaccaggaccagtggcgccaggtgatcggcgtgctcaaggcgcgcaagctgctgccgttcgtcgacatggcctaccagggtttcggctcgggcctggacgatgacgccttcgccgtgcgcgaactggcccgccagaatgtgccctgcctggtggccaattcgttctcgaagaacttctcgctgtacggcgagcgttgcggcggcctttcggtggtctgccaaagcgccgacgaagccagccgtgtgctgggccagcttaccggcgccgtgcgcgccaactacagcaacccgccgacccacggcgcgcgcgtggtggcccgtgtgctgaccacgccggcgctgcgcgcgaactgggagcaggaactggccgcgatgtgccagcgcatcacccgtatgcgccaggccatccacgaccacctgcgcgagcatgtgagcggcgaaaagctctcgcgctacatcacccagcgcggcatgttcacgtacaccggtctgtcggccgatcaggtcgaccgcctgaagaacgagcacggcgtgtacgtgctgcgctcgggccgcatgtgcgtggccggtctgaacgagcgcaacgtgggcgtcgtcgccaacgccatcgggcaggtgctg

SEQ ID NO: 32347 - DNA, 1464 bp, Ralstonia metallidurans
atgtccaataccaatacaacaccagccgtccccgttcccggcctgcgccgcgaactgcgcgcgcgccatctgaccatgatcgccatcggcgggtcgattggcaccggactcttcgtcgcctcaggcgccacgatcgcccaggccggccccggcggcgcgctggccgcctacatcctgatcggcgcgatggtctacttcctgatgaccagcctgggcgaactggccgcgtacatgcccgtgtccgggtcctttgccacctatggcgcgctgtacgtcgacgagggcttcggtttcgcgcttggctggaactactggtacaactgggccgtcacgatcgccgtggagctggccgcggcgcagctcgtcatgcagtactggttccccgacacgccaggcgtgctatggagcgccctgttccttggcctcatgttcgcgctcaacgcgatctccgtgcgcggtttcggcgaagcggaatactggtgcgcgctgatcaaggtcctcacggtgatcgccttcatcgtcatcggtaccttgatgatcttcggcatcatgcgcggtgatttctcccacgcaggcggactggccaacctcaccaccggcgatgcgccgttcgtcggcggcctgcccgccatgatcggggtggcgatgatcgcgggcttctcgttccagggcaccgaactgatcggcgtggccgccggggaatccgacgagccggccaagaacatcccgcgcgcggtgcgtcaggtgttctggcgcatcctgctgttctacgtgctggcgatcctgatcatcggcatcctgattccgtacaccgaccccagcctgctcaagaccgacgtggaaaccgtaggcgtaagcccgttcacgctggtgttccgccatgcgggtcttgcgtttgccgcgggcgtgatgaacgccgtgatcctgactgccgtgctctcggccggcaattccggcatgtacgcgtccacgcggatgctctacaacctggccaccgagggccgcgcgccgcgtatcttcgcgcaactcacccgcaacggcgtgcccctggtcgcgctgctggccaccaccgccgtcggcggcctgtgcttcctgacgtcgctgttcgaaagcaagtcggtctacctgtggctgctgaacctgtcgggcatgaccggcttcattgcgtggctgggcatcgcggtgagccactaccggtttcgccggggcttcatggcgcagagcctcgacctgaaccgcctgccctatcgctcaccgttctttccttacgggccgatcttcgcgttcgtgctgtgcatgatcgtcacactcggccagaactaccaggccttcagcgaaggcaagatcgactgggtggccgtgacggccacctatgtgggcattccgatcttcctgctgatctggctcggctaccggctcgtgcgcaagtcgcgcttcgtgccgtatgccgaaatgaaattcccg

SEQ ID NO: 32348 - DNA, 960 bp, Ralstonia metallidurans
cattcccatccacccgcagtgtccgtgcgagatctgcgtgtgtccttcgcaagcggcggcaagacgatccaggccgtcaacggtgtatcgctggaggtagcgccgggcgaagccgtggcgctgatcggcgagtcgggctctggcaagagcgtcacgctacgcgccttgatgcgtttgcacccgccacgccgcacgacgatatccggcgagattcaggtcgacggccagtccgtgctggatctcgacaaacgcgggctggcccgcctgcgcggcggcaccgtcgccatggtgttccaggagccactcctggcgctggaccccgtctacacggttgggcaacagattgtcgaatgcatccgcacacaccgtggggtatcgacttcggaagcgcgtgcgctggcactcaaggcgctggaatccgtgcgcattcccagcccggagcgacgcctggccgcctatccgcatgagatgtcgggcggcatgcgtcagcgcgcgatgatcgcgctggcgctgtccgcgcagcccaggatcctgctggccgacgagcccacgacggcactcgatgccacggtgcagatccaggtattgattctgctgcgcgaactgcagcgcgagctcggcctgtcgatcatctttgtcacccatgatatcggcgccgccgtggaaatcgccgatcgcgtcgccgtgatgtatggcggacgcattgtcgaggaaggccccatccgcacgctgatgcgtgacgcgcgccatccctacacgatcgcgttgctgcaaagccgacagcatggcatgggccgtggcgaacgcctcgcgacgatcggtggcgcgccgcctgacctcgcagcgctgccgcccggctgcacgttcgcaccacgttgcccacaggccagtgcggcctgcctgtcggaggtcccgaaagccgtatcgctcggcaatgagcatcgcgtcagctgtgtgcgg

SEQ ID NO: 32349 - DNA, 945 bp, Ralstonia metallidurans
ccactgctcatcgcgcgccagttggtcaagcactttccgttgaagtccccggtcccgctgcgcaagggcggtgtcgtgcgtgccgtggacggcgtgagcttcgacgtcctcaagggcgaaacacttggcgtcgtcggggaatctggctgcggcaagtccaccacggcacgcctgctgatgcaactcacgccgcaggacagcggcgaactgatcttcgatgcacagggcgtcgactcccggcaattgccgatgaaggcgttccgcagtcaggtgcagatggtattccaggacagctactcgtcgctcaacccacgactgactatcgaggaatcgatcgcgttcacgccacgtgtccacggcgtttccgcacgggaagccacggaacgcgcccgctacctgctggagcgcgtggggctggagccgaagcgattcgccggccgctatccgcacgaactgtcgggcggacagcgccagcgcgtgaacattgcgcgcgcgctggcgccacggccccgccttgtcattcttgacgaagccgtgtccgccctcgacaagtccgtggaagcccaggtactgaacctgctgatggacctcaaggccgaattcaacctgacctacgtattcatcagtcacgacctcaatgtgattcgctacctttgcgaccgcgtcatggtcatgtatctgggcaaggtcgtggagatcggcgcaaccgaatccgtctatgccaacccggcccatccctatacgcgggcgctgctgacatcgatgccttcgatggaccccgaccagcgcacgctggccgcgccgttggccggcgatccgcccaacccgatcaatccgccatcgggctgcagcttccatccgcgctgcgtgcgtgccgagcccatttgcgagcggcgcgagcctgtgctcaccgacgcgctcgccggccatccagtgtcatgcctg

SEQ ID NO: 32350 - DNA, 1230 bp, Ralstonia metallidurans
cgcaagattaccgtgcgcctgatccctttcctggtcttcctgttcatcctggcttggatcgaccgcgtcaacgtcggctttgccaagctgcagatgctgcaggacttgcagttcagcgaggccgtgtacgggctgggcgcgggaattttcttcatcggctactttctgttcgaggtgccgagcaacctgctgctcgagaagatcggcgcccgcaagacgctggcgcgcatcacgatcctctggggcctggcgtcgatggcgatgatcttcgtgaagacgccgatgcagttctatacgctgcgcttcgtgctcggtgtcttcgaggcgggcttcttcccgggcgtggtgctgtacctgacgtactggttcccggccgcgcgtcgcgcacgcatcaatggcctgttcatgacctcgttcgcaattgccggcgtggtgggcggcccgctggccggcttcatcatgagcgcgatggacggtgtggatggcctggccaactggcaatggctgttcgtgatcgaagggatcccttcggtgctggcgggcatcgcggtgctgatgtatctgccggagaaaccggtcaacgcgaagtggctgacgcagcaggagcagaccatcgtcacgcgcgacgtggaagctgaggcgcgtgaccccaacaagcactcgtccctcaaggacgccttcgccaatgcacgcgtgtggatctgcgcggcgatttacttctgcgtcgtcagcggcaacgccaccatcgcattctggtcgccatcgatcatcaaggaactcggcgtacagggcaacctgcaaatcggcctggtctccgcaatcccgttcgtggccggcaccatcgccatggtcctcaacggtatccactcggaccgcaccggcgagcgccgcatgcactgcgcgatggcaacactggtggcagccgtgggcctgacgctgaccggcttcctgctccacagcgccgtgctggccctgatcgcgctgacgatcgcctccatcggcatcctggccgccttcccggtgttctggtcgctgccgtcggcattccttgccggcaccgcagccgcaggcggcatcgcgctgatcaactcgattggcaatctggccggcttcgtggcgccgtacatgattggttggttcaagaccagcaccggccaactggccggcggcctgtactttgtggccgcactggaagcctgcgcgacggtactggtgatcgctttcatccgc

SEQ ID NO: 32351 - DNA, 684 bp, Ralstonia metallidurans
cgaacagctcttgtaactggcgcaacgaaggggattggactggccttgagcaagcatttgcagcaacttggctggagcgttatcggcgttgcccgccatgcaattgagggctttcccggtcagcttcttacagctgatttggcggacatccagcaaaccgacgcagtactggcccaagtcgtggcggcatcaaggattgatgcggtgatcaataacgctggcatcgcccttccgcaaaaactggaatctctcgacctgccatctctccaaacggtattcgacttgaatgtgcgcgctgcagttcaagttacacaggcttgccttccctcattgaaacagtcgccagcaggacgcatcgtgaacgtttgcagtcgcgcgattcacggcgcacgcgatagaacgtcatatgctgccgcaaagagcgcgctgattggggtcacccgtacttgggccctcgaactcgcaccgctcggcattaccgccaacgccgttgctccgggcccggttgaaacggagctcttccgtttgacgcaccccgtcggtagcgacgaggagaaaaggattctcgctacgattcccatgcagcgactgggcaagccggaggaagtagcgtccttgatctcgtacctcatctcggacggggcctccttcgttactggccaggtgatcggcatagacggtggc

SEQ ID NO: 32352 - DNA, 1497 bp, Ralstonia metallidurans
tccaccatccaaacgctcggcatcgtcggcactggcgccatgggccgcggtatcgcccagatcgccgcgcaggctggcctgaccgtcaacctgttcgacacgaatgcccaggccgtggcggcagcacgccagtatctgcaggataccttcaccaagctggccgagaaaggcaagatgagcgccgccgacggcgaggccgcgctggcccgcgtgaaggcctgcgccgcgctggaagacctgaccgcgtgcgacatggtgctggaagccatcgtcgagaggctcgatgtcaagcgtgacctggtggccaagctcgaagccgtcgtgcgcgaagatgccgtgatcgcgtcgaacacttcgtcgctgtcgatcacggccatcgccgtgggcgcgaagaagcccggtcgcgtggtcggctatcacttcttcaatccggtgccgctgatgaaggtggtggaagtcgtggacggcatctcgggcgacccggccgtgggcgaccgcctgatggaactgtcgcgccgcatgggccatacgccggtgcgctgcaaggacatgcccggcttcatcgtcaatcacgccggccgcggcatgaacatcgaagggctcaaggttgcgcaggaaggcgtggccgagttcgtcgacatcgacaacatcatgcgcgagcaggctggcttccgcatgggcccgttcgagctgatggacctgaccggtcttgacgtgtcgcacccggtgatggagtcgatctacaaccagttctaccaggagccccgttaccgtccgtcgccgatcacgtcgctgcgttcggtcggtggcctgctcggccgcaagaccggcgcgggcttctacgcctaccccaacggccagaaacaggtacccgccgccgcgccggtgccggatgcgcgccctgccagcgtgtgggtgagccgcgccaacgcgcgtggccatgcgatgaccgtcaagctgctgaccgccctgggtgtcacggtcgaggctggcaaccagccgccggctgacgcgctgatcgtggtgacgccgctgggtctggacgcgacctccgctgcactcgaggaaggccttgacgccacgcgcgtggtggccatcgacaccctgatgccgttcgaagccaccaagcgccgcacgctgatgaccacgccggccaccagcgccgccgcacgcgacgccgcgcacggattgttcgccagcgacggcgtgccggtgacagtgattcgcgattcggccggattcgtcgcgcagcgcgtgatcagctgcatcgtcaacatcgccagcgacatcgcgcagcaacgcatcgccactccgaccgacatcgacctggccgtgcacctgggcctgggctatccgaaaggtccgctggcactcggcgatacgatcggcgccgacttgatccttgaagtcctgcgcaacctgaaccgcctgaccggcgacatgcgctaccgtccgagcccgtggctgtggcgccgcgccggacttggcctgtcgttg

SEQ ID NO: 32353 - DNA, 1056 bp, Ralstonia metallidurans
atgctgaagaacaccgacgacctgcgtattcgagaactcaaggaactgctgccgcccgcgcacctgatccgcgagtttgcttgctcggaggctgcgtccgacgtgatctatggcgcccgccaggccatgcatcgcattctgcacggcatggacgaccgcctgatcgtcatcatcggcccgtgctcgattcacgacacgcgcgcggccctggaatacgccaagctgctcaaggtgcagcgcgaccgcttcgcgggcgagctcgagatcgtgatgcgcgtctacttcgagaagccgcgcacgacggtgggctggaagggcctgatcaacgatccgcacatggatggcagcttcaagatcaacgacggcctgcgcaccgcccgcgaactgctgctgaatatcagcgaaatgggcgtgccgacggggacggaatatctggacatgatcagcccccagtacatcgccgatctggtgagctggggcgcgatcggcgcgcgcaccaccgagtcgcaggtgcatcgcgaactcgcttccggactgtcgtgcccggtcggcttcaagaacggcaccgacggcaacgtgaagatcgccgtcgacgcgatcaaggccgcctcgcagccccaccatttcctgtcggtaaccaagggcggccactcggccatcgtgtcgacctcgggtaacgaggactgccacatcatcctgcgcggcggcaagacaccgaactacgacgcggccagcgtgcaggaagcctgcgacgcgatctcgaagtccggcctggccgcacgcctgatgatcgacgcctcgcacgccaacagcagcaagaagcacgagaaccagatcccggtctgcgaggacattggcaagcagatcgccggcggcgagcagcgcatcgtcggcgtcatggtggaatcgcacctggtagccggccgacaggaccatgtgcagggcactccggtggagaacctgacctacggccagtcggtgaccgacgcctgcatcgcctgggatgactccgtggccgtactggagacgctggccaacgccgtgaagcagcgccgt

SEQ ID NO: 32354 - DNA, 1422 bp, Ralstonia metallidurans
taccaggatctcgccctctacatcgatggagaattcatcaagggaggcgaccgccgcgagcaggacgtcatcaacccggcgacgcaggaactgctcggcaagctgccacacgccaccactgccgacctggatcgtgcgctgtctgccgcgcagcgcgccttcgaaacctggaagaaaacgtcgccgctggaacgctcgcagatcctgcgccgcgtagcagaactgacccgtacccgcgccaaggaaattggccgcgacatcacgctggaccagggcaagccgctggccgaagccgtgggcgaagtgatgatctgcgccgaacatgccgaatggcacgccgaggaatgtcgtcgtatctacggccgcgtgattccgccgcgcaacccggcggtgcgccagatcgtggtgcgcgagccgatcggcgtctgcgccgcgttcacgccttggaacttcccgttcaaccaggccatccgcaagatcgtggctgcgctgggcgccggctgcacgctgatcctgaaaggtccggaagactccccgagcgccgtggtggcgctggcccgcctgttccacgatgcaggcctgcccccgggcgtgctgaatatcgtatggggcgtgccgagcgaagtttcgacctatctgatcgaatcaccgatcgtgcgcaagatctcgttcaccggctcggtaccggtgggcaagcagcttgccgcgatggccggcgcgcacatgaagcgcgtgacgatggagttgggcggccactcgcccgtgctggtgtttggcgacgcagacatcgaaccggccgcggaaatgctggcccgcttcaagctgcgcaatgccggccaggtttgcgtatcgcccacgcgtttctatgttcaggaaaaggcctacgacaaattcctggcgcgcttcaccgaggtcatcggctcgatcaaggtcggcaacggcctggacgacggcacccagatgggcccgctcgcacacgaacgccgcatcgcgtcgatggagcagttcctggacgatgccagccatcgcggcggcaagatcgtcgccggcggctcgcgcatcggcgacaagggcttcttcttcgcgccgaccgtcgtcacggacctgcccgacgatgccaagctgatggtcgatgaaccgttcggcccggtagccccggtcacgcgcttcaaggatgcggaagaagtgctgcgccgcgccaacagcctgccgttcggcctggcctcgtatgtcttcaccaactctctgaagacggccaaccttgtatcgaacggacttgaagccggcatggtcaacatcaaccacttcggcatggcgctggccgagaccccgtttggcggcatcaaggattcgggaatcggcagcgaaggtggccaggagaccttcgacggttacctggtgaccaagtttattacccaggtt

SEQ ID NO: 32355 - DNA, 828 bp, Ralstonia metallidurans
cggccaagccctgaccgtttcaagctctatccgtacccgatgaacgataccgccacgctcgccgatcaggcttcttccgccccatccacggatagcagcacgctggtcgtgcgccatctgaagaagcgctatggctcgcgcaccgtggtcaaggacgtctcgctcgacgtcaagagcggcgaggtcgtcggcctgctcggcccgaacggcgcgggcaagaccacgtcgttctacatgatcgtcggactggtcgcgctggacgaaggcgatatcgtgctcgatggccagcacatcagcggcctggccatccacgagcgcgcgcgcatgggactgtcctacctcccgcaggaagcctctgtcttccgcaagctcaacgtggaggagaacatccgcgcggtgctggaactgcaggtggtcaacggcaagccgctgcccaagcaggaaatcgatcgccggctcgactcgctgctcgatgacctgcagatcgcccacctgcgcaacaacccggcgctgtcgctgtcgggcggcgagcgccgccgcgtggaaatcgcgcgcgcgctggcgtcggcgccgcgcttcatcctgctcgacgaaccattcgcgggcgtggacccgatcgccgtgggcgagatccagcgcatcgtcagcttcctgaaggcacgcaacatcggcgtgctgattaccgaccacaacgtgcgcgaaacgctgggcatctgcgaccacgcatacatcatcagcgaaggcaccgtgctggccgagggacagcccgaggaaatcatcgccaacgagtctgtgcgacgcgtctatctgggcgagaacttccgcatg

SEQ ID NO: 32356 - DNA, 510 bp, Ralstonia metallidurans
ctgcgtgaccgcatccgcaccgtgccggactggccgcagccgggcgtgatgttccgcgacatcacgccgctgctgcagaaccccaagacgctgcgcgtgctgatcgacgtcttcgtgcaccgctacatggaccagaacctggacctcgtggctggcatcgacgcgcgcggcttcatcctcgggtcgatcatcgcgtacgagctgaacctgggcttcgtgccgatccgcaagaagggcaagttgccgttccagacggtggccgaggaatacgagctcgagtatggcagcgccaccgtggagatccatgccgatgcctgcaagccgggagaccgcgtgctgctgatcgacgacctgatcgccacgggtggcacgatgatggcgggacgcaagctgctggagcgtcttggcgcaacggtggtggaaggcggggcgatcgtcgacctgcctgagctcggcggctccaagcttttgcaagccagcggcctgtcgctgttcacggtctgcaatttc

SEQ ID NO: 32357 - DNA, 1192 bp, Ralstonia metallidurans
ccacgagcacgccatggccgcctaccccttcgttcccgcgctacgcgagccgcaaggctcgccgatccgcgagctgttcaagtatctctccgacccggagatgatctcgttcgccggcggctatccgtccgccgcgttgttcgacgtggaaggcatcggcgcggcatccgcacaggcattgcgcgaacgtcctgccgagtgcctgcagtacggcgccacggagggcacgcctgcgctgcgcaacgcgctggcggccctgatggcggagcgtggcgcggccgtcgccctggacgaactgctgatcaccagcggctcgcaacagggcttcgattttctcgtgcgcgcgctggtggagcctggcagcctcgtgctggtggaggaacccacctactcggccacgctgcaggcactgcggctggccggcgctgacgtgcgcggcgtgccgtccgaccatgacggcatgaacgtcgacgcactggaggcgatgctcgcagacgcgccggcacgtcctcgcatgatctacacggtgccgaccttcgccaatccaaccggcgccacgctctcacccgcgcgccggcttcaattgctggaactggtggcacggcacgagatcgtgctggtcgaggacgatccttacggcgcgctaagcttcgacggtccgccgccgccatcgctgctcgcgctgtgcgatcaggtgtccggcgcgcgcccgtggctcgtgcatctcgcaagcctgtcgaagacgctggcaccaggactgcggctgggctggatggtggccgcgccggagatcgtgcgtcgcgcggtgatcgccaagcaggtgtcggacctgtgcacgccgccatggctgcaactgaccgccgcgcattaccttcaggccggaaacctgcccgggcagatcgcgcgggaagtggcggtctatcgcgacaaacgcgatcggctgacgacggcgttgcaccaggcgttcggcacgcgcatccggtttgcggatcccgccgggggcatgttcctgtgggtatccgtggacggcatcgacgatgcggcggcgctgctgccccatgccatcgcagagaaagtgctgttcgtgccgggcacaggcttctacgccgagcgtcgcgcgcgccccgcgttccggctgtcgttcgtgggcgccgacccggcgcagatcgaagaaggcgtggcgcggcttgcc

SEQ ID NO: 32358 - DNA, 1131 bp, Ralstonia metallidurans
atcgagatgctgcgcgaatcggtgcgcaactgggcgcaggccgaactggcgccgcgcgccgccgagatcgaccggaccgaccagtttccgatggatgcatggcggaagatgggcgacctcggcgtgctgggcatcacggtggccgaggagtacggcggcgccaacatggggtacctggcccacatgatcgcgatggaggagatcagccgcgcgtcggcgtcggtcggcctgtcgtacggcgcccattcgaacctgtgcgtgaaccagatccaccgcaacggcacggcggcccagaaggcgaagtacctgccgaagctggtttccggcgaatggatcggcgcgctggccatgagcgagccgaacgccggatcggacgtggtcagcatgaagctgcgcgccgatttcaagggtgaccgctacgtgctcaacggcaccaagatgtggatcacgaacgggccggactgcgacgtgctggtggtctacgccaagaccgagccggacctgggcgcgcgcggcatgaccgccttcatcgtcgagaagggcatgaagggcttctcggtagcccagaagctggacaagctcggcatgcgcggttcgcacaccggcgaactggtgttccaggacgtggaagtgccggtcgagaacattctcggggccgagaacgggggcgccaaggtgctgatgagcggcctggactacgagcgcgccgtgctgtcgggcggcccggtcggcatcatgcaggcctgcatggacgtgatcacgccgtacatccacgatcgcaagcagtttggccagagcatcggcgagttccagctgatccagggcaaggtggccgacatgtacaccacgctgcaggccgcgcgcagctacctgtacaccgtgggcaagaacctggactcgctgggcacggaccacgtgcgccaggtccgcaaggactgcgccgccgtgattctgtacaccgcggagaaggccacgtggatggcgggcgagtcggtgcagatcctgggcggtaacggctacatcaacgaatacccggtcggccgcctgtggcgtgatgccaagctgtacgagatcggcgcgggcacttcggagatccgccgcatgctgattggccgcgaattgttctccgaa

SEQ ID NO: 32359 - DNA, 1164 bp, Ralstonia metallidurans
gtcgttatcgtttccgcggtgcgtaccccgatgggtgcgttccagagtgaactgagcagtctgatggcgccgcagcttggcgccgccgcgatccgcgcggcggttgagcgcgcgggcatcaagcctgagcaggtgcaggaggtggtgttcggctgtgtgctgccagccggacagggtcaggcgcccgcccgacaggccgcgcttggcgcgggcctgccgctcgacgtggcgtgtaccaccgtcaacaagatgtgcggctccggcatgcgtgcggcgatgagcgtctacgacggcctgctggccggatcgttcgatatcgccgtggccggcggcatggaaagcatgaccaacgcgccatacctggtgccgaaggcgcgtggtggctatcgcatcggccacggcatgatctacgaccacatgatgctggacggcctggaggacgcgtacgacaagggccgggccatgggcactttcggcgaggactgcgccgccaagtaccacttcacgcgcgaacagcaggatgcgttcgcgatggagtcggtgcgccgcgcccagcgtgccaccgagcagggcgacttccgctgggagatcgtgccggtgacggtgtcgggcaagggtggcgataccgtcatcgacaccgatgaggggccgcgccgcatcaaggtcgacaagatcccgtcgctgaagccggcgtttgccaaggacggcacgattaccgctgcgtcgtcgtcgtcgatcaatgacggcgcctcggcgctggtgatgatgcgcgaatccaccgcgaaatcgctcgggttgcagccaatcgccagaatgctcggccatacctcccacgcacaggcgccgggctggttcaccaccgcgccggtggaggccatcgccaagctgtatcgcaagctcgactggaacactggcagcgtcgatctgttcgaaatcaacgaggcctttgccgtggtgccgatggccgcgatgcacgatctcgacattccgcgcgacaaggtcaacatccatggcggcgcatgcgcgctgggccatccgatcggcgcgtccggcgcacgtatcatgaccacgctgatcggcgcattgcgcaagaccggcggcaagcgcggcgtggccagcctctgcatcggcggcggcgaagccactgcggtcggcatcgaactc

SEQ ID NO: 32360 - DNA, 1119 bp, Ralstonia metallidurans
ctgacccctgaacaggaaatgatccgtgacgccgtgcggcagttcgcgcaggacgtcatcgcgccgcaggccgcccgatgggatcgcgacaagacgttcccgaaggacgtgcacaaggaactggcgcgtctgggtgcctacggcgtggccgtgcccgaagcccttggcggcgccgggctcgactatctgtcgctcgcgctgatcctggaagagatcgcggccggagacggcggcacctccactgtcatcagcgtcaacaactgcccggtgtgcagcatgctgatggccttcgccagcgacgcgcagaagcagcagtggctggtgccgctggcgcaaggtgacatgctcggcgcattctgcctgaccgagccgcacgtcggctccgacgcatcggcgttgcgcaccacggccacgcgcgatggcgaccactacgtgctcaacggcgtgaagcagttcatcaccagtggcaaacatgccgacgtggcgatcgtgatggccgtgaccgacaaggccgcgggcaaacgcggcatcagcgcattcctggtgccgacgtcaacgcccggctatatcgtcgcgcgtctggaggaaaagctgggccagcactcttccgacaccgcgcagatcgtgttcgagaactgccggattccggccgcgaacatgcttggcgaggagggcgccggctacaagatggcgctctccggtctcgaaggtggccgcatcggtatcgcttcccaaagcatcggcatggcgcgcgcggcattcgaggcggcgctggcctacgccaaggagcgcgagagcttcgggcagccgctgttccagcaccaggccgtgcagttccggcttgccgatatggcgacgcagatcgacgtggcgcgccagatggtgtggcatgccgcatcgctcaaggatgccggccggccctgcctgaaggaagcggccatggccaagcttttcgccagcgagatggccgagcgggtatgctcggatgccatccaggtgttcggtggctacggctacgtgaccgatttccccgtcgagcgcatctatcgcgatgtgcgcgtgtgccagatctatgaagggaccagcgatatccagaagatcctgatcgcccgcgcgctt

SEQ ID NO: 32361 - DNA, 636 bp, Ralstonia metallidurans
atggcactgcgtcttggcgatatcgcaccggattttgaacaggaatcgagcgaaggccgcatccgcttccatgattggctcggcgatggctggggtgtcctgttttcgcatccggcggactacaccccggtgtgcacgaccgaactgggcctgaccgcccggctgaaagaagagttcgcaaagcgcaacgtcaaggcgatcgccctgtcggtggatagtgtggaatcgcatcacggctggatccaggacatcaacgacacccagtcgaccacggtcaacttcccgatcctggccgacggtgaccgcaaggtgtccgagctatacgacatgattcacccgaacgccaacgaaaccctgacggtgcgttcgctgttcgtgatcgacccgaagaagaaggtccgcctgatcattacataccctgccagcaccggccgcaacttcaacgagatcctgcgcgtcatcgattcgctgcagctcaccgacaatcacagcgtggccacgccgggcaactggcaggacggcgacgacgtggtgatcgtgccctcgctgaaggacgaagaggtcatccgccagaaattcccgaagggttacaaggccgtacgtccgtacctgcgtctgacgccgcagcccaacaag

SEQ ID NO: 32362 - DNA, 1251 bp, Ralstonia metallidurans
cgtttttcccggattgtgtgaaggctacaggccttcctcgccacaccaaagaaggagacctccatggctgccaacgccgaattcaactgggctgacccgctgttgctcgaccagcaactgaccgccgacgaacgcatggtgcgtgacgccgccgcggcttactgccaggacaagctgatgccgcgcgtgctgcagtccttccgtaacgagaagaccgatgtggagatcttccgcgagatgggcgaactgggcctgctcggcccgaccatccccgagcagtacggcggccccggcctgaactacgtcagctacggcctgatcgcgcgtgaagtggagcgcgtggattcgggctaccgctcgatgatgagcgtgcagtcgtcgctggtcatggtcccgatctacgagttcggcaccgaagcccagaagcagaagtacctgcccaagctggccaccggcgagtggattggctgcttcggcctgaccgaaccgaaccatggctcggacccgggctcgatggtcacgcgcgccaagaaggtggctggcggctacgagctgaccggcgccaagatgtggatcaccaactcgccgatcgccgacgtgttcgtggtgtgggccaagctgatgggcgacgatggcaaggaagccatccgcggtttcatcctggaaaagggctggaagggtctgtcggccccggccatccacggcaaggttggcctgcgcacgtcgatcaccggtgaaatcgtgctggaccaggtattcgtgccggaagagaacatcatgccgggcgtcagcggcctgaagggtccgttcacctgcctgaactcggcccgatatggcattgcctggggtgcgctcggtgctgccgaattctgctggcataccgcacgccagtacacgctggaccgcaagcagttcggccgcccgctggccgccacccagctggtgcagaagaagctggccgacatgcagaccgagatcacgctgggcctgcaaggctgcctgcgcctgggccgcatgaaggacgaaggcacggccgcggtggaaatcacctcgatcatgaagcgcaactcgtgcggcaagtcgctcgacatcgcccgcgtggcgcgtgacatgctcggcggcaacggtatttccgacgagttcggcgtgatccgccacgtggtcaacctcgaggtggtcaacacctacgaaggcacgcacgacatccacgcgctgatcctgggtcgcgcgcaaactggcctccaggcattc

SEQ ID NO: 32363 - DNA, 897 bp, Ralstonia metallidurans
atgagcgaattcaagggatgcccgatggggcacggagccgccccgcaaaacggtgatggcggtgatagcggtgataccggcaatggctggcacggcgcgcaaatggatttcgcgcgcgacatgagctatggggactacctgggcctggaccagatcctgagcgcccagcatccgctgtctccggatcacaacgagatgctgttcatcgtccagcaccagaccaccgaactctggatgaagctgatgctgcacgagctgcgcgcggcgcgtgatggcgtcaagtcggatcagcttcagccggcattcaaaatgctggcgcgcgtctcgcgcatcatggatcagctcgtgcaggcgtggaacgtgctggcgacgatgacgccgcccgagtactcggcgatgcgcccatacctgggggcatcgtccggcttccagtcataccagtatcgcgagatcgagttcatcctcggcaacaagaacgcagccatgctgcgtccgcacgcgcatcggcccgaacatctcgaactggtggagaccgcgctgcatacgccgtcgatgtacgacgaggccatccggctgatggcccgccgcggcttccagatcgaccccgaggtggtggaacgcgactggactcagccgacgcagtacaacgcatcggtggaagcggcctggctcgaggtctaccgcaacccgtcggcccactgggagctctacgaactcggcgagaagttcgtcgatctggaagacgcgttccggcaatggcgcttccgccacgtgaccacagtcgagcgcgtaatcggattcaagcgcggcaccggcggcaccgaaggcgtcagctatctgcgcaggatgctggacgtggtgctgtttccggaactgtggaaactgcggacagacctg

SEQ ID NO: 32364 - DNA, 522 bp, Ralstonia metallidurans
gaaatcgccacgctcggtggcggctgcttctggtgtctggaggcggtctaccaacaggtcgccggtgtgcgcgcggtggaatcgggatacacgggtgggcacgtcagccagcccacctatcacgaggtttgcgcgggagataccgggcacgccgaagtggtgcgggtgacattcgacccgtccgcgatcaactatcgcgagatccttgaaatcttcttttcgatccacgatccgacgcaactgaaccggcagggcaacgatgtcggcacacagtaccgttccagcatcttcacgcactcggaggcgcagcgcgcggtcgccgagtatgtgattggcaagctggctgccgagcatgtctacgatgcgccgatcgtgacacaggtggagccggagcaaccctactggcccgccgaggccagccaccagaactactaccaggagcacccggcgcaagggtattgcgcattcgtgatttcgccgaagctgacgaaattcaggcgcgatttctcgcaccggatgcgg

SEQ ID NO: 32365 - DNA, 1524 bp, Ralstonia metallidurans
accgcgctggcaggctggctgcagcagaaggcaggggtgaagaagggcgatcgtgtgttgctctacatgcagaactgcccgcagttcatcatcagctactacgcgatcctgcgtgccgatgccgtggtggtaccggtcaatccgatgaaccggtccgaggagttcaagcattacgtgaccgacggccaggcgcgcgtggccatctgtacggcggatctggccgctggcgtgatgcaggccgatgccgaactgtcagccgatgagcgcctccagcatctgctcgtgacccaatacaccgatgccctgccgccgacccacgtgcatccggaggacgcaccgccggcttggctcaccgccgagcatccgctgccggacaacgccacgccgtgggccaaggcgcttgccgccggcctgaagccaggcccgcataccgccggaccggatgacatggccgtgatgccgtacacctctggcaccaccggcttcccgaaaggttgtattcatacccatcgctcggtgatgcacaacatcgtcggcggctcgacgtggtcgggcagcggcgcggaatcggtgatcctgtcggtgctgccgctgttccacgtgacggggatgcagtacggcatgaatggtccgatctacagcggcgcgacggtggtgatgctgccgcgttgggatcgcgaagtggctggccacctgatctcccgctaccaggtcacgcactggaccaatatcccgaccatggtgatcgacttcctgggcagcccgaacctggcgtcgttcgacatgagcagcctgcgctatatcggcggaggcggcgcggcgatgccgcaggccgtggcggagcgcctgaagactcagttcggcctgaactatctggaaggttacggcctgtcggaaacgatggcgccgacgcacagcaacccggccgaccggccgaagctgcaatgcctgggcgtgccgacgttcaacaccgacgcgcgcgtggtcgatccggtcacgctgaaggaactggcgccgaacgaggtgggcgagatcatcgtgcgcggtccgcaggtgttcaagggttactggggcaagcctgacgccacgcgcgatgcgttcatcgagttcgaaggccagacgtacttccgcaccggcgacctcggccgcatggacgaggaaggctacttcttcatcaccgatcgtctgaagcgcatgatcaatgcctctggcttcaaggtgtggccggcggaagtggaaaacctgctgtacaagcatccggccgtgcaggaagcctgcatcattggcacgcgcgatgcctatcgcggcgaaacggtgaaggcggtggtggtgctgcgcgcggatgccaagggcaagacccagccggaagacatcatcgaatgggccaaggagcacatggccgcgtacaagtatccgcgcgtggtcgagttcgtcgatgccctgccgaagtccggcaccggcaaggtgatgtggcgccagctgcaggaaacggaaaacgtgcgtcaggctggctgagccggtgag

SEQ ID NO: 32366 - DNA, 892 bp, Ralstonia metallidurans
atggaaaaccgcgtcaccaaggccgtctttcccgttgcagggctaggcacccggtttctgcccgccaccaaggcgagccccaaggaaatgctgcccgtggtcgacaagccactgatccagtacgccgtggaagaagccatggccgcaggcattaccgagatgatcttcgtcaccgggcgctccaagcgcgccatcgaggatcacttcgacaaggcttacgaactggaagcggaactcgaggccaagaacaaacaggcactgctcgatgtggtgcgttcgatcaagccagcgaacgtcgagtgctattacgtgcgccagcccgaggcactgggtctgggccacgcggtgctttgcgccgccaagctcgtgggcgacacgccgtttgccgtgatgctcgccgacgacttgctcgacggtggcaaggacctgcccgtgatgaagcagatggtggatatctacaaccactacaactgctcggtactcggcgtggaagagatcgcgcccgagcaaagccgctcgtatggcgtgatcgacggccgcgagtgggacgaccgcgtgatcaagatgtccgccatcgtcgagaagccggcacccgagaaggcaccgtcgaacctgggcgtggtgggtcgctacattctcaccccgcgcatcttcgaccatatccgcgagcttaagccgggcgccggcggcgagatccagctcaccgacgccatccagtcgatgctcgaccaggaacaggtgctggcctatcgctacaaaggcgtgcggtacgactgcggcagcaagctcggctatctgaaggcgaccgtcgaattcgccctcaggcaccccgaggtgcgcgacgagttcagcgcctatctgtcgcagcgctgcaccagcccgtcaagcgtac

SEQ ID NO: 32367 - DNA, 2694 bp, Ralstonia metallidurans
gttacgctggaaatcgacggggtatccgtcaccgtgccagccggcacctccgtgatgcgcgccgccgccgaggcgggcgtgggcgtgccgaagctctgcgccaccgattcgctgaaggcattcggatcgtgccgcctgtgcctggtggagatcgaaggccggcgcggctacccggcttcttgcaccacgcccgttgaagcgggtatgaaggtgcgcacgcaaagcgaaaagctcggcgatctgcgccgtggcgtgatggagctctatatctccgatcacccgctcgattgcctgacctgcccgaccaacggcaactgcgagttgcaggacatggccggcgtggtgggcctgcgcgaagtgcgatacaacgatggcgccggcactgccccgccgatcgccacgcacacgcatctggccaaggatgaatcgaatccgtacttcacgtatgacccatccaagtgcatcgtctgcaatcgctgcgtgcgtgcctgcgaggagacgcaaggcacgttcgcgctgacgatcagcggccggggctttgattcgcgtgtggcggccggcaccagccagccgttcatggaatcggactgcgtgtcgtgtggcgcctgcgtccaggcgtgtcccaccgccacgctgacggaaacgtcggtgatccagctgggccaggcgtcccacagcaagatcaccacgtgcgcgtactgcggcgtgggatgctcgttcaaggccgagatgaagggcaacgaggtcgtgcggatggtgccgtacaaggacggcgccgccaacgagggtcatgcctgcgtgaagggccgcttcgcgtggggctatgccacgcacaaggaccgcatcctgaagccgatgattcgcgccaggatcaccgacccgtggagggaagtgtcgtgggaggaggcgatcggatacgcggcgtcgcagttccgacgcatccaggccgagcacggcaaggattcgattggcggtatcgtttcgtcgcgctgcaccaacgaggaaggctatctggtgcagaagctcgtgcgagccgcattcggcaacaacaacgtcgacacctgcgcgcgtgtctgccattcccccaccggctacggcctgaagacgaccatcggtgaatccgccggcacgcagacgttccgctcggtggccaaggccgacgtgatcatggtcatcggcgccaatccgaccgacgggcacccggtgttcgcctcgcgcatgaagcgacgcctgcgcgccggggcccggctgatcgtggtcgatccgcgccgcatcgatctggtggaatcgccgcatatccgcgccgactatcacctgcaattgcgtccgggcaccaatgtggcggtggtgacgtcgatcgcgcacgtgatcgtcacggaggggctgctggccgagcaattcatcgccgagcgttgcgaggaccgcgcgttccagcaatggcgagatttcgtcgcgctgcccgagaactcgcccgaggcactcgaagcggagaccggtgtgccggccgaacaactgcgtggcgcagcccgcctctacgccaccggcggcaacgctgcgatctactacggtctgggcgtgaccgaacatgcgcagggttcgaccacggtaatggccatcgccaatctggccatggccaccggcaatatcggtcgcgaaggcgtgggcgtcaatccgctgcgcggccagaacaacgtgcaggggtcgtgcgatatcggctcgttcccgcatgagcttccgggctaccgtcatgtgtcggactcgacggtgcgtggcagcttcgaggccgcgtggaatgtcgagatcaaccccgagcccggtctgcgtattccgaacatgttcgaagcggcgattaccggatcgttccggggtctgtactgtcagggcgaggacattgtccagtccgacccaaatacgcagcacgtggccgaagcgctgtcgtcgatggagtgcatcgtcgtgcaggatatcttcctgaacgaaaccgccaagtacgcacacgtgttcctgccgggttcgtcgttcctggagaaggacggcacgttcaccaacgcggagcgccggatctcgcgcgtgcgcaaggtgatgccgccgaaggccggatactcggactgggaggcaacgatcctgctgtcgaacgcgctcggttatccgatgcactacaaccatccgtccgagatcatggacgagattgcgcgcctcacacccacgtttgcgggtgtcagctacaagaagcttgaggaacttggcagcatccagtggccgtgtaatgccgaggccccggagggcacgccgaccatgcacgtggacactttcgtgcgcggcaagggcaagttcatcatcacgaagtacgtgccgaccagcgaaaaggtcaaccgaaagtacccgctgatcctgaccacggggcgcatcctgtcccaatacaacgttggcgcgcagacacggcgcacgcacaacgtgcattggcacgatgaggaccgcctcgagatccatccgcacgatgcggaggaacgcgggatcaaggacggcgactgggtcgggattcagagccgtgccggtgaaacggtgctgcgagcgatcgtcagcgagcggatgcagcccggcgtggtctatacgacgttccacttccccgagtccggcgccaacgtgatcacgaccgacaactcggactgggccactaattgcccggagtacaag

SEQ ID NO: 32368 - DNA, 1047 bp, Ralstonia metallidurans
atgaaaattaccctagacagcgcgcggcagttcgcgcgcagcatcctggcggcgcagggtgtgcccgccgatatcgccgatgacgtggccgagcacctggtggaagccgatcgcagcggctacgtcagccacggcctgtcgatcctgccgaactaccgccgtgccatcgagagtggcaacgtgaatcccaccggacgcgctgcgtgcgtgctcgaccgcgacatgctgatggtgttcgacggtaacggcggctttggccagcacgtcggcaagaccgtgatgacgcgtgccatcgaacgcgtgcgtcagcacggccattgcatcgtgacactgcgcaaatcgcaccaccttggccgcatgggccactatggcgagatggtggccagcgcaggcttcgtgctgttgagcttcaccaacgtgatcaaccggccgcccgtggtcgcgcccttcggcggccgcgtgccacggctcaccaccaatccgctttgctttgccgggccgatgccgaacgggcgaccgccgctcgtcgtcgatatcgccaccagcgccatcgccatcaacaaggcacgcgtgctggcggagaaaggcgagcccgcgccggagaacagcatcatcgacgccgaaggcaacccgactaccgatgcgggggtcatgttcgacgatcaaccgggatcgctgctgccgtttggcgcccacaagggctacggtctcggcgtggtggcggaactgctggccggggtgttgtccggcggtggcacgatccagccggacaacccgcgcggcggcgtggccacgaacaacctgttcgcggtgctgctgaatcccgaactcgatctcggcatcaactgggaacgggaggaggtagaggccttcgtgcgctacctccacgacacgccgcctgcgccaggcttcgaccaggtgcagtatccgggcgagtacgaagccatgcatcgcgccgcggcggcaacgcatctggagatcaatccgaagatctggagccatctggcagcgttggcgggggatctcggggtggatatgccggcggcg

SEQ ID NO: 32369 - DNA, 1515 bp, Ralstonia metallidurans
cgtctctgcaagatactgtttgtcatcctgtactacgggctcgatgaactcgtgctgtccggcttcaagaaccggcgcatcaagttcctcgtccgagtcatcaccatcggccgcaagctcgatcagccgcgcggcgaacgcctgcgtatggcgctgactgcgctgggcccgatcttcgtcaagttcggccaggtgctgtccacgcgccgtgacctgatgccgcccgatatcgccgacgaactggccaagctgcaggaccaggtgccgccgttcgagtcagcggtggcggtgaagatcatcgagaaatcgctgggccgccggctgacggaactgttcgagacattcgagcacgagcccgtggccagcgcgtcgatcgcccaggttcacttcgccacgctgcgcggcggtccgagccatggccgcgaggtggccgtgaaggtgctgcgtccgggcatgttgccggtaatcgatagcgacctggcgctgatgcgcgacatggccacgtggctcgagcgcgtctgggtggacggtcgccggctcaagccccgcgaggtggtggcggagttcgacaagtacctgcacgacgaactcgacctgatgatcgaggccgccaatgccagccagttgcgccgcaactttgccgaaagcgacctgctttgcgtgcccgaggtgttctgggactggtgcacgagcagcgtcttcacgatggagcggatgcatggcattccgatctcccgcaccgaatcgctgaaggcggcgggcgtcgacatgcacaagctggccgaagagggcgtcgagatcttcttcacgcaggtgttccgcgacgggttcttccacgcggacatgcaccccggcaacatcctggtgtcggtcagacccgagacgttcggccggtatatcgcgctggacttcggcatcgtcggcgcgctgtccgagttcgacaaaaactacctggcgcagaacttcatcgcgtttttccgccgcgactaccatcgtgtggcgctcctgcacgtggagtcgggctgggtgccgccggagacccgggtcgaggaactcgaatccgccgtgcgtgcctgctgcgaaccgtacttcgacaaaccgctgcgcgagatttcgctcggcatggtgctgatgcggttgttccagacctcgcgccgcttcaacgtcgagatccagccgcaacttgtgctgctgcagaagacgctgctcaatatcgaaggcctgggccgccagcttgacccggacctcgacctctggaagaccgccaagcccttcctggaacgctggatgtacgagcaggtgggctggcagggcgcctgggagcggatcaagatcgaggcgccgcaatgggcgaagatgttgcccgactttccccggctggcccaccagttcctggagcgccgcgcgctgcagaacaacgaagggcaggagcgtctgcttacccaactggtggccgagcagcgccgcacgaaccgccggctgtccacggccctgctgctgatgggcgggttcctg

SEQ ID NO: 32370 - DNA, 1185 bp, Ralstonia metallidurans
ctgcaagacgcatacattgtcgcggctacccgttcgccgatcggcaaggccccgaagggcgctttcaagaacacccgtcccgatgacctgctggcgacgatcctgcaagcggccgtggcccaggtgccgagcctggaccccgcgctgatcgaggacgccatcgtcggctgcgcgattcccgaagcgcagcagggcctgaacgtggcgcgtatcggcgcgctgctggcaggcctgcccaacaccgtgggcggcatcaccgtgaaccgcttctgcgcgtcgggcctgtcggccgtggcaatggctgcggaccgtatccgcgtgggcgaatcggatgtaatgatcgccgccggcgtggagtcgatgagcatggtgccgatgatgggcaactcgccgtcgatgtcgccgtcgatcttcgaacgcgacgagaatatcggcattgcctacggcatgggtctgacggccgagaaggtggccacgcagtggaaggtcagccgcgaggaccaggatgcgttctcgctggcatcgcaccagaaggccatcgccgcgcagcaggctggcgaattcaaggacgaaattaccccgattgaggtagttgagcggttcccggatctcgcgtctggtcagatcaacgtcaagacgcgtactatttcgctggacgagggaccgcgtcccgatacgtcggtggaagggcttggcaagctgcgcgcggtgttcgccaacaagggcagcgtgacggccggcaatagctcgcagacgtccgatggcgccggcgcgctgatcctggtttcggagaagatcctcaagcagttcaacctggtgccgcgggcccgtttcgtatcgttcgcggtgcgtggcgtgccgccggagatcatggggatcggtccgaaggcagcgattccggctgcgctgaaggccgctggcctgacgcaggaccagatcgactggatcgagctgaacgaagcgtttgccgcgcaatcgctggcggtgatgcgtgacctggaacttgatccggccaaggtcaaccggatgggcggcgccatcgcgctgggccacccgctcggtgcgaccggagcgatccgttcggccactgtggtgcacgcactgcgtcgccacaacatgaagtacggcatggtgaccatgtgcgtgggcacgggcatgggcgcagccggaatcttcgagcgcgta

SEQ ID NO: 32371 - DNA, 1575 bp, Ralstonia metallidurans
ttgcgcctatcgagcacgctgttcaccgagttgcgtgaaatcctcttctcgaaggtcacgcagagcgcggtgcgagagatcgcgctgcaggtgttccgccatttgcacgcgctgtcgctgcgcttccatctggatcggcagaccggggggatgagccgggacatcgagcgcgggacgcgcggcatccagtcactgatctcgtactcgttgtacagcatcctgcccacgctggtcgagatgtcgctagtgatcggcttcttcgttgtgcgctacgacatctggttcgccgcgatcacgatctgcgcgctggctggctacatcgtgttcacgatcgtcgtgaccgaatggcgcacgcatttccggcgcaagatgaacgagctcgactcgcgcgccaaccagaaggcaatcgactcgctgctgaacttcgagaccgtgaaatatttcgggaacgaggagtacgaggcacgccgctacgacgagaacctgcgtacctatcgcacggcggcgatccgctcgcagaactcgctgtcgttcctgaatttcggccagcaggcgatcatcggcctgggcctgatcctgatcctgtggcgtgccacggtgggcgttgccgccggcaagctcacgcttggtgacctcgtgctggtcaacacgctgatgatccagctctatatcccgctcaacttcctgggcgtgatctatcgcgagatcaagcaggccaccaccgatatggaccgcatgttcgtgctgctcggcacgcaacaggaggtggccgacacgcccggcgcgccggtgctcgccgtcaacggcgccgaggtgcgcttccgccatgtcggctttggctacgagaagaaccgcgtgattctcgacgacgtcgatttcacgatcgcggcggggacgacaacggccgtggttggccacagcggctcgggcaagtccacgctcgcgcggctgctgttccgcttctacgacgtcacgcggggcagcatcgaggtcgatgggcaggacatccgcaaggtgcggcaggtcagcctgcgcgcgtcgatcggcatcgtgccgcaggacaccgtgctgtttaacgacagcatctactacaacatcgcctatggccgcccggaggccacgcgcgaggaagtcatcgaggcagcgcgcgccgcgcagatcgacacctttatcagcgaattgccgcagggctacgacacgccggtgggcgagcggggcctgaagctgtccggcggcgagaagcaacgggtggccatcgcgcgcacgctgctgaagaacccaccgatcctggtattcgacgaagccacgtcggcgctcgactctcgcaccgaacaggcgatccagtcggaactgatgcggctggcgcagaatcgcaccacgctgctgatcgcgcaccggctatcgaccgtggtgcacgccgaccagattcttgtgatggaccgtggacgcatcatcgagcgcggcacccatgccgagctgatgcgggccaatggccactacgccgagatgtggcagatccaggcgcgcaacgcggcggagggctcgcccgatgccgacgcgctggcgatcgatgtg

SEQ ID NO: 32372 - DNA, 1173 bp, Ralstonia metallidurans
ctgggctcgctggcacgctgggtggaaaccctgaagcgcccgaagcgcgcgatgatcgtcgacgtacccatcgaactcgacaacggcacgatcgcccacttcgagggctatcgcgtgcagcacaacctgtcgcgcggcccgggcaagggcggcgtccgcttccaccaggacgtgacgttgtccgaggtgatggcgctgtcggcctggatgtcggtcaagaatgcggccgtgaacgtgccgtacggcggcgccaagggcggtatccgcgttgatccgcgcaccctgtcgcacggcgaactggaacgcctgacccgccggtacacgagcgaaatcaacatcatcatcggaccgagcaaggacattcccgccccggacgtgaacaccaacgcccaggtcatggcctggatgatggatacctactcgatgaactcgggcagcacggccaccggcgtggtgaccggcaagccgatctcgctgggcggttcgctgggtcgtcatgaagccacgggccgcggtgtgttcgtcgtcggttccgaggcggcccgcaacctgggcatggacgtcaagggcgcgcgcgtggcggtgcagggcttcggcaacgtgggtgccgtggcagccaagctgttccatgaggcgggcgccacggtggtggcggtgcaggaccatcgcaccacgctgttcgacccggccggtctggacgtgccgaagatgatggagtacgcgtcgcacagcggcacgatcgaaggctaccgcgccgaggtcatctccaccgagcagttctgggaagtcgattgcgacatcctgatcccggccgcgctggaagggcaactgaccgccagcaatgcgccgaagatcaaggcgaagctggtgatcgagggcgccaacggcccgaccacgcccgaggccgacgatattcttcgcgagcgcaatatcctggtttgcccggacgtgatcgccaacgccggcggcgtgaccgtgtcctactttgaatgggtgcaggatttctcgagcttcttctggaccgaagaggagatcaacgagcgcctggtacggatcatgcaagaggccttccgggcaatctggcaggttgcccaggacaacaaggtcacgttgcggacggctgcgtttatcgttgcctgtacgcgtattctgcaggcgcgcgaaatgcgcggc

SEQ ID NO: 32373 - DNA, 1071 bp, Ralstonia metallidurans
atgagtcaatacaggatcgctgtcattcccggagacggaatcggaacggaagtgatgcccgaaggcatccgcgtcatggatgccaccgcacgacgtttcggcatcgattttcagtgggaccacttcgacttttccagttacgcgtactacgagcgccacggcaagatgctgccggacgactggtttgacaccctggtcaagtacgacgccatctactttggcgcggttggctggccggcgaagattgccgatcacgtgtcgctgtggggctccctgctgcagttccggcgctcgttcgaccagtatgtgaacctgcgcccggtccggctgatgcccggcatcaagagcccgctggccgaccgcaagccgggcgacatcgatttctacgtggtgcgcgagaacaccgagggtgagtattcgagtatcggtgggcgcatgttcccgggtaccgagcgcgagatcgtgatgcaggagacggtgatgagccggcacggcgtcgaccgcatcctgaaattcgcgttcgaactggcgcagaaacgcccgaagaagcacctgacgtcggccaccaagtccaacgggatctcgatcacgatgccgtactgggacgaacgggtggaggcgatggccgccaactatccaggcatgaaggtcgacaagtaccacatcgacatcctgaccgcccacttcgtacagcacccggactggttcgacgtagtggtggccagcaacctgttcggcgacatcctgtccgatctcggcccggcctgtaccggcacgatcggcgtggcgccatcgggcaacatcaatcctgataaggtctatcccagcttgttcgagcccgtgcatggctcggcgcccgacatcgctggccagggcatcgccaatccgatcggccagatctggtgcggtgcaatgatgctcgaacacctgggccacgccgaggctggcgcggccgtgctggcggccatcgagcaggtgctggccgcgggaccgggtcatgcgccgctgacgcgtgatattggcggtaccgcctccacggccgatctcggccaggccatcgcggaggcgctg

SEQ ID NO: 32374 - DNA, 1366 bp, Ralstonia metallidurans
acgttcgaaagcttcgggctggatccgcgcattctgcgcgccttgaccgaacagggttacaccaagccgacgccgattcaggcgcaggcgattcccgtggtgttgctgggcaaggatgtgatgggcgccgcgcagacgggcaccggcaagaccgctggtttcgcgctaccgatcattcagcgtctgctgccgctcgccaacgcgagtgcctctccggcgcgtcacccggtgcgcgcgctgatgctgacgccgacgcgcgaactggccgatcaggtctacgacaacgtcgcccggtatgccaagcacactgatctgcgcagcacggtggtcttcggtggcgtcgacatgaacccgcagaccgatgcgctgcgccgtggcgtggaaatcctcgtggccacgccgggccgtctgctcgatcacgtgcagcagaagtcggtgaacctgtcgcaggtgcagatgctggtgctcgacgaagccgaccgcatgctcgacatgggcttcctgcccgacctgcagcgcatcattaacctgctgccggcgcagcgccagacgctgctgttctcggccacgttctcgcccgaaatcaagaagctggcctccagctacctgaagcagccggtgacgatcgaagtggcgcgcagcaactcgaccaacgagaacgtgcgtcaggtggtgtatcaggtgcaggatggccacaagcaggccgccgtggtgcatctgctcaagcagcgcgccaacgaacaacagtcgcgccagtgcatcgttttcgtcaatagcaagattggttgctcgcgtctggcgcgtcatctggagcgcgagggcatcaacgccgccgcgattcacggcgacaagacgcagaccgagcgtatgcagacgctcgacggtttcaagaatggcacgatcgacgcgctggtggccaccgatgtggcggcccgtggtttggacattcccgccatgccctgcgtgatcaacttcgacctgccgttcagtgccgaagactacgtgcaccgcatcggccgcacaggccgtgctggcgccagcggcgacgcgctttcgatcttcgtgccgggcaatgacgaccgtctgctggccgacatcgagaagctgatcaagcgcagcattccacgcggctcgctggacggcttcgatccgaccggcgagcgtgcgcgtcaggaagacagcgatcgtcgccgcgcgcgtacggaagttcgccgcgttcgcgacaatggcgagggcgaggagcagcagcgccgccgccgtaccgagccgaatggtcgccaggcgttccgtccgtcggacgatccgttcttctcgcgtccgtacgagccgtcgggcagctacacgccggcaccgaagaccgaggaac

SEQ ID NO: 32375 - DNA, 474 bp, Ralstonia metallidurans
ctgctgacactgatcgtcgcgcgcgcgcgcaacggcgtgatcggccgtaacaacaccttgccgtggcgcctgccggaagacttgcagcatttcaagcgcacgaccatgggcgcgccgatcatcatgggtcgcaagacctgggattcgatcggccggccgctgccggggcgccgcaatatcgtggtgacccgcaaccgcgacctgcatatcgagggcgccgatgtggtgggatcgatcgaggatgcgcaacggctgtgcataggtgcggaacaggtattcctgatcggcggcgcacaactctatgcggaggcactgccgagcgccgatcgcctgatcgtcacggaaatcgacgcggatgtggaaggcgatgcgttcttcccggccgtggaccgcacgacatgggtcgagaccgcgcgtgagctccaccattcggaaacgaatggcttcgactatgcgttcgtgacgtacgaacgg

SEQ ID NO: 32376 - DNA, 1299 bp, Ralstonia metallidurans
ttcgcaaaactcggcctcgacgccgctatcctgcgcgcactggccgaagccaactacaacacaccgacaccggtgcaggcgcaggccatccccgccttcctggccggccgcgacctgctggtttccagccagaccggctcgggcaagaccgccgcgttcatgctgcccgcaatccagcgcatcagcgaaaagccggccacgcatcgtccgaccgaaccggccaagcgcatgaagggcaagcgcccccgtccgtctccggcccagccgtcgctgctggtgctgacgccgacgcgtgaactggccctgcaggtaaccgaagccgccgccaagtatggccgccatctgcgccgtatcgtctgcgccagcatcctgggcggcatgccctacccgaagcaactggccatgctggcccgtatgccggacatcctcgtggccacgccgggccgcctgctcgaccatatcgaagccggccgcattgacctgtccgcgctggaaatgctggtgttcgacgaagccgaccgtatgctcgacatgggcttcgccgacgacatcgacgccatcgttgccgccacgccggcatcgcgccagacgctgatgttctcggccacgctcgacgcccgcatcgcccaactggcctcgcgccagctccgcgacccgcagcgcatcgaaatcgccgccgcgcgcgccgaccacagcaacatcgaacagcgcctgcacttcaccgacgacatgtcgcacaaggagcgcctgctcgaccacctgctgcgcgatgcatcgctcaagcaagccatcgtcttcaccgctaccaagcgcgatgccgattcgctggccgagcgcctgtcggacaccggcttctccgccggcgcgctgcatggcgacatgactcagggcgcgcgtaaccgcacgctgacggccctgcgccgtggcaacctgcgcgtgctggtggccaccgacgtggccgcgcgcggcatcgacgtgcccgacattacccacgtggtgaacttcgacctgcccaagcaggcggaagactacgtgcaccgcattggccgtaccggccgtgccggtcgctcgggtgtggcgatcaacctcgtgaaccacggtgacatgttccagtggcgccgtatcgagcgcttcacgaacaaccgcatcgacgcctcggtgatcgagggcttcgaaccgcgtcgctcgccgaagccgcgctcgaacttcggcggcaagccgggcggccgcgacggcttccgcggcaacggtggcaccggtggcggctatcgcggcaacaacggcagcggtggctatcgc

SEQ ID NO: 32377 - DNA, 1380 bp, Ralstonia metallidurans
atgtctttttccgaactcggcttgtccgacaagctggtgcgtgccgtggccgaacagggctacaccacgccgaccccgattcaggcgcaagccattcccgcaattctcaaaggtggcgatcttcttgccggtgcgcaaaccggcaccggcaagacggcaggtttcacgctgccgatgctgcaattgctctccgaaaccgccgcgcgcgccaatggcggcaatgcgccccgcggcgcgcgcccgaacgtgcgtgcgctggtgctgacgcccacgcgtgaactggccgcgcaggtcgaagagagcgtgcgcaactatggcaagtatctgaagctgcgttcgatggtgatgttcggcggcgtcggcatcaatccgcagatcgaggcgctcaggcgcggtgtcgatatcgtggtggccacgcctggccgtctgctggaccacgtggcgcagcgcacgatcgacctctcgcacgttgaactgctggtgctcgatgaagccgaccgcatgctcgacatgggcttcatccacgatatccgcaaggtcctgaacgttctgccgcccaagcgccagaatctacttttctcggccacgttctcggacgatatccgcgcgctggccgatcgcctgctggacaacccggcgtcgatcgaagtggcacgccgcaataccacggcggaaaccgtggcgcagcgcgtgttcccggtcgaccgggaacgcaagcgcgaactgctggcccatctggtgcgccagcacgactggcatcaggtgctggtgttcacgcgcaccaagcatggcgccaaccggctggccgaacaattgaccaaggacggcctctcagcgctggcgatccacggcaacaagagccagtcggcccgcacgcgcgcgctgaccgagttcaaggccggcacgctgcgcctgctggtggccaccgacatcgccgcacgtggcatcgacatcgaccagctcccgcacgtggtcaacttcgatctgcccaacgtgcccgaggactacgtgcaccgtatcggccgtactggccgtgccggcgccgaaggcgaggcgatctcgctggtttgcgtggacgaacatggcctgttgcgcgatatcgagcgcctgatcaagcgccagatcgagcaggtgctgctgcccggtttcgaagtcgatccgagcatcaaggccgagccgatccagaagggccggcagcagcagcgtggcggtcagccgcgcggcaacggccaggggaatgccggcaacggtggcgagcgccgccagccgcgcgccgcgcaaggcgagcgtcaggaagcgccgcgccaaccgcgtccggcacagccggcgcgtggcgaggcccgtaacggcaacgccggaggcagtggtaatgcgccgcgt

SEQ ID NO: 32378 - DNA, 1155 bp, Ralstonia metallidurans
atgaatatccatgagtatcaaggcaaggaaatcctgcgcaaatacaatgtgccggttccgcgcggcatccctgctttctcggttgaagaagccctgaaggcggctgaacagctcggcggcccggtgtgggtcgtcaaggcgcagatccacgcaggcggccgcggcaagggcggcggcgtgaaggtggccaagagcatcgacgaggtgaagacctacgccaccaacattctcggcatgacgctggtgacgcaccagaccggcccggaaggcaagaaggtcaatcgcctgctgatcgaagaaggcgctgacatcaagaaggaactctacgtttcgctggtggtggaccgcgtgtcgcagaaggtggccctgatggcctcgagcgaaggcggcatggacatcgaggaagtcgctgcccacaccccggaaaagatccacacgctgatcatcgaaccgtcggaaggcctgaaggattcggacgctgacgacatcgcccgcaagatcggcgtgcccgacgccagcgttccccaggctcgccaggccctgcaaggcctgtacaaggcattctgggacaccgacgcctcgctggccgaaatcaacccgctgatcctgaccggcgacggcaaggtcgttgccctggacgccaagttcaacttcgactcgaacgcgctgttccgtcacccggaaatcgtcgcgtaccgtgacctggacgaagaagacgccaacgaaatcgaggcctcgaagttcgatctggcctacatctcgctggacggcaacatcggctgcctggtgaacggcgctggcctggccatggccacgatggacaccatcaagctgttcggtggcgagccggccaacttcctcgacgtgggtggcggcgccaccaccgagaaggtgaccgaagccttcaagctgatgctgaagaacccgaacgtgcaggccatcctggtcaacatcttcggcggcatcatgcgttgcgacgtgatcgccgaaggcgtgatcaccgcttcgaaggccgtgcagcttggcgtgccgctggtcgtccgcatgaagggcacgaacgaagagctgggccgcaagatgctggctgattccggtctgccgatcatctcggccgacacgatggaagaagccgcccagaaggtcgtggccgccgtc

SEQ ID NO: 32379 - DNA, 879 bp, Ralstonia metallidurans
atgagcattctgatcaacaaggacaccaaggtcatcacccagggcatcaccggcaagacgggccagttccacacccgcggctgccgtgactatgccaatggcaagaactgcttcgtggcaggcgtgaacccgaagaaggccggtgaagatttcgaaggcattcccatctacgcaagcgtcaaggatgccaaggaacaaaccggcgcgaccgtgtcggtgatctacgtgccgcccgcaggcgccgctgccgccatctgggaagccgttgatgccgatctggacctggtggtctgcatcaccgaaggcatccccgtccgcgacatgatggaagtcaaggacaagatgcgtcgccagaacaagaagacgctgctgctcggaccgaactgcccgggcctgatcacgccggacgagatcaagatcggcatcatgccgggtcacatccaccgcaagggccgcatcggcgtggtgtcgcgctcgggcacgctgacgtatgaagccgtgggccagctgaccgcgctgggcctgggccagtcgtcggccgtcggtatcggtggcgatccgatcaacggtctgaagcacatcgacgtgatgaagatgttcaacgacgatccggaaacggacgccgtggtcatgatcggtgagatcggtggtccggacgaagccaacgcggcttactggatcaaggaaaacatgaagaagccggtggttggcttcatcgctggcgtgaccgcgcctccgggcaagcgcatgggccacgctggcgcgctgatctcgggcggtgccgacactgcccaggccaagctggaaatcatggaagcctgcggtatcaaggtcaccaagaacccgtcggaaatgggccgcctgctgaaggcaatgctg

SEQ ID NO: 32380 - DNA, 675 bp, Ralstonia metallidurans
tggcgaaccttgctcgcgccatgcctgggcaaggccgaatggtcgtcgctgtgcgcgttcgtcgacgaagaacgcgcggcgggcaagccggtgtttccacacgcggtattccatgccctgcacctgacgccgccagacgcggtcaaggtcgtgatccttggtcaggacccgtaccacggcaccggcgtcgtggatggactggagatcccgcaggcacacgggctggccttctccgtacccgagggcgtcaaggtgccaccaagcctgcgcaacatcttcaaggagatcggcgcggaatacggcgtggcgccgacgcgtgcgtcgggcaatctggaaggctgggcacgtcagggcgtgctgctgctgaacacggtactgacggtcgagcagggacaggccgccagtcatgcgaagcgcggctgggaagctgtgaccgactgcgtgatccacgcgctggcggcatcgcggccgaacctggtgttcctgctctggggcagccacgcgcaggccaagcgcgccttgctcgaaggccagacgcattgcgtgctggaagcgccgcatccgtcgccgctgtcagcgcaccggggattcctgggctgcggccatttccgtcaggccaacgactggctcgagcgccacggccgtgacggtatcgactggcaggcgacctgaccg

SEQ ID NO: 32381 - DNA, 1005 bp, Ralstonia metallidurans
ctctcccaagattcagccatgtccacgttccccgagttccgtccccgccgcatgcgtcgcgacgacttctcgcgccgcatgatgcgcgagaatcgcctgtcgcctgacaacctgatctatccggtctttatcctggaaggccagaaccagcgacagaccgtggcgtcgatgcccggcgtggaacgtgtgtccgtagacctgctgatgccggtcgcggaagactgcgtgaagctcggcattccggtcatcgcgctgttcccggtgatcgatccgtcgctgaaaacacctgacggcatcgaggccaccaacccggaaggcctggtgcctcgcgccgtgcgagcgctgaaggatcgctttcccgaacttggcgtgctgaccgacgtcgcgctcgatccgtacacgagccatggccaggatggcgtgctcgacgagaacggttacgtgatcaacgacatcaccgtcgagatcctcgtcaagcaggcacttgtccaggcggaagcaggtgtcgacatcgtcgcgccgtcagacatgatggacggccgtatcggcgccgtgcgcaacgcgctggaagaagcgggccacatccacacgcgcatcatggcctactcggccaagtatgcgtccgcgttctacggcccgttccgcgatgcggtgggctcggccagcaatctgggcaagggcaacaagatgacctaccagatggacccggccaatacagacgaggccctgcgcgaagtcgcacaggacatcatggaaggcgccgacatggtcatggtgaagccgggtatgccgtacctcgacatcgtgcgccgcgtgaaggacgaatttcgctttccgacgtacgtgtatcaggtcagcggcgagtacgcgatgctcaaggccgccgcgcagaatggctggctcgaccacgacaaggtcatgatggaatcgctgctggcattccgccgtgccggcgcggatggcatcctgacctacttcgcgcgcgacgccgcgcgcctgctgcag

SEQ ID NO: 32382 - DNA, 1245 bp, Ralstonia metallidurans
gatttcttttcgcgccgcgatggcattctcgccgtcgagcaagtcccgctgacccgcattgccgaccagttcggctcgccgacctttgtctactcgcgggccgcgctgacggccgcgtacaacgcctacgcggccgcgtgcaagggccgcaacgcccacgtgcaatatgcggtgaaggccaattcgaacctggccgtactgcaggtcttcgcgcaactcggcgcgggattcgacatcgtttccggtggtgagctgctgcgcgtgatcgcggctggcggcgacccgcgcaaggtggtgttctctggtgtcgcgaagaacgtcgccgacatggagttggcgctgagccacgacgtgcgcggcttcaacgtcgagtcgattcccgaactggaccgcctgaacgctgtcgccggccgtcttggcaagcgcgcgcgcgtatcgctgcgcatcaacccggatgtggatgccaagacgcatccgtacatctcgacgggcctcaaggccaacaagttcggcgtcgccttcgaggacgtgctgccgacctatcgtgccgccgcagcgctgccgaatattgaggtcaccggcatcgactgccatattggctcgcagatcaccgaggtggcgccttatctggaggcgctcgacaaggtgctcgacgtggtcgaggcgctcgaggccgaaggcatcaagctggaacatatcgatgtgggcggtggcctgggcatcacctacaacgatgaaaccccgccggacatcacgaagttcgccaccacgctgatcgaccgtgtggccgcgcgcggccacgggcaccgcgaggtcctgttcgaaccgggccgttcgctggtcggcaacgccggcgtgttgttgacccgtgtggaattcctgaagccaggcgcggccaagaacttctgcatcgtcgacgcggcaatgaacgatctggcgcgtcccgcgatgtatgaggcattccaccgcatcgaaccggtcgcccctcgcaacgacgcgggggtgatgtacgacgtagtgggtccggtctgcgagtccggcgactggctcggccgcgaccgcacgctggccgttcaggccggcgacctgctggcggtgatgtcggccggcgcctatggtttcgtgatgagctcgaactacaacacgcgcggccgcgcggccgaggtgatggtcgacggcgataccgtgcatctggtgcgcgagcgcgagttgccggcggacctgttccgcaacgagcgactgctg

SEQ ID NO: 32383 - DNA, 507 bp, Ralstonia metallidurans
gccaatcgcccgaatatcttctttgttggcctgatgggcgccggcaagaccaccgtcggccgcaccgtggcccgtcgtctcaactatccgttcttcgattccgatcatgaacttgaggcgcgctgcggcgtacgaattccgataattttcgagcatgagggcgaagcggggttccgcgatcgcgaggcccaggtgattgccgagctgaccgggcgcagtggcatcgttctggccacaggcggcggcgcggtgctccgcgaggtcaaccgcgcggcgttgaaggccaatggcactgtggtctatctgcgcgccagcccgcacgatctgtggctgcgcacgcggcatgaccgtaaccgaccgctcctgcagacggaggatccgaagggtcgcctcgaggcactctatgccgagcgcgatccgctctatcgcgaggtggcggacttcattatcgaaaccggcaagccgaccgtggcgcagcttgctaatatggttcttatgcaacttgaa

SEQ ID NO: 32384 - DNA, 1065 bp, Ralstonia metallidurans
atgatcacgcttgaagtcgatctcgggacgcgtagttacccgatccacattggcagcggcctgctggaccgcgccgacctgctggccccgcatgtacgcggccagcatgccgtcattgtcaccaacgagaccgtgggcccgctgtacgcggcgcgcgtcgaagctgtgcttgccggccttggcaagaccgtgcgcaccgtggtgctgccggacggcgagcgcttcaagcactgggaaacgctgaacctgattttcgatgcgctgctccaggcaggggccgaccgcaagaccacgctgatcgcgctgggcggcggggtggtgggagacatgaccgggtttgccgccgcatgctacatgcgtggcgtgccgttcgtgcagatgccgaccacgttgctggcgcaagtcgattcgtcggtgggcggcaagaccggcatcaatcatccgctcggcaagaacatgatcggcgcgttccaccagcccaacgcggtgatcgccgacattgacacgctgcgcacgttgcccccgcgcgaactggcggcgggcatggccgaggtcatcaagcacggggcaatcgccgacgccgactacttcgcttggatcgaggaccatatcgccgggctgaacgcctgcgacaccggcctgatggccgaagcggtgcgacgctcctgcgagatcaaggcgtccgtggtggcccaggacgaacgcgaaggcggcttgcgcgcgattctcaatttcggccatacgtttggtcacgcgatcgaagctggcatgggctatggcgaatggctgcatggcgaggccgtgggctgtggcatggtgatggccgcggacctctcgcatcggctcggttttatcgacgtcgagacgcgcgcccgcattcgcacgctgacgcaggcggcgatgctgccggtggtggcgccggatctgggtatcgatcgctatatcgagttgatgaaggtggacaagaaggccgaagcgggcagcatcaagttcatcctgctgcgcaagctgggttctgccttcatcaccaccgtgccggacgcggacctgcgcgagacgctgcgt

SEQ ID NO: 32385 - DNA, 1215 bp, Ralstonia metallidurans
aagtcccatatcacgacctggattctgattgcgatgatcctgggcgccgccgttggctatgcgtgctacatcgcgtttcccgacccgaagatggccaaggaagtggccgggtacatctcgctcatcacggatgtgttcctgcggctgatcaagatgatcatcgcgccacttgtgttctctacgctggtgatcggcatcgcccatatgggggatgcgggcactgtggggcgggtgggcggcaaggcgatggcgtggttcattaccgcgtcgctggtgtcgctgacccttggcctgatcatggcgacggtgctggcgccgggccacaacatcggcctgccgttgcccgacgtgggctccgcgaccaacctcaaaaccaacgccttcacgctgaaggacttcgtcacccatctggtgcccaaatcggtgggcgaggcgatggcgaacaacgagatcctgcagatcgtggtgttctcgatcttcttcggcaccgcgatctcgatgctcggcgaacgtggcgcgcgcatggccggcgtgatcgacgacctcgcgcagatcatgctcaagatcaccggcgcggtgatgtggctggcaccgatcgcggtgtttgcggcgattgcgtccacggtgaccacgcaggggctcggcatcctggtgaccttcgccaagttcatgggcagcttctacctgtcgctgttcgtgctctgggcgctactggcgctggccggctacattttcctcggtagccgcgtcttcacgctgatccggctcatccgcgagccgttcctgatttcgttttcgacggcgagctccgaagcggcctatccgaagctgctcgattcgctcgaccgtttcggtgtcgatcgcaagatctcgagcttcgtgctgccgctcggctattcgttcaaccttgacggttcaatgatgtactgcacgttcgctgtgctgttcattgcgcaggcgtatgacatccacctgccgctgggcacgcagatcacgatgctgctgctgctgatgctgacttcgaagggaatggccggcgtgccgcgcgcctcgctggtggtgatcgccgccacgctgaaccagttcggcattccggaggcgggtttgctgctgatcatgggcgtggaccagttcctcgacatgggcaggtcggcgaccaacgcggtcggcaattcgatcgccgccgctgtggtggccaagtgggaagggcagctg

SEQ ID NO: 32386 - DNA, 1044 bp, Ralstonia metallidurans
tacgccgtgaaggccaacagcgacgcgcccgtccttcgggccttgctcggtgtggccgatggtttcgaagtggcctcgttcggcgagatcgagcgcgtccgcggcgtcgatgccgaagtacccatcgcattcggcggcccgggcaagaccgatgccgagctcgaaggcgcgctgcgtcttggcgtcggcctgattcacgtggaaagcacgctgcagctaagtcggctggatgccgtagcacgacggcaaggccgctgcgccgatgtgctgcttcgcgcgaaccccgcctacggtctgcccggcgccacgctccagatgggcggcggcgccacgcagttcggcatcgacgaggccctgctacccgatgtgctggcgcagtcccgcacgatgcccaatgtgcgcgtggttggcctgcatgtgcacgccgggtccaacagtctcgatgccgacacccatctggccctgatcgaccgccatatcgcgctggccaagcgcctgcgcgacctgcacggcctgacactcgaatggctgaacgtcggtggtggcatcggcatcgactatcagaatccggagcgccacttcgactgggaccgtttttgccatggactggctgccctgctgcgggagacagcgccgagtacgcgcatcgtcttcgagtgcggccgctttatcagcgcgggctgtggctgctatgttgccgaggtcatcgacctgaagcggaatcacgacaaatggttcgcggtgctgcgcggtggcacgcaccacttccggctgcccgtgtcatggcagcacaaccatccgttccaggtgctgccgaatgaccactgggactatccgtttccgaggcccgtggtagagcggcagccagtgacgctgtgtggcgaactctgtacgccgaaggatgtgctggcgcgcgaggtgccagtggatcggctgcgtgtcggagatcgcatcgctttcaccatggctggcgcgtacggctggcatatctcgcaccacgacttcctgagccatccgcaccccgagcgcgtcttcatcggcggt

SEQ ID NO: 32387 - DNA, 1011 bp, Ralstonia metallidurans
atgaaagccgcagtcgtgcgcgcgttcggcgcacctctgactatcgacgaggtgcccgtgccgcagcctggccctggccagatccaggtcaagatcgaagcgtccggcgtttgccacaccgatctgcatgcggcgcagggcgactggccggtcaagccgtcgctgccattcattcccggccatgaaggcgtgggattcgtgtcggcagttggtgccaatgtcaaacgcgtgaaggaaggggatcgcgtcggcgtgccgtggctctacagcgcctgcggttactgcgaacactgcctccagggctgggaaacgctgtgtgagaagcagcagaacaccggctactccgtcaacggtggctacggcgagttcgtggtggccgatccgaactatgtcggtctgctgccgaagaatgtcgacttcatcgaaatcgcgccgatcctgtgcgctggggtgacggtctacaagggtctcaaggtcaccgacacacggccggggcagtgggtggtgatctcgggaatcggtggtctgggccacgtggccgtacagtatgcgagggcaatgggcctgcgcgtggccgccgtcgacattgacgacgcgaagctcgctttcgcgcgcaagctcggtgccgaagttgcaatcaatgctcgcactaccgaccctgctgctttcttgcagaaggaaattggcggcgcgcacggtgtattggtcaccgcagtctcgccgcaggcgttctcgcaggctatcggcatggtgcgacgcggtggcacgatctcgctgaacggcctgcctccgggagacttccccaccccgatcttcgacgtggtgctgaaggccatcactatccgtggctccattgtcggcacgcgtagcgatctgcaggaagcgctcgaatttgccgccagcggtgtggtgaaagccacggtatccacggaaaaactggactcgatcaatagtatcttcgaccgcatgaaggccggccagatcgaaggccgcattgtgctggacttcagc

SEQ ID NO: 32388 - DNA, 729 bp, Ralstonia metallidurans
ggccccggctggagcatcgggcgcgccgccagcgtgacctatgcccggcttggcgcccgcgtctgcgtggtggaccgcgacgccgcctcggctgcggagacgacggcgctgattcgggccgagggtggcgcggcggagaccttcgtcggcgacgtggcggaagaggcggagatcgcgcgcctgttcgcggaggcgcgcgaacacttcggccccatcgatgtgctgcatcacaacgttggcatcggcaagaccggcggggttctggacaccgatgtgcgggatttcgatgcggcccacaacgtgaacgtgcgaagcctgctgctggcgtcgcagcaggtgctgccgtcaatggtcgagcggggccggggtgccatcgtcacggtttcctcggtggcggggctacgctatatcggctatccgcacctgtcgtacagcgtcagcaaggccgcgctgatccagttcacgcggatgatcgcgcagcagtacgcgggcagcggcatccgtgcaaattgcgtggtgccgggtttgatcgacacgccacgcatcgcccataccgtggcgaagcagttctcggcggacagtctcgacgacgcccgcgcggcgcgtgcgagacaggtgccgatgcagcggatgggcaccgcgtgggacgtggcacacgcctgtgcgttcctggcgtcggatgcagcggcctacattaccggcaccgagctggtggtcgatggagggata

SEQ ID NO: 32389 - DNA, 1470 bp, Ralstonia metallidurans
cgggccgccgaccgctggcccgacaacgtcgccattgacgcccccggcggcagcctgcgctatcgcgaactggccggccaggtggcggcgctggccacgcatttcatgacgctcgatcccgcgccgcagagtcgcgtgggcatctgcgccggcaactcggccgagcacatcgtggcgctgctggcggtgctggccagcggcaagatctgggtgccgctgaacccgaagagcactcagcccgagttgcgccgcatcatcgacgccacgacgccgagcatcgtggtactcgatgccgcctccgaagcgctgctgggcgatgcaccgggcacgcggctctacacggactatgcggaccatgcgtcaggcggcgcagacgtgctgagcgccgttgttctccggtatcccgatgccacgcgcccggtgctcgatctgcaccgggacgccacgcaggccatcaagttcacaggcggtaccacgggcgcgcccaagggcgtcatgcagccgtatcgcgcctggatgaccaatatcgtcaaccagatccacgcctggggcttcaccgaggcggatcgctatgtgatggccgcgccgatcacgcatggcacgtccacctacgtcatgccgatcctggcgcagggcggttgtcacgtgatcatggaaggcagcggggcagaagcggtgcgcgccacgttccgtgaccgcgccggcacggtctgctttatgccgcccacgctgatctacatgctgatggcgctgcccggcacatcgcgcgccgactacccggcgctgcgtcgcctgatttacggcggcgcgccgatgccgccgcagaagatccagcaggcgcgcgagttcttcgggtcggtggtggccaccacatatggccagaccgaagcgccgcaactgctgacggtgatcggccccgacgatctggctgacgagcgccgcatggcatcggtggggcgcgccacgtggttcagcgaggtggcgatcatgtcccccgacgggcgtctgctgccccgtggcgaggtgggcgaagtggtggcgcgtggcgatctggtcatgaccggctactggaaccgcccggacctgaccgccgcgaccatcgtcgacggctggttgcataccggggatcgtggcatgttggacgcgcagggtttcctgtatctgaaggaccgcctgcgcgaagtggtgatcaccggcggcttcaacgtctacccgatcgacgtggagaacgcgctgggccagcacccggccgtgcatgaatgcgcggtgttcggcgtgcccgacgacaaatggggcgaagcggtccatgcggccgtgcaattgcgcgaaggatgcgcggtgcaggccaccgagctgatcgcgttcgtgcgcgagcggctgggtccggtgcagacgccaaagcagattcatttccacaccagcctgccgcgctccaccgtcggcaaggtactcaagaacaccgtgcgcgac

SEQ ID NO: 32390 - DNA, 2670 bp, Ralstonia metallidurans
acaccctggcacgccatgaccgccgatgaggtcgagcagcgtttcaaggtcgatccctcgcagggcctggaagccgacgatgccgccgcgcggctgggtacctacggacccaaccggctgccccagggcaagaagcgcggcgccatcgcgcgctttgtctcccagttcaacaacatcctgatctatgtgctgatcgcgtcggccttcaccaagctgatgctgagcctttggctcgacgcatcgatcatctttgccgtcgtcatcctgaactcgttgctgggcttcctgcaggagggaaaggccgaagaggcgctggattcgatccgcaacatgctttccactgatgcacgcgtgttgcgtggtggtgcggcccgcctgcttgacgccgaggaactggtgccgggcgatgtcgtgctgctggagtcgggcgacaaggtccccgccgatctgcgcctggtggaagccaggaacctgcgcacagaggaagcggcgctcaccggcgagtctgtgcccgccgacaagacgacggtaccgatgcccgccaagtccactgtgggagaccgcgagaacatggcgttctccggcacgatggtggtctccggccgagccaccggcgtggttgtggcaacgggaagccagacggaactcggccgcatcaacgagatgctcgggcaggtcaatccgctggagacgccgctgctgcggcagatcacgaagttcggttacgtcatcacggcggccatcggtgttctcagcgtcgtgctgttctcctgggggcactggctcggcaagatgagtttcgtggagctgttccaggcgatcgtcggcattgcggtgtcgatcatcccggaaggtctgcctgcgctgatcaccatcacgctcgcgatcggcgtgaagcggatggcccagcgcaatgccatcatccgtcgtttgccggcggtggagacgctgggctccgtctcgcgcatctgctcggacaagacgggcacgctgacgatgatggagatgatggtgacatcggtcgtgacggccgatgcatcgtatgcagtgacgggccacggctacgcaccggaaggcgcgctcagcacggagggcaaaccgctggacgccgtgccgttgccgctggcgctgatcggtcgcgtgtcgatgctgtgcaacgacgccgagctttttgaggatgatggtcgatggaaggtggagggcgaccccaccgaaggcgcgctctatccactcgccaccaagctcggcatggaccgcaccgccgagggggtggccgcgccacggatcgacgccattccattcgagtccgagcacaagttcatggcgacgctgaaccgctcggccgacggcgagatgctgctggtaaagggtgcgccggaggtgattctggaacattgcgatcaccagcaaaccgcgaatggcgcggtgccgctcgaccgcgcgtacttcgtgagggagggcgatcgcatggccgcgcagggtgagcgggtgctgggacttgcctggctgccagatccgggcctgccgcagggcggtctcgagccgaaggacttgccgagtacgctcgtgttcctcggcctcgtcggcctgatggacccgccgcgcaaggaggcgatcgacgccgtgcgggaatgccatgaaggtggcatccgggtgacgatgattaccggcgaccacaaggtcacggcggccgccgtggcgggaatgctcgggatcggcgatggccgcaccgccgtggcgggtaccgagatcgaggcaatgaacgatgcggccctgcgcgaatgcgtgcgcgaggtcgatgtcttcgcccgcgccagccccgagcacaagctcagactcgtgaaggcgatgcaggccaaccggcaggtggtggcaatgaccggcgacggcgtcaacgatgcacccgcgctcaagaaggccgatatcggcgtcgcgatgggtatcaagggcaccgaggtgacgaaggaggccgcggggatgatcctcgtcgacgacaacttcgcgtcgatctcggcggcggtgaaggaaggtcggacggtctacaacaacatcgagaaggcgatgctgttcatgctgccgacgaacatcgcgcaaggcgccgtgatcgccatcgcgatcctgatcgggttcacgctgccaatcaccgcgccgcagattctgtgggtgaacacggtctcctccgtcgcgctgggcctggccatgtcgttcgaaccccacgaggcggacgtgatgggccggccgccacgctcgatcgaccggtcgatcgtcaccggtttcggggtatggcgaatctgcttcatcggcgtggcgctcgtcatctacacactcgcggcgttcttcgtgatgaaggcgcatggcgcggcggatgaaatggcgcgaacagcggccgtcaacgccatctcgcttggccagatcttctacctgatcaacagccggcacctgctcgaatcctcgctgtctgtgcgcgctcacacgagcaatccgtatctctggtacggcatcggcggcgttgtggtgctgcagttgctgttcacgtactggtacccgttccagttgatcttcgatacccaggcactgaccgtggagcactggctatggctgatcgccggagccgtggtgctgttcttcgtggtggagttcgagaagctggtcattcgatccttcccgcca

SEQ ID NO: 32391 - DNA, 789 bp, Ralstonia metallidurans
aaaatcgccattgcaggggcttccggccgcatgggtcgcatgttgatcgaaacggtgctcaataccgacggcgtgacgctggccggcgcgctcgacgtgccaggtgctgcggcgctgggccaggatgccgggctgtttctgggccgcgagacgggcatcaagatctcctctgacatcgaggccgtgctctcggccgccgattgcctgattgatttcacccgccccgagggcacgctggcgcacctggcggtggccaagcgcctcggcaagaagatggtgattggtaccaccggtttcgatgccgccggcaagcaggcactggccgatgccgccaagtcgatcggcgtggtgtttgccgcgaacatgagcgtcggcgtcaatgccacgttcaagctgctggaagtggcggccaagctgctttccacgggctacgacatcgagatcatcgaagcgcaccatcgccacaaggtcgacgcgccgtcgggcacggcgctggcgatgggcgaagtggtcgccaaggccatcggccgcgatctcgacgaatgcgcggtctacgcgcgcgaaggccatactggcccgcgcgacgcgaagtcgattggcttcgcgacggtccgtggcggcgatatcgtcggcgatcacacggtgatgttcgccggcatcggcgagcgcatcgagatcagccacaagtcgtccagccgccagtcgtatgccgatggtgctgtgcgtgcggcgcgtttcctggccgacaagccgagcggcatgtttgacatgcaggatgtgctgggcctg

SEQ ID NO: 32392 - DNA, 819 bp, Ralstonia metallidurans
gggctatggctgccgatggtcacgccgctgcatcacggccaggtggatttcgacggcgtgcaacggcttgccgcgcactacgcggatgctggcgtcgacggtttgatcgtgctcggcacgaccggggagggtggcctgctgaccgacgtggagcgccttcaggtcgccgccgccaccctcgaggccgtgcaaggcaccgtgcccgtgatcgccggggttggcggcgtggcaacccatgcggtctgcgagcaggtgcgtcggctcgaacggcttgatcttgctggctatctcgtgccgccaccgtactacttgcgcgtgtccgatgaagggatcgcgtggcatttgcgcagcgtcgccagtcatacggccagaccgctgatgttgtacaacgtgccgaagcgcacgggctgcacgatctcgcctgacctcacgtggcgtttggccgcgcatccgcagatcgtggcgctcaaggagtgcgatgcggcgggaatgcgcgcgctggcagggcaggatcgccttgacgtgttctgcggcgatgacgctgccatgctcgaccatctgctgcgcggtggcgcgggaatcgtgccggcctcggcccatatccggcccgatctgttcgtgcggctgattcaacttgcgcgcacagggcgcgaggaagcggcgcgcgcgctgttccggcaactgtcgccgctgatcggaatgctgttcgacgagcccaacccagccccggtgaaggcggcgctggcgctgtgtggtctggcgcgtccggaggtacgtcgaccgctgatgccggcgtcgaagtcacttgtggcgaggctc

SEQ ID NO: 32393 - DNA, 1482 bp, Ralstonia metallidurans
atgaaaaacaggaacgtcatcctggcgatcgacgaaggcacgtctggtacgcgtgccgcggtggttgccagcgacggccacgtctcgtgtcagcagtacaccacgctgcaggtggattcaccgcgtcccggcgtggtggagcaggacgccaacgtgctgctggaaaagacactggaagtctgccgcgccacgctggccgaagccgaacgcaacgacttgtgcatcgtcgcgctggccatcgccacgcagcgctccaccggcgtgctgtgggacaccgtaacggggcgtgcgctggtgcccgcaatggtctggcaggacacgcggtacgcggcggacctcgatcagatggcatccacgtgggacccgcgcttgcgcgccaccgttggtcgtccagccggcgtgcgctcggcttacctgtgggccgcgcgacatctgcgggagacgcgcgccgtcgccgatgcgtggcgcgatcgccggcttgcgttcggcaccgtcgatagctggctgctgtggcacctgtccaccgaacgcgcgtgtgtgaccacaccgacgaatgccacatcgtgcagtgcctatgttcttggtgaacaccgctacctgacggagtgggtcgaggcgctcggattcccgcaagagttgctgccagagttgcgccaggatgccgacgacttcgggcgcacgcgccgcgacctgcttggcgtcgacgtgccgatcctcgcctgcgcgggcgaccaactggcgggcgcagtcggcctcggttgtctcgacgccggccagtcgatgtgcctgcacggcaccggcagctttgttgatctcgtcatcggcccggacctgcccgagcgcagcgggcagtcggacagcacgctgacgatgacggcacgtcgcttcgagggggtttcgcacttttcggtggaaacgttcgtggctactaccggctcggcgctgaactgggtttgcgacaagctgcactggttcgaaagcgcgaagcagatcagcgcattggctgcgtcggtgccgtcatcgcgcggcgtgacgttcattcccgcgctgacgggcttgcgtgtgccgcagatgcggcccgaggcgcgcgctgcgttgaacggggtgtcgatggccaccactcaggcggagatcgcctacgcaatcctggaaggcatcgcgcattccgtggcgtcctgcatcgatgccaaccgcgatattgccggcgtgccggtgcgtgatctcgtcgtcggcgggggattgtcgggcagcgacgcgctgctgcagatgcaggctgaccttacgggcctgccgattcatcggatgcaggagaccgaccgggccagcctgcgtggcattgcctatctggctggcgcatcggggctgatgtgggattcgctgcagcaagcccgcaccaccacgttgccggatgcggtgttcatgccgcgcatcggcgacgacgaacgggaggaacggcgtgcgctctggcacgcgcgtgtcgct

SEQ ID NO: 32394 - DNA, 1533 bp, Ralstonia metallidurans
ctggaatcggaagcattcgacatcctcatcgtcggtggcggtgtcaccggcgcttacgcggcgctggacgccagcctgcgtggttatcgcgtggccctggtcgagaagaacgatttcgcatcggggacgtcatccaagtcatcgaagatggtgcacggtggcctgcgctatatcgagcaaggcaacctcggtcttgtccgccattcgctgctcgagcgtcagcggctgcgccgcaatgcacggcacctggtccagcgcctgccgttcctgtttccggtgatggaacgtgacggtgtgttcgacaagcgcctggccaaggccttcgaaggtctgttgtggacctacgatctggccggcggctggcgtgaaggcatcctgcaccagaagctgacgaaggcggaagtgctgtcgcattgtccgacgttcaacgatgaacatctgaagggcggcttcctgtacttcgatgcgcgcgtcgatgatgcgcggctgacgctgaacatcgcacgcaccgccgcgtttcacggagcggtggtgaccaaccacgcactggtcacggaaatcacgcgtcatgccagcggcaaggtggatggcgcgatcattcaagccgacggccgcgagatccgcgcgcgtgcggacgtggtcatcatggccaccggtgtgtggctgcgcgactggaccggtggcagaaagggcgagcagaagaccctgaacatccggcccgccaagggtgttcacgtcgccattccgtggctcaagatccgcaacgactgcacggtgacgattcccgtgccgggccgcagtcgtcgcgccacgatcacgcgctggggcaacgtctcgtacctgggcaccacggacgaagattacgaaggcgatctcgacaatgtcatgtgcacgcggcaggagcttgatttcctgctggagggcgcgcgttcggcgttgaagaccgatatcgcgccagaagacgtggttggcagcatcgctggctgtcgtccactggtggcaccgcccggcggcaagacgctggaagtccggcgcgaccatcacatccatatcgctggtgatgggctggtgacgatcgtcggcggcaagctcaccacttcgcgccatatggcggagcagaccgtcgacgcggcgcagaaggttcttggcaagcgtgcgaaatgccggacgaagtcggcctttctgcttggcgctgccggatacgatccacaagccatcgttgcgtcgggaggcatgtccgcgcacctgggcgagcgctatggcaccgaggcgcgtttcgtcagtgacatcctccaggccgacccggcgctcgcgcggcccattgtcgaaggcttgccgcattccgaagccgagatcgtctatgccgtgcgtcacgaaatggccggcaccgtcgacgacgtgctgtcgcgccgcattcgcgcgcggctgatggcgcgtgacgcatcggcgcaggccgcgccacgcgtggcccagatcctccaggccgagctcggactttccgggcaggccgtcgcgcagcaggtcagtgactac

SEQ ID NO: 32395 - DNA, 1380 bp, Ralstonia metallidurans
gtcgcgatcgacaacgacacgctcgacgcgttgcgcaaggccgccgatcacgttctgaccgccaccagtgacgtggttgagtggacgcgcgactggtgggctggctcgatgatgaccgagacgggcggcaagcccgccacgccgcgtggcgtgatcgtgcgtgtctccacgatcgagcagattcaggcagtgatgcgcattgcgcacgccaaagccattcccgtgaccgtatcggccggccgcagcaacgtgactggcgcggcgctgcccgtgcgcggtggcatcgtgctcgatgtgtgcgatgtgaacaggctgctgggcttcgaccgcgagagccagatcgtcgaagtggagtcgggcatgttcggcgatatcttcgagcagacgattcagcaggagtacggcatgacgatgggccactggccgtcgtcgtacgcgatcagcacggtcggcggctgggtggcatgccgcggcgcaggccagctttccacgcgctacggcaagatcgaggacatggtggtcggcatggacgtggtgctggccgacggcagcctggtgaccgtgggaggctatccccgcgccgcgctgggcccggacctgatgcaggtgtttatcggatcggaaggcacgctcggggtaatcgtgcgcgtgcgcctgaagctgcatcggctgcccgactatggtcgcgctattgcctacggcttcaagaccttcgcgatcggcctcgacgcgtgccgcgagatcatgcaacgtggcgcgaatcccgccgcgctgcgtctctacgacgaactcgaaagtggcgtgcagttcggcctgcccgagaccaatgtgctgctggtggccgatgaaggcacaaaggaaatggttgacgccgtgatggcgatcagcgagcgtgtctgcgccgaacttggtgacaggctcgatggtgacgcgatcttcgagcgctggctcgacacgcgttacctgactggcaagagtgccgaaggcttcaagcgcagccccggcttcgtggccgacacgctagagatggccggcccgtggagcgatctggccgcgatctacaccgacgtggtggcggcgatcaacgcggtgcccggcacgctggcgggttccgcgcaccagtcgcatgcctatgtggatggcgcgtgcctgtatttttcgttgcgcggtgacgtggccgtgggagatcgccagaagtggtatcgcgcggcatgggatgcggccaacgcggtgctcatccaatacaatgcggcgctgagccaccatcacggcatcggtctgctgcgcgcgccctacatggcgccgtcgctcgacacggcgttcccggtgctggtggcagtgaagcgggcacttgatccgcaaaacatcctcaatccgggc

SEQ ID NO: 32396 - DNA, 1611 bp, Ralstonia metallidurans
atgctgggactgatgcaggaccgaccgctgttgatttcatcgctgatcgagcacgcggctacgtaccatccaacgcgggagatcgtcgcgagaacggtagagggcccgatccaccgtaccaactatgccgagatccatcggcgtgccaaacgcgttgccaacgcgctggcgagtctcggtgtcggggtggcggaccgtgtcggcacgcttgcctggaacacgcatcgtcatttcgaactgtatttcggggtgtccggttcgggcgcgatcctgcacacggtcaatccacgtctgttccccgagcagatcgagtacatcgtcaaccacgcggaggacaaggtcctgttcttcgatattggcttcgcgccgctggtcgagaagctggcgccggccttgaaatccgtccagcactacgtcgccatgacggagcgggcgaacatgccggcgatcgacgtgcccaacctgctttgctacgaggacctgcttgcggagcatagcgatacgtatgactggccggaattggacgagcgcgcggcgtcgtcgctgtgctacacgtcgggcaccaccgggaatccgaagggcgtgctgtactcgcatcggtctaccgtgctgcattcgctcgtggcgtgcgcggcggatgcgttcgccgtgggcgcgtcaacgtctgtgctgctggcggtcccgatgttccatgccaacgcctggggaatgccgtatgcggcggccatggtcggggccaagatggtgatgcccgggccacacctcaatggtcaatcgctctacgaactgatgcgcgacgaaggcgtaactgtctcccaggcggtgcctacagtctggctcatgctcttccagttcctggacgagcacccggagatcgacatgaaggcgcttggcctgaagatcatcggctcgggcggcgccgcatcgccgcgcagcatgatcgagcgctgcgagcgcgactttggcgtcgagtacctgcaggcatggggcatgacggaaaccagcccgatcggtaccaccggccgcctgctgcccaagcatgccgccctgccaaaggacgagcagaccacgatcaagatgaaggccggacgcgcggtatggggcgtaggtctgaagatcatcggcgacgatggtcaggaactgccgcacgacggacgcgccttcggtcatctgcacgtgcgcgggccgtggatcgcaagcggctacttcaagcacacgggtggcgaggtgctggacaaggacggctggtttcccactggcgatatcggcaccatcgatccggacgggtacgtgcaactggtggaccgtgccaaggatgtcatcaagtcgggtggggaatggatttcctcgatcgacctggaaaacgcggcgatcggccaccctgccgtgcacgaggcggcgatcattgccgtcgcgcatccgaagtggcaggagcgcccactgctgctggcggtgaagcgtcccggcaaggatgtcacgcgcgaagagttgctgcagtacctgagcgagcgcgtcgtgaaatggtgggtgccggacgatgtcgtgttcgtcgatcagctgccgcataccgcgactggcaagctgctcaagacgaagttgcgagaggactac

SEQ ID NO: 32397 - DNA, 1479 bp, Ralstonia metallidurans
ccgtctggcgtcgcgacgatttttgcgcaacgcagcacgacgttctcccagctcatcgaccgggttgcaagactggccagcgccttgcgtggccagggcgttgctgcgggcgaccgggtcgccatgctggcgctcaactccgaccgctacgtcgagtacatcttcggcacgctctgggccggcgcggcgctgaaccccgtcaacacccggtggagcgtcgcggaaatcgcctactcgatggaggattgcggcaccagcgtgctgctcgtggatgacaacttcctggatctgatcgggccactgcgcgagcgttgcccctgcatccagaccgtcatctattgcggcgacgccgagaccccggcaggcatgatcgactacgagcaactggtgcggtcgagcgcgccgattgccgacagcctgcgcagtggccacgatcttgccgcagtgctctacaccggcggcaccaccggcgcacccaagggcgtcatgctgtcgcacgccaatatcgccagcaacgtgctgtcgtcactggcagcggcatcgcgcccgccagtgacgtcgatcctgcagatggcaccgatgttccatatcgcggcgctcagcttcgtctttcaggccgtgacgcgcctcgccacgcaggtgatcctgcccgggttcgaccccaaggcagcgattcgcgacctcagccgctaccgcatcaacgaggttttcaccgtcccgacgatgctgaagatgatgctcgacgatcccacgttcgccgaccatgacctgagcagtctcaggaacatcatctacggcgctgccccgattgacggcgcactgctgcagcgcgccatggcgcagattccgtccagccagttcctgcaggcctatgggatgacggagacctcgcctgtctcggcgatactggcggccgattgtcacgtcgtcggcagtccgaggctgaaggcggccggccgcccggcgcccgcgtgcgaagtgcgcatcgtcgatccggcaacggacgaagactgcccgacgggcacggtgggcgaggtcgcggtgcgcggcccgggcgtgatgctgggctactggaacaagccggaagaaaccgcccgcgcgttgcgcaatggctggatgcacaccggcgatgccggatacctggatgcggacggctttctatacgtcaccgatcgcatcaaggacatgatcatcagcggcggcgagaacgtctattcgaccgaagtcgagaatgcgatcctcacgcaccccgcggtgcagctgtgcgcggtgatcggcatccctgacgagaaatggggggaagctgtgcatgcggtcatcgtggtccgccccggtcacgagctgtctgtcgatgcggtgcacgcgcattgccgcgagcggatcgccagctataaatgcccccgcagtgtcgagttccgcgccgacatgccgctctcggcggcgggcaagctcctcaagtacaagctgcgtgaagtctac

SEQ ID NO: 32398 - DNA, 1232 bp, Ralstonia metallidurans
cctaggggagattcgtcggattcgacgaggcacggctgtggcaccggtcctaagatcggccatcggtcgtatcccttccttccatcaccatgtcccagacccgccgcctgatcttcgatgccgatcacgagcagttccgtgcttcggtcgcgcgtttcgtgcagaacgaaatcaccccgtatgtggaccagtggcgcgagcagggctgctgcgaccgtgccatcttcgagaaagccggcgagcagggcctgttgctgatgtgggccgatgaagcctatggcggcgcgggcgtgaccgatttccgctacgaacagatcctcttcgaagagctgattcgccacggagatgtcggcgtgtatctgacgctccattcgcggctggtcgcgccatatattggccggctgggcacggaggcgcagaagcgccggtggctcaccggcgcggccagcggcaagacgatcctggcgattgccatgacagagccgggcgccggctccgatctggccgggatcggcgcacgtgccgagcggcgcgacggcggctgggtcatcaacggcgccaagacgttcatctcgaacgggcacaacgcggatgccgtcatcgtggtcgcgcgtaccaatcccgacgagcgacgtgccttcggcctgttcgtcgtcgagcgcggcatggcgggattcgagcggggccgtcgtctgaaaaagctgggactggacgcgcaggacacggcggaactgttcttcaacgatgtcttcgtcccggacgagaacgtgctgggcaatccggcgcgcggttttgcctatctggcggagggccttgaagaggagcgcctgctgtgcgcgtgccagtcgatcgcgcacgcgcaatccgcgttcgatctgacgctgccctacgtcaaggagcgccgcgcattcggtcgtccgatcggcgccctgcagaacacacgcttcgtgctggcccgccgccgcgccgagctcgacgccatgcagatctggctcgatgcgctcgtcatggagcacaacgccggccggctggatgccgtcacggcggcgtctgccaagctgctgagcacggagttggagaaccgcgtgatcgacgactgtctgcaactgcacggcggctcgggctatatggacgaataccgcatcagccgcatgtatcgcgacgcacgcgtatcgcggatctttgccggcgcgtccgagatcatgctcgagatcatcagccgctcgttgggt

SEQ ID NO: 32399 - DNA, 1170 bp, Ralstonia metallidurans
atgtccgaagcctatatcgtttccgccgtccgcaccgccggcggccgtcgcaatggccgcctgtccggctggcatcccgcggacctcgcggggcaggtgctcgacgcgcttgtcgagcgcagcggggccgacccgagcatggtggaggacgtcatcatgggctgcgtcggccaggcgggcgagcagtcttcgaacatcgcgcgtggcgcggtcttggcttcgaagctgccggaatcggtgccggctacctcggtcgaccgccagtgcggatcttcgcaacaggcgctgcatttcgcggcgcaggccgtgatgtcgggcaccatggacgtggtgatcgccgccggcgtggaaagcatgtcccgcgtgccgatgggcaccccgagcacgctgccgcgaaagaacggcctgggccactacgtcagcccgcaaatgcaggcgcgctatccgggcgtggagttcagccagttcaccggcgcggagatgatcgcgaagaagtacaagctcgataagaccgcgctcgacgcctatgcgctgcgcagccaccagctcgccgccgcggccacgaaggcggggcgcttcgagcaggagatcctgccgctggccgcgcgcatgaatgacggcagcgatctcggcgagttccacaccatcgacgaaggtattcgtttcgacgcgacgctggagggcatcgcctcggtaaagctgatcgccgaaggcggtagcgtcacggcggccaccgccagccagatctgcgacggcgcgagcggcgtcatggtcgtcaacgaacgcgggttgaagatgctgggcgtcaagccgctggcacgcatccaccatatgagcgtgctcggacatgacccggtggtcatgctggaggccccgctgcctgctaccgagcgcgcgctgaagcgggccggcatgcggatcgacgatatcgatctctacgaggtcaacgaagcgttcgcgccggtccccctggcctggctgcaggcgctgggcgccgacgcggatcgcctgaacgtcaacggcggcgcgatcgcactgggccatccgctgggcggctcgggcaccaagctgatgacgacgttgatccatgcactgcatcagcgcggcaagcgctacggcctgcagaccatgtgcgagggcggcggcatggccaacgtcacgatcgtcgaa

SEQ ID NO: 32400 - DNA, 1119 bp, Ralstonia metallidurans
atggatttcaaactcagcgaggaacatcaggctttcgcggactcggttgcccgttttgcgcaggacaaactcaaggatggcgcgctggcccgggcacattcgccccactacccctgggacacggcggcgctgctcgccgagcaggggctgctgggcatcgccttctccgaagaagatggcggccagggcggcacgctgatgcacgcggtgctggcgatcgagcaaatcgcgctggtttgccccaggagcgccgacatcgtccaggctggcaacttcgggccgattcggacgttcgtggaatacgcatcgcccgagcagaaagcgcgatacctgccggacctcctggctggccgcaaggtggtctcgctgggcatgagcgaacccgatgccgggtccgccgtgaccgagttgaaaaccagcgcgcgcctcgacggtgacagctacgtcatcaacggcagcaaggttttctccacgcacagccccgacgccgagcttttcctgatctatgtacgcttcggcccgggcgtcggtggcatcggctccgtgctggtcgagcgcggcacgcccggcttccaggtcggcgagccatcatcgttcatgaacggcgagcagtggtcgcagctctacttcgatgattgccgtatcccggtggaaaacgtgctgctcggaccgggcggtttcaagaagcagatctcggggttcaacgtcgagcgtctgggcaactcgtcacgcgcgctggcgctggggcgccacgcgttcaacgtggcccgggaacatgccatgacccgcaagcagttcggccgcgagctctgcgaattccagggcattcagtggaagttcgcggatatggcgatgaagctggagcaggcgcagatgatgctgtatcgcgccgctctcgaaggcgagcacggactgcccagcgcgcagagcacggctatggccaagctggcctgcaacatggctggctgggaggtttccaatgaagcgctgcaggtgatgggcggcatgggcttcagccaggaatctctcgtggagtactgcgtgcggcggacgcgcggctggatgatcgccggtggctccatcgaaatcctgaagaaccgcgtcgctgaaggcgtcttc

SEQ ID NO: 32401 - DNA, 1812 bp, Ralstonia metallidurans
gtggcgaagaagcccaacatcctgttcatcatggccgatgacctcgggtactcggacctgggcgcgttcggcagcgagatccgcacgcccaacattgacgcgctggtgcgcgatggtcgcatcctgaccaatcaccacaccgccgccgtgtgcgcggtgacgcgttcgatgatcatctccggcaccgaccatcatctggtcgggcagggcacgatggcgaacagcgaccccaattacgtggacgagaacggcaagcccattcccggctacgagggctacctgaacgatcgcgcgctctcgatcgcgcaactgctgaaggacggcggctatcacacctacatggccggcaagtggcaccttggcagtggcttgcccaacgcaacgaaccagggcgcggcggttggcacatcggcgccggggcagacgccggtctcgtggggtttcgagaagagctacgcgctgctcggcggcggcggggatcacttcggccgtaacggcgcaaccgcctacgtggaggacgatcactacgtcacgcccaacacgaccagcttcttctcgtcggacttctatacctcgacgatcatcaagtacatcgactcgagcacgggcaagaacaccgatggcaagccattcttcgcctacctgacctaccaggcgccacactcgccgctgcaggcgccggcaggctatatcgatcgctacaagggcgtctatgacgcgggctacgagccgatacgcgccgcacggctggcccggcagaaagcgctcggcctgatcccggccgacttcacgcccaatccgggtcgtgatgaaacactcgccgtcacgccggccacggcgaactggggcacgcctcaggcgtcgtacgtcagcgccacgcgcagcgtcgcgcaaggcggtgtggatacccgtgtgatgaacgcgaacaagaagtgggacagcctgactgcggaccagaagaaggcgcaggcccgctacatggaaattttcgcggccatggtggagaacctggacgacaatgttggccggctggtgcagcacctcaaggacattggcgagtacgaaaacaccgtcatcgtgtttcagtccgacaatggccccgaagccagctactacgagttcagcggcaagtacgaccaggactacgacacgaagaacgccgatccggccgtgttccccacgctcggcacgccggcctacaagggcacggccacgatcgactacggccagcgctgggcggaagtcagcgccacgccattcaagctgtggaagtcgttcccgtcagagggcgggcactccgtgccgaccatcgtcaagttggccggcacggcatccgcgccgccgcagagcagggtgacggccttcacccacgtggtagacctggcgccgacgttcctggacctcgccggtgtcagcgcaccgaccaagccggccgcgccgctctacgacagcaaggggatcgaccgcaatgcgggcaaggtcgtgtacgacggtcgcaatgtctatccgatcaccggcctgtcgttgctgccgacgctgcagggcaagacaaccggcccgtcgcgcaccacgttctccgaggagctgtacggtcgcacctatgtctatagcgacaactggaaggccgtatggatcgagccgccgttcggcccggcagacggcgaatggacgctctacgacattcgcgccgatcgcggcgagacgaacaacctcgcagcgcagcgcccggatgtgctgagcgacctgaagggcaagtggaacgactacgccgcgcgcgtgggcgcggtgctgcccaaggtaccgggcatgatc

SEQ ID NO: 32402 - DNA, 2574 bp, Ralstonia metallidurans
tacagcattgcctccgcaactgcgggcggtgcggaggccatcgccagactgccgtactgcctgcgcgtgctggccgagaatgtgttgcgccacatcgggaccaacgacgtggaagaggcggacttctgccgcttgcttgcctggcacccgagttctggcgatgtgatccccgtaccgttccatcctgctcgtgtgctgatgcaggactacacggggattccagcgttagttgacctggcagcgttgcgcgatgcgatagctgatcttggccagcccgccacgcggatcaacccacggattcctgtcgatctcgtcattgatcattcgctcatcgtggaccaggcaggtcacccgggggcgctgacctacaatcttggccgcgaattcgagcgcaacacggagcgttaccggctggcgaaatgggccaccgcggcactgagcaatgtgcgcgtcgtaccgcctggcaatggaatactgcaccagatcaaccttgagcatatcgccggggtcgtctgtactcagcaagcgggcttacatgttgtcgcctttgccgacacgatggtcggcactgacagccatagcaccatggtcaacggcatcggcgtgctcggctggggcgtgggtggcattgaagccgaagcggcaatgctcgggctaccaatgactgtgccgctgcgccgcgttgtgggtgttcgcctcagcggcagtctgcaggccggcgtgacggccaccgacctcgtcctcacgctcacgcagcgcttgcgcgcattcaacgtggtcgataccctggtcgagttcttcgggccgtcgctcgcggcgcttgccgtgacggaccgcgccacgattgccaacatggcacccgagtacggttccaccgcagctttcttcccgatcgacgcggaaaccctgcgttacctggcagcaagcggccgggatgctgcgcaggtggcacttgtcgaagcctatgccagggcgcaaggcctgtggcgttcggctgacgcgagggaacccgagtacagcagcgtgctcgagttcgacctgtcgagcgtccgtccgtgtgccgcgggtccgaaacgccctcaggaccgtgtcgaactggacgccatcggcgacagctttcgcgcggcctttccgtcggcagcccctgcgcgggaaacgctttccgacggcgccgtggcgattgccgctatcacgagctgcacaaacacctccaatcccgcggtcatgattgccgcaggcctgctggcacgcaaggcccgcgcacgcggactgcaagcgcgcccatggaccaagacgtcgttgacgccgggttcacgcgtggtcggcgcgtatctggaagccagcggcttgcaggcggacctggacgcgctgggctttcacgttgccggctatggttgcgccacctgtggcgggaactcgggccagctcgatgaggcggtcgagcagcagattcgagacgagaacatcgtcgtcactgcggtgttgtccggcaaccgcaacttcgaggcgcgcattcatccgatggcccgcgccaactacctgatgtcaccaccgctcgttgtcgcctatgcgctcgccggcaacattcaggttgatctgacgcgtgagtcgctgggcaacggtaacgacggccagccggtctacctccacgagatttggccgacggacgcagaggtgcagaacgttctcagaaccgtcttgacccctgacctgttcgagacccagtacagccagctgttcgacggtagtcccgcatggcgcgcacttgaagcgccatcatcggcgctgttcccgtgggactccagcagtacgtacatccgcaagccaccgttcctcgatcactgcgacggcagtgccaccgcgcctgtggaagatatcgtggacgcacgaatcctgctgatgctcggcgacagcacgaccaccgaccacatttcgcccgtcggcaacatcccagccgacagcccggctggcttgtacctgcgcgaccacggcgtcaagcccgtcgatttcaatgcatatggttcccggcgcgccaaccacgaggtcatggtacgcggcacctttgccaacatccgactcagtaacgagctggtccctggcgtgctcggcggccagacgaagtgcctgccgggaggcgagatcatgccaatccatgacgcagcgacaaggtatgcggcgcagggcgtgcctctgttgatcatcgccggccgcgagtacggtacgggttcgtcacgggactgggccgccaaaggtacgaacttgcttggcgtgcgtgcagtcattgccgagagcttcgagcgcatccatcgctccaacctgctcatgatgggtgtgctaccgctcgagtttccatccggtgtcacgcgcaaaaccctgggcctcgacggcacggagacgttcggcattgaagcgatcgacgagcaagcgcgcccgggtgcaaccgtacgggccaccctacgccgcgctgacgggtcttccgtcgtgttggagctcgattgccggattgacacggcaaacgagttcaaggtctggcgtgctggcggaatgatgcgcttcgtgctgcaccagctgtca

SEQ ID NO: 32403 - DNA, 1277 bp, Ralstonia metallidurans
aaattcgaaacgcgttcggtccacgcgggatatagccctgaccctacgactaaggcagtggcagttccgatctaccagacggcggcctacgccttcgacaatgcgcagcatggcgcggacctgttcgatctgaaggtgccggggaatatctacacccggatcatgaacccgacgaccgacgtgctcgagaagcggatcgcggcgctggaaggcggtgtcggggcgctggcggtcgcatccggccaggcggcggtcaccgcggcgatccagacgatcaccgaggccggcgacaatatcgtcgcttcctcggcgctctacggcggcacctacaatctgctggcgcataccatgccgcagtttggcgttacgacacggttgccgatcaccggtgcccggaaagcttcgaggcactaatcgacgatcggaccaaggctgtgtttgtggagtcgatcggtaatccggcgggtaacgtgacggatatcgcgaagattgcggcgatcgcaaagcggcatggtgtgccagtcatcgtcgacaataccgtcgccacgccctatctccttcggccgttcgagcatggcgccgatatcgtcgttcactcgctgacgaagtacctcggcggtcatggcacgagcattggcggagccatcgtcgattcgggcaagttcccgtgggcgaagtacccctctcgctttccgaagctcaataccccggatgccagctatcacggcgtgacgtatacggaagccttcggccccgcggcatacatcggccgggctcgcgtggtcccgctgcggaacatgggcgcggcgctatcgccattcaatgccttcctgatcctgcaaggcatcgaaacgcttggcctgcgcatggatcggatcaacgacaacacgctcgcggtcgcccggcatcttagccagcacgccaaggtgggctgggtcaactacgcggggctcgaggacaaccaggactacgcgctcgccaagaagtacatgaatggcaaggcttcgggcctgctcacgttcggtgtcaaggccgccgatggcgatgggcgggcggctggtgcccggttcctggatgcgctgcagctgttcacgcgcctggtgaacatcggcgatgtgcggtcgctggccacgcaccctgcttccacgacgcatcgccagctttccccggaagagttggcacagacgggcgtgggactggatacggttcgcctctgcgttggcatcgagcacatcgacgacctgctggctgatatcgaccaggcgctgcaggcggta

SEQ ID NO: 32404 - DNA, 1155 bp, Ralstonia metallidurans
atgttcacaccctgtcccaccgaacgcagccgcgacatcgcggatcgcgtcgagcgcttcgtgcgcgacgtggtcgcgccgtacgaacaagatccgcgctgcagcgctcacggccccaccgaggaactggtgctggagcttcgcgccaaggcacgtgccgctggcatcatgacgccccacatcctgcccgacggcgggcacctgagccaactcgagaccgccgccgtgctcaagcgctcgggcctgtcgccgcttggtccggtcgccgtcaacaccatggcgcccgacgagggcaacatgttcctgctcggcaaggtggccaccgccgcgcagaaggcgcggtttcttgagccactggtgcgcggcgaggcacgctcggcgttcttcatgaccgaaccggcggaagagggcggggcgggatcggacccctcgatgctgagcaccacggcagtacgcgacggcaacgactgggtactcaacggtcgcaagaagttcatcaccggcgccgagggtgcccgggtgggcatcgtgatggcgcgtaccggcgacggcgagcgcgcgcaagccaccatgtttctggtcgaccttccgcatcccgccatccgcaccgagcgcgtgatcgacacaatcgacagttcgatgcccggcggccacgcgcaagtgctcatcgatggattgcgcctgccggccgatcaggtgctgggcgaggtcaacgaagggttccgctatgcgcaggtacggctgtcaccggcccggctttctcactgcatgcgctggttcggcacggtcacgcgcgcggacgagatcgcgcgggcctatgccaccacgcgcaaagcgttcggcaagctgctgatcgaccacgagggcgtgggcttcatgctggccgataacctgatcgacctgcagcaggcggcgctgatgatcgactggtgcgcgggtgtgctcgacaccggctcggctggcacgacggaaagctcgatggcgaaggtggccgtctccgaggcgctgttccgtgtggcggaccgctgcgtgcagattctgggcggcaatggcgtttcccgcgacactatcgtcgaccaggccttccgcgagttgcgtgcgttccggatctacgacggcccgactgaagtccacaagtggtcgctggcaaagaag

SEQ ID NO: 32405 - DNA, 732 bp, Ralstonia metallidurans
ctgctcggactggacggcaagcgggcgctggtcaccggcgcctcgagcgggctcggcgcgcattttgcgcaacggctggccgcgcacggcgcggaagtggtgcttgcggcacggcgagtggatgcgctgcaatcggtcgcgaaacagctggagccgtatggccgcgcccgttgcgtggcgctcgacgtcaccagcgcatcgtcgcgcgcggcgatggtggaagaagcgggccccatcgacatcctggtcaacaacgccgggctggttcgcgagggcgctgccctcaaacattccgaagaagactgggacgtggtgctggacaccaacctcaagggcatgttcttcatggcgcaggcgctggcctcggggatgcgcgaacgcggcggcgggagcatcatcaacgtggcgtcgattctcggactgcggcaagcgggcggagtcgtgtcctatgccgtgtccaaggcaggcgtcgtgcaactgacgcggacactggcgctggaatgggcacgccacggcattcgcgtgaatgccctcgcgcccggatacatcgatactgaaatcaatcacgacttctggcagaccgatgccggcaaggcgctcatccaacgcattccgcagcgccggttggggcagcccgatgatctcgacggcccgctgttgctgctggcatccgatgcctcgcgctacatgacgggcgctgtgctgccggtcgacggcgggcatctggtcaat

SEQ ID NO: 32406 - DNA, 1620 bp, Ralstonia metallidurans
gatgcgatcaatggcgtgccggccgacgcaaacatcggctatacgtggaagacctatgccgagcggctggaagaagccggcgtgagctggatcagctaccagaacatgcccgacgaatggggcgacaacatgcttggcgcgttccagacgttccggcgcgcgaacctggcatcgggctttccggtctccagcggcggctcgccgggcaagccctacaccaataccggccaggcagtgccgtatcacgcctatgacgccgccaccgacaataccgccaatccgctgtacaagggcgtggcgaacacgctgccgggcgacaagccggaccagtatttggacgctttcaggaaggcggttctcgacaacaagctgccgcaggtgtcgtggatcaacgcaccgtcgatctactgcgaacatccgtcgccatccagcccagtgcaaggcgcgtggttcctgcaggaggtactggacgccctgactgcgaatccggacgtctggagcaagaccgttctgctgatcaactttgatgagaacgacggctacttcgaccatgtgccctcgccgtcggcaccgtcgaagaacccggatggcacctatgcgggcaagaccacgctggcggatgcggacctgaccgccgagtacttcacgcaaggcgcgccggccggcagcacgggccagcccgcgccggatggccgcgtcttcggccccggtccgcgggtgccgctttatgtgatctcgccgtggagccgcggcgggtgggtcaattcgcaggtgttcgatcatacgtcggtgctgcgcttccttgaggcccgattcggcgtgcgcgagccgaacatcagcccgttccgccgcgcggtctgcggcgacctgaccagcgcgttcaacttcaagacgccgaacaacgagcccatgcccacgctgggcggccgcaccacgcgagagcttgccgacaagctgcgcgcggaccagcagaagctgcagcaggtgccggtgccacgcgacatgcagttgccgctgcaggccgccggtgcgcgtccgtcgcgggccttgccgtatgagctgcataccagcgcgcgttgccgtgcttccggtcaggtcgaactggtattcgcgaactcgggcacgcaggctgccgtcttccacgtgtacgacggtttcaagcttgatcgcatcccgcgccgctatgccatcgaggcgggcaagaccttgtcggacacctgggacgccgcacgtgacaacttcggcaagtacgacctatgggtgctgggcccgaacggcttccatcggcatttcaagggcgacctgaaccgcctgaccggcacgcaggccgcgccggaagtccgcgtgtgctacgacgtagccaatggcaatgtctacgtggacctgatgaacaagggcggccagccgtgcgtgttcaccgtgacgccagtggcctaccgccaggacggtccgtggaccgcgaatgtggccgccggcgccagcaccacccagcactgggagctgcaggccagcgggcagtggtatgacttcgccgtgacgtgcagcagtgatgcgtcgttctatcgccgcttctctggccgtgtggagactggcaagcacgccaccagcgatccggccatg

SEQ ID NO: 32407 - DNA, 753 bp, Ralstonia metallidurans
cgactggcggggcgtcgcattctcgtcgtcggggccggacagcgcgtcatcgatgatccggacccgcccgtcggcaacggccgcgcgatctcgctgctgtttgcgcgggaaggcgccacgctgacctgcgtcgatatttccgaacccgccgtggcggagacctgcaggcaggcgaaggacctgggtgcgaccgtctttgccgaggtggccgatgtcgaacgcgccgagaccatcgcaccgctagtcgagcgcgcagctcgtcagatgggaggtctcgacggcctggtcatggtggtgggcatctccagcgccttgccgatcgataagcaggacgccaatacgtgggaccgcgagtacgccgtcaacgtgcgcagcaacatgctgttcgcgcagcaggccatgcgccatatggagccgggtagttccatcgtgctgatgtcctcgctggctgccttgcgcaacagcagcggcaacccggcctatgagtcgtcgaaggccgcccaggtggcgctggcgcgttccattgcgatggccgggcagaagcagggcatccgctgcaacagcctgttgccgggactcatggacacgccgatgggccgtgccgccaccgcgcgacggcccgcgcgcgtcggtggggcgctgccgttcggccggcagggcaccggctgggaggtggcgtatgcgtgcctgttcctgatgtcgcacgaatcgtcgtacgtcaacgcgcacgcgttgcaggtggacggcggactg

SEQ ID NO: 32408 - DNA, 1146 bp, Ralstonia metallidurans
ctcaagggacaagttgcggtgatcggcattggcgagagtcagtactatcgccacggcaaatcgcccgacagtgaattcaagcttgcactgcaggccattctggctgcttgcaaagatgccggcatcgatccgcgcgagattgacggcttctcgtcgttcagtgatgaccgtaacgatccttcgcgaattgccgctgcactgggccttcccaggcttagggcgacgacgatgcaatgggggggcggcggtggcggctgctgtgcggcagtggccaatggcgcagcttccattcaggccggcttggcggattgcgtggttgtcttccgctccctcgctcagggccagtttggacgctttggtcgcacttccggcgtcgatacgatttccggggaaaaggcatacctgatgccttacggggtgctcacgccgcctcagcgttttgccatgcgagcacgacggttcatgcatgaccacggcgtccggcaggaagccctgcgcgccattgcattggcgtcctaccaccacgcgcagtccaatcctcgggccgttatgtacggaaagccgctgagcgaggagaagtacgaccagtcgcgatggattgccgaaccgttccatctgtttgactgctgcatggaaaatgatggggctgcggccgtgatcctcgtatcggcagaacgtgcgaaggattttccgggcaaagcggcgtacatcctcggagccgccgcaggctccgggtatcgaaccggcgccatcccccataactcgccgctctatggcagcgccagcttcgacactgtagcgcccgacctattcaagatggccggcatcagccataccgatgtgggtgtagttcagagctatgagaatttcacgggtggcgtggtgatggcgcttgcggagcacggattcttcaagccggacgaggcgaacgagttcctgaccctggaaaaccttatcgctccgtccgggaagctcccgctaaacacgagcggaggaaaccttgcagagtgctacatgcatggcttcgaactcgtccttgaagctgtccgtcaaattcgcggtacatcgtgcaaccaggctccgaagaacgatgttgccttggtaatcggtgggccgatggtaacccctgtcagcaatcttttgctg

SEQ ID NO: 32409 - DNA, 1050 bp, Ralstonia metallidurans
atgaagagctacgacatcgtggagtggggcaagcctctccaggaggttctgcgagacagaccaaagccggtcggtactgaggttctcgtaaaggtgcaagcctgtgggatttgccatagtgacctccatattcgggatggcttgctggatcttggcaatgggaagcacatttctttcgagagtgttggggtaaagctgccctttacgatgggccatgagatcgttggggtcgttgcagaggctggcagtgaggcgtcagtcaaggcggggacgccttgtgttgtctacccgtggcacggttgcgggacttgtctgaattgcaccaacggccgtgaagttgactgtgagagtgggcgggcgctcggtacccgtaagccggggggatactctgactacgtcgtggtaccgcatgagcaatacctcctggattacggaaatctcgatccgctgcttgcagctacctgtgcctgttctgggctaacctcgttcagtgcattgaagaagcttcctcccatgctcgaggcagacacgctagtactaatcggcgctggcgggttagggctcgcggctcttggtttggcgccgcagctcacttctgcgcggctagtggtcgcagacatcgatgacgaaaagctcgcccgcgcatcagcggcgggggcacatgaggtggtcaatcttcgctccgaaaacgcggctcgggatttgcgaaaagcagcgccaaatgggattcgagcgattgtcgactttgtcggctcggcgcagacgacgggcgtggcgctggagagtgtggcccgcggaggcaccgtcgtcgtcgtgggcctttttgggggcgccatctctttgtcgactgcacttttgcccatgcggaacgtgactctgaggggctcctatgtcggctcggtggaggaaatgcgagcgcttttggatttgctacaagagaaaggaaagggttcgccggtcaatctcaagtcgctcccaatgtctgcggtcaatgaggctttagaagagcttgcacaaggtcgggttgctggccgtttgctggccatccct

SEQ ID NO: 32410 - DNA, 1323 bp, Ralstonia metallidurans
gccgaaacgcttgaagtcattaacccagctaccggcgaggcttgcgccattgcgcccgtggcttctttgcgacagcttgacgaagctgtcgacgctgcccggcgttcgcaacaaagctggggtggcttgccattgacagagcgcagaacggctctaaaggggttagccacgattcttcgggagcatgttgcggagttggctgcgctgctgacgctagagcaaggccgacctctcgcccagactgaagcggaagtgatgcgtgccgccatgctgctcgaggccatgctcacgattgacatcgacgacgagattcttcgcgaagatgaatctggtcgggtcattctgcaacacaagccgattggcgttgtcggtgccattgccccttggaacgttcccatcggactcgccgttccgaagatcacccatgcactctacgctggcaatactgttgtactaaagccgtcccaatacactcctctggccacgctgcgacttggtgagtacgcatcgaacctgttcccccctggagtgctgaacgtcttgaacggtggaaatgatcttggggaaaggatttgcacgcacccggacatcgccaagatctccctgactggatctgtgccaacagggaaacgagttatggcgtccgctgcagcctcgctgaagcgcttaacgcttgagctaggtggaaacgacgcctgcatcgtccgccaggatgcggacgttgacaagattgcacccgcgctgttcgctgcggcgttcatcaacagtggtcaggtttgcatggcgataaagcgccttttcgtacatcaggatcttcatgagcgcctggttgaaaagctgggaggcctagctgctaaagccaaagtaggcgatggctttgactcgacgagccaaatggggccggttcagaatcgtgcgcaatacgagtcggtaaaagcagttctggccgaagtggccgcagacccggcagcaatcattgtcgcgggtggcgaagcgttgagccgccagggattcttcattgctcccacagtcgtatcgggcgtcagagaaggaaattcccttgtcgacaaggagacgtttgggccagtgcttccagtcctatcttttcaaaccgatgaggaagcgatcgagcgtgcgaatgccggatcgatgggattgggtgcgtctgtgtggggcaatgatctcaaaatggcagagcacgtagcgcggcagttggtagctggcaccgtatggataaacagacatgtgggcgttgaccccttggtgccgtttggcggagcaaaggaatccggtcttggacggcagttcggaaaagcagggttg

SEQ ID NO: 32411 - DNA, 1134 bp, Ralstonia metallidurans
gtggggcgccaccaaactgcagatgatgcagcgctccagacattggagcacgaaatcatgacccgccttgtcgtggatgccgtgaaagatgcgggggtcgacaagcaggatattcaaagtctggtgttcacgctccctcgtccatacacgcgccagaagtactttcacactttcctcatgggccaacttcggctgtcttgccggggcaacgtgatggaagtgatgggtaacggcatgactgctgctctggctttcgaccaggcctgcaatgacatcatgctgggcaggtctgaggtgtcgcttgctctcggtatcaacatggagagcgcggtatcggccgcagaacacatgatgagcagcatgcggacgaccggcgatgtcgactttcacacatcagctggcttcacgcccatcgcttggtatgccatggacgcgatgcggtatatgcatgagcacggagctacgagggaggaactgtgctccgttgccgtgaagaaccgttttcacgcctccatgaatccgcttgcgcagtatcgcaagccggtgacgctggaagaagtcgttcagcagcgtcccatcgtcgagccgctgggactctatgacgttccgccgcgtggcgatggtgcagcgtgtctggttctggcaagtgaggatgtcgcacgcgagcttggccgcccatatgtgctcgtaaagggccgaggattcttccatgatggcagccatcagatcagtgatgtccccaacgacatgattgcattcgagtcggcgagacaggcggcttctgtcgcctatgaacaagctggcatcagcgccaaggacgtcgacgtcgctgagttgtatgcgccttgcacgattgtcgaagtgctggtgagtgaggctattggacttattccgaaggggcatggtgcgcgcgcggcattcaatggagagacacgtctcggcggccatattcctatctcgacctcaggtggtttgacatcccgcggccaccctgcgtacgtcacctcgctctacaactacgtggagctcgctgagcaactgcggggacgggcaggcgagcgccaagtcaagaatgcgcagttcggtctggctacaggagaactcggcaactacaacgcggccatgattcacgtt

SEQ ID NO: 32412 - DNA, 1122 bp, Ralstonia metallidurans
ctgactgaagatcagcggatgatgcgcgaaggcgtcctggacctgctcaaccgggtcctcccgtgggagaaagtccggaagatggacgaggcccgcgagtttccgcttgaagcctatgaggcactggcagatgctggttacatcggcctgttttatcccgagcacctaggcgggatgggcggttcctaccgcgacatcactgtcttgctcgagacgcttggctactactacacgggaatcgcccaagccattacgacttcggcggtctatgccggtatgcatatcgcgaagtttgggacgcccgagatgcagcaagagctgattccgaagatcatttctggcaaggccaagctggcactgtgcatgtccgagcctggcacgggctccgacgtggcaggcctcaagacctacgccgaacccgccggtgatgagtacatcctgaacggcaataaggtctggatcacctgcggccatgtggctgactactttgtcgtcattacgcgaaccgacagggaaggtggccgccatcaaggaatcagcacgctgctggttgatgcaaaggcgcctggcgttaccgtgcgcccgctgcaaatgctggggcgtcgtacgacccatgccaatgaggtcttcttcgacaatgttcgagtgcctgcgaagaacctgttcggtggcgaaggccgtgcctggaaaaacatcatgagctgcctcggcctcgagcgccttggcttggctgcaatctcggcggggcactgcttcaagattactgagtatgcccgcgactatgcgaaggagcgcgtgcagttcggcaagccgatttccgatttccaggtcatccagcacaagctggcggacatgctcatcctgtccgagactgcacgtcaggtagtctaccgcgcagccgacgtgctcgacgccggccaggctgcagttaccgaagcatcgattgccaaggtggttgcaagcgagaacaatttcaagtgtgcagacatcgggatgcagatcatggcaggtgctggctactcgatggagtacgacatgcaaatgttcttccgcgactcccgcgttggtcctatcggtggcggcaccaacgagattcagcgcaacatccttgcgaaacaaatg

SEQ ID NO: 32413 - DNA, 1158 bp, Ralstonia metallidurans
atggatctacgattgtcgcctgcacaagaagcctttcgtgcagaagttcgtgcctttattgaagagaggctgcctgaggacatccgtgctcggctgcgcgcagggcacccggcccaaaaggaagacacggtgacgtggcagcggattctcaatgagcgcggctgggcagcgccccattggccgcggaagtttggaggagccgagctcgggcagttggaaaggctcattctgcttgacgagatgttccgcgcaccgacaccgcttcctcaggtgttcaacgtcacgatgctggggccggtgctgatgaagttcggtacgccggagcagtgcgagtacttcctgcccaagctagccaatctcgacctctggttttgccaaggcttttccgagccaggttcgggctcggatctggcttccttgcggaccgccgccaaacgagacggcgaccactatgttgtcaatggacagaagatctggaccaccacagctcattgggcggattgggtgtttgcacttgttcggaccaatcccgaggcgaagaagcaggaggggatttcgttcctgctgattgacctgaagtcgcctggcatcacgatccgtcctatccgctccattgatggcgaccatcatttgaatgaggtcttctttgatgatgtccgggtgcccgtcgagaaccttgtgggcgaggagaacaagggctggaactgcgcaaagttccttcttggaaacgagagaaccggcattgccaatgtgggcctgtgccgagagcgtttggattacgcgcgcgagctcgcagatcgcactgttcagggtgaaaacaggctcatcgacgaccccaagctgcgatcggagatcgcgacgctggacgccgaagtacgagctctagaggtaacgaactggcgttttcttcttacccccaatgagcaggcgcgcatccccgcgttcgcatcggtgctgaaactcaaaggtgtcgagctgcaacaagacatcaatgccctgctggctcgccttgccggaccacagggcttggaaaagcgcggcaagagggatacggaccgtggtccgctaacgccacgctatttctattcgcgtgctgcaagcatctatggtgggacgagtgaagtgcaaaaggacatcctggccaaggcaattgtagga

SEQ ID NO: 32414 - DNA, 1056 bp, Ralstonia metallidurans
aatttcgaactgaacgaggaccagcgggctctccaggaaagcgttcatcggctgctaaacgaacgctatggatttgagaatcgccggcaatacgtcgaagctgacgccggccacgacgagaaaacttggagcgcgctgtcagaacttggactgacggcgctgttggttcccgaggacctcgagggattcggtgggggcgctgtcgacctgtttccggttatgcaggagctcggggcagtcttgtccctggagccgctccttgcaaccaatttcctcccggccacggcgcttcgcacctacgcgggggacgctcgtgccaaggaagcactgcagtccattgcatccggagagcgtcggattgcgtgggctcacgatgaagtcgaggcgcgtcatacggattggtggatcagcactagagcaaccaagaccggcgaaaagtggctgcttagcggtcaaaagttcaacgttgttggggccaatgatgcccatcaatacttggtcagcgcgcgtgtccaaggctccactgaggacaccgacggttgcgcgctgttcctggtgaatgccgatgcaaaggggctgagtgttcgcaactacaagctcgtggacgatacgcctgccggtgagctgacctttagcaacgtgtcggccttgccgctaggcgaggctggggacggacatcaatcgctaagagccatcgagagcgcgttggccatgggcattgccgccgcctgtgcagatatggtcggcgcagcaggtgcagcgttccaactcgccatcgagtacgtgaatacgcgaaagcagttcggaaggctgatcggcgagaaccaagcgctccgccatcgcgcttcggaaatgcttgtgagcctggagctcgcgaaaagcatggccattgcggcggcggttgcggtggacgatcaagactcggaaggtgcagagctcgatttgcaccgagcgaaattgtcagtagcaaagcatgcccgggcggtggctcatggtgcgattcagctgcacggaggcattggcatgactgaggagtacgcggtaggacactaccta

SEQ ID NO: 32415 - DNA, 729 bp, Ralstonia metallidurans
cgcaccatcgtggttacgggcgctgcacagggtatcggcaaggcagttgtcgaactcggcattgagctcggcgcaaacgttgtcgccgtggatctgaacggtgaaacgctgaacgctgccctcgctccgttgcccgcggagcgcgtgatggccgtcgcaggcagcgtcgcagattcggcgcttgcgacccgcgcagtggctgacgctgtgtcgcgattcggcgccgttcacggtctcgtcaacaatgccggcatcatccgtcctgcaatgatcgataagatgactgaccagcaatggacggatgtcatcgatgtacatctgagcggttcgttctactggacccgcgctgttggtcaacacatggtctcgcgcgcaaaggacggtgacaagaccggcggctcgatcgtcaacatttcgtctgacgcagggcgcaagggctcgattgggcaaatcaactatgcagcggcaaaggcaggcatgctcggaatgacgatgaccgccgctcgcgaatggggccgctacaacatccgttccaactccgtctgctttggcgtggttgaaacgcctatgacggaagtcgttcgcggcgagaagttccgcgacggcatgctcgcgcaaatccccctgggccgctggtcgactcccgaagaggtcgtgaagactgtttgtttcctgctttctgacggttcaagctacgttacgggccaacacctcggggttaacggcgga

SEQ ID NO: 32416 - DNA, 1350 bp, Ralstonia metallidurans
tcaatcgatacaccttcgacgattgaggtagttaaccctgctacgggcgaagtatttgcccaggctccagactgtaacgccgagatgctcgatgccgcagtgtccgccgcccgtaatgcgctcccaagctgggcgaagacgacatgggccgagcgtcaggagcttctaggaagaatcgggtcggtctacctggcgcaccaggaggagttggcaaggctgctgactgcggagcaaggaaagccactgtctcgagcgcgaaccgaggtagccggcgcagcatactggtttgcggagttcgcgcggatgacacttcccgatctcatcgtgcaggataacgaccaggcgtacatcgtcgtccgtcgagttccagtaggtgtggtcggggcaatggtgccttggaactacccggtaatcctggccgcgtggaaaattgctccagcacttctgacgggcaataccctagtactgaagccatctccgtttactccgctcgtaacacttcgggtaggggagctcatgcgtgacgtgttgccgcctggtgtactaaatattgtcagtggcggcgattcgttgggtccccgcatgtcggcgcatcccggtttcgacaagctttcgtttactggctcgacagtgacgggaaagcgggtaatggaaagtgcgtcaaaggatctcaagcgattgacgttggagctgggtgggaacgatgccgcgattgtcatgccggacgtcgacatcgaagaggtcgccacgaagttgttctggggcgccttcgtcaatagtgggcagatctgtatcgctgcaaagcgcgtctttatccacgaatccatctacgacaaattctcggaggtgctcgtacggttggcaaaatcaacaccgatggggccgggcgatcgtgatggagttgagcttggcccagttcagaaccgtgcacagtttgaccgtctgtgtgggttgctgcaggactgcaaggaccgcggcttcaacttgctgacggggggggaagtcgagaaggggccgggtctgttctttcccgtcacactcgtggataacccgtccgacgactccagaatcgtcagggaggagccgtttggcccgattcttccgctgctcaagttcagatccattccggaagtaattgagcgagcgaatgcctcggaatacgggctcgcgggctcagtatggtgcagggacgagagtatcgccatggacatcgcacgtcgtcttcagacagggacggtttggatcaatcagattcaagccgttacgcctcatacgcctatggccggtcacaagcagtccgggctgggcgtcgagaatggggaagagggcctggcgagctatacgttaccg

SEQ ID NO: 32417 - DNA, 783 bp, Ralstonia metallidurans
caacttgagaaaaaagtcgttttggtaacgggtgcggccagtggaatcggacgtcagacttgcgtcacgttggcagctgctggggcgcgtgtcttcgcaagtgatctcaatgaagagggtgccgcgcagaccgttgcgctcattcgcgacgctggcggtgtcgccgacagcctggcgcatgatgtcactgaggagagtgcgtggcatgcagtcgtgcagaaaattgagtcggcgtctggccggctcgatggcctggtcaatagcgcagggctaatggttgtccgaccattcctggagaccgacctagcattgtatcgccgtcagcaggccgtcaacgttgacagcgtgtggctcgggtgccaagcagtctgcaagttgatgacgaaaacggcggccgaatttgggagcgcctccatcgtgaatctctcttctatccttggcctgaaaggtggaagcatgcactcggcgtactgcacgtcgaaaggtgcagttcgcttgcttacgaaggcactcgccgtcgagctcggaagatcgcggattcgggtcaattcggtccacccggggctagttgagaccccgcttgggttagggtccatgaaggacatgattagccacggggtcccgctgggttctctggacgccgccgtcgacatggttgcacaccgcacgcctctaggtcgatgggcacaacccgttgacgtggcgaatgtcatcgcgttcctttgtgcagacgagtctcgattcgtcactggcactgagcttactgtcgacggaggctacagc

SEQ ID NO: 32418 - DNA, 1953 bp, Ralstonia metallidurans
tggacgccgtccgcggcattcaccgaaagcagccatctggccgcctatatgaagtggttgcgcggcgcgcgcggcctcgacttccgtgactacgccagcctctggcaatggtcggtcaccgacatcgaagcgttctggcagaccatcgtcgattacttcgacgtacgcttcgacacacccgcgcagcgtgtactggatcgccgcaccatgccgggcgcgcgctggttcgagggcgcgacgctcaactacgcgcagcagatcttccgccacgccggcaccggcctggcacgccagcgcaccgccattcgccatgccggcgaggcgcaaccgctagccgatatcagttgggacacgctggaatcacaagtcgcctcggttgcccacgccttgcgccagatgggcgtcacgcgcggcgaccgcgtggctggctacctgcccaacgtgccggaaacgatcgtcgcattcctggcaactgtcagcgtgggcgcgatctggtcgggctgcgcgccggacatgggccaggtggctgtgatcgaccgcttccgccagatcgaacccaaggtgttgatcgccgtcgatggctaccgatacggcggcaagacgtacgatcgagcgcctgtggtcgccgatctggttgccgcgctgccctcgctgaccgacctcgtgatcgtgccgtcgatcggcagcaacgtcacgcccgagccacatgcccggcgccacacctggagcgacgtgctggcgcacgacgtgccgctcgagatcacgccggtcccattcgatcatccgttgtggatcgtctattcgtccggcaccaccggtatgccaaagccaatcgtccacgggcacggcggcattgtgatcgagcagctcaagctgatggcattccacaacaacctgggcacagatgatgtgtttcactggtacagcagcagcggctggatcatgtggaatgcgcaggtagctggcctgctgctgggcaccaccatcgcgctctacgacggcaacccggcgtggcccgatgccggcgtgctctggcgattcgtggatcaggcgcgtgtgacgatgttcggcgccggcgccgcattcttcaccaattgcatgaaggcgggcgtagaaccggcggagatcgccgatctgtcacgcctgcgcggtctgggctcgacgggatcgccgctgccggaggaagcgtacgactggatctacgggcatgtgcgcgccgacatctggctggcgccgatgtccggcggtaccgacttcgccggatcgttcgtggccggatgccccctgctgccggtctatcagggcgaaatgcagtgccgttgcctgggcgccaaggtcgaagcctttgacgacaacggcaagccactgatcgacgaggtgggcgaactggtctgcaccgagccgatgccatccatgccgctgttcctgtggggcgatgccgacggcaagcgttaccgcgacagctacttcgacacctatccgaacgcgtggcgccacggcgactggattcgcatcacaccgcgcggcggcgccatcatctacggtcgctccgatgcgacgatcaaccgatacggcatccgcatgggcacgagcgagctgtatcgcgtggtggaagagttgcccgaagtgctcgacagcatggtggtcgatctcgaatacctcggccgcgaatcgtatatgccactgttcgtggtgctgcgagagggcatggcgctggacgatgccctgcgcgacaccctgcgcgcgcgcattcgcgttgcgctgtcgtcgcggcacgtgccaaacgagatcctgcaggtgcccggcgtgccgcgcacgctctcgggcaaaaagatggaagtgccgatcaagaagctgctgctcggtcatgcacccgagaagatcgccaaccgcgatgccatggcgaatcccgagtgcctgacgtggtatttcgcgtatgcggaggactacctg

SEQ ID NO: 32419 - DNA, 1344 bp, Ralstonia metallidurans
attgaaccttcgatcttcaaggcctacgacatccgtggcatcgtcggcaagacgctgacccccgaagtggcccgcctcatcggcctctcttttggctccgccgccgccgagcagggcgagcgggcggtggtggtcggccgtgacggccgcctgtccgggcccgatctgctgggagggctcgtcgaaggccttcgcgccgccgggctcgacgtgatcgatctgggcatggttgccacaccgatggtctacttcggcaccaatatcgagctggacggccgccgcgccacgtccggcatcatggtcacgggcagccacaacccgcccgactacaacggtttcaagatggtgctcggcggcaaggcgatctacggtgagcagatccaggcgctgcgccaacgcatcgaggcgggcaacttcgccaagggtaacggcggctacaagctcgtcgatgtgcgccagcaatacctggatcgcatcgtcggcgatgtgaagctggcgcgccccatgaagatcgcgctcgatgccggcaacggcgtggccggcgcgttcgtgggcgacctgttccgcgcgctcggttgcgaagtgaccgaactgttctgcgatgtcgacggccatttcccgaaccaccatcccgatcccgcccacgtggagaacctgcaggacctgatccagtgcctgcgcgatacggattgcgagctgggtctggcattcgatggtgacggcgaccgcctgggggtggtcaccaaggacgggcaggtcatcttcccggaccggcaactgatgctattcgcggaggagatcctctcgcgcaatcccggcgcgcaggtgatctacgacgtcaaatgcacgggcaagctggcaccgtggatccgccagcacggcggcgaaccgctgatgtggaagacgggccattcgctggtcaaggccaaactcaaggaaacgggcgcgccgatcgccggcgagatgagcggccacgtgttcttcaaggatcgctggtacggcttcgacgatggcctgtacacgggcgcgcggctgctcgagatcctgtcgcgccacgccgacgccagcgccgtgctcaacgcactgccgaactcgaattgcacacccgagctgcagctcaagtgcgccgagggcgaggcgttcacgctgctcgacaagatccgcgccaatgcgaagttcgacggcgcgaaggaagtcatcacgatcgacggcgttcgcgtcgagtatccggacggctttggcctggcgcgtccgtccaacaccacgccggtggtggtgatgcgtttcgaggccgacaacgatgccgcgctggcccgtatccaggccgaattcaagcgtgtgatt

SEQ ID NO: 32420 - DNA, 870 bp, Ralstonia metallidurans
cgcaaaggcattattctggccggcggttccggcactcggctctatcccatcacgcggtcggtgtccaaacaactgctgcccgtgtacgacaagccgatgatttactatccgctgtccacgctgatgctggccgggattcgggacgtccttatcatctccacgccggaagacacgcctcgcttctcggaaatgcttggtgatggcagcaattggggcatcaatctgcaatacgcggtgcaaccgtcgccggatgggcttgcccaggcgttcatcattgggcgcgatttcatcggtaacgacccgtcgacgttgatcctgggggataacatcttccacggacacgacctggttcgtcagctcgagcgttcgtcagcacagcagcagggcgcgacggtctttgcctatcacgtgcacgaccccgagcgctatggcgtggtggagttcgatgaaaactttcgcgcggtgtcgctcgaggaaaaaccagcgaagcctcgctcgcactatgccgtgaccggcctgtatttctacgacaaccaggtttgtgatattgccgccgagatcaagccgtcagcgcggggcgaactcgagattacggatgtcaacaagcgctatctggaaatgtcgcagcttgaggtcgagatcatgggacgcggttacgcatggctcgataccggcacccacgactcgttgctcgaggcagcgagcttcatagccacgctgcagaaccgtcagggactgatggtggcttgtccggaggagattgcctatcggagcaagtggatttccgccgagcaggttgagcgtctggcgaagccactgctaaagaacgcttacggcaagtatcttcagcacatcatttcggaaacaatc

SEQ ID NO: 32421 - DNA, 1026 bp, Ralstonia metallidurans
attcttgtcacaggcggagcggggttcatcggcgccaatttcgtgctgaactggctggcccagccaggcgcagacagcgtcgtaaatgtcgacaagctgacatatgcgggtaaccgcaagactctggcgtcgctggacggcgattcccgtcacgtattctcgcaaacggatatctgcgatcgggacgcacttgatcgcttgctggccgagcacaagccgcgtgcgatcgtgcatttcgccgcggagagccacgttgatcgatccatccacggccccgcagagttcatccagaccaatatcgtcggcacgttcacgctgctcgaggcagtgcgtgcctattggaacggcctggacgccgaagccaaggcggcgttccgcttcctgcatgtttccaccgacgaggtattcggctcactcggcccggccgatccgcagttctccgagacgaccgcgtacgcgccgaacagcccttactcggcgtcgaaggctgcgtccgaccatctcgtccgcgcctaccatcacacttacggcctgccggtcctgacgaccaactgctccaacaactacggtccgtaccacttccccgagaagctgatcccgctgatgatcaccaacgcgctttcgggcaagccgctgccagtctatggcgatggccagaacgtgcgcgactggctatacgtcggggatcactgcagcgccattcgcgaggtgttggcgcgcggccgcgtgggtgaaacgtataacgtcggcggctggaacgaaatgaccaacctggacgtcgtgcacacaatctgcagcttgctcgatcaactcaagcccaaggcggctggttcctacagcgaccagatcaatttcgtgaaagaccggcccgggcacgatcgccgctacgcgatcgatgcacgcaagctggagcgggaactgggttggaagccggccgaaactttcgaaagcggactgcgcaagactgtccagtggtacctggacaatcagccctgggttcaggacgtgatctccggtgagtaccgc

SEQ ID NO: 32422 - DNA, 951 bp, Ralstonia metallidurans
cgcaacccgcagctcaccaagaacggcgaactgaagcacctgctgtcgatcgaggggctgtcgcgtgacatgatcacgcacattctcgataccgccagccagttcgtatcgctctccgactccgaccgcgaggtcaagaaggtgccactgctgcgcggcaagagcgtgttcaatctgttcttcgagaactccacacggactcgcactacgttcgagatcgcggccaagcggctgtcggcggacgtgctgaacctgaatatcaatgcgtcgtccacgagcaagggcgaatcgctgctcgatacgatcaacaacctgtcggcgatgtcggccgacatgttcgtggtgcgccacgccagttccggcgcgccttacctgatcgccgaacacgtggccccgcacgtgcacgtgatcaacgccggcgatggccgccacgcgcacccgacgcagggcctgctggacatgtacacgatccggcatttcaagaaggacttcacgaacctgacggtggcgatcgtcggcgacatcctgcactcgcgcgtggcgcgctcggacatccacgcgctgaccacgctgggcgtgccggaagtccgcgcgatcgggccgcgcacgctgctgccgtccgggctggagcagatgggtgtgcgggtcttccacaacatggaagagggcctgaagggtgtggacgtggtgatcatgctgcgcctgcagaacgagcggatgaccggcgcgctgctgccgtcggcgcaggagtacttcaaggcctacgggctgaccccggagcgcctggcgctggccaagcctgatgccatcgtgatgcacccgggcccgatgaaccgcggcgtggagatcgactccgccgtggcagacggtccgcaatcggtgatcctgaaccaggtgacgttcggcatcgccgtgcgcatggccgtgatgggcatcgtggcaggtaataac

SEQ ID NO: 32423 - DNA, 816 bp, Ralstonia metallidurans
gtcgtagtaacacgacccgccgggcagtcccggcaactgaccgaagcgttacaggccgcgggtctcgacgtgctcagttttccgctgctggcgatcgggcccgcggccgatgacgtgccgctgcgcgccgagcttggccggatcgaggactacgcgctggtggtgttcgtgagcccgaacgcggtgtcctatggactggacacccttgctcaggtccagaacgccccgggcggagcccggtggccggaaagcgtgccggtggccgtggtggggccatcgagcgtggttgcgctggcggaacggggtatcaccccgcccgcgtatcgcgtgatcgcgcctgctggcgcgcagggtaatgacacggccggcgacgcagcgcgcttcgattcagaggcgctctggtccgaactcgacacctcgccgggcgcgtttgccggccgcaaggtcctgatcatccgtggcagcggcgggcgcgaatggctggccgatcgtctgcgcgacgccggcgcgtccgtcgaagccgtggaagcctacagccgcacgctgcccgagccgagcggcatgcaatggcaggccgtgcgcgacagcctcaagcccgatgcgccgccgtacgcgtggctgctgaccagttcggaagccgtgcgcaacctggacgggctggcgcgtttgcatctgtcgcctcaggaacacgaacgtctgaagcagatgcagtgcatcgcaccacatgcgagaattgccgcgcaggcccagtcgctgggatttgcccacgtgctgcccgccgcgcccggagatgccgggctgctggccgcatgcacg

SEQ ID NO: 32424 - DNA, 906 bp, Ralstonia metallidurans
atcgcctcgcgcgaaagccggctggcgatgtggcaggctgaacatgttcgtgctgcgttgcaacaatactatccctcctgcgatgtgtccattctcggcatgacgacaaggggtgatcaaattctcgataggaccttgtccaaggtaggcggcaagggcctgttcgtgaaggagctggaggtcgccatgtccgagggacgcgccgacctggccgttcactcgctcaaggatgtgccgatggagctgcccgaaggcttcacgctgacggcggtgatggagcgcgaggacccgcgcgatgcgctggtttcggcgcaattcgcctcgctcgaagagatgccggccggaaccgtggtgggcacttcgagcctgcgccgcgaagccgcgctgcgcagtcgctttccgcatctggtgatcaagccactccggggaaatctggatacgcgcctgggcaagctggaccgtggcgagtacggcgccatcatcctggctgcggccgggctcaagcgactgggcctgggcgatcgcatccgcgcgctgattgcgccggaaagctcgctgccggcggccggacaaggcgccctgggcatcgagatccgtgcggatcgtcccgaactggccgaatggctggcgccgctgaaccatctgcccacgctgctcgccgtatcggccgaacgggccgtctcacgccgcctgggcggctcgtgccaggtgccgctggccgcgcacgcgcgctggcgtgacgccagtcttcaactcgacgccttcgtggcgctgcccgacggttcgcgtcaggtgcgtgcccatgccacgggacccgtcgctacggtagccgacgccgaagcgctcggaaccgccgtcgcgggcgatctgctggcccagggcgcggacggcgtgctggccgcgctt

SEQ ID NO: 32425 - DNA, 2787 bp, Ralstonia metallidurans
ctgcgcgaggacatccgcttcctcggccgcctgctgggcgactgcgtgcgcgagcaggaaggcgatgccgcgttcgacctggtcgagacgattcgccagaccgcagtgcgcttccggcgcgagaacgaccgcgccgccggcaccgaactcgaccgcctgctgaaacgcctgtcgcgcgaccagaccaattcggtggtgcgcgccttcagctacttctcgcatctggccaatatcgccgaagaccagcaccacaaccgccgccgccgggtgcacgcactggccggatcgccgccgcagccgggcagtctgtcgcgcgcgctgcaggccattgacgccgccggcgtgactggcaagcaacttcgcgaattccttgacgacgcgctgatcatgccggtgctgaccgcgcacccgaccgaagtccagcgcaagagcatcctggacgcggagcgcgagatcgcgcgcctgctggccgagcgcgacctgccaatgaccacccgcgagcgcgaccacaacacggcccagctccgcgcacgcgtgaccacgctgtggcagacccgcatgttgcggaacacgcgcttgatggtggtcgatgaaatcgagaacgcgctctcgtactaccgcaccacgttcctccagggaattccgcgcctgatggccgagctggaggaagacatcgccgaagtcttcccgcgccgttccaagaccggcgccacgcccgcgccgctggcgccgttcctgcagatgggctcgtggatcggcggcgaccgcgacggcaaccccaacgtcacggccgaaaccctcgagcacgcggcgcgccagcaagccaccctgctgttcgactggtacctcgatgaactgcacgcgctgggcgccgagctgccgctgtcgtcgctgatggtcgatgccagccccgaactgctggcgctggccgaagcctcaccggaccactccgaacaccgtgcggacgaaccctaccgccgcgcgctgatcggtatgtacgcgcgcctggccgccacctcgcagttgctgactggccatgtcgcgcaacgccatccggtggccgacgtcgccccctatgagaacgccgaagcattcgcggccgacgtgcagatcgtggtcgattcgctacgcacccatcatggtgaggcgttggcgcgcggccgcgtcgacgcgctggtgcgcgcgatcgcggtcttcggcttccacctggcctcgatcgacatgcgtcaggtatctgacgtgcacgaggccgtgatcgccgaactgttcgcgacggccggcatcgagtccgactacgctgcgctgccggaagcacgcaagctggagctgctgctggctgaactgcgccagccgcgcctgctgacgctgccgtggcacgactactcggaacagacacgcagcgaactggcgatcttcgcgatggcccgcgacctgcgcgcccgctatggcgcccgcatcgcgcgcaactacatcatctcgcacaccgagacgctgtccgaccttatcgaggtgatgctgctgcagaaggaagccggcatgttgcgcggcacgctgggcagcaagaccgatccggcgcgcatggagctgatggtcatcccgctgttcgaaaccatcgaggatttgcgcaatgcggccggcatcatggagtcgctgctggatctgccgggcttcgattcggtgatcgcccaccatggcgtcgagcaggaagtgatgctcggctattcggattcgaacaaggatggcggtttcctgacgtcgaactgggagctctacaaggccgaactggcgctggtgaagctgttcgaggaacgccgtgtgaagctgcgcctgttccatggccggggcggcacggtgggtcgcggcggtggcccgacctatcaggccatcctgtcgcagccacccggcaccgtgaacggccagatccgcctgacggaacagggcgaaatcatcaacagcaagttcgcgaatgccgagatcggccggcgcaacctggaaacggtgatcgctgccacgctggaagcatcgctgctgcccacccagaacgcgccgaaggacctggcgacgttcgaaggcgtcatgcaacagctgtccgaccatgcgttctccgcgtaccgtgacctggtctacgagaccccgggcttcaaggactacttcttcgccacgaccccgatcaccgagatcgcggacctgaacctcggatcgcggccggcatcgcgcaagctgatggacaagaagcaccgccgcatcgaagacctgcgggcgattccatggggcttctcgtggggccagtgccgtctgctgctgccgggctggttcggtttcggcagtgccgtgcaggccctgctggacgccgcgccggacgagaagtcgcgcaaggccacggtggccacgctgaagcggatggtgaagtcgtggccgttcttcagcacgctgctatcgaacatggatatggtgctggccaagaccgacctggccgtggcgtcacgctacgcggggctgtgcgaggacaccgcgctgcgcaaggccgtgttctcacgcatcagtgccgaatggcacctgaccagtgacatgctcggactgatcaccggccggcaggaacgactggctgacaacccgctgctggcgcgctcgatcaagaaccgctttgcctacctggatccgctgaaccacctgcaggtggaactgctcaagcggtaccgggccggcaaggatggcgacgacgtgcgcgtgcgacgcgggatccacctgacgatcaacggggtggcggccgggttgcgtaatagcggt

SEQ ID NO: 32426 - DNA, 1365 bp, Ralstonia metallidurans
tggtccgcccgcttctccgaaccgatgtccgatctggtgaagcgttacaccgcgtcggtcttcttcgacaagcgcctggcgctgttcgacatccagggctcgctggcccatgcggccatgctggcaaagcagggcatcatcgccgaagccgaccgcgccgagatcgagcgcggcatgacgcagatccgtggtgagatcgagtccggcgcgttcgagtggaagctggacctcgaagacgtgcacctgaacatcgaggcgcgcctgaccgccctcgtgggcgacgccggcaagcgcctgcacacgggccgttcgcgtaacgaccaggtggccaccgacatccgcctgtggctgcgcagcgagatcgacagcatcgtcggcctgctgggcgacctgcgcggcgcgctgctcgacctggccgagaagaacgccgacacgatcctgcccggcttcacccacctgcaggtggcccaaccggtcacgttcggccatcacctcatggcctatgtggaaatgtttacgcgcgatgccgagcgcatggccgattgccgccgccgcgtgaatcgcctgccgctgggtgccgccgcgctggccggcaccagctacccgatcgaccgcgagttcgtggccacacaactgggctttgacggcgtgtgccgcaactcgctcgacgccgtgtccgaccgcgacttcgcgatcgaattcctggccgccgcatcgctgatcatgacgcacgtctcgcgcttctctgaagaactagtgatctggatgagcccgcgcgtcggcttcatcgacatcgccgaccgcttctgcaccggcagctcgatcatgccgcagaaaaagaacccggacgtgcccgaactggcccgcggcaagactggccgcgtgtacggccacctgaccggtctgctgacgctgatgaagggccagccgctggcgtacaacaaggacaaccaggaagacaaggagccgctgttcgatacggtcgataccgtggtcgatacgctgcgtatcttcgccgacatggtgcccggcatcagcgtcaagccggacaacatgcgcgccgccgcgctgcagggctacgccaccgccaccgacctggccgattacctggtcaagcgcggcctgccgttccgcgacgcgcacgaggccgtggcccacgccgtgcgcgcctgcgacgaccgccactgcgacctggccgacctgactgtcgagcaactgcgcgaagtctcgggtctgggcgacaaggcctcgctgattggcgacgacgtacacagcgtgctgacgctcgaaggctcggtggcatcgcgcaaccatatcggcggcaccgcgccggatcaggtacgcgccgccatcgccgccgcacgc

SEQ ID NO: 32427 - DNA, 2241 bp, Ralstonia metallidurans
gtcatcatcatcgatgaagacttccgctccgagaacatctccggctcgggcattcgcgcgttggccgaggccatcgagaatgaaggcatggaagtgatgggtctgaccagctatggcgacttgacgtcgttcgcccagcagtccagccgggcatccacgttcatcgtgtcgatcgacgacgacgagttcgtgcgcgccgacgatcagcccgaagcggccgccatcgagaagctgcgcgcgttcgtgaccgaagtgcgtcgccgcaacacggatctgccgatcttcctgtatggcgagacgcgcacgtcgcgccatattccgaacgacatcctgcgcgagctgcacggcttcatccacatgttcgaggacacccccgaattcgtggcgcgccacatcatccgcgaagccaaggtctacctggattcgctggccccgccgttcttcaaggcgctgatcgactacgcgcaggacagctcgtactcgtggcactgcccggggcactcgggcggcgtggcgttcctgaagagcccggtgggccaggtgttccaccagttcttcggcgagaacatgctgcgcgccgacgtctgcaacgcggtcgaggaacttggccagctgctggaccacaccggcccggtggcggcgtcggagcgcaacgccgcgcgcatcttcaattccgaccacatgttcttcgtgaccaacggcacgtcgacgtcgaacaagatggtctggcacgccaacgtggcgccgggcgacatcgtggtggtggaccgtaactgccacaagtcgatcctgcacgcgatcatgatgacgggcgcaattccggtgttcctgatgccgacgcgcaaccactacggcatcatcggcccgattccgaagagcgagttcgacccggagacgatccgcaggaagatcgagaaccatccgttcgcgagcaaggcgaagaaccagaagccgcgcatcctgacgatcacgcagggtacgtacgacggcgtgctgtacaacgccgagcagatcaaggaaatgctgacgtcggaaatcgacacgctgcatttcgacgaggcatggctgccgcacgcggcgttccacgatttctatcgcgacatgcacgcgatcggccgtgaccgtccgcgcagcaaggacgcgctggtgttcgccacgcagtccacgcacaagctgctggccggcctgtcgcaggcctcgcagatcctcgtgcaggattcggaaacgcgcaagctggatcgctaccgcttcaacgaggcgtatctgatgcacacctcgacgagcccgcagtactcgatcattgcctcgtgcgacgtggccgcggcgatgatggaagcgccgggcggcaccgcgctggtcgaggaaagcatccaggaagcgctggacttccgccgtgccgtgcgcaaggtggaagccgactacgacgtcgccaacaatggcgactggtggttcaaggtgtggggcccggacgcgctggccgaagacggcattcctgaccgcgaagagtggatgctcaaggccaacgagcgctggcatggcttcggcgatctggccgatggtttcaacctgctggatccgatcaaggccacgatcatcaccccgggcctcgacgtggacggcgagttcagcgagcgcggcatcccggcggcaatcgtcacgaagtacctggccgagcacggcatcatcatcgagaagacgggtctgtactcgttcttcatcatgttcacgatcggcatcaccaagggccgctggaactcgctggtgaccgagctgcagcagttcaaggacgactacgaccagaaccagccgctgtggcgcgtgctgcccgagttcgtgggcaagcacccgcagtacgagcggctgggcctgcgtgatctgtgcgacgcgatccacagcgtctacaaggccaacgatgtggcgcgcgtgaccaccgagatgtacctgtcggacatggagccggcgatgaagccgtcggatgcctgggcgatgatggcgcatcgcgaaatcgagcgcgtgcccgtcgacgaactggaaggccgcgtgaccgcgatcctgctgacgccgtacccgccgggcattccgctgctgatcccgggcgagcgcttcaaccgcacgatcgtgaagtacctgaagttcgcgcgcgagttcaacaagctcttcccgggcttcgagaccgacatccacggcctggtcgaggacgaggtcgatggccagaaggcgtacttcgtggattgcgtgaag

SEQ ID NO: 32428 - DNA, 1431 bp, Ralstonia metallidurans
gagacgtaccgcaactacatcgatggcgaatggtgcgacagcgccagcggccgtaccgtcgataacgtcaaccctgccgacacgcgtgacatcgtcagccgccacgccgcgtccgacgcgcgcgacgccgccgctgcagtggccgctgccgcagccgcgttcgacgggtggaaaaagaccccgatcggcaagcgcgcgaagatcctcaacgatgccgccgcgcatctggaagccaacgccgacaccatcgccaccgaactgacccgcgaggaaggcaaggcgctgaacctggcgcgcgacgaggtcatgcgctctgcgcagaccctgcgcttctatgccgtggagggtcagacgttcagcggcgaaagctatccgaacgatgatcccgacatgctcgtctacagcctgcgcgaaccgctgggtgtggtgacggtgatctcgccctggaacttccccgtgtcgatcccggcgcgcaagatcgcgcccgcgctgatcacgggcaacaccgtggtgttcaaaccctcgtccgacgcgccgctgtccggctaccggctggccgaagcattcgtccgcgccggcattccgaaaggcgtgctgaacttcctgaccggcagcgccgccgaagtgggcccgaccatcgtggaatcgcgcgaggtccgcgcggtctcgttcaccgggtcgacctccgccggcgagcagattcacaagtccgtgccgatgaccacgcgcacgcagatggaactcggcggcaagaatccgctgatcgtcatggaagacgccgatctcgatcgcgcggtggacctggcagtcaagggcggcctgtcgctgtcgggccaggcgtgcacgggcaccagccgcatcctggtgatgcgcgacgtgaagcaggcattcaccgagaagctggtggccaaggtcaaggcgctgaaaattggcagcggcatgacggcggggatggacctcggcccgctggccacgcgcaagcaactggaaacggtgctgagctacatcgccatcggcaagcaggaagcgaccttgctgtgtggtggtgaacagctgtccgacggcgatttcgcgcacggctactacgttgcgccgaccgtgttcaccgacgtgacccagtcgatgcgcattgcccgcgaggaaatcttcgggccggtgctggcgatcatcgaagtcgacagttacgcggacgccatcgcccaggcgaacgacaccgagtacggtctgtccgccgccatcgccacgcgcaatccgcgctacatgcacgacttcacgcgcgatatcgaatcgggcacggtcaagatcaaccgcaccaccacgggcaacctggtcaacgcgccatttggcggtctcaagcgctcgagcacctcgacattccgcgaatcgggacgcgctggcctcgagttttatacgcagatcaagaccgtctac

SEQ ID NO: 32429 - DNA, 1200 bp, Ralstonia metallidurans
atgagcgaagcattcatcgttgacgccatccgtacccccatcggccgttacgccggcagcctgtccggcgtgcgcgcggacgacctgggcgccgtgcccctgaaggccctgatggcccgtaacgccagcgtggactggtcggcgatcgacgacgtgatctttggcaacgccaaccaggccggtgaagacaaccgcaacgttgcgcgcatgtcggccctgctggctggcctgccggacgccgttcccggcgcgacgatcaaccgcctgtgcggttcgggcatggacgccaccggcaccgccgcccgcgccatcaaggctggtgaagccaacctgatgatttccggcggcgtggaaagcatgagccgcgccccgttcgtcatgggcaaggccacctcggccttctcgcgtgacgcgcagatcttcgacacgaccatcggctggcgtttcatcaacccggcgatgcgcgccgcctacggcgtggactcgatgcccgagaccgccgagaacgtggcgaccgactacaagatcggccgtgaagaccaggatctgatggcgctgcgcagccaggagaaggcatcgcgcgcgcaagccgacggcacgctggcgcaggaaatcaccccggtgacgattccgcagaagaagggcgacgccatcgtggtcgaccgcgacgaacatccgcgtgccacgagcatggaagcgctggccaagctgcgcggcgtggtgcgtccggacggcacggtgaccgccggtaacgcctcgggcgtgaacgatggcgcgtgcgcgctgctgctggccagcgaagcgggcctgaagcagcacggcctgaagccgcgtgcccgcatcgttggcatggcaacggctggtgtggcaccgcgcgtgatgggtatcggcccggcgccggccacgcagaagctgatgaagcaactgggcatgacgctggaccagatcgacgtgatcgaactgaacgaagcgttcgccgcgcaaggcctggccgtactgcgtcaactgggcatcgccgacgacgacaagcgtgtgaacccgaacggcggcgccatcgcactgggccacccgctcggcatgagcggcgcgcgtctggtgacgaccgcgatgtaccagctggagcgcactggtggccgcttcgcgctgtgcacgatgtgcatcggcgtgggccagggcatcgccatggtgatcgagcgcgtt

SEQ ID NO: 32430 - DNA, 846 bp, Ralstonia metallidurans
aaggctgaaatccttgccgaggcgctgccttatatccggaagttccacggcaagaccatcgtggtcaagtacggtggcaacgcgatgacggaagagaaactcaagcacggtttcgcgcgcgacgtgatcctgctgaagctcgtcggcatgaacccggtggttgtgcacggcggtggcccgcagatcgacgaggcgctcaagaaggtcggcaaggtcggcacgttcatccaggggatgcgcgtgaccgacgaagagacgatggaagtggtcgaatgggtgctcggcggcgaagtccagcaggacatcgtcatgctgatcaaccagtacggcggccaggccgtgggcctgaccggcaaggacggcgggctgatccgcgccaagcgtctgcagatgccggaccgcgagaacccgggcaccttcatcgacatcggctacgtgggtgatatcgaggcgatcaacccggccgtggtgaaggcgctgcaggacgatgccttcatccccgtgatctcgccgatcggtttctccgacgatggccaggcctacaacatcaacgccgatgtggtggctggcaagatggccgagatcctcaaggccgagaagctcgtcatgatgacgaacatcccgggcgtgatggacaagaagggcaacctgctgaccgacctgtccgcgcgcgagattgaggaactgttcgccgacggcacgatctcgggcggcatgctgccgaagatctcgtcggcgctcgacgcggccaagagtggtgtgcactcggtgcacatcatcgacggccgcatcgaacactcgctgctgctcgaaatcctgaccgaacaggccttcggcacgatgatc

SEQ ID NO: 32431 - DNA, 930 bp, Ralstonia metallidurans
aaagtgttcgtcgatggtcaggaaggcaccaccggtctccggctgcttgactatctctcgggtcgcaccgatgtggaactgctgcgcattgccgatgacaagcgcaaggacccgcaggagcgagcacgattcctgaacgcctcggacgtctctttcctgtgcctgccggacgtggcctcgcgcgaggccgtgtcgctggtgaccaaccccgacacctgcgtgatcgacgccagcacggcgttccgcacggctgacaactgggcctacggcctgccggaactgacccgtggccagcgcgagaaggtgcgcagcagcaagcgcatcgccgtgccgggctgccacgccagcgcgttcgtgctggccgtgcgtccgctggtggaagccggcctgatgcctgccgactatccggcttcggcgttctcgctgaccggttacagcggcggcggcaagtcgatgatcgcggagttcgaagccggcggaaatccgaagctgatgagcccgcgtccgtacgcgctgggtctggcgcacaagcacctgccggaaatgcgtgtgcagaccggcctgtcgcaggcgccgatcttcaacccgatcgtcggcaacttcctgaagggtctggccgtgacggtgccggtgtatccggggctgctgtcgcgcaaggccgatgcggaagccatcctcgacatctaccgcaagcactatgaaggcgagcagttcgtgcgcgtccatccgttcaacagcgacgccaatctggacaacggcttcttcgacgtccaggcgaacaacgacaccaaccgcgtggacctgttcgtcttcggcaacgaagaacgcctgaacctggtggcgcgcctggacaacctcggcaagggtgcggccggtgcggccgtgcaatgcatgaacgtccatatcggcgccgacgaagccacggggctc

SEQ ID NO: 32432 - DNA, 765 bp, Ralstonia metallidurans
atgttacggattatcagcgccaacctcaacggcatccgctccgcctccaagaaaggcttcttcgagtggatgggcaagcaggaagcggacatggtctgcgttcaggaactcaaggcccaggaagccgacatgaccgaggcgttcctggcgccacacggctatcacggctacttccactatgccgagaaaaaaggctacagcggcgtgggcctctatacccgccacaagccggagcgcgtgatcatcggcttcggcaatacggagttcgatgctgagggtcgctacgtcgaagtgcagtatccgcacctcgccgtgatctcggtctacgtgccttccggctcaagctcggaggagcgccagcaggccaagttccgctttatggaagccttcctgccgcacctgctggagctgaaagccagcggccgcgagatcgtgctgtgcggtgacgtgaacatcgcccacaaggaaatcgacatcaagaactggaagggcaacctgaaaaactccggtttcctgcccgaagagcgcgcctggatcggcgaactgttcgacaaccacggctatgtcgacgtattccgccagctggacccgcgccccgaacagtacacatggtggagcaaccgcggtcaggcgtacgcgaagaacgtggggtggcgcatcgattaccacctgaccacggcgaaaatcgcggctaccgccaaggctacgtcgatctacaaggacgagaagttcagcgaccacgccccgctgtcgatcgattacgat

SEQ ID NO: 32433 - DNA, 849 bp, Ralstonia metallidurans
atgaaactccagttcaccaagatgcacggcgccggcaacgatttcatcgtgctggacggcattcaccagaagctcgacctgaccgacgcgcaatggcgcgcgctggcgaatcgccatttcggcatcggcgccgaccagatcctgatcgttgaaaaatcctcgcgcgacgatgtggatttccgctaccggatcgtcaacgcggacggcggcgaagtcgaacactgcggcaacggcgcccgttgcttcgtccgcttcgtcacggatcgtggcatgaccgacaagcagtcggtccgcgtggaagtcatgaacggcgtcatcacgctgaagctgcaggacgacggtcaggtgaccgtggacatgggtgagcccgaactcacgcccgcccgcgtgccattcatcgccgacggcctgccgacgcgcgccgaagcccaggacacgctctatggtctcgaagtcaacggccgcaccgagtggatctcgcccgtgtcgatgggcaatccgcacgcggtgcagatcgtggacgacgtagagcaattcccggtgcttcaggacggcccggtcatcgagcaccacaagtcgttcccgaaccgggtcaatgccggattcatgcagatcgtcgaccgcaatacggtgcggctgcgcgtgttcgaacgcggcgcgggcgaaacgctggcgtgcggcacgggcgcctgcgcggccgtggtggctggcatccgccgcggcttgctggactctccggtcaaggtgcacacccacggcggcgacctgaccatcgcgtggcaaggcgctggccagcccgtgcagatgacgggccccgcgacgaccgtgttcgaaggcactattgacctc

SEQ ID NO: 32434 - DNA, 1137 bp, Ralstonia metallidurans
ctctttacttcggaatctgtctccgaaggccatcccgataaagtagccgaccagatttcggatgctgtcctggacgcgatccttgcccaggacaagtacgcccgcgtggcggccgagacgctttgcaatacgggacttgtcgtgctggcgggtgaaatcaccacgaccgccaacgtcgactacatccaggtcgcgcgcgaaaccatcaagcgcatcggttacgacaacaccgagtacggcatcgactacaagggctgcgccgtgctggtggcctacgacaagcaatcgcccgacatcgcccagggcgtcgaccgcgcgtcggacgactacctgaaccagggcgctggcgaccagggcctgatgttcggctatgcctgcgacgaaacgccggaactgatgccgttcccgatctactactcgcaccgcctggtggagcgccagtcgctgctgcgccgtgacggccgcctgccctggctgcgtcccgacgccaagtcgcaggtgaccgtgcgctacgtggacggccgtccgcacagcgtggataccgtggtcctgtcgacccagcacgcgccggacatctcgcaggcccagatccgtgaagccgtgatcgaagagatcatcaagccggtgctgccggccgagatgctcaaggaaaccaagtacctggtgaacccgaccggccgtttcgtgatcggtggcccgcaaggcgattgcggcctgaccggccgcaagatcatcgtcgatacctatggtggcgcttcgccgcacggtggcggtgcgttctcgggcaaggatccgtcgaaggtggaccgttcggccgcctacgccgcccgctacgtggccaagaacgtcgtggccgccggcctggcgcgccagtgccaggtgcaggtcagctacgcgatcggcgtggcccgcccgatcaacgtgaccgtgtacaccgaaggcaccggcaagatctccgacgagaagatcgccgcgctggttcaggagcatttcgacctgcgcccgaagggcatcgtccagatgctggacctgctgcgtccgatctacgagaagaccgccgcctatggccacttcggccgcgaggagccggagttctcgtgggaagccactgacaaggccgcgattctgcgcgctgcc

SEQ ID NO: 32435 - DNA, 1299 bp, Ralstonia metallidurans
ctgcgccgcttgcgcaggctcgtgcaggccaatcatgacgccatcgccgcagccatcagcgcggacttcaccaaccgtccacatcaggagaccgcgctgctggaagtgttcccgagcgtggccgggatcgatgacgcattgcggcacggcaagcgctggatgcgcgtgcgccgcgccagcaccggcctctggttcaagcctggccgctcgcgcctgatgccgcagccgcttggcgtggtcggcatcgtggtgccgtggaactacccgctgtacctgaccatcggaccgctgaccggcgcgctggcggccggcaatcgcgcaatggtcaagctgtcggagtacacgccgcgcttctccgcgttgttcgcgcaactggtgcaggcggccttcgcgcccgacgaggtggccgtgatcaacggcgacgccgaagtggccgccgccttcagcaccctgccgttcgaccacctgctgttcacgggctcgaccaatgtcggccaccatgtgatgcgggccgctgcggcgaacctcacaccggtcacgctggaactgggcggcaagtcacccgcgatcatcgggccgcacgcggatttcgagcgggccgtggagcggattctggtgggcaagctgctgaacgcgggccagacctgcatcgcgcccgactacgtgctggtgcaagccgaccaacgcgaccgcttcgcggaggcggctcgccgctgcgccagccggctttatcccgatatcgcgcgcaaccccgactacaccagcatcatcagcccgcgtcacttcgaccggctggtatcgatgatcgccgccgccactgcggcgggggcgcacgcggtgccactgaccgacgccacgccggacgccgccgcgcgccggctgccacctgtgctgctgacggatgtgccggacaacgtgatggcgatgcaggaggaaatcttcgggccggtactgcccgtggtgacgtatcgcagcatcgaggacgcgatcggcttcgtgaacgcgcgcccgcgcccgctggcgctttatgtgttcgacaaatcgggggatgtggtggaccgtgtgatgcgccagaccgtagccggcggcgtgaccgtcaacgacacgctattccatatcgcccaggacgacctgccatttggcggcgtcggcccgagcggcatgggcgtctatcacggcaaggccggcttcgagacgttctcgaagctcaagccgatcttccatcaggccggccttaatggcgccgggctgctcaagccgccctatggcaagcggttcgagtcgatgttgaagctgctg

SEQ ID NO: 32436 - DNA, 1617 bp, Ralstonia metallidurans
tttgactatctcgtcgtgggcgccggctcagccggctgcgcgctggccgggcggctggccgacagtggcaacgacagtatcgcgctgctcgaggcaggcggccacgatcaccatgtgctggtacgcacacccgccgcgggcgctgcgttcctgccacgggccggctcgcgcaacgtcggataccggaccgttccgcaggaagggctggacggcaggcgagtcagccagccggctggacgcggcctcggcggctcgtccttgatctccgccatgatctacacgcgcggccgcccggccgactacgacgcctgggccgatgccggctgcgacggctggtcgtgggacgacgtgctgccgtatttccgccgcgccgagtgcaacgagcgtctggccggcgaggacgacgatccgcttcacggtggcactgggccgctgcacgtcagcgacctgcgctcgccgaacccgttcgcgcaccatttcatcgacgcagcacagcgcgccggcatcgtacgcaacggcgacttcaacggcgacgagcaggaaggcgtgggctggtatcaggtgacccagcacaatggcgagcgatggaatgccgcgcgcgcctatctgcacggcggcaacgcccgcaaccggaccagcaacggcggacgcagccacctgcacgtgctgacaggggtgcaggtgctgcgcgtgctgttcgagcgcaggcgtgcggtgggcgtcgtggcgtggcgcgacggcaaggaactggaaatccgcgcgcggcgggaggtgatccttgccgcaggcgcgttcgggtctccgcaattgctgatggcctccggcgtggggccgatgatgcatctgcgcgagtttggcgttccggtggtccacgatctgcctggcgttggcgccaatctgcaggatcacgtggatgtcgcggtgcaaagacgcgtgcgtgcgtccgagctgttcggcatttcgctgggtagcgccttccggctgattggcgaaagcctgcgctatcggcgcgggcgatcgggcatgctgacatcgaacctggccgaagcaggcgccttcgtgcgcagccgccccgggctggccgagcccgacctgcaattgagtttcgtggtggggctcgtcgacgatgagacgcgccgcctgcgcctggggcatggctacgcgtgccatgccagtgtgctgcgcccgcgcagccgtggcgtggtgcggctggcgtcgccggactcgcgcaaggcgccgctgatcgatccgcattatctgtcggacccgcaggacatggacggcctgctcgacgggttgcgtatcgcgcgacgtatcctggcgcaggcgccgcttgcggcattcggcgggcaggatctgcggctgggccaactgcgtgacgatggcggcaatgacgaagccgcgcgggcctggattcgcgcgcacgcgcaatcggcctgtcagccggtgggcacctgccgcatgggcatggacccgctggcggtggtggaccctcaactgcgcgtgcgcggcatcgagggcctgcgggtggtggatgcatcgatcatgccgacgctgataggtggtgacgcaaacgcgccggcgatcatgatcggcgagcgtgcccacgacctgatt

SEQ ID NO: 32437 - DNA, 1398 bp, Ralstonia metallidurans
ctgaagcaagactacatcgtggccgatatcggcctggccggctggggccgcaaggaaatcgccatcgccgagaccgaaatgcccggtctgatggccattcgcgacgaattcgccgccgcgcagccgctcaagggcgcgcgcatcgccggttcgctgcacatgacgatccagaccgccgtgctgatcgaaacgctcaaggcactgggcgccgacgtgcgctgggcctcatgcaacatcttctcgacgcaggatcacgccgccgccgccatcgccgcgtcgggcacgcccgtgttcgccttcaagggcgaatcgctgaaggaatactgggacttcacgcaccgcatcttcgactgggccgacggcggcacgccgaacatgatcctggacgatggcggcgacgccacgctgctgctgcacctgggtgcccgcgccgaaaaggatgcgtcgctgatcgccaagccgaccagcgaggaagaaaccttcctgttcgcggccatcaaggaaaagctggccaaggattcgacctggtacagccgcaacctggccgccattcgcggcgtgaccgaggaaacgaccaccggcgtgcaccgcctgtaccagatggcgcaaaagggtgaactgaagttcccggccatcaacgtcaacgactcggtgaccaagagcaagttcgacaacctctacggctgccgcgaatcgctggtggacggcatcaagcgcgccaccgacgtgatgatcgccggcaagatcgccgtggttgccggttacggcgacgtgggcaagggcagcgcccaggctctgcgcgcgctgtccgcgcaagtgtgggtgaccgagatcgatccgatttgcgcgctgcaagccgccatggaaggctaccgcgtggtgacgatggactacgccgccgagcacggtgacatcttcgtgacctgcaccggcaattaccacgtgatcacgcacgaccacatggccaagatgaaggaccaggccatcgtctgcaacattggccacttcgacaacgaaatcgacatcgcatcggtcgagaagtacgaatgggacgagatcaagccgcaggttgaccacgtcaagttcccggacggcaagaaaatcatcatcctggccaagggccgtctggtgaacctgggctgtgccacgggccacccgtcgtacgtgatgagcagctcgttcgccaaccagacgatcgcccagatcgaactgtgggccgaacgtgacagcggcaagtacccggttggcgtgtacgtgctgccgaagcatctggacgagaaggtcgcgcgcctgcagctccggaagctgaacgcgcaactgaccgagctgaccgagcagcaggcggcctacatcggcgtgaagaaggaaggcccgtacaaggccgaccactaccgctac

SEQ ID NO: 32438 - DNA, 2307 bp, Ralstonia metallidurans
gagcgggtgacgtaccggatcgagaacatggattgcccgacggaagaagcgctgatccgcgaccggctgggcaagctgccgggtgtgaccgcgctcgacttcaatctgatgcagcgtgtgctgggagtccagcacacgctggcgacctcagcgccgatcgagaaggcgcttgcttccattggaatgcaggctgcgcggcaggacatgcagacagccaccacggtacttcgcatcgcgaagatggactgtccgaccgaggaaagtctgatccgcggcaagctgcaaggcatgccgggcgtgcagggaatggatttcaacctgatgcagcgcacgctcacggttcggcacacacccgacgcgatcaagccggcagtcgaagccatcgaatcgctgggcatggaagccgaggtccagaggactgatgagccgcgcgatgccccggtggccgcgcacaagaccaattggtggccgatggcggtttcgggcgttgcggcggtggccgccgaaggcgtgtactgggtcaacgacggcaatcattgggccgtgatcgtgctggcactggtttcgatcttcaccggcggcctcagcacctacaagaagggctggatcgcgctgaagaacctcaacctgaacatgaacgccctgatggccatcgcggtcaccggcggcatggcgatcggccactggccggaggccgccatggtcatgttcctgttcgcgttggcggaagtgatcgaggcgaagtcgctggaccgcgcccgcaacgccattcgggggctgatggacttggcgcccgagaccgcgaccgtgcggcaggccgatggctcatggacagagctgccggccaaggaggtcgcaaagggcgcggtggtccgcgtgcgtcctggcgagcgcatcgcactggacggcctgatcacctcgggtcgatcggccatcaaccaggcgcccatcaccggcgagagcctgcccgtcgagaaggccgaaggtgaccaggtcttcgccggaaccatcaatgagaccggctctttcgaatacaaggtgaccgcaggcgccagcgactcgacgctcgcgcgcatcatccatgccgtggagtccgcgcagggcagccgtgcgcccacgcagcgcttcgtcgaccagttcgcccgcgtctacacgccggcggtgttcgcggtgtccgtgctggttgccgtcgtgccgccgctcgccttcggcggcgcatggtttgactgggtctacaaggccctggtactgctggtgatcgcctgcccctgcgctctggtcatctccacgccggtcaccatcgtcagcggcttggccgctgccgcccgacgcggcatcctgatcaagggtggcgtctacctggagggcgggcgcaagctcaaggcgttggccctggacaagaccggcacactcacacatggcaagcccgagcagaccgacttcgtgccgctgatcggcgaggcgcaggaagttgccgcctgggccgcaagcctcgcggcacgctcggaccatcctgtgtctcaggccatcgcccgcaaggcgaaccgtgacggcatcgcgctgcacgaggtcgacgacttcgcggcgctgcctggccgcggcgtgcgcggccgcgtcgccgggcgcatgttgcacatgggcaaccacaggctcgcccaggagctgggcctgagcgaagcgacgctccaggctcggctggagaccctggagcgccaaggcaagacagcgatcctgctgatggacgatgcgaccgtgctcggcatttttgcagtggccgacaccgtgaaggaaaccagccgtgaggcggtggccgacctgcaggcgctgggtgtgcgcacgctgatgctgacgggggacaaccagcacacggccgcggccatcgctgcccaggtcggaatctctgaagcccgtggtgaccaactgcccgaagacaagctcaagaccatcgaaagcctggtcggcggcgagggccaggtgggcatggtgggcgacggcatcaacgattcgcccgcgctcgcccgtgccgacatcggcttcgccatgggcgcggccggcaccgacaccgcgatcgaaacagccgacgtcgccctgatggacgacgacctgcgcaagatccccgccttcatccggctgtcgcgtagcactgcggcgatcctcacgcagaacatcgttctggcccttggcatcaaggcggtgttccttgcgttgacgttcacagggcatgccaccatgtggatggctgtgttcgctgacatgggggcaagtcttttggttgtcgtcaatgggctgcgcctcctgaagttcaag

SEQ ID NO: 32439 - DNA, 1671 bp, Ralstonia metallidurans
accctccacatcgaaggcatgacctgcacgtcgtgcgccgagcacgtccagcaggctttgacgaacgtgcccggcgtgcgcgcggcctcggtgtcctatccgcagcggcaggccgaaatcgaggcggatgcaggcgtgagcgtggccccgctggttgccgcagtggccacgctcggctatcgcgcacggcttaccgacacgccgaacaagcctgccggcctgctagacaaggcgctgggctggctcggtggcgaaacgaagcatgttggcggtgaacaagcgctgcacgtggctgtgataggcagcggcggcgcggcgatggcggctgccttgaaggccgtggagcaaggcgcccgcgtcacgctgatcgagcgcggcaccatcggcggcacctgcgtcaatgtcggctgcgtgccgtccaagatcatgatccgcgccgcgcacatcgtccacctgcgccgcgaaagcccgttcgatgctggcctgccggccgcagcgcccgctgtactgcgcgagcggctgctggcccagcaacaaggccgcgtcgaggagctgcgccatgccaagtacgaaggcatcctggcaagcactccggccatcaccgtgctgcgcggcgaggcccggttcagggacacgcgcacgctgaccgtggcgaccgctgacggcggcacgcacgaggtgaacttcgaccgctgcctgattgccaccggcgcgagcccggcgcttccgccaatcccgggccttgcggacacaccccactggacctccaccgaggcgctggaaagcagctcgctccccgagcggctggccgtgattggttcctccgtggtggcggtcgagttggcgcaagccttcgcccggctgggcagccaggtcacgatcctggcgcgcagcacgctgttcttccgagaagacccggccatcggggaagccgtaacagacgccttccgcgccgagggcatcgaggtgctggaccacacccaggcgagccacgttgcctatgcgggcggggaattcgtgctcaccaccgggcagggggaagtgcgcgccgacaagctgctggtcgccaccggtcgcgcgccgaacacgcgcagcctgaaccttgaagcggcaggcgtcgaagtcaatgcgcagggagccatcgtcatcgaccgcgccatgcgcacgagcgcaccgcacatctttgctgccggcgactgcaccgaccagccgcagttcgtctatgtggcggcggcggccggcacgcgcgccgcgatcaacatgaccggcggcgacgcggcgctggacctgacggcgatgccggcggtggtgttcaccgatccgcaggtggcgaccgtgggctacagcgaggcggaagcgcaccacgacggcatcgagaccgacagccggctgctgacgctcgacaacgtgccgagggcgctcgccaacttcgacacgcgcggcttcatcaagctggtggcggaagctggctcagggcggctgatcggcgtacaggcggtcgcgccggaagcgggcgaactgatccagacggccgcgctggcgatccgccaccggatgaccgtgcaggagctggccgaccagttgttcccctacctgaccatggtcgagggactgaagctcgcggcgcagaccttcaacaaggacgtgaagcaactgtcctgttgcgccgga

SEQ ID NO: 32440 - DNA, 2298 bp, Ralstonia metallidurans
taccgaatcgaaaacatggactgtccgaccgaagaggcgctgattcgcgacaagctcgcgaaactgcccggcgtgggaggacttgagttcaatttgatgcagcgaacgctagccgttagccaccagatggcgtcaccgggccctatcgaggaggcgctatcggccatcgggatgcgggcggttcgcatggacgaagcaacgcccctgcaaaatacggtactggccatccaccagatggattgcccgaccgaggaggcgctgattcgcagcaagcttgccggcatacctggcgtcgccagcctcgagttcaatctggtgcagcggacgctgcacgtctggcatgcggctgacacgctatcccacgtgcttacagccctgaaatcactcggcttcgacgccgaagtgcgcagcgccggtgcccccgcagcggccgaggcaccggggcccgcgcgcacgaactggtggccgcttgcggtgtcaggggtggccgcgacgctggcggaggtcgtgtactggctccatggtggcaaccattggggcgtggtcgcgctggcgctggcggccatcttcactggtggcctcaccacctataagaggggctggatcgcgctcaggaatcgcaacctgaacatgaatgcgctgatgtccattgcggtcactggcgccatgctgattggtcattggcccgaggcggcgatggtgatggtgctttttgcgctggccgaagtcatcgaggccaagtcgctggatcgcgcccgcaacgccattcgcggcctgatggatctcgcaccggataccgcactgattcagcaagctgacggcagttgggccgaggtggatgccaaggccgtcgcagttggtagccggattcgagtcaaacctggtgaacgcatcgccctcgacggtcaggtcattgaggggcgctccaccgtcaaccaggcaccgattaccggcgagagcctgccggtcgaaaagatcgagggcgatcctgtgttcgctggcacgatcaacgagtccggctcattcgaattccgcgtcacggcggcagccaacgcgtcaacattggcgcgcatcattcacgccgtcgaagcggcccagggaagccgcgcaccgacgcagcgcttcgtcgaccagtttgcccgcctctacacacccgtcgtattcgccgtggccttggcggtggcggttctacccccgttggtgttcggtggaccgtggctggactggatctacaaggccctggtcctgctggtgatcgcctgcccctgcgctctggtgatttccacgccggtgagcattgtcagcggcctggccgcggccgcgcggcatggcatcctcatcaaaggcggcgtctatctggaagaggggcgcaagctgaagtggttggccttggacaagactggcaccatcacgcacggcaagcccgccctgaccgatttcgtggtgtggggcgacgccaatccggccacatccaggctgctggctgcgagcctggctgcccgctcggatcacccagtgtccctggcggtggcgcgcgccgccgaaggtgaaggattgataccttgcgacgtcgccgatttcgcggcattgcctggccgtggggtgcgtggcagcgtcgatgaccactcctaccatctgggcaaccaccggctggtcgaggaactgggcgtctgttcgccagaactcgaatcgcggctcgctgcgcttgaggccgaaggcaagaccgttgtaatgctggtcggaccagagggggtgcaggcgttgttcgcagtggccgacacagtgaaggagaatagccgtcaagccattgccgatttgcacaccttgggtgtcaaaacgatgatgctgacgggcgacaatccgcataccgccacggcaattgctggccaggtcggcattgaccgcagtcggggcaatctgctgcccgaagacaagctgcgggaagtcgaacaactgtcaacggacgggaagactggcatggtgggcgacggcattaacgatgcgccggcgttggcgcgagcggacattggctttgcgatgggcgcggcaggaaccgacacggcgatcgaaactgccgacgtggcgttgatggacgacgatctgcgcaagctgccgacgttcgtgcggctgtcccgtgccaccgccagcgtcctgaagcagaacatcgctctggcgctcggcatcaaggcggtgttcctggtgctcaccttcactggccaggccacgatgtggatggccgtgttcgccgacatgggcgccagcctgctggtggtcggcaatggattgaggctgttgcgt

SEQ ID NO: 32441 - DNA, 1248 bp, Ralstonia metallidurans
atgcaactgctcgcgatcggtatcaatcacaccacggcacccgtctcgctccgcgaacgtgtggcgtttccgcttgagcagatcaaacccgcgcttggcgcactgcgcacccacctctcgggtcgcaacggtaccgaagccgccattctctccacctgcaaccgcaccgagatctactgcgcgaccgacgtgctgaagccgggcgaggaaggtttcgagcacacgctgcgctggctggcgcagcatcacaacgtccccgcttctgaattggcgccgcacctgtacgcgctgccccagtcggaagccgtgcgccatgcgtttcgcgtggccagcggcctggactcgatggtgctcggcgaaacgcagatcctggggcagttgaaggatgcggtgcgcaccgccggtgaggccggcgcgctgggcacgtacctgaaccagcttttccagcgcacgttcgcggtggccaaggaagtccgcggccagaccgagatcggcgcgcattcagtgtcgatggcggccgctgcggttcgcctggcgcagcgcattttcgagagcgtctccacgcagcgcgtgctgttcatcggcgccggcgagatgatcgaactgtgcgccacgcacttcgccgcgcagacgccgcgccagatcgtggtggccaaccgtaccgtcgaacgcggcgaaaagctggccgaacagttgtccgagcaggggctgaccacccaggcgatccgcctgcaggaccttggcgaccgtctgcatgaattcgacatcgtcgtctcctgcaccgcgagttcgctgccgatcatcggcctgggcgcggtcgaacgcgcggtcaagcgccgcaagcatcgcccgatcatgatggtcgatcttgccgtaccgcgtgacgtggagcctgaagttgcacgcctggatgacgtgttcctgtacaccgtcgacgaccttggcgccgtcgtgcgcgaaggcaacgcgctgcgtcaggctgccgtggcgcaggccgaggccatcatcgattcccgcgtgctgaatttcatgcactggctggagacgcgcagcgtcgtgcccgtcatccgcgaactgcaatcgcagggcgaggcgatccgccaggccgaagtcgaacgcgcgcgccggatgctggcgcgcggtgacgaccccgcggccgtgctcgaggcgctctctggcgcgctgacccgcaagttcctgcacggcccgacccacgcgctgaaccacacccagggcgaggaccgcgag

SEQ ID NO: 32442 - DNA, 1542 bp, Ralstonia metallidurans
gcatcatccgctacaggagacgctcgcatgaaagcgcaagagatcgcagcttgctggcaggccatggacctgccgccaccgtggacgccagccgaaggcgccgcgccaggcgtgctggccgtgcgttcgccgatcgacggcgaggtgttcggccagcttgcgatgtgtgatgccgcgctggccaacgcgcggatcgcgcgcgcccatgcggcccagaccacctgggcgctgacgcccgcgccagcgcggggcgaggtggtgcggcgctttggcgaggcgctgcgcgcaaacaaggatgcgctcgggcgactggtctcgctggagtccggcaagatcctgcaggaaggccttggcgaagtgcaggagatgatcgatatctgcgacttcgcggtagggctgtcgcgccagttgcacggactgacgatcgcctcggagcggcccgcgcacgcgatgcgcgaaacctggcatccgtatggcctgtgcggcgtgatctcggccttcaattttccggtggccgtgtgggcgtggaatgccgcgctggcgctggtctgcggcaacggcgtggtgtggaagccgtcggaaaagacaccgctttgcgcgctggccgcgcagggattgctcgatcgcgtattcgaacgccacgcgccacagttcgacgggctcagctgcgtgctgaccggcggccgccagcttggcgagcacctcgtgcagcatccggccgtgcgcttgatgagcgcgaccggatcgacgcgcatgggccgcgaagtcggcatggcctgtgccgcgcatttcaagcgggcgattctcgaactcggcggcaacaacgcggcgatcgtcacgccatcggccgagcttgaaatgacgattcgcgcgatgacgtttgcggcggcgggcaccgccgggcagcgatgcaccacgttgcggcgcgcctttgtccatgccgatctgatcgagaccgtcaccaatcggctgcgacaggtgttcgcccggctgccggttggcgatccgttggaagacggcacgttggtggggccgctgatcgatcatgcggcgggcgatacgatggccaatgcgctggcgagttgccgtgcccaagggaacgtcgtgcacggcggagagcgtctgcttggcgaccgctatccccatgcctgctacgtgcggcccgcgctggtactgaccgacgcgcagcacgacacgatgctgaccgagacgttcgcgccgattctctatctgatgccatacacctcgctggatgaggccatcgcgctcaataacgcagcgtcgcacgggctgtcgtcgtgcatcttcaccgagtcgttgcgggaagccgagcggtttctgtcatcggcgggcagcgattgcggcatcgccaacgtcaatatcggcaccagtggcgcggaaatcggcggcgcctttggcggcgaaaaggcgaccggcggtggtcgggaatcaggctcggatgcgtggaagggctacatgcggcgtgccacgaacaccatcaactatggcgatgcgttgccgctggcacagggtatccgcttc

SEQ ID NO: 32443 - DNA, 789 bp, Ralstonia metallidurans
attcgcgttgccgtcggtggtgtcaccggctgggccggtggcgagttggcacgcggcgtggcacatgccgccgacatgacactggtggcgggcctgtcgcgtggcgcggcgggacaggcactggcgaaactgacggggcacgccgacactccgggcattgccgtggccagcatcgaggaactaaaccagacgccttacgacgtctacgtcgaatacaccaagccgaccatcgcaaagcacaacatcctgcaggcgctggcgcgcggcgcgcacgtcgtggtgggcacctctgggctgacggacgacgactacgtggaaatcgacgccgccgcgcgcaaggcagatcgtggcgtgctggcttgcggcaatttcgcgatcacggtggtgctgctgcagaagtttgccgaaatggccgcgcgccatctggagcactgggaaatcattgactacgccaaggctggcaaggtcgacgtgccgtcgggcacggtgcgcgaactcgcattccggctcggccaggtcaaggccgccgcgcaggtggtgccgatcgacgaggtcaacggcccgaaggaaacgcgcggcgcgacgatgtcgggcacgcaggtgcacgcggtgcggctgcccggctaccagctcggcgtggaggtgatcttcggcgccgatggccagcgcctgcacctgaagcacgaagccggcgatggctcgaagccgtacgtgtccggtggactgctggcgatccgcaaggtccacaccgtgcgcggcgtggtccgcggactcgacaaggtgatggaa

SEQ ID NO: 32444 - DNA, 1383 bp, Ralstonia metallidurans
gtcgatgccagtaggcaccgctacagtgttcggtcaacaaaatgcgcagacaggagaccccgcatggccgcagacctctggttcgaatcgttgcaccgcaccggcaccgaagtgctcgaccgcggtaatcggctggcgggtggcctgcggcggctggggcttgaggagggcgcggtggtggccgtgatgctgcgcaatgacccggtgtttgccgacgtcgtcttcgcgtgccggacggccggcgtctactactgcccgatcaactggcatttcacgccggaggaagcccgcttcctgctggaggacagcagcgcccgcgtgctgatcatcgaggccgatctgttcccgtcgatgcgcgaagtgattcccgcaggcatgaccgtgctgaccgtgaacggcagcgacgccgatgccaccatcaccatcgcctacgaaccctggctcgccacgcaatcgccgtacgacggcccacgcgttgcgccacgtggacatctggcctatacgtcgggcaccaccggccgtcccaagggcgtgctgcgcagcgcggtgccgctgggtgaactcgaggaccagaccgcgcgcatgcgatcggtggtggccaaggcaatcgggatcgtgccggggtgccgtgcgctgatgtccgcgccgctctatcacagcgcgcccggtgtctttatccagaacgcgctgcagatggccgagcgcctggtactgacgccgcgcttcgacgccgagcaggtgctggcgctggtcgagaagcatcgcatcgacgtgctctacctggtgccgatcatgtacgtgcgcctgctcaagctgccgcccgaggtgcgcgcgcgctacgacctgtcgtcgatccgctttgtcgcgtccacgggctcgccgtgcgccccggaggtcaagcgcgccatgctcgactggttcggcccggtgatccacgaaacctatgcgtcgagcgaggcgggcatggtcaccgtggccacacccgaggatgcggccgagcgtccgggcacggcggggcgtccggttgatgcggccagcgtgcgcatcatcgacgaatccggacgaccctgcgcgccaggcgaagtcgggctcgtgtacgtccgccagcccgcctatcccgatttcacctacctgaacaacgatgccgcacgacggacgatcgacgtggacggtcgcgtcacgcttggcgacatggggtacctcgatgcggatggctacctgttcatctgcgaccgcgcgtcggacatggtcatctcgggtggcgtgaacatctatccggccgagatcgagcatgaactcgtgcgctatcccggagtggccgattgcgtggtgtttggcgtgccggacgacgagtatggcgagcggctccacggcgtgattcag

SEQ ID NO: 32445 - DNA, 330 bp, Ralstonia metallidurans
ctggcccgcgtggcggccacgctggaatcgcgcaagcccgaaaacggtggtgacccggagaaatcctatgtcgccaagctgttcaagaagggtgacgacgcgattctcaagaagatcggcgaggaagccaccgaaacggtcatggccgccaaggatgcacgggctgcagacttggccgacgaggccgttagcaaggtggtctacgaggtggccgacctgtggttccacaccatggtgctgctggctcgcatcggtcggaccccggaagacgtcgtcaatgaactggcgcgccgcgaaggattgtccggactggtcgagaaggccagccgc

SEQ ID NO: 32446 - DNA, 765 bp, Ralstonia metallidurans
atgttagccaaacgtatcatcccctgcctggacgtgaccaatgggcgggtggtcaagggtgtcaatttcgtcgagctgcgcgacgcgggcgatcccgtcgagatcgcgcggcgctacgacgagcagggtgctgatgaaatcacatttctcgacatcacggcaaccagcgacggccgcgacctgatcctgcacatcatcgaggcggtggcgtcgcaggtgttcataccgctgaccgtcgggggtggcgtgcgcactgtggaagatgtgcggcgactgctgaatgcaggcgcagacaagatcagcgtgaactcgtcggccatcgccaatccgcagctcgtgtccgacgcaacgggcaagtacggctcgcagtgcatcgttgtggccatcgacgccaagcgcagctccgcgcccggcgaaccgccgcgctgggaagtgttcactcacggcggccgcaaggccaccggactcgatgcggtggagtgggcccgcgagatggcacggcgcggcgcgggcgagattctgctgaccagcatggatcgcgatggcacgaagagcgggttcgacctcgaactcacgcgtgctgtcagcgacgcggtgcccgtgcccgttattgcatctggcggggtcggtggcctgcaggatctggccgatggcatccgcctgggacacgccgacgccgtactggccgccagcatcttccactatggcgagcacaccgttggtgaggcaaaggctttcatggcccgcgagggcattcccgtccgg

SEQ ID NO: 32447 - DNA, 582 bp, Ralstonia metallidurans
cgtgtcgcagaggtcacccgcaatacttcggaaacgcagatccgcgtttcgctgaatctcgatggcactggccgccagaaactggcgtccggcgtgccgttcctcgaccacatgctggatcagattgcccgccatggcatgttcgacctcgaggtcgaagccacgggcgatacccatatcgacgatcaccatacggtggaagacgtcggcatcacgctgggccaggccgtggcgcgtgccatcggcgacaagaagggcatcacgcgctatgggcacagctacgtgccgctcgacgagtgcctgtcgcgggtggtgatcgacttctcgggccgtccgggcctggagttccacgtgccgttcacgcgcgcccgtgtgggtagcttcgacgttgacctgacgatcgagttcttccgcggtttcgtcaatcacgccggcgtgacgctccatatcgacaatattcgcggcatcaacgcccatcatcaatgcgaaacggtgttcaaggccttcgggcgtgcgctgcgcatggcggtggagctggatccgcgcgcggccaacacgattccgtcgaccaagggcacgctc

SEQ ID NO: 32448 - DNA, 765 bp, Ralstonia metallidurans
gttgatgccccggtgccgggtttcgtcatgtacccaatgtcggcccagttcgccgggctcgagttcgttggtgtgccgctgcgcccggacttcacgctggaccgcgcggcaatgctggcggcgatggccgagcacaagcccgccatcatctatctggcctacccgaacaacccaacgggcaacctgttcgacgccgacgatatggcggcgatcgtgcgtgccgcccaaggcgaggtgtgccagagcctggtggtggtcgacgaggcgtaccagccgttcgcgcaggaaagctggatgccgcgcctgacggaattcggcaacctgctggtcatgcgtaccgtgtcgaagcttggtctggccggtatccgtctgggctatgtagccggcgcgcccgaatggttgtcgcagctcgacaaggtgcgcccgccgtacaacgtcaacgtgctgaccgaagccaccgcgctgttcgccctcgaacacgtggccgtactggatgaccaggccgccaagttgcgtgcggaacggtcgaaactggtcgaggccatggccggaatgccgggcgtgacggtgttcccgagcgcggccaacttcgtgctggtgcgcgtgccgaatgctgcacagatcttcgatcgcctgctggcccggaaggtattgatcaagaacgtgagtaaaatgcacacgttgctggccaactgtctgcgcgtgacggtcagcactccggaagaaaacgcgcagtttcttgaggcattcaaggcctcgttgcag

SEQ ID NO: 32449 - DNA, 1182 bp, Ralstonia metallidurans
gtgaacattcacgaatatcaggccaaggagctgctgcggcgctacgacgtcgccgtgccaaacggctgcgtggcatttacccccgaagaggctgcgcaggccgcacgcaagctgggcgggcccatctgggtggtgaagtcgcagatccacgccggtggacgcggcgcgggccggtttgccggcgatccatccggcaagggcggcgtgcgcgtggtgaagtccatcgacgaggtgcaggcaaacgcctcgcagatgctgggcgccacgctggtgaccaagcagaccgggccggccgggcgcgaagtgcgacggctatatatcgaggaaggctgcgacatcgcgcgcgagctctatcttgggatgctgatcgaccgcgccacatcgcgcatcaccgtcatggcatccacggaaggcggcatggaaatcgaggaggttgccgcgcataccccggagaagatcctgaaagtggcgatcgatcccgccagtggtatccagccgttccatgcccggcgcctggcattcgggctgggtctgtccggcaagcaggtggcggcggccacgcgcttcatcctgtctgcctatcgcgcatttacggaactcgatgcctcgattgtcgagatcaatccgctcgtggtgacaggcagcggcgacgtgatcgcgctcgacgccaagttcaacttcgacgacaacgcccttttccggcatcccgatatcgaagcgatgcgcgacgaaagcgaggaagatccggccgaaaccgaagccgccaggcacgcgctgaactacgtgcggctcgacggcaacatcggctgcatggtcaatggcgcggggctggcgatggccacgatggacatcatcaagctttacggcggcgagccggccaacttcctcgacgtaggcggtggcgccaccaaggaacgcgtgacggcggcgttccggctcatcctggccgatcccaaggtggaaggcatcctggtcaacatcttcggcggcatcatgcgctgcgatgtcattgccgaaggcgtgatcgccgccgcgcgcgatgtcgacctgacagtgccgctggtggtgcgcctggaaggcaccaatgtcgaactaggcaagaccatcctgcgcgattcgggactgccgatcctatcggccaatcatctcgccgacgcggcggagaaagtcgtggccgcggtc

SEQ ID NO: 32450 - DNA, 859 bp, Ralstonia metallidurans
atggccgtgctaatcgaccaacatacgcgcgtgatctgccagggtttcacgggcgcccaaggcaccttccactcggagcaggcattggcctatggcacgaaaatggttggcggtgtcacgcccggcaagggcggagagacgcatctggggctgccggtattcgataccgtatcggccgccgcccatgccaccggcgccgatgcgtcggtcatctacgtcccgccgccgttcgccgccgatgcgatcctcgaggccgtggatgccggcatcggactgatcgtctgcatcaccgaaggcattcccgtcattgacatggtgcgcgtcaagcgggcgctgagcggctccgccaagccggctggtcgggcccaactgcccgggcgtcatcacgcctggccagtgcaagatcggcatcatgccggggcacatccacaagccgggacggatcggcgtggtatcgcgctccggcacgctgacctacgaagcggtggcgcaaacgacggcaacggggcttggacaatcgacctgcatcggcattggcggagatcccgtcaacggcacgaacttcatcgacagcctggaactgttccttgccgatgatcagaccgaaggcatcatcatgatcggcgagatcggcgggtcggccgaagaggaagccgcgcaattcctgcgcgacgcgcgcactcgcaaacccgtggtcggattcatcgccggctccacggccccaccgggccgccgcatgggccatgctggcgccatcatatcgggcggcacgggcacggccgaggccaagatcgaagcgatgcgcgaggcgggtatccacgtggccgcgtctccagcggagctgggcaatacgatggcg

SEQ ID NO: 32451 - DNA, 1311 bp, Ralstonia metallidurans
tttcacgagttcgtcgccgttgatcttgcccatacgaccatgctcgtggaacagggcattctttcggcggagaccggtcgggccatcctggagcaattgctgatcattcggagaatgcagccctccgcgtttcccgtggatgtgcgcaagggcagccttctgctgcagatcgagtcgtatctcttcggcgccatcggcgaggacgtgggcggccagatgcacaccggccgcagccgcatcgatcagggcgccacggtacgccgcctgtacaagcgcaaccgcatgctggatgtgatggaccagttgaacgtattccaggaggcgattgccgaacaagcgcgccaccacgcgcacacgatcatgcccggctacacccatatgcagcaggcccagccatgggtgttcggacactatctgctcagcttcagctcccgattgcatgacagcttcgagcgtctggcgcaggcgtacggacgcgtcaaccgcaatccactgggaaccgtgggtcttgccggcacgtcatggccgcttaatcgcgagcgaaccacggaactgctcggattcgacggccaaatcgagaactccaagcttggccgcgaagctttcgatgcagcggatgcgatctgcgcactgtcgttcatcatggccgatttgaacgatctggctaccgacctgcatatctggtccagtgccgagttcggattggttgaatccgatgacagctactgtggtacgagcagcatcttcccgcagaagaagaacccggtcgcactggagaccatcaggaaggccgccggtcctgccgtgacgtggctgagcgcggcgctggccacgttccgcgcggaagggaccggcgaccaggccatgcgtagcgtctcacatatcgacgaggccttggcaacgacagaaagcatgctcgatctgttcactggcgtcatggaaacgctgatcgtgcatcaggaccacatggccgaatcgctcaagggaagctggtgcaccgcgagcaatctggcggacgtcgtcgtgcgtgaacgacgtctgtccttccgccaggtgcaccacatcgtcgcccgtgcggtgcgcaactgcgtggcgcaaggactgcgtcccgatcagttgaccagcagccgtctcgatgaggcagctctcgaaacggtgggtatcgcgctgaatctgggcgacgcggcggtacgtgatgcgctcgatccggttcgctttgtcgaaacccggattacggaaggcagcgtcgggccgcagcaggttgcgcgactgctcgaacgcgcggcgcaagaacgcgctgcggatcgccaa

SEQ ID NO: 32452 - DNA, 702 bp, Ralstonia metallidurans
atgtcacacaagactttcctgatcaccggtgcgagcaagggaatcggccgggcgttgtcccatcgcctggcggctgccgggcacaaagtgatcggcgtcgcgcgtaacgccgaccccggtttccccggcattctggtgcccatcgatctcacggacccggttgccactgaacatgcgctgacgacactgaggtccgagcacgtgatcgacggtgtcgtgaacaacgtggggttcatcgagcttgcgccacttggcaatatcgacctggatgccatggacgacatgtttcggtcgaacctgcggccagccgttcagcttgtccaggcgctgttgccggacatgcgggagcggggttggggccgtatcgtgaacctgtcgagccttgtcgtgctgggcgttgcgaaccgctccgtctatgccgcggccaaaagcgccatgatcagcttcacacgaacgtgggcactcgaactcgcacccaccgggatcacggtgaatgcggtcgcgccggggcctgttgaaaccgaaatgttccgtgccaatacgccacagggcagcgatgcggagaagcgatttctgtccatggtgccgatggggcgtctgggcaagccggatgaactggccgccgcgatcgaattcctgctttccgagcctgccggctttattacggggcagacgctgttcgtggatggcggcgcgtcgatt

SEQ ID NO: 32453 - DNA, 1449 bp, Ralstonia metallidurans
cggctgacgccggccatcatcaccacggttgtgcttgtcacgctgctgctcacaccgacgccggctggtttgaaggacaacgcttgggatctggtcgccatctttctgaccacgatcgtcgccatcattctcaaggtgatgccgatcggtgtgatggcgatgatggcgatcgtgatcgtgtcactggcgcaagtgacctcgaactcgtccaagggcgccattgccgatgcgctgagcagttttgatagtccgctgatctggctgatcgttgtggccatcctgatttcgcgcggcctgaagaagacggggttgggcagtcgcatcggcctgatgttcatcgcgctattgggcaagcggacggtcggcattggctacgggctggcgatctgcgagctggtactggcgccattcacgccgagcaacaccgcacgcggcggcggcattgtgcacccgatcatgcggtcgattgcaggcgccttcgattctgatccggctaacgggacgcagggaaaggttggtacctatctggcactggtcaactaccacgccaacccgatcacttcggccatgttcgtgaccgccaccgcgccgaaccccctggtcgtcgactacgtggccaaggccagtggccagtcgcttcacctgagctggaccacctgggcgctgtgcatgctgctgcccggcctcgtctgcctgcttctgatgccgcttgttattcgcgtgctctgtccgcccgaactgaaggcgacccccaatgcgatcgaatacgccaagggtgagcttgctcgcatgggccccctgggtggcaaagagcgcgtcatgattggtgtcttcgccatgatgctggttctgtgggccaacgtgccggcaatgatctgggggccgacgttcacgctcgacccgacggtggtcgcctttctcggcctgttcgcgttgatcattaccggcacgatcgactgggacgatgtgttatcggagaagagcgcctgggacaccctgatctggttcggcgctctggtaatgctcgcggaacagctcaacaagcttggcgtaatcgcatggttctcggccgatatgcgcgatgccattgccgccagtggaatgggttggctctcgattgccgccatattggtgctggcgttcgtgttttcccattacctcttcgcaagtaccactgcccatatcagcgcgatgatgctggcctttctgacagtgggcgcgcagttgattccgcagccttatatcgcacctttcatgctgatgatgaccgccggctcggcgatcatgatgacgctgacccactatgccaccggcacatcgccgatcatatttggcagcgggtatgtgacgatggggcaatggtggcgggtcggcgcggtgatgtgtgtctttgaacttgtcatcttcgccgtagtaggaggtatctggtggaagattctggggttctgg

SEQ ID NO: 32454 - DNA, 1242 bp, Ralstonia metallidurans
gcccaactcatggccaccgatgtgttggtcattggtggtggaggtggcgggtgcgccgcggcactcaccgcggcaaagcatggggcgcgggtcatcctcgccaccaagcttcgcctcggcgacagcaacactgtgatggccgaaggcgggatacaggccgccatcggagaggacgacagccctcaattgcacttcgaggacacgctgcgtgccggacacttctgcggcgatcccgcactcgtagcgcaaatggtgatggatggtccggatgtcattcgctggctgatccagctcggcatgatgtttgaccaggaagaggatcggccaatcggcggcaaccttctgcgcaaaaagcccggcggcgcctcggccgcgcgcattctttcctaccgggactacaccgggctggagatgatgcgggtgctgcgggaagcggtggacctggatcccggcatcgaggtatggaaccgctgcccggcggtcgagctgctgtccgacgagcggggaaactgcgcaggggccgtgatctacaacctcgaatcacgcacctttgtgctagtgcgcgctgctgccgtgatcattgctaccggcggagccgggcgcctgcacctgaattcgtttccaacatccaatcatttcggtgccaccgccgacggcctcgtgctcgcctaccggatcggagcgcgcctgcgcgagctcgactcgttccagtaccaccccaccggcattgcgtaccctccccaccttgcaggcggactcatctccgaggccgcgcgctccgcgggcgccaagctgatcaacggcgagggtgagcgctttgtggacgaactcaaggcacgggacatcgtggcctcggcgatattgcgcgaatgtgcgcaggggcgcggcatcatccgtgaggggcaggtgggcgtgctgctcgacacgccgacgctcgaaatggagcatcccggcatcctggacaagcgccttgtgacgttgagccaccttgcgcacaagtgcggtcacgatgcagcgaaggaacccttccttgtctacccaacccttcactaccagaacggcggcgttgcgatcgacggacatgggaccaccagcgtatccggactgtactgcgtgggtgaggtagcgggaggcatccacgggcgcaaccggctgatggggaatgcgctgctcgacatcctaagcatgggtcggcgcgcgggcgcgtcggcagcggaggcgaagcgttcggctgtggccagc

SEQ ID NO: 32455 - DNA, 1035 bp, Ralstonia metallidurans
atgggcactgttgcgcgttttgaaatcggctttacccgctacctctcccccgacggctcgccagagcccgaccttcccgactttgcccgcgatccggccaccctgctgccgctctatcgcgccatggtgctgacccggcagttcgatctcaaggccatcgcgatgcaacgtaccggccagatcggcacgttcgcgtccgcgctgggccaggaagcgatcggcgtcggcgtggccacggcgatgcgccgcgacgacgtgctggtgccgtcgtaccgcgatcatgccgcgcagtttgtgcggggcgtcacgatgacggagagcctgctgtactggggtggcgacgaacgcggcagcgcgtttgccgcagtgccatatgacttcggcaactgcgtgccgatcggcacccaggttggccatgcggccggcgtggcctacacgttcaagctgcgccaggcaccgaacgtggcggtgtgcatcctcggcgacggcggcacctcgaagggtgacttctacgaggggatgaacatggccggcgcgtggcacgtcccgctggtcatcgttatcaacaacaaccagtgggccatctcgatgccgcgcgccaagcagacggcggcggcgacgctggcccagaaggcgatcgcagcgggcattccgggcgaacagatcgacggcaacgacgtgattgccgtgcggcagcgcgttggcgcggccatcgaacatgcgcgccacggcggcgggccgacgttgatcgaggcggtgagctaccgcctgggcgaccatacgacagccgatgatgcgtcgcgctaccgggacgaggcatcggtcaaggaagcctggcgctgcgagcccattatccggctgcgagactacctggcccgcctcggcgcctgggacgccgcgcaggaagaggcgctgatcaaggaatgccagcaggccgtcggcgcggccgtgcaggcctatcttgcgctgccgcatcccgatgcatcggcgatgttcgattgcctgtatgaaacgctgcccgacgccatggccgaa

SEQ ID NO: 32456 - DNA, 960 bp, Ralstonia metallidurans
ctgcatatggtggaagccgtcaacctggccctggcccatgccctcgccaacgatcccgacgtggtgctgctgggcgaggacatcggcgtgaacggcggcgtattccgctcgactgtggggctgcagtcgcgcttcggcgaggcccgcgtcatcgacacgccgctggccgaaggcgccatcgtcggcgcggccatcggcatggcggcgatggggctcaagcccgtcgcggagatccagttcgccggcttcatctatccggcgatcgacaacatcctgaatcacgcgggtcatatgcggcaccgcacacgcggccggatcacgtgcccgatggttgtgcgcgcgccgagcggcgcgggcatccacgcgcccgaacaccattccgaaagcccggaggccctgttcgcgcagatgccgggcatccgcgtggtcatgccttcatcgccggcgcgcgcctacgggctgctgctcgcggcgattcgcgacccggacccggtgatcttcctggagcccacccgcctgtaccggctgttccggcaggaggtcgccgacgacggccaggcgctgcccctcgacgcctgcttcacgctgcgcgagggcacggacctcacgctggtgagctggggcgcgatgttgcgggaaacgctggccgcggccgatgtgctggccgacgacggcgtttccgcggcagtgatcgacgtggccacgctcaagccgctggacatggagaccatcctggagtcggttgcgcagagcggccgatgcgtgatcgtgcatgaagcaccgcgcaccgccggcctgggcgcagagattgccgccaacctggccgacgcgggactctattcgctgagcgccccggtgcagcgcgtgacggcgcctgacacggtggtgccgctggcgcgactcgaacacagctacatgccgtcggtggcgcggattgtcgacgcggcgcgacgcgcgctg

SEQ ID NO: 32457 - DNA, 1122 bp, Ralstonia metallidurans
aagctgcccgacctgggcgaaggcctgcaggaagcggaaatcgtcaactggcatgtgaagcccggggacaccatcgcagccgaccagccgctgttgtcggtggaaacagccaaggccatcgtcgagatcccctccccgttcgccggacaggttgcgaaactctttgcgcaaccgggcgacatcgtccacctgggcgcgccgctggttggcttcgagggcgcgggggcgtccgacgatgccggcacggtggtaggcgccgtgaaggtcggcacgcatgtggtcaatgaaggcgtcacgcgcgtaggcgccgccggcattcccggcggacatggcatcaaggccacgccggccgtgcgcgcgctggcgcgcaagctgtcggtcgacctgtcgatggtcaccccatccggccacgatggcgtgatcacggccaccgatgtgcagcgcgtggccaccaccctggcggacgtcggcgcgccggacgtgctgcgcggtgtgcgccgcgcaatggcgcagaacatggcgcgcgcgcagagcgaagtggccgcggccacggtcatggacgatgcggacctgcatgcgtggcaggcgaccggcgcatcggtgaccggtcaggacatcacgatccgcctggtgcgcgcgctggtggccggcgtgcgcgcggaaccggcgctcaacgcgtggtacgaaggcaggaccggcagacgccacctgctcgagcggatcgacgtgggcattgcggcggacctgccggaggggttgttcgtgccggtgctgcgcaacgtcggcaaacgcgatgccgccgacctgcgtgccgggctggaccgaatgcgcgccgacgtggtcgcacgcaccatcgcgccggaggagatgcgcggcaataccatcaccctgtcgaacttcggcatgatcgcgggccgctacgcggcgcccatcgtggtgccgccaacggttgccatcctcggcgcggggcgcgtgcgcgacgaagtggtggcatccggcggcgtgcctgccgtgcaccgggtcatgccactgtcgctgacattcgatcaccgcgtggtcacgggcggcgaggcggcccggttcctgcgcgcggtcatcgaggatctggaacggcccgagtag

SEQ ID NO: 32458 - DNA, 648 bp, Ralstonia metallidurans
atggcaatccgacttggcgaggaagcaccggacttcaccgccgacaccactgaagggaagattcattttcatgagtggatcggcgacagctgggccatccttttctcgcaccccaaggatttcacgccggtctgcaccaccgagctcggctacatggccaagctgaagcccgagttcgacaaacgcaatacgaagatcatcggcctgtcgatcgatccggtgggcgaccattcgcgctgggtcaaggacatcgaggaaacgcagggcgccacggtcaactacccgatgatcggcgatcacgacctcaaggtggccaagctctacgacatgatccaccccgaggcgagcggcggcccacgcacggcagcggacaacgccacgatccgcgcggtgttcatgatcggccctgacaagaaggtcaaggccatgctggtctacccgatgagcgcgggacgcaatttcgacgaggtgctgcgcctgctcgactcgctgcaactgaacgcgaaacacaccgtcgccacacccgtcaactggaagccgggcgacgacgtgatcatccccacctcggtgtcggatgacgacgcgaagaagaaatatccacagggcttcaagacgctcaagccttatctgcgaacggttgcccagccg

SEQ ID NO: 32459 - DNA, 1608 bp, Ralstonia metallidurans
atggacgtaaccgaaatgcagcgctacaacacgcttctggctacggccagtcgtgaggccgaagctgccacggaagccaagtctcgttttctggccacaatgagtcatgaaattcgcacgccactggccacggtcattgcctcgctggacctgctgcgcgagagcgaactctccacccaccagcgggaagaactggatctggccgatcattcggccaagcttctcctggagattctcggcgatatcctcgacttttccaggatcgaagcaggggagatgaagcttgaacaggcgccgattgacctgcgactgatcatcgaggatgttctgcgcatccaggcgcgccaaatcgaaaagaagggcgtgatactcgacttctacgtggaagcggggctggccgcgacgttgcttggcgatgcagtgcggctcaggcagatcgtgctcaatctcgtgggtaatgctacaaaattcacgcttcagggcagcatcgttgttcgagcattgttgatagcggaccatcccgaaacacagacgattcaactggaagtcagcgacactggtatcggaatccccgcggagaagcaagccgctctcttcaaggcattttctcaggctgatgtctccacaacgcgccgattcgggggcagtggtctggggctgtcgatttgctccaggctcgttcaagccatgggtggggccgtcgtcttgactagtacgccaggtgtcggcagcacgttccgcgtggaactgacgctgcccgtcgtcgagcgcagcacgcggatggtggagtttgcaaaaactcacatcgcgattgatgtgtcgcgtgcagatgacgcagcagtgtttcgtgagcacgctgttgcactcggtatgcagcttgccccccttgattgcctgaatccttccgatattgctgtgattgatgaagacgccgcctcagacaaagtgcctgtgggcgtgctgaccatcccttacgggaaaaagcacggcaatctgtctggcccacccatctggtggagcgagtttcgcgcggcatgtctcgatgcagttcttcgcgatacgcatcggtttcccgcgcaaggtcaagatgtcacggcaacaccaccgatctccgattcgctggccggtctgacatctctaccgattctcgtcgcggaagatcacacaccattccagatcgtaattcgcaggcagattgaaaagcttggtctggcatgtgacgtcgtatccgacggaaaggaggcgctggctgcgattcgcaacaagcaatatggcatgatcctgaccgactgccacatgccgtatatggacggctacgaactcaccagcgcgattcgggcatccgaggctcaaggacaacggctcccgattgtcgcgctgagcgcggatgcttcggatgagcaaagacaccgcggccgtgccgccggtatggacgacttcctgctcaagccgctcaaactcccggaactacgcgcgtgcatccagcggtgggtgcttcggtgattccaggtcggtggcctctgggatagcctgccacggccccggcgtgcgagctggcgccctccttaccggaaactcctccacgtcgggacgccgcactcaggcttt

SEQ ID NO: 32460 - DNA, 1663 bp, Ralstonia metallidurans
ttcgtcgccgcacgggactttctgctgcgacatcgcgcggactacgatcgcgcatatggggaatttgcctggccacagctcggcgagttcaactgggcgctcgattacttcgacgtcatggcgcagggaaacgacaatcccgcactctggattgtggacagccccaatgatgcaggcgcgccattgtctttcagggagatgtctggagcgctcttctcgcatggccaactacttacgcggcttgggtgtctcgcgcggtgaccggctcctcctgatgctgcccaatcgggtcgagttgtgggatgtcatgctggcggcgatgaagctcggtgccgttgtgctgcctgccacgacccagttatctcccgacgatgttcgcgatcgcgtgcaactcggcgaggcgcggttcgtcgtggtcgacggtgcggagctgggaaaattcgaagatgttgacgcgagcgtcacccgtatcgcggtgggcgagcgcgtcgcagggtggcatcacattggtgacgcgtatcaggcgtcgccaaccttcgtcccggacggggtaacccgcgcgacggatctgctgctcctgtatttcacgtcgggcacgacatcgaaaccaaagctggtcgaacacacgcatcagagctatcccgttggccacttgtcgacgatgtactggattgggctccagcccggggacattcactggaacatcagttccccgggatgggccaagcacgcatggagttgcttctacgcgccgtggaatgcccaggcgtgcgtcttcatctacaacttcgcccgcttcgctccgagggatgcgctggacgtgctcgtgcaacgcaacgtcactacgctctgcgccccgccaacggtatggcgaatgctcgtgcaggagccgttggcttcgtatgcggtaaagctgcgcgagatcgtcggggcaggagaaccgctcaacccggaaatcatcgagcgggtgcagagcgcgtggggcatcaccattcgcgacggattcgggcagaccgagacaacctgccaaatcggcaatccgccgggtcagcccgtcgtgccaggctcgatgggcaggccgcttcccgggtaccgtgtcgatctggtggatctggatgatcatcccgcaaacgagggcgagattgtcctctcgctggccagccgcccgcttggattgatggcgggctactcgaacaacgagaaggcgactgcggaagccatgcgcaatggcttctatcacacgtccgatatcgcgatgcgccgggacgacgggtaccttgtctacgtgggtcgcgcggacgatgtcttcaaggcatcggactaccggctgagtccattcgagctggagagcgtcctgatcgaacacgaggccattggcgaggccgccgttgtgccgagcccggacccggtaaagctgtatgtgccgaaggcctatgtcacggttcgccagggctacgaggctggccccgaactggccagggcggtattccgcttttcgagagagaagctcgctccgtacaagcggattcgcaggctgcagttcagcgagctacccaagacgatctccggaaagatccggcgcgttgacctccgccgccgcgagatggagcgcgaggatcagtcgtcgaggatgcccggtgaatactgggaggaagatttcccc

SEQ ID NO: 32461 - DNA, 723 bp, Ralstonia metallidurans
ttgcagggacgcgtagcgatcatcaccggcgccgccgccggcatcggttttgccaccgccgaacgtttcgccgccgaaggcgcgaagctcatcatgtgcgatgtgcaggaggcccgcgtgcgcgaggccgccgagcggctggccgccaagggcgcgcaggtcgaggcgcacaaggtcgacgtcacgcgccgcgacgaggtcgatgccatggtggcagccacgctggcccgccacggtcgcatcgatgttctcgtcaacaacgccggcatcaccaaggacgcgcgcctcgccaagatgaccgaggcacagttcgatgcggtcatcgacgtcaacctgaagggcgtgttcaactgctcacaggccgtggccagcatcatgtccgagcagggcagcggcgtgatcctgaacgcatcgagcgtggttggcctgtatggcaacttcggccagaccaattacgcggcttccaagttcggcgtgatcggcttcaccaagacctgggcgcgcgaactgggtccgaagggcgtgcgcgtgaacgcggtatgcccgggctttgtcaataccgagatcctgcagaccgtgccggagaaggtgctcgacggcatgaaggaacattgctggatgcgccgcctggccgagccgtcggagatcgccgcgatctacacgttcctggccagcgacgacgccagctacgtcaacggcacgacgatcgaagccagcggcggc

SEQ ID NO: 32462 - DNA, 834 bp, Ralstonia metallidurans
agcgtcgaccgctacgtggtggtgggcaatccgatttcgcacagccgctcgccggcgatccatgccgccttcgcgcgccagaccggcgaggcggtgcagtatgaccggctcgaagccccgctcgatgcgttcgcagatacgatgcgcgaattcctggccggcggaggccatggcttcaacgtaaccgtgccgttcaagctcgaagcgtatgacctggccgatcgcctcacgccgcgtgccgaggctgccggcgccgtcaacacgatgtggatcgaggacggactgatccatggcgacaacaccgacggcatcggcctggtgcgtgacattcaggacaaccttgatgtgctgctcgaagacaagcgcattctggtgcttggcgccggtggcgccgcgatgggcgcgatgctgccgctgatcgaatgccgcccggcgcgcatcgtggtggccaaccgtaccgcctcgcgcgccagcgacatggtcgaggaattcgtggaagcggcggaccagtacaacgtggagctgtgggccggtggcctcgacgcgctcgatgcgctgtccgaggacgagcgctgcgatgtggtgatcaatgcgtcgtccagcagcctgcaaggcgaagtgccgcccgtgcccgagcacctgctcggcgaaggcgtgctggcgtacgacatgatgtacggcgcgcagccgacggtgttcctggcctatgcggccaaatgcggcgcgcgcacggcggatgggcttggcatgctggtcgaacaggctgccgaagccttctacaactggcgcggcgtgcggcccagcaccgcccccgtgctggccgagctgcgcgcg

SEQ ID NO: 32463 - DNA, 495 bp, Ralstonia metallidurans
aatctcttcttcatcggcttcatgggcgccggcaagacgacgatcgggcgcgccgtggcgcacgagctcggccgcccgttcttcgacaccgaccacgagatcgagacgcgctgcggtgtgcggatcgccacgatcttcgagctcgagggcgaggaaggcttccgccagcgcgagtcgcgcgtcctggatgaactgacgcagcgcagcgggatcgtgctggccaccggcgggggcgcggtactgcgtccggagaaccgcgccatgctgcgtgcgcgcggccaagtggtctacctcgacgcctcgctgcccgagatctggcgccgcacgcggcgcaaccgcaaccgtccgctgctgcagaccgacaatccgcgcgcgcggctcgaggcgctgttttgcgaacgcgacccgctgtaccgggaaattgcccacatcgtcatgccagcccatggtggcagcattgcccaggctgtcgccaatgtcctggcacggttggac

SEQ ID NO: 32464 - DNA, 1737 bp, Ralstonia metallidurans
atgacaactgaattgaagaagctgttgatcgccaaccgcggagagattgcattgcgcgtccagcgcgccgcacgcgacctggatattggcaccgtcgcggtgtactcgcaggacgacgcgggctgccgccatcggatgctggccgacgaagcgattgcgctggacggtgcgggccctgctgcgtacatcgacatcgcgggaatcatcgctgccgcgaaggcatcgggcagcgatgccgtacacccgggctacggctttctgagtgagcgggccgattttgcgcaggcgtgcatcgatgccggcatccggttcatcggaccgacggtcgagcatctcgcgctgttcggcgacaagggccgcgcgctgcaattggcggccgagtgcgacgtgccggtcatgcccgccacgcatggcggcgcgtccctggaggagatcgaacgcttcttcgatgcacagggcgacgccggcattgtcatcaaggcggttggcggtggcggcgggcgcggcatgcgcgtggtgcgcagacgcgaggatctggcggaggcctatgcgcgctgccggtccgaggccagttccgcgtttggcgtggatgcgctgtacgccgagcggctggtcagccgggcacgccatatcgaagtgcagatcgctggcgacggccagcacgttattgcgctgggcgagcgggactgcacgctgcagcgccgtttccagaaactggtggagattgccccgagcccggtgctcaagccggagctgcgcgcggagattatcaaggccgcgctgcggctggcgcgtcgcgtcaactaccagagcctgggcacgttcgaatttctggtcgaggaaagcgagtcgggcgagcagaagcgcttcgtctttatcgaagccaatccccggctgcaggtggagcacaccatcaccgagcaggtgaccggcgtggatctcgtggcgctgcagatcgggctggcctccgggcggacgctcgtcgaacttgggctcgatccggcttcgccgccgcaaccccggggctatgcgatccaggtgcgcgtcaatgccgaaatgaccgatgcgcaagggcttgcgcgtccggcatttggccgtctggagcgcttcgagccgcccgccggtccggatgtgcgggtggactcccacggctacgccggctacgagccgtcgccgaacttcgacaccctgctggccaagctgatcgtaagcagcgccgcacccgggttcgaagctgccgtgcgccggctgcagcgcagtctcgcggaattccgcatcgttggcgtgccgaccaacctcaacctgttgcgggcgcttgcccaacgcgaggacttcctgacgcaggacgtccacacgcgtcttttcgagtcgatcctgccggcgctgatggcgtcggcggaaaccatcgccgaagccgagcgcgcgcaggacgcgcgtttcggcggcgcatcccatgcaacgcccgtccacgcgagccacgcgacccgcgcgccggaggctgaagaggaactggaagaagggctcgtggcgatccgcgcgccgctgactggccgcgtggtcgacatcccggtgcaactggacgagatcgtcaagcctgggcagacggtggccgtgctagatgcgatgaagatggagcatgcgattgtcgcgccgtgcgcgggccgtgtggtcgatctgcgcccggagaagggtgcgctggtgtccgaaggccacatgctgatcgtgctcgagcaggca

SEQ ID NO: 32465 - DNA, 1476 bp, Ralstonia metallidurans
gtcgccatccgcctgcaggccgagcgcgaactccagcgggctcatcgactggccgaggatgcgaacgcagccaagtcgatctttctggcggcgatgagccacgagatgcggacgccgttgtacggcatgttgggtacgctggaattgttgtccctgaccgcgctggatgatcggcagcgccaggacgtcgggacgattcagacgtcgtcggccacattgctgtcgatcatcgacgatctgctggactacaccaagttcgagggcgggcagctcactctggagtccgtggcgttcgatcccgtggaactggtggaggccgtagctcgatcccacgcgccgctcgcactgcgcaagggattggcgctgacctgctatgtgcaggccgatctaccctggctcatcggcgatccggtccgtgtcaggcaggccctcgacaattttctaaccaacgcgttgaagtttacgtcggaagggcacgttggcatccgggccttccgcgccgcttcgacgccctcggacgagacgacgctgtgtctggtgctggaagtcctcgataccggtatcggcatgtcgccaggcacgcaggcacaactcttcgaaccattcgttcagggtgatgccaccacggcccggcgtttcggtgggtcgggcctcggcctttcgatctgcaggaggctggcccgccggatgggggccagcattgtcgtcgagagcgagcttgggcgcggcagccgcttttccttttccgtgcccctggagattggggaggcacgacagtcggtcgaaccggcattgcccaatgtcgtcgtccgggcgcaggaccccgtatggcgcgcggatgtcatcgccatgatccgccagtcaggaggaagggcaattgcctgccagggcgacgccaccgacccgggcactatcctgctgatagcggacgagacgcagggccccgtgccgaacggatacgccggagtggtcaggctcaaggcaagtgggccgctggaggccgtggcaaggcccgatggcctggttgtatccgcctatcatcaggccggcatcgtgcgcgcgctgtgtcgggcggcaggcatcccgctgaccagcacggcgtctccggttcaacgttcgacgcagatgttgaagctggatctgcaggtgctggcggtggacgaccatccggtcaatcgccggctgatgcagcagcaactagaacagctgggttgccggacgaccatggtcagtagtggcgaggacgcattgcttgcttgcaggcagggccaattcgatgcggtgctgaccgatgtgcacatgccagggatggacggctatgcacttgcgcatgccttgcgcgcggacggcttcaccatcccgatcatcggcgtcaccgccagcgtggccaccggagaggccgagcgctgcgtggcatcggggatgaacggacatctcaccaagcctgttctgttgcaggcccttgccgatagcctc

SEQ ID NO: 32466 - DNA, 1368 bp, Ralstonia metallidurans
acctcattcgccacgctgccgctgtccgcggccatgcaggctaccctcgtccagctcggctacgacgccatgacgccgatccaggccgccagcctgccgctcgcgctggctggtcacgacctcatcgcccaggcccgcaccggcagcggcaagaccgcagcgttcgcgctctcactgctgcatcgtctcgatccgcgtccgctcgacgtacaggcgctggtgctctgtcccacacgtgaactggccgatcaggtcacacaggagatccgtcgtctcgcccgcgcggaggacaacgtcaaggtgctgacgctcagtggcggcacgccaatccggccgcaggtggagagccttgttcacggcgcgcacgttgtcgtaggcacgccgggccgcatcatcgatcacctcgatcgcggaagcctgaatatcgatgcgatcaacacgctggtgctcgatgaagcggaccgcatgctcgacatgggctttcacgatgacatcgcatttatcgccagccacgcaccgaaggaccggcagacgctgctgttctcggccacctatccggctgccatcgacaagctcgcccatcgcttcctgcgccagccgaagacggtgaaggtggaggaggcgcacgacgcggccaccatcacccaacgcttctacgaggtggaggagggcgatcgtctcaacgccgtcggccgattgctcgaccatttccgcccggccaccacactcgccttctgtaatacgaaggcgcgctgccgcgatctggccgacctgctgcgcgcgcagggatatgccgcgcttgaactgcacggtgacctcgatcagcgcgatcgcgaccaggtgctggtgcagtttgctaaccggagctgctcggtgctggtagctaccgacgtggccgcacgcgggctcgacatcgcgcagctggaagccgtgatcaacgtggacgtgacgcccgaccccgaggtccatgtccaccgcgtcggccgtaccggacgcgctggcgaagcaggctcggccttcagcctcgtcagcctggatgaaatgggtcgcgtcggcaacatcgagcagcaccagggcggtgagttcgaatggcacgcgcttgacgaactgaagccgtcaggcggcggacgtctgctgccgccaatggtcacgctgcagatgctgggtgggcgcaaggagaagatccggcccggcgacatcctcggcgcgctgaccggagaggctggcttcacaaaggagcagatcggcaagatcagcgtgatggagatgtcgacctatatcgccgtggaccgcgccatcggtcgcgaggcggtgaaacggctgaacgaaggcaaggtgaagggccgcaaggtgagagtgagaatgctg

SEQ ID NO: 32467 - DNA, 714 bp, Ralstonia metallidurans
aaacgagcgatagtcaccggcggcagccggggtatcggcaaggcgattgcgctccagctcgcgcaagaaggcgtcgacgtggtggtggcagcccgtggacgcgcggcgttggaagcgacggctgcggagctggcgacgctgacaggaagacggatcgtgccactcgccgtcgacacttccagcaaggcttccgtggacagcatggtgaaccaggccatcgccgcattgggcggcatcgatatactggtcaacgccgctgcattgcccggtggaatctcatcggcgtcccggctcgatgaaatcgacgatgcgcaagccattgaagacatcgacatcaaggtgattggctatctgcgcaccgcgcgggcgctcgcgccacacctgattgccaatggctggggacggatcgtgaacattggtggcttggcgatctatcgcaccggccgccccattgccacgctgcgcaacgtcggcgtggctgcgatcaccaagaatctggcggatgaactcgggccgaagggcatcaatgtcacggcggtccatcccggagcgacacggacggagacaaccgacgcggcattcgaggcctgggccgcggcaaggacctcgctgggccgcattgtggaagcccgcgaggttgcagccgtcgtggcattccttgcatcgccagtgagtgtggcgatcaatggcgatgccatttctgtcgctggcggg

SEQ ID NO: 32468 - DNA, 729 bp, Ralstonia metallidurans
gttgtcttgattaccggcgcgaccgccggcatcggccgtgcgacggcgcttgcctttgcagccaagggcgcgcggctggtctgttccgggcggaatgccgcagccggagacgccctcatctccgaacttcgggagatgggcgcggaagcagacttcctggcggccgatgtcagccgtgaggacgatgtcatgcgtcttgtcagtcatgccgtcgagcgctttggctgcctcgatatcgcagtgaacagtgccgggacggagggcacaccggggtcgatcgtcgagcagaccgtccagtcgtacgcgacgacgttcgatgcgaacgtccttgggacgttcctttgcatgaagcacgagctgaaagcaatgatcgggcaacagcgcggagtcgttgtcaatctgtcgtccacgatgggcagtcgcggcaatccgcgcaatccgatgtatgtggcgagcaagcacgcaatcgagggcctgaccaagtccgcggcccttgacgtcatccaggcgaatgtccgcgtcaatgccgtggcgccgggcccgattgaaacggccatgctcgggcgcattgccggtggcgcggatcggcttgcctccgtcgctgcgacgatccctgccgggcgcgttggcaccccggaagaggtcgccgatgcgattctgttcctggcatccgatcaatcgacgtacatcacggggcagatccttcatgtgaacggtgggaagaccgcc

SEQ ID NO: 32469 - DNA, 810 bp, Ralstonia metallidurans
atgaaggatttccacaacaaggttgccgcgatcaccggcgccggctcgggcatggggcgctgtctggccatccagctcgcgcagtccggctgccacgtggcgatatcggactgcaatgaggcgggcctcgcgcagacggtggccgaagtgcgccgcgtggcgcccatggtgcaggtcaccagtcatcgcgtggatgtcgcggatcgcgccgccgtccatgcctgggcggatgacgtggcgcgtgcgcatggccgcgtgaacctgatcttcaacaatgccggcgtggcgttgtcgagcacgatcgaaggcatggcctacgacgatctcgaatggatcatcggcatcaacttctggggtgtggtgtatggcacgaaggcattcctgccccatctgaaggccagcggtgaaggccatgtggtgaacacgtcgagcatcttcggcctgttcgcgcagcccggcatgggcgcgtacaacgccagcaaatacgcggtgcgcggatttacggaatcgctgcgccaggaactcgatctgatggactgcggcgtgtccgcgaccactgtgcatccaggcggtatcaagaccaatatcgcgcgtgccagccgggtctcgtcgagcgtgaacgggctgctggtgcgcgacgcgcagcagggccgcgaggagttcgagaagttcttcatcaccacggcagacaaggccgcgcgcgtgattctggacggggtgcgcgcgaacaagcgccgcgtgctgatcggcccggatgcctacgcggcggatgccctctcccgcgtcctgcctgccgcgtaccagtcgctg

SEQ ID NO: 32470 - DNA, 1800 bp, Ralstonia metallidurans
gtcaagaaccagaaactggtcgcctgggttgccgacatcgccgcattgaccaagcccgaccaggtctactggtgcgatggctcgcaggaagaatatgaccgcctgtgcgagcagatggtcgccgccggcacgatgcgccgcctgaacccggccaagcgcaagaactcgttcctggccctgtcggatccctccgatgtggcacgtgtcgaagaccgcactttcatctgctcgcagaagcaggaagacgccggcccgaccaacaactggaccgcaccggccgaaatgcgccagacgctgaacggcctgttcgacggctgcatgcgtggccgcaccctgtacgtggtgccgttctcgatgggcccgctgggttcgccgatcgcccacatcggcgtcgagctgtccgattcgccgtacgtcgccgtgaacatgcgcatcatgacccgcatgggccgcgccgtgtacgacgtgctgggtgccgacggcgagttcgtgccgtgcgtgcataccgtgggcaagcctctggccgccggcgagaaggacgtggcatggccgtgcaatccgaccaagtacatcgtgcacttccccgagacgcgcgaaatctggtcgttcggttcgggctacggcggcaatgcgctgctgggcaagaagtgcttcgcactgcggatcgcctcgacgatgggccgcgacgaaggctggctggccgagcacatgctgatcctcggcgtgacctcgccggaaggcaagaagtaccacgtggctgccgcgttcccgtcggcctgcggcaagaccaacttcgccatgctgatcccgcccaagggcttcgagggctggaaggtcacgacgatcggtgacgacatcgcctggatcaagccaggcaaggacggccgcctgtacgccatcaacccggaagccggctacttcggcgtggccccgggcacgagcgagaagaccaacttcaacgcgatggcgacgctcaaggaaaacgtcatcttcaccaacgtggcactgaccgacgacggcgacgtgtggtgggaaggcatgacgaaggaagccccggcgcacctgatcgactggcagggcaaggactggacgcccgagatcgccaagtcgaccggcgccaaggctgcccacccgaacgcccgcttcaccgcgccggcctcgcaatgcccgtcgatcgacgacaactgggacaacccggctggcgtggccatcgatgcattcatcttcggcggccgccgcagctccaccgtgccactggtgaccgaagcccgcaactggaccgaaggcgtctacatggccgccacgatgggttcggaaaccaccgccgccgctgccggccagcaaggcgtggtccgccgcgatccgttcgcgatgctgccgttctgcggctacaacatgagcgactacttcggccactggctggcgttgggcaagaagctcgaagccgccggtgccaagctgccgcgcatctactgcgtgaactggttccgcaaggacgccgacggcaacttcgtgtggccgggctttggcgagaacatgcgcgtgctgtcgtggatgatcgaccgcgtggaaggccgtggcgaaggcgccgagcacgtgttcggcacgtcgccgcgctacacggacctgaactggaacggcctggccttcaccgccgagcaattcacccaggtcacgtcgatcgaccgtgacgcatggcaaaaggaactggcgctgcacgacgaactgttcacgcagctcaagcacaacctgccgcaagcgctggcggaaaccaaggacgcactggccaagcgcctgtcg

SEQ ID NO: 32471 - DNA, 2093 bp, Ralstonia metallidurans
atgtctaaagccctcatcatcgcggaaaagccatcggtcgccgccgatatcgcgcgcgccctcgggggctttaccaagcacgacgagtatttcgagagcgacgactacgtgctgtcctcggccgtcggtcacttggtagagatcgcggcgcccgacgattacgaggtgaagcgtggcaagtggagcttcgccaatctgccggtgatcccgccgcacttcgatctgcgcccgatcgccaagaccgagtctcgcctcaaggtgctgaaccgcctgatcaagcgcaaggacgtgaccgcgctgatcaatgcctgtgacgcggggcgcgaaggggaactgatcttccgactgatcgcccagcaggccaaggccaagcagccggtgcgccgcctgtggctgcagtcgatgacgccgcaggccatccgcgacgggtttgccgcgctgcgcgaggacgaggaaatgctcccgctggccgacgcggcccgctgccgctccgaagccgactggctggtcggcatcaacggcacgcgtgccatgacggccttcaacagcaagggcggcggctttttcctgaccaccgtgggccgggtacagacgccgacgctgtcgatcgtggtcgagcgcgaggagaagatcaaacacttcgtcccccgcgactactgggaggtgcgggctgagttcatcgccgccgcgggcctctatgagggtcgctggttcgacccgaagttcaagaagaacgaattcgatcccgaggcgcgcgactcgcgcctgtggagcgaggcggaagccaagagcatcgtggcggcctgccgtgacaagcaaggcacggtcaccgaggagtccaagccgtcgacgcagcagtcgcctgccctgttcgacctgaccaccctgcagcgcgaagccaactcgcgctttggattctcggccaagaacacgttgggcctggcgcaggcgctgtacgaaaagcacaaggtgctgacgtacccgcgtaccgatgcgcgcgcgctgccggaggactacctggacacggtcaagcagaccatggacatgctggccgacagctcgccgaactatctgccgcacgcgaagaaaattctgtcgagcggctgggtgaagccgaacaagcggatcttcgacaacagcaagatcagcgatcacttcgctatcatcccgaccctgcaggcgcccaagaacctgtccgagcccgagcagaagctgtacgacctggtcgtgcgacgcttcctggcggtgttcttcccgaccgccgagttccaggtgaccacgcggatcaccgaggttgccggccaccacttcaagaccgagggcaagatcctggtcaatccgggctggctggtgatctacggccgcgaggcgcagggcaaggacgacaaggacgccaacctggtgccggtgcagaaggacgagaaggtcaagaccgacaaggtcgagtccgtcggcctgaccacgcgcccgccggcccgctataacgaagcgacgctgctgtcggccatggaaggtgccggcaagctcgtggacgacgatgcgctacgcgaggcgatggcaggcaagggcctgggcacgccagccacgcgcgcggccatcatcgaaggcttgctggctgagaagtatctggtccgcgaaggccgcgagctgattcccacggccaaggcgttccagctgatgacgctgttgcgcgggctgggcgtggaggaactgacccaggccgaactgacgggtgagtgggaacacaagttgtcgcagatcgagcgcggacgtctgaagcgtgacgagttcatgcgcgagatcgcgcagatgacgcagcagatcgtcaagcgtgccaaggaatacgacaacgacacgattccaggcgattacgcgacgctcgacacgccgtgcccgcagtgcggtggccaggtcaaggagaactaccgccgctttgcctgcacggcctgcgaattctcgatcagcaagatccctggcggccgccagttcgagatcgaggaagtcgaggaactgctgctgaagaaggaaatcggcccgttgcagggattccgcagcaagatgggccggccgttcgcggccatcctgaagttggc

SEQ ID NO: 32472 - DNA, 1476 bp, Ralstonia metallidurans
ttgctggatagcaacgtacgcaagtatccggacaagccgttcctgcggtatgccggacagtcgatcacctatgcggaattcgatgcgttgtcgcgcggcgcggccatcgtgcttgccgaccacggcgttggcgcgggcgaccgcgtggccgtgctgtgcttcaacacgccgggtatggtggcggcgatgttcggggcgtggcggcttggcgcggtggcggtgccggtcaaccacaaactgcagacaccggaggtcgactacatcctcgaacatgcaggcgtgaaggtgtgtgtgttcgacggcagcctggcttccgtggtctctcgcctgcagacgccagtgaagctgttggccaccagcaccgatgcggccgggttcgattcgttcgacgcgcaattgccggcggccggcacctacaatgcgctgccgccggccgacgacgccatcgcccagattctctacacgtccggcaccacgggccggcccaagggctgcgtgctgacccatcgggccgtgtgcatggcaggaatgaccgccgcgctggcgttgtcgatgcagcgcgacgagcgcacgttgatggcgatgccgctctggcactcgtcgccgcttaacaactggatgcttggcacgctgtacgtcggcggcaccgtcatcctgctgcgcgagtaccacccgctgcatttcctgcagaccgcgcaggacgagcgcgccacgctgtacttcggcgcgccagtgtcgtacctgctgccgctgcagatgaagatcgacgtcaccgcgttcgatctggggtcggtccgcgcatggatctatggtggcggcccgatcggcgcggacaccgcccgccagcttgcgcagctttatcgcagcgatcgcttctatcaggtcttcggcatgaccgagaccggaccgtccggcaccgtgctgtacccggaggaacaggtcgccaaggctggctcgattggccgcgtggccacgccgggtctggacatgcgtgtggtgcgcacgggcggtgccgatgctggccccggcgagattggcgaaatctggatcaaggccgactccaatatgctgggctacctcgataacgaagccgccacgcgtgaagtcatgcgcgacggttggtatcgcagcggcgatctggcccgcctggacgccgacggcttcctgttcgtggtggatcgcaccaaggacatgatcattaccggtggcgagaacgtctactcgaaggaagtcgaggacgtactgggggcgcaccccgatgtccaggacgttgcggtgatcggccggccacacgaccagtggggcgagaccgtggtagctgtgctggtgcccaggcccggcacgcagccggacccggagggcatcaaggccttcgccgccgagcggctggcgcgctacaaggtgccgcgcgagttcctgattcgcgacacactgccacgtacccccacgggcaagctgatgaagcacgtgctgcgc

SEQ ID NO: 32473 - DNA, 1104 bp, Ralstonia metallidurans
atggatttcacgtatagcgaagaacagcggatgctcgccgacagcctgcgccgctttgtcgaatccgagtactccttcgagaagcgccgccgcaacgcccgcgaacacggcagcttcgaccggggcatctggtcgtcgctggcggagatgggcgtgctcggtctggccgtgccggctgaccacggtggctttggccacggcccggccagccaggttgtcgtgcagcgcgaactgggccgcgcgctcgtgcaggagcctgtgatcccgagcggtgtcatcgccacggcgatcctcgcgcatcacgcgcctgctgccctgcaggccgagtggctgcccgccatcgcgagtggcgacaagatcttcacgctggcctatctggagccggactcgcgttatcgccccgaagtcgccaggacgacggcccgcaaggccggtgccgacggctatgtgctcaatggccggaagtcggtggtctggcatggcgcggcggctgatacgtacattgtttcggcgatgctcgacggcgcgctggcgctgttcctggtgagccgcgacgcgaaggggctggcggtaaccggctatccgaccatggaccgactgtcgggcgcgggcctgcaactcgccgacgtgcccgccacgctggtcacgacgaacggtctcgaggccctggagcttggactcgatcacggcgttgccgcgcaatgcgcggcggcggccggcgctatcgaacggctgatcgagatcaccgccgagtaccttggcacccgcaagcagttcggcaagccgctggcatctttccaggcccttcagcaccgcgtggccgacatgctgctgcagaaggaactggcgctgtcgatggcctacgtggccgcgcagggcctcgatgccaccgacgcggccgagcgccgccgcaaggtgtccgccgcgaaggtcgtcacggccaaggccgcgcgcttcgccggccagcaggcggtgcagttgcacggcggcatgggtatgactgatgaactggaggttggcgactatttcaaggcgctgaccatggtagacgtcctgctgggcgataccgacctccacctggaacgctacggcgaagccatggcg

SEQ ID NO: 32474 - DNA, 1497 bp, Ralstonia metallidurans
catcacttgctagaccgctggctgaccgagtcgcccgatcaaccgttcatccatctgccggacggccgtagcctgaccttcgccgatctgggcgcgctgaccaccgcggccgaagcggaattgctggcgctcggcgtcctgccgggagaccgcgtcctggtcgtggcggaaaactgccccgaacacgccgcgctgattctcgcctgcagccgtgtgggggcgtggtcctgcggcgtcaacgcgcggatggcgccggccgaaatcgacgccttcgccgccaaggcagatgcccgggtgatctacttcaccgcggcggcgtcacgtgccgcatccgcccatgcacgccggttcgacgccgtgccttccgcgctgaacggcatggagcacagccacgtccgcgccaacgccatgccggaagggcagccgctgcaggaccaggtggccgctctgatcttcacctccggcacaaccggcgaacccaagggcgtgatgctcacgcacgatgccctgattcactttgcccgcgtgacgtgcgaggcccgcgcgctgagcccggtggaccgcagctatgcctttgtgccgatgacccacattttcgggctcggcaccgtcctgctcagttcgctgctggccggcgcgcaactggtcatgcgcccgcagttcgatccagccgacctgctggatgcgctggcgcactgcggcgtatcgcaactgcaggggccgccgacgctgtattcgcgtctgctggcgcacctgcaacatgagggcatcacgacacccacggcgcccgcgctgcgctacctctacaccggcgccggtccgctggatctgtcgctcaagcagcgtgtggaggccacatttggcctgacgttgcaccacggctacgggctgtccgagtacgcaggctcggtgcacgtgacgcggctcggcgaccggcgtgccgatactagcgcgggttatgcggtggccgaggccgaagtgcaggtcaccgaccccgtcaccggcacaccgttacccctgggtgaacgcggcgagctgtggctgcgcggcaggggcctgatgcccggctatttccgcgatccggatgccaccgcgaaagccatgcgcgaaggcggctggtacgcgagcggcgacctcggcgaaatgcacgcggacggcgcgctgttcgtggtgggccgcctgaaggaaatgatcatccgctccggcttcaacgtctatccggctgaggtggagaccgcgctcaacacgcaccccagcatccagcgctcagcggtggtcggctgccgcgaaagcgatggcaacgaggagatcattgccttcgtggaactgcgccccggcgccacgctcgacgttgccgcgctgcagaaccacctgcgtgaacgtctggccccgtacaagcgccccgcgcgcatcgtggcgctgccagagctgccaacgaataacaacggcaagatcctcaagcgcgagctgcaggaacaggccgcatcactgctgtca

SEQ ID NO: 32475 - DNA, 1470 bp, Ralstonia metallidurans
gcgacccgtaccccgcacaatgtggcggtgcgcgagggcgaccgtgtcgtcagctatgcgcaactctgggaaggcgtcgaactggcccagcgctatctcgaagcgcagggtgtcggcacgggcgatcgtgtgctgatcgtcgcggagaacagcctggccatgatcacgctgatcttcgccttgtcggaactcggtgcgtggccggttgtgacgaatgccaggctgactgcgcgtgagatcgaggagatccgcgcgcattgcacaccgcggctgatgctcttcactcatgccgcatcccccgatgcattgcggcatggcttgcgctatcgcgcccgcgaaatctcgccaccgggtctcggcccgctgatggccgccgacgcagatgccggcagcgagcgcgagcctgctgaactggcgcgcgacgtggccgcgctgatctacacgtcaggcactaccggccaacccaagggcgtgatggtcacgcatcgcgggttgctgcactacgcccgcgttacggcggagatccgacggatggggccggaagactgcgcgttcgcgatcatgccgatgtcgcacatcttcgggctggcgacgttgctgctcgccacattccaggccggtggcagcctgtatctggttgcgcgcttcaacgtggccgatgcctgcgcggcgctgcaacgcgacgagatctcgatcctgcagggtgtgccggcgatgttcagtcgcatcctggcttacctgggcaagagcggcgtcaccacgctgcatccgaagcgtctgcgttatctctataccggcggtggcccgctcgatctcgcgctcaagcgcaacgtcgaggcgatgttcggccagccgctgcatcacggttatggcatgaccgagtatgcgggttcgctgttcatcacgcgcacggaccggccgcgcagcgacagctctgccggggaaatcgtggaaggcgcggagttgcgcgtggtggggccgggtggcgaaccagtgcccgagggcagccccggagagttgtgggtgagaggcccgggtgtcatgcgcggctactatcgcgcacccgagcagacggcggaggcattgcgtcccgacggctggctcaatacgggcgacatcggacgcatcgatcaggatggcgcgttgttcatcgtgggtagaacgagagatctgatcatccgttcgggcttcagcgtttatccaatcgaagtggagtcggtcatcaactcgcatccgtcggtccgcttgtctgccgtggtcgggaatccggcggaagacggcgacgaggagatcatcgcgttcgtcgagattcgcgaaggcgagacgttcgacgagagggatcttcacgcgtaccttgccgaaaggctctcgccgtacaagcgcccggcgcgcatcgtgcgcgtgtcggcggtgccgacgacggccagcggcaagctgcacaagcaccgcctgcggggaatgatcgcggaa

SEQ ID NO: 32476 - DNA, 1521 bp, Ralstonia metallidurans
cagctctacacctctgcttttcgtgcttgtccccaggctctggcgctggtcgaggacggtgtgacactcacctatgaggcgttggcccggcgctcgtaccgcatggccaggttgttccatgcacgcggccttcaacgtcaggatgtcgtggcctttctggtgggcaatcgagtcgaggcagtcgtggcgatcatcgcggcgcagcttgcaggactcaaggcggtttcattgcatccgatggcgtcggaagaggaccacgcattcgtgctcgccgacgccggtgtgaaagcgctggtagtcgacgatgcgcgtttcgcagcgcgcgcgcaggtcctgctggcgcgtgtcgcaaacgtgctgatgatgccgctggacgacggcgtgctaggtgcgggtctcgccagtcaggcggcggccatggacgacgcggaactggaaccgggcgacgacgccgctgaaatcagcaagatctcatacaccggcggtaccacgggtcgctccaagggcatcctccacacgcaccgcacggtggtgacgatgctgcaggccatgctggcgacgtatgaatggccgcagcagatccgctatctggtgaccacgccgatttcacatgcttcgggcagcctgatcctgccgacgcttttgcgcggcggtaccgtgtacttgtgcgacaagttcagcccttctgactttgtgtcgcgggtagccgagcagcgcatcaatctgaccttcctggtgccaacgcagatctacgcattgctggatcacgctggccttgcggaggcggacttgtccagtctggagctggtgctgtatggcgcctcgccgattgcgccgtctcgcctgcaggaagcactgaacaggattggcccggtattcggccaggtctacggtcaggccgaggcgccgatgaccatcagctatctgtccagacgcgaccatgacttgtctcgctcgcacctgctgagctcgtgcggcaaggtcatggtcggcaatcaggtcaagttgttagacagtgcgaggcgcgaagtgccagtcggcgaagtcggcgagttgtgcgtgcgcggtccgctggtgatggacgggtatctcaaccggcccgaagagaacgagaaagtattcgctggcgactggctgcataccggcgacatggcgcgccgcgatgcggcgggctatctctacatcgtcgatcgcgccaaggacatgatcatcacgggcgggttcaacgtttatccgagcgaagttgaacattgcctggcacaacacccggccatcgccatgtccgcggtgttcggtgtgcccgacgagaagtggggcgaatccgtcacggccattgtggtgccgaagccaggacagacaccagatgcgaacgagcttatcgagttcgtcaagagcaggaaaggcgtggtcaatgcgcccaagacggtgatcttcgcggagcagttgccgatgacggcgcttggcaagatcgaccgaaaggccatccgaggcagctactggaacggcaaagaccgacaagta

SEQ ID NO: 32477 - DNA, 1285 bp, Ralstonia metallidurans
atgtcccgtaaccagcagcttttcgatcgcgcccagcagaccattcccggcggcgtcaactcgcccgtccgcgccttccgttcggtggtcggcacgccgcgctttatcacccgcgtccgagggtgcctatatgtgggatgccgacggccagcgctatatcgactacatcggctcctggggcccgatgattgtcggccacgcgcatccggacgtggtgcgcgccgtgcaggagaccgccacccagagtttctcgttcggcgcgccgaccgaggccgaaatcgacatggccgaggaaatctgcaagctcgtgccatcgatcgagcaggtgcgcctggtgtcgtcgggcaccgaagccaccatgagcgcgctgcgcctggcacgcggcttcactggccgcgacctgatcatcaagttcgagggctgctaccacggccatgccgacagcctgctggtcaaggccggctcgggcctgctgacgtttgccgacaccacgcagaacgcgccgtcgtcggcgggcgtgccggcggatgtcacgcggcacacgatggtgctggagtacaacaacgtcacccagctcgaggaagcgttcgcgcgccacaagggcgagatcgccgccgtgatcgtggagccggtggccggcaacatgaacctggtgcgcgccagcgaggcattcctgaccgccatgcgcaacctgtgcagcgagcacggcagcgtgctgatcttcgacgaggtgatgacgggcttccgcgtggcgcttggcggcgcgcaggcgcactacggcatcaagccggacatgacctgcctgggcaaggtgatcggcggcggaatgccggcggcggcgttcggcggccggcgcgacatcatggccaagcttgcgccgctcggtggcgtctatcaggcaggcacgctctccggcaacccgctggccgtggccgccggcctgaccacgctgcgcctgatccaggccccgggcttctacgaccgactggccacgcagacgcgcaagctggccgacggcctgaccaaggccgcccgtgaggctggcgtaccgttctgcgcggacgcgatcggcggcatgttcggcatctacttcaccaacgaagtgcccggcagctttgccgaggtgaccaaggccgacgtgggccgcttcaaccgcttcttccatgcaatgctggccgaaggcgtctacctggcgccgtcggccttcgaggccggcttcgtgtcggccaagcatgacgatgcgatcatcgaggcgacggtggctgccgccgccaaggccttcaag

SEQ ID NO: 32478 - DNA, 858 bp, Ralstonia metallidurans
tttcgcggcatctggctgccgctcgtgaccccttttcaccgtggcgaagtcgatttcgatgccttgcagcgtctggttggccacttcagcgtcaccggcatcgccggtttcgtcgtatgtggcagcaccggcgaagcggccgcgctggaggagcccgagcaactggccgtgctcgatacggtgctcgaatgcgcaaacgggctaccggtgatcatgggtctggccggcaaccatctgggtcatgtgctggcacgcctgggccgctgcaacgaacggccgctggcgggcgtgctggccccggcgccgtactacatccgtccgtcgcaggacggattgcgcgactacttccggcgcctggcagatgcctcgcgggccccgctcgtgctctatgacattccgtaccgaaccggcacgacgctgatgctggagacgctgctatcgctggctgatcacggcaatatcggcgcgatcaaggattgcggcggcaatgcccttaacacgcaggcgctgatcgccgatggcaggctggcggtgttggcgggagaggatcaccagcttctcggcacgctggcgttgggcgggcagggcgcgatcatcgcttgcgcgcacttccatccggagcggttcgtggcgatctggcgtgctgtgtccgaggggcggctggacgaggcgcgccgcttgttctacgcattgatgccgctgatccagacgctgttcgcggagccgaacccggggccgatcaaggcgctgctggcgcgtcatggctggttgcgcgacgaactgcgcgcgccgatgacctgcgcatcgccggaactggcgaaccagctcgcggcgatgttcgatgcgatggatatcgtg

SEQ ID NO: 32479 - DNA, 2535 bp, Ralstonia metallidurans
cgcctgaacgaccactgcgcccgtgctctggcggatgcagccagtctttgcgaaacccgcgcgcaccgtgacatcgaggtggagcactggctgatcaaactgatggaacagggtgacggcgacctgcttgccatcctgcgtcgctacgagctggatgtcgatgggatctggaacggactgctggctgcggtcgaccacctgccgcatgacctccggggcaggccggggctatcgcagcgcctgggccagtggctggaggcagcgtggatgcgcgcctcgctcgaatccacggccccgggcgtagacagatcgattcgttcggcccacttgctggcggcactggcggagacgccgcacctgttgcgcgccccggatgcctggccgctgctgagcgtgtctgccgcgcagattgagcggctgatgcctgaactggacgagatatctgtcgaggcaacatcgccgatcacgcctagccagggaccggcgaccatcgctacaaggcgccctgccggccagcccgacaactctgccctctctcgtttcaccacggacgtcacgcaaaaggcgcgcgatggcaagatcgaccctgtgtttggccgcgacgtcgagatccggcagatggtcgatatcctcgcccggcgccgtaagaacaatccgattctggtcggcgaaccgggggtcggcaaaactgcgctcgtcgaagggctggcgctcaagatcgccgaagaggatgtgcccacggccatccgggacgtgaccgtactcaccttggatatgggcctcctgcaagccggtgcgggcgtcaagggcgagttcgagcagcgcctcaagaatgtcattgaagccgtccagcagtcgccgacgcccatcctgctcttcatcgacgaggcgcacaccctgattggcgccggcaacacggccggtggcgccgatgccgccaacctgctcaagcctgcactggcacggggcgaactacgcacgatcgcggcaaccacctggtccgaatacaagcagtacttcgagcgcgacgcggcgctggagcgccgcttccagatggtcaaggtcgatgagcccgatgatgagaacgcctgcctgatgttgcgcgggctcaaggatcggtatgcacagcaccacaacgtccacatcaccgatgccgccgtcgcagccgccgtccgtctttcacgtcgctatctgactgggcgccaactgcccgacaaggctgtcgacctgatcgacacggcggctgcgcgggtgcgcatgagtcaggaggccaggcccgtggcgatctgcacccttgaagccgaacgcgcggcgctgggggtcgagtacttggcgctgcagcaggatcagggtgccaccggcgaggacaagcgcaatcgtctgtcggcgatcgagacgcgcctacgcgaacttgccatcgaactcggacagcttgagttcgaattagcggcgcagaaggacgctgccgacaagctgatggtgctgcgtgcccaatggcaggccgctaccgacgcttccgagcgccacgatctcgcgtcctccattcaggctgcccaccaggtcctggccgcgcacggtcaggcgacacttctacatgcagaagttgctgagaccgtcgtggcgcaggtaattgccgactggaccggcgtgccggttgacaacctgttgtcgaatgaactggccaccctgctggagctggaggcacgcctcggacgggtcgtggtcgggcaggacgaggcgctggccgcgctcggcaaaagcctgcgcgcctccaaggcgggcttgaaatccgaggaggcaccgctgggcgtctttctcctcgtgggcccttccggggtcggcaagaccgaaacggcacgggcactggccgatctcatgttcggcggtgaacgctcgctcatcacgatcaacctgtcggagtatcaggaagcccacaccgtatcgcaattgaagggatcgccgccgggctatgtcggctatggcgagggcggcatcctgactgaggctgtccgtcagcgcccctacagcgtggtcctcctggatgaggtggaaaaggcccatcgggacgtgctcaacctgttctaccaggtcttcgatcgcggcttcatgcgcgatggcgaaggccgggtcattgatttccgcaacaccgtcatcctgatgacatcgaatctcggcagcgagcaaatcctggcggccaccgacgccacaacggaagctggtgtggaaatccccgccagcgcgctgatggagaccatccggccgctcctgatcgaccgcttccaacccgcgctgctggcgcgcttccagaccattgtgtaccggccgctcgccgcggaggccatggccacgatcgtagggatgaagctggccaaggtggccgagcgcatcgaacgccggttcgacgtgccgctgcgctgcgacgacgccctggtggccgaactggtgcgcgcctgcctgctgcctgactctggcgcacgcaatatcgacagcctgctcgaccagcagatcttgcccgtgctgtcgcgtgaattgctg

SEQ ID NO: 32480 - DNA, 1614 bp, Ralstonia metallidurans
acggtgcctgcgctgctggcgaacactgccgcgctccacggcagccggccggcggtggtattccgggagcagaacatccgctggacctggaatgaattcagcgccgaagtggacaggatggcctccggcctccacgcgctgggcctgcgcaagggcgaccgggtcggcatctggtcccctaaccgcttcgagtggctgctgacgcagtttgctacggcccgggttggcctggtcatggtcaacatcaacccggcgtaccgccttgcggaactcgaatacgcgctgaacaaggttggctgcaaggcgatcatcgcgccggaagcattcaagacctcgcgctacctggacatgctggcaacactggcccccgagttggccaaagccgaaccgggcgcgctgaacgccgcccggctgccgctgctgcgctgggttatccgcatggaagacgtgccgacgcccggcatgctgaccttccgcgagttgctggcgcgcggcgcaaacgtgccaaagactgagctcgacgagatcaccgccggactcgacgcgcgcgaccccatcaatatccagttcaccagcggcaccaccggcgcgcccaagggcgccacgctcacgcaccgcaacatcgtcaacaacggccgttcgatcgcgggcgcgatgcggttttccgaacaggacaagctctgcatcccggtgccgttctaccactgcttcggcatggtgctgggcgtgctggcctgcgtgtccaccggggccagcatggtgttcccgggtgaggcattccaccccggcgccacgatggccgccgtcagcgaggaacgctgcacggccctgcatggcgtgccgaccatgttcatcgcgcaactcgacgaccccgacttctcgaagtacgacttttccagcctgcgcaccggcatcatggccggcgcgccctgcccggtggaagtcatgaagcgcgtcatggcggacatgcacctggccgagatcaccattgcctatggcatgaccgaaaccagcccggtgtcgttccagagcgccaccgacgatccgatcgacaagcgggtgtcgacggtcggccgcgtgcagccgcatctggaatgcaaggtggtcgacgtggatggccagacgctgcccatcggcgccaccggtgaactctgcacgcgcggctactcggtgatgcttggctactgggacgacgaggaacgcacgcgcgaggcaatccgcgacggctggatgcacaccggcgacctggccacgatcgacgaagagggctactgcaacatcgtcggccgcgtgaaggacatgctgatccgcggcggcgagaacgtctacccgcgcgagatcgaggaattcctgttccggcacccgaaagtccagtccgtgcaggtcttcggcgtgcccgacgagaagtacggcgaggaagtctgcgcctggatcgtcctgaagccgggccagagcgccaccgacgaggaaatccggaattactgccgcgaccagattgcccactacaagatcccccgttacattcgctttgtagacgagatgcccatgacgatcaccggcaaggtgcagaagttcgtcatgcgggaccagatgacccaggaactcggaatcagc

SEQ ID NO: 32481 - DNA, 1108 bp, Ralstonia metallidurans
cgcgtgcagcacagctccgcaatcggccgtacaagggtgggatgcgcttccacccgacggaacctgtcggtactgaagttcctggggcttcgagcagaccttcaagaatgcgctgaccaccctgcccatgggcggcggcaagggcggctcggacttcgacccaaagggcaagaccgacgctgaagtcatgcgcttctgccaggcgctgatcaccgagctgtatcgtcacctgggaccggacaccgacgtgccggccggtgacatcggcgtgggcgcgcgggaagtcggcttcatggccggcatgatgaagaagctgtcgaaccagtccgcctgcgtgttcactggcaagggtctggccttcggcggcagcctgatgcgtcccgaggccaccggctacggcacggtgtacttcgcgcaggagatgctgcatcgtcgcggccgcgaattcgacggtctgcgtgtgctgctgtcgggctcgggcaacgtggcgcaatacgccgccgaaaaggcgatcgagctgggtgccaaggtgctgacggtatcggactccggaggcgtgctgcacttccccgagggcatgaatcgcgagcaactggacgcgctgatgacgttcaagaacgacacccgtggccgcctgtccgactttgccgagcagcatggcctgcgcttcgaggccggcaagacgccgtggcacgtgcccgccgacgttgctctgccgtgcgccacccagaacgaactgaacggtcaggatgccgagcgcctgctgtcgaacggcgtgttctgcgtagccgaaggcgccaacatgccgtcgacgctggacgccgtggaccgcttcgtggccgcacgcatcctgtatgcgccgggcaaggccagcaacgctggcggtgtggccacttcgggcctggagatgtcgcagaacgccatgcgcatggcctggcatcacgccgagatcgacgagaagctccacgccatcatgaaggacatccacggcaactgcatccactacggccagaaggaagacggctacatcaattatgtggaaggcgccaacatcgccggcttcgtcaaggtggcggacgccatgctggcgcagggtgtgatctgatcc

SEQ ID NO: 32482 - DNA, 726 bp, Ralstonia metallidurans
cgcattgcggtagtgacggggggcatgggtggtctgggcgaagccatcgccgaaaggctgctgagcgacggattccgcgtggtcgtcacgcattcgcttggcaacgatcatgtcgcgacctggctgcgcgagcacagtacgcagcaacgcgagttcgtggcctacccggtagatgtcgccgacttcgaatcctgccagcaatgtgcggccaggatattgtccgaggtgggcccggtggatgtcctgatcaacaatgccggcatcacgcgcgattcgaccttgcgcaagatgacgcacgaggcctggcgcgccgtgatgtctaccgacctcgattcggtgttcaacatgaccaagccgttctgcgaaggcatggtggagcgtcgctggggccggatcgtgaacatctcatcgatcaacggctcgaagggcgcgtttggccagactaactatgcagcggcaaaggccggcatccacggattcagcaaatcgctggcgctggagctggccagcaagggcgtgacggtcaacaccgtttctcccggttatctcgatacgaagatggtgcgggcagtgccgcaggacgtgctcgaccagcacgtgattccgcagattccggtcggccgcctgggtcagccgaaggaagtggccgcgctgatcagttacctctgctcggacgatggcgcgtacgtgaccggcgccaaccttgccatcaatggtggccaacat

SEQ ID NO: 32483 - DNA, 1518 bp, Ralstonia metallidurans
atgcgttacgcccatcccggcacccccggcgccatcgtttcgtacaagccgcgctacggcaacttcatcggcggcgagttcgtgccgcctgtcaagggccagtacttcaccaacaccacgccggtgaccggtgaggcgatcgccgaatttccgcgctcgaccgccgaggacattaaccttgcactcgacgccgcccacgccgctgctggcgcctggggccgcaccgcggtacaggaccgctcgctgatcctgctgaagattgccgaccgaatcgagcaaaacctcgaactgctggctgttaccgagacgtgggacaacggcaagccagtgcgcgagacgctcaatgccgatattccgctggccgtggaccacttccgctacttcgccggctgcatccgcgcgcaggaaggctcggcggccgagctgaacgagcacaccgtggcgtaccacatccacgaaccgctgggcgtggtgggccagatcatcccgtggaactttcccttgctgatggcggcatggaagctggcgcctgcgctggctgctggaaattgcatcgtgctcaagccggccgagcagacgccgctggggatcaacgtgctgatggagctgattggcgacctgttgccgccgggcgtgctgaacgtggtgcacggcttcggcaaggaggccggagaggcactggcaaccagcaagcgcattgccaagatcgccttcactgggtcgaccccggttggttcgcacattctcaaatgcgcggccgagaacatcatcccttcgaccgtggagctgggaggcaaatcacccaatatctacttcgaggacatcatgcaggcggagccgagcttcatcgagaaggcggccgaagggctggtgctggggttcttcaaccagggcgaggtgtgcacgtgcccgtcgcgcgcgctggtgcaggaatccatctacaaccgcttcatggatgccgtgatgaccaaggtggccgccatcaagcgcggcgatccgctcgacaccgagaccatggtcggtgcgcaggcgtccgagcagcagtacaacaagattcgcggctatctggagatcgcccgggaagagggcgccgaatgcctggtcggcggcgatgtggaggtcatgcccggcagccttgccaagggttactacatcaagccgacgctgctcaagggccgcaacgatatgcgcgtgttccaggaggaaatcttcgggccggtcatcgccgtgaccacattcaaggatgaagcggaggccgttcggatcgccaacgacaccgagtacggattgggtgcggggctgtggacgcgcgacatcaaccgcgcctaccgtgtgggccgcgccatccaggcggggcgcgtgtggaccaactgctaccacctgtatcccgctcacgccgcttttggcgggtacaagaagtcgggcgtgggccgcgagacccacaagatgatgctcgaccactaccagcagaccaagaacctgctggtcagctacgacacgcaaccgctgggcttcttc

SEQ ID NO: 32484 - DNA, 1119 bp, Ralstonia metallidurans
cgcgtagcgatccagcgcttcatcgacgaggaactgcggccgctggagcgcgagctggatctgggcgcggaagacccgtggccgcgcgacgtgctgcgcaacgtctggcgccgttccagcgaactcgggctctacgcggcatgcctgcccgtggaacttggcggcaagggtctcaatatcgcggagcagtgcgcgctcaaggccgatctggccgccagcggggcggtgctggcgccgcacgtgctgggcgatctcggcgggccgccccgcgtgggcaacatgctcaaatacgcgacgcctgaccagatcgaacgctacttccaaccggtaattcgcggagagaagtccacgtgcttcgcgctgacggagacgcattctggctcggatgtgcagagcattcggaccagtgccgtcgtagatggcgatgatctcgtcatcaacggagagaagcactacatcagcggtgcgccgttcgcggactttgccatcgtgatgtgcgtgaccgatgccgccaccgcgccaccgtcgatcacggcggtgctcgtcgaccttgatttgccgggcgtgaccgtcagtaccgagtacgtaccgatgtctggccagcatattgatggcgatatccgcttcgagaacgtgcgtgtgccgcgtgcgaacatcttcggtggcgaaggacgtggcttcaaactcggcatgtcgcgcatcaacgtcaaccggctgctgcattgtccgtcgatgctggggctggccatgagcgcgtacaaggcgtcggtacagtacgcgggcgcgcgccgccagtttggcggcccgatcgcgcgtttccaggccatccagcacatgctggccgatatggcggccgcgctgtgggcgtgcgagagcatgatcgcgcagacagcgatgcttgccgatgccggcgctgacctgcgcatgaaggcggcggcgtgcaagctgttcgtgtcggagcgctgcttcgaggtggccgacaaggcagtgcagattcacggcaatgtgggcgtgacgcgcggccatccggtggagcagacctggcgcaagctgcgcatgttccgcatctttacgggcaccagcgagatccagcggaatacgatcgccaaggcgattctc

SEQ ID NO: 32485 - DNA, 1518 bp, Ralstonia metallidurans
atgacgttcgcctacttcctcaggcgcgccgctcgttactggggcgacaacccggccgtgctgtaccgggatcgcgtgctgacctatcgccagctcgacaagcgttccacgcggctggcgaacgcgctgctggcgctgggcctgacccgtggcgaccgcgtggcgatccaggcgcgaaactgtccggagatcgtggagatcgaatgcgcgctgtacaaggccgggctggtcaaggccgcgctgaatccccgtttcaccgccgaagaggcgtcggatgtcgtggaaaactgcacgccgcgcgtgatgatcgtcggccccggctacacgcgataccagcgggaatcacgcgggttcggctgcgtggagcatttctttgcgattgccggggcggagggccagtacggtgcctatgaagcactgatcgatggcggcgccaccaccgccatcgactatgtgccgcagcctgacgacctcgccgtgctgcatttctcgtcgggctccaccggcaagatcaaggcggcgatgcagagctatggcaaccggctggcgtcgatgcgcaagatgatcctgggcatggatcgccctgcacgcccgggcgatcgcctggcgttgatcgggccgattacccatgcgtctggcatgttgatgcagccgtatctgttccttggcgccacgctggtcctgttcgagaagttcgagcccgcgcacttcctggccgaggtgccgcgtctgaacctgacgcacgtgttcatggtgccggcgatgatcaacctgctgctggccgagcccacgctggccacggcagacctgagctgcctgaagacgctggcctacggcgccgcgcccatggcgcccgcacgtattcgcgaggcgtgggaacgcatcggcccgatcctgtcgcaaggctacggcgccagcgaatcgacgtccggcgttacccggctatccacggcagatcatgccgaggcactcgcgcggcatccagagcgactggcatcgtgcggtcgcgccatgggggaaaccgaggtgcgggtcgtcaacgaacgcggcgaggaggtctgcgacgacgagattggcgaactcgtgattcgtggcgaggatgtgttccagggctactggggtgagcccggtctcaccagcgaggtgctggtcgacggctggctgcacaccggcgacctggcgcgtgtggatgccgatggctacctgtacctggtcgatcgcaagaaggacatgatcatctcgggcggcttcaacgtgtacccgaccgaagtggaagccacgctgtaccagcatccggacgtcatggaagcctgcgtgatcagcgtgcccgatgaaacctggggcgaaagcgtcaaggccgtggtggcgctgtggccgggccggcaagccagcgcatcggaattgatcggccattgccgcgcgcgcatcgccgactacaagtcgccgcgcacggtcgatttcgtggccgagctgcccaagaacgcaagcggaaagctggcgcgcaaagtcgtgcgggaa

SEQ ID NO: 32486 - DNA, 1494 bp, Ralstonia metallidurans
gcccgggagcgggccggggccattgcgtacgccttcgaaggccgcgagaccacgtttgccgatttcgatcgccatacggatcgcgtggcgcaggccctgctggccgacggcgtgaaggctggcgaccgcatcgcctatgtcggcaagaacagcgaccactatttcgaactattctttggcgcggccaagatgggggccgtcattgcaccggtgagctggcggctggcggggcccgaaatccagtacatcgtctcgcactgcgacgcgacgctggtcttcgtcggccccgagtcatcggcatcggttcgcaacctgctgccagcgctgccactggtgcgccgcgccgtggcgatggagggcggggagccagactggccggcctacacggaatggcgcgacgcgtgcccggatacaccaccggcgcacgaagcgaagcccgccgacgtggtgctgcagctctacacgtctggcactaccggacgtcccaagggcgtgatgctgatgcatcgcaacctgaccagtggtaccgagatctcgatgcgcgaaggtgccgactggtcgcaatggaacgacgaagatgtgtcgctggtggccatgccggtggcgcatatcggcggttcgggctggggcgtgcgcggtgttcttgtcggctgcaagggtgtcgtggcgcgcgaattcgatccgggcaaggtgctcgactatatcgagcacgaccgcatcagcaagctgttcatggtgccggctgcgatgcagatcgtgctgcgtgatccgcgcgcgcgccaggtggactattcacgcctcaagcacatgctgtacggttcgtcgccgattcccgcagcgctgctgcgtgagggcatggcggtgtttggctgcggcttcgtgcagcagtacggcatgacggagaccacgggcacgatcgtggcgctgccgccggaagatcatacgcccgccgatgtcccgcgcatgcgcgccgccggcaaggccatgcccggtagcgaggtggcggtggtcgggccggatggccagaggctggctgccggcgaggtgggcgaagtggtgatccgctcgccgcagaacatggcgggctactggaagcaggaggaagagaccgcccgcaccatcgacgccgacggctggctgcgcagtggcgatgctggctacatggacgcggacggctacctctatatccacgaccgggtcaaggacatgatcatcagcggcggggagaacatctacccggccgaggtggagagcgccatctacggccacccggccgttgccgacgtggccgtgatcggtgtgccggacgagcggtggggtgaggcggtcaaggcgatggtggtgctgcgcccgggtgtggccgctgacgccgacagcattctgggctgggcgcgcgagcgtatcgcgggtttcaaggtgcccaagagcatcgacttcatcgatgccatgccgcgcaatccgtcgggcaagttgctgcgtcgggcgctacgggaa

SEQ ID NO: 32487 - DNA, 2078 bp, Ralstonia metallidurans
tcggccgccggctggcgtcccgattgctggcgcgcgttcgcgcgcgaccttggcctgcttggcatcgggattcccgagcgcttcggtgggctgggcggcggcatcatcgaccacatcgtggtgatggaacagttcggccgccatcttgtgctggagccctaccttggcacggccatccttgcggttgatgcactgcaatatgccaatgagacgctggccgccgaagcgctgcccgccatcgcggcaggcgaactggtggtcggctgggcgcacgccgaaccggaatcgcgctacggaatgatggtgcgaacacgcgcggatgcggctgccggcggttaccggttgcatggacgcaaggcgcttgtcaccggcgcgccctgggccacgcacttcattgtcagcgcgaacacggaagccggtccgacgctgttctgggtcgaacgcacggcgccgggcctgacgttgatcgaagcccccacctttgacggcggccgtactgctgacctgatactgaccgacgtgccggtgagcgccgcacaagtgctgggaatgcctggcggcgcattgccgctgctggagcaactgggcgacaccgccgccgtcgcgctgtgtgccgaagccaccggcgccacggcgcgaatgctggagaacaccatcgagtacgcgcgtcagcgccagcagttcgggcaggcgatcggcagcttccaggcgctgcagcatcgcatggccgacatgtacatgttgcacgagcaggccgtcgccctcacacaggtggctgccatgcgtcttgctggcgagccacatgaacgggcgctgggtgccagcaccgccaaggcccatgtcgacgaagcaggccgccgcatcgggcagggcgcggtgcagatccacggcggcatgggcgtgaccgaggaaacggcggtcggccactacttcaagcgtgtcaccgccatcggcctgcagttcggcaacgttgcctaccatctgcgccgttgtgtcgacctgcgctacccggccaacgcataaggaccgccatggatatcgacgagtctccgcaagacctgcagtttcgcgccgaggtgcgcgcctggatctccgaagcgtttgatgacgagcttcgcgccatgatggcgcaatcgaagaacggttatctcgacaaggcggcacaggtacgctggcaaaaggccctgcacgcgcgtggctgggccgcgccgaactggccgcaagcacatggtggccccggctggacacccacgcaacggcacctcttccagagcgaactggccgccgccggttgcccgccggtgtcgccgatgggtctcaagatggtggcgcccgtcatcatgaagtacggcagccccgagcaacaggcccgcttcctgccgcgcatcctggcgtccgacgactggtggtgccagggctactccgaaccgaactcaggctccgatctggcctcgctgcagatgcgcgcgacacgcggcgtcgatgcgaatggcgagcactacatcctcaacggttcgaagatctggacgacgcacgcccagtgggccgactggatgttctgtctggtgcggacctcgcgcgagggcaggccgcaggagggcattacgttcctgctgctcgacatgcgcacgccgggtatcaccgtatcggcgctgcctacgctcgacggcccgatggagggccagcaggaggtcaatcaggttttctttgacgatgtgcgcgtgccggccgcccaacgcattggcgaggagggcatgggctggaccattgccaagtacctgctcgagttcgagcgtggcggcagcttcgcgccgatgctgcaccggcaactggacaaggtggctgccatggccgccgctcagcccggtgaggatggcaccgggcggctggtcgacgatcccgtcttccggcaacggctgggcgccacgtatgtgcgcgtggcggcgaccgaggcggcggagttgcggctgttctccggcgtggcctcgggtacgtcgatcggcgcggcgtcgagcatgatcaagttggtcggtaccgagacggcacaggccatctccgagctagccgtcgacgtgctc

SEQ ID NO: 32488 - DNA, 1119 bp, Ralstonia metallidurans
agcggcgacctggagatcttccaggatggcattcgcaagttcgtcgagcgcgagcttgcacccaacgaggatcgttggtggaagcagcagtacatcgaccgtgaagtctggtacaaggcaggcgagatggggatgctctgcgcaagcattcccgaagagtacggtggcggcggcgggacgttcgcccacgaggccatcatcacgatggaacaggggcgggccggcgtgagcagcctcggcaccaacgtgcacagcggcatcgttgcccactacatcctgcgctacggcactgaggaacagaaacgcaagtggctgccgaagatggcgacgggcgagctggttgccgccatcgccatgtcggaacccggcgcgggttcggatctcaagagcgtcaagacgcgcgcgctgaaggagggcgacagctacgtcatcaatggttcgaagaccttcatcacgaacggctatcacgcgaacctgatcctggtgatctgcaagaccgatcccgaggcgggcgcgcgcggcgtgtcgatcgtcgtggtcgagaccgatggccagcagggattccgccgcggtcgcatcctggaaaagatggggcagaagggccaggacaccgccgagttgttcttcgacgacatgcgcgtgccgtgcgcgaacctgctcggcaccgaagagggcaagggcttctaccagctcatgcaacagttgccgcaggagcgcatgatcatcgcgctgggcgcgttggcatcgatggagcgcgcgctgggcctgacgatcgagtacgtgcgcaatcgcaaggtcttcggcgaatcactgatcgagctgcagaacacccgattccggttggcggagtgcaagaccaacgcgaccatcgcgcgcagcttcgtcaacgattgcatggagaaaatcctgcgtggggagctggaccccggcacggcggcgatggccaagtggtggtgcacgcagcgttcgtgcgagatcatcgacgaatgcctgcagttgcacggcggctatggctacatgatggagtacccgattgcgcggatgtatgtgaacgcgcgggtcagcaagatctacggtggctcgaacgagatcatgaaggaactgatcgcgcgcgaactc

SEQ ID NO: 32489 - DNA, 741 bp, Ralstonia metallidurans
gccgtcgtgaccggcggtgcctccggcctcggccttgccagcgccaaacgccttgtggagaagggtgtcaaggtggtgattgccgacatctcggaagaacgtgccgctgccgcgctggatgcactgggtcccaatgccacgttcgtccaggccgacgtcaccgataccgaccagatgacgcgcgtgttcgacgctgcagtcgcgatggggccgctgcgtgcgctagtgcattgcgcggggctcggtggcgcggtacgcgtggtggaaaaggacggctcgccgggctcgctcgaagcctatgagcgcgtggtgcggatcaacctgattggcaccttcaacgtgctgcgtctgggtgcggcacgcatggcgaccaacgagcccgtcgacggcgagcgtggcgcatgcgtgctgaccgcgtcggtggcggcctacgaaggccagatcggccagattccttacgcatcggccaaggcgggcatcgtcggcatgaccatcgtcgcggcacgcgatctggcacagcgcatgattcgcgtctgcacgatcgccccgggcctgttcgacacgccgctgctggcccgtctgcccgataacgtgaaggcctcgttgggtgcgatggtgccgcacccggcccgcctgggcgcgccggacgagtacgcgtccaccgcgctgcacatcctcgagaatccgatgctcaatggcgagaccatccgtctggatggcgccatccgcatggccccgcgc

SEQ ID NO: 32490 - DNA, 1170 bp, Ralstonia metallidurans
atgcagcaagctttcatcatcgacgcaatccgttcgccgctgggccgttccaagcccggctccgcctttaccgaactccatgccaccgaactgctggcccaggtgctgtcgcagctcgtgcggcgcaatgaccttgacccgggtctggtcgatgacgtcatcaccggttgcgtgacgcaggccggcgaacagtccgcaggggttgggcgcgtggcctggctggcggcgggctttccggagcacgtgccggccaccaccatcgaccgcaagtgcggttcgagccagcaggccgttcactttgccgcgcagggcatcatggccggcgcgtacgacatcgtgattgcctgcggcatcgagtccatgagccgggtgccgatgggcgcggcgcgtattggccagaacccatatggtccgtcgtttgaggaacgctacgcgccggggctggtcgggcagggcgtgtcggccgagctggttgccgccaagtgggagctttcgcgtcacgacatggacagctactcggcgcgctcgcaccagcgtgccgccgccacccaggcagccggcggattcaagcgcgagatcgtcggcatccagaccgtgaatggtctggtggagcaggacgagacgatccgcgccaacaccaccgtggagcgcctggcgacgctggagtcgccattccgcaacgacgaactgagtgcccgttttccgcagatcggctggaatgttaccgccggcaacgcctcgcagatcagtgatggtgcggccgcaatcctgattgtcagcgagcgcatggccacgaagctcggcctcaagccgcgcgcgcgttttgtcggtttcgacgtgatcggcgccaatccgctggagatgctgaccgcgccgatccccgccacccagcgcgtgctggcaaagaccggcatgacgctcgagcagatcgcgcactacgaaatcaacgaggcattcgccagtgtgccgatggcctggcagaagacgatgaaggccgatggcgcgcgcctgaacccgcgcggtggcgcgatcgcgctaggtcacccgcttggcgcatcgggcgtgcggctgatgaccaccatgctccatgcgctggaagacagcggcgagcgcttcggcctgcagtcgatgtgcgaagcgggcggcatggcgaacgccacgatcatcgag

SEQ ID NO: 32491 - DNA, 1527 bp, Ralstonia metallidurans
ctgcacgactgggcaaccgtggcgccgcaaaagccagcattgatccaggctgaatcgggccacgtcatcacgtatggagagttggacgcgcgcgcgatccgcgccgcgcaatggctggtgtcgcgtggtctggaagccggcgactgcatcgccgtgctggtggagaatcacccgggcctgatcgagatcgcatccgcggcgcggcgcgtcgggctgtactacaccgcagtcaacacgcacctgagcccggcggaagcggcctacgtgctgaaggattgcggagcgaaactgctgatcgcgtcgcccgccatgttgccgctggtcgaagcagtacgcgcggccgatgcccacgcgctcgatctgcctgtctttgtgctggctggcgcttcgaacctgccgccaggctttgaagcgtacgaagccgcaatctccgcgttcgcccctgacgccaccctgcccccgcgtccggtcggccgcgacatgctctattcgtccggcaccaccggccaccccaagggtatccgccggccgctcacgccctacgaagaccgcgacaaacctgagcttgaaatcatcgcctggcgccgtgcattcggtttcgacgagaacacggtctacctgtcgaccgcgccgttctatcacgccgcgccgctgcgctacatcatgcgtacgcttgacgtcggcggcacatgcgtcgccatgtcgaaatacgacgccgagggcgcgctggccgcagtcgagcgctaccgcgtcacacatagccagtgggtgccgacgatgtttgtgcgcctgctgggcctgcccgacgaggcacgccgccgttatgacctctcgtcgatgaaggtcgccatccacgccgccgcgccatgcccggtccatgtcaaacaggccatgctcgactggtggggcgacatcctttacgagtactacgccggctccgaaggcgccggcacgacctccatcgggccactggaatggcgcaagtatccgggctcggtcggacgcgcgtcggccggcgtcatccacatcgtggataacgccggcaacgagttgccgcccaacgaagtcggcatgatctacttctcgggcgtggcaacgttctcgtaccacaacgccccggagaagacgcgatccgcgtacaacgacaagggctgggccacctatggagacctcggctacgtcaacgaggaagggtatctgttcctgagcgaccggcgcgcggacctgatcctgtcgggcggcgtgaacgtctatccgcaggaaatcgaaagcgtgctgatgcagcacccgtcggtggcggacgtcgccgtgatcggcgtgcccgatccggagttgggcgaggtaccgaaggccgtgatcgaactgcgtgacggcaaggccgccacgccggatctggcgcaggacatcgtcgactactgccagggcaggctcggtcgcctgaagctgccgcgcacggtggtcttcgacgaacgcctgccacgcacccccaccggcaagctgttgcgacgggaactgaaggaccgccat

SEQ ID NO: 32492 - DNA, 786 bp, Ralstonia metallidurans
ctccagggcaaggtcgccgtcgtcaccggcgccggcagcgggatcggccgcgccgtggcacaggcgctggcgcagcgcggctgtcatctggcgcttgcggaccgcaatcaggaagggctcgccgagaccgccgcgctgccggaactgaacagcgtgaaagtcagtctccacacccttgacgtggccgaccgcgacgcggtggcggcctttccgcaaacggtgctggcccaccacgatcgcatcgatctcctcgtcaacaatgccggtgtggcgctggccggcagctttgaacaggtcagcgagactgacttcgattgggtcatggcgatcaacttccatggcgtggtgcgcatgacgcgggccttcctcccattgctgcatcgcagcgacgacgcccgcatcgtcaacatctccagcctgttcggcctgatctcgccgccggggcagagtgcctactcggccagcaagttcgccgtgcgcgggttctccaatgcactgcgccatgaactggccgacagccgcgttggcgtcaccgtcgtccaccccggcggcattgccacatcaatcgcccggaatgcgcgcgtgtccgcggacattccgcaagcgcaaatgcaggagcgcctcgcgaactcgcagaagatgctgcggatgccgccgccgaaggcggccgacatcatcgtgcgcggtatcgagaagcgtagcgcccgcgtgctggtcggctcggacgcggtcgtgatgtcgtggctcgaaagactgttcccggtacgctactggaacctgctcgcc

SEQ ID NO: 32493 - DNA, 1098 bp, Ralstonia metallidurans
cggcgccgggcactgatcaccggcatcaccggccaggacggttcgtacctgtgcgaatacctgctcgacaagggatacgaagtccacggcatcaagcggcgcagttcgctgttcaataccgagcgtatcgatcatctgtacgaggacccgcaagcaccggaccgcaggttgatcctccatcacggcgacatgaccgatacggcgagcctcgtgcgcgtcgtgcaacagtcccgccccgacgaggtctacaacctcgcggcgcagagccacgtgcaggtgtccttcgaggagcccgagtacaccgccaacaccgacgccgtcggcacgctgcgcctgctcgaggcgatgcggattctcggcatggagcaaagcacgcgtttctaccaggcatccacgtccgaactgtatggactggtgcaggagattccgcagaaggaaaccacgccgttctatccgcgcagcccgtatgccgtggccaagctctacgcctactggatcaccgtgaactaccgtgaagcctatggcatgtacgcgtgcaacggcatcctgttcaatcacgaaagccccgtgcgcggcgagacgttcgtcacccgcaagatcacacgcgccatcgcgcgcatcgcgctgggcctgcaggaagtgctctatcttggcaacctgtccgcgctgcgcgactggggccatgcgcgcgactacgtcgagatgcagtggctgatgctgcagcaggaaacgccgcgtgatttcgtcatcgccacgggcgagcaacacagcgtgcgcgagttcgtcacgctctccgcgcagaagctcgggctaacggtcaccttcgagggcagcggcgtcgacgaggtcggcatcatttctcatatcgacacctcacgccgcgagttgtcctcccgctgcaaggtcggcgacgtgatcgtgcgcgtggacccgcgctacttccgcccgaccgaagtcgagacgctgctgggcgacccgacgcaggcacgtgagcaactgggctggtccccacgcatcacgttcgacgaactagtgcacgaaatgatcgaagcggacttcgtggccgcgcggcgtgacgcgctggtcaagatggccggc

SEQ ID NO: 32494 - DNA, 1125 bp, Ralstonia metallidurans
ttgctgcgcgcttcggtgcagcgttttatcgacgatcgcctgaagccggccgaggacacgctcgaagagattgacgatgtgccggccgatatcgtggccgacatgaaggaaatgggcctgttcggcatctcgattcccgagagctatggtggcatcggcctgtcgatgtcgcaggaatgcgatgtggtctacgacttgggccacactgcttttgccttccgctcggtgttcggcactaacgtgggtatcggctcgcagggcatcctgatggacggcaccgaggaacagaagcagacctatctgccgaagatcgccagcggcgaactgatcatctcgttcgcgctgaccgagccgaacgccggctccgacgccgcctcgctgcaaacgcgcgccgacctcgacggcgaccactacgtgatcaacggtaccaagcggttcatcaccaacgcgccgcgcgcgggggcgttcacgctaatggcacgcacgggtggccaaggcgcgtcgggcatttcgtcgttcatcgtgccggccgataccccgggcatctcactgggcaagccggacaagaagatgggccagcgcggtaccaagacgtgcgacgtggtgctggaaaacgtgcgcgtgccggccgccaacatcatcggcggcgttccgggcgtgggtttcaagacggcgatgaaggtgctggaccgtggccgcctgcacatctcggcgctggcctgcggcatggcgcaccggctgattaccgacgccgtggcgtatgcgaaggagcgcaagcagttcggcaagccgatcggcgatttccaactgatccaggggatgctggccgacagccaggccgaactctatgcgggcctgtcgatggtgcgcgattgcgcacagcgttatgatgcgaagccggctggcaagagcgatccggaagtcagcatgctggcatcgtgcacgaagatgttctgtaccgagatggtgggccgcgtagcggaccgcgcggtgcagatccacggtggtgcgggttatatcgccgaatacaaggccgagcgcttctaccgcgacgtgcgtctgctgcgcctctatgaaggcacgacgcagatccagcagctcatcatcgccaagcaactgctgcgc

SEQ ID NO: 32495 - DNA, 507 bp, Ralstonia metallidurans
atgagcagccatcacatcatcgacagcccgctgggcgacatgctgttgcgtgccgatggcggcgcgttgaccggcgtgttctttgccggccagaagtactaccccgggctggcgcgtcccactcccgtctcggcgatgcccgcagcggatgcgcgcgtgctggagcaggccgcgatggaactcggcgcctacttcgacggggcattgcatggattctccgtcccgttccggctggttggcagcgcgttccagcagcggatctggcaagcgctgtgcgatatcgaatttggtgagacttcgacctacggacaactcggcgcggggctcggcttgccgccaagccattcgcgggcggtgggcggtgccgtggggcgcaatcccttgtcgatcatcgttccgtgtcatcgcgtgcttggcgcgtccggcgacctgaccggctacgcgggcggcgtggaccgcaagcgtgcgctgctgacgctggagggcgtgctttatccgggccagttg

SEQ ID NO: 32496 - DNA, 1323 bp, Ralstonia metallidurans
atgactaccatcctgcagcacattccttccggccagcgcgtcggaatcgccttctcgggcggactcgataccagcgccgcgctcctctggatgcgccagaagggcgccattccctacgcctacacggcgaacctgggccagcccgacgaaccggattacgacgacatcccccgccgcgccatggcgtacggcgccgaggccgcccgtctggtggattgccgcacccaactggtggccgaaggtatcgccgcgctgcaatgcggcgcgttccatatctcgaccgccggcgtgacctacttcaacacgaccccgatcggccgtgccgtgaccggcacgatgctggtggcggccatgaaggaagacggcgtcaacatctggggcgacggcagcacgttcaagggcaacgacatcgagcgcttctaccgctacggcctgctgaccaacccgggtctgcagatctacaagccgtggctggaccagcagttcatcgacgaactgggtggccgcgccgaaatgtccgagttcatgcgccagcacggccatgcctacaagatgtcggcggaaaaggcgtactcgaccgattcgaacatgctcggcgccacgcacgaggccaaggatctggagcacctggattccggcatccgcatcgtccagccgatcatgggcgtgcagttctggcgcgatgacgtcgaagtgaagcgcgaggaagtgaccgtgcgcttcgaggaaggccagccggtggcgctgaatggcaagacgttcgccaatgccgtcgacctgctcatggaagccaatgtcatcggtggccgtcatggcctgggcatgagcgaccagatcgagaaccgcatcatcgaagccaagagccgcggcatctacgaagccccgggcctggcgctgctgttcatcgcttacgagcgcctgatcaccggtatccacaacgaagacaccatcgagcagtaccgcgacaacggccgccgtctgggccgcctgctgtaccagggccgctggttcgatccgcaagccatcatgctgcgcgaaaccgcccagcgctgggtggctggcgccgtgaccggcgaggtgacgatcgaactgcgtcgcggtaacgactactcgatcctgaacacgacgtcgccgaacctgacgtacaagcccgagcgcctgacgatggaaaagggcgagtcgatgttcacgccgctggaccgtattggccaactcacgatgcgtacgctcgacatcgtcgacacgcgcgagaagctgcagacgtacgccaagtccggcctgctgtcgaaccagaccagcgcggcgctgccaaagctcgaagac

SEQ ID NO: 32497 - DNA, 1782 bp, Ralstonia metallidurans
atgccctttgccttgcacggcattccggtttctcgtggggtcgccatcgggcgagcccatattcttgcgccggctgcgctggatgtgtcgcactacctggtcgatgaagaccggctcgaagccgaggtggagcgattgcgttcggcacgcgccgcggtgcgggccgagctgatcacgctcaagcgtgacctgccgcgcgacgcgccggaggaaatgggggcatttctcgatgtccacgcgatgatcctcgacgacgaggccctgtcgcgcgaacccgagacgctgattctccaacgccgctataacgccgagtgggccctgaccacgcgactcgaagaactgatgcgtcagttcgacgagatcgaggacgagtatctgcgcgagcgcaaggccgacatcgagcaggtggtggagcggatcctgaaggtgctggccggagcgcccgtgctggcgccggcgcccgtgccgacgctcgcgccggatggcgaggccacgccgggggtgatcgtggtggcccacgacatcggcccggccgacatgctccagttcaagcacaccgtgttccacggtttcgtgacggacctgggcggccgtacatcgcacacggctatcgtcgcgcgcagtctcgacatccccgccgcggtgggcgtcaagaacgcgagcgaactgatccgtcaggacgactggatcatcatcgatggcgatgccggcctggtgatcgtcgatccgtcggccatcattctcgaagagtatcggcaccgccagagcgagcgcgcgctcgagaagaagcgcctgcagcggctgcgccacatgccggcggtgacgctggacgggctcgagatcgaactgctggccaatatcgagatggcggaggatgccggtgcggcgctgtccgccggcgccgtcggggtggggctgttccggtccgaattcctgttcatgaaccggcgcgacgagctgccggatgaagacgagcaatttcacgcgtatcgcaacgccgtggaagcgatgcacgggctgccggtcacgattcggaccatcgacatcggcgccgacaagccgctcgacggccgtggcgacgacttcgagaccgcgctgaaccccgcactgggtttgcgcgcgatccgctggtcgttgtcagagccggggatgttcctgacccagttgcgggcgttgctgcgcgcttccgcgttcggcccggtccggattctgatcccgatgctggctcacgccggtgagatcgaccagacgctggacctgatcgagcaagccaagcgccagctcgacgaacgcggcctgccgtacgacccgggtatcaaggtcggggcgatgattgagatcccggctgccgtgctgctgctgccgctgttcctcaagcgcatggacttcctgtccatcggcaccaatgacctgatccagtacacgctggcgatcgaccgcgccgacaatgccgtggcgcacctctacgacccgcttcacccggccgtgctgcagctgattgcccggacgatccgcgaagccaaccatgcgggcgtgcccgtcgccgtgtgtggcgagatggcgggggatccggcgatgacccggctgctgctgggcatgggactacgcgagttctcgatgcacccggcgcaattgctgcgggtgaagcaggaagtcatccatgcggactgcgagcgcctgagcaaggcggtcgaccagatcctgaactgctatgaaccggacgagcttacggccgcgttgaagcaactgacagcgtgacgccaccctgaaaccctgaagatt

SEQ ID NO: 32498 - DNA, 1830 bp, Ralstonia metallidurans
gcctatctttcccggctgaatccggaacagcgcgcggcggtggagtacgacggtgacgcgccgctgctgatcattgccggcgcgggctctggcaagaccaacacgctcgcgcatcgggtggcgcatctggtcgtgaacggcgcagatccgcgccgcatcctgctgctgacgttctcgcgccgcgccgcctccgaaatgggccgccgtgtcgagcgcatcgtcgaccaggcactcggcatccagaccggcgcggggcgcgccgcgctgcagtggtcaggcacgttccacgccatcggcgcccgcctgctgcgcgagtacgccgaaacgctcgggcttgctccgaccttcaccatcagcgaccgcggcgatgcggccgacctgatgcacgtggtacgccatgacctcggactatccgagcagacctcacgctttccgcgcaaggaaacctgcctcgcgatctattcacgcgtggtcaacacgcagttgccgctcgaggttgtgctgaagacgcagttcccgcgctacgcgatgtgggcggacgcgctcaagggcctgttcgccgcctacgtggaagccaagcagaagcagcaggtgctcgactacgacgacctgctgctctactgggcgcaggcgatgaccgagcccgcactggcgcaggacatgggcgcgcgcttcgaccacgtgctggtcgacgagtaccaggacaccaacgcgttgcaggcgtcgatcctgctggcgctcaagccgcaagggcgcggcctgaccgtggtgggcgatgacgcgcagtcgatctacgcattccgcggcgccaccgtgcgcaatatcctcgatttcccgacacagttctcgccgccggccgagcaggtcacgctgtcgcagaactatcgctcgacgcagccgatcctcggcgccgccaatgccgtgattggccttgcggccgaacgcttcaccaaggatctctggtccctgcgcgaatcggcggagaagcccggcgtggtggtggtcaacgacgaggccgagcaggcgcgcttcgtcgtcgagcaggtactggcgcggcgcgaggctggcttgtcgctgacgcagcaggcggtgctgttccgcgcggccgaccacagcgcccaggtcgagatcgagttggcccggcgcaatatcccgttcgtgaagttcggcggactgaagtttctggagtcgacgcacgtcaaggacgtgatggccgtggtgcgctggctggaaaatccacgcgaccgcatggccggattccgcacgctgcagttgctgcccggcatcggcccgaaaacggccgcgcgcgtgctcgaaggactggaagccgccaccgaaccgttgatcgcgctcgaagccttcgagccgccccccgccgccgcgcccgcctgggatgaactggtgacgctggcgcgtgcgctgatggcgccgacctcgccctggccatctgaattcgaacaggtgatcgcctggtacatgccgcacctcgaacggatgcacgacgatgccgccgcgcggcaggcggacctgcagcagatcgagcgcatcgcggccacctatgcgtcgcgggaacgcttcctcaccgaactcacgctcgacccgcccagcgcgtcgagcgacgaatccggcgtgccctcgcgcgacgaggactacctgattctgtcgacgatccattcggccaaggggcaggagtggaaggccgtgtacgtgctcaatgcggtcgatggctgcatgccatccgatcttgccaccggcaccaccgaggaaatcgaggaagagcgccgcctgctgtacgtggcgatgacgcgcgcgcgcgaccacctcgacatc

SEQ ID NO: 32499 - DNA, 1587 bp, Ralstonia metallidurans
catccggccgacatcgacggccaccacctgacccccgacaccgtcgccgccatcgcacgcggccagcgcgccgccatcgtcccggagcccgtcctcggcaaggttgccgatgcccgcgcccgcttcgagcaggtggctgcggccaatgtgccgatctacggcgtctccacgggctttggcgaactggtacacaactgggtcgacatcgaacatggccgtgcgctgcaggagaacctgttgcgcagccattgcgcgggtgtgggtccgctgttttcgcgcgacgaggtccgcgcgatgatggtcgcgcgtgccaatgcgttggcacgcggatactcggcggtgcggccggccgttatcgaacaactgctgaagtatctggaagccggcatcacgccagccgtgccgcaggtgggttcgctcggggccagcggtgatctcgcgcctctgtcgcacgtcgccatcacgctgatcggcgaaggcaaggtgctgaccgaggatggcggtacggcacccacggccgaagtcctgcgcgagcgtggcatcacgccgctcgcgctggcgtacaaggaagggctggcgctgatcaacgggacatcggccatgaccggggtgtcgtgcctgttgctggagacgctgcgcgcgcaggtccagcaggccgagatcatcgcggcgctggcgctcgaaggactatccgcctcggccgatgccttcatggcccatgggcacgacatcgccaaaccgcatccgggacagatccgctcggcggcgaacatgcgcgcgctgctggccgattcggcacggctctccggacatggcgaactgtccgccgagatgaagacacgcgcgggcgaggccaagaacaccggcactggcgtgttcatccagaaggcctacacgctgcgctgcattccgcaggtgcttggcgcggtgcgcgatacgctcgaccattgcgccaccgtggtcgagcgcgaactgaattcatcgaatgacaatccgctgttcttcgaagacggcgagctgttccacggcggcaacttccacggccagcaggtggcattcgcaatggacttcctggccatcgccgccacgcaactgggcgtggtgtcggagcgccgcctgaaccgcctgctgagcccgcatctgaacaacaatctgccggcgttcctggcggcggcgaacgaggggttgtcgtgcgggtttgccggggcacagtatccggccacggcgttgattgccgagaaccgcacgatctgcagcccggcgagcatccagagtgtgccgtcgaacggcgacaaccaggatgtggtcagcatggggctgatcgctgcccgcaatgcccgccgcattctcgacaataaccagtacatcctcgcgctggagttgctggcgtcatgtcaggccgccgaactcgcgggcgcggtcgagcaactggcgccggcaggccgcgccgtgttcgcgttcgtgcgggagcgcgtgccgttcctgtcgatcgatcgctatatgaccgacgacatcgaggctatggcggcgctgctccgtcagggcgcgctggttgaggtcgtgcgtggcgcgggcatcgaactggcc

SEQ ID NO: 32500 - DNA, 1248 bp, Ralstonia metallidurans
aggaaacccttctacaagatcctgtacgtgcaggtcctgttcgcgatattcgtgggcatcctgctgggccactactggcccgacaccggcgtggccatgaagccgctcggtgacgccttcatcaagctgatcaagatgatcattggtccgatcatcttctgtaccgtggtgtccggcattgccggcatgcgcgacatgaagaaggtgggccgcgtgggtggcaaggcgctgctctacttcgagatcgtgtcaacgttcgcgctgctgctcggcctgatcgccacgcacgcgctcaaaccgggcgtgggcttcaacatcgatccggccacgctggacacgaagtcgatcgcgcagtacgtgtcgaaggcacacggtcagagcacggtcgagttcttcatgcacatcatcccggacacgatcttcagcgcgttcgccaacggcgacatcctgcagatcctgatggtctcgatgttcttcggttcggcgctggccgtggtgggtgagcgcgcgcgcatcatccacgacatggtggaccaggtgtcgaaggtgttcttccacatcgtgcacgtgatcacgaaggtggccccgatcggtgcattcggcgcgatggcgttcaccatcggcaagtacggcctgggctcgctgattccgctgctcaagctgatcggcacgttctacctcacggcgatcgtgttcgtgctggtggtgctgggtaccgtggcgcgcctgaccggtttctcgatcatccgctttgtcgcgtatatcaaggaagaactgctgatcgtgctcggcaccagctcctccgaggctgcgctgccgcacctgatggagaagatggagaagctcggctgctcgaagtcggtggtgggcctggttgtgccgaccggttactcgttcaacctggacggcaccaacatctacatgacgatggcggtgatcttcatcgcgcaggccaccaacatcgagctgacgctgatgcagcagctcacgatcctggccgtggcgatggtgacctcgaagggcgccagcggcgtgaccggctcgggcttcatcacgctggcagccacgctggccgtggtgccgacgattcccgtggccggcatggtgctgatcctcggtatcgaccgcttcatgagcgaatgccgcgcgctgacgaacatcgttggcaacggcgtggccacggtggtggtctcggcgtgggagcacgagctcgaccgcgcccgcctgacccgcgtgctgcggggcgaa

SEQ ID NO: 32501 - DNA, 1923 bp, Ralstonia metallidurans
gaatcgtcggcaacgaccttcccgcgatgcctgctggcgcacgccacgcagcggcccgatcatccggcctatcgcgagaaggatctcggtatctggcagacatatggctggtcgcagaccgcgaacgaggttagggcccttgcctgtgggctcgcggcgctgggcttccggcgcggcatgaacctggccgtggtcggtgacaaccgtccgcgtctttactgggccatgaccgccgcccaggcgctgggcggcattccggtgccgctgtaccaggacgcgatcgccaacgagatgatctacgtgctcgacgatgcggagatcgagttcgcgatcgtcgaggaccaggaacaggtcgacaagctgctcgaagtggaatcgcagctcgccgcgcgtggccgcgcggtacgccacctgatctacgaagacccacgcggattgcgcgactacgatcatccgtcgctgctttcgtacgaacgcgtgcaggagatcggccgcgagttcgaccgcgcgaaccccggattctttgacgcggcagtgcaggccggcgcgccggaagacacggccatcatcctctatacatccggcaccactggcaaaccgaagggcgtgtgccactcgcatgcgggcctgattggctcggcccgtaacggctgcaagttcgatggccttggtgccgatgacgacgtgctgtcgtacctgccgatggcctgggtaggcgacaacctgttctcgtacgcgcaggcgctggtggcaggcttcaccgtgaactgcccggagtcccgcgagaccgtgatgacagatctgcgcgagatcggcccgacctactacttcgcgccgccgcgcatctatgaaggattgttgacgcaagtcatgattcgcatggaggacgcgggctggatcaagcgccgcctctttcaatgggcgatgaacgtggcgcgccgttgcggcgcggacatcctcgacaagcggccggtagcgacgctggatcggctgcgctatgcgctgggtgaagcgctaatctacggcccgctgcgcaacgtgcttggcatgagccgcatccgcgtgggctacacggcgggcgaggcgatcggcccggacctgttccgcttctatcgctcgatcggcattaacctgaagcagttctacggccagaccgaaacctgcgcttacgtctgcctgcagccggacggccaggtcaagttcgatacggtgggaccggccgccccaggcatggaaatccgcatcgccgaaaacggcgaagtgctggtgcgcggcgtggggctgctcaagaactactacaagcgcgacgacgccacacgcgaggcgatcaacgacgaaggctacttcctgaccggcgacgccggcgtgatcgatgccgacgggcacctcaagatcatcgaccgggccaaggacgtgggcaagctggccgatggctcgatgttcgcgcccaagtacatcgagaacaagctcaagttcttcccgtacatcaaggaagcggtggccttcggtaccgaccgcgaccgcgtctgcgcgtttatcaatatcgacttcgacgccgtgggcaactgggccgagcgccgccatttgccctatgcgggctacgtcgacctggctgcccagcccgacgtgatcgcgatgatcgccgaatgcgtcgagcaggtgaacgccgatctggccgccgatgcgatgctggctgggtcgcagatcgcacgcttcctgatcctgcataaggaactcgatccggacgacgacgaactcacgcgcacgcgcaaggtgcggcgcggcttcatcgcggagaagtacggcgtgctggtcgaggcgctctatgcgggcaagcccgagcagttcatcgagacgcgcgtgaagttcgaggatgggcgcgagggcagcgtgtcggccacgctgaagctggtggatgtgaag

SEQ ID NO: 32502 - DNA, 828 bp, Ralstonia metallidurans
ggcatcgttggtgccggcacgatgggtaacggcattgcgcaggcctgcgcggtggtcggcatcgacgtggtgatgatcgacatcagcgacgccgccgtccagaagggcatcgccaccgtggccggcagcctcgaccgtctgatcaagaaggaaaaggccaccgaggcggacaaggccgcggcgctggcacgtatccacggcagcacgtcgtacgacgatctgaagcgcgccgacatcgtgatcgaggcggccaccgaaaacttcgacctgaaggtcaagatcctgaagcagatcgatggcatcgtcggccccgacgtgatcgttgcatcgaacacctcgtcgatctcgatcaccaagctggccgctgtaacgtcgcgcgcggaccgctttatcggcatgcacttcttcaacccggtgccgatgatggcgttggtcgaactgattcgtggcctgcagaccagcgatgccgcgcacgccgacgtcgaggacctcgccaagcgtctgggcaagtacccgatcacggtcaagaacagcccgggtttcgtggtcaaccgcattctctgcccgatgatcaacgaagcgttctgcgtgctcggtgaaggcctggcctcgcccgaggaaatcgacgaaggcatgaagctcggctgcaatcatccgatcggtccgctggcgctggccgacatgatcggtctggacacgatgcttgccgtcatggaagtgctctacaccgagttcgccgatccgaagtaccgtccggccatgctgatgcgcgaaatggtggccgcaggctatctgggccgcaagacgggccgtggcgtgtacgtgtac

SEQ ID NO: 32503 - DNA, 1380 bp, Ralstonia metallidurans
agtctctttcgcaccaaaaacatcgacgccatgctggaagtcagcgagcacgacggattgcgaaaggtgctgggggcggtggatctggtgctgatgggtatcggggccatcatcggcaccgggattttcgtgctgactggcaccggggcgctgaccgcgggccccgcgctgacggtgtcgttcgtgatcgcggccatggcctgcggcttcgcggcgctgtgctatgcggagttcgcttccgcgatccccgtatcgggttcgatctacacgtatagctacgccacgctcggcgagatcgtggcgtggatgattggctgggacctgctgctcgagtacgggctggccacgtcggcggtgtcagtagggtggtccggctacttccagtcgctgatcgccgggttcggcatccatctgccgaccgtgctgactgccgcgccgggcgcggtgcccggtgaacacacgctgttcaacctgcccgcctgcctgatcatgctggcgatcacctggatcgtttcatacggcgtcaaggagtcggcgcgactcaacaacgtgatggtggcgatcaagatcggcgtcgtgctgctgttcatcgccgtcggcgtctggcacgtgaagcccgccaactggcagccgttcgcgccgttcggcatgaccggcgtcttcaacgccgccgcgctcgtcttcttcgcgttcatcgggttcgatgcggtgacgtcggccgccgaggaagtgcgcaacccgcgccgtgacctgccgatcggcatcatcggctcgctggcggtttgcaccatcctttacgtgaccgtggcagccatcatgaccggcatcgtgccattcatgaagttcgagggcgttgaccatccggtgtcgctggcgctgcaatacgcggggcagaactgggtggccgggtttgttgatctgggcgccatcctcggcatgaccaccgtgattctggtgatgacctacgggcagacgcggatcatcttcgccatgtcgcgcgacgggttgctgccggaagcgttatcgacggtgcacccggttcatgcaacgccgtacacggccacgtggaccgtcggcatcgtgttcgcggcgatcgccgccttcgtgccgctgaacgtactggccgaactgatcaacatcggcacgctggccgcgttcacgctgatctcgatcgcgatccttgtgttgcgccgcacgcgcccagatttgcggcgcggcttccgctgcccgggcgtgcccgtggtgccgctgctggccgttggcttctgcctgttcctgatggcccatctgcaggcgctgacctggattgcattcctgtgctggatcgggctgggtctgatcatttacttcgcttactcgcgccgcaacgcggtgctgcac

SEQ ID NO: 32504 - DNA, 1440 bp, Ralstonia metallidurans
atccatcactacgttggcggaaccgtgcgccgtgcgggcacggaccgctttgccgatgtgttcaaccccgccacgggcgaagtggctgcgcgcgtggccatgggctcagccgatgacgtggcggcagcagtcgccgccgccaaggccgcggccccggcatgggcggagatgccgccgctgcgccgcgcccgcatcctgttcaagttcaaggaactgctcgaccgccatcacgacgacctggccgcgctgatcacgcgtgagcacggcaaggtgttttccgatgccaagggtgaagtgacgcgcggtatcgaggtggtggaattcgcctgcggcatccccaacctgctcaagaccgacttcaccgacaacatcggcggtggcatcgacaactggaacctgcgccagccgctgggcgtggtggccggcatcacgccgttcaacttcccggtcatggtgccgatgtggatgttcccggtggccctggcgtgtggcaacacgttcgtgctgaagccgtccgagcgagatccgtcgccgagcctgctgatcgccgatctgctcaagcaggccggtctgcccgatggcgtgttcaacgtggtgcagggtgacaaggtcgccgtcgacgcgctgctggcgcacccggacgtgcaggcactgtcgttcgtcggttccacgccgatcgccgagtacatctacacggaaggcacgaagcacggcaagcgcgtgcaggcgctgggcggcgcgaagaaccacctggtggtgatgcccgacgccgatctcgatcaggccgtggacgcgctggttggcgcggcgtacggttccgccggtgaacgctgcatggcgatctcggtggccgtggccgttggcgacgtggccgaccgtctggtgccgcgtctggccgagcgcgcggccacgctgaagatccgcaacggcatggaggacgacgccgaaatgggtccgctggtgaccgccgcgcacaaggcgaaggtcgagggctatatcgccaagggcgtggccgaaggcgcgaagctggtgaccgatggccgcggccacaaggtggacggtcacgagaacggtttcttcgtcggtggcacgctgttcgacaacgtcaagccggacatgacgatctacaaggaagagattttcggtccggtgctgtcagtggtacgcgtgcacgactttgccgaggcggtggatctgatcaatcgccacgagtttggcaatggcgtgtcgtgctacaccagcgacggcggcatcgcacgcgctttcgcgcgtcagatccaggtgggcatggtcggcatcaacgtgccgattccggtgccgatggcgtggcattcgttcggtggctggaagcgctcgctgttcggcgatcaccacgcttacggcgaggaaggtgtgcgcttctacacacgctacaagagcgtgatgcaacgctggccggac

SEQ ID NO: 32505 - DNA, 1284 bp, Ralstonia metallidurans
gaatccctgtggatgccctttacggccaatcgccagtacaagtccgcgccgcgcctgctggtatcggccagcggcatgtactacacgacccatgacggtcgccagatcctggacggttgcgccggcctctggtgcgtggccgcgggccacgcccgcaaggaaatcgtcgaggcgatcgcgcaacaggccgccacgctcgactacgcgccgccgttccagatgggccacccgctcgaattcgaagcggcgaccaaggtggcgtcgctgatgccgcaggggctggaccgcatcttcttcacgaactccggttccgaatcggtcgataccgcgctgaagatcgcgctggcctatcaccgtgcccgtggcgaaggccagcgcacgcgcatcatcggccgcgagcgcggctaccacggcgtgggcttcggcggcatgggcgttggcggtatcgggccgaaccgcaagatgtggtcggccaatgtgatgcccggcaccgaccacctgccggccacgctgaacatcgcagaggccgcgtactcgaagggccagccgcaatggggcgcccatctggccgatgaactcgagcggctggtcgcgctgcacgatgcctcgaacatcgccgctgtgatcgtggagccgatggccggttcggccggcgtgctgattccgccggtcggatatctggaaaaactgcgcgagatcaccagcaagcacggcatcctgctgatcttcgacgaagtgatcactgcgttcggccgcctgggcgccgcaaccggcgccgagcgtctgaaggtgacgccggacctgatcaccatggccaaggccatcaacaacgccgccgtgccgatgggcgccgtggccgtgcgccgcgaagtgcatgacgcggtgatcaacgccacgccgcaaggcggcatcgagctgccgcacggttacacgtactcgggccatccgctggcgatggcggcctgtatcgccacgctcgacatctacaagcgcgacaagctgttcgaacgcgcggccgagatgtcgccgaagttcgagtcggccgtccacggcttgcgtggtgcgccgtatgtgaaggacatccgcaaccttggcctggtggcgggcgtggaactggaatcgcgccccggcgcgccgggcgcacgtgcctacgaggcattcctgaaatgcctggagctgggtctgctggtacgctacacgggcgatatcctggcgttctcgccgccgctgatcatttcggaggccgagatcgaccaaatgttcgacaccgtgcgccaagccttg

SEQ ID NO: 32506 - DNA, 2008 bp, Ralstonia metallidurans
cgcacgctatatcagaagctcgtggactcgcacacggtcgtcacgctcgatgcggacaacgtgctgctgtacgcggatctccacatcatgaacgagtacacgagtccgcaggcgttcgccgggctcgccgagcagggccgcaaggtggcggcgccgggccagaacctggccgtggtcgatcacatcatcccgacgcacgcggaatccccgcgcgtgatccaggatcccgcctcggcgctgcaggctcgcaacctgaaacgtaattgcgacctgcacggtattccgctgttcgacaccaatgatccgctgcagggtatcgagcatgtcatcgcgcccgagcacggcatgatccggcccggcatggtcgtgctttgcggcgacagccataccaccacctacggcgcattcggcgcgctgggcttcggtatcggcacctccgaggtggagcacgtgctggccacgcagacgctggtctaccggctggcgcgcgacatgcgtatccgcgtggatggcccgctgccatcgggcacgacttcgaaagacctgatcctccacatcatcgcgcgcatcagcgcgcagggcgcgcgtggctacgcggtggagttcacgggcagcacgatccgtgcgttgtcgatggaagcgcgcatgaccctgtgcaacatgaccgtggaggcgggcgcgcgcggggcactgatcgcgcccgatgccacgtcgatcgactatgtcctgcgccgggcaccagacatcgacgccgacatggccgaaaccgcgcgccgggcatgggccgggctgcggtcggatgccgatgccggcttcgatctcgaactggcattcgatgccgctgcggtggagccgttcgtcacctggggcacgagcccggatcaggcgattcccgtgagcgccacggtgccgcagccggccgacgccggggacagcaacgcccgcgtttccgccgagcgcgcgcttgagtacatcggcgtgacgcccggcgtgtcgctgcaggggctgcctgtgcagcgggtgtttatcggctcctgcacgaatggccgcatcgaggacttgcgccaggtggccgccgtggtacgcggccgcagggtggcgccgggcgtacgtgcaatggtggtgccgggctccggcgccgtgcgcgatcaggctgaagccgagggcatcgcggccttgctgatcgatgctggattcgaatggcgcaagcccggctgttcgatgtgccttgcgatgaacgacgacgtgttggcgccgggcgagcgctgcgcgtcgaccaccaaccgaaacttcgagggccgccagggccgtgccggacgcacgcacctgatgagcccggccatggcagccgccgcagccgttaccggctgtatcaccgacgtgcgggaactggagatccaacatggatgacatcacgacgatcgaaggtgtcggcgcgccactaccgctgccgaacctggataccgaccagatcatgccgaagcagttcctgcgtggcatcgacaaggcggggctcgaccgcgggctgcttcacgacatgcgtttcgacgcgaacggagccccgcgtgcggacttcgtgctgaaccagccggcgtggcgcgacacgcgcgtgctggtcgccgggccgaacttcggctgcggttcgagccgtgagcacgcggtctgggggctgcagcaatatggcatccgcgcggtcatcgcgccgagcttcggcgagatcttctactcgaacgcgatgaacaaccggttgttgctggtggcgctgccgcaggcggatgtcgaccagatcatggcggccgtgagtgaccccgtggcgccggcgtcgatccgtatcgacctgtcgaccatgacggtcaatgccggcgacttcgccaagtcgttctcgctctctccgcgccacctcgacatgttccggctcggcctcgatgtcatcggcatgtcgttgacgcacgccgatgcgattgcggcattcacaagtcggcaccacgcggacaacccctggctacgc

SEQ ID NO: 32507 - DNA, 1842 bp, Ralstonia metallidurans
atgtgtggcatcgttggggcggtctctcaccgcaatatcgttcctgtcctgatcgaaggcctgcgccgccttgagtaccgtggctacgattcctgcggcgtggccgtggtgcgtgacggtattctcgagcgcgcccgtaccgtatcgcgcgtggccgaactggacgcgcagacgcaatcgtctggcctggccggccacatcggcatcgcgcacacgcgctgggcgacgcacggcaagccggacaccgtcaacgcccacccgcacttctcggacgagaccatcgcgctcgttcacaacggcatcatcgagaactacgagccgctgcgcgacgaactgcgcgcggtcgggtacggtttcgaatcgcagactgatactgaagtggtggcgcacctgatccaccaggcttacacgtacccgagcagcgccacgcgaggcgacctgttcggcgcggtgcgcgcggtcaccaagcgcctgcatggcgcctacgcgatcgccgtggtggccaaggaccagccggacgtggtggtcggcgcgcgcgccggctcgccgctggtggtggcactgggcgaggacgaatcgttcctggcctctgacgcgctggccgtggccggcaccgccaaccgcatcatctatctggaagagggcgacgtggtcgagatctcgcgcggtggcgcgcggattcgcgacgtgcacgatcacgaggtcgagcgcgaagcgcgcgtggtggaagcccacgccgccgcggtggaactgggcccgtaccggcacttcatgcagaaggaaatcttcgagcagccgcgcgcgctgggcgacacgctggaaggcatctccgcgatcacgcccgagctgttcggtgagaacgccgcgcaggtgttctcggaaatcgacagtgtgctgatcctggcctgcggcacgagctactactcgggctgcacggccaagtactggctcgaatcgatcgcgaagatcccgacccaggtggaagtggccagcgaataccgctatcgcgacaccgtgccgaacccgcgcgcgctggtggtggtgatttcgcagtcgggcgagacggccgacacgatggccgcgctgcgtcatgcccgctcactgggccacacgcacacgctggccgtctgcaacgtggcgacgagcgccatggtgcgtgagaccgagctgagcttcctgacacgcgccggtaccgagatcggcgtggcgtcgaccaaggccttcacgacacaactggccgcgctgtacatgctgacgctggcgctggccaaggtgcgcggctacctgaccgatgcgcaggaagccgaagccctgaccaacctccgccacctgccggccgcgctgcatggcgtgctggcgctggagccgcagatcatcgcgtggtcggaagacttcgcgcgccgcgagaacgcgctgttcctggggcgcggcctgcattacccgatcgccctggaaggcgcgctcaagctcaaggaaatctcgtacatccacgctgaagcctatccggccggcgaactcaagcacggcccgctggcgctcgtgaccgaggcgatgccggtggtgaccgtagcgccgaacgacgcgctgctggagaagctgaagtcgaacatccaggaagtgcgcgcccgcggtggccgtctctatgtgttcgccgactcggatacgcatatccagtcgtcggatggcatccaggtgatccggttgccggagcactatggtgcgctgtccccgatcctgcatgtggtgccgctgcaactgctggcgtatcacaccgcctgcgcacgcggtaccgacgtcgacaagccgcgcaacctggccaagtcggtgacggtggagtaagcg

SEQ ID NO: 32508 - DNA, 720 bp, Ralstonia metallidurans
gcgctggtcaccggcgccgcacgccgcctgggtcgtgccatcgctctcgaacttgccgcacaaggctgggacgttgccgttcactgcaaccgctcgcgcgacgaagcggacgcgctggccacccagatccgcggcctcggtcgccgcgccgccgtgctgcaggccgacctgtcggatgaagccgccacggcccgtttgattcccgcctgcatcgacgcccttggcgtgccggcctgcctggtcaacaacgcgtcgctgttccagtacgacgtggcgacgagcttctcctatgggtcgctcgacacgcacatgcgcaccaacgtggcggccccgctgctgctggcgcgtgagatgcacaaggcgcttggcgccgacggcaacgagaccgggcagctcggcgttgtgatcaatctgctcgaccagaagctgaacaacctgaatccagatttcctgtcgtacacgctgtcgaaggccgcgctgcagactgccacggtgcagcttgcgcaggcactggcgccgcgtctgcgggtggtgggcgtcgcgcccggcatcacgctggtgtccggcgaccagtccgacccgggctttgtccgcgcccatgggatgacgccgctgggcaagtcgtccacgccggaagacatcgcgcaggccgtggcctacctggccgtggcgcgcgccgttaccggcaccacgttgtacgtcgacggaggccagcacctg

SEQ ID NO: 32509 - DNA, 1167 bp, Ralstonia metallidurans
ctgcaggcattccggcaggaggtgcgcgagttcctgcgcgagagtcttccccccgacctgccgcgccgcaagggtggctttcgctccccacgcgcggatttggcccgctggcaggggatcctgcacgccaagggctggggcgcgccgtactgggccagcgagcacggcggtaccggctggaccgtgccgcagcggctgatcttcgacgaggagtgcagcgccgcgggcgcgccgacgcaggatggcttcgcgcagaagctggtggggcccgtgctgaactatttcgcgacgccggagcagcgggccgcccacgtgccggcgattctcgccggaaagcggatgtggtgtcagggcttctccgagccgggttccgggtcggatctcgcttcgttgcggacccgcgccgagcgcgatggcgatcactacgtcgtcaatggtcagaagatctggaccagctatgggcatgaggccgactggatctttctgctggtgcgtaccgacacgcaggtgaagaagcaggccgggatcagtttcctgctggtggacatgaagacgccaggcatcaccgtgcggccgatcatcagcatcgacggcgcgcatcatctgaacgagacgttcttcgaggacgtacgggtacccgtgagcaacctcgtcggcgccgagggcgaggggtggaagctcaccaagttcctgctcaataacgagcacgcgtcgacggcggacctgccgacgctgcagcgattccagcggcaattgcgtgcgttggctgccacgcggggggcgggcggcgggaccttgatcggccggcacgaatttgccctgcgcctggcgcgcctggaggccgagttgcaggcgatcacggtgatggtgcagcgtgtggcggccatggaggcggaccatagtcccgccgctcacgcgatgggttcgatcctcaaggtgcgaggtaccgagctgcagcagaagatgagcgagttccttgtcgaggcgctcggcgaccatggcgcggtggcgtatccgggatcgcacgcggccacggcaggcgcccggtcgctgccgatgcaggaggtggcgcagtccatcgcggccgacatgctcttccggcgggccaccacgatctacggtggtaccagcgaagtgcagcgcggcatcatcgccaagtcgctgttt

SEQ ID NO: 32510 - DNA, 1122 bp, Ralstonia metallidurans
ttcaagctgaatgatgcgcagcaaatgctgcaggacagcgcccgccgcttcgtcgagaaggcatatgcattcgaagcccgcaccgcgttgatccaggcgggccagactggcggtacccgtcactggcagacctttgccgagaacggctggcttgccgccgcgctgccggagacttgcggcggcctgggcggttcggtgatcgacaccgccctgatcgcgcaggaactcgggcgtggcctggtgctggagccatttctgggtagcggcgtgctggccacgcagacgctgctggccgcagccacgccgagccagagagaggcactgctgccatcactggccgaagggacacgacgttacgcgcttgcgtacagcgaggccgatgcgcgtggaatgccggagatcctttcgacgtctgccgaggctggcacggacggctacacgttgcgtggcaccaagacgctggtgctgggcggtgtggacgccgatgccttcatcgtgtcggcgcgccttgccgatagtggggagccgtctgcgatcacgctctttctcgtcgacgccggcacgccgggtctgacgtgccacgcgctgccactacatgacggcacatgggcggcggagctggagatcgatggggcgcgcgtgccggcttcggccatgctcggccagccgggcgaaggtttgcgggcattgcgccacgggttggcgcatgcgacggcggcgctgtgcgcggagcttgtcggcggcatggagaaagccgtcgaggtcacggcggattacctcaaggtgcgcaagcagttcggcgtgcccatcggcagcttccaggcgctgcaacaccgcatgtccgacatggccgcggagatggagctggcgcgttccatgctgttctcgctactggcagccatcgaccatgaggacgaagccacgctgttgcatcgggtttcccaggccaaggcgtttgtcggccgtgctgcccggtatgtctgcgggcaggccattcagttgcacggtggcatcggcatgaccgacgagtacttgatcggccactactacaagcgcgccattgttgcggatttgatcttcggctcggcggatcggcacgaggcaatctgcgccgaggccatt

SEQ ID NO: 32511 - DNA, 507 bp, Ralstonia metallidurans
gtgaagatgtttctcagccaactggattcgccgctgggtgccatgctgctcgtgaccgatgcgcggcgggtcgtgcgtgcgctcgacttcgccgaccacaagtcacggctgtatcgcggtctgcgcgagcactatggcgaggtggaactgactgagatccctgccccggccgagattgccgatgcactggcccgctacttccatggcgagctggaggcgctgaaggtgctgcggactgcgacgtctggttcggcgttgcagcgccgggtctgggccgcgctgcgccgcatccctgtgggcacgaccacgacctacggcaagctagccaaggcgctgggtttcgacgacccgcgcgcggccgtcgagatcggcgcggccaatggcgccaatccgatcgccatcgtcgtgccgtgccaccgcgtcattgcgagcaatggcgacctcaagggctatgcctggggcctgcaccgcaagcgctggctgctggagcatgagaacgcgatggtg

SEQ ID NO: 32512 - DNA, 1191 bp, Ralstonia metallidurans
acgggcacgattttgattcatgcgggcgatggcgcgccgccggcaggaatgctgggattcgaggccctgctcgcagacgcgagccctgtaccggacgccatgcgcggcggcgaggatctggcctcgatcatgtacacgggcggcaccaccggcaagccgaagggtgtcatgcagtcgcacctgaacctgtggtcgtcgtcgatctcgcgcctcgcccagttcccgctggacgaagcgacgatcacgctccacgcggcaccgctgttccatacggcggcgatggccaaggcagtgggtgtgttcgtcatcggcggcacgcacacgatggtcccgacgttcgatccggccgaggtgctggaaacgctcgaacgcgagcgcgtcaacgacatcatgctcgtgcccacgatgctgcaggcgatcctggcgtgcccggacttcgccagacgcgatgtcagcagcctgaagcgcatcaactatggcgcgtcaccgatcaacggcgcggtgctcgatgcggcgctggccgccatgccgaatgtcgagttctcgcacgcctatgggctgaccgaagcgtcgccggtggtatcggtcaatccgcctgccaaccacggcccggtgggccgcgccagcgggctgtaccggtcggcgggccgccccggcttcggtgtgttcgtcaaggtcgtcgacccgaacggcgatgaagtcccacgcaacacgatcggcgagatcatcgtgcgcggccccaacatcatgcagggatactggaacaagccggaggaaacgcggcaggcactgcgcaacggctggctgcatacgggcgacggcgcatacatggacgatgccggctatctgttcatcgtcgatcgcatcaaggacatgatcgtcaccggcggcgagaacgtctattcggccgaggtcgagaacgcgctggcccaacatccggcagtccattcctgcgcggtcattggcgtgccgcacgagcgctggggcgaagcggttcacgcggtggtggtgctcagacccggcttgcaggctggcgaggacgaattgcgcacgcattgccgcgcgctcatcgccagctacaagtgccccaagagcgtggagttccgcaccgagctgccgctctccgcagcgggcaagatcctcaagcgcgacctgcgcacgcgctactggcaggaccagccgcggcaggtc

SEQ ID NO: 32513 - DNA, 1167 bp, Ralstonia metallidurans
aaagtggtggtagccggtgtcggcatgattccctttaccaagccgggcgcgagcgacgactacggcgtgatgggcgcgcgcgccgcgaaagccgcgctcgccgacgctggcatcgactacgcgctggtgcagcaggcctacgtaggctacgtgttcggcgattcgacgtcgggacagacggcgatctacggtgtcggcctgaccggcattccggtcatcaacgtcaacaacaactgcgccacgggatcgacggcgttgtatctggcccggcaggccgtggagagtggcgcggtggaatgcgcgatcgcgctcggcttcgaacagatggtgcccggcgcgctgaagggcgcgtacacggaccgccccggcccgatggagcgcttcgcccgtgtgatgaacgacgtccagggcttcgacgaacaggcgccgcgcgcggcgcagttcttcggcggtgccggccgtgcctacatgaaggaattcggcattcggcccgagaccttcgcgcgtatctccgtgaaagcccgccagcacgcggcgcgtaatccgttcgccgtattccgcaacaccgtcacgctggaagatgtgatgacctccccgaaggtgttcgatccgctgacgcgtctgcagtgctgtccgcccacctgcggcgcggccgccgcgatcctgtgcaccgaggcgttcgcgcgcaagcatgggctcgacacgcgcgtggccatcgcggcgcaggccatgaccaccgaccgcaacagcaccttcgatgaaggcgacatgcgcaaggtggtcggctacgacatgacgcacgcggcggccacccaggtctacgaacgcgcaggcatcgggcccggcgacgtcgacgtggtggaactgcacgactgcttcaccgcgaacgaactgatcacctacgaagggctgggcctgacgcccgaaggcaccgccgagaagttcatcctcgacggcgacaacacgtacggtggccgcgtggtgaccaacccctcgggcggcctgctgtccaagggccacccgctcggcgccacgggactcgcacagtgcgcggaactggtctggcaactgcgcggcgaagcaggcgaccggcaggtagccggcgcgcgcctggcactgcagcacaacctgggtctgggcggcgcgtgcgtggtcacgctgtaccag

SEQ ID NO: 32514 - DNA, 810 bp, Ralstonia metallidurans
aaactgaccaacaaggtagcgatcgtatcgggctccggccggggcatcggccgcgagatcgcgctgaagctggcaagcgaaggggcggcggttgtcgtcaacgatcttgacgcggaaccggccgaggccgtggtccgcgagatcaccacgatgggcggccgggccgtagcctgcgtgggcagcgtgaccgaggccgacttcggcacgcgcttcgtgggtaccgcattgcagacttttggcgggctcgacatcatcgtcaacaacgccggctatacgtgggacaacgtgatccagaaaatgaccgacgaccagtggtcggccatcatggatgtgcacgtcactgcgccgttccgcattctgcgcgctgcggcggactacttccgcgagacctcgaagcaggaagccgagcaaggccgcgaagtattccgcaaggtggtgaacatctcctcggcctcgggcgtgataggcaatgccggccaagccaactattcggcgggcaaggctgccatcaacggcctgaccaaggcgctggccaaggagtggggacgctacaaggtcaacgtcaacagcgtcgcgttcggcctgatcaagacgcgcctgaccgaggccgtagcaggcgaaggccatgccaccatcgacatcgctggcaatgaaatcaaggtgggcgtgaatccgcagctcatgaagaacatcgaggccacgattccgctgggccgtggcggcacgcccgccgaagccgccggctccgtctacctgctttgcattccggaatccaactacatcacgggtcaggtgcttgtggtgggtggc

SEQ ID NO: 32515 - DNA, 1446 bp, Ralstonia metallidurans
gtgagcttgcccgatttcgacatggtgctgttcggcggcaccggagacctggcgcggcgcaagctgctgccagcccttttcgacgcgcaccgcacggggtgtctccacccgtcctcgcgcattctcgctaccggaagtcatccgcacaccaccgagcaatacaaggcgatgctcgaggaaagcgtgcgtcctggcctcgaacatgcgccacccgaagcgtggacctcgttcatggatcgtatcggctacgtgcaggccgacgcgcgccagccggcgcacttcgacgcgctggccgagcaggtgctggcccgcaagcccgaagtggtcgtgtgctatctggccacggcgccgcatatcttcgtgccgatctgcgagcaactggggcgaaccggcctcaatgcacccaacgtgcgcgtggtgcttgagaagccgctcggccatgatctcgactcgtcggaggcgatcaacaacgccgtgtcgcggtatttcggcgaggaacagatctaccggatcgaccattacctgggcaaggaatcggtccagaacctgatggcgatccgcttcgccaacgcgctgttcgagccgctgtggcggcgcgagtgggtgcaggacgtgcagatcaccatcgccgaggaactgggcgtggagacacgcggtgatttctacgatcgcaccggcgcgctgcgagacatggtgcagaaccacctggtgcaactgctgtgcatggtggcgatggaaccgccggccagcctgtccgaagacgcgattcgcgacgagaagatcaagatcctcaaggcgctcaagccaatcctgccgcaggacgttgccgagaagaccgtgcgcggccagtatcgcgccggcgccgtcggcggcaagcccgtggtcagctacgtcgacgagcagggcatcgccgccgacagcacgaccgagacctttgttgccatcaaggccgaaatcgccaactggcgctgggaaggggtgccgttctacctgcgcacgggcaagcggatgcaatcgcgcgtggccgagatcgtggtccatttccgcgacgtgccccatgcgatctttccccggccgctgaccctgtcgccgcagaaccggctcgtgatacggctgcagcccgaagagagcatccgcctgtatttcctggtcaagcaaccgggcgataccgtggagctgacgccgacctcgctcgatctcgacttcgccaactcgttcaagatgcgccgtgcgggcgcatacgagcggctgttgctcgacgtgatccgcggcaagcttggcctgttcgtgcgacgcgacgagcaggtgcaggcgtggcgctgggtcgagccgattctcgatacgtgggaccagagcaccgtgccgcccaaaccgtacacggccggcacctggggaccggcggcatcgtcggccctgatgtcgcgcgacggcgcgttatggcatgag

SEQ ID NO: 32516 - DNA, 1584 bp, Ralstonia metallidurans
ggactggcccgcaaccccgccaactacgttccgatcaccccgctcgacttcatcgcccgcgcggccgaggtctacggcgatcgcctggccatcgtgcatggcacggtgcgccagaactggcgcgacacctacgcgcgctgccggcgcctggccagcgcgctgacccgcgcgggcgtgggcaagggcgataccgtggcggcgctgctgcccaacaccccggcgatggtcgaggcgcacttcggcgtgccgatggccggtgcggtgctgaatgcactcaacatccgcctggacgccgccaacctggtcttcatgctgcgccacggcgaagccaaggtgctgctggcggacaccgagttcgccgatgccgcccgtcagatggcgcgcgaggtgcgtggactcaaggtgatcgcggtggaagacgtgctcgggcccgacgccgagcggttcggtgacaccgattacgagtccttcctggccagcggcgatccggaattcgactggaagatgcccggcgacgagtgggacgccattgccctgaactacacgtcgggcactaccggcgacccgaagggcgtggtctatcaccatcgcggcgcggccatgaacgccatctccaacatcctggagtgggacatggccaagcatccggtctacctgtggacgctgccgatgttccactgcaacggctggtgcttcccgtggacagtcgcggcccgcgccggcgtgaacgtctgcctgcgcaagttcgagccgaagctcgtcttcgacctgatgcgcgacgaaggtgtgacgcactactgcgccgcgccgatcgtccacaccgcgctggtcaacgcgccgccgtcgtggcgcgaagggctgcgcgggccggtgcgcggcatggtggcgggcgccccgcccccggcggcggtgctggcgcagatggaagcgatgggtttcgacctgtcgcatgtctacggcctgaccgaggtctacggcccggccgcggtctgcgcggagcaggacgcctggcacacggtgtcgcaggaagaacgcgcggtgctgaaggcgcgccagggcgtgcgctatcacctgcagtccggcgtcacggtgctggacccggatacgatgcagcccgtaccgcgcgacggcgagaccatcggcgaaatcatgttccgcggcaacatctgcatgaagggttacctcaagaacgacaaggccacgcgcgaggcgttcgcgggcggctggttccatacgggcgaccttggcgtgtgcatgcctgacggctacatcaagatcaaggaccgcagcaaggacatcatcatctccggcggggagaacatttccagcgtcgaggtggaagacgcgctctaccgccaccccgcggtgctggccgccgccgtggtggcgcagccggatgccaagtggggcgagacgccgtgcgcgttcgtcgaactgaaggatggcgcaagcgtcacggccgaagaactgattgcacattgccgcacgctgctggccggcttcaaggtgccgaaggcggtctacttcgggccgctgcccaagacctctaccggcaagatccagaagttcgaactgcgcaagaag

SEQ ID NO: 32517 - DNA, 1119 bp, Ralstonia metallidurans
tttccgctctccgtctggcagacgggctccggcacgcagaccaacatgaacctgaacgaggtcatcgccaaccgggccatccagctcctgggcggcgaggtcggcagcaagaagccggtgcatccgaatgaccacgtcaactgcagccagtcttccaacgacagctttccgacggcgatgcacatcgcggccacacgcgcgatccagcagacgctgctgccttcgctggagaaactccagcagactttcgcgaagaaggtcgaggcattcgacgatatcgtcaaggtcggccgcactcatctgcaggacgccgtgccgctgaccctgggccaggaattctccggctacatgacacaggtggccgatgcccagtcgcgcctgcaacaggccatgctgcgcgcgatgccggtgcctcagggtggcacggcagtcggcaccggactcaacgcgccgccgggattcgccgtcgcctttgcccgcgcgctggccacctacaccagcctgccgttcgagcccgcgccaaaccgctacgcactgcaagccgcccacgacgcgctggccgacctgtccggcgcgctgaacaccacggcttcgtcattcctgaagatcgcccgcgatttcatgctgctgggctcggggccccgtgccggcgttgccgaactgcaattgcccgccaacgagcccggctcgtcgatcatgcccggcaaggtcaatccgacgcaggctgaggccttggcgatggtctgttgccgcgtcatcggcaatcacacgacggtgacactggcaaacagcctcggcacgctggaactcaatgcgtacaagccagtgatcatctacagcctgatgcagtccgtcacactgctggccgacgccgcatcgagcttcgccgaacacatggttgaaggcgtggaacccgaccgcgcgcgcattcaggaactgcttgagcgctcgctgatgtctgtgaccgcgctcaacccgcatatcggctacgacaaggctgccgagatcgcgaagctcgcggtgaagaagaacctctcgttgcgcgaggccgccatcgcatcaggccacgtcaccaacgaacagttcgatcagtggatcgacttcaaggcaatgacgaag

SEQ ID NO: 32518 - DNA, 1066 bp, Ralstonia metallidurans
atgccactcgtatccatgcgccagttgctggaccatgccgccgagaacaactacggtctgccggctttcaacgtgaacaacctcgagcaggttcaggccatcatgcaggccgccgacgaggtcaacgccccggtgatcatgcaggcatcggcaggcgcgcgcaaatacgctggcgagcacttcctgcgtcacctgatcgaagccgccgtggaagcctatccgcacatcccggtggtgatgcaccaggatcacggccagtcgccggcgatctgcaaggccgccatcgacctgaacttctcgtcggtgatgatggatggctcgctgaaggaagacggcaagaccccgtcggactacgagtacaacgtcgacgtgacccgcaaggtggtgcagatggcccacgcgctgggcgtgaccgtggaaggcgaactgggttgcctgggctcgctggaaaccggtgaagccggcgaggaagacggcattggcgccgaaggcaagctcgatcactcgatgctgctgaccgatccggagcaggccgccgacttcgtcaaggccacccagctcgacgcgctggccatcgccatcggcacctcgcacggcgcgtacaagttcacgcgcaagcccacgggcgacatcctggccatcgggcgcatcaaggaaatccacgcccgcattccgaacactcacctggtgatgcacggttcgtcgtcggtgccgccaggaactgctggctgaaatccgccagttcggtggcgacatgaaggaaacgtacggcgtgcccgtggaggaaatccaggaagcgatcaagtacggcgtgcgcaagatcaacatcgacaccgacatccgtctggcgatgaccggcgcgatccgccgcttcttcgtggagaacccgagcaagttcgacccgcgcgagtacctgaagccggcccgcgaagccgccaagctcgtgtgcaaggcccgctacatcgccttcggttgtgaaggccaggccagcaagatcaaggccgtgtcgctgaccgacgttgcccagcagtacaaggccggcaagctcgcccaggtcgtgcagtaa

SEQ ID NO: 32519 - DNA, 1434 bp, Ralstonia metallidurans
gcccgcatgacacgttccaccaagatcgtcgccacgattggccccgcatccagcacgctggaagtgttgacccgcatgatcggagcaggggttgacgtggtgcgcctgaacttctcgcatggcaccgcgcaggaccatatcgatcgcgccgccctggtgcgtgaggcggcggcggcctgcgggcgcgaggtggccatcatggccgacctgcagggccccaagatccgcgtgggcaagttcgagaacggcaagatcacgctcaagccgggcgacgcgttcatcctcgattcggcctgccagatgggcaatcaggagcgcgtgggcctggattacaaggatctgccgcgcgatgtgggcccgggcgacctgctcctgctcaacgacggcctgatcgtgctggtggtggaccgcgtgctcggcaacgagatcttcaccacggtgcgtatcggtggcgagctgtccaacaacaagggcatcaatcgtcagggtggcggcctgtcggcgccggcgctgaccgccaaggacatggaggacatcaagaccgccatggcgctgggcgcggactacgtggccgtgagcttcccgaagaacgccactgacatggaaatggcccgccagctcaccaacgtggcaggccagccgcacaaccacaaggcgcgcatgatcgcgaagatcgagcgggccgaggcgattcgtccgggcgtgctcgaggaaatcctgctggcgtcggacggcatcatggtggcgcgcggcgatctggccgtcgaagttggcaacgccgccgtgcccgcgctgcagaagcgcatgatcaagctggcccgcgaggccaacaagctgacgatcaccgccacccagatgatggagagcatgatcgtcaacccggtgccgacgcgggccgaagtgtccgacgtggccaacgccgtgctcgatggcaccgacgccgtgatgacgtcggccgagaccgctgccggccgctatccggtggaaacggtcgaagccatggccgcgatctgtctggaagccgagaagtcggaggtggtgcagctcgacaccgacttcctgaaccagaccttcgcgcggatcgaccagtcgatcgcgatgggtgcgctgttcaccgcctatcatctaggtgtcaaggcgatcgcggcgctgaccgattccggcgccacggcgctgtggatgagccgtcaccgcattcatgtgccgatctacgcgatgacgccgaacctggcgtcgcaacgcaagatgcagctctatcgcaatgtggtgccgctgccgctgcagtcgagcgcggaccgcgacgtggcgcttgagcaggccgaggaactgctgctgtcccagggcgtggtgcagcgcggcgatttcatcgtgctgacgatcggcgagccgatgggccagcccggcggcacgaatacgctcaagatcgtgagggtg

SEQ ID NO: 32520 - DNA, 1219 bp, Ralstonia metallidurans
cgcccacgtcccgctcttatcgccatgacctctgtcctgcgtcttaccgatctcatttcccaaggcaaaatctccggcaaacgtgtgttcatccgtgccgacctgaacgtgccgcaagacgacgcaggcaatatcaccgaagacacccgcatccgcgcgtcggtgccggccattcaggcctgcctggaagccggcgcgaccgtcatggtgacgtcgcacctgggccgtccgaccgagggcgagttcaagccggaggattcgctggcaccgattgccacgcgcctgtccgaactgctcggcaagccggtgaaactggtccagaactgggtcgacggtgtcgaggtggcgcctggccagatcgtgctcctggaaaactgccgcgtgaacaagggcgagaagaagaacagcgacgagctggcccagaagatggccaagctctgtgacgtctacgtgaacgacgcgttcggcaccgcccaccgcgccgaggccaccactcacggtatcgccaagtttgccccgatcgcctgcgccggcccgctgctggccgccgagatcgacgcgctgggccgcgcgctgggccagccggcgcgtccgctggtggccatcgtggccggctcgaaggtttcgaccaagctcaccatcctgaaggcactggccgacaaggtggacaacctgatcgtcggcggcggcatcgccaacacgttcatgctggccgctggcctgaagatcggcaagtcgctcgccgaggccgacctcgtgggtgacgccaagacgatcatcgacatcatggccgcgcgcggcgcatcggtgccgattcccgtcgacgtggtctgcgccaaggagttcagcgccacggctgcggcgacggtcaaggacgtcaaggacgttaccgacgacgacatgatcctcgacatcggcccgaagaccgccgcgatgctggccgaccagctcaaggctgccggcacgatcgtctggaacggtccggtcggcgtgttcgaattcgatcagttcggcaacggtaccaaggtgctggccgaagccatcgccacgtcgaaggcattctcgattgcaggtggcggcgacacgctggccgccatcgccaagtacggcatcgccgatcgcgtggggtatatctcgaccggtgtcgggcgccttcctggaattcctggaaggcaagaagctgcccgcattcgaagtgctggaacagcgcgccgcaggc

SEQ ID NO: 32521 - DNA, 1119 bp, Ralstonia metallidurans
ctgtacttcgcgttcaccgtgttcatcgaaccgatgcgccagtctctcgggtacggcaaaccgttcctggcgggcggattctcgctggggctgctggtctgggcgatgtgctcgttcgcagtaggccggctgctggaccgcgtgccggcacgcaaggtcatgggcacgggctcggtgctggccgccatcggactgctgctctgggcgtggtgcccgtcgccggcggtattcctgctgatgtggattccgctcgggctggccatggcgtcgacactgtacgagccggcgttcgtggtgctgcgtcaggcctggggggacggctaccagaagccgatcgtccatgtgacgctgcttgctggcttcgccagcacgatcttcatcccgctggcgcagtggctggtgctccatctgggctggcgcgagacgctggtcgtctttgccgcgctaaacctgttcgtctgcgcgcccttgcacgcgcggctgcgctacgccgtgcatcccagctacgcccatgccgccacccacagcggcacaccgctggccggcgcggcgtcctccggcatcgcccgcgcgacgctgcgccagccggtattctggtgtgttgtgctggcgttcacagccacggcggtgatcgcatcgctactcggcgcccacctgattccgatgctgacggagaaggggatgcccgtcgcgcagcaattgatcgtggccgcgctgatcgggcccgcgcaagtggccggacggctcgccatggcgcggctgccgatcgatcacccggtgcggctgtcgatgccggtctacatcgtgatgaccatcgggctggcctgtctggcgctggggaacggctactggctgatgttcgcggcgatctgctatggctgcgccaacggcgtcaacacgatgctgcgcgcgatggccatgcccgaactgatctcgcgtcatcactatgcaacgctgaatgggttaatgatgacccctgtgttgctgatgcaggccgccgcgccgtggttcggcgccctgctctggcgtgccgccggcggctactggctgatgctgtgggtcatggtggcgctatccatcggcgcgctggccgcctttgcgttcgcgctgcatcagcgt

SEQ ID NO: 32522 - DNA, 1074 bp, Ralstonia metallidurans
cttggcgacgaacaggccatgatggtcgacacgatgaggcggtggctgagcaagcattacagcttcgagttcaggcagcaggccatgcacacgccaggcgggtgcagtgcatccgcgtggtcaggcctggccgggctcggcatcaccagcctgaccataccggaggcgctagggggcatggggcagccgatgacggatctgctcccactgatggagacgctgggtgaggcattggtactggaacccgtgccgtggagcgcggtgttcggtacgcagatattgcttgcgctccccgtcggcccgtcacgtgatgcgcgcctggccgcattggccggtggtgatgcgcgctgcgcagtgctatgcgggaaggaaccaggcgtcgggaagacgccgcaaccgaccgtgatcgcgcagcgtgtcggcgacgagtggcagctcaatggtgacgatgcaatggtcatgggcggcaccgatgcgcatcacttcatcgtggccgcgacgctggacgacggcagcctcggcctgttcgatctgccggccgatgcctctggcgtcgtcgtgcagggctatcgctttcatgacggccgcggcgcggcggaagtgcagctgaccaacgtgcggctgagcgcgtgctccatgcttggccaaggcgaacaggcggcgacggcgctcgatataggcatgacattcgccacgctggccttgtgtgccgacagtatcggcgccatgcggcgcgcgctgggcatcactgcggagtacctgcgcacgcgcaggcagttcggccgcacgctcgcggaacagcaggtggttcaacaccgcatggccgaccacttccgcgcctggaacggtgcgcgtcatcttgcaaggcgggtactggccgattgggatgcggcgccgcctgccgagcgccgtcgccgcatctgcgcggcgaagcacctgtctggcgtggttggccgcgccattgcgttcgacgtcctgcaattgcatggcgcggttggcttgcaggatgagacgccgatcagccactacagcaaacggcttgtcggcaacgatttgctgcttggcagcgccgat

SEQ ID NO: 32523 - DNA, 756 bp, Ralstonia metallidurans
tccgtttcctacgaggtccgcgacaacatcgcggagatccttcttgatagccctcccgtcaacgcgctgaacgaggcgatgatcgacgcgttgctgcaagggctgcgccgagcagccgaggacgactcggtacgcgccgtgatactggccagcgccgtgccacgccggttctgtgccgggctgcaactcgatagcctgcgcgacgcgccgccatcgcgcggctacgcactggtggagaagctctatagcgggctgtgcgaggcacagttccatcttggcaagccgtcgatcgccgccgtcggcggtaccgcccggggcggtggcatgacactggcgatccactgcgacatgatcgttgccgctgacaccgcgaccttcggctatccggagatcgatgtcgggctggtacccgcgattcactacacccatctgccgcgcatcatcggccggcatcgtgccttcgatctgctgttcacggggcgttcgttcgatgcggcggaagccatgtcgttggggctggtcaaccgcgtggtgccagaacagcgcgtcatggaggaggctcgcgcgctggcgcgctccctgtgccagaaatcgcccgagatcatgcggatggggcggcaggcattcatgcgggctaacgacatcgactaccggcgtggcgtggcaggcgcggtggaaacgttcgggaacatctttgctaccgaggacgcgcaggaaggcatcgccgcattcgtggagcgacgcaagccacgctgg

SEQ ID NO: 32524 - DNA, 561 bp, Ralstonia metallidurans
atccccgcgccggccgtcgacgaaaaagccggcacgagccataccgagaccgcggtattcgccggtggatgcttctggggcgtgcaaggcgtgttccaacatgtccgcggcgttacacgggtaacgtccggttactctggcggctcggccagcaacgcccaatacgagatggtgggcaccggcatgaccggacacgcggagtcggtcgaaatccgctacgaccccacccagatcagctacggcaagctgctgcagatcttcttctcggtcgcgcacaatcctacgcaactgaactatcaggggcccgatcacggtacgcagtaccgctcggcgatcttcccgcgctcgccggtgcaacgctcgattgccgaggcgtatatcacccagctcgacacgtcgaaagcgtaccgcgcgccgatcgtcacgcgcgtcgaggattacaaggggttctttccggccgagaactatcaccaggattttctcgtcaagaatccgagctatccgtacatcgtcatcaatgacctgccgaagatcggcaatctgaaaacgatgttcccggac

SEQ ID NO: 32525 - DNA, 2403 bp, Ralstonia metallidurans
atgacccatcctgccgcatctctccaaccatccgaatggcgtctacctgttgagggtatgacgtgtgcttcgtgcgtgcgccgcgtggaaacggcgctggccaaggtgcccggcgtgcatgacgtcgcggtcaatctggccaccgagcaggccacgctgcaagcggatagccccgaagtgctgaacgcggctgccaaggccgtggccgatgccggctacgacgtgccgcgcgccgagatcgaactcaatatcgccgatatgacctgcgcgtcatgcgtgggccgtgtcgagcgtgcgttgcgcgccgtgccgggcgtggtggacgcgcaggtgaacctggccactgagcgtgccacggtcaccgtgctgcgcggcgcggccgatgtggcgacgctggccgccgccgtggagcgtgccgggtacggcgccacgccggtggtcgaagccgctgccgcagcggtgggtacggccgaggccggtcccggtttctgggccggcccgtggccggtggtgatctcggcagcgctgtcgttgccgctggtgatgccgatggtgttcgaatggttcggcattcacgcgatgctgccgggctgggtgcaatgggcgctggccacgccggtgcagttcgtgttcggctggcgcttctacaaggcgggctggaaggcggtgcgcgccggtgccggcaatatggacctgctggtcgcgctcggcacctcggcggcgtactttctgtcgatctggcagatggccgaggctggcgatgccatgccacatctctatttcgaaagcgcggccgtggtgatcacgctggtgcggctgggcaaatggctcgagacacgggccaagcgccagacggccgacgcgatccgcgcgctggctgccttgcgccccgataccgcacaggtacgccgcaacggcgtggagcagaccgtgccgctggccagcgtgcgtgttggcgatgagatcgtggtgcgtcccggcgagcggattccggtagacgccgatgtcgtggaaggcagcagccatgccgacgaatcgatgctgaccggggaatcggtacccgtgcccaagcagcccggcgacaggttgaccggtggctccatcaactacgacgggttgctggtggcacgcacggcggccgtcggcgccgagaccgtactggcgaagatcatccgcatggtcgaacatgcccaggccgcgaaggcgccgattcagcgcatggttgaccaggtcagcgcggtattcgtaccaatcgtactggtgatcgcgctggcgacgctgcttggctggggcttggtcgtgggcgactggaccaccgcattgctcaacgccgtggcggtgctcgtgatcgcctgcccgtgcgcgctgggtctggccacgccgaccgcgatcatggcgggcactggcgcgggcgcccgcgcgggcatcctgatcaaggacgcggaggcgctcgaggtggcgcatcgcgtatcggtagtggctttcgacaagaccgggacgctgaccgtgggcaagcccgaggtggtggcgttgcatgccgccgatggcgacgagcccgcattgctggcgaagctggccgcactccaggccggcagcgagcatccgctggcacgcgcggtgacgacgcttgccacggaacgtggcatcaccgtgccagcggtcactgacgtgcgcgcgctgccaggacgcggtatcgctggcatcgttgcatggcaggcgctgcaactcggcagcgatggcctgcgtgcctcgttgcaggccgatgcgggggcgctgcagaccgaagccgagcggctgcgtggcgaaggccgcaccgtctcctggctgatcgatacagaccagcgccgcgtgctggggctggtggcattcggcgacgcgctcaagccgggcgccgctgccgcgatcgcacgcctgcgtgaggccggcatccgcacggtgatgctgacgggcgacaacgcaggcgccgcggcgcgtgtgggcaagcaactggggctcgacgaagtacaggccgaggtgatgccggaagacaaggcggcgcgcgtcgtcgcactcaagcgcggtggagaggccgtggtggcgatggtgggcgacggcatcaacgatgcccccgcgctggcggcggccgatgttggcatcgccatgtccactggcacggacgtggcgatgcacgcggccggcatcacgctgatgcgtggcgacccggcgctggttgccgatgcgctggccgtgtcgcatcgcacggtgcgcaagattcgccagaacctgttctgggccttcatctacaacgtgatcggcattccgctcgcggcggccggtctgctcaatccggtcgtggcgggcgccgccatggcattttcaagtgtcagcgtggtcagcaacgcactgctgctgcgccgctggcat

SEQ ID NO: 32526 - DNA, 732 bp, Ralstonia metallidurans
ggcacggtgctgctggtacatgggctggccgagcatagcgggcgctatggccacgttgctgcagcgctttgcgcgctcggcctgcgcgtgcgggcctacgaccatcgcggccacggcgcgagtggcgggccgcgcatggtggcgcccacgccggacagctatctcgacgatctggccgaaatctacgatggtgcaatgcggcaatggaacgaattgccgatcgtgctcgggcacagcatgggcggactcattgctgcgcgctttgccaccgcgcgcgtgcggccgatccgcgcgctggtgctgtcgtcgcccgcgctggcgcttcgtctgtccaattctatgcttacgatgcatcgagtgctacttgctttgatgcctcgtattcgtgtgccgaatcccattgatgcccggctgttgtcccacgatgtcgaagtggggcgcgcatatcgcaccgatccgctggtgcaggggacgatcagcgccagcgtgctggagacattcatccggggaatgccgcaggccctggctgatgcgccgcggctggaagcgcccatgctgatgctcgtgggtggcgcggaccgcatcgtcgatccggagggcagccgcatcttcttcgagagcgcgccagaggatctgcgcgagatggtctggttcgacactggctatcacgagatattcaatgaagctgagccgttgcgcggcgaggtgtttgcggcactgaccggctggctg

SEQ ID NO: 32527 - DNA, 1587 bp, Ralstonia metallidurans
ttcgactacatcatcgtgggtgcgggttcggcgggttgtgtgctggccaaccggctgacgcaggacagcgatgtcaacgtgctgctgctcgaagcgggcggcaaggacgactatcactggattcatattccagtcggctatctctattgcatcggcaatccgcgcaccgactggctctatcgcaccgtggccgaagccggcctgaacggccgctcgctcggctatccgcgtggccgtgtgctgggcgggtcatcgtcgatcaacggcatgatctacatgcgtggccaacgcgaggactacgacgactgggcacgcatcactggcgatgacggctggcgctgggacaacgtgctgccgttcttcaaacgcagcgaggaccatcaccgtggcgcgaacgagttccacggggccggcggcgaatggcgcgtggaagcgcagcggctgcgctgggaaatcctcgagtgcttcatcgaggccgccgagcaggctggcattccccgtaccgacgatttcaatcgtggcgacaacttcggcgtgggatatttcgaggtcaaccagcgtcgcggcattcgatggaatacgtcgaaggcgttcctgcgccgtgcggcggaacggcccaacctgaccatcgtcaccggcgcgcaggtcagcgcgttgacgttcgatagcccggacggcctgcgctgcaccggcgtgcaatacctgggcggtggccagccccacgaggcgcgcgcgaagcaggaggtgatacttgctgccggcgcgattggctcgccgcagttgctggagctcgcgggcatcggccagccagaccggctgcaggcgctgggcatccgcgtgcgccacgcgctgcgcggtgtgggcgagaatctgcaggatcacctgcagttgcgttcggtggtcaaggtccagggcgtgcgcacgctcaacacgcaggcggcgcattggtggggcaagcttggcatcggcctgcaatacgccttcaaccagagcgggccgatgagcatggcgccgtcgcaactcggcgcgttcgcgcgcagcgatccggagcagcctcgcgccaatatcgaataccacgtgcagccgctgtcgctggacaagttcggcgatccattgcacagcttcaatgccttcacggcgagcgcctgcaatctgcgccccacgtcgcgcggcagcgtgcatatcgaagacaccgatttccgtcgcgcgccattgatcgcgccgaactatctgtccaccgaggaagaccgcaaggtcgccgccgattcgatccgcctgacgcggcgcatcgtgtcttcgccggcattggcgcgctacaagccgcaggagtatctgcccggcgcaacattccagaccgacgaggaactggcggaagctgctggcgcgatcggcacgacaattttccatcccgtcggcacttgccgcatgggtggcgcggacgatgccgacgccgtcgtcgacaaccgccttcgcgtgcggggcatcagtggtctgcgcgtggtcgatgcgtcggtgatgccgttgatcacgtccggcaatacgaactcgccgacgatcatgattgccgagcgcgccagcgatatgatc

SEQ ID NO: 32528 - DNA, 534 bp, Ralstonia metallidurans
atggctgaaaccgcaaccattgcccgtccctacgcggaggcgctcttccgcgtcgccagtgaagccggtgcaggcaacctgggtgcatggtccgagctggtgtcggaaatggggcaggttgccgccaatcccgacatgcaggcgctcgccaccgacccgaacatttccggcgacaagctcgaggaagtgttcctgtcggtgcttaagagcccggtcaacgacgaagctcgccgcttcgtgaagctgctggtggaaaacagccgcctgacagcgttgccggaaattgccgaacagttccatgcgctcaagaacgcccgcgagggctcgtccgacgtcgagatcaccagtgcattcccgctggacgcctcgcagacgaacgaactggtcgccgcactcgaacgcaagttcggccgcaagctgtacgcaaaggtggcggtggacccgtcgctgatcggtggcgtaagcgtcaaggtcggtgacgaagtgctcgacacctccgtgcgctcgcgtctggctgccatgcaagccgcgctg

SEQ ID NO: 32529 - DNA, 1530 bp, Ralstonia metallidurans
atgcaactgaacccctcagaaatcagcgagctgatcaagtcccgcatctcgggtcttggcgccgacgctgaagtgcgcaacaccggcacggtaatttccgtgaccgatggtatctgccgcgtgcacggcctgtctggcgtgatgcagggcgagatgctggaattcccgggtaacacctacggcctggcactgaacctcgagcgcgactcggtgggtgccgtggttctgggtgagtacgaacacatttcggaaggcgatacggtcaagtgcaccggccgcattctggaagtgccggttggcaaggaactgctgggccgcgtggtgaacacgctgggtcagccgatcgacggcaagggcccgatcaacgccaaggaaacggacgtgatcgagaaggtcgctccgggcgtgattgcgcgtcagtcggtgagccagccggtgcagaccggtctgaagtcgatcgacgcgatggtgccgattggccgtggccagcgtgagctgatcattggcgaccgccagacgggcaagaccgccgtggccgttgactcgatcatcaaccagaagggcaagggcgtcttctgcgtgtacgtggcaatcggccagaaggcttcgacgatctccaacgtggtgcgcaagctggaagagcacggcgccatggagtacacgatcgtcgtggccgcaacggcttcggactcggccgccatgcagtacctggctgcctacgccggctgcacgatgggcgaatacttccgcgaccgcggtgaagacgcgctgatcgtttatgacgatctgaccaagcaggcctgggcctaccgtcaggtgtcgctgctgctgcgccgcccgccgggccgcgaagcctaccctggcgacgtgttctacctgcactcgcgtctgctcgagcgcgctgcccgcgtgaacgaagactacgtggccaagttcacgaacggcgccgttaccggcaagaccggttcgctgaccgcgctgcccgtgatcgaaacgcaggccggtgacgtgtccgcattcgtgccgaccaacgtgatctcgattaccgacggtcagatcttcctggaaaccgacctgttcaacgccggtatccgccccgctatcaacgccggtatttcggtgtcgcgtgtgggtggtgcagcgcagaccaaggtcatcaagaagctctccggtggtatccgtaccgacctggcccagtaccgtgaactggctgcgttcgcgcagtttgcttcggacctggacgacgctacccgcaagcagctcgagcgcggccgccgcgtgaccgaactgctcaagcagccgcaataccagccgctgcaggtgtggcaactcgccgcgtcgctgtatgccgccaacaacggcttcctcgacaacgtcgacgtgaaggacattctgccgttcgagaagggcctgcacgaccacctgaagaccaagttcgccgacctcgtcaaccgcatcgaagataccaaggatctgtcgaaggaagacgaagccgccctgcgtgcagcgatcgaggatttcaggaagtcc

SEQ ID NO: 32530 - DNA, 867 bp, Ralstonia metallidurans
atggccggaacgaaagagattcgaaccaagatcaagagcgtgcaaaacacgcgcaagatcaccaaggcgatggagatggtcgccgcatccaagatgcgcaaggcgcaggaacggatgcgcaacgcccgcccctacgccgagaaagtgcggaatatcgcggcgcacctggcctctgccaaccccgagttcaagcatccgttcatggtggcacgcgacgtcaagcgtgccggcatgatcgtggtgacgaccgacaagggtctgtgcggtggcctgaacaccaacgtgctgcgcgcggtgaccaacgaactgaaggacctgcagggccagggcgtgaacgtgcaagcgaccgccatcggtaccaagggcatgcagttcctgggccgcatcggcgccaaggtggtctcgcatgtggtgcagctgggtgacaccccgcatctggaaaagctgatcggcgcgatcaaggttcagctggacgcctataccaacggcgaagtcgacgcggtgtacttggcatataccaagttcatcaacacgatgaagcaggagccgatggtcgagcaactgctgccgctggcagcggacaagctgagccagaccgaagatgaaaagcgcgcctactcgtgggattacatctacgagcccgacgcccagaccgttgtggaagagctgctcgtccgctacgtcgaagcgctggtgtaccaggccgtggccgagaacatggcgtcggagcaatccgcgcgtatggtggccatgaaggctgcatccgacaacgccaagaacgtgatcggcgaactgcaactggtctacaacaagacccgtcaggcagcgattacgaaggaactgtcggaaatcgtcagcggtgccgct

SEQ ID NO: 32531 - DNA, 1071 bp, Ralstonia metallidurans
atgaccgcattgcagaacgacaccttcctgcgggcgctgcgccggcaacccactgaatacacacccctctggctcatgcgccaggcgggtcgctacctgcccgagtacaacgccacgcgcgcgcgcgccggcagcttcctcggcctggccaagaacccggcctacgccaccgaggtgacgctgcagccgctcgaccgctacccgctcgacgccgcgatcctcttctcggacatcctcaccgtacccgatgcgatgggcctcggcctgtcgttcgcgcagggcgagggcccgcgttttgcgcatccgttgcgcacggaagccgacgtggccaagctcgcggtgccggacatggcgtcgctgcaatacgtgttcgatgcggtcagcgaaatccgcaaggcgctggtgcaggacggccgtcagcgtgtgccgctgatcggtttctcgggcagcccgtggacgctggcctgctatatggtcgaaggtggtggctcggacgacttccgcaccgtcaaggcgatgatgtacgcccggcccgacctgatgcatcgcattctcgacatcaatgctaccgccgtgtccgcgtacctcaacgcgcagatcgaagccggggcccaggccgtgatggttttcgacacctggggcggcgcgctggcggatggcatgtatcaggccttctcgctagcgtacatgcgcaaggtacttcagggcctcaagcgcgagcacgacggccagcagatcccagtgatcgtattcaccaagggcggcggcatctggctcgaggaaatcgccgggatcggcccggatgcgatcgggctcgactggaccgtgaacctggcgaaagctcgccgtcggaccgaaggccgcgtggcactgcaaggcaatatcgacccgaccgtgctgttcgcgtccgaatcggccatccgcgaacaggtacggggcgtgctcgactcttacgcatccgccggtggcagcgatggacacgtcttcaacctcggccacggcatttcgcagttcacgccgcccgagaacgtttcggtcctggttgacgaagtgcacaaccatagccgcaag

SEQ ID NO: 32532 - DNA, 3933 bp, Ralstonia metallidurans
atggccaccaccaccctcggcgtcaagctcgacgacgcatcgcgcgaacgcctgaagcgcgttgcccagtccatcgaccgcaccccgcactggctgatcaagcaggccatcttcacgtacctggaacaggtggaacgcggccatctgccccatgaagctggtgccggcgcgactgcagataccgatggcgccgatgctggcgacgcgacgcaggccgatgccgcgccgcaacctttcctcgaattcgcgcagagcgtccagcctcagtcggtactgcgcgcggccatcacgtccgcctaccgccgtccggaaaccgaatgtgtgccggtgctgctggagcaggcgcgcctgccgcaggcgcaggccgatgccgccatcaagatggcgcgagccctggcggcccggctgcgtgagcagaaagtaggcagcggacgcgaggggctggtgcaggggctgatccaggagttctcgttgtcgtcgcaggaaggcgtggcgctgatgtgcctggccgaagcgctgctgcgcatccccgacaaggccacgcgcgatgcgctgatccgcgacaagatcagcggcgccaactggcaatcacatctgggccagagcccgtcgctgttcgtcaacgctgccacctggggcctgctgctgaccggccggctggtggccacgcacaccgaagccggactgtcgaaggcgctgacgcgcatcatcggcaagggcggcgagccgttgatccgcaagggcgtggacatggcgatgcgcctgatgggcgagcagttcgtgactggcgaaacaatctccgaggcgctggccaacgcgcgcaagtacgaggaagagggcttccgttactcgtatgacatgctcggcgaagcggcgatgaccgaggccgatgcccagcgctacctggcgtcctacgagcaggcgatccacgcgatcgggcaggcttcgcgcggccgtggcatctacgaaggcccaggcatctcgatcaagctatccgcgctgcacccgcgctacagccgcgcgcagcacgagcgcgtgatcaccgaactctacggtcgcctgaagagcctgacgatgctggcccgccagtacgacatcggtatcaacatcgacgccgaggaagcggaccgcctggaaatctcgctcgacctgcttgagcggctctgcttcgagccggagctggccggttggaacggcatcggcttcgtggtgcagggctatcagaagcgctgcccgttcgtgatcgattatctgatcgacctggcgcgccgtagccggcatcgcctgatgatccgcctggtcaagggtgcgtactgggacagcgagatcaagcgcgcccaggtcgacggcctggagggctacccggtctacacgcgcaaggtctacaccgatgtgtcgtatgtggcctgcgcccgcaagctgctgtcggtgcccgacgcgatttatccacagttcgccacccacaacgcccacacgctggcagccatctaccagatcgccggccagaactattaccccggccagtacgaattccagtgcctgcatggcatgggcgagccgctgtacgaccaggtggtcggcccggtggcggatggcaaattcaaccggccgtgccggatctacgcgccggtcggcacccacgaaacgctgctggcatacctggtgcgccgcctgctcgagaacggcgccaacacctcgttcgtgaaccggatcgccgacgagacgatcgcgctcgacgatctcgtcgctgacccggtggccgtggtcgaaaccatgcacaagacagagggcgtgcttggcctgccgcatccgcgtatcccgcagccgcgcgcgctgtatggcaaatcgcgcgccaattcggccggcatcgacctgtcgaatgaacatcggttggcgtcgctgtcgtccgcactgctggccggcaccagcgagacgccgcgcgcggaaccgctgctcggcgccgcagtggcgggcacggatgccacgtccgagccggtactgaatccggcggatcgtcgcgacgtagtggggcaggtcagcgaggcaacgccggctgagaccgaagccgcgcttgtggccgccgtcaacgtggcgccgatctggcaggccacgccgcccgaagtgcgtgccgccgcgctggaacgcgccgccgatctgatggaagcccagatgcagtcgctgatgggcatcatcatgcgcgaggccggcaagacgttttcgaacgccatcgccgaagtgcgcgaggcggtcgacttcctgcgctactacgcggtgcaggtccgcgcgtcgttctcgaacgatacccatcgcccccttggtccggtggtctgcatcagcccgtggaatttcccgctggcgatcttcaccggccaggtggccgccgcgctggcagccgggaatccggtgctggccaagccggccgaacagacgccgctgatcgccgccgccgccgtgcgtctgctgcgcgacgccggtgtgcccgcagccgcggtgcaattgctgccgggccggggcgagaccgtcggcgcggcgctggtaggcgacgcccgggtcaagggcgtgatgttcaccggctcgaccgaagttgcccgcctcctgcaacgcaacgtggcgagccgtctcgatgccgcgggccgtccgattccgctgatcgccgagacgggcgggcagaacgcgatgatcgtcgattcctcggcgctggccgagcaggtggtgggcgacgtggtgacttcggccttcgattcggccggccagcgctgttcggcgctgcgcgtgctgtgcctgcaggaagacgtggccgaccgcatcctggaaatgctcaagggtgcgatgggtgagttgacgctgggcaacccggatcgcctctccactgacgttggtcctgtgatcgacgaggaagcgcgcggcaatatcctgcgccatatcgaagcgatgcgggccaagggccgtcgtgtgcaccaggccgacccgggcgcggcggacacgccggcctgccgccatggcacgttcgtgccgccgacgctgatcgaactcgattcgatcgcggagctgaagcgggaggtgttcggtccggtgttgcatgtggtgcgcttcccgcgaaccgcgctggacaagctgatcgaccagatcaatggcactgggtatggcctgacgctcggcgtccacacgcggatcgacgagacgatcgcgcacatcgtcgaccgcgcggatgtgggcaatctctatgtgaaccggaatgtcgtcggcgccgtggtgggcgtgcagccattcggtggcgaagggctgtccggcacggggccgaaggcgggagggccactctatctgcaccggctgctgtcggtctgcccgcaggatgccgtggcgcgcgccgtgcgtgcgtcggatgcgactggtggcgtggccgccgcgccggtgtcgcccgaactggccgcgctgaaggcctgggcgcaggcgtcgctgcccgaggtggccgaggcctgcgatcgcctggccgcggcatcgccgtcggggctcggtgtgacgctgccgggtcctaccggcgagcgcaacacctactcgctgctgccgcgcgagcgtgtgctttgcctcgcccagcaggagtccgatctggtgctgcaactggccgccgtgctggccgtcggcagcgaggcgttgtgcgttgacacagcgcagaccagggccctgtctgaaaggcttcccgccgcagtacaatcgcgcgtccgcatggtttccgactggacgtcgacggatacggcattcgatgccgtgctgcaccacggcgattccgaccagcttcgcacggtttgcgagcaggtggccacccgcactggtccgatcgtcggcgtgcagggccttgcgcacggtgaaccgaatatcgctctggagcgtttgttgatcgaacgttcgctgtccgtcaatacggcggccgcgggc

SEQ ID NO: 32533 - DNA, 2031 bp, Ralstonia metallidurans
ctcaattccgcgcaatccgaagccgttcgctatttcgacgggccatgcctcgtcctggcgggtgccggatcgggcaagacgcgcgtgatcacgcagaagatcgcgcacctgatcgaggacaaggggttcgagccgcgccacatcgccgccgtcacgttcaccaacaaggcggccaaggagatgcaggagcgcatcggcaagctgatggagggcaagaccacgcgcgagggcaagcggattccgctcaagcagctcacggtctgcacgttccattcgctcggcgtgcagatcctgcgcatggaagccgagcaccttggcctgaagccgcagttctcgatcatggattccgatgactgcttcggcctggtgcaggagcagcttggcaccacggacaagaagctgatccgcagcgtgcagggcacgatctcgctgtggaagaacggcatgatcgatccggagacggcgctcgcgcaggcgagcgatgccgacgagcaccaggccgcgatggtgtatcgcaattacgtggccacgctgcacgcgtaccaggcggtggacttcgacgacctgatccgcctgcccgccgaattgttcgcgcgcgacgaagccgtgcaattgaagtggcagaaccgcctgcgctacttcctcgtcgacgaataccaggacaccaacgcgtgccagtaccagttgctcaagctgctggccggtggctcgcatctgcgcgcgccggcgttcaccgcagtgggtgatgacgatcaggcgatctatggttggcgtggcgccacgctcgacaacctgcgcctgctgcagaccgattttccgagtctgaaggtggtcaagctcgaacagaactaccgttcgaccgtgcggattctggaagccgccaacgcggtgatcgccaacaacccgaagctgttcgacaagaagctgtggtcggaacacggcatgggcgatccgatcgcgatccacccgatgaacgacgaggagcacgaggcagagtcagtggtattccggctgtccgcgcacaagttcgagcggcgcgcgcagttccgtgactacgcaatcctttatcgcggcaatcaccaggcccggctgttcgaacagatcctgcgccgcgagcgcattccgtatgtgctctcgggcggtcagagcttcttcgacaaggccgagatcaaggacatctgcgcgtacctgcgcctgatcgccaaccccgacgacgatcccgcattcatccgcgcgatcaccacgccgcgtcgtggcgtgggcaacaccacgctcgaagtgctcggcacgttcgcgggccaggccaaggtatcgctgttcgaggcggccatgatgggtggcatcgaggcgaagctgcagccgcgccagcttgagccgctgcgcacgttctgcgagtcgatggtacggctggccgatcgtgcgaagacagacccggccacggtggtgctcgacgatctcatggaaggcatccactacgaggcctacctctacgacaccttcgacgaacggcaagcgcaatcgcgctggaccaacacgctcgaattcctcgactggctcaaacgcaagggcacgcgtcccgagccggaaggcgagggcgaagccaccggattcgacaccgccgatggtttcggcgacgaaggcaagaacctgctcgagcttacgcagaccgtggcgctgatgagcatgctggaaggccgcgaggaagatcccgatgcggtgcgactgtcgacgctgcacgcgtcgaaagggctcgagtatccgcacgtgttcctggtcggcgtggaggagggcatcctgcctcactcgcgcgaggacgaggaaatgggcgacgagaagatcgaggaggagcgccgcctgatgtatgtgggcatcacgcgcgcgcagcgcagtctgcagatcagctggtgcaggaagcgcaagcgcgcccgcgatacgtatgcgtgcgagccgtcgcgtttcatcgccgagatgaagctcgaggacagtcccgccccgaaggacgagactccggccatgagcccgaaggatcgt

SEQ ID NO: 32534 - DNA, 1434 bp, Ralstonia metallidurans
gagacactcatgagacgccagcgcaaagccaagatcgtggccacactgggcccggccagcacggacatcgcggtcatccgccaactgttcgatgccggggccgacgtgttccggctgaacttcagccacggcacgcacgaggaccaccgcgcgcgctacgacgccgtgcgtcaggtggaagccgagaccggccgtccgatcgcaatcctggccgacctgcagggcccgaaactgcgcatcggcacgttcgcggccggcaaggtggccgtgagcgccggcgacacgttcgtcctcgacagcgacccgacgccgggcgatgcgaagcgcgtctacctgccccaccccgagctgttcaaggccgccaacgcgggccagtcgctgctgatcgacgacggcaaggtacgcctgaacatcgaatcggtggctagcggcagcatcaccacgcgcgtggccaacaacggcacgctgtccgaccgcaagggtgtgaacgtgcccgacgcggtgatcccgatccccgcgctgaccgaaaaggatcgcaaggatctggccttcgcactggagcttggcgccgactggatcgcgctgtcgttcgtgcagcgtccgtcggacatcctcgaagcgcgcgaactgatcggcacgcgtgccggcgtgctgtcgaagatcgagaagccggccgcgttgcagcagctcgaggaaatcgtacgggtgtcggatgcagtgatggtcgcgcgtggtgacctcggcgtggaactgccgcccgagcgcgtgccgggtgtgcagaagcgcatcctgcgcatctgccgccagctgggcaaaccgatcgtgatcgccacgcagatgctcgaatcgatgatcgactcgccggtgccgacgcgcgccgaagcgtccgacgtggcgagtgcgatctatgacggcgccgatgccgtgatgctgtcggccgaatcggccaatggccgtcatccggtggccgctgtctcgatcatgaatcgcatcatcaccgaggtcgagaacgatccgctctaccgcaacatgatcgacgcccagcacgaggcaccgctctccacgcgccaggacgcgatctgcgcggcgctgcgcgaggtcacgcagatcatcggcgcgaaggccacggtgacgtacacgtcgtccggcgccaccgcgctgcgcgcggcacgtgagcggccatgcgcgccgatcgtcagcatcacgccgaacctggagatcgcgcgtcggctggccatcacctggggggtgcattcgactgtcagcccggacgtgcagagcgtcgacgaaatggtcgaggccgccgcgcgcgccgcgctggtggaaggctatgccgcaccgggcgaccagatcaccatcgcggccgggatgccatttggccagggcggcacgaccaacctgctgcgcgtggcagaggtgggtacggaagtggcc

SEQ ID NO: 32535 - DNA, 1419 bp, Ralstonia metallidurans
ttcgacgtgatcgtgatcggctccggcccgggtggatatatcgccgccatccgtgcggcccagctaggcaagacggtagcctgcatcgaggaatggaaagacgacgctggcaagccacggctcggcggtacctgcctgaacgtcggctgcattccaagcaaggcgctgctcgcctcgtccgagtacttcgagcaagcgaagcatgggctggccgaacatggtgtgcaggtcaagggcgtcacacttgatctggcgcagatgatccagcgcaaggctgcaatcgtcgacaagttcaccggtggcgtggagttcctgtttcgcaagaacaaggtcacctggatcaagggccatggcaagttcaaggggcgggccgcggatggcgtgattaccgtggaggccagcaacggcggcgagacgacgtcgcatacggcacgcaacgtcatcatcgcaacgggttcgaaggcccgccatctttcgggcgtgccggtcgacaacaaaatcgtctccgacaacgagggcgcgctgtccttcgattcggtgccgaaaaaactcgcagtgatcggcgccggggtgatcggtctcgaactcggctcggtatggcgacggctcgggtccgaagtcacgctgctggaagccctgcccacattcctcggcgcgcttgacgaagccgtggccagggaagccgccaaacagttcggcaagcaggggctcacgattcaccttggtgtcgacatcggcaatatcgaagccaccgccaagggcgtcagcatcgcctacaaggacaaggacggcgccgaacagaagctcgtcgcggaccggttgatcgtgtcgatcgggcgcgtgccgaacaccgacaatctgggtctggatgccgtgggcctggccgccgacgcgcgtggcttcatccccgtggacgaccagtgccgcaccccggtggcgggcatctacgctatcggcgatgtcgtgcgcggcccgatgctcgcccacaaggccgaggacgaaggcgtcatggccgccgaggtcatcgacggccagaagccacacatcgactacaactgcattccgtgggtgatctacaccgagcccgaaatcgcctgggtgggcaagtcagaagcccagttgaaggcggaaggccgcgagttccgttccggccagttcccaatgatggcaaacggccgcgcgcttgggatcggacatccggatggcttcatcaagatgatcgcggacgcaaagaccgacgaaatcctgggcgtgcacatcatctccgccaatgcctcggatctgatcgccgaggccgtggtcgccatggagttcaaggcggcatcggaggacatcggcatgatctgccacccgcacccatcactgtccgaggtcatgcgcgaggctgcgctggcggtgcgaaagcgggcgctcaatatg

SEQ ID NO: 32536 - DNA, 1068 bp, Ralstonia metallidurans
gcaggcatgcaagctgcggtttttcaggggcccggcaagatcgtgctgcaggaaaagccgatcccggccgtcggccccaccgacgcactgatccgcatcaccaccaccacaatctgcggcaccgatatccacattctcaaaggcgagtatccggtagagcggggcctgacgatcggtcacgaaccggtgggcatcatcgagaaactcggcagtggcgtgaccggttatcacgagggtcagcgcgtcatcgcgggcgcgatctgccccagcttctactcctacgcgtgccaggacggttgcgcctcgcaggacggacaaggccactcgcacggctacaagcccatgggcggctggcgcttcggcaatacgattgacggcacccaggccgagtacgtgctcgtgccggacgcgcaggcgaacctcgcgcccatccccgacgggctgaccgacgaacaggtattgatgtgtcccgacatcatgtcgacgggcttctccggcgcggagcacgccaatatcaagatcggcgatatcgttgccgtgttcgcgcagggtccgatcggactgtgcgcgacggctggcgcccgcctgcgtggcgcttcgctgatcatcgccgtagatgggatcgatgaccgcctgaacatctctcgccagatgggtgccgacgttacgctgaacttccgcaataccgacgtggtgcaggagatcctgcgcattacgggcggccgtggcgtcgacgcgtcgatcgaagcactcggcacgcaggccaccttcgaatcggccctgcgcgtgctcaagcccggcggcacgctgtcgagccttggcgtctattccagcgacctgaagattcccctggacgccttcgcggccggtctgggcgatcaccgcatcattacgtcgctgtgcccgggcggcaaggaacggatgcgccgactcatgaacgtgatcgaaacgcagcggatcgacctcgggccactggtcacgcaccgcttcaagctcgccgatatcgaggccgcctacgacctcttcgggcaccagcgcgacggcgtgctcaaggtagccatcacgcct

SEQ ID NO: 32537 - DNA, 749 bp, Ralstonia metallidurans
aaggtcgcactggtcacgggcgcggcgcgcggtatcggcaaggcagtcgcacaggcgatgctcgcggacggttatcaggtcgtgctggccgggcgcaccgccgaaacgttggaagccctgggccgcgcaagctacggctgcgggccagaccgcgctggccgtgcagtgcgatgtgagtgatgccgcctcggtcgacgctttgttcggcaagatccgcgaacgcttcggccggctcgatgtgctgttcaataacgcaggcatcaacgcgccgggcgtcagcatcgacgaactgtcagtcgagcagtggaaggcggtggtagacaccaacctgaccggcgccttcttgtgcgcgcgcggcgcgttcgcgctgatgaaatcgcaggacccgcgtggtggccgcatcatcaacaacgggtcgatctccgcccacgcgccacggccgaattccgtggcctacacggccaccaagcatgcgattaccgggctgaccaagagcctgtcgctcgatggcccgtccctgggacatcgcctgtggtcagatcgatattggcaacgcgggtaccgacatggccaaccgcatggcgcgtggcgtgccgcaggccaacggcgagatccgcccggagccgttgatggatgtggcccacgttgccagctcggtactgcatatggccaatctgccgctggaaaccaatgtgcagttcatgaccgtcatggcgaccaagatgccgttcgtgggacgcgggtaatgc

SEQ ID NO: 32538 - DNA, 507 bp, Ralstonia metallidurans
atgatggaacagcctcaagccacgatgtccgcggaagatgaagcgcgcatgatcgccgcgctgggccaggtgttcgatctcgcgcgcaatggcgacgccgtggcgctcgcggcgctgatcgaacgcggtatgccaccgaacctgcgtaatgagaagggcgacaccctcgtcatgctggccgcctaccatggccatgcgaacgcgctgcgcacgctgctggaagtcggcgcttcgccggacattcgcaatgcgatgggtcagacgccgatcgccggagccgcctacaagggctacaccgaaatcgtcgaaatcctgctcgagcatggtgccgacgtcgaaggtgcctcgcctgacggccgcacggcgctgatgaccgccgcaatgttccagcgcacggatatcgtcgacatactcaaggcgcatggcgccgaccccaacgcacgcgacaaccgcggcatgaccgcagccgatgcggcggctttcatggccggccggcacggtagcacc

SEQ ID NO: 32539 - DNA, 1431 bp, Ralstonia metallidurans
ctcacgaccgcatttggcgcgcccgttgtcgataaccagaacgttcagaccgccggcccgcgtggccccgccctgctccaggatgtctggttcctcgaaaagcttgcccacttcgaccgtgaagtgattccggaacgccgcatgcacgccaagggcgccggcgcttacggcacgttcacggtcacgcatgacatcaccaagtacacgcgcgcgaacctgttctcacaggttggcaagaaaaccgacctgttcctgcgcttctcgtcggtggccggcgagcgcggcgcggccgatgcggaacgcgacatccgcggctttgcgatcaagttctacaccgaggaaggcaactgggacctggtgggcaacaacaccccggttttcttcctgcgcgaccccctgaagttccccgacctgaaccacgccgtgaagcgcgacccgcgcacgggcatgcgtagcgccgaaagcaactgggacttctggaccggcctgcccgaagccctgcaccaggtcacgatcgtgatgagtgaccggggtatcccgcgcacctggcgtcatatgcacgggttcggcagccatacctacagcttcatcaacgccaacatggagcgtttctgggtgaagttccacttcgtcacccagcagggcatccagaacctgactgacgaggaagctgcggagatcacgggccaggaccgcgaatatcaccagcgcgatctgtttgaatcaatcgaacgtggcgatttcccgcgctggaagctctgcgtgcagatcatgccggaagccgaagccagcaaggttccctaccacccgttcgacctgaccaaaatctggccgaagaaggactacccgctgatcgaagtcggcgtgctggaactgaaccgcaatccggacaacttcttcgccgaagtcgaacaggcatcgttcgcgccgtcgacgatcgtccctggcgtcggtttctcgcccgacaagatgttgcagggccgtctattctcgtacggcgacgccgcgcgctatcgcgtcggcgtgaatcatcaccagattccggtgaactcgccgaaagccgcgaagtacgtcaacagctatcaccgcgacggcacgatgcgcgtcgacggcaaccggggggccgccatcggctatgagcccaatacgaagggcgagtgggccgagcaacccgacttccgcgaaccgccgctgacgctggaaggcactgccgaccactggaaccatcgcgaggacggcgactacttctcgcaggtcggcgcgttgttccgcctgatgtcgccgacgcagcagcaggcgctgttcgacaacacggcccgctcgatcaagggtgtgtcgaaacacatccagcagacccacatcaagcattgcacggcggctgaccccgcctatggtgcgggtgtcgcggctgctatcgagatgatcgaggcc

SEQ ID NO: 32540 - DNA, 1683 bp, Ralstonia metallidurans
atgacccatctaaaaatcaccggcatgacttgcgactcgtgcgcggcgcacgtcaaggaagcgctggaaaaagtgccaggcgtgcagtcggcgctggtgtcctatccgaagggcacagcgcaactcgccatcgtgccgggcacatcgccggacgcgctgactgccgccgtggccggactgggctacaaggcaacgctagccgatgcgccactggcggacaaccgcgtcggactgctcgacaaggtgcggggatggatggccgccgccgaaaagcacagtggcaacgagcccccggtgcaggtagcggtcattggcagcggtggagccgcgatggcggcggcgctgaaggccgtcgagcaaggcgcgcaggtcacgctgatcgagcgcggcaccatcggcggcacctgcgtcaatgtcggctgtgtgccgtccaagatcatgatccgcgccgcccacatcgcccatctgcgccgggaaagcccgttcgatggcggtattgcggcaactgtgcctacgattgaccgcagtaagctgctggcccagcagcaggcccgcgtcgacgaactgcggcacgccaagtacgaaggcatcctgggcggtaatccggccatcaccgttgtgcacggtgaggcgcgcttcaaggacgaccagagccttaccgtccgtttgaacgagggtggcgagcgcgtcgtgatgttcgaccgctgcctggtcgccacgggtgccagcccggcggtcccgccgattccgggcttgaaagagtcaccctactggacttccaccgaggccctggcgagcgacaccattcccgaacgccttgccgtaatcggctcgtcggtggtggcgctggagctggcgcaagcctttgcccggctgggcagcaaggtcacggtcctggcgcgcaataccttgttcttccgtgaagacccggccatcggcgaggcggtgacagccgctttccgtgccgagggcatcgaggtgctggagcacacgcaagccagccaggtcgcccatatggacggtgaattcgtgctgaccaccacgcacggtgaattgcgcgccgacaaactgctggttgccaccggtcggacaccgaacacgcgcagcctcgcgctggacgcagcgggggtcactgtcaatgcgcaaggtgccatcgtcatcgaccaaggcatgcgcacgagcaacccgaacatctacgcggccggcgactgcaccgaccagccgcagttcgtctatgtggcggcagcggccggcacccgtgccgcgatcaacatgaccggcggcgatgcggcgctcgacctgaccgcaatgccggccgtggtgttcaccgatccgcaagtggcgaccgtgggctacagcgaggcggaagcccaccacgacgggatcgagaccgacagccgcaccttgaccttggacaacgtgccgcgtgcgctcgccaacttcgacacacgcggcttcatcaagttggttatcgaggaaggcagccatcggctgatcggcgtacaggcggtcgcgccggaagcgggtgaactgatccagacggcggctctggccattcgcaaccgcatgacggtgcaggaactggccgaccagttgttcccctacctgacgatggtcgaggggttgaagctcgcggcgcagaccttcaacaaggatgtgaagcagctttcctgctgcgccggg

SEQ ID NO: 32541 - DNA, 463 bp, Chloroflexus aurantiacus
cgcgaccacgtctggcttccctatacccagatgaagacggcacgcccgccgctgccggtggcttcagccgaaggggtgaagcttcgcctcgcggacgggcgcgaactggtcgacggcatttcgagctggtgggccacggttcacggctatcgtcacccgcacatcgaggaggcgatccggcgccagcttgaaaccctgccgcacgtcatgctgggcgggctggcgcacgaacaggcctatacccttgcgcggcggcttgcaggaatgctgccgggcgacctcgatcatgtgttcttcagcgattccgggtctgtcgcagtcgaggttgcgatgaagatggcggcgcagttctggctcaaccaagggcaccggcgcgtgaagtcctgtgcttccgtggcggttaccatggagacactttgcccgatgagcgtgtgcgacctgacagggcatgcacagctgtcct

SEQ ID NO: 32542 - DNA, 885 bp, Chloroflexus aurantiacus
agcaaaaagcagcggatcggcgtgcttaccagtggcggtgacgcgccaggactcaatgccgtcatccgtgcagtcgtcaagtcggcgtccggtctgggttgggaagtgatcggtattcacgatggttttgagggtttattagggacaaagagctaccgggtacttaccaatgctgatgtacaggtattattgccgcggggtggcacaatcctgcgcacaaccaacaaggggcattttggcccacgccggagcgatgagctgtcagaggccgatccgtatgttcgtgcggtaaaggcgattgaggagatggggctgcgggccttgatcactattggtggtgaggggacgcagcggattgctcttgaactgcataaattgggtgcaccggtgatcggcgtaccgaaaacgattgataacgatcttgccggaactgatcgtacattcggtttcgatacagcgttgcaggtagcaaccgatgcgattgatcggttacacaccactgctgccagccataatcgcgtcatggtgttggaagttatgggccggcataccggttggatcgctctccacgccggtctggctggtggtgcagatgtcatcttgattccggaaattccattttcgattgagcgagtcgccgagaaggttatggcgcgtgaccagcagggtagctcgttcagcatcatcgttgtggctgaaggtgcccgccctcgtggtggtagcgagatgtatatcgccgaaggccggttgggtggaattggtcactgggttggtgaacagctcgaaaagctgaccgccaaagaggttcgggttgtcgttttgggacatttacagcgtggtggttcgccatcgccttatgatcgcctgctttcgacccgctatggt

SEQ ID NO: 32543 - DNA, 711 bp, Chloroflexus aurantiacus
atggagtacgagcacagtgcagagatcaagatgctgcgacaggcggtgcgtgagttcgttgacaaagagattcgcccgattgcacgtgccatcgatgaagaggagcgcgtgcccttcgagacgatgaagaaagcggctgagctagggtttcttggcgtacccttccccgaacggtacggtgggcttgagctgggcattaccggctactgcgtgttgatggaagaactgaaccgggtctgtgccagccatgccaccatcattggtgctcattcgcaactggcggcgatgagtatctatctcggtggcaccgagcagcaaaaagagacctaccttcgtgccctgatcgaaggccggaagtggggcgcttgggcgctcaccgaacccaatgccggctcagatgcggctcacattcagacgaccgccgaacgacgtggcgatgagtgggtgatcaacggtcagaagatgtggatcaccaacggcagctttgccgatgtcatcgtggtctttgccgcaaccgacaagaacctcggtgcgcgtggtggtattactgccttcatcgtcgagaagaccatgcccggtttccgggtcgggaaggtggaagagaagatgggcttgcgcgcctcgcacacggccagcctctacttcgaggattgccgggttccggcagaaaatgtgctcggtcagtcgtatggatttccgctcctatgcgca

SEQ ID NO: 32544 - DNA, 627 bp, Chloroflexus aurantiacus
gcgctgaccggtgctcgctacgccagtgggttggtctgctacgccacagccaccaacgttgccctgttgccactggttgaagcgaacctgatcgaccgcagtcgcccgatcattgccgacgtgaaagtcggctcatcggaaggtggggccaccgttaacgaagccagtcaccaccccgaacggtctggtgcggtacgctcctttgcgccggtgggacatcgccacctcgccgaagtcgagcaagtgaccggcctgcgcaatgtgcatctctcaattactgccattgagctagtgcgtggcgcactggcaacagttcacgctttcgccagtcgcgaactgagcgagaaggaactctggcaggcctaccggacatttgcccgcgaacagccgttcattcgtatcgtcaaagagcggcagggcatttaccgctatccagaaccaaagattctggccggcaccaactacgccgacatcggcttcgcgtatgaaccggcgaccgggcggattgtgagtatctgtgctatcgacaacctgatgaagggtgctgccggcagtgccgtgcaatgtatgaacctgatgtgcggctttgcggagacgacagccttgacatttgccggtttacatccg

SEQ ID NO: 32545 - DNA, 975 bp, Chloroflexus aurantiacus
gaggccgtgattctttcgacctgcaatcgagttgaattgtacggtgtaacgaaccctggaacgacggcccaacacgttgtcgattttctggccgcttttcaccgtcgtccagccgcgagctttgtccacacgctctatttttaccagggtgaagccgttgcccgtcatttgtgtgcaactgccgccgggttacgttcgctggttttgggagaggcccaaattcagggtcaggtgcgcaatgcctacgaagcggcgcaacggatcggcagtgtcggttcgatcttgcaccgtctgtttcagattgccctggtcgccgggaaacgggtgcgccacgaaacgactatcgggaaaggggcggcgagtgtttcgcaggccggtgttgagcttgcccgtcgtcggctcggtgatctacggggccgtgaggtgttgttgatcggcggcggtgaggtgagcgagcttgccgcccagaatctgatcgccaacggtgctgatcgattgacgattgtcaatcgcacgtcggcgcgtgctgccgccctggccgaacgctacggtgctgagatgcttgatttcggtgctctaccccaggcgttggcccgcgccgacattgtcattagctcgaccgcagcaccggtaccgattatttaccgccatcacgtggccgaggcgattgcccataaacagcgggctcgcgcctgtggtgagtgcgatccgccgacgatgttgttgatcgatctggccgtgccccgcgacattgcggctgatgtcgcccagattcccggtgtacacctcttcacggttgatgatctgcgtgaggttgtgagtcatacgattgagttgcggagcgcagtcctggagattggccaacagattgttgaagagcaggtgcaggagtttctgtcctggatgcgtacccaggagggcctgccggtactgacaatgttgcgccagcgggctgaggaagtacggaatgaggaa

SEQ ID NO: 32546 - DNA, 392 bp, Chloroflexus aurantiacus
tttgctcgcctgtacaccttcgccgctgcccatcgtctgcatgcaccagccttgagtgatgaggagaatctggctatttatggcaaatgcaataatcctaatggtcacggtcacaactatacgctagaggttacggtacagggccgattgatccggcaaccggtatgctggtcgatctggagtggcttgaccgcacggtacactcggtcatcgaccgattgcatctgcgccacctggatcgtgagattccggcttttgccgaccgcccatcgaccgctgagaatatcatcgtttacctctggaatgaacttgcgccgctccttgaaggtcgcctggcgctcttgcgcttgtgggagacccgcaagaacatctttagctatgccggtccgtcg

SEQ ID NO: 32547 - DNA, 578 bp, Chloroflexus aurantiacus
ttacaaggtcaggttgctattgttaccggtggtgcacgcggaattgggcgtgccacgacaatcgagctggctaacgctggcgcacgtgtagtgatcaactaccagcgtagtgccggtgcggctgaatctctggccgcagaaattactgctgccggtggtgaagctctaccgtatcaggctgatgttgccgacgaacaggcggtcaccagaatgatacaggcggctctgtcacgctggggacggatcgatattctggtgaataacgctggtattaccgccgatgcgccaatggcacggctacgccctgagcagtggcaacaggtgatcgagactgacctgacctcagtgtttctgtgttgccgtgcggtagtgccgatcatgcggagcaccggttatggtcggattgtttcggtcagttcgctggcggcactggccggtaatgttggtcaaacgaactacgccgcagcaaaggccggtattattggtctgagccgatcactggcgcgtgaagtggctcgtgatgtatcacggtcaatgttgttgcgccgggttatatcgagaccgatatggatgagacg

SEQ ID NO: 32548 - DNA, 687 bp, Chloroflexus aurantiacus
atgattgatttcaacggacaggtagcaatcgtcaccggcggttcgggcggtatcggacaggcagtggtagagggtctggcccgttatggtgcccgagtgctggtaggttatcaccacaatgaagcagccgcgactgatgtggtagcggccgtccagtcctctggtcgtgaagccgcagcgctggcaatcgatgtgcgcgagccggatagtggcaatgtgctggtagccacagcaatagagcgctggggaaaactcgacatactcatcaactgtgccggtattgccgattacggcccattaagcgagatgagcagtgaacggtggcggcagacgattcagacgaatctgaccggcatctaccacacctgtcgagcagcattgcgaccgatgatgcagcagcgttatggacgtattgttaatctggcggcgctctacggtacatcgggctttcccggtcaggccgattttgctgcggcggctggcgggatcatcggtttgacacgagcactggcccgtgaagctgctccatggcagataacagttaacgctgttgcgccgggtatgatcgagaccgacttgatagaagtgattcctgcagaaatccagcagtggagtgccggtatcattgcgctccgccgtttgggtaagccggaggaagttgccgcagcagtgttgtttcttgcctca

SEQ ID NO: 32549 - DNA, 1183 bp, Chloroflexus aurantiacus
atagggcatcgctttaatccacataagctgttgatcgatccttacgcccgtgctctctgcggcgaattgacctgggataaggcaaactatggctaccgcgttgatagtccatacggtgatctgaccatcggtaagcgggatagcgcaccgtatatcccacgttcggtagttatcgatcccaccttcgattggggcgatgatcgccatcccaatattcctttggccgactcggttatctacgagctgcatgtcaaaggcttcaccaggcttcacccagaagtacccgaaaatctgcgtgggacctacgccggtctggcatcgccggcagttattgactatctcaagcaattaggggtgacagcggttgaactcttgccggtccatgccttcattaccgatcagttcctggctgatcgtggtctgaccaactattgggggtatcagccgatcaactatttcagcccggagccgcgctatgccagtcagtccgatccgcaggcacaggtgaatgagttcaaggcaatggttaaggcactccacgcccgccgggattgaagtcattatcgacgtggtctacaaccataccggtgaaggtaatcacctggggccgacgctgagctttcgcgggattgacaacgtggcctattaccgcctcgttcccgatcaaccgcgttactaccttgacgacaccggtaccggcaatagccttgacctgaaccatccacgcacgcttcagttagtgctcgactcattgcgttattgggtcactgagatgcatgttgatgggttccggtttgatcttgcccgtacccttgcccgtggcccggccggttctgacctgcccagtcccttcttcacggctgttcgccaggacccggtgctctcgcgggtgaaactgatcgccgaaccgtgggatgttggttttgatggctattgggtaggtcgctttccggcaccctgggcagaatggaatggtcgttaccgcgataccgtgcgctgcttctggaagggtgatcccggtcaggccgccgattttgcctcgcgttttatgggatcgatggatctctaccatcacaatggccgtcgtccatatcattccatcaatttcgtgacggcgcacgatggcttcaccttgcgcgatctggtgtcgtacaacgaaaagcataatgaagccaacggtgaa

SEQ ID NO: 32550 - DNA, 1220 bp, Chloroflexus aurantiacus
gagaatccggtctttcgtatgcgggtgttgcataccaatgaccatcacgcccgcattgaaccggtattcagtgggaataacccggttcacggtggtgtttcgcgacgcaaagcactgattgacaagattcgacgggaaacggcattaccaaccttgctggttgatgccggtgacgtttttcagggaacactgtacttcaatcagtataacgggatggccgatctcgaattctacaatgcgatgggatacgaggcgatggccatcggcaaccacgagtttgataaagggccgcaggcactggtagatttcatcacccgggccaaatttccggtattgagcgccaatatcagcgttgccgccggtaatccgctggccggtctgatcaagccacgtaccattatcgaaaaagatggcaggaagattggtatcttcagtctgactccggaagatactggggtgctctcgaatgccgggccgggtattagttttacttcggcgattgaagccgcccggcaacaggtggctgccttgaaagccgaaggggtgtttaccattattgccctgacccacgttggaattaacgttgatcgccagattgctcgtgaagtcggggggatgagcctgattatcggcggtcactcccataccccaatggcgccaatgaacaacgtcaagacgccgccgtaccccgaactgattgccggtcccgatgggaagccggtggttgtggtgaccgattgggagtgggggcgctggttgggtgatattacggttgccttcaacgcttccggtaccgtgatcgatctacagggtaacccgaccgaaatcgtaccatcactcaccgccgatcaaggcttcgagaaccggatcgccgtcttccgtggcccaatcgatcagttgcgggcacgtgtggttggttctaccgcggttgagcttgatggtagtcggacaaatgttcgctctcgtgaaaccaacctggggaatctgatcgccgatgcgatgctggctaaagtgcgcaattcgggggcaacgattgcgattatgaatggtggtggtattcgaacctcgatcccggctggaccgattacggttggtcaaatcctggaagtgttgacaatacggtaacaacctgacgctggtcacctgaccggtgcgcaggtgatagaggcgtgaataatggtgtgagcaggggacatggtgcggtcatcccgcagctgcgg

SEQ ID NO: 32551 - DNA, 969 bp, Chloroflexus aurantiacus
gcagcagtgatcggctggggtatggccgttccacaacggctgatcacaaatgacgaattggcgcaacggattgatacatctgacgaatggatacgcacacgcaccggtatccgtgaacgacgtgttgccgggcctggtgaaagtacttcgacactggccactgctgccgggcgtgaagcgctgaccatggccggtgtttcgcctgcgactatcgatacggtgattgtcgccacctgcacgcctgatcgaccatttccggctactgcctgcaccgtacaggcaaatttgcaaattccgcgcgcaacagcgtttgatttagcagcagcctgtagtggctttgtctacgggttgactgtcgctaccagtttgattaaaagtggtgtaagtcggcggttgttgctgatcggagccgatatctttacccactacattaactggaatgatcgtaatacctgtgttctgtttggtgatggtgcaggcgctgtggtgctcgaagcaaccgatgaaccgctcggtttactggcttcgacgctgagtgcaaatggtgaactcgaggatttgatggcggtggatgccggtggtacacgtatgccgcttactgccgatcttcttgaggcgggtcgtcagtatgtgtatatgaacggacgggagatttttaagcatgccgtccgcgagatgagtgattcggcgttacaggtgatccaggatgccggtttgactgttgatgacattgcgttggtcatccctcatcaggcgaatgtgcggattattgatgctgtcgctcgtcgtctcgagattccaccagagcgggtgatggttaatcttgaccgatacgggaatacatcagcagcttcgatcccaatcgcgctctatgaagcggcccaacaggagcgaatcaaggctggtgataatgttttgttaactgcctttggtggtggcctgacgtggggatcgggcctggtacgctgg

SEQ ID NO: 32552 - DNA, 822 bp, Chloroflexus aurantiacus
atgggagttcgtatctacaaaccaacctcggccggtcgccgcaatatgtcggtttcgaccttcgaggagattacaaagaaagaaccagagccacgcttaatcgaaccgttgcgcaagaaagctggccgtaataaccagggccggattaccgtgcgccatcgcggtggtggccataagcgcttctatcgcattatcgattttaagcgcaacaagtttggcgtgcccgcgaaggtacaggctatcgagtacgatccgaatcgtaccgctcgcatcgcgctgctggcgtatgccgacggcgaaaagcgctacatcatcgcgccacttggtctgaaagtcggcgacacggtgatgagcggccctgatgcggaaattcgggtcggcaatgcattaccgctgagcgccatcccgctcggtacccagatccacaatatcgagcttgaaatcgggcgtggtggtgtgttggttcgttcggcaggtactgcggcccaattgatggctaaagaaggtgattatgccatcgtgcgcatgccctctggtgagatgcgcatgatccacctgcgctgtatggcaactatcggccaggttggtaatgttgatcaccagaacattcgtctcggcaaggctggtcgttcacgctggctgggccgtcgtccgcgcgtgcgcggtgctgctatgaacccccgcgaccatccccacggtggtggtgagggccgggcacctcgcggtatgagcacgccaaagacgaagtggggtaagccggcacgtggcgtcaagacgcgtcacaatccgcgcttcgaccgtttcattgttcgccggcgcaag

SEQ ID NO: 32553 - DNA, 717 bp, Chloroflexus aurantiacus
aaagtagccctgattaccggtgctggtcaggggattggacgggcaaccgccctgttgtttggtcagcacggcgccaaagttgccgttgccgatattaatgaggaagcagcccaggcaacagctcaggcgattgtggatgctggcggtgaagccaaagcgtttttcatgaacgtaggccaggccgcctcggtggaagctgcggtaaaagcagttgttgaatgggcgggtagaattgacgtattggtgaacaatgccggcattacacgcgatgcccggatgatcaagatgactgaagagcaatttgatgccgtgatcaatgtcaatctgaaaggcgtctggctctgcaccaaatatgtggctccaatcatgatcgagcagggcggcggctctattattaatgcagcttctatcgtggcgtttgaaggtaatttcggtcagaccaattatgtcgctaccaaagctggcgtgattggaatgaccaagacctgggcccgcgaatttgggccaagtggcatccgcgtcaatgccgttgccactggcttcacccaaactgagatgattgctcacgtgccggaaaaggtgcttgaggagttcaaaggccgtacaccgctacgccggttaggtactgccgaggatatggcctacgcctatcttttccttgcatctgatgaggcgagctttatcaccggtgaggtgttaccggttgatggaggtctg

SEQ ID NO: 32554 - DNA, 785 bp, Chloroflexus aurantiacus
atgatcgtggtgaagattggtggtagtgccggtaacgattacgatgcgctttgcgatgatattgccgaacgctggcgtgccggtgaacggctcattctcgttcacggcggttcagatcagaccaaccgtttgggtgaggcgcttggccatccgccgcggttcgtcacctcgccgagcggacataccagtcgctataccgaccgccgcacactcgaaatctttatgatggcgactgccggcctgatcaacaagcaactggttgaacgcctgcacatgcgcggtgtgatggcacttggtctcagcgggcttgatggccgtctcttgtccgggaagcgcaaagcgacgatcagagtcattgaacagggacggcagatgatcctgcgcgacgattggactggtaccatcgagcaggtcaatcgtgatctgttgcacatgctgctcgctgccggttacctgccggttgtggccccgctggcctgttcggaggccggcgaagcggtgaacgtcgatggtgatcgtgccgcagcggccattgcgacagctattggtgcgcagacgctcatcctgctctcgaacgtaccgggcctgctgcgcaatttcccagacgagtcatcactgattacccatatcccccgcaatgatctcgaatcatccatgacatatgctgccggtcggatgaagaaaaaattgctcggtgcgcaggaggcctggccggtggggtgcagcgcgtgatccttgccgatgcccggattccggcgtgtgtgagtcaggcattgaatggtgcg

SEQ ID NO: 32555 - DNA, 1044 bp, Chloroflexus aurantiacus
aacctgcacgttcgcgaattaacccctctccaaccaccgcgagcgttgaaaaacgaattaccgatcacaccggcggcagcgcatacggtcgctgaaacccgtgctgctattcgacgcattttacgcggtgaagaccagcgccgcatcatggtcgttggcccgtgctcgatccacgatcccgaagcagcccttgaatatgcccgccgtttgcaggcattgcaaaagccattgggcgatcagttggttatcgtaatgcgggcctacctcgaaaaaccacgaacgacagtaggctggcgcggcctgattaacgacccacacctcgatggttcctttgatatggctgccggtctccgcattgcccgacaattgctgctggcgatcaatgagctaggggtaccggttgcgaccgagatgctcgatccgatcagcccacagtacctcgacgatcagatcagcctggcaactatcggtgcccgcacgagtgaagcgcagactcatcgggcgctagccagcggtgtctcgatgccggtcgggttcaaaaatggcaccgacggcgggattcaggttgccgtcaatgcctgcgtttccgccgcagtaccgcacagctttctgggcatcgatgaagacgggcgcagtgccgtcgtgcgcacaaccggcaaccccgatagctttgtcatcttgcgcggtgggcggcatgggccgaactatcacctggagtatatcgtccagaccacccgcctgatgcgtgaagccgaacgacagcccgcagtgatgattgactgtagtcatgccaactccggcagtgattttcgccggcaggaggccgtctggcaaacggtgcttgggtatatggtagaggaaccattgccgatcatcggcatgatgctggagagcaatctctttgagggcaagcaaccgctggttgccgaccggagtatgctccgctacggcgtctcgctcaccgatggctgtgtgggttgggacaccaccgaacgactcttgcacgaagcacatctggccctctcgcgcaggtagatgcaagcg

SEQ ID NO: 32556 - DNA, 1178 bp, Chloroflexus aurantiacus
atggcaccacgggttctgatagttggcgcatcggtaggcggagcgaccgcagccatcacgctgcggtcgttcggtatcgagaccatcatgctagaaaaggagttgagtaaggctaagccgtgtggtggcgcagtaccgccagccgcctttcgtgaattcgatctcccgaccagcctgattgatcgcaaggtaaagcagtgtctgatcgtgtcgccgtcgggccaggagacgcgcgtaccggtagccggcacgatccccagtgacgatgattacgtcgccatggtgcggcgcgaggtctttgatagctttttgcgtcagcgtgcccaagagcgtggtgccgatctgatccacgcccagttgaccggtttgcgggttgaccggcgtggggttgtcgccacctaccgcacgccatccggccatgaaggttcggtctgggccgatgtggtcatcggcgccgatggtgcctattcgccaacggcgaagtttctcggcttaccccatctcccccgcgcagtggccattcaagagcgcattaagctctccccagacaagatggcgcgctgggaggagacggctgacctgtacctcggctatgaagtcagtcccgatctgtacgcctgggcctttcccaagcgtgaccatatcgccgtaggtatcggtgccggacctcgccatagtaccgcagcaaaacagttgttgacgaacctcaagcggcggcttggtgatgccctggctggtggacagacgatcctgcgcgaggcgcacgcactgccgatggaacctcgaccacatatggcgtttgaccgtgcgatgctgatcggggatgccgccgggttggtcgtacatacctctggcgaaggtatctattgggcaatgaagagtggccagatggcagcccaaacactggccgagtatctcgatgctcccagtgcggcaaacctgcgccactacgaacggcgctggtggaaacagtacggcacaatgtaccgcttcttgcgctttttgcagatgtggggctacggtaacgagcggcagatggaggtatttactgaaatgtgccgtaattacgatgtgcaacgcttaaccttcgacagctatatgcacaaacagatggcccccgcgcctggctggcccagttgcggatgactgccgagattattgccagtgagttgcaatat

SEQ ID NO: 32557 - DNA, 1677 bp, Chloroflexus aurantiacus
catctggccgaactcgccgacgcgggtgtcacccatgttcacctcttgccggtatttgacattgccactatcgaagagattcgtgagcagcaggtgcccttaccctacgaccagcttcgggcactcccacccgattcacctgaacaacaggcattgatcgagccaatccgtgatcttgatggttttaactgggggtacgatcccttccactactcagtaccggagggaagttacagcaccaatcctgatgggccacagcgcacgcttgagtttcgcgagatggtgcaggcgctgaatgaaactggcctgcgcgtcgtgatggatgttgtctacaaccacaccaacgccagtggtcagaatcctcgctcagtccttgatcgtatcgtgcccggctactatcaccgactcgacggtgacggcaatgtcacgacttccacctgttgtgcgaacacggcgaccgagcatcgcatgatggagaagttgatgatcgactcggtggtgctgtgggcgaagtattacaaagttgatggcttccgcttcgatctgatgggccatcacatgaaggacaacatgctggcggtgcgcgcagcactcgatgcgctgaccttagagcgcgatggggttgatggcaaatcaatcatcatctacggcgaaggttggaattttggtgaagtcgccaataatgcccgtggtattaacgctacccaattcaacatggccggtaccggtatcggtaccttctcagaccgcctccgcgacgcagcccgtggcggtggtcccttcgacgatccacggctccaggggttcatttccggtctggctaccgatccgagtgatttcccgcaagggacaccggatgcgcagcgggtcaaactgctggctgagaccgatttgatcaaacttggcctggccggtaacctgaagacctaccggatgatcaattacgaaggtcgtctcgtacccggtgagcagatcaagtaccgtggcgcagccggcggctacacgcttgatccgcaagagcagattgtctacgtttcagcccacgacaacgaaacgctgtttgatgcggtacaactcaaggccgcagccggtacacctatcgccgagcgagcacgaatggcccaactcggtctctcactgactgcgctggcgcagggtattcccttcttccacgccggtgatgaactgctgcgctcgaaatcgctcgaccgcaacagctacaactcatcggactggttcaaccggattgactggcgtggtcaggagaatacttttggctccggtctgcccccggcctgggacaaccagagcaactggccgatcatggcgccattgctggccaacccggcactcaaaccggacgccagcctgatgcaggcgacgtatgaacacttccgcgagatgctccgcatccggcgcagtacacctctcttccgtctgcgcacggctgccgaggtcgagcgcatggtttcgttcttcaataacgggcctgatcagattcccggtctaatcgtcatgagcatcagtgataatggcccaagccgactcgatccgaacatcgggcaggtggtggtcttgttcaatgcccggtctgagacagtgacgattaccatccccgaactggcaaatggcgatctgcctttaacgacgtcaggttgcgtgagcgatgagcgggtc

SEQ ID NO: 32558 - DNA, 921 bp, Chloroflexus aurantiacus
caggacaaatctgttgtagtgacgggtggtgccggctttctcggttcgtatgtagtcgaaaagctacatgagcgtggtgcgcggcggatcgttgttccacgttcgcaccagtacgatctgcgccagcttgaggctattcgccagcttctagccgatgcgcaacccgatattgtcatccatatggcggcccgggttggcggtatcggtgccaatcgcgatcatccggcagagttcttctacgataacctgatgatgggcgtacagcttttgcacgagagctggcggtttggcgtacagaagttcgtgacgattggtacggtttgtgcatatcccaaatatacgccggtgccgtttaaggaagacgacctctggaacggctacccggaagagacgaacgcgccatacggtctggcgaaaaagatgctgctcgtgcagggtgaggcgtaccgccagcagtacggtttcaattcgatctttctattgccggtcaatctctacggcccacgcgataatttcgatttagaaacgtcgcacgtgattcctgccctgatccgcaaatgtattgaagccaccgaacgcggtgacgatgagattgtggtttggggtgacggttcaccaacccgcgagttcatttatgccgctgatgctgctgaaggtatcttgctggcgagtgagcgttacaacgatccggcaccggtgaacattggcagtagttacgaaattagcattcgcgatctggtcaccttgatcgccgatctgaccggctttcgcgggcggattgtctgggatacgacgaagcccaatggtcaaccgcgtcgtaagctcgatgtgagccgggcgtgggagcggtttggcttccgggccgaaacgacgtttgccgatggtctgcgggcaacgattgcatggtatcgcagccagcgt

SEQ ID NO: 32559 - DNA, 1320 bp, Chloroflexus aurantiacus
cgtcacggcccggcgatggcgatcacctttctgtctgcggctactgcggcgacggctgcaccacttaatcccaaatatcggcgggacgaatttgccttctactatgaagacacccaggcccgcgcattaattgttgcccctggcgagggcgacgaagcccgggctgcattgcgttcagacatgctgctgatcgaagccgccttcgacagcaaccatcagcttaccttctcgacatctggtaccgccggatcaccacgccgcgatggcctggccacacccgacgacatcgccatgatcttgcacaccagtggcaccaccagccggcctaagcgggtacctattcgccatcgtaatctggccgcctcgaccagcaacatcatcactacctatcaattgagcgcggcggatcgttcgctctgcgtgatgccgctcttccacattcacggcattgttgcctcgttgctaagccagttagccgccggtggagctgttatctgtccaccaggttttgatggtctcaaattctggagctgggtcgaacaagagcgtccaacctggtactcggccgtcccgacgatgcaccaggtcctcctggcccgagccgggcgcaacactgctataatcaaagctaacccattccgcttcatccgctcctcaagtgcacctctacctccggttgtgatggagcaaatggaagaggtcttcgcggcgccggtgattgaaagctacggcatgacggaggcttcacatcagatgacctcgaatccgttaccacccggtcggcgaaaacccggctcggtggggattggattcggggtagaagtgggtatcatggacgaacacggccagttgttgccggcaggtgtgaagggcgaggtcgtagtgcgcgggccgaatgtcgttgatgggtacgaaaataatcctgaagccaatgccacagcatttgtgaatggatggtttcggaccggtgaccaggggtatctcgacgaagatggctatctctgtctgaccggtcgtatcaaagagttaatcaaccgcgggggcgaaaagatttcgcccctggagattgatgacgtactgctccgtcatccggcagtcgccgaagccctggcctttgccgtgccacatccaacgctgggtgaagaggtgcatgccgccgttgtattacgcgaaggcatgagtgctgacgagcgtgaattacgcgagcactgtgcccgcctgctggccgatttcaaagtgcctcgtgcaatccatattctgagcgcactaccacgcggtgccaccggaaaactacaacggatcacgatggcgaaaacactg

SEQ ID NO: 32560 - DNA, 1050 bp, Chloroflexus aurantiacus
catccttacgcgctgagcggcccgactatgatcgagcagggaattgcccggctgcgggcaatctgcgaggctgctggctatccgcttgccggcaatctcaaccgtaacgtctttctccccaccgcactgggagcattgcgccctaccgcctttgccccggcaacgatgatcgccggcgacgcccgccagttgcgtgatggacggcctaccctgatcgccagcttcggcgaactgcgtgacttcttcccgcccctgatcgcggccaacctgcgtgcgcagggcattcatgctgaagcagcgcagcttacccttcctccaaccggtcgtcagcgtgactttaacccggtgacgctggcgcgcctgttcgatcagcccgcttttcgggccagtgtcggcgaccagctcgcaggtctggtgcgcaagggagggtatgcacgcattgggatgccggctattctcggtttgaaacatgcgaccgaggtagtacgtgatttgcagaatcggtctggcgcactgatctttgaaattcctacgcttcccacctctgtggccgggatgcggctctatcatatgctggaagacgaattgatccgcctgggcggcagggtgcagttaggcggttttgtccaacgcggtgagcatattcagcagacactggttgctgttttcagtgaggcagctgctcgtgagcaacggcacactgcccgccgttgggtactggctaccggtggcatcctcggtggtggggtgcgggcaacaccggaaggtcagctccgggaaactgcgcttgaccttcccctccagactcccgccgggagagcgggctggtttgcgccccgtttccttgctgaagacggtcatcctgtcttccagagcggagtgcgcgttgatcgtgatctgcgccccctcgacgccggtggtcaactggtctacgacaatgtgatggttgccggcagtgcacttgccggttttgacccgattcgggaaggatgccttgagggtgtcgctattgccaccggctggaaagccgggcagcagtagtcggccaag

SEQ ID NO: 32561 - DNA, 864 bp, Chloroflexus aurantiacus
aaggattattatcaggtattgggggtaagccgtaccgccagcgacgaagagataaagcaggcataccgacggctggctcgaaagtaccaccctgacgttaatccaggtgatccgaaagctgaagcacgcttcaaagagattaacgaagcctatcaggtgctatccgacaaagagcaacgtgcgaaatatgaccgctttggcagtgattttcgccgttacgaacaaaccgggtttggcggttttgattacggtagtcaggattttgctgatttatttgagacactctttgggcagcgccgcacaaccggcggtgggttcaatgtacgtctcgatgggcaagatgttgaacaaccggttgagctgacgcttgaggaagcgtataacggtacccaacgcacagttcagttttcaaaccctaacggcacaccacgcacaattaccgtaaagattcctgccggcatcgataccggcaaacgggtgcgcgtgccgggggaaggcgcgcctggtctcaatggtggtcggcgtggcgatctctacctggtcgtgaccgtcaaaccgcacgagcggtttgaacgtaagggcaatgatctgcacacgactatcccggtgagtatgtataccctgctactgggaggacaaacccagattccactgctgtcaggtaaaactctgaccctgaatattccaccgcaaacccagaacggacgggtatttcgtattgccggtcaggggatgccgctgatgcatagtcatcagcatggcgatctctacgttaccgtcagcgccgttttgccgaccaacctttcgccgcaggcacgcaagctggtggaggaattgcagcaactgacggaaggagataggaga

SEQ ID NO: 32562 - DNA, 988 bp, Chloroflexus aurantiacus
ccgaacttacggcaaaatatcgctactcgtgaatgggttatcattgccagcgaacgtgcccgtcgtccaaattcgtttaccgaacatcgtcagcaactgttgaccgccgagcgacctcagcacgatcctcaatgccccttctgtgtaggcaatgaagaactcgacctcgaagttgatcgctatccgatcaccgggccttggcaggtgcggattgttcgcaacaagtatccggcgctgcacggtgataggccgcttgtacgtcacttcgagggtgtacggcgtaacataagtggttatggttaccacgaggtattggtcgagcatccacaccacaataccacgcttggtctgatgacccatgctgaggtgcggctggtgctggcaacctatcttagccggggactggcgatgagcagtgatccccggattgagcaggtggtgatcttcaaaaaccacggtgaacgggctggggcctcgttgccacatccgcacagccagctcatggccgttccggttgtgcctgctgatgtgcgccaccggatcgaagaggcacgtcgtttcttcgacgataccggacagtgtgtcttctgtacaatgctggccgacgaactggcgcagcgggaacggatcgtctacgccaatgatgattttgtggcttttgttctctacgctgcttcgtcaccatttcatatctgggtcttgccgcgaaaacatcgtgccagcttttttcacattgccgaggcggagcttgatggtctggctgatgttgtccgtgaggtgtttcatcgcctctactatcggctcaacgatcccgattttaatctggtattgcgctcaactccggccagagaagcagagaacggctactttcactggtacctggcaattgttccccgcctttcgtatatggccggctttgagctgggcagcgggcatctttatcaaccccagcattcccgaagcctgtgctgcatttctgcgtgagtag

SEQ ID NO: 32563 - DNA, 1349 bp, Chloroflexus aurantiacus
attggagtcttaaccagtggtggcgatgcgccgggtatgaacgccgcagtacgggctgttgtacgcaccggcatcagtcgtggctgtgaagtctttgcaatctacgaaggctatcagggtctgatcgaaggtggaaaattgatccggcgcatggattggagttccgttggcggcatcatccagcgtggcggtacgatcattggtacggcgcgcagcgcggcattccgcacccgcgagggccgacgccgcgcagcagcgaatctcttggcccacgggatcgaccgcctggtcgtgatcggtggtgatggcagcctcaccggtgccgacctctttcgtcgtgaatggccggaactgctggccgaactggtcgcagctggtgagttcagcagcgagcaggccgccgcccatcccaatctcctcattgccgggattgtgggcagtatcgacaatgacttctgcggtaccgatatgaccattggtgccgacacggcgctgcatcgtatcaccgaggcgattgatgcaatcagctcgacggcggccagtcatcagcgtacctttgtcatcgaggtgatggggcggaattgtggctacctggcgctgatgggggcgattgccggtggcgcagactgggcatttatccctgaaatgcctccccaaatggatgactgggagcagcatatgtgcgatgtgctgcggatcggacgcgaacaggggcgacgcgacagcattgtggtggtagccgaaggggcgtgtgatcgcgacgggaaaccaatcacggcttcgtatgtcaagaaaattttggaagagcgtctgggtgaagataccagagtgaccatcctcggccacgtgcagcgtggtggcgctcccagcgcatttgatcgctggatgagttcattattgggggcaacggcggttgaagagttactggaagccgatcccaatgccgaaccgaaactgatcgggttgcgtgagaatcgggttgtgcgtctaccactgatgacctgtgtccgcgatacccatcaggttgccgaggcgattgcccagcgcgactacgaacgtgcgctggcgatgcggggcaatagcttagtggaggcgtaccgcaccctcggcaccctcattcagtcgcagcactcagacccccgaccgattacggcgcgggcatcgcttcgcaagagctgcaacagtggcggcccggcacccgagaatgaatacgcggtacgggcagcgggcggatcggcatgaacggggcatacaagcccggtggcgcacgggtccaggacgaccaggggactcagcacacggatggtgagcaagggtgggcccatgtgcccaagtggccatcccggtcc

SEQ ID NO: 32564 - DNA, 798 bp, Chloroflexus aurantiacus
gtaccgggattcatccatatcgagtcgccgtacccctaccgcttcgtacaatcctaacccgcacctgagcgatggggtggacgaagccaacctgctcgaagaggcgattgtacgtgaagggccggacacggatgcagccttcatcgctgaaccggtgcagggggccggtggcgtcatacccccgcaagacgactacttcaagcgcattcgcgaaatctgcgactactacgatgtgctcttgatcagcgatgaagtcatcaccgagttcgggcgtaccgggcgctggtttgggctggaacactacggaatcgagccggatattgcccagttcgcgaaggggattacatcgggctacattcccctcggtggcatcggcgtgagcgaccgcatctacaggctatccagtcggtgccacccgaacagcgctggatgcacgccttcacctattcaggccacccgaccgcctgtgccgttgccctggccaacatcgccatcatcgaacgcgagggcctggtgcagcgggccgccgaagttggcgattacatgctgcggcgactgcaagagctgtacgccctaccgcatgtcgggaacgtccgaggtaaaggtatgatggccggaattgaactggtcgcagacactgcaaccaaagcgcccttccctgccagtgccaacgtcggcgtgcgcgtccaaaaagagatgactgctcgcggcctcttcacccgtgtcgtgggggacacgatctgtctggcgccgccgctggtcaccacctacgaacagatcgatcagatcgtgcaaatc

SEQ ID NO: 32565 - DNA, 1203 bp, Chloroflexus aurantiacus
atggccaaacagaaattcgagcggacaaaaccgcacatcaacgtcggcaccatcggtcacgtagaccacggtaagacgaccctgaccgctgcgattaccaaggtgctgtcgctcaagggtgcagctcagtttatggcgtatgaccagatcgacaacgcccccgaagagcgcgcccgtggcattacgattgctattcgtcacgtcgagtatcagaccgacaagcgccactatgcgcacgtcgactgccccggtcacgccgactacatcaagaatatgattaccggcgcggcccagatggacggcgccattctggtggtgagcgctcccgatggcccgatgccgcagacccgtgagcacattctgctcgcccgccaggtgcaggtgccggccatcgtggtcttcctgaacaaggtcgatatgatggacgacccggagctgctggagctggtcgagctggagctgcgcgagctgctcagcaagtacggcttcccgggtgatgagattccgattgtgcgcggcagcgcccgcaacgcgctggaaagcccgagcaaggacatcaacgccccagagtacaaatgtattctggagctgatgaatgcggtggacgagtacattccgacgccgcagcgggcagtggatcagccgttcctgatgccgattgaggacgtgttcgggatcaaggggcgcggtacggtggtgacgggccggatcgagcgcgggaaggtgaaggtcggtgacacggttgagatcgtgggcatgaccaacgacgcgccgcggcgaacggtggtgaccggcgtggagatgttccagaagacgctggacgaagggattgctggtgacaacgtcggctgtctgctgcgtggcattgagcgcaccgatgtggagcgcgggcaggtgttgtgcgcaccgggcagcatcaagccgcacaagaagttcgaggcgcaggtctacgtgttgaagaaggaagagggtggccgccacacgccattcttctcggggtaccgcccgcagttctacattcgcacgaccgacgtgacgggggcgattggcctgccggcggggatggagatggtgatgccgggcgataacgtggtgatgacgattgagctgatcgtcccggtggctatcgaagagggcttgcgcttcgctatccgcgaaggtggccgcactgtcggtgctggtgtcgtaaccaagatcctggat

SEQ ID NO: 32566 - DNA, 1170 bp, Chloroflexus aurantiacus
tttaccggacccagtacggccgcagttcacgcgggtgaaccgcgtcagcgtgcatttgatgccatcaccccaccggttgttcacagtgccacctacaccttccgtgatagcgctgagttgatcgctttccagtcaggcgacctggagcgtgaagagtacggtcgctacggcaatccgactgtacgagccgttgaagcgcgattagccgctctcgaatcaccaacggcacctgccgcagcactgctttgcgcttccgggatgaatgcattaacgacggtgatgctggcacttctcccatcaggaagccacgttattctgaccgatgacggttatcggcgcacccgccagttcgtgcgtaccatgctggcccggctgggtgtgacgcatagcgttgtagctgccgccgatcctgccgcgattgcggctgctatcgagccgggacgcactcgcctgattgttacggaagcgcctaccaatccttacctgcgggtgatcgatctggctgccgtggcaagcattgcccgcgagcatcggattaagacgctcatcgatgccaccttcgctaccccctacaatatgcggccactggaatacgggatcgacctggtggtgcatagctgtagcaaatatctggcaggtcacaacgatctgctggccggtgtgatcattggtcggccacccatcatcagtgcgctgcgcgaaactcagggtatcctcggtggtatctgtgatccgcataccgcgtatctgctcggtcgtgggttgaagaccttcgccctgcgcatggagcgccacaatcacaatggtcaggcagtagccgaatttctggcccgtcatccacgggtaagccgggtgcattatccgggattacccgaacaccccgaccacgccgtcgcccgtgcccaaatgcgcggctttggcggcgttgtctcatttgaagtagtcggcgatttgcagagtgccatggctgtggtcgaccggttgcgtctgccgtacattgcaccgagctttggtggtgttgaaagcctggttgaacaaccggcacttatgagttactatgaattgagtagtgaagaacggctggcggtgggtattcgcgacaacctcatccgcctttcgtgcgggattgaggatgtgagtgacttgatcgccgatctgcaacaggctctt

SEQ ID NO: 32567 - DNA, 1230 bp, Chloroflexus aurantiacus
ctgctgaacattgtgcagcagcattttgatcaggcggctgaactgctcgaccttccggcacgtctccgcggcattttacgagtgccgcagcgcgaattgaccgtcaactttccggtgaagcgggatagtggacggatcgaggtctttcagggctttcgtgtccagcacaatctggcccgtggcccaacgaaaggcggcattcgctaccaccccaatgtcacgcttgacgagacccgcgccctggccatgttgatgacctggaagtgtgcgctggccggtttgccatacggcggtgcgaaaggtgcggtgattgttgatcccaaacagctttcagtcggtgaaatcgaacgcctgacccggcgttttgccaccgagattagtgttgtaatcggccctgagcgcgatattccggcgcccgatgtcggtaccaacccccaggtgatggcgtggattatggataccatctcgatgcaccagggccataccgtaccggcagtcgtaaccgggaagccgatcaatatcggcggctcggaagggcggcgcgaggctaccggtcgcggattaacctacgtgttgacggctgcggcccaccatctcggtctgaatatctcggatatccggctggcgatacaggggtgtggcaatgttggctcaaccgtggcccgcgaagcagtcgcgctggggatgaaggtcattgcccttagtgacagccgtggtggagtctacaatccgcacggactggatattgaggctatcctggctcacaaagcgcataccggcagtgtggttggtgccgtcaatgccgactcactgaccaacgaagaattgctggaagttgaatgcgatgtattagtgccggcagcgttgagtggtgtgatcacagcccaaaacgccggtcggatcagagcgcagatcgtcgctgaagcggccaatggccccaccaccaaagctgccgatgcgatcctgtatgatcggggatgcctggtcattccagacattctcgccaatgccggtggtgtcaccgtgagctacttcgagtgggtgcagggtttgcaagagtttttctggagcgagcgggaagtcaacacgcagttgcgccgagtgatgaccaatgcgttgcaacaggtcttgcgggtctcagccgagcgacaggtcgatctgcgcacggcatcgtatatgctggccgtgcagcgcgtggccgatgccgtcacgacccgcggtatttatccg

SEQ ID NO: 32568 - DNA, 649 bp, Chloroflexus aurantiacus
gtttcgtttgatgttcagcaaggggaagtggttgggatcatcgggcgtaatggtgccgggaagagcaccctgctgaaagtgctctcgcgcattaccgaaccaacccggggcagagccgaattgtacggtcgggatggcttctttgctcgaagttggcaccggttttcatcccgaattgaccgggcgcgagaatatttatctcaacggtgccattttgggcatgcgcaaacgcgaaattgatcgcaattttgacgcaattgtccagtttgccgaggtagagaagtttatcgatacgccggtgaagttttattcatcgggcatgtatgtgcggctggccttcgcagttgccgcgcatctcgagccggaaattctgattgtcgatgaggtactggccgtcggcgatgcgcgctttcagaaaaagtgtctcaacaagatgcaagatgtaggtcagcaggggcgtaccgtcctgtttgtctcgcacagcatgcaatccatcctgcgcatgtgtcagcgggccattctgctcaatcaggggcaggtggtggccgatggaccggcacagcaggtggttggtgtctatctggggaagggcacacattcgattgcggaacgggtctggccggatcgggcgagtgcgccgggcaaggaa

SEQ ID NO: 32569 - DNA, 1202 bp, Chloroflexus aurantiacus
ataattttgcgcatgcacgttctccaaatttcgtgggaatatcccccgcacatcgttggcggtcttggccgccacgttgccgacctggcgccggctctaactgaacacgacgtgatcgtcaccgttcttactccgcaattacgcggcggagacaccttcgagcgccacgaaaacctcactatctgtcgtgttactgtgcctcaatttgacactgacgattttcccacctttgtttcgcataccgggcggcaccttgaacaggcagcgcatgccctattccccggcgggcgtcccgatctgatacacgtccacgactggctcaccgccgaagccgggattgctctcaagcaccactggcgcatcccactgattgcaaccatccatgccactgaacggggcaggggacggggagcgctcaatggtcatcgcgcacaacagatcaacgatctggaatggcgcctgacctacgaagcctggcgtgtgattgtctgttctcactttatggcccatcagatacgcgagtacttcacgacgcctgctgacaagatcgatgtgatctctaacggtgttcacctgcccccaccgccctttgctacgcctgctgaatgggtcgccttccgccgccggttcgccgctgacaccgaagcgctggtgatctttgtcgggcgactggtctacgagaagggtgtacacattctcttagaggcgtggccgcaggtcgtagccgaaatgccggcccggctggtcattgccggtaccggcagcgcactcgatgaactgaaggcacgtgcagccactcttggcacaaccgtcgaatttctcggtgtcatcagcgacgaagaccgccaatgcgccttctacgctgtcggggtgacattgccgtcttcccttcgctgtacgaaccatttggcattgtggccctggaagcatttgccgccggctgcccagtgatcgtctcgaatactggtggcctcgcggaagttgtccagcacgagctgaacggccttgtggtgccggcaggtgatgtcggagcactcgctcatgccctgctcaacagcctgcgttctcctgccgagtctcgcctgcgagcggcccgtggcgcagccctcgcccgtgcttactatacatggagtcggattgccggcgaagtcaaagcagtgtacgatcgagtctggacggaatggaaagccggctcgtgggga

SEQ ID NO: 32570 - DNA, 444 bp, Chloroflexus aurantiacus
ctggatcggcctgtagcactggttggtttaagtggatgtggcaagtcaaccctggcccggttgctggcacgcgccctgagctggccctggtacgataccgacgcggcgattgccgccgccgccggtatgagtgtggccgatctgtttcagacctatggcgaggccgagtttcgcgtgcgcgagacagccgcgctgaccgaagcactgcgtgaagcgcaggtgattgctaccggcggtggcattgtcttgcagccggaaaaccgacgtatgctgcgcgaatatgcgacggtgatctggctggatgctgctgatgcgacgatcctgacccggctggctgccgatgccgaacaacgcccattgttgcacggcgatgccgcagcgcgactggccgaattacgtgcgcgacgtacaccgttgtatgctgaagtggctgatgtaatcatc

SEQ ID NO: 32571 - DNA, 1152 bp, Chloroflexus aurantiacus
cgcggtcaatgcgaatccacaccacatcaagagacgggagtgtattggcgtgcccaaacttttcgccaggagcaagccgtctacgctgacttcctcgatgtgaatcagaagagtcgacggatcaatctccgcacgcgctatacctttagcagcatctttccgttgctcaatctgctggccgcagttgggacagcattactggtctatctgggtggacaggcagtgtatgccggtgaactcaccaccgggagctggttcctgttcattcaaggtctgcaaagcttctggtttccgctgaccagtatcgcttcgttctggagccagtttcagctcggtctggcagccggcgagcgggtctttgccctgatcgacgctgaaccgcgagtagtgcaggttgaccggcttgatccgggacgtctccgtggcgagatcaggtttagcgaggtcgattttgcgtacaagccgggtgaaccggtattgcgccagttcaacctgcatatcaagccgggtgaacgggtagcactggtgggccacaccggttcgggcaagagtagcattgccaagctgattgctcgtttctacgaatttcaaggtggtcagattcagatcgatggctacgatattcgtcgtctcgatctgaatgcctaccgtagtcagcttgggatggtgacccaaatccccttcttgttcgacggtacggtgcgcgagaatattcgttacggacgaccagatgctgacgatgaggcggtgatggctgctgcacagcgtgtcggcaacggcgactggctgagtagcctgccagccggactggacacaccggtaggcgagcgcggcagtggcctgagtatgggccaacgacaactggttgccctggcgcgggtcttattgcaagacccggcgattctgatcctcgatgaagcgacggccagcattgacccgctcaccgaggcattgatccaggaggggcttgacgaggcaatgcgcggacgtaccgcgatcattatcgctcaccggctaagcactgtgcgagaggtggatcggatcatcgtgctccgccatggcaccattctcgaacagggcacccacgatcagttgctggctgccggcgggcattatgctgagctttacaacacctattttcgccatcagagc

SEQ ID NO: 32572 - DNA, 1005 bp, Chloroflexus aurantiacus
atggctgtgcgcgtagggatcaacggattcgggcggattggacggctcgcgctgcgggcggcgtgggcatggcccgaactcgatatcgtccatattaacgaggttggcggtgatgccgctaccgcagcgcatctcctcagctttgattcgacgcaggggcgatggtcggttgaggtgcacggtgaaggcaatcagttgctgatcgatgacaaaacggttggttacagtcagattcgcgatcccggtgctgtgccatgggcagatgccggcgttgacattgtgcttgaagcaaccggcaagttccgcactgcggagcaactggcggcctatttcagcgctggggtgaagaaggtgattgtggcggcgccggtaaagggtgaggcgctgaatgtggttatgggggtgaacgatcactggtatgagccagatcgccatcacctgctgacggccgcctcgtgtacgaccaactgtctggcaccgattgtgaaagtaatccacgaagggattggcattcgccatggcatgatcacaaccattcacagctcgactaacacccaaaccgtgcacgaccgtccacacaaagatttgcgacgggcacgagcggctagtctgtcactcatccccactacgaccggctcggcaaccgctatcggtctgatctttcctgaattgcagggtaaactcgacggacaggcggtgcgggtaccgttgctgaacgcatcgctcaccgattgcgtcttcgaggtacgtcgtccgacaactgttgccgaggtgaacggattgttacaggcagcggcagagggtgcgctgaaggggattctcgcctatgagacgcgcccgctggtgtcgattgacttcctcggcaacccacattcggcgattgtcgactcgctgtgcacgatggtcaccaacgagacgcaggtgaagatttacgcctggtacgacaatgaatggggatacgccaatcggtatgtggaattagcgcgaaaggttgccctgctctta

SEQ ID NO: 32573 - DNA, 654 bp, Chloroflexus aurantiacus
tttaaaccgcaacccgatttttactatctggcctcgttccccaagtcggggaatacctgggtgcggtttttgctggccaacctgctggccggccaggaattgggactccagggctttgggcgctacgttccagacagccatatcaaaggcgatctggtctacatggccgatccaacaaccccttttaaccagatgcgcccgcggtttgtgaagacccatctgcactaccgaccggtatttcggcgggccatctacatcgtgcgcgatggtcgtgatgcgatgacatcgtactatcactggcgcaaccggcggtcggataagccggtaagtctgcacgagatcatcgtgggtgacatctactggggacgctggtcggatcacgtgttggggtggctgaacagcggcgctgagttgctggtggtgaagtacgaagatctctacgctgatacgccctcacaggtgcgccgtatcctcaatttctgccatattcaggccaccgacgaccagatcgcggcagcggttgccgcctcgtcgttcgagcgcatgcgcgccaaggaacaggctgccaatggcgctgcaacgccattcttcgtgcgcaaaggtggatctggcgactggcgcaatttgttttcgcccgccgatgaggaactgttc

SEQ ID NO: 32574 - DNA, 1675 bp, Chloroflexus aurantiacus
ctgccattcacggcaattgttggcctggatacggcccggcaggcgctgctgttgctggcggttgatccatcactggccggggttgcgattggggccggcgccggcaccggcaaaagcgcactggtacgggcttttgcccgtatgctggccggtggtcgtgaatttgatccgaccatcccctggcagttggtcgagatgccggtcggcgtgagcgaagatcgactgctgggggggatagatattgaagcaaccctggcgacgggtgagcgtgtccatcgcagcggtctgctggcccgcgccaatggcggcatgctctatgtggatagtgtgaatctgctcgatgacagcacgatcaaccatattttgagcgcactcgatagcggtgttgtgcgggtcgaacgggagggaatttcggtcgttgaaccggcccgcttcgtgttgctggtaacttacgatccggcagaagggccacctcgtcgccacttactcgaccgcctgggattgattgtggcgccaattgggaaagcgccggtaacgaccagagctgaagtggtgcgtcgtaacttgcaacccggcaccgattacgaagatgacgaagcgctggtattggccggcatcctggctgcacgtgagctattgccttcagtcaccatcagtgatgagcaggtccagcagttgagcctgacagcgatggcactcggtattgaaggtcatcgtgccgacctgtttgcagtacgtgcagcccgcgccgccgctgcactggccggacgggaagaggtgaataacgacgatctcgaactggcagtacgattggtcatgctgccacgcgcaacccgcctccccgaaatgacgccggaagaggccgggccgccgccaccaccggaaccggcgccacctccgccatcaccagagaatagtgacgatgagcagcgcgacgatgaagaggaaaaaccaccgcagccgcctgaagacgagctgaccatcgaagagctgattctggcagcgatggagactgatgtgccgccagacattctcgaaacaccgtttaccgtgcggcgacgcggacggagcggctcacgcggcacaatttcgggtcagcgcgggcgacatatccgctcggtgccggggaaaccggctcagggacggctcgatgtcattgccacgctgcgggcagccgcgccatggcaacggattcgggcagcggaataccatccccaccgacgcggacgtatccatctgcgtgctgatgatttgcatatcaagaaatatcgctcgaaggcaggaacgctcttctgctttctggttgatgccagcggttcgatggcgctgcaccggatgcgccaggccaagggagcggttaatgcgctcttgcaacaggcctacgttcaccgcgaccaggtagcgttactggcattccgtggcgaacgcgccgacctgctaattcccccatcacaaagcgtcgagctggccaaacgcgcctcgatgtcttgccaaccggtggtggtaccccctggccgcagcctcctggtgagtacagattgagacaagacggtcacaaggcacatccggaaaaatcggataaaacgcggacgacaaagacgacagagccaccctgtgcacaacgggaaaaacagcgccgaaagaacacggggaggagtgacccgaagagagaatg

SEQ ID NO: 32575 - DNA, 1425 bp, Chloroflexus aurantiacus
ctcggcgagccggtaactcaggcggtgattactgtcccggcctactttaacgatagccagcgccaggctacgaaagatgccggcaagattgccggcctcgaggtgctgcgtattgtgaacgagccaacggccagtgcgcttgcctatggcctggataagaagggccaggatgagctggtggtcgtctacgatatgggtggcggcactttcgacgtcagtattcttgagctgagcgaaggtgtgattgaggtaaaggctaccagtggcgatacccacctcggtggggacgattttgaccagcggattattgattggctggccgatgagtttcagaaagaacacggaatcgatttgcgcagcgaccgggtagcgcttcagcgcctgaaagaagcggctgaaaaggccaagatggagcttagctcgttgatgcagaccgagatcagtctgccattcatcacggcagattccagtggcccgaaacatctgagcgctacgctgacccgctcgcgcctcgaacagctctgcgccgatctgatcgagcgcagcatggggccggttcgccaggcgttgcgtgacgccggtttgcaacccagccagatcgatgagatcattctggttggtggtcagacccggatgccggcaattcaggccgccgtccgcaatttctttggcaaagaaccgaaccgcagtgtgaacccagatgaggtagtcgccattggtgccgctatccaggctggtgtactgggtggtgaagtcaaagatattctgctgctcgatgtaaccccgctaacgctcggtattgagacttatggcggcgtcatgacgccccttatcgagcggaacacgaccattccaacccgcaagagccaggtcttttcaaccgccagcgataaccagaccagtgtagaaattcatgtcttgcagggtgaacgggctgaagcgcgctataacaagagcctcggtcgctttgagttgtcgggtatcccgccggctcctcgcggtgtgccacaaattgaagtcacgttcgatattgacgccaacgggattgtgagcgttagtgcgcgtgataaggcaaccggtaaggaacagcgaataacgattaccgcctcttccggtctctcgaaagaagagatcgagcagatggtgcgcgatgccgaactgcacgcagaagaggatcgccgacgtcgtgagctgattgcagcacgaaaccaggccgatagcattctgtacactgccgaaaagtcgttacgcgaagccggtgacaccctcgacccggccttgcggagcacggttgaagagaagatgatggccctgcgcagtgtggtcgccgatgataacgagcagatgatccgcaatcggatcgcagaactggccgttgcgctgcaacagatcacaaccacgacaacgtcgaataatgctgccggc

SEQ ID NO: 32576 - DNA, 2267 bp, Chloroflexus aurantiacus
cactaccgcccagcccgcggctgccaatgcgcagatggctttaaccgctgccgcgcaggaataccaggcaagcagtacagtcgtccaaagcaccaggcaggccgtcgaacagttacgtcaagcgcgtgcggcactcgatgaagagcgggccggctgtcgccacacgctggccgaacgcgaagcccgtctggaagcgctaacccggctggcccgttcccacgccggaacatttgccggcgtgcgcaccgcactcgaatgggctgaacgtcacggtcgccggttcaccctggtacagcaactgatccgggtaccacccgaactggagacggccatcgaagtggcgctgggtgcccgtctgcaacacattgtggttgagcagtggcgcgacgccgaagatgccatcgccgaactccgccgcaccggcgtgggccgggccacctttctcccgctcgacaccctgcgccgtccagatcacagccgtcggcctgccttctcatcccaggtcattggcgtggcctcagaactggtcacctgcgatcccgattacgctatcgtcgtcgatcaactcctcggtcgcaccctcgttgtcaccgacctggcaacggcacgcgccgaagtgcgcaatctcccccctggctggacgattgtcaccctggccggcgaccaggtgcagagcggcggtgcagtcaccggtggtgcaccaaccaaagagagcggtgccctgcgccgcgaacgtgaactgcgcgaactaccggaacaggttgccgctgcccgatcagccctggccgccattgacgaacggcgccaggcgcttgatcaggagttgcaggcaaccattacccgcctccgtaacgccgaacaggccgaacgcgaagctcaacggcggcgcgatgccgcccgcaacgcgctggaccaggcgcaacatcgctgcccgccagagcgagcaagagcagcaatggctggtgaaccaacaggaacgtctgcaacaggaactgacatcgctaaccgcccaactcacctccctgcgcgaacaacaaactgcgttgcgccacgagcgatcagttgccgaggccgaactggcagcgttgcgcgaaaagcaagaacagcaggcccaggccgatcgtgccggacaagagcggctggccaatctacgggccacgctgaccgccggcgaaagccggcagcgcatgctcgccgaattgcttgccggccacgaacgcaccctggccgatctcacgcgccaggctcacgaccttgaggcgaccctaaacgcgctccgcagcgaacggatcgagcgtgaagctggttacgccaccatgatcacccgccagcaacagctcttgagcgacctgcaaaccctgcggagtcacatcgaaccgctggaagcagagataggcgctgcggaagctgaactgtctcagcttgaagcagccgaggttcaggcaaccaacgacctgctggctgcggaagccgaacacagccggctcgtgcgcgaagcgcaacgcgccagcgaccggctcgaaacactcttcgagcgcgccgctgccgatggagttgacctgacggccccaccgccggctgaggaagggccaccgctatccgaactaccggcagccatcgaagcgttacgggcacgcatcctacgccttggcgtcgtcaatcccctcgcactggaagagtatgaagaagcggcgaaccgccatgccttcctgaccagccaggctgccgatctacgggctgccagtgccaccctgcaccagctcattgccgaactcgacgaagcaatgcacagccgcttcgagcacaccttcaatgcagtagccggcgaattcagtgccgtattccaggaactcttcggcggtggcagtgcccgcctcgaactcgtcgaaagcaccgacagcgacgaacacaacggcaagcgcactgcgccgggcgtagagatcattgcccgcccgccgggcaaacgaccacaaaacatcgccctcctctccggcggcgagcgcacactcacggcggtggcgctcctcttcgccatcctgaaagtcaaccccagccccttctgcattctcgacgaaaccgacgccgccctcgacgagagcaacatcgggcgattccgcaccatgctccagcgcctcaccgaccgtacccaattcatcgtcatcacccacaaccgtggtacgatagaagtagccgacaccctgtacggcgtaagcatgggtgacgacggagcatcacgggttgtctcgctgcgtgtcgccgaatacgtg

SEQ ID NO: 32577 - DNA, 723 bp, Chloroflexus aurantiacus
gtaatgcctggagaaggtgctatgaagctaaaggggcgcgttgcgattattactggcgcttcgagtggagtcggctatgctgctgcccgtctcttcgcccgtgagggggcgaccgttgtcgctgctgcccggcgacgtgatcgattggaacatttggtcagtatgattacatctgagggtcatcacgcctttgcaattccaacagatattaccgtttcagctcaggttcagcaactggttgacaccacggcccaaatgtttggtcgcatcgatattgtcttgaactgcgccggcaatatcgagaagatcgcgccgctcgaacagtttagtgacgccgaatggcaagatgtgatgaatacgaatctcaacggcgtcttttacctcatgcgggcagttgttccctatatgaagcgccagcgcagcggtacgattgtcaatctcggttcacgagttgggaaggttgggatggcaaatattgcaccgttctgtgcagcgaagtttgctctatcgggtctgtcacaggcgctcgctcaggagttgcgtccgtacaacgtcttcgtaacgaccgtgtattctggtatgatcaatgccgatattgcgccgctcaatcctgccgaagaactgcgcaagcgattgatgactgttgatgatgtcgcgcaggcactactgtgggtctgtaccttaccgccaagcctgcgggttgatgaactaccgattatgcca

SEQ ID NO: 32578 - DNA, 925 bp, Chloroflexus aurantiacus
gccatagagaccatctatctgacgctccgttacagtaaggttgtcgctctggatcactttgattgtcaggtgagtcaggtcagtatttgtcggtttcatcggcccctatggtgcaggatgtactaccttcctgcgcttgctggccggattgatcacgccgaccagtggtgaaagtcgcctgttggttgatcggttgacgatgcggtcagctcagcgattagtgggctatatgcccgatttttttggtgtgtacgatgatctgcgtgtatgggtattcctcgatttctttgcccgttgctacgggttacgtggggcgcgtctccgccaggtggttgacgagctgctcgatctggttgatctgagcgcctaacgagatgccttcgtgcagaccctttcgcgtggtatgcagcagcgcctctgcctggcccacgcactggtacacgatccgcctatcctgctcctcgatgagccggccagtggtctcgatccgcgagcacgggttgagttacgtgaattgttgcgaaccctgcgcgatatgggaaagacgataatgctcagttcacacattttgagtgagctggccgaggtgtgtgatgcgattggcattatcgatcatggccggatgatcatcagtgggtcgctggccgaagtacagcagcagttggtcaccggatcacgcattcgtctccgcattgtgcatgagcgtgacctgaccagtgctgtatcgttcttacaacagcaaccgctggtgcaggcgatcagcactgtcccagccgatccgcggtcgcttactatcgaactgacgcaaacggtgaacgaagagcagtgtgccggtctgctcgccggtctggtgcaggctggcgtcgcaatcagtgagttcagtgcgcgcagtgaaagcctcgaagagtttttcttacggttgacg

SEQ ID NO: 32579 - DNA, 1599 bp, Chloroflexus aurantiacus
tctgcgcctgatgcagacctcagcaggtgtggcaaaccgcacgaggaggtgtgtccgatgcacatgtatgagcttggcctggacaagaacgcagcaaattacacgcccctgaccccgctctcgtttcttaaacgaactgcgatggtctatcccaatttgccggcagttattcacggtgaacggtggtatacgtgggcacaggtctacgaacgatcacgacggcttgcttcagccctgcgtgcgctcggtgtcggcttccgcgatacggtcgctgtcgttctcagcaacacacccgaaatgtacgagtgtcatttcggtgtcccaggagctggtgctgttctcaataccatcaatgtccggcttgatgccgcaacgattgctttcatcctcgaccacggtgaagcgaaagttttgattaccgaccgcgaattttcgccggtggtgaaagcagcgttggaacagtgtaaccgaacgttgaccgtcattgatgtagacgatcctttgtacaccggccccggtgagcggttgggtagtcttgaatacgagcagtttctcgccagtggcgatcctgaatttgacttgatctatcctgccgatgagtgggaagcaattacgcttaactacacgtcaggcacaacggccaatccgaaaggtgttgtctatcaccatcgtggggcttatctcaatgccctctccaatattgtttcgtgggggatgccccatcacgccgtctacctctggacgctgccgatgttccactgcaacggctggtgttttccctggacgatagctgcgaacgcgggtaccaacatttgtctccgtaaagttgatgccgggttgatctggcaggcgattgaaacgtaccgtgtcactcattactgcggtgccccgattgttcattcgttgatcgccaataatgcccctccgcactggcgcgaaggccggggcacccataaggtcagcggtctgattgccgccgcgccaccgccggcagccgttttgcaggcaatggccgaaattggctttgatattacccatgtctatggcctgaccgaaacctacgggccggcagcggtatgtgcaaagcaacccgactggcatacgctcccgattgccgaacaggcgcatctcaacggacgccagggggtaacctaccatgcgcaagaggcgattagtgtgcttgatccggcgacgatgcagccggtgccgtgggatgggcagacgatgggtgaagtgatgtttcgcggcaatatcgttatgaagggctatctcaagaatccagccgcgaccgaagctgctttccgcgatggctggttccactctggtgatctggcggtagtacatccagatggctacatcaagatcaccgaccgtgcaaaagacatcattatctctggtggcgagaatatttcttcgattgaggtggaagatgctctctacaagcatccggcagtgatgctggctgcggtggtcgctgcgcccgatccgaagtggggcgaggtaccacatgcgtttatcgagctaagggaaggggttaccgtcaccgaggaggagttacagcagcactgtcggcgttttctggccggttacaagattccc

SEQ ID NO: 32580 - DNA, 1638 bp, Chloroflexus aurantiacus
ggtgttgctcacgcaatcaagctcaaaggcgaaccacgggttgccatgtgtttttttggtgatggcagtgcttcacaaggactggctcatgaagcgatgaattgggcgagtgtctttaaattgccgatggtgattatctgcgaaaataatcagtacgcctactcaaccccgctgagccggcagatggcaatcacagatattgcccagcgggcagccggttacgcgatgccgggggtgattgtagatggcaacgattttgccgcagtgtatcgtgcaaccaaagaagcggtcgaacgggcacgcgctggtggtgggccgacattcatcgaatgtaagacgatgcgtatgcgcggtcacgccattcacgacaatatggcctacgtgccgaaagaattgctcgccgaatgggaagctcgcgacccaattgcccgtatagaggaagtgttgcgcagccgtggtttactcgatgatgcaaagctggctgccctgttggcccggatcgaagccgagcttgatgaggcacaggcgttcgctgaagcttcaccgtatcccgatccggcaacgctgaccgatggcgtctatgcgtgaaccacgagcaggaggcaggcaatgacgtgggatcaaggtttacataaatcgacaaccgtcctgagtgacgatcaggggacacgcgagttgacctatctggaggcaatccgggccgcactgcgttacgagatgcagcgtgatccgcgtgtgctggtgatgggtgaagatattggtgtgtatggtggcgcattcaaggtaacccagggattgattgatgaattcggtgaggatcgggtgatcgacacccccatgaccgaactggccatgctctacgcagcgattggcatgtcgttcgagggcttcttgccggtggtcgaaatgcaattcgccgacttcatctcaaccggttttgatgctctggtgcagtttgcggcgaccaaccattttcgctggcgtcaaccggtgccgattacggtacgtgctcccggtggcggcggcttgcgggccggccccttccattcgcaatcgaacgaagcctggtttatccatactcccggtctgaaggtggttgccccggcgactcccgccgacgcctacggtctgctgctcagcgccattcgtgaccccaatccggtgatctactacgagacaaagtacctctaccgttcgctcaaagggatggtgccggaaggcgatgcgccagtaccaatcgggcaggcagcactgcgacgtaccggtgaggaggtgagcattattacttacggagcgatggtgcaagaagcgctaagtgcagcccagacccttgaacaggaagggcatagcgtcgaagtgcttgatctgcgtaccctcaaaccactcgacgaagatgctattctgacgacggcgcgtaaaaccggcaaggttttgattgttcacgaagcgaatcgtacttgcggcgtaggtggtgaggtggctgcaatcattgctgaacgcgcctttgagtatcttgatgggccgattatccgtctggccgcacctgatacgccggtgccgtacagtccacctctggaagatgcctaccggcccaacgcaaccaaaattctggccgcagcccgtgatctgctggcgtat

SEQ ID NO: 32581 - DNA, 1524 bp, Chloroflexus aurantiacus
  unsure (1)..(1524): unsure at all n locations
atgctcattaacggtcagtggcaggctgccgcgcagggtgaggtctttcccgtgcacaaccctgccaccgaagaggtgatcgactacgttccccgggcgacggcggcagatgccgagcaggcaatgattgcggctgaaaaggcgtttcgtgaatggcgtcgctatacggcccacgacaaggctcacatttgctgcacgaggttgcgcacaagaatnngcgcacgnncacgcgnngaagagtnnntggcaannccctccttgnnacgcnntcgaagnggntggtaagncnncgctggntnncgagaaaatcgggnaantgaaatnntggctggtnnngtgcggcnnctgttttggannctattacnngccgagnttnngcaacgnngaatanncacggggncnncgcgtgnnatcccgnntcggtcgnannaccaagccnnaactggcgaaatggtgtnntgaaagaannccatacggtgtnnggtagcggcaanttggtgccgnnntggaactatccgttgctgttgaaatgtcgtggaaagtgggcaccggcactggccgccgggaacacagtggtacttaagccgagtgaaaatgacccctctggccacattgcgcttcgccgaattatgctgtgaccatctacctcccggcgtgctcaacattattacaggttttggtgatgttggccgtgaactagtggtcagtccgcgcacacagatgatcgcctttaccggcagctttgccaccgggcgcgagattgcccggcttgcggcggagcgggtgaagaagacccatcttgagttgggcggaaaagatgcgtttatcgttgccgaagacgccgatctcgatgtggccgtaccgggggtggcctgggcagcgctgttgaatgccggtcaggtctgcaccagcaccgaacgagtttacgtccacgagtcgattgctcgccccttcaccgagcgtctggtggaatttgtccgttcactacgcctggggcctggtatggaccccgataccgatattggcccactgatcggtgaaaaataccgggcaaaggtcgaagaccacgttgaagaggcacgagcgcgcggcgcaacgattctgaccggtggccggcgtccgccacagttcagtcgcggcttcttctacgaaccaaccgtcctgaccaatgtcgatcacagcttccgcattatgcgggaagagacatttgggccaacgattccgattatgacctaccgcaccttcgacgaagccatcgagctggtcaacgattgcgattacgggttaggcgccaacctctacactaacgatccccgcaaggtcaagcagtactacgaagaggtcaaggccggcacctgctgggtcaatgatccactgaccgataacgatgccgggccgtttggcggcatgaaatttagcggtggtgcccgtgaactcggtgaagaggggctggaagagttccttgagacgaagcacgtccactgggacttcacgatggtgcgcaagccctggtggtacccttac

SEQ ID NO: 32582 - DNA, 918 bp, Chloroflexus aurantiacus
cggtgtctgaaatatggagtaactgccgattacgtattgggattaacgacggtactggccgacggctccatcgcccgctacggcgatggcctggccggtcagggtgagagcgatggattagtgcaactccttgtcggctccgaaggaaccctggccgtgattaccgaggcaaccctgcggctgatcccactgccccgcgcccgccgcacgaccatggcgatcttcgccgatctggccgcagcctgtgccacagtcgaacggatcatggcatcggggattattccagccagtctggagctgatggatgacaccactatcgccgccgtggaagcgtatctgcgcatcggcctgccggctgatgccggagcgatgttattaatgctggccgatggtgaaccggaagcggttgaacgcgacgcagcagccctggccgaactggcaaaggccggcggcgcacaacgggtagcagtggcgcgcaacgccaccgacgaagcaaacctctggcaggcacgacgagtgatcgcaccggccctggctcgcattcgccctaaccgattgggtgaagacatcagcgtaccggtgacccgcatcgccgaatgtgtcggccagatcaagcaggtaagcgccacctacggcctgcctatcgtagtctttggtcatgccggcgacggcaacctgcatccaaacatcctcttcgatgcccgcaatccgaccgaagtggcgcgattatggccgtgcgcagaagccgtcttcaaagtggcgctggccgtgggtggtacgctgtcgggagagcacggtatcggcaccctcaaacgaccattcatgacccaggcgctcggtgaggcccagcttgctgtgcaacgtcagatcaaagcccatttcgaccccaccggtcggctgaatcctggcaaagtactc

SEQ ID NO: 32583 - DNA, 1681 bp, Chloroflexus aurantiacus
atgacaaagaagtgggtctacctcttccgggaaggaaatgcgtcgatgcgcgatctccttggcgggaagggggcaggtgtcgccgagatgacacgaaccggggtgccagttccacccggttttacaatcacaaccgaagcgtgcaatgcctattacgaaaacggccagcagttccccgaaggcatgtgggaacaggtactggaaggcttgaaagatatcgaggcgcaaaccggcaaacggtttggcgatccgtccaaccctctcctggtctcggtgcggtcaggcgccaagttctcgatgccgggtatgatggatacggtactcaacctcggtctaaaccagcagactcgcgaagggctggcgcgcctcaccaataatccccggttcgccgccgatgcctaccgccgctttgtccagctcttcggcaagattgtgttgggtgttgacggtgatcgcttcgagcacgagatggacgaagcgaaaggtcacggtcaacgccaggacaccgatctaaccaccgaagagttgttggcgctggccgagaagttcaaagcgatcatcaaggaagatgttggtgtcgattttcccgaagaccccttcgagcagttgcgcgcagcgattgccgccgtgttccgctcatggaatggacggcgcgctgtcgattaccgccgcgttaacaagattcccgataatctcggcacggcagtcaatgtccaggccatggtcttcggcaatatggggaatgactcggcaaccggcgttgccttcacccgcaatcccagcaccggcgagccggaaattttcggtgaatatctggtaaatgcccagggtgaagatgtcgtcgccggtattcgcacaccacagccgatcagcaaactggcccaagagatgcctgaagtctacgagcaattccatcagattgccaagcagctcgaacggcattacaaagacatgcaggatgtcgaatttactatcgagcgtggcaagctatggatgttgcaaacccgtaccggcaaacgcaccggcgcggctgcggtgaagatcgccgttgatatggtcaacgagggcttgatcgaccgggcaactgctgttcagcgggttgatccgcatgcactcgatcaattgctccaccccatgatcgatcctgcggctcgcaaggacgcccatcctctgactgttggcctaccggcctcacccggtgctgcgtccggtaaagtggttttcgatcccgacgaagccgaggagctggccaaaaccggcgaaaaggtgatcctggtgcgcgtcgagactgcacccgaagattttcacggcatggtggccgcgcaggctatcctgaccgcccgcggcggcatgacgtcgcacgctgccgtggttgcccgtggcatgggcaaaccgtgcgttgcgggtgccggtgatttgcgcattagctacgccgaccagttaatgaccgtgaatgggacaacgatccgcaaaggcgattggattaccctcgacggcggtagtggtgaggtcttcgccggcaagatgccgacggtggaacccgaactttcgggcgattttgccaccttgatgtcgtgggccgatgaattccgcaagctcggtgtgcgggccaatgccgatattccgcgcgacgcccgtgttgcccgtcagttcggtgccgaagggatcgtctatgccgggt

SEQ ID NO: 32584 - DNA, 1465 bp, Chloroflexus aurantiacus
ttcttcatggcccgtacccgcatctactgggttaagccgggagagacaggcgtgagctttaaggattatcgcggtaatccagaggtactagaagcggctcgtcgggtggttaccctgttgaaaggtgccaaagagtttaagcagatgggtggtgaagtcacccgtggcattctgctgattggcccacctggtaccgggaagagctatctggcgcaggctatttcgaccgaggccggggtgccgtttgggtatctgagcgcgccctcgctactctcggcctggatgggcatgggcaatattaaggtgatgaatctgtaccgcaaagcccgccgtcttgcccgtgagtacggtgcctgcatcctctttattgatgaaattgatgcgattggaatggcgcgcagctcaaacctgatggggacaggagctgctggtgccgggatgaataaccgcgagaatgtggtgatgggggttggcggtatgatgggtggtggtagcagcctgctcaatgagttgctgctccagatggatccaccgccgcaagagcagacctggtggggtaagctgctgcgtctggtcggtttacgccgtggtaaggcagagatgccaccagtgcttacgatggcagccactaaccttgccgagactctcgatgccgcactgctccgtcctggtcgctttgatcgcaagatcgcggttgagccgcccgatgccgatggacgccgtgaggtgatcgagtactatctgagcaaggtgaagcatgaaccaatgcctattgaccggatggttgccgacaccattggctacaccccggttgcgatcaagtacgtgatcaatgaggcaaccattcatgcgcactttgacggtcgggctgcaatcaattattgggacttcacccaggcgcgtgaaattcacgagtggggcttgaagcagccgattcgcagtatgtcgtatgaagagcggcgccgaatcgcgtatcacgaagcaggtcacgcgctacgctgcggtgaagctgttgaagaaagagcgcctcacgaaggtgactattgtccgtcacggcaatgcccttggcttcgcggcatggaaaccggaagaagagattcacacccgtacccgcgaggagctgctggatcggatcaagatctcactggccagccgggctgcggaagaactcttcctcggtacccagatgagcggtgtaaccggtgatctacagagcgctaccggcattgcggcgatgatggtcggtgcgtatgggatggataacagcttcttctcgtacctgctctttgggatgcagggcttgtcggcacctgatgtcaaaccgcgcgtagaagcgattctgcaagagcagtaccgcatcgtgaagcagatgctcgaacagaatcgcatggcggtgattgctatcgctgaggcgctgatcctgcgtaacgagttgactgacatcgatgtgaaggagattctggca

SEQ ID NO: 32585 - DNA, 543 bp, Chloroflexus aurantiacus
gagtttgttgatggcctgcgcgtgacatcgccggcagtgatggacattatgcagatggtggtctgcggtaccatcaataagcggatcgtcacggcgctggtgaacgccggggtcaaagcgatagggctgagcggtctcgatctgggattgctgcgttgtgaaccgtaccgcccggcagggcgcgatctcggacgtgtcggggaggtaaccgcagtcgatggcgcggcattgcttcatctgctggctctgggctggatgccggtcattgccccggtcgcgctgggggctactgacggtctcagctacaacgtcaatgccgatatggttgccgaagcggtagccggtgcgctggcgggggctgaactggtcttcgtcagtaatgtccctggcgtactggttgatggtcgggtagtgccggctctcaccccggcggcggtcgaagaactgattgcaaatggtgtcatatccggcgggatgatccccaaagtacgtgcggcattagcagcactccaacgcggtgccagcagtgtgcgcatcgtcaat

SEQ ID NO: 32586 - DNA, 1272 bp, Chloroflexus aurantiacus
aaatacacgattattgtggtcggttctggactggccggagcgtcggcagccgctacgctgggtgaagccgggtacaacgtgctttgcttctgctatcaagatagtccgcgtcgcgcgcacagcattgccgctcagggtggtatcaacgcagccaagaattaccgcaacgacggcgatagcatttatcgcctcttctacgataccgtgaaaggtggcgatttccgggcacgtgagagtaatgtctaccgcctggcccaggtctccgtcaatattatcgaccagtgcgtggcccagggtgtgccgtttgcccgtgagtacggtggcttgcttgataaccgctcgttcggtggtgcccaggtggcgcgcacgttctacgcccgtggtcagaccggccagcagttgctgctcggcgcgtaccaggccctgagtcgccagatcgccgccggtaccgtgaagatgttcccccgtaccgagatgcttgatctggtggtagttgatgggcgagcgcgagggatcattacccgcgatatggtaaccggcaagatcacgcgctacgctgccgatgcggttgtgctggcgaccggtggctacggcaatgtcttctatctgagcacaaacgccaaagggtgtaacgccacagcgatctggcgcgctcatcgccggggggcgtttttcggtaatccctgctttacccagattcacccaacctgtattccggtcagtggtgaataccagagcaagctgaccctgatgtcggagtcgttacgtaacgacggccgaatttgggtaccgaagaagaagggagatacccgccgcccgcaggatattcccgaatcagagcgcgattactatctcgaagagcgctatcccagcttcggtaatctggtgccgcgtgatattgcctctcgtgctgccaagcaggtgtgtgatgaggggcgcggtgttggtcctggcggtctgggggtttatcttgacttcgccgatgcgatcaagcgcctgggccgacagaagattgccgaacgctacggtaatctcttcgatatgtacaagcagattaccggcgaagacccgtatgaaacgccgatgcggatttatcccgccgtccactatacgatgggtgggctgtgggttgattataacctccagagcacgatccccggcctgttcgtgatcggtgaggcgaacttctcggatcacggtgccaatcggttgggtgcatcggcgctgatgcagggtctggccgacggttacttcattctgccttacactatc

SEQ ID NO: 32587 - DNA, 1050 bp, Chloroflexus aurantiacus
atgaaaggtcttgtgctcagtggcggtaaaggaactcgactgcgaccgattacctacaccagtgcaaaacagcttgtgccggttgccaacaagccggtcttgtttcgggtaatcgaagcgatccgcgacgccggaattaccgacatcgggattgttattggcgataccggtgatgagattcgctcagcggtgggcaatggtcggcgctggggcgtgaaaatttcgtacatcccgcaagaagcacccctgggactggcccatgccgtgaaaatcagtcgtgactttctcggtgatgaccggtttgtgatgtttttgggcgataactgcattcagggtgggatcagtccgttaatcgagcaatttgggcggagcgattacaatgcccagattgtgttgaaaaaggtcagcgatccgcgctcgtttggtgtcgccgaactcgatgatgagggtcgggtcgtgcgtctggttgagaagccgcgtgagccgaagtcggatctggcgctggtcggtatctacatgttcgatcaccatatttttgaagcggttgaggcaatcagaccatcagcacgcggtgaacttgagattaccgacgctatccagtggctggtaagcaacggctacaacgtgtatccctacgttcacgagggctggtggatcgacaccgggaagaaggatgatatgctggaagccaatcgcctggtgctcgaagagctggaaccttcagtgcaagggtatgttgaccgcgactcgcagttgatcggcaaggtgatcatcgagccaggtgcagaaatcatcaatagcacgatccgtggcccggcaattattggtgagcatacccggatcgtgaacgcctatgtcggcccgttcacctcaatctatcaccactgccacattgaggaatgtgagatcgagcatagcattgtgcttgaatactgcacgatccgtggtctgccacaccgcctggaagatagcctgatcgggcggaatgtcgagatcgggcgtagtccattgcggccaaaggcgtatcggtttatgctcggggataacagt

SEQ ID NO: 32588 - DNA, 948 bp, Chloroflexus aurantiacus
attcgggtctttattaccggtattaccgggccggtcgtcagttttctgtccgattatctgttgacaatacctggcgtggacattcacgccttcaagcgctggcgtagtgatccgcgtccaattgaacatttgatcggacggatcaccattcatgagggcgatattgtagatgcgtttgcgatagatcgggccattgccaccgcacgcccagatcgcatctttcacctcgcagcgcagagctaccccagtgcttcctgggacgcgccgattctgacgatgcgggctaatgtggaaggcaccatcaacctgcttgaagcagcgcgccggcacgtgccgaaggcgcgtattcatattgccggtaccagtgccgaatatgggccggttcgccctgatgaggtgccgatcagcgaggaccatcccttacgaccggccagtccatacggggtgagcaaagttgctgctgaattgagtggcctgcaataccacgccagttacgggttgcacgtggtggtgactcgttcgtttaaccatgtcggcccccgccagggagatcgttgctcgatccaaaccttctgtcgccagatggcgttaatcgaggccgggcagcaggaaccggttatgtatgtcggcaatctgtcacccaaacgtgatttcacccatacccgcgatgttgcccgggcactctggctactgctggaacacggtacgccgggtgaggtgtataacctctgttcggggcaggcggtacgcatcggtgatattgtggatatggtgattgcaatggggcgcgtaccggtgaccgtacaggtcgatccggcccgcctgcgcccggtcgatgagccgatcctccagggagacaaccgcaaactgcgcgcagctaccggctggcaacccgaaatcgggatcgagcagatcgtggctgaagtgcttgattactggcgtcaacag

SEQ ID NO: 32589 - DNA, 2154 bp, Chloroflexus aurantiacus
gaggtcctgcgtgaagtacgaggtgctcagcgcgtaaccagcccgacgcccgaaggcacctatgcggcgctggaacagtacggacgtgatctgaccgagctggcagcgcggaataagcttgaccccgtgatcgggcgtgatgaagagattcggcgtgtaatccagattctctcacggcgcacgaagaacaacccggtgctgatcggtgagccgggtgttggtaagacggccatcgtagagggactggctcagcgcattgtacgcggtgatgtgccagaagcgctcaagaataaacgggtgattgcacttgatctaggcgccctgattgccggcgctaaatatcggggtgagtttgaagaacgactgaaagcagttctcaaagagattcaggagcgcgacgatattattctgttcgtcgacgagctgcataccgtggtcggtgccggtgcagccgagggggcaatggatgccgggaatatgctgaagccaatgctggcccgcggtgagctgcacatggttggcgcaaccacgctcgatgagtatcggaaacacatcgagaaagatgccgcgcttgaacgacgcttccaaccggtgatggttgatccaccgtcggttgaagacaccatctcgatcttgcgtggtctgaaagagcgctacgagacccatcacggtgtgcgcattactgacggtgcgctgatcgcggcggcaatgctctcggatcgctacatctcggatcggttcctgcccgacaaagctattgacctgatcgatgaagcagcggcccgtctgcgcatggagatcacatccgatccgcaagagcttgacgacctcaagcggcgcataatgcaattggaaattgagcgggaagcgctgcgcaaagagaaagatcaggccagcaaagagcggctggagaagctagagcaggagcttgccaatctgcgcgagcagcgcagtgcgcttgaagcgcaaatccagcgcgaacgacaggaacttgagcgtatccagcagctcaaagagaagatcgaacagacgcgcgctgccatcgagcaggcccaacggcagtacgactacaacaaggcggctgagctgcaatacggtactctggtcagcctggagcgcgaattacaggctgccgaagctcaacttggtagccagagccgcctgttgcgccaggaagtgaccgaaaccgacattgccgagatcatctcgaagtggacgggtattccggtcacgaagcttctcgaaggtgagctagagaagctggtgcatatggaagagcgcctgcatcagcgggtagtcggtcaggatgaagcggtgattgccgtctcgaacgcagtacggcgtgcgcgcgccggcttgcaagacccgaaccgtccgttgggtagcttcctcttccttggcccaaccggtgtgggtaaaaccgagctggctcgggcgctggccgagttcctcttcgacgatgagcaggcgatgatccggatcgatatgtccgagtacatggagaaacactccgttgctcgactgatcggtgcgcctcccggctacgttggctacgacgagggtggtcaattgaccgaggcggtgcggcgcaaaccctacagcgtcgttctgttcgatgaaatcgagaaggcgcatcccgatgtcttcaacgtcttgctgcaagtgctcgatgatggccgccttaccgacggccagggccggatcgtcaacttcaagaacacggtcatcatcatgaccagtaacattgccagcacgacgattcaggaattgacgcgcgccggcgccggccaaagcgaaatccgggcggcggttatggaagaattgcggggtgtgctccgcccagagttcttgaaccggatcgatgaagtgatcgtcttttcgccgctcagccgcgaacacattgaccggatcgttgagattcagctcaaccggttgcgcaaactgctggccgaccgtaagctcaatctggtgctgaccgacgcagcccgtgcccaactggctgccgaaggctatgatccggtctacggcgctcgcccgctcaagcgggtcatccagcaacgcatccagaacccgctggcgctgcaattgctccagggggccttcccggagggcagcacgattgtggttgatgtcgagaacgggacgtttgtcttc

SEQ ID NO: 32590 - DNA, 1120 bp, Chloroflexus aurantiacus
ggtatgcgcatcgccctctacaacctgaccaccaccaccaaaatcggtggggtagagagttatgtctgggacctggctcgtgaactggcccagcgcggtcatgcggttgatattttgggtggggtcgggaatcagacgcgaaacggcaccgggagtacgtgtgcttaccttcccatttatttcgcgtcgcttctggcaggcgttcccgctgctgcgccgggcttatgccgaagcaaagctgctggagcggctgacgatggcggttgccgcactccccaccctggtgcgcgagaagtatcagattatccatctgcaaaaaccgtatgatctggcaccggcgctactggcacgccggcttagcggagcgcgcgtcatccttggttgccacggtgaagacttttaccgtggcgatacctggctggcacggcgagtggacgctgcggtctcgtgttcgcgtttcaatgcgcagacgattgccggtcgctacggcttcatgccggaggtggttttcaacgggattgataccagtctgttccgtccacagccacctgatccaactctgcgcgaacggcttggcgtgtcgtcgaccgtgcccctgctcctctttgttggtcggctccaaccgtggaaaggggtagagacggcaattcgggcactctgtcacatcgatcaggcaatcctggtcattgccggtgatggcgaagatcggccacggttggcggcgattgcgcgtgaactcggagtgagtgaacgggttcgctttctggggagtgtgccgcgccagcatctgccggcgctctacgctactgtcgatctgctgctggcaaccagctatgccagcgaaacgtttggcattgggccggtcgaagcgcaggcgtgcggattaccggttgtagcaacccgtttcggaggctttcccgaagtcgtcgccgagggtcagaccgggctactggtaccgcctcgcgatccggcggcgctggctgcggctgtcaatagtctgctctccgatccggcacgtcgggcagcgctggccgcggctgcgccggcgtgggcagcccagtttgcctggccggcggtagtggatcggatcgaggcggtctatcgggctgtcctgcaaact

SEQ ID NO: 32591 - DNA, 870 bp, Chloroflexus aurantiacus
tttccactgctggcgatggtcggtcagaccgagctgaaaacggcattaatccttggcctcatcaatccacaggtaggtggcatcctgctcagtgggccttacggcgttggcaaaacgacggcagtccgtgccctgatcgacctgatgccattcgttacacgcgaacccccggatgccgatgggaagacgatagtcgagcggatgcggctaattgaactcccactcaatgcccgcctcgaagacgtggtgggagggattaacgagcgggtggccctcgaacaacgaattgtccggctggaagaggggattctggcccgcgcccacggcaacgtcttgtacgtcgatgagatcaatctactcgaccaggccgttgtcgatgccatcctcgatgctgcggcgcagggacggacattcgtgcggcgtggtgcgatggtgcgtctcttccccagccagtttgtgttaatcggctcgatgaatccggaagagggcgcactgcggccccaaatcctcgaccgttttggcttgcgagtatgggtagcgccggtaaacgatcagcgtgcccggcttgaaatctaccggcgggcacgtgattttcgcaacgatccggcaggattccggcaggcatacgcggctcaaacggctgcgctggccgaagagatcatgatcgctcgtgagatacttccccacgtcacaattccgcctgagctggaagagcaggcactggccctggtacagcagttgcgcatcccttcccatcgggccgagattgcgcttctcgaaggcgcacgagcacgggccgccgccgattttcgcaatgtcgtcaacgcagaagacattcggcggattgcaccgctggcactgacgtggcgg

SEQ ID NO: 32592 - DNA, 471 bp, Chloroflexus aurantiacus
gcatatgcagatagccccctcggtcgagtgttggtagctgcgaccgatagcggtctctgtgcggtctatttaggtgatgatgacgcagcactgctggctacactccacgctagctttccggtagcgggcactgccgctggtgttctggcggagactgcggcatcggcaattgcagcctatctgcgcaacgaggcaccgctccccgccttcccacttgatccaattggtaccccctttcaacaactggtctggcaggcgctttgtacgatcccgcgtgggagcacccgtacctacggtcagctagctcaggagttaggattaccaaccggcgctgcacgggcagtcggacgggcctgtgcgagcaattcactggcgatagtggtgccctgtcatcgtgccctggggagcgatggcaggctccatggctttcgctgggggatcgagcgcaagcgtgcgttgctggcccttgaa

SEQ ID NO: 32593 - DNA, 1074 bp, Chloroflexus aurantiacus
cacaacttcaatcccggcccggcagcgttgccgcctgacgtaatcgcacgtgcgcaggcggaactggctgattaccacggctgtgggatgtccgttcttgaaataagtcatcgcagcaaggaatacgaggcaatcaatgcggcagcggaagccaatctgaaggcgctgctgggtctgggtgacgattatcgcgtgttgtttatgcagggcggcgcctcgatgcaatttgccctgatcccgctcaacctgttgcctgccggtgccactgctgagtatatcgtcaccggtacctggggcgagaaggcgtatgaagaggcgcagcgggtcggtgcggtgcggttgctggcaagcacagccgccgatggctaccgcagtttgccgtccatcgatgccattacgcctgacccacaggcggcctatctccaccttaccactaacgagacgattcagggggtgcagtggccggctgagctgcccgatctcggttcggtaccgctggtcgccgatatgagcagtgattttctctcgcggccattcccggcgcagcgcttcgcgctgatctacgccggtgcgcagaagaacctggggccggcgggtgttactgtggtcgtgattcggcaggatatgatcgagcgcggacgcaaagacctgccggtcattatgcgctatgccacgttcgccaaaaacaattcgctttacaacacgccacccgtctttgcggtgtatatggtgaatctggtgttggagtggatcaaggatcagggtggattggcggcgatggccgaacggaacgcccgcaaggcggcactggtctacgccgcgattgatggtagcgatggcttctacagcggtcacgcggtgccggcagcacgttcgctgatgaatgtaaccttccgtctgcccacgcccgaactggaaaagcaatttctgaatgaagcccaggccgccgggatggtcgggctggccggtcatcgttcggtaggcggcattcgcgcatcgctgtacaacgcggtcgcgccggagtcggcggcagccctggccgactttatgcaagacttcgccaaacgccatgga

SEQ ID NO: 32594 - DNA, 1839 bp, Chloroflexus aurantiacus
agtatgaatgataatcgttggttgaagaatagttttgtctatctcatcattctggttgcagcgctagcgctgttcttccaatatttcggtcagggtgccagccagactgaggagaaaggcattgccgatgtcatcgccgatgctcaggttggcctggtaagtgaaattcaggcgcaggctggcgacgaacagattattgtcacctacaaggatggtaagaaatatcgctcacgggtcgaaacttcggatagcgtgatgcagttgctggccgactacaacgtaccgctgtacgacgagaacggtcggcggacgatcaacgtaaccgtgcaaccggcaccggcctggggcggtttactcagtatctttaccattctgctgccaaccctgttgctcatcggctttttcgtcttcttcatgcgtcaggcgcaggggagcaacaatcaggcgatgtcgtttggcaagagccgggcacggatgtttgccggcgataagcccacaattaccttcgccgatgtggccggtcaggaagaggcaaagcaggacctggccgaaattgttgagttcctcaagtttcctgacaagtttgccgcgctcggggcacgcattccgcgtggtgtgctgatggttggcccgcccggtaccggtaagacgttgctctcgcgggcagtcgctggtgaggcaggtgttcccttcttcagcatctctggctctgagttcgtagagatgtttgttggcgtaggtgcctcacgtgtgcgcgacctgtttgatcaggccaagcgtaatgcaccctgtatcgtcttcatcgatgagatcgatgccgtcggtcggcagcgcggtgccggtttgggtggctcacacgacgagcgtgagcagacgctcaaccagattctggtcgagatggatggcttcgacaccaacacgaatgtgatcgtgatcgccgcgacgaaccggcccgatgtgctcgacccggctctcgtgcgaccaggccgctttgaccgtcaggtggtgcttgatgcgcccgatgtgcggggtcggatcgagattctgaaagttcacgtcaagggcaaacctctggctgaggatgtcaatcttgaggtaatcgctcgtcagacacccggtttctcaggcgccgatctgatgaacgttgtgaacgaagcagcgattctggctgcacgtcgctcgaagcgcaagatcagcatggcagagttccaggatgcggtcgagcgggtcgctatcggtggccctgagcggcgttcgcgcgtgatgaccgaccgccagaagctggtggtggcctaccacgaggccggtcacgcgattgtcggtgctgcgttgccgaaggccgataaggtgcagaaggtgacgatcattccacgtggacaggctggtgggtataccctcttcctgcctgatgaggatagtctgagcctgcgcaccgtttcccagttcaaggcacgactggccgtctcgttaggtggccgggtagctgaagagattgtcttcggcaacgacgaggtgacaaccggcgcttctggtgatttgatgcaagtcacccgtattgcccgggcaatggtcacgcgctacggtatgagccagcgccttggcccgatggtcttcggcgagaaggaagagctgatcttcctcggtcgcgagatcagcgagcagcgcaactacggtgatgaggtggcgcgccagattgacgaagaggtgcatgcaatcgtcaccgaagcctacgaaacggcgcagcaaatcctgcttcagaaccgggctgtgcttgacgatatggcgaatgcgttgctcgaatacgagacacttgatggcgaacagctcgaggagatgatc

SEQ ID NO: 32595 - DNA, 705 bp, Chloroflexus aurantiacus
atgattgaagccattcagctcggtaagcaatttggtgattttgttgcggtacgtgacctgaatctggttgtgcaaccgggtgagctggtggcactgttggggccaaacggtgccgggaagacgacaacggtgcggatgctggcagccatcctaccgccggggagtgggcaggcgcgcatttgtggctacgatgtggtcagccatgcacaacgggtgcgtggtatggttggtttgctcaccgaataccccggtctctatggccgcatggccgcattggaataccttgccttcttcggtgcattgctcggtgtcgaggcaacgttgtgtcgtcagcggagcgaggctcttttgcgtcagtttggtctgtgggaggtacgtgatcggcaactggagagcttttccaagggtatgcggcagaagatggcgttgatccgggcgctgatccacgatccgccggtgctctttctcgatgagccgacgaccgctatggatccgcagagtgcgcgcacggtacgcgatgcaatcggtgagttgcggagtgcgcagcgcagtattctgctgacgacccataatctgagtgaggcggaagaactggccgaccggattgcgattattcgtggcgggcagattattgcctgtggctcgtttgccgaattgagccggcagttgctcggtgagccggcgtttgagttgaagctgactaat

SEQ ID NO: 32596 - DNA, 2559 bp, Chloroflexus aurantiacus
agtaaacgtatgagcggacgaaccactgctaacgaacatgatctgttatcggcaaacattcgcgcactaggcgatgcacttggccgggtcattatcggtcaacacggtagcgaagcactggcactggtggaacaggtgcgccggatggctaaagacctccgcaatgcaccaaccaacaccgatccacaggcacttccccaattgattgccgatctggatttgccacaattacgcagtctggtcaaggcattcacgctctattttggattggtcaatctggcggaaggggttgaacgtctgcgcgttttgcgggcgcgcgatctacgccatgcgcccgccccccgtgccgagagtattgccgacgctatcgaattgctgaagcgtcacggagtaccggcacctgcgatccaggaatggctggatcacgcgctgattatgccggtgttgacggcgcacccgaccgagtcgcgccggcgcacaatcctgattaaactgcggcgcatttttgatacgctggtcgatttgacatttggagagcggttggtcttacctgccgaccggcaggccgcgcttacccgcatcgagcgggagatcgtcgggttgtggcagagcgatgatgtgcgtaatcggcgaccatcggtgctcgacgaagtggagaatggactgttcttctttcaaaccgtcctctgggaactcctaccgcacatctatcgtgagatgagtgatgcgctgcaagcagcatatccggatcacccctggcgtctgccgccatttctgcgctttggaagctggatgggcggggatcgcgacggcaatcccttcgtgacgccagaggtaacggtcgagacggtacggctgatgcggagcgcaatgctgcgttatctgatagattgccttgatcggctgatcaccgatttgagccaatcggtgcagcaggtgaaggtggatacggcgatcattgatcgcatcgccgaatatcgcgagttgatgccagatgcagcagcgacgctcaacccgcattaccgctgcgagccataccgccagttgtgccattttattcaggcccggctgcacaacacccttcagtacacgttggactacacgcctcgttgggggatcgatccaccgctcgcacggcgacccgacatctactaccatagccgcgaactcttagccgatctcgacctgatcgatgccagtctgcgcaataacggcagtacgttaatcgccggagggtctgttgcgcgatgtacgaacgctcgtggcagtttgccatctgcacacggccaccctcgacgtgcgccagcacgccagccgcacacacactgagcgatctgccgctgctgtgtggtcgacgattacgaagcgctcgatggcagacggattgcggtgttgagcgtggaaattcgccgaccgcgcccactcacgcccaccgatcagtcatttcagtccgcgacgcggaaaccattcacacctttcggtcatacgcatcagcgacagctgacccagaaatctttcagacgtacatcattcgaccaccagtcagtcagcgatctgctggcagtgttgctgctctgccgcgatgccggtctctaccagcccggtcaggccagtcagttgcatattgtgccgctgtttgaaacgggtgacgacctgcaacgcgcaccggcgctcctggatgaactgctccgcttgccggtgtaccgtgagcatctggcgctacgcgacaacctgcaagaggtgatgctcggttattccgacagcaactaagagggtggctttgtggctgcaaactgggcactctaccgggcacaggtggaactgacagcggtcacagatcggcacggcgtccgcttgcgcctcttccatggccgcggtggcgctgttggccgcggtggcgctgttggccgcggtggcggccctgccggacaggccatcctcgcccaaccacccggaaccctccacggtcagatcaaggttactgaccagggtgaaatgatctcagaccgttatctcgatccgcggactgcccatcgtcacctcgaacaggtggttaatgccgtgttgcgggcgggctttcccggcatggcgcggcagcccgaaccaacctggctggccgcgatggaggagatggcgactacggcacgtactgtctaccggcaactggtttacgaagacccggattttctgatctattttcgcagtgccacaccggtggccgaattcaaccggctactcgtcggctcacgtccggtctcgcgccgcaagagtgatcggatcgaagacctgcgggccattccatgggtctttagctggatgcagagtcggcacacgattccgggctggtttggcctgggcagtgcgctggaagcatttgtggaagccgatccgcatcacctgcatctattgcgcaccatgtaccagcactggacctttttcagcacgctgctggataacgcgcagatgatcatgctgaaaggcgatttaacattcccaggcttcgccagcctggtccggatcgtcatctggcgaaccgattttcacggatcgaaagcaatt

SEQ ID NO: 32597 - DNA, 606 bp, Chloroflexus aurantiacus
atgcgtctcattcttgtgcgacacggcgagacgccgtggaatcaaacgttacagtaccagggtcacgcgccgataccgctcaacgagcgtgggcgcgaacaggcccgacgggcagggatacgattggttcggagcggggcagttgctctgtacagtagcgatctgccccgcgcatgggagacagccgagattattgggtcacacgtcaatctgcaaccggttgctatgccggatttgcgcgagattgatgtcgggttatgggaagggctaacccccgacgaactctatcagcgcttccccgaccatatgcgcgaatacgaccgcgacccggcacgaactgtgcgtctcggcggcgaaagttatgcccaattgcaagcaagggtgctgcgggcgtttgcccggatcgaggccgctcaccgcaatggtgagacgattatcgtggtttcgcatggcggctccatccgcgccttgttctgtcacatcatcggtctcgatctggcaaactttagcaaattgtggctcgacaatggttcgttgagcgaaatcgtccgcgggcgaagtggctggcggctattacggatgaatgatgtcgcccaccttgaggaa

SEQ ID NO: 32598 - DNA, 668 bp, Chloroflexus aurantiacus
acttacggtgatcacgccgacacattatcttgatggcgatgaccgaccccagcaagggtacgaaaggcatcaccgcatttctggttgacacccacgcgccaggttgtcgggtggtcaaagtcgagaacaagctcggcattcgcagtgcacatagctgccagatggcgtatgacgactaccgcataccggcgtggcggcggctcggcgaagagggtcagggtttcaagattgcgatgacgattctcaacgccggtcgcatcgggattgcggcacaggcggtcgggattgcgcaaggcgcgttcgaggcggcactggagtacagcaaagttcgtgaacaattcggcaaaccgatccacgaattccaggccgtcggctttacgctggccgatatggcaacccgtatcaaagcggcccgtctgctcacctacgaagccgcctggcgcaaagatcaggggcttgatttcatcaaagacgcctcgatggcgaagctctttgcttccgagacggcgatgtgggtggcgacgaaggcggtgcaactgcacggttcaaacggctactcgaaagagtatccggtggaacggttcttccgtgacgcgaagattaccgagatttacgaagggacaagtgagattcagcgcctcgtgatcagccgcgaactggtacgctga

SEQ ID NO: 32599 - DNA, 1554 bp, Chloroflexus aurantiacus
atgacgacgattactgaggaattgatcgcccggctgaagcaggggatcacgagcggcgtcgaccttcagccgcgccaggtcaatgtcggtacggtgattgccgtcggagacggcgtcgcgcggctgtccggccttgatcaggtcgtcgcctctgagattgttgaatttcccccgaaagccggtcgcaatgagtcgatttacggtattgccctgaacctcgaacaggatagcgtcgccgccattatccttggtgacgatgagacgattgaggaaggggatatggttacctcaaccggccgggtgatttcggtgccggttgggcaggggttgttgggacgagtggtgaatccacttgggcaaccaatcgatggtaaggggccaatcgtctacgagaagacccgccccatcgagcgcattgcccctggtgtgattacccgtaagtcggttgatacaccggtgcaaaccggtatcattgccattgacgcgctgattccgattggacgcggtcagcgtgagctgattatcggtgaccgccagaccggtaagacggcggtggccattgataccatcctcaaccagaagggccaggggatggtatgtatctacgttgccattggtcagcgccgggcacaggttgcccaggtggtcggaacgctcgaacgatttggcgcgatggagtacaccatcgtcgtgtcggcaaccgcctccgagagcgctgcgttgcagtacatcgccccctacgccggttgtgcgatgggcgaagagattatggaaaacggcgttatgctcaatgggcaactggtcaaggatgccctgatcgtctacgacgacctgagcaagcacgctgttgcctatcgccaggtatctctcttgctccgccgcccacccggccgcgaagcctatcccggtgatgtcttctacctgcactcgcgtctgcttgaacgcgccgctcgtctgaatgaagagtacggtggtggttcgctgaccgcgttgccggtcatcgagacgcaggcaaacgacgtgtcggcctacattccgacgaacgtcatctcgatcaccgacggccagatttatctggagtccgacctgttcaatgccggtcaacgtccggcgctcaacgtcggtatctcggtgtcgcgtgtcggtggtgctgcacagacccgggcaatgcgggcagttgccggtaagctgaaaggtgagctggcacagttccgtgacctggctgcattcgcccagtttgccagcgatctcgatgcgacgaccaaagcgcaaatcgagcgcggtcagcgtctgcaagaattgctgaagcaaccacagtatcagccgcttccggtcgaagaccaggtagccgtgctgtacgcagcaaccaacaactatctcgatgatgtaccggtgccgttgatcaccaagtggcgcgatgactttctggccttcctgcgcaccgctcaccccgaggtgcggaagctgatctacgacaatcgccttgatcgcaagttcccgacgcctgaagtgaaagaggcgctggaagcggcgattaaggaatttaaggcaacc

SEQ ID NO: 32600 - DNA, 879 bp, Chloroflexus aurantiacus
atgccgagtagtcgcgagattaagcgccgcatccgctctgtgaagaatgttgctcagattacgcgagcgatggagatggtgtcagcatcgaagatgcggcgcgcccaacggaatgtgttagctacccggccatatgccgaccggatgcgggaggttatggccaatcttactgctcgagtcgtgggagcggcacgtcgcggtacgttgcttgaaaagcgcgagacggtgaaaagtgttgcactgctagttgtaacgcctgatcgagggctttgcgggagcctggtggcgaatgtgctacgtcgcgccggtcgctttatcaccgagcaacgcgctatgggacgcaccgttgatgtgtatacgttcggtcgtaaggggcgcgatttcttcttacgaaccggttttgccccggcaggtgaagcaacccgtctcggcgatgcaccaaagctcgaagcaatcctgggtgtcgcaattagcgccattaatgggtttcagtcgggcaagtatgatgaactctacattatttatagtgagttcatcaatacgttggtgcaacgtccggctatcaagcaattgttaccggtagagagtcctgacatctcgaccacgacgaatgttgattatacctacgagccgggagaagaagaagttctcaatagcattctgccgcgttatgtcgaaacccagatttatcaggcagttcttgaaagcatcgccagtgaacacagtgcacgaatggttgcgatgcgtaatgcaacgaacaacgccaaagatctggtccgcgatttgaccctgtcgtttaacaaagcgcggcaggccgccattactaaagaggtcagcgaaatcgcttcgggcgccgctgctctcaccagttaatgacaa

SEQ ID NO: 32601 - DNA, 948 bp, Chloroflexus aurantiacus
gccaagggggttattcaagagattatcggtgtggtcatccgggccaaattcccggaagacgaggtaccggaaatctataatgcaatcgaaattccattagggaatggcgaccgtctcgtctgcgaggtgcaacagcagctcggcaatggcgtggtaaaggcggttgcaatgggttcgaccgatggtctgcgccgtggtcttgaggtcattgataccggtcggcctatcgcggtgccggtcggcccggctacacttgggcgcgtgttcaatgtgttgggagacccaatcgatggtatgggacctatcggtccagaggttgagcgccgcccaattcaccgtgatccgcccagctttgaagagcagaatacccaggctcagatttttgaaaccgggattaaggtgatcgacctgattgcgccgtttacccgtggtggcaagaccgccatcttcggtggtgctggtgtgggtaagacggtggtgatccaggagttgattgccaatatcgctaaagagcagtcggggttctcagtcttcgccggcgtaggtgagcgatcccgcgagggaaatgacctcatccacgaaatgaaggaagcccggatcgacgaaaacaccaccgtgttcgacaagacggtgatggtgttcggtcagatgaatgaaccaccaggtgctcgcttgcgggtcggtctgactgccctgaccatggccgagtacttccgcgatgagggtcgcgatattctgctctttattgacaatatcttccgcttcgtacaggccggttcagaggtttcatcactcctcggtcgtatgccgtcccaggtaggttatcagccaacgctgggcaccgaaatgggtgaattgcaagagcggattacgtcaaccaagcgtggttcgatcacctcgatgcaagcggtatacgtgccggctgacgactacacagacccggcacca

SEQ ID NO: 32602 - DNA, 2358 bp, Chloroflexus aurantiacus
ccaaacccaatgcaacgtccgcctatgccggagataccggatgtcttgccggtattgccgattaacaacgcgatcctgttccccggcatgtttttgccgctggtggtgagtggtgaagcctgggtacggctggttgacgaggcagcactctctaccaagatcatcggcgtcttccgccgcattcagtccggcgccgagtttgagccggagatgctggcccagaccggcacggcagccttaattgtgcggatgatgcgcctgccccagggtggcgtgcaactgttgttgcaagggcaggcccggatcaaggtgcagcggtgggtgaccgtcaagccatatccccaggcgcacgttacggtcgctctcgatccagttgatgtttcgatggagaccaccggcctggcgcgagcggtactggcaggtttccagcagatcgttgagcaaagtccgaatttgcccgatgaactggcgattgccgccgcgaacgctccccatccgggcatgctggccgatctgatcgcggccaacctgaatctgaatctcgacgatcagcaaaaggttctcgacacgtttgatgtgcatgagcggctgcaactggtgttgcgtctgcttgagcgtgagcgcgaaatcctgttaattggccgcaaagcccaggaagaggtctcgaagaaccagcgcgaatacgtgttacggcaacagctcgaggcaatcaagcgcgagctaggcgaaaccgatgatcatgccgctgaaattgccgagttgcggcggcgcatcgaagaggccaatctaccggctgaagcccgtcaggaagcagagcgcgagctgttgcgccttgaacggatgccccctggcgcagccgaatacaccgttgcccgcacctacctcgactggctgctcgatctgccgtggcacaccagcaccgaggacaatctcgatattacccaggcccgccaggtacttgatgaagaccactacgatctcgaacgcatcaaagagcggattatcgagtatctggcggtacgcaaattacgccgggaagaaggtgctgacaacgaggcgcgtggtccgatcctctgcttcgtcggtccgcccggcgtgggcaagacgagtctgggcgcgtcaattgcccgggcgttagggcgtaagtttgtccgggttgccctcggtggtgtacgcgatgaggccgaaattcgtggtcatcgtcgcacttacatcggtgccctgcccggtcggattatccaggggctgagtcgggccaagagtaacaatccggtgctgctgctcgatgaggtggataagctcagcatcggctttcagggcgatccggcagcggcactactcgaagtgctcgatcctgaacagaatgtcgcgttcgttgatcgttacctggatgtaccgtttgatctgagtaaagtactctttgtttgtacggccaaccgggctgataccatcccgccggcgttgctcgaccggatggaactgctggaacttgccggttacaccgaacaagaaaagctggaaatagcccgtcgctatctcatcccgcgccagcgccgtgaacagggcatgacaaatcgcgggccagagttgaccacagccgccttgcagcgtctcattcgcgaatacacgcatgaagccggcgttcgtgatctggaacggcggattggggcgatctatcgcaagatggcgacccgtctggcctcggaacagacgctacccgatcaggttgatgcggctgatctcgacgacctgctagggccgccgcgcttccgcagcgagaccatcctcggcgacaatgaagtgggggtggttaccgggctggcctggacaccgaccggcggtgacgtgctcttcgttgaggtgagtgtcattccgggcaatggtcagctcatcctgaccggtcaattgggtgatgtgatgaaagaatcggcgcgggccgccctgacctacgcccgttcgcgcgcatccgctctgggtatcgatccagaggtcttccagaagagtgacattcacattcacgtgccggccggtgctgtgccgaaagatggcccatcggcaggcatcaccatcgccagtgcgctcatctcggcgctgaccagacgcgaagttgacaaacggatcgcgatgaccggtgaagtaaccctccgtggcaaggtattgcctatcggcggtgtcaaagaaaaactacttgccgcgcagcgggccggtgtgcgcaaagttctgctccctaccgaaaacgagatcgaccttcgcgacgtacctgccgaaacgaaggagcagttggagattgtgctggtcaagcatatggacgaggtactgcacgaactgggtctggaaattgccccgcaaccggtgagt

SEQ ID NO: 32603 - DNA, 1242 bp, Chloroflexus aurantiacus
gtagcgatgatcatggcaggcggcgaaggaactcggctcagtgtgctttcggaaaagcgcgccaaaccttcagtgcccttcgccggtaagtttcgcatcattgactttaccctctcgaattgcgtcaactctggcatcttcgatgttgccgttctgacgcaataccggccccattcactcaacgaacatatcggtattggtaaaccatgggacctcgaccgtgcccgtggcggtgtgcgcctgctgcaaccgtaccagggtcgccgtgacgagtcgtggtatcggggcacagccgatgccatttatcaaaacctgaattacatccaggaacggcgcgccgatctggtgttgatcctctctggcgaccatatctacaagatgaactataacgacatcattaaaacccatctccagaaacgggccgacctgaccgtggcggtgatggaggttcccatcgaagagacggatcgcttcgggattatgacaaccgatgaacatgaccgcattatcgaattcaccgaaaaaccgaaggcgcgggacaagggaaatctggcgtcgatgggcatttatgtctttaacgccgatattctgatccgtcggttgtctgagggtgggccggagaaaccacggatcgacttcggcaaggacgtgattccagctatggtcgccgaagaccgtgtgtttgctcatcgcttcaaggggtattgggttgatgtcgggacaatccagtcgtattgggaaacgagtatgcaattactcgatccatcactcgatttcgatctcttcgatcccaactggctgatccgcacccgcagcgaggagcgaccaccggccaagatcgggccgcaggccaaagtaacccaatcgatcatctgcaatggctgtacgatccgtggcacggttatccattcggtcttgtcgcccggagtgtacgtttcgccgggggccattgtgcgtgatagcgtggtgatgaacgatacctggatcggccctggcgcagtactcgaccgggtgattgttgataagaaagtcgtggttggtgccggtgctcgcctcggttttggcgatgatctaaccgttcccaatcgaaaacaacccgataaactcaatagcggggtaactgttgtcggtaagtcggcgcacattccagccggcattacgattggccgtaacgttgtgatcaacgccgaccgcgatgccgaagattttcccgcaggtgatgttccatcgggcgagacgatc

SEQ ID NO: 32604 - DNA, 1203 bp, Chloroflexus aurantiacus
atgatacgcacactcgtgatgattcttgccggtggcgactcgccggccctcagtgttctcaccgctgaacgaactgaggccgcagtacctttcggcggtaagtatcgaattatcgattttgccctctcgaattgcgtcaattcgggcttatacaatgttgccgtcctgacccagtatcgcccccgctcgctgcatgcccatctcggtgtcggccgtccgtgggatctcgaccgggcgcagggcggtttgcgcttactccatccatcacccacgcccgatggcggtggctggcagcgcggtaccgctgatgcagtgcgctacaacctcgatttcgttgaggatcagcaggtagatgcggttctgttactggctggagatcacatctacaagatggattatggccccctcctcaaactccatgccgaacaagaggcggatgtgacgatggcggtacgcagcgttagcccgcacgatgctcaccgctacgggattgtgtcggttggcagtgatggccgggttgatcgcttcgtcgaaaaacctcgacgcgccgactctaatctggcttcgatggggatttatgtctttcgcaaacagtttctcatcgatctcttacgttcgaccgatgccgttgattttggccgtcatctgcttccccagatcgtgagcagcgcccgtgctttcgcgtacaattttcagggctattgggccgatgttggtacagtacaggcctattacgaggcaaatctggcgctgctggccgagacaccggccctcgatctatacgatccagagtgggtaattcacactgttagctcggaccgaccgggtgccgagatcggcgtccaggccagagtcgagaacagcttgctaagtgacggctgtcgcgtgtacggcacagtcatcgggtcggtactctcaccgggtgtcgttgttgccgccggtgcggtggtacgcgattcagtagtgctgggtgatgcagtgattgaggcaggtgctgtccttgaccgctgtatcattgatgaaggggtgcgcatcggcgaaggggcacacgtcgggtttggtgatgataatacacccaacgctgaagcaccagaacgcctgaataccgggctaacccttgttggcttgaaagcacagattccggcaggagtacgtatcggtcgcaatgttgccatcaaaccgcgcacgcagccggctgcattt

SEQ ID NO: 32605 - DNA, 1095 bp, Chloroflexus aurantiacus
atccgggtggcgatgctggctcgcgccgtcttccctctgcacggctacggtggcatcgagcgtcacgtctaccacctcaccaaatatctgacccgcctgggagttgaggtaaccctgtacgtacaatcgccgccagacaacgccgaacagggtgatctccaaccgcacgccatcgagacactgcgctacgactatacctcaccgctgctggccccaaatggcgtgattggccgccagatcaattttccaatctacagttggcggatcggccatcgggcagcccggcgcgtgcaacacggcgatttcgatgtcgtccattcgcagggattatgtgcctttgggtacgcggttgcccgcaatcggataacgctactccgcagcgttccctttgttgccaatccgcacggcatggaggaatttcgcacgccggatcgacgcaaatggctggcgtatgcgccattccgctggctctacgcctatggtcatcgccaggccgaccgcgtgatcgccaccgatgcctgcacgaaagacgacataccccactacctccgggtcgatccggatcgggtcgtcgtcattccgtcggcgattgatgtcgaagaatgcctcgctcaggtacgaagtgagctgcgtacagcgctccggtttcgctttggtttgggaagtagtgatccaattctgctcagtgtcggtcgtctcgaaccgaacaaagggtttgacattctgattgctgcgttagcccgcctgcgcaacgaactaccaccccgctggcgctggatagtagttggtaatggttcggcgcgtgctgcgcttgaacagcaggcgcaggcagccggcattgctgaacacaccttgtttgtcggacgtttgaacgatgaggaactgcacagcctctacgaagagatcgatcttttcgttcacccaacccgctacgaaggcagctcactggtcaccctggaagcaatgatccaccgtcgtccggttgtcgccagcgctatcggtggtatccccgataaagtctttcccgggcgtaacggcttactggtacagcccggcgatgttgatgacctgaccggtccagttcagggcgggctt

SEQ ID NO: 32606 - DNA, 939 bp, Chloroflexus aurantiacus
ttagggaatgaacgcttgcgtgaatgggtgcttagaatgcagattattcgtgcttttgaagaaaaagccgaagaactgtttgcgcgtggattagtacacggcacgatgcatctttcgatcgggcaggaggctgtggcgataggtgcttctgcagcgatgaaacctggagattatttgcttaaccatcatcgtggccatggacattgtctggcctggggtagtgatgtacggctaatgatggcagagtttttaggcaaagaaacaggatattgccgtggtcgtggtggatcaatgcacattgctaatgttgaaatgaataatttgggtgcaaatggtattgttggtggtggtattcccatttcagttggtgttggattgagtattaaaaagcgccgatcttctcaggtttgtctcactatttttggtgatggtgcagtcaatactggtgcttttcacgaatccctaaatatggccagtatctggaacttacccgtggtttatctctgtgagaacaaccaatacgctatgtcaatgccgatccagaaagcgtgcagactcaatcacctgagccagcgagctgctgcatatgcgatagctggaataacggttgatggtaacgatgcattagcagtgtatgaagcagttcgccaggctgtggcaagagcgcgaagtggttatgggccaacacttgttgaagcgattacctatcgttggaaaggtcattctaagagtgaccgtcaagcttatcggagtcgtgatgaggtgaaagattggcaatctcgtgatccaatcatgcgattagccagactgattcaaatgagtgacgctgaattcaaagctatcgttgatcaagctcggactatgatcgaggaagcggtcgaatttgctcaggccagtccggaacctgatcctgatactatttttgagggattgtatgcg

SEQ ID NO: 32607 - DNA, 2190 bp, Chloroflexus aurantiacus
gctgccgagcggctgcgccgcgatcataaggttgatctgagcttggctatctacgatgcggcaacgttgagtaatgccgcaggatgggcgaaactcgaccgcgatctggcaagggccgatctggtgttcggggcacgcctgttcagcgaagacctggtgcggccactggtcgaacgattggcccattttgaacgaccaacgctgattattacctcaaatccggcactgatccgttgtacccggatcggtggcttttcgttgcggcgcgaaagcgagaacgaaccggggccacttcgtcgttgggtgcagaagctccgaccgcagggtggtgcaggcgaggcccggcgtcaattggcgattttgcgcaatttaagtaaggtgttgaaagttatccccggcacgtcccgcgatttgtacacctacattaccagtcatcaatactggctgaatgcctcgccagagaatctctaccgcctgctttgcgtgctcatcggtcgttatggcccatcgccgcgcccaaagctgccacagcttgacccactaacctatcccgatacggcgatctaccaccccgacgcgcccgatctctttacgtcgttgaacgattactaccgctggcgtggaaaacgcataccgtctgcgggtaaggttggtattctgaccctgcggacggtggtgttgagtgggaataccccgcatattgatgcattggcccgcgctattgaggcgcgcgggctggaagcccgtgtcgcctacgctgccgggcttgatttgcgtccgctgctcgataaggagctggccgatgtcgacctgctggtcaatgcaaccgggtttgctctggttggtggcccagccgagagccagcctcagcaggctgccgaggcattaactcgcttcgaccgtccatacctcagtctggtaccgctggcgtttcaacgaatcgacgactggcgcgccgatgataacggtctggtgccggtgcagcaggcgctgagtgtcgccattcccgaactggaaggtgctgccgaaccgctgatctttggcgggccggcggctgatggtcagcgctttgccccagcccaggcggaaatcgagcagattgccgaccggattgcgcgccgggtggccctacgtcggatgccgaacgcgcagaagcggctggcggtggtgatctacaactttcccccggccctgggcacggttggcactgccgcctatctcgatgtctttgccagtctgtttcgtctgttacaggcgctggctgccgacggctatcaggttgaggtgccggaaagcgttgatgcgttacgccagcttctgttggccgatggaccggcccacggtgccgatgcgcacatcgccgattggctcagcgcggacgagtatcgccggctcttcccggcgtataccgacatcgagccgtactggggaccggcaccgggtgatctgctgcgcgacaatcgtgggattcggattctcggtcgtcagtttggaaatgtctttgtcggggtacagcccagttttggctacgagcgcgacccaatgcggttgttgctggcgaaagatgctgccccgaatcatgcctttgccgcattctacacctggctgatccacaaattccgcgccgatgctgtcattcatcttggcacacacggcgcaatggagtttatgccgggcaagcaggttgggttgagtgcccgctgctggccgctgcgcctgatcgggccgttgcccaatttctacgtctacagtgtgaacaatccgagcgaggcggcgattgcaaagcggcgcggcgcggccacactggtgagctatctggtaccaccggtgcaacaggcagggctgtacaaagggctgcggacgctgcgcgatgcaattgatcagtttgaacgccatcccgatcctgccctggtgagcgatgtgcgcgagcgggcagcgcaattaggcattccaatggcggccagtggtgatgattacgctgatgttgccggtctggctcacgagctactgcggatcgagcagcgcatgatccctctcggcctgcacgtcctcggccaacccccggcaccggctgagctggccgactttctcctgctctacgccagtttacaaccagatggtggtttgcccgctttgattgcccgtgggatgggaatgattacgctgatttatgcacgcacctacagacgg

SEQ ID NO: 32608 - DNA, 768 bp, Chloroflexus aurantiacus
atgggcctgatggagggaaaaaagggcctgatccttggcgtagccaatgatcgctcgattgcctgggggattgcgcaggcactacaccgcgagggagctactatcggtttcacgtaccttggtgaagcacttgaacggcgggtccgtccgctggcggaaagcctcaactcgccgttgatcgtgccctgtgacgtgtccaaagatgaagacattaccgccttgatcgaacaggcacgtgaaacattcggacagattgattttctcgtccacgctattgccttcgccaacaaagaagagctgagtggcacaatcctgaacacaacccgcgaaggattccgcatcgcccttgagatcagcgcatactcactgatcgcgctggtcaaggccgccgaaccgatctttgcccctgacgccagcgtcctgacattaacctaccacggtgcacgccaggtgatcggcagctacaatgtgatgggtgtcgccaaagctgcgctggaagccagcgtgcgctatctcgctgccggtcttggcccccgtgggatcagagtcaacgcgatcagcgccggcccgattcgcaccctggctgccagtggcattgccaatttccgcagcctgcacaaacatttcgccgaatatgctcccctgcggcgcaatgtcacgattgaagatgtaggaaatgccgccctgtatctctgctcaccgctcgcagccggcgtaaccggcgaaatccattatgttgatgccggctttaatgtggtcgtgcccggt

SEQ ID NO: 32609 - DNA, 690 bp, Chloroflexus aurantiacus
agtggcctccagtacgtcgaaattcaggccggtgatggcgagcagccccaacccggtgcgattgtcgccgttcactatcgcgggatgctggccgatggcagtgtgtttgatagttcgtatgagcgtggcgagccgatccgctttcccctcggtgtcgggatggtcattcccggctgggatgaggggattggcctgatgcgggttggtggcaaggcgcggttgattattccgccccatctcggctatggagcgatggggtatccgccggtgattccaccgaacgcaaccctgaccttcgatgttgagctggttgaggttttgcccggcccaccggaagcgccgcaagacctgccggctgatcggtatacgaccagtgccagtggcctgcaatacgccgatctaacagttggtgatggggcaaccgccatggccggtcgcactgtaaccgtccactacaccggctggctcaccgacggcagtatgttcgatagctcgctcagccgtggggaaccgtttgtctttccgctcggtgccggacgagtcattcggggctgggatgaaggggttgccggtatgcgggttggcgggcgtcgtcagttaattattccggcggcgttggcctacggcaatcgcggggcgggtggtgtgatcccaccaggagcaactctgatctttgaagtggagctgttg

SEQ ID NO: 32610 - DNA, 555 bp, Chloroflexus aurantiacus
catataccgggcttgaaagtagtaatgcctgcaacaccctacgatgcgaagggattgctcatcgcatcgattgaagacaataaccctgtcatatttatcgaacataagcttttgtataaaacaaaaggtgttgtaccagaagatatatatcgagttcctcttggaaagagtcacgtagttcgccagggtcgtgatgtcacaattgttgccacttcggtgatggtacaacgagcacttgaagctgctgaacaattggctcgagaaggaatagaagcagaaatcattgatccgcgaacgttgcgacctttagatgatgaaccaattctagagtcggtggtaaaaaccggtaaggtgttaatagtgcatgaagctgttaagatggctggctttggtggcgagatcgctgctcggatcgctgaaagtacggcctttgattacctcgaggcgcctatttgccgacttggtggactcgatattcccatcccatataaccgaactcttgaatatcacgcagtgcctcagattgaaaatattattgcggctgctcgtgattta

SEQ ID NO: 32611 - DNA, 1387 bp, Chloroflexus aurantiacus
atggtgcgtgaagtaattatgccaaaatttggctttacccaggagactgcagaaattgttcgctggattaaacgtgagggtgatttggttgatattggcgaaccgattgttgaagtaactactgataaggtcaatatggaggttgaagcacctgcacgtggtgtacttggtaatgtgcgctatcgagaaggtgacgtcgtaccggtaacggaagttatcgcgtacattatgccactcgaagaagtaggggtgcaatccgcaagtcagagcggcacagaccatcatatggttgttaactctgcaccttcacaacgcagcgagccgaaggcaacaccgcttgctgaacgggtagctcgcacagttggattgtctcttgaccgaatccagtggtagtggtccaaacggacgaatccttcgtcgtgacgtagaaaacactctacggcagttatcaatgaataaagttcgagcggtgccggcagcacgccgattagcacgtgaagcaggtattgatataagcaaagtgaaaggtacgggtcctcatcatcgtgtgcaatccagtgatgtgcaaaattatttggctaccagatcttcattagatgcgacatttaccacgtctgggccaatcaagcaacccgaagatgttgtgacgtcttcaaccatcactggtgatacccaaacgcaatccggttatcgcaagctgccgctcacaggcatgcgtcgtaccattgctcgccgactccagcggagtgcacaggaagctccacatatccagcttgaggtacgcgttgatgtaactgaggtagaagcactgcgagctaaagctaatcgacaccatcttgacgaacagcctaaagttagcttgacagctatttttgtgaagagtgctgcatgggcattgaaacggcacccttacctaaatgcctggttacaatcaattgggcatgaggaacagatcgtcttagttgatgaaattaatattggtattgcagttgcgcttgaacaagggttgattgtaccagtaatccgaaaggcaaatgaaaaggggatattacaaatagctcgagagatcgacgacctgagtcagcgggctcgtactgataaactacgtccagatgaggtcgtagatggtactttctctatctctaaccttggtatgtttggtatagagcgcttttcggcaattatcaatcctccacaggttgctattttggcggttggtgcagtatgtcgagaggttgttgctgatgaaaataatggaatttcagttcgtccccttgtgaagcttacactttgtgtcgatcacagagttgtcgatggggcggtggctgctgcttttcttcacgatctcaaggtagtgcttgaggatccacaggttatgttgttataa

SEQ ID NO: 32612 - DNA, 1215 bp, Chloroflexus aurantiacus
accgtgcagcaattcgcattcccaacgggttttttgtggggagcggccacttctgcccatcaagtagagggtaacaatatcaatagtgatagttgggtgttagaacatttgcctgatactatatatgctgaaccgtcgggtgatgcatgtgattattatcatcgttatccagaagatattgcactattggctcagttgggttttaatgcgtatcgtttttctatcgaatgggcacgcatagagccggaagagggtgaattttctttcgcttctcttgaacattatcgtcgtatgctggcaacttgccatgagcatggcttgaaaccggttgtcaccttgcatcattttacgtcaccgcgctggctgatccgtgctggtgggtggttagatccaaaaacccctgatcgttttgttcgctattgtgagcgcgttgtgcattatctcggtgatttgattgctggtgcctgtacattcaatgaacctaacttgccagtcttgttgagcaaaataatgccggcttcgcctttagcaagtcctttctggcgtgctgcggctgcagagtttgcagttacaccggatcgtttagggatattccagtttgtaagtcagccgcgtatgcgagagattatcttcgctgcccaccgtcgtgcgtttgaagttcttcatgacggaccgggaagttttccagttggtatgacactggcattggttgatatccatgccggacctgatggtgagcgtatggcagcagagttccgtcgtgagcttgcagaggtatacctggagcaattacgcgaggatgattttgtaggtgtgcaaacctattcacggcttgttgtgggccctgcagggattattccgcctggtgatgatgtggaaaaaacgcaaacgggtgaggagtactaccctgaagcaattggtggtacgattcgtcatgcggcagcagtcgccggtattcctgttgttgttaccgaaaatggtctcgcaactacggacgatactcggagagttgagtattttcgacgagccttgcgcagtgttgctgaatgcttgatcgacggtattgatgtacgaggttattttgcctggtcagcattggataattttgaatggattagtggttataaacctaaacttgggatcatcgctgtagatcgaacgacacaagctcgtaccccaaaaccaagtgcatattggcttggtaatgtagcacgt

SEQ ID NO: 32613 - DNA, 1273 bp, Chloroflexus aurantiacus
atgagtcgaacgcgcaattctggtcgtgatccgtatgcctgctcgttctgtgggcgcggacaggatgaagtacaacgcctgatcgctggccctggtaacgtctttatctgcgacgaatgtgttgcgctttgcagcgccatcattgccgaagagagcgatcagaaggcaccaaacgcccgtcgcagtacccctccaggcccgacccgtttacccacccctcgtaaactgcgcgaacgactcgaccagtacgtgatcgggcaggatcgggcaaagattgcgctggcggtagcggtttacaatcactacaagcgagtacgggccggtgccaggatcgatgatgttgagatcagtaagagtaatatcttactgatcgggccaaccggtagtggtaagacgttgctggcgcaaacaatggcgcgtttgctcgatgtacctttcgcgattgccgatgccaccgctctcaccgaagccgggtatgttggcgaggatgtggaaaatattctgcttcgcctgatacaggctgctgatggtgatctggaacgagcacaaaccggcattatctatatcgacgagattgacaaaattaattgctcgtaaggctgataacccctcgatcacgcgcgatgtctctggcgagggggtccagcaggcgctactcaaaatcctggaaggaggcgttgcccacgtcccacccctccccggacgtaaacatccgcaacaagagtatatcccgtttgacaccacaaatgtgctctttatctgtggcggtgcgtttgaggggatcaccaaaattattgccaaacggctgcgaggaaaacaattaatcggctttggcagcaatccggtcaatccggttgaagaagaaggtgcgttactggctcagatcacacctgatgatctgatgcactttggcttcatcccggagttcgtcggtcgcctgccggtgattgttgcgctcgaaccgctcagccgcgaagccatgctgcgcatcctgaccgaaccgcgtaacgcgattatcaagcagtatcaaaagctcttcgctcttgatcactgtgaattggaatttacacctgacagcctggaagcgattgttgatcgcgcgatggctgcccgcaccggtgcccgtgctctgcggagcattgtggaagaggtgctgctcgatgtcatgtttgaattaccatcgcaagaacacatcgggcgctgcatcgttacggcggaagtcattcaaggtcgcgggcgtccgatcctggtgccgcgtgccgattaccgtcgt

SEQ ID NO: 32614 - DNA, 1773 bp, Chloroflexus aurantiacus
cagaacgcggaacgttttggcgataaggtggccctgcgcgaaaaggattatggcatctggcaaacggtgacctggcggcagtttgctgaccacgtgcgcgccttcgcgatgggattacacgcgctgggggttcggcgcggtgatgtcattgccattctcggtgataaccgccccgaatggttgtacgccgagttcgccgcccaaaccatcggtgcaatgtcgattggggtctatcaggactcagttgccgaagaggtctattacatcgtctcggctgccggcgcacgggtgatcgtggtcgaggatcaagagcaggtcgataagatcatcgaaatctggccgcggctggaaggggtgttgaaggtaatctactacgaaccgaaaggcatgcgcaattatcgccagccctacctcgccgattttccgtctattgaagagcttggccggacgtatgatcgcgagcatccgggtctgtttgaggctgaactcgctgccggtaaacctgatgatgtagccattctctcgaccacctccggtaccaccggcaagccgaagctggccatgctgacccatcgcaacatgatcagccagggtgccggtctgctctctgtcgatcctctcggccccgatgatgagtttgtcagcttcctcccgctggcctgggtgggagagcagatggtgactgtggccgccggtatgcagtgcggttttaccatcaacttcccggaatcggccagtaccgtccaagagaatattcgcgagatcgggccacgggtgatgttctcgccaccacgcatctgggagaatatgctctcgcaggtgcaggtgaagattcaggactcgacaccgctcaaacgtgcgatcttcgagtgggcaatgcgccaggggtacgagatggccgatacccgcttcagcgggaaacagcccgatctctggctgcgcctgcgctatgggttggcgcgcctgctggtctttgagatgctcaaagaccatcttggcctgcgcttcctcaaacgggcttacaccggcggtgccgcgctcggccctgatgtgttccgcttctaccacgcgattggggtgaatctgaaacaggtgtacgggcaaacggaaagtgccggcctgagcgtcatccatcgtgatgggcagattaagtttcaaactgtggggacaccgctgccaaatacccagattcggattgccgaaaatggcgaaattctggttaaaagcccctctgtctttgtgggatactatcaaaatccggaggcaaccgcagaagcgctcgaagatggctggttgcacagtggcgatgccggctattttgatgaagatggccatctgatcgtgattgatcgagccaaggatgtaatgactcttcacgacggcactaaattctcgccacagtttattgagaataaactcaagtttagcccatacatcaaagaggccgtggtcttcggtggtgactggcccttcgtgaccgcgatgatcaacattgatttcgcgaatgtcggtaaatgggccgagaacgctcaaatttcctacacgacgtataccgatctggcgcagaagccgcaggtgtacgccctcatccgcaaagatgttgaacgcgccaatgccgatttacccccggcagcacggattcgccgctttctgctgttgcacaaggagcttgatgccgatgatggtgaactgacccgcacccgtaaggtacgccgtcgtctggtcgcccaacgttatcaagagattgtcgatgcgctctatagcgatcaggac

SEQ ID NO: 32615 - DNA, 948 bp, Chloroflexus aurantiacus
aagcgtgcgttgatcaccggtattactggtcaagatggcagttaccttgccgagttcctccttgccagggggtatgaggtgatcggcatggtgcgtcgctcgagcaccgtcaatttcgagcgtatcaggcatattcaggacaaaatcacgctggtaagtggcgacctgctcgatgaagtgtcgctgatccatatcctgcgcgagcatcgcccacacgaggtgtacaatctggctgcgcagtcgtttgtgcagacatcgtggccccaacctgtgttcaccggcgaaacgaccgctctgggtgtgacccgcttacttgatgcggtacggattgttgaccccgaaatccgcttttatcaggcgtcgagcagtgagatgttcggcaaagtggtggaggtgccccagaaggagacgacacctttttatccgcgaagcccctacggggtggctaaggtctatggtcactggatcacggtcaactatcgtgagagctacggcatgcacgctacgtcgggcattctgttcaatcacgagagtccgcgtcgtggtctcgaatttgtgacgcgcaagatttctcatggcgtggcgcgaattaaactcggtctcgatgaagaactacgcctgggtaatcttgaagcgcggcgggattgggggtttgccggcgattacgtggaggcaatgtggctgatgttgcagcaggatcagccagaagattacgtgatcgctaccggtgagacccattcggttcgtgagttttgtgaactggcatttggttatgttggtcttgactatcgcgattatgtggtgatcgatcagcgctttatgcgtccggctgaagtcgatttgctgatcggtgacgccagcaaggctcgccaaaaactgggctggcaaccacgcactacgttccctgaactggtgcagatgatggttgaggctgatctacagttagtt

SEQ ID NO: 32616 - DNA, 1332 bp, Chloroflexus aurantiacus
aatccaaccattttcaaagcctacgatattcgtggcatttatccgaccgagcttaacgaagaggtcgcctatttgattggtcgggcgttcgtcacttttctcggtgccgaaacggtgattgttggccgggatatgcgcacatcagggccagccctgttcgacgccgtcacccgtgggattatggatcagggtgccgatgtggccgatattggcatggtcagcaccgatcagtactactttgcctgtacgcaacttggcttccccggtatgatggtgacggcatcacacaaccccaaacagtacaatggcttcaagatggtgcgccggatgccgtacctcttgtcgggtgatgagggtattcaggatttgcgccggttagtcgagagtgaagcctttccgaccccaacccgccgtggtcagcgccgggagtacgacttcaaagagcaattcgtgcagaaggtgctctcgttgattgatgtagacgctatcaagccgctgaaagtgattgttgacaccggtaacgggatggtagggccgattttgcaggaggtgtatgcccgcttaccgatccaattgaccgggatgtacctcgatcccgatggtacgctgcccaatcacgggcttgatccgctgatgccggaaaaccgcgccgaattgcaacagcgtgtgaaagatgagggagccgacatcggcttcgcattcgacggtgacggtgatcgtttcttcgcgattgatgatcgcggtgagtttatttccggtgattttctcacggcaattctggggcgttacctgcttgagaaagaaccaggcgcaaagattctctacgacgtgcgggcatcgtgggcggtacccgatgaggtgcgtgctgccggtggtgttccgctggtcgaacgggtcggtcacgccttcatcaagcgccgcatggccaatgaagacgcaatctttgccggtgaagtctccggacattactacttcaaagccttcgcgttcgccgactcaggcatcattccatcactctacctgctcgaaatgctctcgaagcgcggggtcaagatgagcgaactgctcggtcggctggagtcgcgctacttcatttcgggtgaaatcaactcacgggtcagcgatgtagccgccaagctcaatgagattgccgaacgctacagtgatggcaaaatcgaacgaattgacggcgtttcggtgagttacgatacctggcactttaatgtgcgcgggtcgaataccgaaccgctgatccggctcaatctcgaatcgattgcctcacgcgaagagatggaggcaaaacgcgatgaggtgctggccgtcattcgttcg

SEQ ID NO: 32617 - DNA, 1653 bp, Chloroflexus aurantiacus
tatgttcagcgcaccatgttgcggcgctgggtgtctattgctcgccgcttccgtatgatggcggttgagcttgggggcatgcagatcaagctcggtcaattcctctcatcgcgggccgatattattcccgatgtcgtgcgccgcgagttgaccggtctccaggatgaagtgccccccgcacccgccggccacgtgctggaggtgattttagaggaactcggtgcgccacccagcgagatctttcgcagctttgagaccgattgtgtcgccgccgcatcgctaggacaggtgcactatgccgtgttgcacgatggccgtgaggtggcggtaaaggtgcaacgcccctggatagataagattgtcgaggtcgatctgagcgcagtgacctgggtcgtgcgcctgatcaaaaactatccgcccattcgccggcgtgccgacctggaagcgttgctggccgaatttgcccgtgtgctcgtgcaggaattggactatgtgcaagaggcgcgttcggcagcgacgttccgccagaactttgctaaccatccggggatttacattcccgaaccgatcttcgagttaacgacccggcgtgtgttggtgatggaacggatcaacgggattaagatcaccgacctgcataccctcgatcagttgggtgtcagtcgggttgagctggctgcccgtttgaacaattgctacctgaaacagtttttcattgacggcttcttccacgctgatccgcatcccggcaatctcttcgtgcgggtagaaactgcgctggcgcccgttcagccatcaccaccggtaacatcggttagtcgtaatggccacctctcgatggatgcggttgaggccgggctgccgattgacactcctccagatgaagtgccagccggcacacccttcacgctcatctttgtcgatttcggcatggttggtcgtctgccaccgcaaacgatggagattatgcggcagggtgtgttgggtctggcaaccaacgacgccgaccggattctgaactgtctcgaacaactcaatatgatcctgcccggtgccgaccggcgggcaatcaagacggctatcgagacgatgttgcgctactcgttcaaccgcaccgtgcgcgagctgaccaacctcgatgtcgaggcgattatggccgagacgaaggatttaatttacgatctgccttttcagattccccaagacctgctctatttggggcgggcgttgagcatggttgccggtctcgccactgagatttgccctgacatcaatctgttccatgagctacgaccattcgcacgagcgatgctggctcaagaacaacgcaatggcaattgggttgagaagttgcagcaagagctaactgaacttggtcagatactgatcgggctaccacggcagatggatgcctactaccgggcggcaaatcggggcgaattgcagacccgttccgatctgagccggcttgaacgcagtatgaaacgggttgagcgggcgactgaccgcttgatggggggaatgctcgcaaccggcctgttcctcggtggcgtgcagctccgcactcgtggtctggaacgggaagccaaccgggcctggtgggccgcagcagcggcgattgtgtgggcactctggccgcgcaacgagcgctgg

SEQ ID NO: 32618 - DNA, 1320 bp, Chloroflexus aurantiacus
ggcgaagccattcaaatcagcaacgggcgcttgcaagtacccgatcatccaattattccattcgtagaaggtgacggtaccggacgtgacatctggcgggcaagtgtacgtgtcttcgacgcggcggttgcactggcttacggcggaaagcgtaagatcgagtggcttgaggtgttggcaggcgaaaaagccttccacgagacgggtaactggctccccgacgagacaattgagacgtttcagaagtacctggtcgggatcaaaggcccattgacaaccccggtcggcggtggcattcgctcgttgaacgttgccttgcgcaagcatctcgatctctacgtctgtcagcggccggttcgccattttgccggtgttccttcgccggtcaagcacccggagaaggttgatatggttatcttccgtgagaacacggaggatgtttacaccggcatcgagtatcgcggcggtagcgaagaagcggcgaagatcatcgcatttttgcagcgtgaattcccgaaggatttcgacaagattcgcttcggcacgcctgaaaagactgatgaattccgccaactgatcggcgaagaaccggaaggaaagattgaggttggcatcggtatcaagccaatcagccgcattggtaccgagcgcatcatggcagcggctattcagtacgccattacctacaagcgcaagagcatcaccctgatgcacaagggtaacatccagaaattcaccgagggcgctttccgcgattgggcctatgaatatgctgagcgggcctttggtgattatgtctatacgtgggcacaatgggagcgcacgaaggctgcgcggggtgaagcagcggcgaatgccgagcagaaagaggcgctggccgccggtaagattctggtcaaggacgcaattgccgacattatcttccagcaggttctgacccgccccgatgagtttgatgtgattgttgcgccgaacctcaacggcgactacctctctgacgccctcgcggcccaggtcggtggcatcgggatcgcccctggcggtaacatcaattacgtcaccggtcacgctatcttcgaggctacccacggtacggcaccaaaatatgccgatcttgacaaggtcaaccccggctcagtcattctgtcgggtgagatgatgctgcgctatatgggctggacggaagccgccgatctgattattgccggcctcgagcgcaccattgccgacaagacggtgacatacgactttgcccgtctgatggagggcgcgcgcgaggtgaagacctcggagtttgccagcctgatcattgccaacatg

SEQ ID NO: 32619 - DNA, 2475 bp, Chloroflexus aurantiacus
cgatttaccgaaaaagcgcaaaatgccttccatattgcgcaagagattatgcaggagcatcaacattcacagctcgatgttgagcatctctttctggcgatgctccggcagcgtgatggtctggcagctcgtgcgttggcgcggttgaacgtagacccccacgaggtggaacgacgtgtcgaacgcgagctggaaaagctccctaagattctcagcccatacggtatgggcagtcaggtctatattacgccacgcacgcagcgattagtcaagcgggcagaggaagaggctaaccgcctgggagaccagtatgttggccttgatcatctgctgatcggactggccaatgagcgtgatggcccatcggcgcggattttgcagagttatcagattgatcaggagcggatttatcaggtgttgatggagattcgtggtagccaacgcagcgatgacccgtcggctgagagccgctacgagattttgagcaagtatagcgtcgatttaaccgagctggcccgtgaagataagctcgatccggtgattggccgtgaagccgaaattacgcgggtcattcgcatcttgtcgcgacggacaaagaataatccggtgctggtcggcgaaaccggcgtcggcaagacggcgattgtcgagggattggcccagcgtattgcgcggggtgatgtaccaccgaccttacgtgatcggaagctgctggcgctcgatctggccgggatggttgccggttctaagttccgtggtgagtttgaagagcgcctcaaagcggtcatggacgaggtgcgcaatgcgaaggggcggattattctctttatcgacgaattgcatacggtcgtcggtgccggtgctgcaaccggtagcatcgacgcctcgaatatgctgaaaccggccctctcgcgtggtgagattcaggtgatcggcgcaaccaccatcgatgagtaccgcaagcatgtcgagaaagatgctgcccttgaacggcgcttctcaccggttttcgtcgaagaacctgacccggagacgacggtcgagatgctgcgcggcctgcgcaagcgctacgaggagcatcatcagcttactatcagcgatgaagctctacgggcagccgttcagctttcgagccggtatattaatgatcgcttcctgcctgacaaggcgatagatttgatcgacgaagccagtgccaagttgcgcatcgatatcttctcgatgccgcctgaattgaaggctaaagaggaagaattgacgcgacttcaggccgaagaggaagaggccggtgcccgacgtgattacgagcgggctgccctgctccgctcccgctaccttgccctccaggcccagtttgaagccgagcgcaatgagtggctggcacgcaacaacctcgatgaagttgtcgatgatgaagatgtggcccagatcgtctcaagctggacgggtgtgccggtcagtcgtatgctcgaaaccgaacgcgagaagctcatccatatggaagagcgattgcacgagcgcgtgatcggtcagcacgaggcgattgtcgccctgagcgatgcaattcgccgtgcccgttctggtctgcgcgatccacggcgcccgattggttcgttcctctttgttggcccaaccggtgttggcaaaactgagctggcgcgtgccctcgccgagtttatgtttgacagcgaagaggcgatgacccgcgtcgatatgagtgagtatcaggaacgccacaccgtcagtcgcctgatcggtgcgccacccggttacgttggctatgatgaaggtggtcagttgaccgagagcattcgccgccgaccgtaccaggtcgtgctcttcgatgagatcgaaaaggcgcatcgcgatgtgttcaatgccctcttgcaggtgcttgacgatggacgcttgaccgacggtcaaggacgcacggtcgattttcgcaataccatcatcatcatgaccagcaatgccggcaccgaacatctgcaaggcggcgggattggtttcaatgtcgggggcaaaaacgccaaaacgattgatatgcgtgaggcgcgaaagaaggtcgatgaagcgctgcggcagaccttccggcccgaatttttgaaccggatcgatgagatcattctcttccatccgctttcgatggacgatctgaccaggatcgtcgaactccagatcgccgatctggtggaacggctgcgcgaacagcaaattggtctcagcttgacccaggctgccaaggaatacctggtgcaagaggggtacaatccggtctttggtgcacgaccgttgcgccgcaccatccagcgcctcctcgaaaccccgatctcgcgggagctgctgcgcggtatgttccgggccggtgatcagatagaagtagatgtcgagaatggtcaactggtcttccatcgcggtggcatcttgacaatggaagaacatcgcccggctgaacctcttgatgcctgaactgta

SEQ ID NO: 32620 - DNA, 1419 bp, Chloroflexus aurantiacus
atgcgtcgcacaaagattgttgccactctagggccggcgaccagcacccctgaacggatcgccggactgattcgggccggtatgaacgtcgctcggctcaacttctcgcatggtacccatgccgagcacgcagcacggattgcaatggtgcgacgggcagcggcggaggctggacggcatgtagcgattctgcaggacttgcaaggcccgaagattcgtaccgggccacttgaaaatgggcaaccggttgaactggttgccggacagcggtttgtgattacgactgagccgatcgttggcgatgcgcatcgagtcagtaccacctatcgtgcgttgccactcgatgttcgtccgcgggatcggattcttctctcagatggcctgatcgagctggttgtgaccggccataccgacaccgaagtggagacggaagtcgttcacggtggtcggctccgcgaacatcaagggattaacctgccgggagtgcgggtcagtgctccggctgcaaccgagaaagacctggccgatctggcgtttggtctcgaacagggagtagattatgtcgcgctctcgtttgttcggcgcgccagtgatgtgcgtgaggtgaaagagtttatccggcgggcaggtaaacaaacaccggtcatcgccaagatcgagcgtccggaggcgcttgacgtgttgccggagattctggctgaagctgacgggatcatggtggcgcgtggtgatctgggcgtcgagatgccaccggagcgggtgccgattgtgcagaaacagattattgccgccgccaatcaggcgctgcttccggtcattacggcgacccagatgctcgagtcgatgatccacaacccgcgaccgacacgggctgaggccagtgatgtggcgaatgccatcattgacggcactgatgccgttatgctcagtggcgaaaccgctgctggggcctatccgattgaagcggtgcagatgatggcattaattgctgatgcggttgaagcatcgtataccggtggccagcactcgacaacaccgcggtggtcgattgcgccggcgcaatcgacgccgcgtgccattgccgcagcagcatgcacaatcgccaactcattgccggtacgtttcattgtcgttctcacccaaagcggtgcgagtgcccgtctggtatcgcactaccggcctgaagtgccaattctggcattctgtcccagtgaagagaccgcccgccgtaccagtctctactggggtgtcacccccattgtgatcgaggcgcgtgatcgcctcgacgaacttgaacaacagattgtgcgcatgatgcgcgaaaccggaatggttcgaaaaggcgatttgatcgtactgagcggcggccatccggtttaccgctacgggccgaccaatttcctaaaggtgatcacgata

SEQ ID NO: 32621 - DNA, 744 bp, Chloroflexus aurantiacus
ggcaaaatagccatcgttaccggcggtgcgcaggggatcgggcgcgcaaccgctcttgcactggcccgtgaaggggccgcagtggtaattgccgaccgtgatgaagcggctaccacggcactggtttccggtatcaacgcctggggcgggcgggcgctggccgttatcgccgatgtcagtgatgaagccgatgcggcccggattgccaatgaaacagtgctaacgttcggcggcattgacctgttggtgaacaacgccgggattcaacaaccggggacaattgaaagcacgaccgttcagctctggcaagagattattgccgtgaatctgaccggtgtattcctggtttcgcgctttgtgatgcccgaattacgccgacgcggcggtggggccatcgtcaatgttgcttcggtctacgggttacgggccgaagctggttgggccgcttactcagcctcgaaaggtggggtcattgcgctcacccgggcaatggcgctcgatggcgctgccgatgggatacgggtgaattgcgtctgtcccggcatgattgacacctcactgctccgcgccaatgccgctttgctgaacgcacaacgtcccgatgaagcgttacgcagctttgcgcggcgggtaccacttgggcgcctgggcaccccagaagaggtggccagtgtcatcctttgcctgctcagtccaaccgccggctatctcaccggggccgtcattaccgcagatggtggctgg

SEQ ID NO: 32622 - DNA, 2616 bp, Chloroflexus aurantiacus
cgctggcatgcactcgaactaactgatgtttttacccatctgaacagctcacccaccggtttgacgccggatgaggcagcaaaacgcctgtcgatctacggcccaaacgagttacaggcagcagcgcgcgtctcaccatggacattgctactcaaccagtttaagaatgtcctgattatcatcctcttgatcgctaccggtctgtcattgttgctcggtcacgggatcgaatcagttgccattatcgttatcgtgctctttgccgtattgctcggtttcatccaggaataccgtgccgaacgggcaattgaagcactccgccgtatggctgcacccaatgcgactgtgttacgtgatggcattgagcagtctgtccccgcgcacacactggtgcccggcgatgttgtgctattacgcgctggagatcgcgttcccgccgatctccgcctcattgaagcgctgaatctgcaagtggaagaggcagcgctcaccggcgagtcggtgccggttgagaagactgccgccatcaccttgcccgccgaagccccggttgccgaacgcaggaatatggtctacgccggaacatcgatcagttatggtcgtggtcggggagtggtggtagccaccggtatgcagaccgagttcggggtgattgccacgatgctgcaaacgattgagaccgggcgcacccccctgcaagacaacctcgaccgggttggacatatccttgcccgatcagccctggtcattgtcgctgtgattaccttgctcggcttttggcgcggccaaccaccggtcgagatgattatcttcggcatcgcactcgcggttgcggtcgttcctgaagcattaccggcagtggtaaccatctcactggctatcggcgttcagcgcatggtgaagcgtaatgcgttaatgcgtcggttgccggcagtcgaaaccctcggcagcacctcggtcatttgcaccgacaaaaccggcaccctgaccaaagacgagatgacagcgcgccggctctttgttgccggccgctggtgggacattaccggttctgggtacgatccggtgggcgagtttcggtgcgatgatcggacaacacctgctgatgaagctgtacgtcggttgctcgaaggtgcggtgctggcatccgatgcccgcattgtctaccgcgaacaacgctggcatgcccagggtgatccaaccgaagcagccctggtcgtcgccgccatcaaggccggcctggttgttgaggaggtcgtaagtcgagcaccgcgcattgctgaaatccccttttcgtcggaaacgaaacggatgatcaccctccatgaagtcgagggcgaaagagtcgcttacgctaaaggggccccagaggtgattgtcagtgcctgtagtcattggctaacccccaacggcgttgccccgttgcagcctgaagatcgcgacaccatattgcaggccgcgcagactatggccagtcgtgccctgcgtgtgctggcagttgccaccaaagccaccgccgatgtagccgatgctgaacacgatctgactctgctcggtctggtcggcatgatcgatccaccccgtcccgaagccaaagcagccattcaaacctgtcaacaagccggtattcgggtcgtcatgattaccggcgaccacccgttaaccgccgccgccattgcgcgtgaactgggtctgctcacccacgggcgcgtaataaccggtgtcgaactcgatacgttgagcgacgaagagtttgcgcgtactgtcgagactatcgatgtctatgcccgcgtcgcgccagtacacaaactgcgcgtggtgacgaccctacagcaaaagggatatgtgttcgcgatgaccggcgatggcgtgaacgatgcacctgcgctgaagaaggccgacatcggcatcgccatggggattaccggtaccgatgtcaccaaagaggcatcggccatgaccatcaccgacgacaattttgcgtcaattgtggccgctgtcgaagagggacgacgcatttttggcaatatcaagaagtacctgatgtatctgctctcgtcgaatatcggcgaaattacgctgatggccggggccaccttcgccggcttacctctcccgctgacagcagtacaaatcctctacgtcaaccttgccaccgatggcctgccggccctggcattagcggttgatccacccgaagatgacttaatgcgccaaccaccgcgtgatcctcgtcggggcatctttacccgtccggtcgttgggttaatgctagccggtggtttgtggtcagcattggtcaatatcagcctcttcgtctgggccttgcagagtgggcgcggtctcgcggaagcaatgacgatgacatttgtctcgctcgtgttgatccagtttttcaaggcgtataacttccgctcagatcacctctccgtcttccatcgcccctttgccaatcgctggctcaatctggctattctctgggagcttatcttactgctgggtgtggtctatctgccattcttgcatgaaccatttggtacatttccactctcgctgatcgattgggtaatcatcggtggtgtcgctttgaccattgtcccggtgttagagctggtc

SEQ ID NO: 32623 - DNA, 1086 bp, Chloroflexus aurantiacus
gccgatccgcttgagttacttggcattgattatgttgagttttacgtcagcaatgcccgtcaggctgcccatttctaccgcaccacactcggcctgcgtccggttgcctacgccggtctcgaaaccggggtgcgcgaccgggccagttatgtgctcgaacgccgcaatgtccgcttcgtcctgaccgctcccctcctgcccgatcacccgattgcgcagcacattgcccaccacggcgatggggtgaaagacattgccctgcgcgtccgtgatgcggtgactgcgtatgaaacagcggttgcccgtggcgggattccggtgcaggcgccgaccgaatatgtggacgaacatggccggattatcaaggcgacgattgccacctatggcgacaccgtccactcatttatcgagcgtgaaaactaccagggaacattcatgcccggcttccagccgatcactacaccactaccggtaccggaaaccgggattgccgccattgaccacatcgtcggcaacgtggaactgggggcaatgaatcgttgggtcaactactaccgtgatgtgctcggcttcagccagttggtacacttcgacgatcacgacatcagcaccgagtacagtgccctcatgtcgaaggtgatgcaaaacggtaccggtcggatcaagttccccatcaacgaaccggctgaggggcgccgcaagagccagatcgaagagtttcttgagtactacggcggccccggtgttcagcacattgccctggcaaccggcgacatctgtgcgaccgttgatgcactgcgcgctgccggtattccgtttatccacgtacccgacgcctactacgatgatctcgaagagcgggttggcaaaatcgacgagagccggcaggccctccaggagcgggggattctggttgaccgtgatgaagaggggtacctgctccaaatcttcagtcagccactccaggatcggccaaccctcttcatcgagattatccagcgcaaaggcagccggggcttcggcaagggtaatttcaaggcgctcttcgaggccattgaacgcgaacaggcccggcgtggcaatttg

SEQ ID NO: 32624 - DNA, 1860 bp, Chloroflexus aurantiacus
atgtgtggtattgtgggctatattggtggacgtgaggcgaccgaagttgtgctgaatggccttcaacgattggaatatcggggttacgattcggcggggatcgctatctaccatccagatgccgggttgcagttgcgtcgcagtgttggcaagctcatcaatttgcaacaacgggtgcaggccgatccaccgcgtggccgggtcggcattggtcatacgcgctgggccacgcatggtggcgtcaccgagcaaaatgctcacccccaccgtgatgccagtggcacgattgtggtgattcaaaatgggattgttgagaattatctaagcctgaaggggcgtctgatcgaattggggtaccagtttgagtcgcagaccgatactgaagtgattgcaaagctgattggacattactatcaagagcagcgtgatctggtcgcggccacacgtcaggcgttgcaggaactacgcggtggcaatgcggttgtcgccttttgtattcacgagccggacacgctggttgcagcgcgcctgggcaacgccggtggcatcgcgattgggcttggcgacaacgaacagtttatcgcttccgatattccggctatcctcgattacacacgcaatctgatctttctggaagaccatgacattgccgttgtccggcgtgacgaggtaacgattacccggctcgatggtacaccggttacgcgcgcagtacacagtattgcctgggaccccgtggcggcagcgaaaggtgattatcgccactttatgcacaaagagatcgatgaacaaccacgggcgctgatggatgtgttgcgcggacggatcgatcaggagcgtggtctgatcacgctcgaagacctccgcctcgacgatcaggacttacgtcgggtccgtcgtatctacgctatcgcgtgcggtacggcgtggcacgccgccttggtggcgaagtttatgattgagaatctggcacgagtgcgggttgaagtcgactatgccagcgagttccgctatcgccagccgatattgcagagcaatggtgagcgcgatgcgctgattcttaccttcacgcaaagcggtgaaacagtcgatacgctggccggcatggaagaggcacgcagacagggcgttcccagtgtagcaatcgttaatgccatcggcagtcaggccgcccggctggccgatggcggcccgatctatctgcacgccgggccagaaattggggtcgcttcgaccaaagcctttacctcgatgctggttgcaggctacctgtttgcactacgtctggcgcaggcgcacgggacactgacaccggcccagattcgggaacatattcaggcgctggtggaattgccggggaaggcggcgcaggtgatcgagcaagtcacgcctgtatgtgtcgagttagccgagcgctactatcgggttggcaatgccctcttcctgggtcgtcaaatcaactacccaatcgcgctcgaaggcgcgctcaaactcaaagagatcagctacattcacgccgaaggctacccggcaggcgaaatgaagcacgggccaattgccttgatcgatgagggtatgccggttgtctgcattgctacccgcgaccacatttacgaaaagatgatcagtaacgtcgaacaggtgcgtgcgcgtcacggccaggtgattgcaatcggtcacgagggtgatgagttgttggcggcaaaggcgaatcatttcatcggggtaccggcgacattaccactactccaaccggtgttgaatgtgataccgttgcagatctttgcttatcacgttgccgtgttgcgcgggtgtgatgtcgatcagccgcgtaatctggccaagagtgtgactgtggag

SEQ ID NO: 32625 - DNA, 1971 bp, Chloroflexus aurantiacus
cggagaagcggttttgcccaaattacgcccatgttcaaccgtatcctgatcgctaatcgcggcgagattgccgtgcgtattatccgcgcctgtcgcgaactgggcattagcccggtggttgtctactcggctgccgatgccggtgcgctgcacgtgcgcatggccgatgctgccgccttgatcggcccaccccctgccgcacaaagctatttgcgtgccgaggccatcgttgaagcagcgcttcaactgggtgcccaggccatacaccccggctacggctttctcagcgaaagtgtcaaactggccgaacagtgtgcagcggctgggatcacgtttatcggcccgccaccatctgcgattgctgccatgggtggtaaagcggaagcacgtgcgctggcgcaggccgccggtgtgccggtggtgccggggtatgatggtgaagatcagagtgatgagcgcctgctggccgaggcgcaccgtatcgggccaccactgctgatcaaggcgagtgctggtggcggtggcaagggcatgcgttccgttggtgatctggccgcagtacccgccgctatcgaaggcgcccgccgtgaagcccgtgccgccttcggcgatgaccggctgatcatcgagcgtctcgtcctccgcccccgccatgttgagattcaggtgctggccgatcagcacggcaatgtcgttcacctcggcgagcgcgactgttcgatccagcgccgccaccagaaggtggtcgaagaggcaccatcgccggcgctgacccctgctctacgcaacgcgatgggccaggctgcggtggcggtcgcacgagcggcagggtatgtcaatgccggtacggttgaattcattcttacccctgatggtgaattctactttctggagatgaacactcgcttgcaggttgagcatccggtcactgaactgatttgcggttatgacctggtgcacttgcagatcgcgattgccgccggtcagccacttccgttccgacaagaggatgtcacggtgcgcggtcacgcaattgaagtgcgtctctacgccgaagaccctcgcacctatctgccggcggttgggaaggtggcgctgtttgtgccgccacaagggccgggcgtgcgcgtcgatgccggcctgaccagcggcgatgaagtgaccgtccattatgacccgctgttggccaagattattgtggccggagctgatcgtcagcaggcggtggcccggctgcgccgggtgctgcgcgagatggtggtgctggggccaacgaccaatttaccgctcttgcaggcgattgccgagcacccggcatttgccgccggtgctactcataccggcttcctgagtgaacacgaaggactggtaccgccacccgcaccaccaccgtgcgaagtgctggtcgccgccgccgtcctgacagttaccgccgaaccaccggctcgcgacccgctggccagggtctggcgtctgggtggcgacaccatcccgctcacttttagctcccatggcgatcaccgcctgcgggtagcgccgtcaaccagcggctggcatatccatggcgatggctggggtgtgcagacaacactggtctatcgtggtgaccacgaactggctctggacattgatgggcaacgccagcagttcttctttgcgcaggccgatgacggctggctgatcgcatggcgtggtgaagcgtaccatcttacccgccccgctcccttgaccgccgatagcgtgacgcgcagtggtgatcagaatgcggccagcttcactgcgccgatgcccggcaccattgtgcgtatccacgttgccgtcggtgagcaggtacgcgaagggcaaccactgctggtgttggaggcgatgaagatggagcacacagtcgtcgctccgtatgccggcattgtccgtcgtctaccctaccaggccggtgccagcgtcgcggctggcgctcacctcgttgacctt

SEQ ID NO: 32626 - DNA, 945 bp, Chloroflexus aurantiacus
acgatgctcggtgtgcgcaatgggtttcagggactgatcgatggcgacatccacgaaatggattggatgagcgtaagtggttgggcaacgatgggtggcgccgagctgggcaccaatcgcaaggtgccgcaaggcagcgagctataccagattgcccgtaacatcgagcgcttcggaattgacggtatcttgatgatcggtggttggaccgggtatcaggcaatctacaagctgtacagcgagcgacacatcttcccggcattcaacatccctatgatctgcttgccggcaacgattgacaacaatcttcccggttctgagctgagtctgggtgcagataccgcattgaacagcatcgtcagtgcaattgatcggatcaagcagtcggcggtggcttcacggcgctgtttcattgtcgaagttatggggcgtgactgtggttatctggccttgatgagcggattggcaaccggcgccgagcgggtctacctccccgaagaaggcatcagcctgcgcaaattgcaagccgatctcgacgagatgatgcgctggtttcgtgctggtaagcgcctgagtttgatcattcgcaatgaaaaagcgaatccgatctacaccacctcgttcatctgctcgttgtttgaagaagagggtggtaagctattcgaggtacggcaggcgattctcggtcatttgcagcagggaggtgatccttcgccgttcgaccgtattcaggctacccgtctggccgtgcgctgtatcgagttcctggtcgagcacgctgaccgtcgcgaaccaatcggggcgttcatcggctatcggggcggtaaagtccagatacatcagctcgacgatatgccacgcctgatggatccggtgcatgcccgtccgcgagagcagtggtggatgtctttgcggcaaatgaccgatttgctcacgacgccgcca

SEQ ID NO: 32627 - DNA, 1431 bp, Chloroflexus aurantiacus
ataagttccgacaatctccatggtgaaggtgatcctatggcaggcgctcaacaacgtccgcgttaccactttttgccgccggcaaactggatgaacgacccaaatgggcttattcaatgggaagacacgtttcacttgttttatcagtacaaccccgccggcgcatatcatcgccatatccattggggtcacgcaaccagtcacgatctaattcactggcaacatcaaccgattgccctctcaccaacgccaggtggtgctgatgctgatggttgctggtcgggctgtgccgttaatgaccacggcacacccaccctgatctacaccggctttcgattgcctgaagtacaacaaccgtgcctggcagtcagtcacgatggtttacaaacctggcagaagtggccagagccgatcattgctgcaccaccgccggaactcgatctgcttggctttcgcgaccatactgtctggcaagaacagggagtctggcacatgctgatcggttcgggcattcgtggtcagggtggtaccgtcttgctctaccgctcgcccgatttacgacactgggaatacgcaggcccactcttgatcggtgatgccggtcagttcgatccggtctggacgggtttgctctgggagtgtccagactttttcgcgctaggcgaccagcaggtgctcgtctgctcggcctgggatcgacgaccatactacacgattgcgatgatcggcgcgtatcgggatggccgctttgtcccgcatacaacccacaaactggattatggcgacgctcatttctacgccccgcaaaccatgccgatccgcgatggacgacgcatcatgtttgcctggtcaatggagggacgaagcgaggagtccattgtagcggcaggttgggccggggtgatgacgctgccacgcgaggtgaagatagccgatgatggtcagatcgtaacattgccggtgaacgaagtccagcagttacgtcaagacgagatcgttatcccatcaacgcgggtcatgccgcacgacatccactggctgcccgtccacggtgcgcagcttgaggtagagttaatcctgcgcccaccacggcatggaacgtgcaccgtcatgctgcgggccagccccgacggcagcgaagcgaccgttttgcgctacaacagccgaaccgcaaccctcaccctcgaccggcgccggtcgagtctggccggtgatgtctggcgtgacgctcaccacgccccccttactctgcacaacgatgagccgttagtgctgcgcatctttcttgatgcctcgttgattgaagtctttgccaacgaacgccgttcgatcaccagtcgtatctacccaacccgccctgacagcacgggtattgcgatttgtgccgacgaggctgcggttgatctccttgccggacgggtgtgggagatg

SEQ ID NO: 32628 - DNA, 1110 bp, Chloroflexus aurantiacus
acaatggatgcagtgcttgtcttagaagatggtcgcgtctttcccgggcggtcgttcggtgccccgggtgagcgtgttggtgaggttgtttttcacaccggcatgaccggctatcaagagattttgaccgatccctcgtactgcggtcaactggtcacgatgacagcaccgcacattgggaacaccggcgtcaacgattttgacccggagtcgatccagccgcaggttgccggttttattgtgcgtagctacagcgaacactacagctcatggcgtgcgcgtggcagtctctctcaactgctgcgcgactatgggatcgtggcgattagcgatgttgatacccgtgccctcactcgccatatccgtaccgccggggcgatgcgcggcattatctccacaaccggcgagtcgatagagtcgttactcgcgaaatgtcgggccgcgccgccgatggaagggttggatttaacgcaagtggtgacctgtcccgaaccgtaccattgggcaaccaacagtgtgccgtttaccccgccctacccgaacggcccggcgcaagaactgcgcttccacgttgttgcttacgacttcggcctcaagcgcaccattttgcgccgtctggtcgatcatggctgtcgggtgacggtggtaccggccacaactccacccgaagatgcgctggccctccaacccgacggtatcttcttctcgaatgggccgggcgatccggcagcggcgacctatgctgtggccacgctgcgctcgctgctcggtaaactcccgatctttggcatctgtctcggccatcaattgatggggctggccctcggcgggcgcacctacaagttgccgttcggccaccacggtgccaaccatccggtgcgctatctgcccaccggtcgggttgagatcacctcgcagaatcatgggtttgccgtcgatccggactcgttgccggcaggtgttgttttgacccatatcaacctgaatgatcagaccctggagggttttgattatcctgaattgcagtgcttcagtgtgcagtaccaccccgaagcagggccagggccacacgatgcaacctatctctttgcccgctttgccgaggcaatg

SEQ ID NO: 32629 - DNA, 1002 bp, Chloroflexus aurantiacus
gtcgttgcccgtctgtccgccaatgaaaatccacttggcccatcaccgcgggctatggctgccgtgcaagaggcgctgagcacgatccaccgttatcccgacgcaagtggcgtggccttgaaggaggcattggccgctcgcgtcgatctgcaccccgaccaggtgatgctgggcaatggttcagatgagctgattatgcttatctgccatgctatgctcggcgagggtgatgaagcagtcctggcgcagggatcgtttatcagctatgcccgccggattcaggcccaaggcgcgattgcccgtcaggttcctctgcgcgagatgacacacgatctcccagccatggctgccgcgatcacaccgcaaacccgccttatctttgtatgtaatcccaacaatccgaccggtaccacggtcggcgccgctgaattgatggcatttctcgaacaggtaccgcctgatgtactggtcgttgttgatgaagcctatctggaatttgtgacgcgcccggattttcccgatctgctgccgttgttgcgcgacggacgcgataacctgctgattgtgcgcaccttcgccaagattcacggtctggccggtttacggctgggctacgctttcggcaacgccgatctgatagcgtacctggaacgggcgcgtccggtcttcaacgtgaacgttctggcccagattgccggccttgccgcccttgacgacgttgaccatctcgaacgctctctggcccatgccgctgccagccgggcattcctcaccgaccatctacgggctatggggatgacggtgatccccggtgaaaccaattttgtcgtcgccgcaattgccgatgatactgcagtggcagcagagcttgctcgccgcggggtgttggtcacaccgctgagtgggtggggcttaccgggctggatgcggatttcgtttggcactgcggaagagaaccgtgtgtttattgaggtactacgcaatttgatgtcaaaaggtacc

SEQ ID NO: 32630 - DNA, 1085 bp, Chloroflexus aurantiacus
attgctgtccttcccggcgatggaatcgggccagaggttgtggctgagggcgtgaaggtactacaggcgattgccaggcggttcggtcatcaattcacctttcacgaggctctgatcggtgggtgcgcgattgatgcgacaggagagccactaccagcggctacgattacattatgtcaatccgccgatgcggtgctgctcggtgcagtaggcgggccgaaatgggacgatccgcaagcccgtgtgcgcccagagcagggattgttgggcattcggaaagcactcggcctgtttgccaaccttcgtccggtacgcatctatccgcagttgatcaacgcctcgccgatccgacctgaacggttgcagggagttgatctgattgtcgtccgtgaactgaccggcggtatctacttcggcgagaaacgtcgcgaacgcactgccgatggcgaatgggccagcgacctctgcatctacaccgaggaagagattgtgcgcgttgtgcgcgttgcagcacggctggcccgtcaacgacgcggtaaagttactctggttgataaggccaacgttttggagacgagccgtctatggcggagtatcaccacacgtctgatgcaaaccgagttccccgatctgcaatttgagaccatgctggttgatgcgtgtgctatgcacctcatccgccgtccggctgatttcgatgtgatcgtcaccgagaatatgtttggcgacatccttaccgatgaagcctcgatgctggccggttcgatgggtatgctcccatcagcgtcactggctgatggtcggctgggtttgtacgaaccgatccacggctcggcaccggacattgccggtcaaggcaaggcgaatccactggcaacgatcctgagtgtagcgatgctcttgcgctactcgctcgatctaaccgcgaagcgattgtgtcgaagcggcagtggctcgggatcgaccgcgaatgtgaccgcatttgctttccggaccgctgggtcggccgaaccgcgtatccgaattctggatgcgcttatggccgatgcaacgaggccctcgcaccatcttacggagggcccgag

SEQ ID NO: 32631 - DNA, 666 bp, Chloroflexus aurantiacus
gatgtcatcgttgtcgaaggacttaccaaaagctacggtcatgtctcggtcttgcgcggtgttcatctgcgggttgcagcaggtgaagtgtacggcttgctgggaccgaatggtgccggcaagtcaacgcttatccatctgttactcggttttttataccccgatagcgggcggattcgcgtactgggaagcgctgatctcgaagcacagcgtcggcagattggctacatccccgaacggcagcgttatcacaactactacacaccacgcgaataccttaccttcctcggtcgtttcgatggcatgccggaaaccatcttacgcaagcggatcgacgagctactagagctaaccggcttaactgctgttgccaaccgctacctgcgcaccctctcgaaaggcatgattcaacggttgggcatcgcccaggccctgcttaccgatcccgatcttttgctaatcgatgagccaaccagcggcctggatcttgacggccagcaagaactgctcgtcttgctcaacgatgttcgccagcgcgggcacactgtcttgctctgcacccatcgtcttgctgaagttgaatatctctgcgaccgggtcggtattttaaccaacggtaaggttgcgcttgaggtgaatgtcgccgatgtacgacacatgaccggc

SEQ ID NO: 32632 - DNA, 1009 bp, Chloroflexus aurantiacus
atgattgtcgtcatgcaaaccgactcaacccctggacagattgaagcggtgttaaaccggctgcgcgaacacaatttgcgcggccatctgaccgttggtgaggagcgcacggtgatcgcggtggtgggggcagcgatcccgccaaccttgcgggaagagctagaacactttgccggtgtgaaggagaccctgcgcatcacgcaaccctacaagctggtatcccgtgaggtaaagcccagcgatacggtggtgacggttggtgatgtaaaggttggcggtgggcacctggcaattattgccggcccgtgctcggttgagagtgaagagcagattatggcgaccgcccgtgcagtacgcgaggctggggcgaacatgttgcgcggtggtgcgttcaagcctcgctcatcgccttacagtttccgtggcctgggtgaggttggtttacagttgctggcgcaggcacgtgccgagacgggattgccaattgtgaccgaagttatgactccggctgacgttgatctggttgcccgctatgccgatgtcttgcagatcggcgcccgcaacatgcagaattatcagttgctggaagaggtcgggcgtaccggcatgccggtgctgctcaagcgcggtttatcggctacgattgaagagtggttgttgtcggctgagtacattattgcccagggctaatccaaatgtgattctgtgtgagcgcggaatccgcacgttcgagacggcgacccgcaataccctcgatctgaatgcagtagccgtagccaggaagcgctcacatctaccggtaattgttgatccgagtcacggtaccgggaagtggtatctggttccaccattaaccctggctgcaattgccgccggtgctgatggtgtgatcattgaagttcaccccgatcctgatcgggcaaagtcggacggcggccagtcactgaacccagagaacttcatgggcctggtgccccaaatgcgagccatcgcgaaagttgttggcaag

SEQ ID NO: 32633 - DNA, 921 bp, Chloroflexus aurantiacus
gatctcggtgctatcgagcaacgtctgctggaatgtacgcagtcccgtgttgcggttatcagtgccgccggtatgcatacggtgcgctccggtggtaagcgactgcgtgctgccctggctgtgctggccgcacgcctcgggcactatcagcttgaacgggtgatccatccggcagcggcggctgaactgattcacgctgcctcacttgtgcatgacgatctggttgaccaggctaatcgtcggcgtgggcagatcacggtgcatgcgcgttgggacaacgacgtggcactgatggtaggcgattacttttttgctcttgccgccgccgagatggcccgtagccctgatccacggattattaccttctatgccgaggctgtccagacgatctgtgagggtgaactcagtccggtcacggttgccgagccttttgataaagccttgcgccagtatctctacaaaaccggggccaagacggcagtgctcttcgaggccgcctgcaaggccggtatggttgccggtggcggcagcgatgaagagattgctgcgctggggagctacgggtacgatctgggtatggccttccagatcatcgatgatgtcctcgattttatcggtgatgagcgcacccttgggaagcctgccgggaacgatttacgtcagggtacgattacgttgccgcttatctatgccactgctgcatcaccgagtcaggtcttacgcgatgtgcttttgcacactccaccatccgatacgttggtggccgaggtgatccgtgaagtgatcaatgctggtggggtggctgcggcccagaccgaggcggctcgctatatcgaccaggcggtaagtcaccttgagcggttcccatccagcccggctcgccaggcgttgatcgacattgcccactttgtgcttgagcgc

SEQ ID NO: 32634 - DNA, 1359 bp, Chloroflexus aurantiacus
cgtgatgacctgataaccgctctcctgagcgtcgttgatccggcaattgtgctgcgccggccagaagagctgatgctctacgagtacgatggctcagcccttgatcagggtatgccggaggtggtcgttgtgccgcgcactactgccgaagttgcggcctgtgtgcaggtggcagctcagcttggcgtgccaatcgttgcccgtggtgcgggcaccggtctggccggtggctcggtacccgaacagggtgggctggtcatttccctaacccgcctcaatcggattctagccatcgacccggtggcgcgtactgctcgcgtgcaacccggtgtagtcaacaccgatcttagtctcgctgctgcaccttacggtctccactttgctcctgatcccagtagccagcgcgccagtaccatcggcggcaatattgctaccaacgctggtggtccgcactgtctgaagtatggcgtcaccaccaaccatgtcctggcggtagcgctagtcttgggtgatgggcgggtgatcgaggtgagtcgcgctgcccttgatgcgccaggctacgatctgctgggggttgtggtgggcagtgaaggaaccctcgggatcgtcaccgaagcagtggtgaaattaacgccaaatcccgagtcgatctacacctttctggccatctacgacgatctcgacgcagccagcgagacagtatccgcgattattgcccatggcatcattcccgctgcgcttgagatgctggttgggcagggcatcgccgctgtcgaagccgcagtccaggcggggtatccgtctgatgcgcgggcggtattgttgatcgagctggatgggttgcgcgaagaggttattgcccaggcgcaagcgattgaacagatctgccaccattatggggtgcgcgagttgcgggcggcgcaagatgcccatcagcgcgagaagttgtgggccggtcgtaaaggcgctctggcggcctgcgcacggattgccccgcactatcacattcaggacggcgtcgtgccgcggtcgcgtctgccggaactgttgcgtctgaccgaagaggtggcggcccgccaccagatcacgattgtcaatatttttcacgccggtgatggtaatctccacccgctattgctgttcgatctccgtcacgccggtgcgcttgagcgggcagttgccgccagtgaagagattttgcaggcgtgtgttgctgccggcggtacgatcagtggtgaacatggtatcgggattgagaagcgtaattatctgggctggatttttggcccgtccgatctggccgccttcgccgacctgcgcgccatcttcgatgcgaatggggtgatgaacccctgtaaa

SEQ ID NO: 32635 - DNA, 2703 bp, Chloroflexus aurantiacus
gagatggatggggcagtcgccccggttgtgctcggcgggatgcggggtagtacgatcacgactgttccggatcggcttgagcggctggcccgcatggcccgtgggtttgtccggctgcgcaagaaagcgaatcgggacaagaaggtggcaatcatcgtctacaactatccgccaggtcaggggaaggtggccacggctgccctgcttgatgtgccggccagtctgattgcgatcctcgaccggctggcggctgaagggtacgatgtgggccgttacccccgcgatccggctgtctttgcccgctgccttgagggtctggtgagcgatcagccgctgccacccggccatccgccggtagtgattggtaccagcgccgaccgccaggatttttatcgctggctccggccaatcgatcaagagcggatcaacgcacggtggggcgaatttcccggtgatattgcaccgctcggtcgcgacaaggtgcggctggccggtacccagattgggaatatctttatcggtgtgcaaccggtgatcggtatgcccggtgacccgatgcgtctgctcttcgacaaagaaaacacaccgcaccatcaatacgcgctcttctaccgctatctcagcgagcagtttggagccgatgcaattatccatctcggtatgcacggtaccgccgagtggatgcccggcgtgcaactcggtgtgaccgaccgctgctggcctgatgtgttgttgggtgaggtgcccaatttctacgtctatcccatcaataaccccgccgaagccaatattgccaagcgtcgcggctacagcacgatcatcggtcacgccatcccgccgtatggtcgtgccgggttgtaccgcgaattgcaggccctgcaagacctgctgactgaatatcgcgagcgtccggcagctctggccgatgatgatcaaagccctgaagcggtagcgattatgcaaaagatcgctctgctcaatctggatcaggatttggtgcgccagcccgatgaaccgttcagccgttttgcgtcgcgtgcgtatgcgtatctgcgcgatctggcaaccaccatgatcacggatcggctgcatgtgctgggtagcgcaccaccaccggaagaacagcttacgctaatcgtcgaaacgctgaaggtgccacggggcgaactgcccggcctggccgatctgctgttgtcggcacggcagcccggtttgcgctacaacgaattactggcacaggcgcgtcagggtgatgccaccgcattagccttgcgcgaagagattgaaacccgctgtactgagctggtgcagcagactgtcttcggccagatgacccctgaacgggctgcgcagacctttggtctgccagtagcggaggttacaggtctggtacagcacgggcgggccttgctggctgcattgcgcgacaacacacaggagctggattttctgatgcatggtctggccggacgctacattccggcagcccccggcggtgacatcattcgcgatggtgtgaccgtgttgccgaccggacgcaacattcacagccttgatccgttccgcgtgccgacagatagtgcctatgagcgcggtgttcgcattgccgaggcgctcattgctgctcatcgcgccgagaccggtcagtacccggagacgattgcccaggtgctgtgggggctggatgcgatcaagaccaaaggcgagtcgattgggattgtcctcggcctgatcggagcgcgaccggtcaaggatggtcagggtaaggtgggtcgttatgccctgatcccactagctgaactggggcgaccacggatcgacgtgctcatgaccgcttccggcatcttccgcgatatttttgccggtaccatggatatgcttgatcgcctggtgcgtgaggctgcgtcggctgatgaaccaccgaccatgaactacatccgcaaacacgtgcaagagatgatggctaccgggaagaccttcgatcaggcgaccgcccgcatctttacccaggccgccggtacctacgggactgatgttgacgaggcgattgaaggcagcgcctgggaaaaacgggaagaacttgaggagctgtttatcaagcggaatgcgtatgccttcggtggacggcaaaacggtgaggcacgtcccgaagtcctgcgcaccttgctcggcacggtgagtcgagtggcccaggagatcgacagcgtcgaatatggtctcaccgacatgcagcactactacggttattcaggagccttaaaagcggctgccgaacgggccaccggtcagcgcgtaccgctcaattttgttgagagctttacggctgagaccaaactgcaaaccctggagcagacgctgcgggtcgaataccgcacgaaattcctcaacccgaagtggtacgagggcatgttgcgccacggccacaatggtgccgccgagattgccagccgcttcacctacatgctggggtggagcgccaccaccgatgcggtcgatcagtgggtctacgacgaagcagcccaaaccttcgtgctcgacgatgccatgcgaacccgaattgaagctctcaacccggcggcagcgcgcaatatggtagggcgtttgctggaagcgaacgcaagagggatgtggcagaccgatgaggcaaccctcgaacggctacgcgaactacacgccgacctggaagaccgtttagagggtgtg

SEQ ID NO: 32636 - DNA, 1199 bp, Chloroflexus aurantiacus
ctggcccggctcagggcattactagacattgccgggaatccacatcaacaactggcggcggttgtcgttgccggtaccaaagggaaggggagtacctgcgccttgattgaagctatggctcgcgccgccggtttacgggtgggtttatggacatcgccccaccttagctcgtatcgcgaacgcatccagattgatcgcgaaccgatctctcaggcgacgctgattcagcttgtgcgggatgtgcaaccgattgttgacgcctttgacaccgctacctacggtcgtcccagtacgtttgacattgggtttgtgatggcgatgcgccattttgtagcagctcacgtcgatctggcggtcgttgaggtcggtctgggggtcgtttcgatgctgcggcgaccattactccactcatcgcggtgatctcgtcgatcagctacgaccacatggcgattctggggccaacgctgcacgacattgcctacaacaaagcgggtattatgcggccaggccgaccggcgattaccgtaccacaacacccggaagcagccgctgtcttcgccgccgaagcccagacggtcggtgccccgctctggctggccgctgaacacacggttgaaccgtggctggcgtctggtcaaccgctcacctatccggccccaccgcaaccggggcgcttgcgcggtggcttccagcgcgaaaatgctcgtctggcaatggggactgccctgctgttgcgtgatcagggagtgccgattgatgaccaggccatccggcgtggtctcgccgaagcctggtggccgggacgtttcgagttgattgccggcccgccccgtatccttatcgacggcgcccacaacggcgactcggcgcagaaattgtggcaggccattagcgacgagctaccgcatcggcagtttattctcgtgctcggtacctcgcgcgataaagacattgcggctatcgccgctgccctggcaccgcaggcagcccacgtgattatcacccgctcgaaccaccccaaagcgatggatctcgaccggattgccgccgaggttgccccctttaccaacgcaccaatgcagattgtgccggtcgtggctgaagcgctggcgaccgcgcaggcgctggcggaacaggacgatctgatttgtgtcaccggctcgctgttcgtcgtcggcgcagcccgtgaagccctgggc

SEQ ID NO: 32637 - DNA, 678 bp, Chloroflexus aurantiacus
atgattaacgtccagaatctctcttttacctatcccggcaccagcacaccggcgttgcatgacatcacctttaccattgaggccggtgaaatcttcgggtttctcggccccagtggtgccggtaaatccaccacgcagaagattctgatccgcctgttgcgtggctttcgtggtcacgtcacgatcctcggtcgcgatctgcgtgactgggacgacaacctctacgagcaggtaggtgtctgcttcgagctgcccaatcactacggcaagctcacagccatcgaaaatctacgctactttgcgcgcctgtattccaggccaaccctggcacctgagactgtgctcgacatggttggtctgagcgaggacggccacctgctggcttcacaatattcaaaggggatgaagatcaggctcaacctggcccgtgcgctcctgcatcagccccaactgctctttctcgatgagcctactgccggtctcgacccggtcaatgcacggcggatcaaagacctgatcaaggcccagaaagaagctggccgcaccatcttcctcaccacccacgacatgaacatcgccgaagagctgtgtgatcgggtggcattcatcatcgacggtcagatcaggctcatcgactcgccacgggagctgaagttgcagtacggcaaaaaactggta

SEQ ID NO: 32638 - DNA, 1482 bp, Chloroflexus aurantiacus
gtgtcaccacgaattgttattgtcggcgccggccctggtgggatggctaccgccattcgcttagccggtcagggctatcaggttgaaatctttgaagcagttgatcgtccgggtggacgcatgcgcggcttctcactcggtgattaccatttcgacacggggccaacgatcttgcaagtgccacgggtctacgatgagttgtttagcagtgccgggttacgtttcagcgattatgtcacgctcatccggctcgatccaaatacccgcattcgcttttgggatggtgaatatcttgatttgacctcaaacattgcagccttcaaagcacagttggcccgctttgatccagcattgccggcagagtttgagcgctggtatatcgagcatatccgtaagaatgtggtcggttatgaaccatacctgggcacaccggtgcgcagtccactcgtctacttgaaacctcgcgagatcgcggctgcgctggccttccgcccctgggagagcttatacgatcacttcaagcgcttcttccgcgacgaacgggtcgtctacgcgctgtcataccaggccaaatatctgggcatgcacccaaccgcgtgttccagcgtgttcagcctggtaacctttctcgaatttgccgacggcatctggcacccgcgtggcggcttccgtgccctggccgccggcctggcgaaagctgcaaccgacctgggtgttgttattcactacaacagtccggtgaagcaagtactggtagaagagggacgggcctgcggcgttgagctggtcggtggcgaacggataaaggctgatgcagtagtcgtgaatgccgattttggtcacgcgctcactcatattattccgccccacgcacgcggcacatacaccgaccagaagctcaactcgatggagttttcatgctcgacctttatgctctacctgggcgttaaccggcgttgggatcatctgccacaccatcaactctacctgtcggccaacattcgtcgcaacgatcctttgtgggcgaagagtgccgttctggatgaagatgacccatcattctacgtatgcaacccgactatcgttgatccaaccaacgcgccgcccggacacagcaccctcttcgtgctggtaccagttcctaacctgcgctatccggtcgattgggcagcggtcgagcagcgctatcgcgacctgattatccggcagatggccaaactcggctttgaagacgttgaacgccacattgtcgttgaacgacggtacactgcggagacatggcgtgacgagcaccacacctatctgggtgcagtcttcaatttgattcacagttggagtcaactcggcccttttcgcccgcatatccgccacaatggcgcacgcaacctctactggatcggtggggcagtccatccaggtagtggcttgatgaccattctggaagcagcgaagagcgctgtacattttatcggtgaagaccta

SEQ ID NO: 32639 - DNA, 2032 bp, Chloroflexus aurantiacus
caacacaacgtgttcgtggttgctgcccgcatgattgccccgatacctgtgccaccataacggaagtgcgtgatggacgggcagtcgcgttttatgccgatcctgaacatccgatcacccagggctggctgtgtgccaaagtccgtccgtacctcgaacgagtgtacagtcctgatcggctgctctacccactccgtcgggtaggaccaaaaggcagcggacgctgggaacggataagctgggacgaagcgatcactaccatcgcagagcgctggcaggcaattatcgccgaatacggtgctgctgcgatcctgccctattcgtacagcggcacgctgggtttgctgcaaacggcgattgttgatgcccgcttgtggaaccggatgggagccagcggtctggatcgaacgatctgctgtgctgctgcccacgctgctgtctatgccacgctcggtgcccgccgcagtcctgactacgacgacctgcggcacagccggctcataatcctttggggacataatccggccagtgccggccctcacgcaatgccgtttatccgtcaggcacagcgtgccggtgcctatgtggtggtgatcgatccacgacggacggctaccgctcgctctgccgatctccatctggcgatcaggccggcaaccgatggggcgctggccttgggcatgatgaatgtcatcttcgctgaaaacctgcacgatgaggcatggttagaagcgcatacggttggctggcgtgaattgcgcgcgcgggctgccgaatatgatcccgaacgggtagcaaccattaccggactgccggtatcaaccatcattgaactggcccgtcgctatgcaaccaccaaaccggctatcattaaaacagccgacggtattcaacgccatcagaatggtggtcagaccttccgggcactcctttgcctgccggcggttgtgggacagtacggtgtgcgtggcggtggcctggcctattccaccggcggttatgcaacgtgggatgcggaagccgttggtcatgcctctgaatgcccaccagtaccgcggactgtcaatatgaaccgtcttggcgcggctctcaccggcgaagtaaccgatccgccgatcatgtccctctttgtctactgcgctaaccctctcgcttcatcacccaatgccggcctcatcgaacaggggttgcggcgtgaagacctctttaccgtcgtccacgaactctttatgaccgatacggcccgctacgccgatattgtcttgccggcaaccagtcaactcgaacacctcgatctgcaccgtgcctatggccatcgttatctcacgcttaaccaaccggcaattgcccccttgggggaagcgaagagcaattgggacgtgacccgcttgctggcgcaggcgatgggctatagcgaaccgtggctgcacgagagtgcggaagaggcgatccgtggtgtcctcgatgcctcgcgggcacgcaatccatttctggccggcatcacctttgaacgtctgcaacaagagggaaccatccggctcacactgtcaccagagaacgaagtgccgtttgctgatggtcacttcccaaccccatcaggcaaagttgaattgtggagtgcgaccatggcggctcaggggcttgatccgcttccccattatgaaccaccggctgagtatgtcgcacatccgccggaggagggatggctaaccctcatctcagccgctgctcaccattttgtctcgtcaagtatggccaaccagcccagtttgcgggcaaaagagggagaaccgactatcgagattaatccggtcgatgctgccgcgcgcaacattcgtgatggtgacgttgtcgttgtcagtaatcaacgagggcagtgccatctgcgtgcagttgtgagtaccaacgtaccgcccggtgttgtctctgcggtcaagggccactggccttcactctcgcccgatgggcgaaatgtcaactggacaactcccgatgcactggccgatctgggtggacagagcacatttcacag

SEQ ID NO: 32640 - DNA, 813 bp, Chloroflexus aurantiacus
ttttcaatcgacggcgcgaaaatccatgccattgataccgggccgcgtaatgcccaattggcgatcctgatccatggctggtcaagttcatcgttcgcgatgtcgcctttgattccactgttgagtcggcgttttcgctgcattgccgtcgatctccctggctatggtgaatcgccaccgttgcgtgaacgagcgacaattggtcgctatgcgcagatcatcggtcgcctgataaccggcttgagcgaacatccagcggtgctggtcggtcattcgatgggggggatgatcagtgcgacactggcgttgcagattccccagttagttgatcggatggtcttgctctgcccgaccatatccgggcggttatcattctggatcaacacctttgtctcaccgatcaccatgcttgagcgttttccgctctttagccgactactcgcgctgcttgagccgtcgatgctctatgttaccgacagcctgatgaaaccggcttcatttgccgagcgttcggcaatcagcgaggccgactatctgcggctgcgggctgatgcccggcgaccggggcagggtcgggtgcgggccgaatgttttgtggcgatgcgtaatcaggatttgagcggacgattgcgcgaattggagacgccggcgctggttatttggggggcggaagacaatacggtgccgttgcgtgatgcaggtgtgatcgccgatgaatggcgtagtgccgatctgcggattgtgccaaaagccggacactggccacactttgagacgccagacgtgacgctgcgctatattgccagttacctg

SEQ ID NO: 32641 - DNA, 3434 bp, Chloroflexus aurantiacus
tttgcccagcgcatgttgattgcggtgacgtcgtatcgaattgagaacgatctgcgtgccgatctgtttgatcgtctgttgtcgtttgaacagatgttttatcagcaacactacaccggcgatctgatggcacgtctgacgaacgatttgagtgcggttcgtcagtttcttggccctgggcttaacggtgccgctactgcgattctgacctttctggctgccgctgtgttgatgtttctggttcagccggtgctggcgttgattgtggtcttgttgttgccgttggcaacgattgtgtttgtcgctatcggtggccggatgcgccagattttccatcgggtgcaggatcagtttggtgtgctgtcgactcgtgcccaggagaattttgccggtattcgcacagtgaaagcctttgctcaggaagaggctgagattgcggtgtttaccgctgataacgagcggtatcgtgatctgaatctacgctatgtgctgctgtcgggcgcgttgtggccggcaatgacactgtgcctcggtctgatttcggcgttgatcttgctggttggtgggcagatggtagctgccgggacgctgaccatcggtgagctggtgcagttcaatgcgtatctggcgctgttggccttcccgatgatcattctgggctggatggttaatctgtttcaacaggcaaccgcttcgctcgaacggttaagtgacattctgcgccgtcaaccgctgattacctcgccggcaacgccacgtctgcctgccggcgagggcgaaattgagtttcgtggtgtgggtgtgcgggccggccattccgatcagcaatggctgctgcgcgatctgtcgttccgggtgccggcaggtacggtgctggctattgttggggcgaccggtgccgggaagacgacgttgatcaatctccttggtcgcgtgcgcgatcctgatgtcgggcaggtgttggttgatgggattgatatccgtgatctcgatctggctgcactccgacgaatgattggctatgtgccgcaggagagttttctcttcagtattccgttgcgcgagaatattgggttcggcgtcgaaacggttgatcctgatcgcctcaattacgtggttgaggtctctcgtctggtcaatgatctggatcagctacccggtggtatggagacgatggttggtgaacgaggagttacgctgtctggtggtcagaaacaacgggttgcgattgcccgggccttaatgcgcgatccgcggattctggtcctcgatgatgcgttgagtagcgttgatactcacacggcggcccagattctggccggcctccgcaccgagatgaccggtcgaacgactatcatcattgcccagcggattgccaccgtgcgtgatgccgaccagatcattgtgctggacgaaggtcagattgttgaacgtggttcgcatcaagaactgcttgcccgtaacggacgttatgcagctatgtatcgccgcgagttgatcgccgcggagctggaacgtgatgattagcaggttcggaatgtgtcagcagaaccttacgggattgggtgaaggcattgccttcataatcataatcatcagactcaccggggtatatctgaataggcgctaagcaggtctggcgtgttttcagtcataaggagttcagagtggcacatcagtttgatgatgacacaattctcggtaaagcctacgatggccgtttggtgcggcgtctggcaacctatgtcattccctattgggggcggcttagtgttgcaattgtgctgttgatcggagcgatcctctctgatctggtgccgccgttgttgatccaacaggccatcgatggtccgattagtgccggtgtcattgacggtgtctggccctactttgtcgcctttcttggtgcgctgctggccaattttctattccgctatagccattcctacttcatcaacagcgtcggtcagcaggtgatgaaggatttgcgagttgcgatctttcgtcacattcagtacatgagcctctcgaacttcaatcgcaacccggtggggcggttcatcacgcgcattaccaatgatgttgatgcgctcaacgagttcctgactcagggtgtggtgatgattgtggacgatctaatgaacctgatcgggattattgtggtgatgttagtgctgaactggcgtctggccttgatcagtctggcgacgttgcccgtcttgatgctgattgtttccatctaccagcgctttatgcgtgcggcatatcgcctggtacggcagcgcctggcccggatcaatgccttcctcagcgagcagatcagcggtgtcctggtgacccagctcttcaacggggaagcacgtagtcgggcagcgtttgcacgtttgagtgatgactacatgcaggccaacatccgttcagtactgatcttcgcgatctttatcccatcggtcaacctgctggccgccatcggtacggcagcactgctgtggggcggtggcaacggcgtactggccggttgggcatcgctgggtatgctggtagcgtttattcaatatctcgaacgcgcctttcaacccatccgtaatctggctgaacggtataccgttttgcagtcggcgatggcatcggcagagcggatttttgcggtgctcgatacacaggctgaggtccgcgacccggtgcaaccccgtaccctgccgacgccggtgcggggcgagatcgagttgcgcaatgtcgtgtttggctacaatccgcaggaacccgtgttacgcgggatcagtctgcatattcctgccggacaatcggttgctatcgttggcgcgaccggtgccggcaagagttcgctggtcgggctgctagcccggttctacgatgtgcagcagggcagtatcacgctcgatgggatcgacattcgcgatctgccgcaggctgaattacgacggcacgttgcagccgtgccgcaggacccggtctgtttcagtgggactatcgccagtaatattcgcctgcacaataacgcgatcagtgacgatcaggtgcgggccgctgcggaactggtcggtgcccaccggtttatcgaacggctgccgggtggctacaaccacgaagtgcgcgaacggggagcgaatctctctatcggccaacgccagttactggcctttgccagagccattgcctttaaccccgaagtattgctgattctcgatgaagcaaccagcagtgttgataccgagaccgaagctcttatccaggaggcactggcgcgattgatgcgagggcgcacgagcatcatcattgcccatcgtctgagcaccattcgccacgttgatcggattatcgtgttgcacaaggggcgagtggttgaggacggaacccatgatgagctgctggcgcggcacggctattactaccgcctgtatcagttgcagttt

SEQ ID NO: 32642 - DNA, 1253 bp, Chloroflexus aurantiacus
  unsure (1)..(1253): unsure at all n locations
ctgacctttgccagcatggttggtctgacgattgagaatgtccagctctacaacgaccttgaacaacaggtagcgcgacgaaccgaagagctgcgggtggcgttggaacgggcacaactggccgaccggcgcaagagcgattttctggccagtatcagccatgagcttcgcacaccgttgaacgccattcattggcttttctaccgtgttactcnngatgataccgatacagccgttaactccgacgcaggcgcgaagacatcncagagtatcaatcggaacggacgcttcctgcttcatctcatcaatgaattgcttgacctggctcgcatcgaagccggtcatctcaatctggaaattagcaatgtcaatcttctataatattacgagcgaggtctgtgataccgtccagacgcttgagaccgaccggtgacgttgcgcaatgcagtcccggtcaccttacccgacatcgccgctgatggtgatcgactgcggcaaattctgtttaatctcctctcgaatgcaatcaagtttacagaacgtggtactattacagtaagcgcacgagtgcatgatgaagtaaatgaagacgggaaagtcgggcggtatgttgcggtcagcgtgtcagacaccggcatcggaataccgctggaacgacaacacgaaatcttcaacgaatttgttcagattcacggtcgccggtcacggctcagcggtaccggtttaggattggcgatcacgcgcaaattagtgctggcccaggggggaagaatttgggttgatagtacaccagggattggttcaacatttaccttcacgataccggttgcgcaaccggcattgctggcagcgccggtaaacattgacacaacgacgccatgaaccagttgccacaaattctgtacattgaagacaacccagacaatcagcgtctggttcagcgagtactcagcgctcgtggctatcaggtcgtcatcgccgaagacggccctggtggtctcgcgcttgcccgcacgacccatccggcgctagtgctggtcgatctcggcatccctggtctcgatggctacgagacgacaacccgcctgcgttcgctggcccacatgcacaatgtgccgattatcgccctgaccgcagatgcctcacccggatcacgcgaacgtgccttagttgccggctgcgatgggtatctgagtaagccgattgacgcccgtgcgctgccggcgcagatcgccgaattcattgaggggcgt

SEQ ID NO: 32643 - DNA, 477 bp, Chloroflexus aurantiacus
aaaatctgtttactgggagaattctcggttggtaaaaccagcctgatccgtcgctttgtcgaaggtgtcttcgatgagcgctatttgagtacgcttggcgtcaagatcaaccggcatacactgcatatcgatcaaaccgaaattaacctcattatttgggacacagccggtggcgagaagtttgatcaggtcgttcagaactattatcgcggtgcggcaggtgccattctcgtctgtgatgtaacccgacctgaaacgttatccgcacttcacgaatacgcgacagcttttcactcggccagtccgcataccccgttcgttattgcggcgaataagatcgatctgaccacacagcggcgcattgccgatgaagagattgcgacagtagcaacagcgctccaggctgattggatattcaccagtgctcgcaccggtgaaggtgttagtgacatattccacgcgctagggcgtcgcatc

SEQ ID NO: 32644 - DNA, 1182 bp, Chloroflexus aurantiacus
ctgcaacggcagaatgtcgagctggcgcgcatcaatgccagtttgctcaagaccacgaagatcaaagacgagtttctggccagtatgagccacgagatacgcactccgctcacggccattttgggcatggtagacctgctgcgcgctcagttggttggtccattgagtgatgagcagatgggcgcgattgatggcattaaaaaaggcagtcagcatctgctctcgctcatcaatgactatctcgatattgccaaagttgaagcgggtcggatggagctagacctgactccagtttcagtgcaggatgtctgcatgtcgttgcgcccactggtggctgacctcatcaggcgcgccaatctgtcattgatcttcgacattgattctgcggttcaggtcattctggctgatgcacgacggctgcgccagattttgattaatctgctctcgaatgccatcaagttcaccccagccggtggtaaggtggggctagaggtacgtggtgagccagaacggggagcggtgcgctttacagtatgggacaccgggattgggatttcggctgaagatgctgtgcgcttatttgagccattccagcagattgagagtgaacggcagaaagaggtgaccggtagtggtctggggctggcactggtggccaagctggttcgccttcacggtggcagtgttcgcgtcgaaagtgaagtaggggttgggagtcgttttcacgtcacgctgccctgggaaccggacgagcaatatcgctttctggaacaactcgatcagcaagagcgggaggaagatactcacccaaccgagttgcctgccgcctcgccacgggccggtgatcgcccactcctgatggttgaagatgatgtcgccagtgctaccttgattgccgactacctgcgccgctgtgggtatcgggtagtgcatgtcgagtcaggcgaagaggcgctggcctacattcagggtgaattgccgtgtttaatcctcctcgatgtccgcctgcgcacgatgagcggttttgaagtgatgcagcacttgcgcagtcaggtagccactcgtgatttaccagttctggtcttaacggcgctggctatgcccggcgaccgtgaacggtgtctcgaagccggagctgatgagtacctcgccaaaccgattcgtttacggctcctcgccgaa

SEQ ID NO: 32645 - DNA, 1461 bp, Chloroflexus aurantiacus
acctcatcaccacgtaccgtatttgttcatctctttgaatggaagtggacggacattgcccaggaatgcgagaactttctggggccacgcggctttgcggcagtgcaggtgtcgccaccgcaagagcacgcgattgttgccggttatccgtggtggcaacggtatcaaccggtcagttatcaattgaccagtcgtagcgggacacgggctgaattcgccaatatggttgcccgttgcaaagcggtcggtgttgacatttatgttgatgcggtcatcaatcatatgaccggcgtcggcagcggtgtcggatcggctggctcaacgtatagcccgtacaactatccgggcatctatcaatatcaggattttcaccactgcggcagaaatggcaacgatgacatccagaattatggtgatcggtacgaagttcagaactgcgaactggtgaatcttgccgatctcgataccggatcatcgtatgtgcgggatcgcttagctgcctatttgaacgatctcatcagtctgggagttgccggttttcggattgacgcagctaaacacattgctgccggggatattgccgcaattttatcccgtgtgaatgggagtccgtacatttaccaggaagtgatcggtgcggctggcgaaccgattacaccgtgggaatacacaaataatggtgatgtcactgaatttaagtatagcaacgagatcgggcgggtctttttgaatggtaagctggcatggctgagtcagtttggcgaagcctgggggatgctgccaagcgacaaagcgattgtcttcgttgataatcacgacaaccagcgcgggcatggcggtggtgggactgtggtcacatacaagaatggtgtgctgtacgatctggcaaacgtgtttatgctagcgtggccgtatgggtacccccaggtgatgtcaagttatgagtttagcaatgattttcaagggccaccgagtgatgcgaacggcaacacgcgcagcgtctatgttaacggccagcccaattgctttggcgaatggaaatgcgagcatcgctggcgaccaattgcgaatatggtagcgttccgcaatgccacagcgagtacattcagtgtgagtgattggtggagtaacggcaacaaccagatcgcctttggtcgtggcgataaagggtttgtcgttatcaatcgtgaggatacaacgctgaatcgcacgtttcagacgagtatggcgcctggggtctactgcaatgtgattgttgccgattttacaaacggtacgtgcagtgggcaaaccgtcaccgtggacagtaatcgacggataacggtctctattccgcctttcagtgctcttgccatccatgtaggagcgaagttgtctacgcaaccggcaactgttgcggttactttcaacgtgaatgcgacgacctactgggggcagaacgtgtttgtggttgggaatatc

SEQ ID NO: 32646 - DNA, 1428 bp, Chloroflexus aurantiacus
aacaccatgacagaactggcacattttattgcgattgacatcggtgcttcgagcgggcgcgtcattctagggcgttgggacggcacacgcttcaccctggaggagatccatcgctttccgaatgggatgatcgagcgtgacggtcatctgttttgggatgtcaatcgactctggcacgaggtgcagcacggactgcgtacctacgcccgtcacgagcaatcaagccggttagccagcattgggatcgacacctgggcagtcgattacggcctgattgatgaagcgggtaatctcatcggtgatcccttcgcctaccgcgatgctcgcaatgaaggcatggccgagcgagttgatgcgattatcccgccgaccgaactatatgagcgtaccgggctgcaacggctccctttcaacaccctctaccagttgtacgccgaacggcagggtgaccgcttgccgcgagcagccacgatgttgcttatacccgatctctttcactactggctgaccgggaaacgggtcgccgagtataccaatgcgtcaacgaccatgttcctcgatgcccgacgacgggtatgggcaaccgatctcctggagcggttgggcatcccaactcacttgctaccaccactggttatgccgggaacgccgcttggccctctcgtgcccgaactgcgtgaagcgctcggactgccgggcaacgttacggtggtggcggtcggcacgcacgacaccgccagtgccgttgctgccgtacctcaccttgatgcccagagcgcctacatcagtagtgggacgtggagcctggtaggggtggagcgcagcgaaccactgatcaatgaagctgcccgccgcctgaacgtgacgaacgaaggtggcgtgtatggaacgattcgcctgctcaaaaatgtcagcggattatggctcttgcaagagtgtcagcgctgctggcaggccgatggcctgaacctgagttgggatgcgatcatcgcgcaggctgctgctgcaccagcaggacgttcatatatcgaccccgacgcgccagaattcctggccgttggcgacatgccggcccgcatccgcgaatactgccgacgcaatggtcagcccgtaccagagacggtaggcgagattgcccgctgctgcctcgatagcctggcgttacgttaccgagaggtcattgatgcgctggccgatctcaccggtcaaccgatcacgacggtacggattgttggtggcggcagtcagaacacgctcctctgccagttaacggccgatctgtgccggcgaccggtagttgccgggccaaccgaaggcacggccctgggcaacattctggtgcaggcgatagcgatggggtatctgcctgatctggcgacggcacggcaggttgctgcggcgtcggtcagccagactacataccggccg

SEQ ID NO: 32647 - DNA, 720 bp, Chloroflexus aurantiacus
aaggtcgcactcgtaacgggtgcgggtaccggaatcggagaggcaatcgcagagcgtctacttgctggcggggccttggttgtgctggttagtcgtcgccttgagccgttggaattagtttgcaggagaattgatccgaagggagcaagaactttggctcttgaggcagacgtgcgcaatccaatggcgatggaagccgcagttaagcgcaccattgagcgatttgggaagcttgatatggctgtgaataacgctggtgtaactggtccggctggcgtgccggtccaagacgtagaagcagaaatatggcgtgaggtcattgatactgatctcaccggtattttctactccatgaaatatgagatacccgcgatgctcgccaatggttctggagcgatcgtaaatatgtcgtctgccaatggcttggtcggcctggcaggtatggctgcatacaccgcagcgaaacacggggtaattggattgactcgttcggccgcactagagttggcagagtcgaatatccgcgtatgtgcagttgctccaggctatgttgcaacaccacgaataatggactccggcaaagaggtcacggactggatggcgagcttgcacccaatgaagaggcttgcaacgcgggaagaggtagcagattttgtagcttatttgctaagtgagcgtgctgccttcatgaccggaagtgtccattctatagatggcggg

SEQ ID NO: 32648 - DNA, 927 bp, Chloroflexus aurantiacus
gaagacagcattgttatgcgagcaatttttttcaatggtgacctgcaatataccaccgattatcctgaccccgttcgtcagcccggtgaggccttaattcgtccgcacctggtcggtatctgcaacaccgatctggagatcactcgtggctacatgaattttcgcggcgtacttggtcatgagtttgttggtaccgttgtcgccagtgacgatccatcctggcaggggaagcgcgtcgtcggagaaattaatgcggcctgtcgccgctgccccacctgtttgcgcggcgatgtcagccattgtccacaacgcacaacccttggtatctaccggcgtgatggagcgatggccgacctgttcacgttacccgaggcctgcctgcacgaagtgcctgcctcggtgagtgatgaagctgcggtcttcaccgaaccgctggcagccgcgctcgaaatcgtcgaacagagccatattcgtccaaccgagcgggttgctgtcgtaggtgacggcaaactcggtgctatgatcgttcaagttctccgtctcaccggttgtgaactcacgctgatcggtcggcatcccgaacggtgggacgtttaccgtcagcagggaataacctgtgtgcgcagtacagaccttcccggcaccttatttgatgtcgtcgtcgattgtaccggtaatccatctggcttgaatatcgcacgacaaatcattcgtccacgtggtcgattaatcttgaagagcacctttgctgccgagactcagcttaaccttagcatggtggtagttgatgagattcaattgattggctcgcgctgtgggccatttgcgcccgcattacgcttactagaacggggactgattgccaccactcccttgatcagtgcccgttatccacttgctgaaggtttacaagcgtttgccgctgct

SEQ ID NO: 32649 - DNA, 876 bp, Chloroflexus aurantiacus
  unsure (1)..(876): unsure at all n locations
taccgacgtttgtgcatattcgtngaagtagggccgcgtgatggtttgcagaatgagccaacgattctgacgacggcgcagaagataacgttgattgagttgttggcagcgaccgggttgcgtgcgattgaagtaggggcatttgtgcgtccgcaacaagtgccgcagatggccgatacggaagctgtctttgccggtatcaagcgccagcctggggtagtgtacagtgcaattgcgccgaatgttatcggagcgcggcgggcaattgccgccggtgcagatgttgtgcaggtgtttctcagcgccagcgagagccataatcgcagtaatgtgaatatgagtatcgagcaatcactggtgcaggtggccgagatggcgacgctggtgcatgcagccgggaagccatttgatgcggtgctgtcggtggccttcggctgcccgtttgaaggggatgtgccgattgagcgggtgttggatctgtgtcagcgcttgctcgatttgggtgccgagcagttgacgctgggtgataccaccggcatggctcacccgctgttggtgcaagaggttgtcagggcgtttcgcgcacgttttccgcgccagcccttgcgtttgcatttgcacagtgcgcggggggcgggtctggcaaacctgctggcagcgttgcaattgggtgtcgatctgtttgactctagcattggtggtattggtggttgtccgtttgcgcccggcgctcctggaaatctctgcaccgaagatgtcacgcatttgctgcacgagatggggattgcgaccgggttgaatctgccggcactcatggcgacggcgcgtgaacttgaacgcatgttagggcacgaagtgccgggacagacgattaaa

SEQ ID NO: 32650 - DNA, 1266 bp, Chloroflexus aurantiacus
ccgcgcttcaccggttttgaaactctcgccctgcatgccggccaaacccccgatccgaccactgggtcgcgagctgttcctatctacgccaccacatcctatcaattcaaagacacagaccatgcagcacgcctgttcaatctgcaagagtttggtaatatctacactcgcattatgaatccgaccaccgatgtctttgaacagcggatggcggcactggagggcggagtaggtgcgctggcgctggcatcggggcaggccgctgaaacgctggctattctcaacctggccggaagtggcgacaatatcgtcgcatcctctgacctgtatggcggcacctacaacctcttccgtcatacattaccaaagttaggcattacgactcgctttgttgatgcccgtgattacgatggctttgccgctgcgattgatgggcgtaccaaagccttcttcctcgaattagtcggcaatccacggcttgatgtgctcgatctggagcgcattgccgcaattgcgcatgcgcagggtgtgccggtcatcgtcgatgcgaccacggtcacaccgtacctgtggcaaccgatccagcacggcgccgatattgtgattcactcggcaaccaagtacattggtggtcatggcacggctatcggaggcatcattgttgacagtggtaagtttgattgggcagccagtggccgttttcccgaatttaccaatcccgatccgagctatcacggcctgatctatacccaggctttcggcaacctggcgtacattatcaaggcacgagtgcaagggctacgcgacattggggctgcgcttagcccatttaacagcttcctgttcctgcaagggctggagacgttgccactccggatggaacgacacagcaagaatgcgctggcagtggcccgttatctgagtgagcatcccaaagtggcgtgggtcaactaccccggtcttcccagccatccaagctatgccctggctcagaaatatctgccgcgtgggcagagtgggattgttggcttcggcctgaagggtgggcgtgccgccggacgtaccttcattgagcggttacggctcttctcgcacctcgccaatattggcgatgccaagagccttgcgatccatccggcaaccaccacccacagccagttgacgccggaagaacaattgctgaccggcgtgaccgacgattatgtccggctctcgattggcctggagacgattgacgatattctggccgatcttgatcatgccctg

SEQ ID NO: 32651 - DNA, 894 bp, Chloroflexus aurantiacus
atggaagtaggtttgatcggacttggtcggatgggcgcgaacatggcaattcgcttgcggcgcggcggtcatcgggtgattgtatataaccggacggtggccaaagcgcgcgaactggcggcagaacacgatttgatcgcagccgaagagctgtccgacctggtagcaatgctcaccccaccgcgtgttgtctggttgatgctaccggctggtagcgcaactgatgagcatctggcagccctaaccccgctcctgacgccgggagatattgtgatcgacggtgccaacaacaactataaagccagcatcgctcatgccgaacagttgacagcccaggggctgcgcttcctcgatatcggggtaagtggtggtatctggggtttgcaaatcggctactgcctgatggtcggcggtgacgaagaaaccttccactacgttgagccactcttgcaaacgctcgcgccaccagagggatacctcctctgtgggccgcatggtgccggacacttcgtcaaaatgatccacaacggcattgaatacggtatgatgcaagcgtatgccgaaggttttgaaatcttgcgccagtcccgctacgatttcgacctcgccaaaatcagtcatctctggaaccagggcagtgtcgttcgttcgtggttgctggaattagccgaacgtgcgttcacagccgatgccgatctgtccagtatccggggctatgttgaagacagtggtgaagggcgctggacagttcaggagagcatcgatctcgatgtaccggcaccaattatcaccctgtcgttacagatgcgtttccgttcacggcaagaagacagcttcagcatgaaggtgctggccgctttgcgccagcagtttggtggccacgccgtcaagaag

SEQ ID NO: 32652 - DNA, 1506 bp, Chloroflexus aurantiacus
gtcctggacaatccgctccgggccggactacggatagggcgtacccctgaaccctgtacaatggtcatcttcggcgccagtggtgacctgaccagtcgcaaactggtgccggccctctacaatctggcccgtgagcgccgcctgcctggcggcttctcagtcgtggggtttgcccgtcgcgattggacagacgaaacattccgcgaactgttgcgcgaagcggttaatgccaattcacgctctggcgcagttgatccagatttatgggcaagttttgcgcaaggcattcaatatcatcgcggtagttttgacgatgcagatgcctatacccgtctggccgaacgactggcaactatcgatgccgagcgtgggaccggcgggaatagagtcttttacctggcgacccctcctgaagcctacccaaccatcatcgcccaactaggcgcgcatggtctggcgcattcgcatggttggacgcggatcattatcgaaaagccgtttgggcacgatctgaacagtgcccaggcactcaatgccgaggttttgtcggtcttcagcgaagatcaggtctatcgcattgaccactatctcggcaaagagacggtgcaaaatatcttgatttttcgctttgcgaacggcatcttcgagccgatctggaatcggagccatattgaccatgtccagatcacggttgccgaaaccatcggggttgaagatcgcggcggctattacgacacctcaggtgcgttgcgcgacatgatccagaaccacctgatgcaattgctgtgtctggtggccatggaaccgccggcagtctatgatgccgatgcagttcgtgacgaaaaggtgaaggtgctgcgcgcaatccggccattgtcggtcaatgatacggtacgtggtcagtacgggccgggtagtgccaatggccgaccggtgcgggggtatcgggaagagaagggggtttcgccaacttcacagaccgaaacctacgtcgccctgaaactcttcatcgacaactggcgctgggccggggtgccattctatctacgcagtggcaagcgactcccgcgtcgggtaagcgagattgcgatccagttcaaagcggcaccgacaatgatctttgccgatacgccactgaacgatcttgaacccaacgtcttggcgatgaagattcaacccgatgaaggcatctcgctgaaattcagttcaaaggtgccgggtcaaccacaaatccgtccggtcactatggatttccgctacggtgcctcgtttggggtcacctcgcccgaagcctacgaacgcctcttgctcgattgtatgctcggcgatggtacactgttcacgcgacgcgatgaggtcgagaccagttgggcattgttaacccctattttgcgcgactgggccgaaggtccgccacaaccgtttcccaattacgaggcggggagttggggacccgccgcagccgatgaatttatcgctcgcgatggccgattctggcggcgattg

SEQ ID NO: 32653 - DNA, 1365 bp, Chloroflexus aurantiacus
tttgcggtaatcaatccggcaaatggcacagtgttgggttatgtccccaacgctggcgtcgaagagacacgaactgcaattgcggcagccgtagccgctcagccgggctgggcagccaccccagccggtgagcgggccgccttgttacggcgggttgcgcagatgatgctggaccggcagcaagaactcgccactattatgaccctcgaacaaggcaagccgctggccgaagcacgcggcgaaatcgcttacgctgcgagttttctgagctggtttgccggtgaagcggaacgcatctatggcatgacgattcccgcttcgaccaacgccaaacggattctggtgttacgtcaaccggtgggtgtagtggcgatgattacaccctggaactttccgagcgcgatgataacccgcaagctggggccggccctggccgccggttgtacggtcatttgtaagcctgccgagcagaccccgctctcggcactggcgctaggccaactcttcagcgaggccggtgccccacccggcgtgatcaatatcctgacctgtcaggacccgcgccccttcgccgacacgatcttcgccgatactcgcgtgcgcaagattagctttaccggtagcaccgaggttggcaaagagctgatgcgccgctcagccgacacccttaagcgggtgtcgctggaattgggcggaaatgcgccatttatcgtcttcgctgatgccgacctcgatgctgcggttcgcggcgcagtagcctcgaagttccgtaacgccggtcagacttgtgtgtgtgcgaatcgtatctttgtgcagcgtcctatctatgcggcctttgccgaacgctttgcggctgaagtcaaccgcctgacggttggtgatggcttacagccgggggtcaacattggcccactcatcgatgatcaggcccgccagaaggttgaacgtcacgttcacgatgctattgctgccggtgcgcgagttctggttggtggcggacctgccccgctcggcggcaatttctggttgccgacggtgctgcttgatgcgcgcagcgatatgctggttgcccgtgaagagacgtttggcccggttgccccgctcattcccttcgacgacgaggcagaagtgattcggatggcgaatgatacgccgtatggtctggcagcttacgccttcacccgcgatgtcggtcgggtctggcgcctggcggaagggctggaatacgggatcatcggtatcaacgatcccattccctcgacagcacaggcaccgtttggcggtgtcaagcagagtgggatcggacgcgaaggcgggccaaccggtattgacgaatatctggatatcaagtatgtctcgattggc

SEQ ID NO: 32654 - DNA, 1242 bp, Chloroflexus aurantiacus
gtggtcgtcgttggcgccggtgcagccggcctggcggcggcccgcaccttgcacaacgccggtgcacgggtaaccattgttgaagcccggccacgcatcggtggccgcgtctggactgaacggagctgcggcccctatccaatcgagttaggggccgagttgatccacggtgagcacaccagtacggtagcgctggcgcacatggccgggctgaccctcgctgaggttgaccgttacaacgggttacgttggggtacacctgcccgcttagtccaggatttaccggccacagacccggcctggcagacaattactgcggcacgggatgtgtggcataagctggcgacacagtacgctgatgacgctgctgatcgttccctggccgccgaattgatacagcgcggagttgacccggccaggctaccgattgccgatgtcgtcctggcgcagacctgttgcgctgaactggaaacacttagttgtgttgatctggcccgcgaaatacgcggagatcgcgccggtcctcgcgaattccggttgcgtgaaggctacgatacgctgctgaactggctggcacgagacctcgatattcggttaggttcgccggtacacgcgatcatccatcaggctgatgaagttcagattaaaacgccggccagcatcttgcgggcgcgtcactgcatcatcacggtaccagtagcagtgctggctgccgggatgattcggtttgatccgccactttccgcttccaaacaggcggcaataaccgcatttcgcaccttatcggccaccaaacacttcttctggttcgatgagccgctgtgggatgccggatttgcctacgctgcgcacggcggcctgtttgcccgctggtggacgccggcccatcccgatctgagtgcgcccctaatctgctgttacgtaacggccagtcgggccgaaatacttgaccgcttacccgatgatacagtgcgaacgctgggactcgccgaactcagccgcatcctgggccgtgacgatgtggccaggcggtgtaccgggtttcgccgctatcgctgggcacatgatccttttgccagaggtggctatgcccatctgctgccgggaatggcttgggcacgaccggcactggcagcggcagaaggatcgctgcattttgccggtgaagccaccgcgttcgacagcaacccgcaaacagtccacggcgcaattgacagtggtcggcgagcagcgcaagagtgt

SEQ ID NO: 32655 - DNA, 1023 bp, Chloroflexus aurantiacus
cggctttggggtggacgtttcagtgaaccgacagcggcggagatgcgtcgcttcaacgactccttccattttgatgtccgtttggccgaggtcgatattgccggcagtatcgcctgggccggtgccctattgcaggccggtctgattaatgaaaccgaacacgccgacctcgtgcgcgggctggaactggtgcgggccgaattcgcgaacgggagcttcgtggccgcagcgggtgacgaagacattcataccgctgttgagcggcgcctgcgcgagttaatcggcgatgcggcgctcaagctacacaccgggcgctcacgcaacgatcaggtggcaaccgatatgcgcctctacactatcgggattgcgcgccagcttgatcggcgtctgcgcgatctgcaacttgctctgctggcccaggccgaacaacacactgccacggtgatgccgggttatacccatcttcagcgtgcgcaaccgatcacctttgggcattggtgtctggcgtatgttgagatgtttgcccgtgaccggagtcgtctgaacgatgccatccgccggatgcgtgtactgcctctcggtgccggtgcgttggccggtaattcactcggcgtcgaacgcgagcgcctgaccgagttgctcgatgaatttgatgagctgtccgccaactcactcgatgcagtcagtgatcgtgattttgttgccgaagtgctctttgcctgtgccttaatcggtgtccacctgagccgattggccgaagatgtgatcctctacgccagtgctgaatttggctttctcgaactggctgatgcctacagtaccggctcaagtctgatgccacaaaagaagaatcccgatagtatggaattgctgcgcggcaaaagtggtcgcctgctgggcaaccttgtcgccttgctgacggtcctgaaagggttgccgctgacctacaacaaagacctgcaagaggaccaaggaaccgtctttgacagctttgatacgctcgaactgggtttgcaggttgcc

SEQ ID NO: 32656 - DNA, 1221 bp, Chloroflexus aurantiacus
tctggtatggtaacgtttctcgccgatggtcatgtgaccagtccacgcggctggcgtgccggggtggcagcgtgtgggatcaaatacgccaatcgcgacgatctggcgctgctggtgagcgattatccggcgacggcggcagccgtctttaccacgaatgcggttaaggctgcaccggtgcgctacgatatggcgctgatggcgcagggccacgatctgcgtgccgttgtgattaatgccggtaatgccaatgcctgtaccgggagtgatggcgatgccgccgccgctgcgatggctcaggctgtcgaacaggcgctggatttgccgccccaaagcgtttttgttatgtctaccggaacgattggcgttcccatgccggttgagaagattgtgcgcgggatcgccgtcgctgcttcccacttgagtcaggatcacggcccggcggctgcgcgggcgatcatgaccaccgatacccgccccaagtattgcgcagtggcggttacgctccctgatggtcaggtgatcacaattggtgggatggctaagggggccgggatgatccatcccaatatggcgacaatgctggcggtggtcacaaccgatgcgaccgtaccacgggcggtactcgaccaggcgcttcgccgggcgctagaggtgagcttcaacagcatcagcattgatggcgataccagcaccaacgatacgctgctggttatggcaaacggtgccagcccggcaccacccattactgacctcgactcccctgccggttcggccttttacgccggtctggtcgcagtgtgtcagcatcttgcccacgcgattgtgcgtgatggcgaaggagccactcgttttgtgactatcacggtgcgaggggcggtgaacgatgccgaagcaaaggtggcggctatgactatcgcccgctcgccgctggtcaagacggcgctgttcggcgccgatcccaactgggggcgtgtcttgtgtgcgattggctattcaggggcgaccgtagaccccgaccgggtggtgctgtcgtttggggggatgcgcgtgttggaaaatggtctgccattaccttttgatgagaaggcagcgcatcagttgctcgatgtccctgaaattactatcgacgccgacctcggcctcggtgatgggcaggcgaccgtgtggacgtgcgattttagctacgactatgtgcggattaatgccgaataccgcacg

SEQ ID NO: 32657 - DNA, 1272 bp, Chloroflexus aurantiacus
aagcgattgcgcggtgtgatcgaggtaccgggcgataagtcgatttcgcatcggtcagtgttgttcaatgccatcgctacgggcagtgcccacatcacccatttcctgcctggcgctgattgtctctcgacggttgcgtgtatccgggcattaggcgtgacggtagaacaacccgccgaacgcgagttgatcgtccatggtgtcgggttaggtggcttacgagaaccggctgacgtgcttgattgtggaaattccggtaccaccctgcgcctgctggccggcttgctggcgggccatccgtttttcagtgtcttgaccggtgatgcctcattgcgttcacggccacaacgccgaatcgtcgtcccgttgcgggcaatgggtgcgcagatcgatggccgtgacgatggtgatcgggcaccactggcgattcgaggtaaccgactgcgtggtggccattatgagttgtcaattgcttcagcacaggtgaaatcagcgttgttactggcagcgttgaatgctgaacaacccttaacactgaccggacgcatagattcgcgtgatcataccgaacgtatgctggcagcaatggggttggagattaccgttactgcggatcagatcacgatccagccaccatcagaggcaactgcccccactgcgctctcgctgcgtgtccccggcgatccctcatcagcagcattctggtgggtagcggctgccatccatcccgatgctgaactggtgacgcccggcgtttgcctgaatccgacccggattggggcgatagaggttttgcaagcgatgggggccgaccttactgttatgaatgaacgactggaaggaagcgaaccggtcggcgatgttgttgtgcgttcttcatcactgcgcggcacaacgattgcgggtacgttgattccgcgcttaatcgatgaaattcccgtgctggcagttgctgcggcctgtgctagtggtgaaacagtgattcgtgatgcgcaggagctacgggccaaagaaaccgaccgcatcgcgacggtggctgccggcctgagtgcaatgggcgcagtcgttgaaccaaccgctgatggtatggtgattgtcgggcagccggggcaactccagggtacgacactcaatagttttcatgaccaccggctggcaatggcctgggcgattgccgcaatggtagctcgtggtgagacaacgattcttgaaccggctgcggctgcggtaagctatcccgaattctggcagacgctggctatggtacaggag

SEQ ID NO: 32658 - DNA, 765 bp, Chloroflexus aurantiacus
cggcgaatcggtcgctacgaattgatcgaagagcttggccgcggcggcatggcacgagtgtatcgcgcccgtgatacacaacttcaacggatcgttgccctgaaagtgctggccgcgcaactaagcatggacgcagagttcatcaagcgctttgagcgcgaggcccgcacggcagccaatctgcgccatcctcacatcgtaacggtttacgacattggtgaagatcagggactgcactacattgcaatggagtatattgatggccggccgttgcacgcgatcctcgagcaatacggttcactcggcctgaaatacgctattgctattcttgaaccaatcgcgcttgccctcgattatgctcatcaggccggtgccgttcatcgtgatgtcaaaccgcacaatattttgatcgaccgtaacgggcgggtggtattaaccgatttcggcattgcgcaaacgcctgaggctgatgaacaacgattgacccgcaccggtgtgtttatgggcacaccagagtatatctcacctgaacaggctgaagcccggcgggttgatggtcgtagtgatctctactcattagcggtagttgcgtatgagatcattgccggtcgtgtaccgtttagtggtgccacgcctcaattgatcgttgcccatgctcagttaccaccgccacctatcacctcatttgcccctgatttaccgactgaccttgatttggtactgacgcgggcgttggccaagcgtccagaacgacggtttcagacc

SEQ ID NO: 32659 - DNA, 1395 bp, Chloroflexus aurantiacus
atgcgtctggtcatgaagtttggtggtacttcggttggtagtgccgatgcaatccggcgtgtaaccgagattgttggtacgtatgcccgcgatcacgaggtggtcgtggtggtgtcggcaatgaatgcccctgatctgcgcacgaccgatactctgattgcagcggcgaaagcggcagcggcgggaaatggtgatgcgactgcgcaaatcgcccctcgtctgctcgatctgcatatgcgcacagcagcagaggtggcatcgccagcggagtgtgcggcgctcgaaccgcagatccgttccatgctcgactacatgagtaacctttcacgcagtattgccgtgttaggggaattgactccgcgggcattagacctgtttagcggtcttggcgaacggctcaatgcgcgcctgatcgctgctgcgctgcgcagcgccgggattgatgccgaggcgattgatgcgactgaacttatcgtgaccgatgatcggtacgggaatgcctcgcctatcgaaccggatacgcgcgagcggagccgggccaggctcttgccaatgctggccgaccgcaaggtgccggtcgtcaccggtttcatcggcgcgacccgtgcgggtgtgccgacgacattgggtcgtggcggttcggattacacctgtgccattttgggggccgatctcgatgccgatgaggtctggttctggaaagaagttgacggcgtcctttcggccaacccgaaggtagtgccggaagcccgaaccttaccccgcctctcgtatgccgagatgggtgagatggcctattatggtgccaacgtcctccatccgaagaccgtacagccgctggtgcatcggcgtattcccattcgcatccgcaataccttcaatccgagccatccgggaacattaatcgatgcggaaggtgacggcgaaagtgtgcgggcaatcactgccattaggggtctcagtctgatcacggtaggtgggccgggtatgctgggtctcaccggtgtggcagcccgtatcttcggcgcagttgcccgcgttggcgccaacattctgcttatctcgcaggccagcagcgagcagagcgtctgttttgccgtaccaggtgatgagtcagagcgggtggtagaagaactccgtcgcgaactggcgcgcgaatttgcggcccacgatgtcgatcacatcggcaccatcgccccggtcgtgattgtcgcagtggtcggatcagggatgcggggcacgccgggcattgccggacgggtgtttggtgcgttgggtgcagcgcgggttaacgtgatcgcgattgcacagggtagcaccgagaataacatctcgctggtggtcgccgaggccgacgccgatgctgctgtgcgggcagtgcatgcggcttttgta

SEQ ID NO: 32660 - DNA, 1927 bp, Chloroflexus aurantiacus
ccttttgtctcccgtaaacagataccttgttactcgcagaggaggatcgccgtgggctacgaagccgtttaccgccggtcgattgaggaacccgaagcgtattgggccgagttcgccgctgaactacactggtataaaccctgggagaaggtactcgataatagtaatcccccttttacgcgctggttcgttggtggtgagacaaatctttgctacaacgccgttgatccgtcacgccttgggcggcaggcgcgggcaggccgccctgatctgggagagtgctgaaaccggacaatcgcgaaccctcacctacttcgagctgtaccgggaagtgaaccgcctggccggtctcttccacaacctgggtgtgcgaaagggagatcggatcatcatctacatgccgatggtacctgaagccatcttcgcgatgctggcctgcgtgcgcatcggcgccattcactcggtcgtcttcggcggcttctcggtaacctcgttagcctcacgaattgatgatgctgaaccggtgctgattgtgacggctgatgccggtatgcgcaaaggccaaccggtaccactgaaagagattgttgataaggccctggccgaagccaatactgatagtgtacgtgatgtgctggtgttgaatcgaggattggtaccggtagagttgaagaaaggtcgcgatctcgactggtacgagcaactggctaaacgcggtgagcgctacgtcgaaccggtaccggttgccagcaccgatccctcgtacatcctgtacacgtcgggtaccactggcaagcccaagggagttgtccgcgataccggtggctatatggttgccctctacgccagcatgagcaccatctacaattgcggcgatggcgatgtcttctggagcaccagcgatattggctgggtggtcggacattcgtacatcgtgtacgcaccactgctcaaaggtgtaccaacagtcgtctatgaaggccggcccgatcaccctgatcccggcgtctggtggcgggtgattgaaaaatacggtgtgacccacgtcttcacagcaccaactgcgctacgggcactgcgcaaattccccgaacactggatgcgtgacgccgatattagttcactgaagctattgtatgccgccggtgaaccactcgatgccccaacctacgaatgggcaagcgcagcgctcggagtcccggtgattgaccactactggcaaacagagagtggctggccgatggtgaccaatccggtcggcgtcgagttgttaccgatcaaacccggttctccaaccaaaccggccttcggtcatcgcctcgaagtggtcgatgccgacggcaacccggtaccacccggtgaaaagggctttctggttgaacatgggccactcccgccgggaacactgcttaccctctggaacgacgatgagcgcttcgtgaaggggtattggggccacttcaaggataagctcctctacatgaccggcgactatgcgattaaggatgctgatggctacctgtttatgctcggacgcgccgatgaagtgttgaatgtgagcggtcaccgattgggcacgcgcgagattgaagaggtggtttcggcgcatccggcagtcgctgaggcgagtgtgattggcgtgcgcgacgaactgaagggcgaagatgtgctggttgttgccgtccttaaacagcatatcactcctcagatgcaagacgacatcgccaacgaaattcgccaactggtgcgcgaacggatcggcccgattgcaactccgaaagcggtacactttgtgagtatgttacccaagacccgttcgggcaagattatgcgacgagtcatccgtgccgtgtatcagggtgacaacctcggcgatctgagtaccattgaagacgacgccaccgtcgatatggtgcgcgaagcgatt

SEQ ID NO: 32661 - DNA, 1914 bp, Chloroflexus aurantiacus
cgcgatgtggcgctgcctgacaccagtgaattgtattaccccgatccggcgctggttgagcaatccaatgtgatggcgtatgcccgtagcaaaggcttcaattcctacgatgagctgtatcagtggacgatcagccatcgtgaggagttttgggccgatatggccagccagctcgaatggttcaagccatgggacaaggtgctcgacgatagcaacaagcctttctatcagtggtttgtgggcgggaagacaaacatcgtttacaacgcgattgatcgccatctcaaaacctggcgcaagaataagcttgccctgatttgggaaggtgaagatggcagtcagcgcacctattcgtactaccagctcaactacgaagtatcacgtattgcgaatgtgctcaagagcatgggggtaaagaaaggggacattgttaccatttatatgccccgcatccctgagttgatgttcagcatgctggcctgtgcgaaaatcggtgctgcccacagcgttgtatacggtggcttctcggaagcggccctcgccgaccgcctggccgacgcgaagagcaaagtgctgatcactgctgacggtggctacatgcgcggcaaagtggtcgagctgaagaagatcgtcaacgaggcgctgtcgcgcacgccgactgttcaaacctgtctggtcttccgccacaccaaccacggtgccccgatggagcagggccgtgacttctggatgcacgatctgctcggcctgccaatcgcgaacggtcattgccccaccgaagagatggacgcggaggatatgctctttatcctctacacgtcggggacgaccggcaagcccaagggggttgtccatacccacggtgggtacatggtcggtacgtacacgaccctgaagtttgtctttgatattaaggacgaagaccgttactggtgcgccgccgatccaggctggatcaccggtcactcgttcattgtgtatgcaccgctgatcaatggcgcgacatcgtttatgtacgagggtgctcccaattatccctatcccgaccgctggtggagcatggttgccaaacacgggattacgatcctctacaccgctcctaccgccattcgcggtctgatgcggttcggcgacctctggccgtcacgccacgatctgagtaccttgcgcctgctcggttcggtcggtgaaccgattaaccccgaagcgtggaagtggttctacgagaagatcggtcatggccgctgcccgattatggatacctggtggcagactgaaaccggtcactttatgattacgccgacacccgccgtgccactcaagcccggctcggcgactcgacctttccttggtatcgaagctgatgttgtgcatgaggacggttcaccctgcgcaccggatgaggacgggttgctagtgatcaaaaacccgtggcccggtatgatgcgcacgatattgaatgatccacagcgctacgtagaaggctactggcagaaggtgcccccctactacgccgccggcgacagtgcccgtaaagacaaggatggctacatctgggtcattggccggttggacgacgtgattaaggtgtcaggctatcgcctcggtaccgccgaagtcgagagtgcgctggtcagccacccggcagtggccgaagcggctgcgattggtctgccgcacgaagtgaagggcaatgccattcacgccttcgtgatcctgcgcgccggctacgaaccgagccacgacctcgaagagaagctgcgggcacacgttggtcacgaactcggcccaattgcccgtcccgactcgatcacgtttgtgacatcgctgcccaagacgcgctccggcaagattatgcgccgcgtcttgcgcgcccgtgccctcggtctgcccgaaggcgatgtctcaacgctt

SEQ ID NO: 32662 - DNA, 885 bp, Chloroflexus aurantiacus
gatacccgtaccatcgtacacgatctgatgcggagtggccagcagcggttatgcgccgcctttgaagagatcgatcagcacgctcagtttgtcgccgagagttgggagcgcccaggtggtggtggtggcaccgcacgggtaatgactgaaggggctgtcttcgagcgggccggtgtcaatgtctcggcggtctatggtgtcgaagtaccacccagcatctggcaacatcgcccctcaacccgtggtcagccctacttcgcaaccggcatctcgatggtgctgcacccgcgcaacccctacgtaccggcgtttcacgccaattttcgctactttgaagccggcgatgactggtggtttggcggggggatggatctcacccccagctacggtttcgctgaagatgcccgccattttcacgtaacattacgcgactattgtgcccgtcacccaattgccgactatcgtgaaatgaaggcgacctgcgataactacttcttcctcaagcatcgcaacgaaatgcgagggattggtggcatctttttcgatgatctgcatcccgccggcgacgatggcttcgagcgcgccttcgccttcgtgagtgatggcattaccaccatcctcgacgcctacctgcccatcgtgcgtcgtcgtatgcacaccccatacggtgaacgcgaacgcatgtggcaactctaccgtcgtggacgctacgtcgaattcaatctgatttacgaccgtggcaccctctttgggctgcaaaccgggggcaacatcgaagcgattttaatgtcattaccaccgctggcgcgctggcaattcaaataccagcccgaacccggttcaccggaagcagcgatggccgaatttctcaagccacgtgactgg

SEQ ID NO: 32663 - DNA, 1281 bp, Chloroflexus aurantiacus
cgttcgcaggccgattatgctgctgctcgggaagtgattcccggtggtgtaaattcgccggtgcgggcttttcgaggggttggcggaatacctatcttctttgagcgtgggcagggcgcttatgtgtgggatgtcgatggcaatcgttacatcgactacgtgctctcgtgggggccgcttctgctcggtcacgcccatcctgcggtggtcgaggcgattacccttcaggcacaacggggtaccagcttcggcgcgccaaccgagctggagaccgaacttgcccggctggtgatcgaactggtgccttcgattgaacagattcgctttgtcaacagcggtaccgaggcaacgatgagcgcattgcgtctggctcgtgccgctaccggtcgccgcctgattgtcaagttcaacggttgctaccacggccatgccgatatgctgctggtgcaggcgggcagtggggtggcgacccttggcctgcctgatagtcccggcgtcccgccatcggtggctgccgagaccatcaccatcgagtacaacgacctcgatgcggcggcagcgttgtttgccaaccgtggtgccgagattgcggcagtgattgttgaacctattgccgccaatatgggcttcgtgctgcctaaacctggcttcctgagtgggttgcgtgaactgacccagacccacggcgcgatcttcattctcgacgaagtgatgaccggtttccgggtggcggcgggtggtgcgcaggcgctgtggggtcttgatcccgatctgacctgcctggggaaggtcatcggcggcggtttaccggtaggtgcctatgccggcaaacggcagttgatgcaactggttgcgcctgccgggccgatgtatcaggccggtaccctgagtggtaaccctctggcgatgaccgccggtctgacgacccttcgtaccgctttcggcggggatgccggtgccttccagcaggcagtcacccgcactgcccggcttgccgatggcctgcgcatgcttggcgaacgctatcgcattccggtgcaggttggtaatgtcggcactatgttcggctgctactttttgcgtcaagaggggagccagatcaccagctatgccgaagcaaaagcctacgccgattcccagcgctacgcccgtttcttctgggcgatggccgatcagggcatctatctggccccgtcacagtttgaggccggtttcctcagcactgcgcactccgatgccgacatcgatgaaaccctggcggcggcagaagtggcgtttgct

SEQ ID NO: 32664 - DNA, 1142 bp, Chloroflexus aurantiacus
cagcccgacaggaatgcaccaccgaggcacagcagacacagagataacaaaaaaacctctgtgccctctgtgtctttgtggtaacccaacccgccattgtaaagattgagaggagtgcaatgcgagatcgttttctgcgcgcctgtcgtcgtcagccggttgatcgcacaccgatctggttaatgcgccaggctggacgttacatgccggaataccgggccatccgcgagcgctatggctttttgcagatggttaaaaccccagaagttgccgccgaggtgacccttcagcctgtgcaggcatttggcgttgatgcggcaattatctttgccgatattttgcccccactcgaagggctagggttacagctcacgtatgaaaaaggggaagggccggtcatccacaacccgatccgcagcccgcatgatgtcagtgtattacgctcgtgcgatccgcgcgagacggttgcctataccctggcggcactgcaacttgtcaagcgggagctgaacggtttaccgctcatcgggttcagcggtgcgccatttacgctcgccagttatgccattgaaggtggtggatcgcgcgaatatcggcttaccaagcgctttatgtacgagcaaccggcagcgtggcacgatctgatggaacgtctcagccggttagttgccgactatctaatcgctcagatcgaagccggtgccgacgcggtccagatttttgatagctgggccggtgctctctcgcctgccgactaccgggcgtatgtgctacgccatacccaggcgctcgtgcaaacaatccgcgcccgtttaggcgacgtaacaccaccaattatttattttggtaccgatatggccggtctggccggcgaagtgcgccagatcggagccgatgtgctcggtgttgattggcggattgatcttgatgtggcctgggcgcagtacgggttcaatcatgcggttcagggcaatctcgatccgatgaccctctttgcaccgccgtcgatcattgccgctcgtgcccgtgacattctggaacgggccggtgggcgtccgggacacatctttaatctcggtcacggcattctcaccgaaacaccggttgatcacgtgcgctatctggtcgagtttgtccaatcg

SEQ ID NO: 32665 - DNA, 561 bp, Chloroflexus aurantiacus
gggtacctgcttaatgatccaaccctggcgctgctggccgaagcatcgatagtgcatgcccgtgccggagccgatattattgccccttctggcatgatcgatggcatggtggcggcgattcgctcggcgctggacgctgcggggctgagccataccgcgatcatgagctatgccgcaaagtatgccagcggtttttatggccccttccgcgatgctgccgaaagtccgcctcagttcggtgatcggagccagtaccagatggatccggccaatgcgcgtgaagcactgcgtgaagtcgatctcgatgtggcggagggagcagatatcttgatggtcaaaccggcactcgcctacctcgacattatccggcaggtgcgcgaccgccatacattgccgctggcagcgtatcaggtgagcggcgagtacagtatggtgaaggccgcagcattacagggctggctcgacgagcagcggattgcgttggagatgctgaccgctattcgacgtgccggcgctgacatgattatcacctattgggccagagaagccgccgaatggctt

SEQ ID NO: 32666 - DNA, 681 bp, Chloroflexus aurantiacus
ctgaacagtgttcatctcgatctgtacgcaggtgagggggtggcaattgtcggggctaatggcgccggcaaaacctcgttgatcaaacacttcaacggtcttcaccgtccccaacagggacaggtacgggttatcgggaaagacacccgtacaacaccggtatcggtgctggcccgtcacgtggggatggtatttcagaaccctgatgaccagttgtttacgacccgtgtccgcgatgaggtggcggttggtgctcgcgtcatgggtgtctatgatccggatcaggtagcggctgtattacgcacatttcagcttgaacaccttgttgagcgctcgccctttaccttgagtgccggcgaaaaacgacggctgacactggcggcagcgctggtgaccaatccggcaatcctggtgctcgacgagccaacaaccggtctcgactggccggcacggcaggcgctggcccggcatctccgcgaacaggtgcagcatggtcgcaccgtagtcgtggtgacgcacgatctggagtttgccggcgcactcacctcacactggttcgtcctggccgatggatgcctgctggccgaaggggtacctcacgcgatatgtatgcaacccgccgtggtacaggcggctgacctcctgcttcctgatcgctaccggctggcgctggcgttacaa

SEQ ID NO: 32667 - DNA, 1812 bp, Chloroflexus aurantiacus
gcgtcgcacagcgttgaagcgacgagagcagcattgaggagcgctgcgatgtttcgtacaatattggttgccaatcgtggagagattgccctgcgcgtgatgcgcgcttgccgggaattggggttgcggtgcgtcgccgtctattccgaagcggatcgcgacgccccgcacgtggcgtatgccgatgatgccttcctgatcggcccaccttcaccggctgaaagttatctcaatattgacgcaattatccgagcggccaaagctaccggtgctgaggcgattcaccccggttatggttttctagctgaaaatgccagttttgtccgtgcagtcaccgcagccggtctgatcttcattggccctcccgccgaagccatggagcgcatgggtggcaagaccgctgcccgccgtgaagcgaccgctgccggcgtgccggttgttcccggtgtgctcgaaccggttactgatgcggcagaggtgcggcgattggggaaagaattcggctacccgattgcgatcaaagcggtaggcggtggcggtgggcgtggtctgcgcgtggtgcgttcaccggaagaggttgatgaagccttcgcagcagctcggcgtgaagctgaagtcgcgttcaagaatggtgaactgtacgtcgaaaaataccttgacgatccgcgacatattgaaatccaggtgctggctgatcgttatgggaatgcggtagctttgggggaacgcgactgttcaatacagcgccgccatcaaaaactgatcgaagagtgcccctcgccagccctgacgcccgaactgcgggcagagatgggggctgccgcggtacggctggcaaaagccgtcgggtatgtcagcgccggcacgttggagtttctctttcaggatgggcgctactacttcctggagatgaacacacgcattcaggtcgaacacaccgtcaccgagatggtgtacggcatcgatctggttgccgcgcagattcggattgcccagggcgagaagctctggttcaaacaagaggatgtagtgccccgcggccacgctattgagtgtcggatcaatgcggaagacccgctccacaactttcgcccggcactgggcaccatcggcgaataccacgagccggttggcttcggggtacgggtagatagcggcgtgcgcgcctactataccgtgccgtcacattacgactcgctgctggccaaactgatcacctggggaagtgaccgacaggaagcaattgcccgtatgcgacgggcactggccgagtaccggattgagggtgtcacgaccattattccattccatcaggccgcgcttgaacatcctgtttttacggcaggtgcagcgaccgtcaactttattccgcgccatcccgaactcttctcccgtgcggcagagctaacgccaccaacggctgcttcagcaggggctgaaccggcaccggaaccacgccgatttaccatcgaagtcaatggccggcgttttggggtggccgtttttggcgacggtatgaatgcgacaccagttgcatcgccatcacgttcagcacctgcgcgccgtgctgcccccaagaagacgacgctggccgcgccggttgatgcggtgatcagcccaatccagggtcgtgtcgttgcggtgcgggtggcccatgggcagcaggtggaagcgggccaggtgctcttcattgtggaagcgatgaagatggagaatgagatcaccgcgccgcatagtggcaccattgctgaagtacgcgttgaggtgggaacgacggttgaagccggggcgatgctggcaacgtatcagaat

SEQ ID NO: 32668 - DNA, 858 bp, Chloroflexus aurantiacus
ctgggcgacatcaatgtcgatctcggctttttgttgccgcactttcctcgcgaaggcgacgacaatccggcgatggcggtacattggggtgggggtggtgccggtctcaatatggcagttgcggttgggcggttgggagctattccctatttgattggtcgggttgggaatgatctggccggctcgtttgcgctacagacggcacgcacccatggtgtgcaggtcagtacagtccaggttgatccgggcgctgctaccggtttatgtggtattgtggtgacccctggcggtcagcgcagttttctgagctttcgcggtgcaaatgtcttttgtgatgcctctacaattacgccttcgctcatccgctcaagtcgtttgctgctgattggatcgcacgccctacttgatgatccacagcgttcagccgcacttcaggcaatggaactggcaatcgagcagcgttgcccaattgtgcttgatctttgtttgccggcgattcgtgttgcccgccgcttaatcgtgcggctcttaccacagttgtggctcctgaccatgaatgaagatgaactgcgggccttgttgccgggtcagagtattgcccaggcacttgatagcttgctgagcgccggtgtgcagcatgtggcgatcaaacgtggtgcccaggggtgtagtgtcgccaacaatcagggacgccgactcgatgttttgccgcctgcggtgtcagtcgttgatacgacagcatgcggtgatgcgtttagcgctgcgtatgcctgggcattgatccacggtctcgatctgtcgcaaagtgcaacgcttgctaatctggtcggtgcgctaacagcgacgcgccacggtgca

SEQ ID NO: 32669 - DNA, 519 bp, Chloroflexus aurantiacus
atgcgtcaggacattgattacatcttgattggggaagatcagatcaaacagcgggttgcggagctggctgctgagatcagtgccgattatcgcgacctcggtgatctgctgctggtcggcgttctgaagggctgcgccatgtttatggttgatctggcgcgggcaattgatctgccacttgcgattgatttcatcgcggttgccagttatggcgccagtaccgagtcgtcgggtgtggtgcgtttgatcaaagacctcgacaccgacatttcgcagcgccacgtattgattgtcgaagacattattgatagcggcctgatccctggcgtacctgcggtcgcaattgctgcggcgcaatccggccagtctgcgcatctgcacgttgctcaacaaacctgaacgacgtacagcagatgtgccggttgactacattggttttgacatcccgaatgcctttgtggttggtacggactggattatgcagagcgctatcgcaatctcaacttcagtggcggtcca

SEQ ID NO: 32670 - DNA, 2400 bp, Chloroflexus aurantiacus
ttgcgcgggcagttggtcgtcgccgcctacgatggcagtgggaaccggattgatgccactcgtgtccagattcagggggtgcttgatgatctctatgccgccaacgcgacaactcaaaccctgggtgtgagctatagcggtgccgttcccacggttcggctgtgggcaccgacggcgaaaacggttactctccgccgttttgccagctccacgacgacgacctacaccgatcacccgatgacgctcgatccgacgagtggcgtctggagtgtcaccggcgatgcgagttgggatcgtcagttttatctcttcgcggtcgaggtctatgttccggcactcgatgcagtggtcacgaacctggtcaccgacccctacgccgtcagtctctcgcaggacggtgccgccgccaatgatgtgcggagtcagtttgtcaatctcgacgatgccgatctcaagccgaccggttgggatacactgagcaagccggccctgaccaaccctgaagacatcgtgatctacgaggtgcatatccgcgatttcagcgccaacgatagcactgtcgctgccgctgatcggggtacgtatcgggcgtttacctacgatggcgccggccctcacccgaatacaaccctctctgatgggatgaaccatctgttgcaactgcggcaggccggtctgacccatattcatctgttgccaaccttcgatatcgcctcggtgatcgagaatcctgctgagcgcagcgaacccaccatctcgttcaacccggcgaccgaccgggcttcgagcaatccccaggcggcagttggtgcgacccggcaaaccgatagtttcaattggggctatgatccataccactacggtgttcccgaaggcgcgtacagtagcgatccggatggcgtgacgcgcatccgcgagttccgtgagctggtgcaaacccttaaccagaacggcctgcgcgtggtgatggatgtggtctacaatcacactgccgccagcgggcaagatgataaatcggtactcgataagattgttcccggctactactatcgctacgataccaatggcacgctttaccagtcgtcgtgctgtgccgatacggccaccgagtacgccatgatggagaagctcatgatcgatacggtcgtgcgcttcgcgactgcgtacaagatcgatggcttccgcttcgatctgatgaacctgcatacccgccagaacatgctcaatgtgcgatcagcagtgcaggcactgaacctctccacccatggcgttgatggcagcacgatctacctgtacggcgaaggctgggatttcggttcggccagagacaaagggctgaccgtttgcccgcactgctatgcgcacaagcacaacatgaccggcagcggtatcggtgtcttcaacgatgtcattcgtgatgccgcgcatggtggttacagcaccgacccggttggtattcgtcgccagggtttcatcaacggtctgagctacgattggaacggttacaactaccccaaccgcttccagagcgatctgcacgctaccatggatacgctgcgttcagcgttgcgcggcagcggtaccgattggaacgggcagggtaatcccttcaccgacgatccgcaagaagcgattaactacgttgaaaaacacgataacgagaccctcttcgaccagaacgtcttcaagttgcccaacggcgacggtagcggcaatccgggctggatcggcagtagcattcccaccaccacaatgagtgatcgggtgcgcagccagaatatgggagtgagtctgatcggcctggcgcaggggattcccttcttccatatggggcaggacatcctgcgctcgaaatcgctcgaccgcaacagttacgattcgggcgattggtttaaccgcgtctactgggatcgcagcgcgaacaacttcggacgtgggctgccgccggcctgggataacagttcgcgctggggcatcatgacccccttgctcaacaacacagctctcgatcccactactgccgatatgaatgcggcggcggcgcatctgcgcgagacattgcggctgcgtatgagttcgccgctcttccgcctgaccagcgaagccgacgtgaatgcccgtgtttcgcactacaacaccgacaacagtcgcgatgccttgctggtaatgcggctctccgatcaggtcgcgcccgatctcgacccgaattgggagaacattctggtcttcttcaacgccaacaaggttgcgcaatcgatcaccattcccaatgcgaacgggtttgttctgcatccactgcacaccaacggtattgacgacgatccggtgatcgcaaccgcgacgttcaacgacgcgaccgacacctttaccatcccggcgcgcacgacggttgtcttcgtt

SEQ ID NO: 32671 - DNA, 1551 bp, Chloroflexus aurantiacus
gtccacctctttgaatggcgctggagtgatgtggcaaaagaatgcaccttcctcggtcaaaaaggctacaccggggtgcaggtctcgccaccgaacgagcatattgtgccaaccgctgatctgggtggcaatccggccaatgacttcccctggtgggcgcggtatcaaccggtcactcacgacaccacccgctttaccagccgcagcggtacctgggctgagttccagcagatggtgaacacttgtaatgctgccggggttgccgtcattgtcgatgcggtgatcaaccacatggccgacattcaggtcggcacaccaccaaccggcactgccggtaccacttaccagtcgcaaccggcaggctcacgattttacgggacgcaatacctgcccgatgattttcacgccgattgtttgattagcgattacagtgatcgctatcaggtccagtattgtcagttagccggcctgccagacctcgataccggtaagagcactgtgcagacgaagctgcgtgcttacctgcaagccctgctcaatgccggtgtcaaaggcttccgcattgatgctgccaagcacatggccgcgcacgaggtcggtgccattctcgatgggctgaccctccccggcggcggtcgtccgtacatcttcagtgaagtcattgacatggatcccaatgagcggatacgcgattgggaatacacgccttacggagacgtcaccgagtttgcctacagtattagcgtgatcgggaataccttcaattgtggtggatcgctcagcaatctgcaaaacttcaccacgaacctactgccctcgcacttcgcccagattttcgttgacaaccacgacaaccagcgcgggcacggtcccggtggtggctgtgtcgttgaccatcgcgacggtcgggcacacgtgctggccaatatcttcacgctggcctacccctacggccacccgtctatcatgtccagctattactggacaaccaaccccaacagcaatgccggagatagtcttggtccgccgagtagcaacgatggtggtacaacctgggggccggggctgggtgccgatacacgtccggtctacggtgccgggcagagcgcaggcgattatccggccaattgtgccggtacgtacccgaacccggtgaccggtggtgatctcggcaagtgggtttgcgaacaccgctatccggcaattgccaatatggtgcagttccgccagaccacgcacggcgaaccggtaacgaactggcagaatattgggggaaccccaaccaaccatattgcctttgggcgtggcaacaagggctttgtcgccatcaacaacggatcggtagccgcaccaacgacctaccagaccggcctgcctgccggcttctactgtgacgtgacgaagtacgatttccagggcgggaagtgtgtcctgcccggtaccaacacaccggcgccggccagtgcattgattgaggtcaatgccagcggtcagatcgtcaactataccctggccgcgcaggatgcattcgccattcacattgatgcccgg

SEQ ID NO: 32672 - DNA, 1035 bp, Chloroflexus aurantiacus
ccgcaccgccgcctgaatcggctgaccggcgaatgggtgctggtgtcgccgcatcgtacccaacgcccgtggctggggcaggtggagacgttgccgccagccgaattaccgtcttacgatccggcctgctatctgtgtccgggaaatacgcgggcgaatggcgtccagaacccaccgtataccgagacgtttgtcttcgagaacgattttgccgctcttttacctgatattccgttggatcgggtcagtgtgcggctgcccctcgccgatcagcacgacgcagggccggtgctgctccacgccgaggccgaacgtggtatttgtcgcgtggtgtgcttttcaccccgtcatgatctgacgctggcccaaatgtctcaggcagaggttagacgggtcgttgatgtgtgggttgaccagtacaacgagttgggggccatcgattgggtgcagtcagtgttgatcttcgagaatcgtggcgcgatgatgggtgcatccaatccacatccccacggtcaaatctgggccaacgagcagttgccaaacgagatgcgtaaggagctggccacgcaaacggcgtactggcacgagcatcaacgttgcctgctctgcgactatctggcgctggaattgcagcttggtgagcggatcgtgtgtgccaacgacgcctgggtggcgctggtgccgttttgggctgtgtggcccttcgagacgttggtgttaccgcgggtgcacgccggtgccattggtgatcttgatgagagtggtcgtgatggcctggcggcgatattgcgcgagttaaccggtcgctatgaccgtctcttcaatgtgtcgtttccctacagtatgggatttcatcagcgccctaccgatggccttgctcacgaaggctggcatctgcacgcacatttctacccgccattactccgctcggcaactgtccgtaagtttatggtagggtacgaaatgctgggtcagccgcagcgtgatctgacgccggagcaggcagccgcccgcctgcgcgatctgtaatctgtt

SEQ ID NO: 32673 - DNA, 2226 bp, Chloroflexus aurantiacus
atgacaggtgatcttttagctaacctcaatgaaccccagcaacgtgccgtgaccaccgttaccgggccggtgctggtattggccgggccgggaagtggtaagactcgtgtgcttacccaccggatcgcctatctgatcgccgagacggggattgatccgcttcagatactggcagtcaccttcaccaacaaggcagcgcgtgagattcgcgaacgtctgaacctgctcgtgggcgaaaccgttgctcatgagataaccatcggtacctttcatgcgatttgtacgcgctggctgcgacgcgatattgttcatctcggtcgtgaacgtgacttcgtgatctacgatagcgatgatcaagaacgcctgatgaagcgggtgttgcgcgaactgaatctcaatgaaaagcagtatccgccgcgcgctattctaggggtcatttcacgagccaaaaatgagctggttgatccagaggcatttgctcgcactgcccgtagctacttcgacgagattgtcgcccgttgctacacacggtaccaacagctcctgattgaaagcaacgcgctcgacttcgatgatctgctcgtcgaaacggtgcgcctgttccaggaacatcctgccatccttcatcattaccatcagcgctaccggttcctgctcgtcgatgagtatcaggatacgaaccgtgcgcagtatctgatcgtgcgtgctcttgccgaacgcgaccgcaatctgtttgtggtcggggatgaagcacagagtatctatgcctggcgtggcgccgatattcgtaatatcttgcaatttgaacacgattatcccgatgccagggtgattttgctcgaacagaattatcgcagcacgcaggctattctcgatgctgcgcaggcgttgatgcacgccagcccccaacgcaaatacgccaaaaacctctggacggtcaacggcaaaggcgaggcggtcacgctgtacgaggcaagcgatgaagaggacgaagtccagtttgtcgttgatgaaattctgcgcttaatcgcggaaggaaaggctcgtcccggcgattgcgccatcatgtaccgtaccaatgcgcagtcccgtctggttgaagaggctctcattcatgccggtgtgccgtactacgtggttggtggggtgcgtttctacgaacgcaaagagatcaaagatgtgctcgcgtatctccggctgatagcaaatccatacgatagcgtcagtctacaacgcatcatcaactggccaggtcgtgggattggcgagcgtaccgttgcggagctgatcgcctgggccaggacgttgggactaccactctatcaggcgttgcgcgagattgccgacaatgatgcgatttcccatccctttggtggacgagcgcgtactgcactgactgagttttatcgcctgctgagcgagctgcatcagttgcacggaatgatggcgctgagtgatctgatcgattatctgctcaatcgaatcgacgtgcgcgcaaccctctacagcgaatacgatggcgatgaagccgatgatcgctggcgcaacgtgcaggagttacgaaatgcggccttgaagtatgtcaacttgccggttgagactcaacttactgcctttctcgaagagattgctctggttgccgatgttgatgcgattgatcgcaacagcgatacggtcacctgcatcacactccatcaggcgaaagggcttgagtttccctgtgtctttctgctagggattgaagagggactgctgccgcatagccggtcgctggataaccgcgactcgattgaagaagagcgccgtctcctttacgtcgggatgacccgtgcccaacggcgtttatacctctgtcatgcgacaaaacgcaccatgttcggtcgcgtgaatatcggtgcccgctctcggtttctcaacgacattccaccgacactcgtccagcaggtgcatcgtcgtggttatcgggctattcccgctgtagctgggacaacgtggcagttccgcacctctggtcagtctgagcagaaccgacgcacgtcaagaaaccaggctccgcttcccacaccacaaaaagccgttttcttccctggacagcgcgtgcgacacgccaccttcggcgaaggaattgtcgttgacagccgcctgatcgaaggtgatgaagaggtgaccgtccgttttgctgatcgcgaacgccgactattggcgagttttgcccggcttgaacag

SEQ ID NO: 32674 - DNA, 834 bp, Chloroflexus aurantiacus
gggcgatattgtgatattgatgcagtacggcaggctgtacgttcgtacaacatcgacaccatcgtcaactttgccgccgaaacgcacgttgatcggtcgatcatggcccctgatgccgtcgtgcgcacgaacgtcaacggcacctgggccttactcgaagtggcccgcgagtttcagcttgagcgatttcaccagatcagtactgacgaggtgtacggcgctattccggcaccgcgccggtcacgcgagggtgatccgctcgaaccgcgcagcccctattcggccagcaaagccggtgccgagcatctggtgtacgcctactacatcacctatggcgtaccaatgacgattacacgcggctcgaacaatattgggccgtaccactacccggaaaaggcggtaccactcttcaccaccaacgcgattgacaatctgcccctgccgatctatggcgatggcctgcaagtgcgcgattatcaatacgtcctcgaccattgcgaagcgattgatcttgtgctgcacaagggtcagattggggaagtatacaatgtgggtaccgaggtcgaaacgcccaatatcgaaatggcccgcaagattctcgatattctcggcaagccctacagtcttattcaacacgtcaccgaccgggccggtcatgatcggcgctatgcgctcgattgctccaaattacgcgcgttaggctggcgttcacgccataccttcgacgaagcacttgaaaagacggtgcgctggttcgttgagaacgaagcctggtggcgaccgattaaatcgggggagtatctggaatactaccgccgccagtatgtcgaacgg

SEQ ID NO: 32675 - DNA, 840 bp, Chloroflexus aurantiacus
tctatgagcggttacgcccatcccgaagcactggtcgagacccagtgggtcgccgatcacctcaatgatcccaatgttcgcatcgtcgagagcgatgaagatctgttgctgtacgataccggtcacattcccggcgcggtgaagattgactgggtgcaagacttgaacgatccggttgttcgtgattatcttgactctgatcggtttgccgcactgatgcgggtaaagggcatcagtaacgatactacggtcgttctgtacggtgataagcacaactggtgggcaacctatgccttttgggtctttaaactcttcggtcatcgtgatgtgcgcattatgaacggtgggcgggcgaagtggattgctgagggtcgtccgttgacgcgcgaagttccctcgtatccaccaggaaattatgtcgcgccaccgcgcaatgacgctgaaattcgggcatttcgcgatcaggtgctggagtttgtccgtcagcgcaaaggtgttctggtcgatgtccgtagcccgcaagagtataccggcgaacgcacccatatgcccgattatccgcaagagggcacgctacgcggcggccacattcccaccgcggtcaacattccctgggccagggcggtgaatgaggatagcaccttcaagagcgtcgaggagctacgcgagttgtacgccgctcagggtgttacccccgacaaagaggttatcgcctactgccggattggtgagcggagcagccatacctggtttgtgctgacctacttgctgggcttccccaatgtccgcaattacgatgggagctggacggagtggggcaacagcgttggtctgcccatc

SEQ ID NO: 32676 - DNA, 1296 bp, Chloroflexus aurantiacus
cgtcttgtcactgaaatacccggcccgcgttcgcgcgcattactggcgcggcgtgatgcggcggtggttgccggtttggggcgggcaacgccgatagcgattgcctccggccagggtgcgctggtgaccgatgttgatggcaataccctgatcgattttgttagtgggattgggacgctcgccgtcggccactgtcctcctgaagtggttcaggcgattcaggctcaggccgaacagttgatccatctttcggcgttagttggcacctacgaaccgtatgtcgccctctgcgagcggttaaatgcgctggcacccatcagcgagccgtgcaagacgttgctatcgaattcgggcgccgaaggggtggaaaatgcgatcaaatttgcccgcgctgcgaccggtcgtccggccattatcgtgttcgatggcgcgtaccacgggcgaacgctgcttacgctttcgctcacgtcccgcacctacttcaaaaagaaattcggcccctttgccccagagatttaccgcgcaccttttccttacgcttatcggatgggcatgagtgaagcggaggcagttgagcagtgctgggccgcatttgaacgcatgcagattgccggtgtcgatcccgaaacggtggctgcggtcttgattgaaccggtgcagggtgaaggtggctttatcccggtgccggtcgaatttatgcggcgcttacgcgaattctgcacgcgcaacggctcactgttgattgtcgatgaagtgcagagtggttttggccgtaccggtacgctcttcgcgattgagcagtttggggttgaacccgacatcattgtagcggccaagagtattgctgccggtatgccactggctgccacaattggtcgtgcccgcattatggattgcgcccactacggcggtgtcggtggtacctacggcggcaatccgctcgcctgtgtcgcagcgctggccactatcgatctgattgaacgcgagcgcttgctggaacgggcaaaggtgatcggccaacagattcgggccagatttgaaccattactgaccgatgattcactcgatccactggttggtgatgttcgtggtctgggggcaatgatcgggatcgagctggtcaaggatcgccgcaaacgcacgccagccgccgccgaagaggtgctggcgatcctggggcgtgcgcttgaacgtggtgtgctggcgatgcgggccggtctgtatgtgaactgtatccgcttgctggtaccacttgttatcaccgatgatcagctcgatgaagggttagaggtgctg

SEQ ID NO: 32677 - DNA, 1023 bp, Chloroflexus aurantiacus
gccaccgtcattttgcgcgatgtttttggtttcagtacgttccgccctcatcaagagcagattatcggccgtgtattgcgtggcgaatcgaccctggccgtcttaccgaccggtgccggcaagtcgttgacctatcagttaccggcccagcttttaccacaggccacagtggtgattagccctttgatcgcgttaatgaaggatcaggtagaccggttaccacctgccgtccaggaacgggcaaccatcatcaactccacccttaccgcaggagaggtgcgcgaccgcttacgggcaattgctgccggtaagtacaaactggtttatgtcgctcccgaacgcctgcgacaacgctcattcctttttgcgcttcgtcactgtggcgtgtcccgtcttgtgatcgacgaggcgcactgtatcagcttatggggacaaaattttcgccctgattatttgttcatcaaccgggcgatgaacgaactcggccaaccgccagttctggctgtgacagctacggctgcctctgatacgatccatacgctgcaaacgatgatcggcccgctgacggtcgttcaggcacctgtctttcgccctaacctgttttttcaggtgatccaggtgcgaccagggatgtcaaaggcacgtagtctgattgaactctgccggaagatcaatggctcaatcatcgtgtatgcccgtgcgcgccagacttgtgaagacctggcgctggagctgcgttctgccggtgttgctgccgatcactatcacgctctgcatcctgatcgagcaggtgtgcaagagcggttcatgaacggaaagacgcgggttctggttgcgacagtcgcgtttgggatgggggttgacaaagccgatattcgtgctgtcatccactacaatcttcccgcctcactcgaagcctactaccaggaggcgggccgggccgggcgtgatggcttgccggcgcgctgtattctctttttcagcgagaatgatgctcgtgtattgcggacctggttgcaatca

SEQ ID NO: 32678 - DNA, 3267 bp, Chloroflexus aurantiacus
atgccaaagcgcaccgatttacataccatcctgatcatcggctctggcccaattgtgattggtcaggcctgtgagttcgactattccggcacccaggcttgtaaggcgttacgtgaagaagggtatcgtgtcgtcctggtcaactcgaatccggctacaatcatgaccgatcccggcctggccgatgcaacgtatattgaacctctaactgttcccagcctcgagcggatcatcgcccgtgaacgaccagatgcgattctgcctactgttggtgggcagacggcgctgaatctggcagtggctctccacgaggccggtatcctggagaagtatggcgtagaactgattggcgcctctgttgaagcggtacgtatcgccgaagatcggcaacgcttcaaggacaaaatgatcgagattgggttacaggtgccacgttcagggacggcgaccacgcttgaggaagcgttagccattgtggcgcaaaccggttttccggccattattcgcccatcgtttacgctgggtggtgaaggtggtggcattgcctacaatatggaggagttccgcaccattgttgaacgcggactcgatgcctctccggtatcacaggtcttggttgaagagagcgtgctgggctggaaagagtttgagctggaggtgatgcgcgaccggaacgataacggcgtaatcatctgttccattgagaacatcgacccgatgggtgtccataccggtgatagcattaccgttgcgccggcgatgacgctcaccgaccgcgagtatcagcgcatgcgcgatatggggctggcggtgctgcgggcggttggtgtggaaaccggtggctcgaatgtgcaatttgctgtgtcgccaaccgatgggcgtatttacgtgattgagatgaaccctcgtgtgtctcgctcgtcggcactggcctcgaaagcgaccgggttccccatcgccaagatcgcggccaagctggccgttggctatacccttgatgagctgcccaatgacatcacccgcgagacaccggcgtcgtttgaaccgaccctcgactatgtggtggtgaagattccgcggtttacgttcgagaagttcccccaggccgatcagaccctcaccacgtcgatgaaatcggtcggtgaagtgatggcaattgggcgtaccttcgctgaagcgttccagaaagcctggcgttcgctcgaacagggacgtgccggctggggagcagatggtcgcgatgcgattgagccggaacggctgcgcgaacggttgattaccccgcatcctgatcgcatgttttacatccgctacgccttgcagagtgggatgtcggttgagcaaattagcaatctgactaaaatcgatccgtggtttatccgtcagctcgaacagattgttaatctggaaggacgtttgcgggcgttcgatctggcaaccatcccgcccgatctgctccgtcaggccaaacggatgggattcagcgatgcgcaactggctcatctcctgcgcgtgcctgccggcccgcagcgctggtctgccgagttggctgttcgccaacgccggctagagttgggcatccggcctacctatcaccgggtagatacctgcgctgctgaatttccggcctttaccccctatctctactcatcgtatgagagtgaagacgaggccgaaccgactgatcgcaaaaaggtgatcattctcggctccggccccaatcggatcggccaggggatcgagttcgactactgttgtagtcacgccgtctttggtctgcgtgcccttggctatgagaccattatggtcaactgcaacccggagaccgtttccaccgactacgacacagcagatcggctctatttcgagccgctcacgctggaggatgtgcttaacgtagtcgatgttgaacgtcccgacggcgtcatcatccagttcggtggtcagacaccgctcaaactggcgcgggcactcgaagcagttggtgtacccatctggggtaccgcacccgaagcgattgatctggccgaggatcgggatcgctttggggcgttgttaaaggagttgaatattcccgcacctgagcatggcagtgctacctcgtgggaagaggcattgaccgtcgcccgtcggattgggtatccggtcgtagtacgtccgagctatgtgctcggcggacgggcaatggcaatcgtctacgacgatgccgcactcgaacgctacatgcgcgaggctgtcgctgcctcgccggaacatcccgtcctcatcgaccgttttcttgaggatgccttcgagatggatgttgatgccgtgtgtgatggtcatacggtcgtgattgccggcatcatggaacagattgagctggccggtgtccattccggtgacagtgcctgtgtgatccccacatacatggtggcggaagaacacgtcgtgaccatgcggcattacacggaacggctggcgcaggcgctgggtgtggtcgggctgatgaacatccagtacgcgatgaaagacggggttgtctacgttctggaagtcaatccgcgtgcatcgcgcactgtgcccttcgtcgccaaggctaccggtgtgccgtgggtgcaactggccgtgcagtgtgcagccggtgcccggcttaaggttgatcaggatcaggtgtatgttacgcatcccgtcctgcctgattcaccccgctatcgcctggacgtcagcagtgagcaacgctttcatgtcaaagaggtggtgctgccgtggtcgcggtttagtggcgttgacacactgctcggccctgagatgaagtcgaccggtgaagggatgggcagcggggcgaccttcggggaggcattcgccaaagcccagatggcctgtggtagccacctgccgacgagcggtaacgctttcttgagtgtcaatgaccgtgataaggcgacattgctaccgattgcccgcgaactggccgcactcggcttcaatttgctggcaaccagtggtactgctgcgtaccttcaacagcacggcctgaaggtcacaccgatctacaaggtgaatgagggacggccaaatgcggtcgattacatcaagaatggcgaaattgcgctgatcgtcaacaccccgctcggcaaagtaagcttcttcgacgaggcggcgatccggcgggcagcgatcacctacggcgtgccgacgctcacgacactctctggggcggcggcggctgtgcaggctattcaggcgttgcgggccgggcaatggacgctccagtcattgcaggaa

SEQ ID NO: 32679 - DNA, 2517 bp, Chloroflexus aurantiacus
ggtttcacacctaatgatgcccagcgtgaggctatcttgcacgtagatggccctctctacctgactgctggtcctggttccggcaaaacgcgtgtccttctctggcgaacgctcaacttgatggtttactatggagtgaaagccgaggagatttttcttgctacgttcaccgagaaggcagccagacagttaagcgatggtttacgctcctatctcggtctggtcaccaacctgaccggccagccttatgacctggctggaatgtacattggcacagtacattcgctctgccagcgtatacttaccgaccgacgacgtttttttctcgaccgccagcggcctcgttcgcctgcgcttctggatgacctggggcagtatttccacctttacgaacgagccaactgggagatcgtcacccgcgctgctggccttgatcccagttcggctgctgaagtcgttaccggacacttgaacacgcaaccttcagcttctcgtcatcgtgcaatcgaagcactacgccccttcttcaaccgcttctcggaagaattgcttgaccccgccgagttgcgcccgcgcctttccagcctggtacgtggcgagttttcaccgcaagatgtagatttgctgctggcgctctacgagggttatcttcaaagcctgcgagaggcgggaagaaccgactttgccctgcttcagcgcgaggcgttccaggttttacaggagttccagggggccggtggtgtctttcgccacgtgattgtggatgaatatcaggataccaacactatccaggaacgcatcttctttcgcttggcagaaggaacaggtaacctatgcgtagtaggagacgacgaccaggcactttaccgctttcgcggcgcaactgtggaaaactttgtccagtttccagcccgctgccagaagtatctgaaccagacacctcgtaccatttccctggagatcaactaccgctcacgttcccacattgttgaaacctatggacgctttattaatcacaccaattggcaagacagagatggaatggtctaccgcatccctaaaaatattcgtgcctatcgtaacgacctggcgccagccgtagtagccagcactcccgctgagccggagcaggcttgccaggagattgcccgttttgtccgtcgccttatcgagacagggaaagttcaaaacccgaatcagatcgcctttctctacccctcgctcaaatccgaacaggcgaagcgtatgatcgctgcattgaaagcggaagggctggacgtgtatgctccacgcgctgggcgttttctggaagtggacgaagccagagatgtactgggcatcttccttgccatcttcggacgccctacaatcgaagggaggggacatgatctgcgaacttttgaggtttacttaacggcccttcaaacccgcgctgatgaattacagcagaccgacccgttactcaagcagttcattcagaaccgccgcgacgagattcagcgcgccctcagcgattatgccgccctgcaagccgtgctgacccgcaaccgctggcttcccgatcagctctacgatccggcaagcatgaaacgcgccctggctgacgcaccaggactttcagagaccggacaccgcctggtgtctagcgcatacctcgaccgcctcgtgctcctgcgcgccagcgagggacgaccactttcgctggaatatgttattcgccgtgcaacctcactcgactggaacctgctcgacctgttctaccagttgatgggctttgagcacttcaaagccatgttcgaccgtgccgaacgacaaggcgacgaaggcgcagtagccaatctgggactgctaacgcaatacctggcacgcttcgtgcaggaacgtgtcaacattctgaccgctgccattctcagtgaacacaaattttcgggaatgttcttcggttccttcatcttcgctctctaccgcctggaagagggcgagcgcgaagacgaggagaatcccttcccacgcggacgcattccctttctgaccatccaccaggccaaaggattggagttcccggtcgtagtgctgggcaatctcgataaacgcgaccacggtgctcctctcatcgaacgtctggtacgccccttattgtcacgcccggccggcgaaccacttgatcgaatgaccgcctttgatattgcccgcatgttctacgttgccctgtcgcgggcgcagaatttgctcatcctggctcatttttccggacgcgggcagcgccaggacgaagcgttcaaacctatcttgaacggtaatctacctcgcctggctgatttcgacctgaacagtttgcccaacgctgtcgcaaccgatgagacgttgcccaaagtgtactctttcaccgccgattacctgctctatcagacatgcccgcggcagtacatgattttccgtaagttcggtttcgttccttctcgttcgcaaacgatgttcttcggctcgctggtgcatcgcacgatagaggatttgcac

SEQ ID NO: 32680 - DNA, 3228 bp, Chloroflexus aurantiacus
ccggtcgtcggtctgctcttctaccgggcacatttgctgagcgggaataccggattcgtggacgcgctgatcaatgggttgcagtcccgtggcctgcgggtgcgcgctgtctatacccaatctctgaaagcgatcaatgcggaaggtatcccgattgggctggctttgatcgaacaggcggggacggtggatgtgatcatctctaccctgagttttgcgcttggcgatgatgatccgcatccctttacccgtctcgacgtgccggtgatacaggccctcctcagcagtagcagccgggaagcctggcaacgggacgggcgtggtctggggccgctcgataccgcgatgaatgtcgccctgccggagcttgatggacgaatcatcagcgtaccgatagcgtttaaggcgcaagaaggtgaagcggctgcgcggtcgctgcctgaccctgaacgaattgaacgactggccggactggtctggcgattgagtcaacttcggcacaaaccgaatgcacagaagcggatcgctatcatcttgactaacagcagtgccaaagcgcagcggattggaaatgcagttggtcttgatgcacctgcctcgctgatgcgtctgtttgctgcgttgcaagatgccggctattccgttgctggcctgccggagcatggtgaccgtctaattgccgatttgattgctcgctgctcatacgacgagacctggctgacgactgagcagttggcacaggcgtatcgcattcccagcacgacctatcaacgctggtttgccgaattaccattgtcgttacaagaggcgatgacgcgccaatggggaccgccaccgggtcgtgcgtatgttcatcgcggggagctggcgctggcggggttggagtttggcaactgctttgtcgccctgcaaccaccacgtggatacgatatggatccaaacgccatttaccatcgccccgatttaccaccgcctcacaactactacgcgctctaccgctggttgcgtgatgtgtggcaggccgatgccatcatccatctcggcaaacacggtacgctcgaatggctgcccggtaagggggttggcttgagtgccacctgcttccccgatcccttcctgggcgatatgcctctgatctatccgtttatcatcaacgatcccggcgaggggacacaggccaaacggcgagcgcatgcggtaatcatcgaccatctcacgccaccgatgacgagtgccggcgcgtatggtgacctggccgaactggcgcacctggtcgatgagtattaccgcatggaacggcttgatccaacgaagctcccgctgttgcaacgccaaatctgggatgtgttgcaacgcagccaactggccgacgacttgcgctacattctccaggccgaccacggcgatcaccgtcatgaatgggacggcagcgtgctggaagatggtacgcctaccgtgctggccgagttggaggggcgcgaggtagcgcatctgcttgaggatattgaagggtatttgtgtgaactgaccggagcacagattcgcgacggtctgcacattctcggcacgctgccggagggtgatcagcttgttgatctggtttaccacctcttgcgattacccaacctgcacgcaccggcactgccggcgtctgtcgccaccgcactcggtgtcgattggtatgcactccagaacacaccgggacaacggcgcaatggtgacgatcactttttgacgaatgccgatgtgattgcccatatcgaaacgctctgtcgcgatctgctgcggcggcttcaggcagagcactggcaagcggcgatgatcacgtcagtaatcgaacaggtgctgccggcgtgtcgtgataccactgcggttgcgacagcactgcaatacgcctgcgattggattatcccccgcctgcggcagagtgcaattgatgagatcgatcatctgctggcggcactggccgggcgcttcgttccaccagggccgagcggcgctccgacacgcggtatggcgcacgtcttgcccacgggacgcaacttctacagtctcgatccgcgaagcgtaccggcaatggcagcctgggagaccgggctgggactggcgaatgacctgctgcgccgttatcagcgggaatacggtacgctgccggaaagcgtcggtatcagtatctggggtaccagcctgatccgcactgccggtgacgacgtggcgcaggttatggcgctgctgggagtgcgtccgcgctggcaacgcgaaaatcgtcgggtaatcggttttgaagtcattccactgacggaattgggccggccacgtattgatgttgtctgccggattagcggtttcttccgtgatgccttcccgcatctgatcgagctgctcgatcaggcgatccaaacggtcatcgacctcgatgaaccgctcgaactgaattttccccgcaagcatgcctacctgaccgcacaggcgctggtcaatggcggtaccgatcaggaaacggcccaacgcgaggctcgctatcgcatctttggtagtccaccgggtagctatggcgcaggtatgttgcccttaattgacgggcaaaactggacgaatgacgccgatttggccagggtgtatctgcgatggggcggatatgcgtacacggcaaccgaacagggagtaccggctgaaacggcctttgctgctgcactcagcaccgtccaggttgcgaccaaaaatcaggacacgcgcgaacacgacattttcgatagcgatgactattttcagttccacggtggcatgatcgcggccatccgtgcgctcagtgggcgtaatccggcccgctactttggcgacagtagcgatccggctcgcccgcgcacgcgcgatctgcgcgaagaggcgcgccgcgtcttccgggcgcgggtcatcaatccaaagtggctggccagtatgcgccggcacgggtacaaaggcggcctggagctggcggcaacggtcgattatctcttcggctatgacgccacagcccaggtgctggcagattggatgtacgagcaggtgacgacccattacatccgcgaccctgagattcagcagtggttacacgaagtaaatccgtgggcgctccaggcaatcgccgagcggctcaacgaggccatcgggcggggcatgtggcgccatccttcacctgaagcgcaggccgctatcgccgaggttctggcacagggggaggagttacgt

SEQ ID NO: 32681 - DNA, 1107 bp, Chloroflexus aurantiacus
atcacaaccacgctcacagttacgaccagcacaacttcctacccggtcatcgtcggggcaggtatcctgtccaacctcgccgactacctggctgaatgcgccctgcgcgggacagcctggattgttgccgatgaacacctgaccgccattgccgatcagaccgcagcccacctgacagcagccgggtatcgcgttcacacgaccactgtgccatcaggtgaacagagcaaatcgttcggcgaactgaaccgactgtacgactggatgatcgaacacggaatcgaacgccgtgatgtcgtcctggccctcggtggtggcgtggtcggtgacctggcagggtttgcggcagcgaccatcttgcgcggtgtggccctcgtccagataccgagcacgctcctggcgatggttgatgctgcggtaggtggtaaaaccggcatcaaccacccgctgggcaaaaacctgatcggagcctttcatcaaccacggctggtgttggccgacaccaacctgctggcgacactaccggctcgcgagctacgcgccggctgggccgaagtgatcaaacacggtgtcattcgcgatgccgaattgtttgacgccctggaaacactcgccgcaacccaacgctggcacgccgacaatccggctacctgggatgcgaccgatccggccctcaccggtgaactgaccaacatcatcgcccgcgctgttgcggtcaaagtcgacgttgtatcacgtgatgaatttgaacgcggcgaacgcatcaccctcaattacggacataccattggtcacgccatcgagcaactgcttgggtatcgcctcctgcacggcgaatgcgtcgccatcggcatggatgccgctgcgcgcattgccgtcgccctgggcatctgcccgccggccctggtcgaacgacagcgtaacctcctcgccgcctacggcctatcaaccgcgctgccggcagaccttgaccgcagtgcgatcctgaccctcatcggtcgtgacaaaaaggtacaggccggaaatgtgcgctgggtcttgccaaccgctatcggtcaggtcgtcgtgcgcgccgacgtgccgcttgcggtggttgaagcggtgctg

SEQ ID NO: 32682 - DNA, 1311 bp, Chloroflexus aurantiacus
atggctaaaattctgcaacacctgccggttggcgaaaagatcgggatcgctttttccggcggcctggacaccagtgctgcaatccactggatgcgcgccaaaggtgctattccctatgcatacaccgccaatctcggtcagcccgatgaacccgattatgaggatattccccgccgggcactgatgtacggcgccgaagcagcccgcctgatcgattgccgccagcagttggtcgctgagggactggctgccctacagtgcggtgcatttcacatctcaaccgccggtttgccctactttaataccactccactcggacgtgcagtaaccggtaccatgctggtcgcggccatgcgcgaagatggggttcatatctggggggacggcagtacctacaaagggaacgatatcgaacggttttatcgctatggcttgctggtcaaccccgatctgcgtatctataaaccgtggctggatcaggcgtttatcgacgaattgggtggtcgggccgagatgtctgcctacctgagtcgggccggttttgagtatcgcatgccggcggaaaaagcctattcaaccgactccaatatgctgggtgccactcacgaagcgaaagacctggagtttctcgaccgcaacatcacgattgtcaagccaattatgggcgtggccttctggcagccggatgtgcatatcgaatacgaagaggtacgcatcacctttgaagagggcttcccggttgcgattaatggcatgaccttccccgaccacgtcgccctcatggccgaagccaaccgcattggtggacgacacggcctcggtatgagtgatcaaatcgagaatcggattatcgaagccaagagtcggggtatctacgaagcccctggcatggcgctgctctacattgcctacgagcggctggtaaccggcattcacaacgaagatacgattgatcaataccgtgagtacgggcgaaaactggggcgtctcctctacgccgggcgctggttcgatccacaggcgatgatgatccgtgagtcgttgcagcgttgggttgcccgcctgatcaccggtgaggtgacgattggtctgcggcgtggtaacgattattcaatcctggacacgacctcacctaatttaacctacgacccggcccggctgacgatggagaagggggaagccagcttcacaccccaggatcggattgggcagttgcacatgcgcaacaacgacattgccgatacgcgcaagaagctcatggtttacctgcgcaccggtctcctcggcgagagtggcgtattgccgcaactt

SEQ ID NO: 32683 - DNA, 933 bp, Chloroflexus aurantiacus
gatggtcgtttgctcatttttaccggcaatgccaacccggcattagcgcaagagattgcccgcaacctgcgcatcaatctgggccgggcactggttggtaccttcaaaaatggcgagacacgggtcaagattcacgacaatgtccgtggctgtgatgtgtttgtgattcaacccacctgtacgccggtggaccatcacctgatggaattgctcatcatgatcgatgccttccggcgagcctcggcagcgcgggtcacggcggtcattccctactatgggtatgccaagcaagagaagaagacctcgggccgtgagccaatctcggccaagctggtagctaatctgatccgcaccgccggcgctgaccgcgttctgacgatggatctgcacgctccagccattgaagggttcttcgatattccggttgaccacctgcaagcctcgccactgctggccgattacattcgcgaactgaacctgcctaacccggttgtcgtctctcccgataccgggggcgtggggcgggccaatcgctttcgtgagcggattggtgccggactggcgattattgccaaacaacgacccgaaccagatacagccgaagttatcgaaatggtcggtgaggttgaggggaagacggcaatcatcgtcgatgatatgatctcaaccgggggaaccctgattgaagcagcccaaacgctgctggcccgtggcgcacgggctgtgtatgcctgtgctacccacggtatttttgccgaaaacgccttacagttgatcgccgagtccgatctcgtcgagacggtagtcaccaacacgatccctcaaccaccaaccgccgcagcagcccgggtgcgcacgattagtgtggcaccattgtttgctgaagcgattatgcgtatccacaaagatctatcactgagcgcgcttttttcc

SEQ ID NO: 32684 - DNA, 861 bp, Chloroflexus aurantiacus
gaattaccatcagggccactcgtcgaaaccgactggctggctgcccatcttgggcatcccaaactccgcatcgttgacatgcgcggtaccgttttgccaccctctgcccctaaaccgcactactttgcccgccacgacgactacgccgccgggcatattcccggcgctgtctacattgattggacacgtgatattgttgatcttgacgatccaacccctgtgcaggtagcaccacccgccaaaatcgctgaagaattgggaaagcgcggtatcggtgacgattgtgtagtggttgcctacgacgactggtattcgatgtttgccgggcgtctgatgtgggtactacggtattacgggtttgagcaggtgcgcgtgctgaatggtggcatggtcaaatgggttgccgagggccgaccgttgacgacggaagtgccagactatccgccggcgatctttacccctcgcccccagccacacctgcgtaagaccgccgaccaggtgctgcaagccctgggtagcgatctgctcttgattgatgcccgtcatgaacgggagtatcaaggcttcgagtcgcgtgccgctcgcggcggccacatccccggtgcacgcaatgtcttttatcagagcctggtcagcgggccgcatcaaacctatctctcacccgatcaactccgcgaacgttttcttgccgccggaattgatcctgacgccacgactgatcgtgaggtcgtcgcctactgcaacggcggtgtttcggcgacacccacagccatcgcctttgaactggtgagtggtcgccgggtcgcgatctacgatggttcgtggaatgagtggggtaacgatccaaccaaaccgcttgaa

SEQ ID NO: 32685 - DNA, 1335 bp, Chloroflexus aurantiacus
gaagtaaccatgcctcgtctctccgacacaatgtcggaaggtactgtgggccgctggttgaagaaggtcggcgatcagatcgcggtgggcgatattatcgccgaaatcgagaccgataaggccacaatggaactggaagcgtttgaagccggggttttgcagcagattttgatcccggaagggcagacggtaccgattggtcagccgattgccatcattggtgatagtgcggccccggttgcggctgcgcctgcaccaacccctgcaccggcagccgcaccagctcctgagccggcagccgcaccgacccctgccccagcccccgcactggtgacgaccgcagcggctcccggcggtggtgatgaaaatggtcggatcaaggcctctccggtcgctcgtcggttggctgaagagttgggcatcgatctccgccaggttgttggtaccggccccggcgggcggattatcaaggaaaacgtggaagagtttgctgcccggcgtggtaccgccgctccagccgctgctccggcaccggctcccgctccagccgctgtcccggcaccggctcccgctccagccgctgcctcggcaccggctcccacaccggcaccggcacctgccccaacccgtgcgccggcaccgactccggctccggcactggccggcgctgagccactgagccggatgcgcaaagcgattgcccgggccatgaccgacagtaaaccgggtgtgccgcatatctacctcactatcgaggtggatgctgatgcgctgatggcgctgcgcgaacagatcactgccggtggtacccgcgtctctgtcaacgatcttgtggtgaaggcggcggcaaaggcgctggcaaaggtgccggcggtgaatgtcagcttcagccagaccgctgacggccagccgggtatcgtgcgccacaaccagatcaatatcggcgttgcagttgcactcgacgatggtctggtagcgccggttgtgcgcgatgccgataagaagagcattagcgtgattagcgccgaaatccgcgatatggcgctgcgtgctcgcgaagggaagatcaagcaaaacgaactcgaaggggcaacattccaggttaccaacctcggtatgttcggcatcgttgagttcgggtcgatcatctcggtgccccaggctgcctcgctggccgttggtgccgtgcggaaggtaccggtcgtgcgtgacgaccagatcgtgatcggacaggtgatgaatctcaccttaagcgccgatcaccgggtgatcgatggtgccgtgggtgcgcagtacctgcaagagctgcgcaagctgctggaagcaccgatgaat

SEQ ID NO: 32686 - DNA, 963 bp, Chloroflexus aurantiacus
attacctatcgccaggctctgaacgatacgcttggtgaggaattagctcgcgatccgaacgtctttctgatgggcgaagagatcggcgtctttcagggttcgtatcgggttaccgagggtttattggccgagtttggcccgaagcgggtagttgatacccccatcgctgaagaaggttttgtcggcgtggcgattggcgccgcgatgctggggctgcgtcccgtcgtcgagattatgaccattaactttattctggtcgctatcgaccaggtcgttaaccacgcctcaaagattcactatatgtttggtggtcaggtgagtgtgccgctcgtgattcgcactccttccggcggtaccggtcagttggctgcgacgcactcacagtccttcgagaactggtttgcctactgccctggtctgaaagttgtggcaccggcaactccctacgatgctaaaggcttgctgcgtgccgccattcgtgatgatgacccggtcatctttatcgagtcgctggccctctacgacacgaagggcgaagtccccgaagacgatgactatgtcgtgccgattggggttgcggaagtcaagcgtcaggggactgatgtcaccgtggtttcctattcgcgtatgacggcggtagctctccaggtggcccagcgcatggaacaagaggggattagcgtcgaggtcgtcgatttgcgctcgctccggccactcgaccgccccacaatcattgagtcggtgaagaagaccaatcgtgcggtcgttatcgctgaagactggtattcatacggggtgacggctgaaatcgcggcgacgatccaggaagaggcgttcgattatctcgatgcgccagtctatcgggtggccggtctcgaagtgccgctgccatacgccaaggaattatcggctgcttcaaagccgaatgctaacagcctgatttacgctattcgacaggtaatg

SEQ ID NO: 32687 - DNA, 954 bp, Chloroflexus aurantiacus
cccctacttgaacgcgccaccgccgacgaacttaagcattattactatcaaatgctattgttgcgtcggtttgaagagcgcgccggcgagatgtatgtaaaagctaaaattggcggatactgccacctcaatctcggtgaagaggcaaccatcgttggtctgatggctgccctgactccagacgactacatcttcactaattatcgcgagcacggttacattattgcgcgcggtgttccccctggcccggtgatggccgaattgttcggtaaggaaacgggtgtctctggtggtcgtggcggttcgatgcatctgttcgaccgcaagaccaattttatgggtggctatgccatcgttggtggtcaggtaccgctggcagtcggtgcagcctatgcactgcgttaccagaacaagcccggtgtggttgttgcccagatgggtgacggtacgacgaacatcggggcattttacgagtcgctgaacctggcgaaactctggaagtgtccggtgctcttcttcatcgttaataacggctacggtatgggcacctcggtcgaggccggttcatcagagccggatttgtggaagaaaggtgcttccttccgcatccacggcgagcgcgttgatggtaccgatgtcctggctgtgcgcgatgtcgttcgccgcttgcgggcacgcgccgaagccgaaggcgagccggcgattatcgatgccgtgagcttccgcttccgtggccattcggtgatcgactcggatcgctaccgtgacccggaggctgtgcggcggggacgcgagttgtacgacccgattcggaagtttgctaccctcctgcttgaccatggggtcgttgacgatgcctggttgaagggcatcgccgaacaagttgagcgtgaagtgcaagaggccatcgatttcgcgaacaatagccctgatccgaaattcgaggacctctac

SEQ ID NO: 32688 - DNA, 1395 bp, Chloroflexus aurantiacus
tacgatctcgtggtacttggttcagggccgggcgggtacgttgctgccatccgtgctgcccaactgggtatgaagacagcgattgttgaggtgaatgccctgggtggcgtgtgtctgaacatcggctgtatcccaaccaaagcactcttgcacagcgccgatctgcttgaagaggtgaaggaggcgaagcgtttcggcattaccgttgagaacgtcgcctttgagctggccggggcaatgaagcacaaagatacggtcgtcaagcagagcaccgatggcgtggcatttttaatgaagaaaaataagattgaggtagtggccggtcggggccggctaattggtcgcggtcaggtgcatgtgcagttaaacgaaggtggtgagcgggttctggcggccaaacatattattgtcgctaccggtggtcggccacgtcccttccccggtattcccttcgatggcgagcgggtgctctcttcgaccgatatgcttaccttgaaaacggtaccgtccagtctgctggctatcggtgccggagccatcggggttgaattcgcctcgatgttccgttcgttcggcagtgatgtgacgattgttgaagccttaccccgcattgtgccgaatgaagacgaagaggtcagtgctgagttgaccaaggcgttccagcgccgagggatcaagacgctggccggggcaaaggtcgaaggggtggatgttggcggcgagaaagtggtggtgaccgtggttgatagctctggcaagccacagcagattgccgtcgagaagttgctggtctcgattggcatcgctcccaacaccgagaatatcggcctggaggaggtcggtgtcaaggtaaacaatcgcggtttcatcgagaccgacggtttcctgcgaaccagtgccgagggtgtctatgccatcggtgattgtaccgccaataccccctggctggcgcacaaggccagcgccgaggggattctggccgccgaacatatcgccggtcatcacgtgacgccgattgactacgggaagattgctgcctgtacctactgcaaccctgaaattgccagtgttggtttgaccgaggcaaaggcacgcgagcgtggttaccaggtgaaggtgggcaagttccccttctcggccaacggcaaagcgcgggtgctcggtcagacccggtttggtttcatcaagctggttgccgatgcccagtacgatgagattttgggtgtgcatatgatcggcccgcgggtcaccgaaatgatcgccgaaggtggcattgccctcagccacgaagcaaccggtgagagcatgatgcagacgatccatgctcacccgacgctgtacgaggcgattggtgaggctgcccatgcgctggtgcacggtgcgccgatccatctg

SEQ ID NO: 32689 - DNA, 609 bp, Chloroflexus aurantiacus
atgcgactgatcattgttcgccacggcgagagtgaatggaaccggatcaaccgttatcagggccagcaggacgcgccactctctgaattggggcgcaagcaggcagcagcgttgggtgagcgtttacgacacgaaaagattgacgttgtgtatagcagccgcctgcaacgcgcagcccacactgcgcaggcgattgtagcccaccatcccggtcttgagatcatctacgacgacgcgctgcttgagatcaaccacggagaatgggaagggaagtatctgcacgagattctggagcgttacgccgatggtctgcgcgaatggcggcagcatcccacccgttcgcagatgccgggtggcgagagcttctcgaacgtactcaagcgggtactcgacttccgcgagcggatttgtgtccaacacgccggacagacggtcttgatcagtacccacgatgtcatcgttaagattctggttgccgatgctctgggaatgaatatggatcgcatcaatcgcatctgggttaccaacgccagcatcagcgtgattgaatacggtgatgatctgccctacctggtgagcctgagcgaggcgtgccatctcggtcatttg

SEQ ID NO: 32690 - DNA, 1542 bp, Chloroflexus aurantiacus
cttggacgctaccgcgaaattgctcaggtgctggtgcatcacggttttggctatctggtcgatcagcttgggttgagtgggctgttgtcgttgccccgccgggtcattttgcgggcaccggcaccgccaccactcggtagtgcagcccggctgcgcgaggcgctgatcgagctggggccgacgttcgtcaagctgggccaggctttgagcactcgtcccgatcttcttccagccgatgtggttgccgagctgagtaagttgcaggatacggtgccgccgtttcccggcgatcaggcggtggccctgatcgaagcaacctttaatcggccacttgatcaactgtttattgcctttgatcgtcagccctttgccgctgcctcgcttggtcaggtacacgctgccgttctgcctgatggaacgcaggtggtggtcaaggtgcaacgcccggatattgcctcgcgcattcagaccgatctggcaatcctggccgatctggcaacactggcacaggaacgtctggccttcgccgcccaatacaacctgagcgagattgtgtgggagtttagcgccatgttgcgcgccgagcttgattacgtccgtgaagggcgcaatgccgagcgcttccgccagatgttttgcacaaatccgcatatctatattccgcgggtgtattgggaatataccggtagccgtatcttgaccacggagcggattgttggggttaagctaaacgatatggcaggattgcgtgctgccggggttgacatgtcgcgcctggcgcgggcaagccttgatattacgctggaagagatttttacccacggtttctttcacagcgatccccatccgggcaacttcttcgtactcgatggtgacgtattgggagtagttgatttcgggcaggtaggcacgcttgatcacgccacgatgcagggcttgctctggctgatgggtgcgctggtcaatcacgatagtcaggggctgctcagatcactcgaacgcctggaagtcataccccggcgagcggcaaatctggcgttgcgtcgcgatctggaacggttcgtcgagggatttgtggatcggcccctcggcctgatttcggcccgcgagacattcgatggcctcaccacactcctacggcggcaccgtttaaccattcccggccctctggccacgttgctcaagaccattgtgatgatggaggggttggggatgcaacttgatccgaacctgaatgtcttcgctgccgcccgcccgtacattcagcgcgcccttcgtgagcagatgaatccaaccgccctcggcgctcaggcgctggcaggtggtcgtgaattgggtgaactggcgtttgatctacccatccagatcagtcaaactctccaacacctcaacgatggcgagttgcgcattcaaacccgcgagcttgaattgcgccgactggccgctgcgttgatcggtgctgccaatcggctggcactggcgctggttgttgcagcgtttatcgtaggggtagcagcattggtcattgcaatgcgtgctttg

SEQ ID NO: 32691 - DNA, 648 bp, Chloroflexus aurantiacus
cgtcaacctcgtgcccctctgcggtacgtggttcgtgaactgctcgaaacagctatctttattctgctggtttttctcatcgtgcgcggtgtcgtgcaaaatttcaagattgaaggctcaagtatggagccaacgctccacaccggtcaatatattttagtcaacaaactcatctattttcatttcgatttaaacgcaccactacgcctgcttcccggccaatctgatcttccaccccgtattgtatatccttttcgccctccccaacgcggtgacattgttgtctttgagtatccacgtgatgtacgtaaagattatatcaaacgagttattggtttgccgggtgacattatcgagattcgtgaaggtaaagtctttgtcaataacgaaccgctcgatgagccatacctgcgcggtgcgtccacctattgtctgggtgggtatccctgcgcccagggaccggtcctggtgccagccggtagtatcttcgtgatgggtgacaatcgcggcaatagttccgactcgcgagagtgggatgccttaccgctggatcgggttgtcggtcaggcatggctcatctactttccgtttagtgattggggattggtaccgcaccatcgctacgagaccagtactgcggtagcacct

SEQ ID NO: 32692 - DNA, 1252 bp, Chloroflexus aurantiacus
tacgacatcaaagatatcaatctggccgagcaaggccgcaagcgcattgagtgggccgaaaaagagatgcccgtgctgcgcctgatccgcgagcgctttgcccgcgagcgcccactggccggtctgcgcatcagcgcctgtctgcacgttaccaccgagactgccaacctcatgcggactttggctgctggcggtgccgacgtggtgctggttgcatccaaccctctgagcacgcaggatgacgttgctgctgctctggtggcctatgaagagattccggttttcgcaatcaaaggcgaaagcaacgaggtgtattacagccacatccggggctgcgctcgatcacaatccgcagttaaccatggacgacggcgccgatctggtgaccggtgtgctgagggatcgccccgatctgatcccacacatggtcggtagcaccgaagagactacaaccggcgtcattcgcctgaaggcgatggccaaagagggtgtcctgccgttcccggtcatcgctgtgaacgacagtgacaccaagcacatgttcgataaccggtacggcaccggtcaaagcacgctcgacgggattattcgcgctaccaatattctgctggccggcaagacctttgtggttgccggttatggctggtgctcacgcgggattgccgagcgcgcacgcggcctgggggcgaatgtgattgtgaccgaagttgatcccatcaaggcgcttgaagcagtgatggacggcttccgggtgatgccaatggaagaggctgcatctcaggccgatttcatcgtcactgcaaccggcaacaagcacgtgatcgacagcaatgcctttgccgttatgaaagacggttgtgtgatcgcgaatagtggtcacttcaacgtcgagatcaatattcctgcgctcgaggcactgagtgttgaaaagcggcagccgcgtgcgtttgttgaccagtacattctgcgcgatggccgggcgatcaacctgctcggtgaaggacggctgattaatctggccagtgcagaaggccatccgagcgcggtgatggatatgagcttcgccaatcaggcgctggccagcgagtttttgttgcgcaaccagggcaaactaccggttggtgtgcatgccctgcccaaagagctggatcgcgagattgcagcgctgaagttggcggcgatgggcatcaagatcgacaccctcaccgccgaacaagaggcgtatctcaattcctggcaagagggcacgtaa

SEQ ID NO: 32693 - DNA, 1173 bp, Chloroflexus aurantiacus
cgcttctacttcaccagtgagagtgtcagcgagggccatcccgacaaaatgtgtgatcagatcagcgacgcaattctcgatgcgttcctgagtcacgacccgaaggcacgggtggcagtggaaacggcgacaaccaccggtctgatcgtggtgctgggtgaagtaacttacgaacgcggctacattccgattgaagagatcgtccgccgcacggtgaaagagattggctataccagcgccgaatatggcttcgacgccgacacctgtggcgtgatggtcgccattcacggtcaatcgcccgatattgcgatgggtgttgataaagcgcttgaagccaagatcggcgctatggccgatgacgtggaagcggttggggccggcgatcaagggatgatgttcggcttcgcctgtgatgagacgccggaactgatgccggccagcatcgccctggcccatcgcctgatccgtcggctggagcgggtacgcaaagatggcacactaccctatctgcgtcccgacgccaaatcgcaagtgacggttgagtacagctttggcaaaccggtgcgggttgatactgtgctgatcagcagccagcatgcaccggacatcactcaggatcaaatccgcgccgatttgatcgagcacgtcatcaagacagaaattcccgaagcatggctggatagccagaccaaaattttcatcaatccaaccggtcgcttcgtgatcggtgggccaatgggtgacagcggcctcaccgggcgcaagatcattgtggacacttacggtggcgttgcccgccatggtggtggtgccttcagcggcaaagacccctcaaaagttgatcgcagtgctgcctacgcctgccgctgggttgcgaagaacattgtcgccgctggactggcccgtcgggtcgaactgcaagtgagctacgctatcggcgtcgcccgcccgctctcgctcagcgtcgaaaccttcggtaccgctgccgttcccgatgaagtcatcctcaaagcggtgaatgaggtctttgatctgcggccaggtgcgattatccgcgatcttgatctgcggcgtccgatctaccgcaagacggcggctggtggacatttcgggcggactgacatcgatctgccatgggagcgcacgaatcgggtggaagagctgcgccgcgct

SEQ ID NO: 32694 - DNA, 1507 bp, Chloroflexus aurantiacus
cgaccaccggtgtgaccaattatggttcacttggaccacggtaagaccaagctgctcgatgcgatccgctcaacccgtgtcgccgagggtgaggccggtggcattacgcagcatattggcgcgtatcagattgaggttaatcaccgcaagatcaccttcctggatacgccgggtcacgaagcatttaccgcaatgcgtgcccgtggtgctcaggtgacggacattgtggtgctggtggtggctgccgatgacggtgtgaaaccgcaaaccgaagaggcgattgcgcacgtgaaggctgccggtgtgccgatgattgtggcgattaataagattgatctgcccacggccaaccctgatcggatcaagcagcagttggcaaacgttggagtgattgttgaagagtacggcggaaatgtgccttgtgttcacgtttcggcacgccagaaaatcaatattgacggtttgctagagatgatcttgctggttgccgatctcgaagatctgcgcgccaatccaaacgctcccgctgtgggcaccatcattgaggccaaactcgataagagccgcggcccggtggcgactgtcttgatccagaatggaacgctccatctggaggataatgttctggtgggatgcgtggccggtaagatcaagtcgatgttcagtgatagtggcaaacgtctgcgccatgccgaaccgtctacaccggtagagattgttggtctggaaggtgtgccacaggctggtgatattttgcaggtcatggatgacctggttgtagcccgtgaaattgctctgcaacgtcaacgccagcaacgggcagaggttatggccgctgctgcgcgcggtaccagcctcgaagagttgttcggcaaggtgaaacagggccaggtgaaagagttgaacctgatcctgaaagccgatgtccagggttcgctcgatgctattgcccatttgatcgagcagttgaaccagtcgcagcaggccgtacagacccgcatcatccatcgcggcgtaggagcaattactgagggtgatgtcaacctggtccctggccagtcacgcgatcatcatcggctttaatgcgcgccccgacccggcagcgcgtcgccacgccgagcagcacgggatcgatattcgcttctacaatatcatctatcagttgcaggatgatctgaagaaggcgatggccggtatgctggcccccactgtcaaagaggtggtcgaaggctatgccgaggtacgcaataccttccgcttgccaacccgtgaggtcgtcgccggtgtctacgtttccgatggaaagatcacccgtactggtcagaatgtgcgtgtgctacggcgaggcgtggtgatccacgacggtaaaatctcgtcactcaaacggtttaaagatgatgtgcgcgaggtgactgccggctacgagtgcggtctgattgtcgagggcttcaacgatatcgaagtcggtgatgccctggagttctaccgccaggagacggttgccgcc

SEQ ID NO: 32695 - DNA, 798 bp, Chloroflexus aurantiacus
ttaccaattgccgttattggggccggcgcgatgggcgaagcaattatcggtggcctgttgcgcaacgagctggttgccgccgatcagattttagccagccatccccgcgaagaccgccggcgcgaactgagccatcactacggcattcagaccacgcacgataatctggccgctgcccaatggggacgggtggtcatcttcgccgtcaagccgcaacagttacgccgggtgctgccaccactgcgcggcgccctgcgcgacgacgatctggcgatttcggtcatcgccggcgctaccatcgcctcgtttgccgaggcgcttgaccatcaggccgttgtgcgcagtatgcccaacactcccgcccaaatcggttgtggaatgacggtgtggactgcggcaccggcagtgaatgagcgtcagcgcggctgggcagccactgtgttgggtgcgctcggtcgtgaattgtttgtcgataacgagacctatctcgatatggcaaccgcgatcaatggcaccgggccggcgtatgtcttcctgatgatggaagcgatgatcgatgccggtgttcaccttggcctgtcgcggcggattgccgaagagctggtacaacagacgatgctcggctcggtgcaatacgccattcagagcggtttgcatccggcacagttgcgcaatgcggtcacctctcccggtggcaccagcgccgccgcgttgagtgagcttgagcgcggtggtctgcgcactgtcctggccgatgccatttgggcggcttatcggcggtcggttgaattgggaagg

SEQ ID NO: 32696 - DNA, 648 bp, Chloroflexus aurantiacus
atgaaacaagggttctttatcacatttgaagggccggaaggagccgggaaaagcacacaggctcgacgattgtatgagcgattacagtctatcggctaccctacaattttgactcgtgagccaggtggtactcgcatcagtgaattgattcggcgcattctggtggatctccgccataccgagatggcaccaacaaccgagatactgctgttctcggcagcccgggcccaattggtgagcgagttgatccggccatacctggcaaccggtggtatcgtggtgtgtgatcgctacgccgactcgacgtttgcctatcaggggtacggtctgggtcgcgatcttgaagagttacggacgattaccgatattgctaccggtggtttgaaacccgacctgaccctgtatttgcgaattgatgttgaagtcggtttgcagcgtaaacgcgccagtcgtgaacgaattgaacctggcagtgtgcaaccaccggaatggaatcgactcgatgctcgtgatctggcgtaccatcaacgggtagctcagggcttcaacgagttgatggcgcaagagcctgagcgctggtatgcgttggatgccgatcaaccggtagatgagttagccgaacagatctggcaggttgtgatggcccgg

SEQ ID NO: 32697 - DNA, 1158 bp, Chloroflexus aurantiacus
gatggtcacattgccagcccaaccggctttcgcgccaccggtgtttccgccgggctaaaagagggcagtaaagcgcgcgatctggcactcgtctactcgcaatacccgtgccgggcagcggcattatttaccaccagtgtcttcaaagctgcaccagtctttctcagtcaggctattttattgcgtaatcacgatgctattcgtgctgtgttgatcaatgccggtcaagccaatgccggcaccgggcagagcgggttgaatgatgctatcgaatgtgccaagatcaccgctgatgaactggaggtaccacgcgactcggtgttgttgatgtcaaccgggttgatcggggtgccgctcccgatgcaacggatgcgcaacgggatcaggcgggcagtgagcgaactcgacagcaatggtggtcgtcgcgcagccctggcaatcttaaccaccgacactcgacccaaagagcgggtcctgcgtgtcaccttgcgcaacggccctcgcttcactctggccggcatggcgaagggaacccgcatgatccatccgcgcctggctaccgtgctggctctgattactaccgatctggcgatcagtcaacctctcttgcaacgggcactgcaccaaagcgtagagcgctctttcaaccggctcaatattgatggcgattgcagcccaaacgatagtgttatcatgctggccaacggtgccatcgatcatccacccattaccgactccagcacctgggaatttggtgtgtttcaagaagcactcgattttttgtgtgcagatctggcagggcaaatcgtgcgcgatgccgccggttctggtaaagtaataaaggtagtggtgcaaggggcagccgacgaagccgccgccagcgcaattgcccacaccgttgcccgctctggatcggtacgtgccgcctgtcggcgtcattcatccgattggggagcactcctggcggcaattggggccagcaacgtagaattgcgccccgatctcctcgacttacggatcggaacagtgccggtcatgctccgcggcgcacccgttcctttcgacccgacgatgttggtgcagacgatgtcaggcccggaaatagaactgctgatcgatctcaaccttggcccggctgaaacaaccgtctggacctgc

SEQ ID NO: 32698 - DNA, 915 bp, Chloroflexus aurantiacus
atgatttcgactgaacaacgtgtctcgctcagccgaaaaatccgggcacatattgaacttgccgatccggtgacatggatctcgccagtgctggtctgcttttgtggcgccctggcatcaggctacgagcgaggttttgattggacgcgacccgatcactggtggcttatgctactgggggcattaatgaccggcccgttgggtaccggcttcagccagagtatcaacgactactttgatcgtgatctcgacgcgatcaacgatccgcaacggcccattcctgccggtatcatctcactgaacgaagcccgctggaactggatcgtactcggtgcggccacccttctcgtctcactggtcttcggcaatccactcatcgttttgtttgctgtggtcgggatcgtgttgtcggtgatctacagcatgccgccaatcaagctcaagaagcacttctggcttgggccgccggcagtggggctaggctatgtcagtatgagctggatggccgggcatctaatctttgccccactgacctggcagagcgtggtggtagcgttgatcaatggcggtctggcagccggcttgctcttcctcaacgacatcaagagcgttgagggcgaccggaagctgggtctgcaatcgctcacggtagcaatcggggtgaaacgcaccctgatcgttgcctacgtcaccattaacagcttcgaggcaatgctgatgatcctggcgttgatttggggacagtactgggtagcggcatttatgtttctggccctggtggcaccgatctacaatcagatcaaactctaccaggaaccaacccagcaaaactatgttcgctatctactggcctcaaatccattcgtcgcgttgattcagattatttcgggttttctcgtaggcggctattttggc

SEQ ID NO: 32699 - DNA, 960 bp, Chloroflexus aurantiacus
atcagtcgggagaaactcctctgggcgtatgagcggatgcggctcattcgtgagttcgaggatcggttgcacaccgattttgctgccgggaagatacctggtttcgttcacctgtatgccggtgaagaagcggtagctgttggtctctgcgcgcacctgcgggatgatgattttattaccagcacccatcgcggtcacgggcactgcattgccaagggagtcgatctgcgggcgatgatggccgagatctacggcaaggcaacaggagcctgtaagggcaaaggcggttcgatgcatattgccgatgtcgataagggcatgcttggcgccaacggcattgttggtggcggcccgccactggcctgtggtgccggtctgaccgcgaagatcaagggtaccgatcaggtaacggtttgcttcttcggtgatggagcgtcgaatcagggtacgacgtttgagggtctgaatctggcgggaatctggaaattgccggtcgtgtttgtgtgtgagaataacggctacgccgagacgacgtcaccccgttattctgtttccgggcaagacatcgctgcacgcgcacgtgggtttggtatgccgagcattgccattgacggcctcgatttctttgccgtttacgaggcagccggtgaagctgtagcgcgtgcccggcgcggggaaggcccgacgtttatcgaggcgcagacgtatcgctactatggtcacttcgagggtgactcgatccgctatcgcactcgcgatgaggaagctcattatcgctcgctcgactgtctccaccgttttcgccagactgtgacagcgcagggattgttgacggctgctgagcttgatgagatcgatgcccgtgctcgtgccgcggtggaagatgcggtacgcttcgctgccgaaagcccattgcccgatccggcagagctgttgaccgatgtctatgttgattatccg

SEQ ID NO: 32700 - DNA, 1005 bp, Chloroflexus aurantiacus
cgtactctgagctatcgtgaggcgatcaatgaggcattgcgtcttgagatgcggcgcgatccaacggttatcttaatgggtgaagatgtcaccggagcatcccatagtgaagacgagagccatcttgatgcctggggtggggtgttgggggtgacgaagggtttagtacacgaatttggccgtcagcgtgtgcgtgatacgccaattaccgagtcgggatttgttggagccggtgtcggcgcagcggcaaccggtctacgaccggtggttgagctgatgttcatcggctttatgggggtatgcctcgaccagatcgtcaatcaggccgccaagatgcgctacatgttcggtggcaaggcgcgcattccactcgtcattcggacgatgatcggggccggttttcgggcagcagcccagcactccgactcgatctactcgacgtttgttcatttccccggcctgaaggtggttgcgccggcgactccggctgatgcgaagggattgctggcagcggctattcgtgacgatgacccggttatcttctgtgagcacaaactgctttacgatatgaaagggccggttcccgaaggtgaatatgttattccgcttgggcaggctgatgtgaagcgcgaaggtggtgatgtcacgattgtagccatctctcgtatggtattgcacgctttagaggcggccgagcgattagcgcaacaaggtatcagcgctgaagtcattgatcttcgcaccttatcaccactcgatgagacgacggtactggagtcggtgcggaagaccggccgtctggttgtggttgatgaagataatccacggtgcagtgtggcgggcgatattgccaccctggcggcgacacaggcgctggaatttttgaatgcgccggtcaagctggtcacaccgccgcataccccggtaccgtttagcccgacactggaagatgcctatgtgccttcgcctgagcggattgtggcagcggcgcgggcgacatttggc

SEQ ID NO: 32701 - DNA, 663 bp, Chloroflexus aurantiacus
atgtacaagacggttggcgaagcaacgacgctggtgcgcgatttgctggccggtctcggtgaattatcggatcgcgaagctatcgtttgtccgcccttcaccgcactcgctgccgtggcagcgctggtcgccgatagcccgctggggttgggggcgcagaatctgtaccccgaagcgcagggtgcgtttaccggtgaggtctcgccgccaatgctggttgatattggctgtcgttacgtcattattggtcatagcgagcgtcgtcagtattttggcgagagtgatgcgtttgtgaatcgaaaattgcgtgccgcccttgcccatggtctgcgtcccattgtgtgtgttggcgagagtaagccccagcgtgacgccgggcaggccgagccgattgtgacggcacaggtgcgtgctgccctgcttgaggtgcctccggatcaaatggcaaacgtggtgattgcttacgagccgatctgggccattggtaccggcgatacggcaactcctgcggatgcgcaggcgatgcatgcggcaattcgggcaactctggccgaattgtacggttctgagattgccgcaacggtacgtatccagtacggtggcagtgtgaagccggataatatcgacgaattgatggctcagcccgatattgatggtgcgttg

SEQ ID NO: 32702 - DNA, 2247 bp, Chloroflexus aurantiacus
cagccctggcaacaggcgtttgatgatagtgaagcgccgttttaccgctggtttagtggtgggttgacaaatgcctgctttaatgaagtagaccggcatgtcatgatgggctatggcgacgaggtggcctactactttgaaggtgaccgctgggataactcgctcaacaatggtcgtggtggtccggttgtccaggagacaatcacgcggcggcgcctgttggtggaggtggtgaaggctgcgcaggtgttgcgtgatctgggcctgaagaagggtgatcggattgctctgaatatgccgaatattatgccgcagatttattatacggaagcggcaaaacgactgggtattctgtacacgccggtcttcggtggcttctcggacaagactctttccgaccgtattcacaatgccggtgcacgagtggtgattacctctgatggtgcgtaccgcaacgcgcaggtggtgccctacaaagaagcgtataccgatcaggcgctcgataagtatattccggttgagacggcgcaggcgattgttgcgcagaccctggccaccttgcccctgactgagtcgcagcgccagacgatcatcaccgaagtggaggccgcactggccggtgagattacggttgagcgctcggacgtgatgcgtggggttggttctgccctcgcaaagctccgcgatcttgatgcaagcgtgcaggcaaaggtgcgtacagtactggcgcaggcgctggtcgagtcgccgccgcgggttgaagctgtggtggttgtgcgtcataccggtcaggagattttgtggaacgaggggcgagatcgctggagtcacgacttgctggatgctgcgctggcgaagattctggccaatgcgcgtgctgccggctttgatgtgcacagtgagaatgatctgctcaatctccccgatgaccagcttatccgtgcgctctacgccagtattccctgtgaaccggttgatgctgaatatccgatgtttatcatttacacatcgggtagcaccggtaagcccaagggtgtgatccacgttcacggcggttatgtcgccggtgtggtgcacaccttgcgggtcagttttgacgccgagccgggtgatacgatatatgtgatcgccgatccgggctggatcaccggtcagagctatatgctcacagccacaatggccggtcggctgaccggggtgattgccgagggatcaccgctcttcccctcagccgggcgttatgccagcatcatcgagcgctatggggtgcagatctttaaggcgggtgtgaccttcctcaagacagtgatgtccaatccgcagaatgttgaagatgtgcgactctatgatatgcactcgctgcgggttgcaaccttctgcgccgagccggtcagtccggcggtgcagcagtttggtatgcagatcatgaccccgcagtatatcaattcgtactgggcgaccgagcacggtggaattgtctggacgcatttctacggtaatcaggacttcccgcttcgtcccgatgcccatacctatcccttgccctgggtgatgggtgatgtctgggtggccgaaactgatgagagcgggacgacgcgctatcgggtcgctgatttcgatgagaagggcgagattgtgattaccgccccgtatccctacctgacccgcacactctggggtgatgtgcccggtttcgaggcgtacctgcgcggtgagattccgctgcgggcctggaagggtgatgccgagcgtttcgtcaagacctactggcgacgtgggccaaacggtgaatggggctatatccagggtgattttgccatcaagtaccccgatggtagcttcacgctccacggacgctctgacgatgtgatcaatgtgtcgggccaccgtatgggcaccgaggagattgagggtgccattttgcgtgaccgccagatcacgcccgactcgcccgtcggtaattgtattgtggtcggtgcgccgcaccgtgagaagggtctgaccccggttgccttcattcaacctgcgcctggccgtcatctgaccggcgccgaccggcgccgtctcgatgagctggtgcgtaccgagaagggggcggtcagtgtcccagaggattacatcgaggtcagtgcctttcccgaaacccgcagcgggaagtatatgcggcgctttttgcgcaatatgatgctcgatgaaccactgggtgatacgacgacgttgcgcaatcctgaagtgctcgaagagatt

SEQ ID NO: 32703 - DNA, 1008 bp, Chloroflexus aurantiacus
ggagtaccatgtatgaaacaacgcaggctgggcaatagcgatttgaacgtctcggcgattggtttaggctgcatgaccatgaccggtggctacagtgtttctccgaatcgtcaagagatgatcgcactattgcgcaaagctgttgagttgggggtcacattcttcgatactgccgaagtgtatggtccattcattaacgaggaacttgtcggcgaagctctcgaaccatttaaggggcaggttgttattgccaccaagttcggattcaagcatgatcacaacaatcgccctacccctgctgcgggtttagacagtcgccctgaacagatcaaacgagttgccgaagcatcattgaagagattaagagtggaagcaatcgatctcttctatcagcatcgggttgatccgaatgtgcctatcgaagaggtggcaggggcggtgaaagatttaatccaggccggaaaggtcagatactttggcatgtcagaagcgggggcgcatacgcttcggcgtgcacacgcagtttgtacggtgacggcagtccaatacgaatactcgctatggtggcgacgccctgagcaagacatcctccctctttgtgaagagttgggaatcggttttgtcccgtacagtcctttggggaaaggattccttaccgggaaaatagatgcaacgacccactttgatagcaccgatttgcgtagtcgtatcccgcgctttacatcagaggcacgcaaagctaatcaggcgctggttgatctcctcgacgagattgcccgccaacatcatgccacaccggcgcagattgcactggcctggttattagctcagaagccctggattgtgcctatcccgggtacaacgaaactgcatcgtctcgaagagaatatcggtgcagtgaaggttgagctgacgtcatctgatctacaaagaatcaatgatgcagtggctctgatccccattcagggcgcacgctatcctgaagaattggagcggatgacctatctg

SEQ ID NO: 32704 - DNA, 1755 bp, Chloroflexus aurantiacus
ccggcatacattaaacaccaccggttacgcgagtggatttcagacattgtcgcactctgcgaaccggcacaagttcatttttgtgacggaacaccggcagagtacgacacgctctgcaaccagatggtagaaaacggaacattcattcgactcaatcccaaactacgccccaacagctttctcgcccgctcagacccctcagatgttgctcgcgttgaagatcgtaccttcatctgtagcatctcgaaagacgatgctggccccactaataactggatgccgccgaaagagatgaaggaaatcctgctcaaattgtttaaagggagtatgcggggccgtgtcctgtacgttattcccttcagcatggggccaatcggatcacccattgcccacattggtattcaattaaccgactcgccatatgtcgtggtcaacatgcacataatgacccgcgtctcaactaaaatttacgacgtattgggtgaggacggcgagtacatcccatgcctccatagcgttggaatgccgctggaaccgggtcagcccgacgtaccctggccctgcaatccaaccaaatatattgttcactttcccgaagagcgttcgatctggagtttcggatcggggtatggcggtaatgctctgcttggtaaaaagtgcttcgcattgcggattgcgtcggtcatggcccggcaagagggctggcttgccgaacacatgttgatcctgggagtaaaagaaccatctggacgcaagacctatgtagcggcagcgttcccctcggcatgcggaaaaaccaattttgccatgctcatcccgcctgacaccttcaagcgagagggatgggaaattacaaccgtcggcgacgacatcgcctggatcaaacccggtgcaaatggcaaactctacgcaatcaatcctgaagcagggtattttggtgttgcgccgggcacatcatataaaaccaatcccaatgcgatggaaagctgccgcgccaataccatcttcaccaatgttgcgctcaccgatgacggcgatgtctggtgggaaggcatgaccgatgaaccaccggcacacctgatcgactggcaggggcgtgattggacaccgggatgtggccgcctggcagcccatccgaatgcacgttttacagcaccggccaggcagaacccggccattgatccggagtgggaaaatccgaatggggtgccgattgaggctttcattttcggtggtcgacgtagccgggtggtgccactggtctatcaggcgttcaactggacctatggtgtgtatctggccgccacgatgggttcagaaacaaccgcagcagcgatggggcaacagggtgttgttcgccgtgatccgtttgcaatgctaccattcgccggctaccatatgggcgactacttcaatcactggctgagttttggccgtcgcttgcgcaatccaccgcgaatcttcagcgtcaactggttccgcaaagatgaaaacggtaagtttatctggccaggttttggcgagaatatgcgagtgttaaagtggatcatcgaacgtgcccacggccaggccgtcagtgtcgaaacaccgattggctgggtaccacggtatgaagacatcgactggcgtggtctcagctttagcgccgagcagtttgaacaggtgatggagtgtaacgtcggtgagtggcagcaagagatattactgcacgaagaactgttcatcaaactatacgaccgtctcccgaaagaactg

SEQ ID NO: 32705 - DNA, 1581 bp, Chloroflexus aurantiacus
tccaccgatgtgctggttattggtggcggcgctaccggcaccggttgcgcactcgatctggcaatgcgcggtatccgttgtgtgctggtagaaaagggcgatttgacacacggtaccaccggtcgctatcatggcctgctccactcaggtgggcgctacgtaaccaaagacccccagtcagccagcgaatgcgcccacgaaaatgcgattttgcggcggatcatgccgcattgtatcgagcaaacctctggcttctttgtgattacaccgtgggacgatgagagctatggcgatgtcttcgtcgccaactgccatcgtaccggtgtaccggtccaggagatcagcgtcgccgagatgctgcgtcgtgaaccactccttaacccccgtatttcccgcgtctttgaagttcccgacggctctgccgactcgttccttgctacccattcggtcgcactggcggcacgtgaatatggtgctgatattcgcacctaccatcatgttgtcgaactcattcgggtcggggatcgcgtcgtaggcgcaatcgccgaggatttacgtagcggtgaacgggtgcggatcgactgcgcgtatgtgctcaacgcggcaggtgcctgggccgggaagattgccgccctggccggtctaacggtgaatgtcgtgcccggtaaaggtaccatggttgcgatgaaccaccgtatggtgaatactgtggtcaatcgctgtaagctgccgtctgatggtgacattatcgtgccaattcacacggttgctgtgatcggtacgaccgatgtgcacgttcccgatcccgatgtctttgggatcgaacccgaagagatacagtttatgctcgacgaaggcgagaagctcattcccggcttccgtcagtatcgtgctttacgagcctgggctggcgtgcgcccgctctacaaagataaagatgtggctagcgaccgcgatattccccgcacgttcaaattacttgaccacgaagaacgtgatggcgtgagtggtatcttctcgattgttggcggtaaatggacaacctatcggctgatggccgaacaaacagtcaatgagattgctcgccgcctgggtaatactcaaccctgtcgcacggcaagcgaggtcttgccggtgccccgtttcgagcacagtagccgcgcgacggtcactgtttcacccaatccggctgcgcaaactcctcactactggttggggaaaccattggcgctcgttgagagtcaccacgcggctggtgatctgatctgtgaatgcgagctggtaacacgcgaccggattcaggctgcaattgatgctggtgcgcataatcttgacgatattcgccgcgatgtacgtatgggcatggggccgtgtcagggcggctggtgtatctaccgcactgccaacctgctctatgaacaacgctgtgcagcaggtctcagccatgttcataccaacgaagcgatcatgcacttcctccaggaacgctggaaaggtctgacgccggtattgtggggcgaccagttgcgacaggcacgcctcgatgaactgatctacgtgggtgtgctgggcattgatcgc

SEQ ID NO: 32706 - DNA, 1494 bp, Chloroflexus aurantiacus
atggcaaagtacgccgctgctatcgaccagggcacaaccagtacccgctgtatgatcttcgaccatagcgggaatgtcatttgctacgatcagaaagaacacgagcagatttatccccgccccggctgggtagaacacagccctgatgagatttgggagcgtacccaaagtgtgattcgtggggcactaagcaaaggcggcctgagcgcaagcgatattgtcgccgtcggcattaccaatcagcgcgagacaacggtggtctggaatcgcaaaacaggccgaccggtgtacaatgcgatagtctggcaagacacccgcaccgaccagatttgtaatgaacttgccgccgacggcggtcaggatcggttccgccccaaggttggcttgccactggcaacctacttctccggtcccaagattcgctggattctcgacaatgtgcccggcgcccgtgaggcggcggaggccggtgatgtggtgtttggtaacatcgataccttcctgacctggtggctcaccggtgggcccaacggtggtgtccacgttaccgatgtgaccaacgcctcacgcacgatgttgatgaatctcgaaacccttgattgggatgatgagattctcggcattatggggattccgcgccagatgctgcccaagatcgtaccctccagcatggtttacggtacggcaacaggtgaactggccggtgtgccggtggccggtatcctgggcgatcagcaggcggctatggtcggacaaacctgcttcgatgtcggtgaggccaaaaatacctacggtaccggttcgtttatgctgctcaacaccggcacgaaactggttccatccaagagtggcctgctgaccaccgtctgttacaagttcggcgatcaacccgccgtctacgccctcgaaggctcaatcgctatcaccggtgctctggtgcagtggctccgcgataacctcggtctgattacatcctcggcagaagtcgaggcgctggcaaatctggtcgaagataacggcggtatctacttcgtgccggccttctctggactcttcgcaccctactggcgctcggacgcccgtggtgtgattgtcggcctgactcgttatgtcaacaaagaccacctcgcccgcgccgtgctcgaagccactgcctaccagacgcgcgaggtgctcgacgcgatggagcaggactcaggcgtcaagctgaccgccttgaaggtcgacggtggtatggtgtacaataataccctgatgcaattccaggccgatattttgggtgtgcccgttattcggcccaaggttgcagagaccacatcgctcggtgctgcctatgcagccggtttagcagtcggcttctggtcaaataccgatgagatgcgggccaactggggtgttgatcacacctggacaccacagatggatgaagcaacccgcgagcggctctatcggggctggaagaaggcagttacccgtaccttcgattgggtggag

SEQ ID NO: 32707 - DNA, 999 bp, Chloroflexus aurantiacus
aagcctgtgaagaagttgatcaacgcaccggagaatgtcgtaaaagaggcattagccggaatggcaattgcccatgccgacctgattcaggttcactacgatcctgattacatcgtgcgcgtcggcgcaccacacaacaaggtcggtgtcatctccggtggcggctcaggccacgaaccgatgcacggtggttttgtcggctacggtatgctcgatgctgcctgtcccggtgccgtctttacctcgccggtgccggatcagatgctggcggcaaccaaggcggtgaacggcgggaagggtgttttgcacatcgtcaaaaactacaccggtgacgtgatgaacttcgagatggcggctgaactggccgctgccgagggcattgaagttgccagtgtggtgacaaacgatgacgtggcggtcgaaaacagcacctggacggcaggtcgtcgtggcgtgggtgtgactgttctgctcgagaagatcgttggggctgcggctgaggccggtgccgatctggcgacctgtaaggcaattgccgagcgagtcaatgccagtggccgcagcatggggatggcgctaacaccctgtaccgtaccccaggccgggaagccgggtttcgagctggccgatgatgagatggaagttggtatcggcattcacggcgaaccaggccggcgccgcgagaagttggctccagcacgggatattgctgagatgctggctggcccgatcctggaagacctgcccttcaagagcggtgatgcggtgctggcgtttgtcaacggtatgggtggcacaccgctgattgagctgtacgtgatgtacaatgaattggcacgtatcctgaaggatcgcaatattacgattgctcgttcactggtgggaagctatatcacatcgcttgagatggccggtgtcagctttacgcttctccgcctggacgatgagatgatcaaactttgggatgcaccggtgcatacaccggcgttacgttggggc

SEQ ID NO: 32708 - DNA, 1602 bp, Chloroflexus aurantiacus
cgtccggtggtcttgataattatggatggctggggtattgcgccgccagggccgggtaatgcggctgatttggccgatacgccccatgttgatgcgtggatggcgaattgcccctttacaacattgggagcttcagggcttgatgttggcctgcctgaaggtcagattgggaactccgaggtaggccatctcaatattggggccggttttgtggtctatcaagaactgacgcgcatcagcaaagcgattgccgatggtgatttttttaccaacccggtcttgctccaggctatcgaacacgtcaaacagcgcaactcggccttacatttgatggggttgtttgggcctggaggcgtccatgcccatgaagatcacctgcacgcgctgctggaactggcccaccgccatcatctccagcgcgtctatctccacctcttcctcgacgggcgcgatgtgttgccgcgcagtgccctgggttttctcgacaccctcgaaggggtgatcgcccggcttggcgtcggcacgattgctaccgtttccggtcgttactatgcgatggatcgtgataagcgctgggaacgcacgggacgggcgtatgcggccctggttgatggggtgggtgagaaggcaccttcagcgcgggcagcgattgaggcatcgtatgcccgtgatgtcagtgatgaatttgtcttacccacagtgattgtcaccgccagcggcgaaccaaccgctaccgtgcgcgatggcgatgccgtgatctttaccaacttccgccccgaccgcggtcggcagttgacccgcgcttttgttgatccagacctcaacgaacgtattcgtcagcactatgaacggcaaaaggctgaaggccagccgttgcctgccacgatctggcagcgtgagcgtcagttgcgcgatctctgtttcgtgaccatgacccaatacgaagagggcttgccggtactggttgccttcccgccccgttacgtcaccaatccgctggccgctgtgatcagtcaggccgggctgcgccagtttcatattgccgagaccgagaaatacccgcacgtcaccttcttcctcaatggtgggcgcgaagagccgtttcctggcgaagatcgtcagctcattccatcacccaaagtcgccacttacgatctgaaaccggaaatgagtgccccggaagtcaccgaggctctgctggccgcaattgatagcgatcaatacgatttcatcgtggtcaattacgccaaccctgatatggttggtcacaccgggagtatcccggcggtgatcaaagcctgtgaagccgttgatgccgggttggcgcgggtggtgccggccattctggagcggggcggcgtggccctcgtcatcgccgatcacgggaacgccgagcagatgattgacccggaaactggggggccgcacacggcacacaccaccaatccggcaccttgtttcctgatcggtggtgccggttatggcaaagatgctatcgaactgcggcacggtggacgattggccgacgtggcaccaacactgctcgaactgttggagttagaaccgtcacccgatatgaccgggcagagcctgattgtgcgt

SEQ ID NO: 32709 - DNA, 954 bp, Chloroflexus aurantiacus
cgcaccggtaaagttggcgtcgtcggaacaggcatggttggtacctcctttgcctatgcactgatgcagcgcagcctggccagcgaactggtgttgattgatattgatcatgcccgtgcagaaggggaggcgatggatcttaatcacggcctgccctttgttcgcccaatgcgcatctatgccggtacctatgatgatctggccggcgccgacttgatagtcatcgctgccggggcaaatcagcggcctggcgagacccggctcgatttattgaatcggaatgtagccattttccgtgagatcattcctccaattctggcagccaatgatgatggaatcatcgttgttgccactaatccagtggacatcttaaccaccattggggcacagattgccggtcccgcagcgaatcgagtgatcggatcagggaccatccttgatacggcacgctttcgctacttgcttggtcagcactacggtgtcgatccccgctctgtgcacgcctacattgtcggcgaacatggcgatagcgagttagcgctctggagcctggcaaatattgccggagtcaggctagttgattttgtcggtgcaaatggtcagggctacaatcaggcagcgcttgatgcgattctcgaacaaacccgtaacgctgcatacgagattattaagcgcaagcgggcaacctattatgctatcggtctgggactgctatcgattgccgaagcagtgctgcgtgatcaacacacggtgatgacgatcagcagcttgatgaacggtcagtatggagtaagcgggattgcaatcagtctaccaacaatcgttggtcgtgatggtgctgaggaggtgctcaatttaccattgtccgaacaggagattgctctctttcagcgctctgccggtattctaaaagaacacctgtctcacgttcagtaaagagatcgctgtatcgtg

SEQ ID NO: 32710 - DNA, 1029 bp, Chloroflexus aurantiacus
atacgcccgatcttgtttcggctcggtcggggcgacgccgagacggcccatgaacgtaccttgcatatactggcgttgatcagtcgctcacgcctgttgtgcaagaccatcgggtatctgaccacaattcgcgatcaacggctccagcgcacggtttgcgggataccttttcccaatccggttgggctagccgccggcatggataaggatggtgtggcaataccggcctgggcagcactgggctttggcttcgtcgaggttggcaccgtcacccatcacccacagccgggcaacccccggcctcgcctgtttcggctaccagagcaggaagcgctgatcaatcggatggggttcaacaatcaaggcgctgccagcctcgccagacgattggcccgcttgcagccggcacccatcccggttggcgtatcaattggcaagtcgaagattacccctctcgaacaggcaattgatgattaccgggcgtcgtttcgtcagctctttccgtatgcggcatacatcgccatcaatgtcagctctcccaatactcctggcttgcgccagttacaagatgccgaccagttgcgtgcgctgctggcagctctgcaacacgacaatgcggaattgggccgcaccgaccagcgcggcccccggccacttctcgtcaagattgcgcctgatttgagcgatacagccatagaagaggtgttgaccgtctgcgccgaccacggtgttgccggtatcattgccaccaatacgacgatcagtcgtgaaggactgaccggggttgatccgcggctggcagccgaagccggcggcctgagcgggagaccactgattgcacgtgcccttcacgtggtacgcctgattgcccgtttgacaggcaatcgccttccgattattggggtcggaggcattcatacacctgatgatgggttacgtatgttggaagccggtgccagcctgatccagatctacaccggactggtctactacgggccactgttgcccagacggatcaaccgcgctatc

SEQ ID NO: 32711 - DNA, 1002 bp, Chloroflexus aurantiacus
ttaattactggcggagccggttttctgggcattaacctgacgcgctacctgttagcgcgagggtatctcgtgcgctcacttgatattgccccctttgattaccccgaacgcaaccagattgaagagcacacgggtgacattcgtgaccgggctgccgttgatcgggcgatgaaggatgtgcgcttcgtcgttcacaccgcagcagctctgccgttgtactcgccggcagacatcttctcaaccgatattgatggtacgcgcaacgtcctcgaatcggctcgcgatcacggggttgagcgcgttgtccacatctcctcaaccgccgtgtatggtattcctgaccatcacccgctgctggaaaccgatcccctgagcggcgttggcccctacggcgaggcgaaagtgaaagccgaagaactgtgcctcgaattccggcgtgccggtatgtgcgtgccaattctccgccccaagtcgttcgtcggcccagagcggctgggcatcttcgcaatgctgtacgactgggcaatggatgggcgcaacttcccactaccggggaacggcaagaatcgctaccagctcctcgatgttgaagacctttgtgaagcgattgtacgctgtctggaacttgaccgtgatcgggtcaacgacaccttcaacatcggtgccaaagagttcggcacgatcaaagaagattttcaagccgtactcgatgccgccggtcatggcaagaagatcatcaccttcccggcagcaccgatggtgtgggcactggcgattttagagaaactgaagctgtcgccggtgtataaatgggcgtatggcacagtcaccgaagactccttcgtatcggtggaaaaagccgagcgcgtcctgggcttcacgccgaagtattccaacaaagaggcgctggtgcgcaacttccagtggtacgtcgagcacgctaaccagtttggtcagcaaactggcgtctcgcaccgggtgccctggagtcagggtattttg

SEQ ID NO: 32712 - DNA, 1908 bp, Chloroflexus aurantiacus
atggaacaactcaacctgctgaatcccgcccagcgcgcggctgttactgccccaattgggccgatactggtcaaggccggggccggtagtggcaaaacacgggtcttgacgctgaggatcgcctatctgattacgcactacggggtagcgccgcagcagattctggcggttacttttaccaataaggcggcacgcgagatgcgtgagcggttaagcaatctgccagggctgcgcattcgtggtttgaccagcggtacttttcatgccatctgcacacgtatcctgcgcgagtcgattgagggtcggctgaaaggatatacctcttcgttctcgatctatgccggcgaggagcaattgcaactggcggctgaggcattggcgggcgtaggcgagacaccaccccggttgatcgaagccgatgaggtgttgcggctgatttcacgggctaaaagccggatgttgaccccacgcctgatggcacggttcgccaccgacccgcttgatcgctttatcgctgcctgttaccggcgctatcagcgggcactcgaacaggcgaatgccctcgatttcgatgatctgatcctgaccgcgtatcgcctgctgagcgatgatcccgatttgctggcaacgtatcagcagcgctggcaacacgtgctggtcgacgagtaccaggataccgatccgagtcagcacgcgctgattgagttgctcacccggccaacggcgcagcgtccgcgctcgctcttcgtggttggcgatgcaatgcagagtatctacggctttcgcaacgccgatcacagcattatcaaccgctttgctaccgattttcccgatgctcgtgtgatcgagttgacaacgaactaccgttcgcgccagcctattctcgatgcggcttatgcaattattcgccacagccgcagcgtggcaccgatggaattgcgtgctgcggcacggaatgttgatgaacgttgtgtgttgatcagcgaagccagagatagtcgtgatgaggccgatcaggtagctcgttcgattgccgatctgcaacggcaagggcgacggttgcgcgatattgccgtgctctaccgcacccgtcatatgagccgaccgttcgagcaagccttgcgccatgcccggattccgtaccaggtgcgcggtggagtgagtttctttgatcgggcggtggtgcgtgatgccctggcctatcttcgctgtattgccaatccggcggataacctcagtttgacgcgcattgcgaatgtgccggcgcgagggttaggcgggcaggcgctggcaaccattgccgcctatgcggcagcccaatcgttgccgatcagtacagctcttggccatgcccggaatattcccggtctgagtccacgggcggtcgagggtgcccatcggctcttcgcattgttgcaacgctggtggcggttggccgaaagcaccatgccgccggatcacgtgctggccgatgtgctggagcagagtgggtatatggcggcattagctgaacgtttcgacgccgaggagctggccgaggcgcgtgcccatttgcaggagttgctgcgggcagcggaagagcacactgatctgcgttcgttcctgcaagaagttgcgctgatgacgaatacagacgatgaagatgatgagcgtgatcgggttcagctcttgacgatccacgccgccaaggggttggagtggccatttgtgtttgtggtgggcttagaggagggaacgctgccgcacgaacggagtatcggcgatccggcggctatcgaagaagaacggcgcttatgctatgtggcgctgacccgtgccgccgaacggctctatctctcgtggacggcaagccggcagcgtggtcagcgtctgaaaccgtcgcgttttctcgatgagatctgcattgac

SEQ ID NO: 32713 - DNA, 777 bp, Chloroflexus aurantiacus
atgctgacgcgacgaatcattccctgtcttgatgtcaaagcaggacgtgtggtgaagggcgtgaaattcctgaatcaccgtgatgccggtgatccggtagagctggcggctgcctacaatgctgccggggccgatgaactggtcttctacgacatcacggcatccagcgacgagcgggccattatggtcgaggttgtagaacgcacggctgccgaagtatttattccgctcacggttggtggtgggttacgcagcgttgacgatatgtaccgcatgctgcgggccggtgccgacaaggtcagcctgaatacagcagcggtctacaacccgcagctcattgccgagggcgcccggcggtttggcagccaatgcattgtgctgtcggttgatgccaaacgggtgaacgcgccaggcgaaccaccacgctgggaagtctttacccataccggggccaatccgcgcccgacggggcttgacgctatcgagtggatcaagcgagggatcgatctgggggccggtgaaatctgtatcaatagcatggacgccgacggtgcgcgtaccgggtatgatctggagctattacaggcgattaccgccatttccccggtaccggtcatcgcgtccggtggtgtcggttcgccgcacgacatgtatcgcggcatcgtcgaaggcggtgccgatgcggtactggccgcgtccatcttccacttcggcgactactcagtggccgatgtcaaacgctacctggctgaacggggggtggcggtgaggatgata

SEQ ID NO: 32714 - DNA, 1323 bp, Chloroflexus aurantiacus
ctcaatcaaacgattttccgggcgtatgatattcgcggtattgttgaggttgatctcgatgaggcgatctatgaacggttagggcgcgcaaccggcacgctcttccgcaacgagggccggcagcggattgtcgtggcccgtgatgctcgcctcagttcaccgcgatttcaagcagcattaattcacggcttacgtgccaccgggatggatgtgatcgatattggtatggtggcaacgccggtgatgtattttgcggttgaggcattaggggctgatgccggggccattgtttcggccagtcacaatccgccggaatttaatggtctgaagttacgccgcgcagaaccgcgctttgggtctgaaccattaccatcggctgctattcaagaagtgggacggatcgccgcttctggggagttcgctcaggggagtggtggctacgagcaggtggacatcggcccggcctatgtcgagtcggcacggcgctggattgatttcggcggtcgacgtcctcgcgttgtgctggatggtgggaatggtgtggccgggccgctggctgtcgcaatgtatgaggcgttggggattgaggttattcccctcttcattgagccagatggtacctttcccaaccatcatcccgatccgttgaaggtcgagaacctgcgccacttgcaggccgcggtccgcgaataccgggccgatctcggtattgggcttgatggtgatggggatcggctgggtgtagttgatggtcatggcgaggtggtgtttgccgaccgctatctgattgtgctggcgaaggcgctcctggcgaagcgcaaagggccagtggtcttcgatgtgaagtgtagtgcggtgttaccccaggctatccgcgagttgggtggtgaaccggtaatgtggaagaccggctacaccagcctctcggcgaagatgcgcgagattgatgccgtactggggggtgagctgagcggacatacgatctttccgttccccgggcggtacttcgacgatggcgcgtttgccggtgcagtgctcttgcatgcgctgtcagagctggggcagacgctcagcgaagcattggcaccgtatccggtattgccttcaattgatgaaggacgaatcccgtttcctgaagaacggaagtttgcagtgatcgatttcttgcgcgagcgatttaccggtaagtatccgattattgatatcgacggggtgcgcatcgattttggtgatgggtgggggctggtgcgtgcctcaaataccgagccggcaattacgacccgcttcgaggcgcagacgtgggagcgcgttcaagcaattcgt

SEQ ID NO: 32715 - DNA, 1884 bp, Chloroflexus aurantiacus
agtatcctcagcgaggatgatatttatctgttcaaccagggcacccattaccgcttgtacgacaaatttggtgctcagccggtggtgctggaaggtgtaccgggcacctattttgcggtttgggcaccaaatgccgagtatgtggccgtgatcggcgactggaataactgggacgccggtgccaacccgctccggcagcgcggcttttcgggtgtgtgggagggatttatcccccacgtcggtaaaggcatgcgctacaagttccacatcgcctcgcgctactacggctatcgcgaagacaagacagatcccttcggcacctacttcgaggtcgcaccgcagacggctgccattatctgggatcgcgattacacctggtcggatcaacagtggatgagcgaacgggggcagcggcagcgcctcgatgcgccgatctccatctacgaagtgcatttgggatcgtggcggcgcaaaccggaagaggataaccgtccgctcaattaccgtgaactggcccacgagctggtcgagcatgtgaaagattgtggctttacccacgttgagctgttaccggtcaccgagcatcccttctacggttcctgggggtatcaatcgacgggtatgttcgcgccgaccagccggtacggaacgccgcaagacttcatgtattttgtggattatctgcatcaaaacgggattggggtgatcctcgattgggtgcccagccacttcccgaccgacggtcatgggctggcctacttcgatggtacccatctctacgaacacgccgatccgcgtaaaggctaccatcccgactggggaagctatatttacaactatggtcggaacgaggtacgaagcttcctgatcagctcggcgctctgctggctggataagtttcacattgacgggatacgggttgatgcggttgcgagcatgctctatctcgactattcgcgccgagccggcgagtggattcccaacgaatacggtgggaacgaaaatctggaggcgattagcttcctgcgcgaattgaacacccagatttacaagtactaccctgatgtgcagacaattgccgaggagagcacagcctggccgatggtatcgcgaccggtctacgttggtggattgggcttcggcttcaagtgggacatgggctggatgcacgataccctgcagtatttccggcgcgatccgatctaccggcgctttcatcacaacgaattgaccttccgtggcctctacatgttcagcgagaactacgtgctaccactctcgcacgatgaggtcgttcacggcaaagggtcactgctcgacaagatggccggcgatgtctggcaaaagtttgccaacctgcgcctgctctacagctatatgtttgctcaacccggtaaaaaactgctcttcatgggtggtgaattcggacagtggcgcgaatggtcacacgacaccagcctggactggcacttactgatgtttccctcccatcagggcgtacaacgattgattggcgatcttaaccgtctctaccgtactgagccggccttgcacgaactggactgtgatccacgtgggtttgagtggatcgatgccaatgatgccgatgccagcgtctacagctttctgcgcaagagccgctacggcgagcaaattctgatcgtgatcaatgccacgccggtcgtgcgtgaggattaccgaattggggtaccggtgggtggctggtggcgtgaattgtttaacagcgactcggagtattattggggaagtgggcaaggcaatgccggcggcgtgatggccgaagcaattccaacccatggccgggatttttcgttgcgactgcgcctgccgcccctgggtgcgctcttcctgaaacctgccggc

SEQ ID NO: 32716 - DNA, 1617 bp, Chloroflexus aurantiacus
ccgctctggtacaaagatgcggtcatctacgaattgcacgtgcgcgctttttgcgatagcaatggtgatggtatcggagattttcccggtctgaccagcaagctcgactatctgcaagatttgggcgtaacggcaatctggctgctccccttctatccctcaccgctgcgcgatgatggctacgatatagccgattatacgaacattcatcccaattacggcacgctggccgattttaaggtgtttattcgcgaagcccatcggcgtgggctgcgcgtcatcaccgagcttgtctgtaaccacacctctgaccagcacccctggtttcaacgtgcccggcgggctaagcccggtacttcagcccgcaacttttatgtctggtcggatacacccgaccgctacaaggacgcccggatcatcttcaaagattttgagaccagtaactggacgtgggatccagtggcgcaggcgtactactggcaccgcttctacagccatcaacccgatctcaactttgaaaatccggctgtccagcgggctgtcttcaaggcgatggagttctggctcgatctgggagtcgatggcatgcgtctcgatgccatcccctacctctacgaagcagagggcaccaattgcgagaacctgccggaaacccacgcctttctcaaacgcttacgtaagcatatggacgaaaagtaccaggggcgtatgtttctcgccgaggccaatcaatggccagaagacgcggttgcctatttcggggatggcgatgagtgccatatggcctttcacttcccggtgatgccccgcctctttatgtcggttcaccttgagaatcgctatccgatcattgatattatgcggcaaacgccgccaatacccgacaattgccagtgggcaatctttctgcgcaatcacgatgaactgaccctcgaaatggtcaccgatgaagagcgcgactatatgtaccgggtctacgctcgcgatccccaggcccggattaatctcggcattcgccgacgactggcaccattgctcggcaaccatcgccgcaagatcgagttaatgaacggattgctcttctcgctgcccggtacgccggtgatctattacggtgatgagatcgggatgggcgataacatctacctcggcgaccgcaacggtgtgcgcacgccgatgcagtggagcggtgatcggaatgccggtttttcgcgggctaatcctcagcaactctatctgccggtaattaccgatccggagtatcactacgagacggtcaacgtcgagacgcaaagcgccaatcagcattcattgttatggtggacgaaacgcctgattgcactacggaagcgttacgccgcatttggccggggcacgctcgaatttctctatcccgaaaatcgtaaggtgctctgtttcctgcgcaaaaccgaggatcagattctcctggccgttttcaatctgtcgcggtttgttcagggtgtcgaactcgatctctcgccgtaccgtggcctgatgccggttgagctattcggtcaggtggaatttccaccgattggcgatcagccctatttcctgacccttggcccacacagcttctactggtttacgctaaca

SEQ ID NO: 32717 - DNA, 1026 bp, Chloroflexus aurantiacus
cttggtcttggtggtgttggtcgggcacttgtccgtcagatgctggctgtggcaccgaccattcgccgacgctatggcatcgacttgcgctacacagccctggtggacagccgtggcgcactggccggcgatccggcactcaccgatgatcagattcagactgtgcttaccgccaaagcggcgggtcatcatattgatagtcttgcccacgctattactgatcgacactggctggaactcttaccggcaacgatggctatcgtggttgacgtcacggcggcggggagtcacgcggcaccgcttgctgctgctatctctgccggacaccgggtggtgctggccaacaaacgaccgttgtgtgagagttatgaactctttgccgcgctgactgaacgtggcgcgacccgctacgaagcaaccgtcggcgcaggcttaccggtgattggtgtgctgcaaagcctgatcgatagcggcgacgaggtacgcgccattgaagcggccttgagtggaaccctcggctttctcatgagtgagcttgaacgtggggttggcttcgccgatgcagtacgcacggcccaccagctcggttacaccgaacccgatcctcgcgacgatctgagcggtgcggatgtcgcccgtaaagcgctcattctggcccgtacctgtggcatgcatctgccgcctgatgctgtaatcgccgagccactcttcccggcgaccctgaaagagatcagcgtcaccgaatttctccaacggcttgaggaagcagaacacgaggtgatgaaccgtttgcaggtggccagtgctaacgggaaggtgttgcgctacatcacccgcatcagtcctgacaatggggtcgaggttggcctgcgcgaattgcccaccgatcatccgctcgccagtctgcgcggcccagataatatgatcagtttcacgacgaatcgctacgctgatcgcccgcttgtcgtccgtggccccggcgccggcgtagaagtgaccgcagccggtgtgttgagcgatattatt

SEQ ID NO: 32718 - DNA, 1446 bp, Chloroflexus aurantiacus
ctgtacattgatggtgcgtggcaaccggcagagaatggccaaactttcaccgtctatgatccggctaccagccagcccattgccacctgtgtccagtgctacccacagcgatgttgaccgggcagtccgcgccgcccgcgccgcgttcgatcacggccctggccgcatacatccccggcccaacgtgcggaaattctccacgcaattgccgatgccctcgaagcacgcaactttgagctggccgagattgagtcgcgcgatgccggggtaccgatccgcaagacaacctacaacgatattacccttggcctggaaattctgcgcggttgtgccgaaatggcgcgcaagcatccttacgagccactcccgtggaacgatctgccgagcgtgtcgtggaattttgtctggcgtgaaccaatcggggtgtgtgcccagattattccctggaattacgccttttgtatggcagcctggaagcttggcccggcgctggcaaccggcaatacggtcgtctttaagccatcctcactcgcaccactgagcacgctggcgattttccagaccattcacgatctcaatttactgccgaaaggggtgatcaatctggtgttggggcctggtggcgatgttggggagtatctggttactcacccggcggtcgacaaagtcgccttcaccggcagcaccgaagtcggacgcaagatcatggcgctggcggcaccgcacatcaaacgggtcaccctggaactgggcgggaagaatgcgatgctgatcctgcccgatgccgacctcgatctggtcgtcgatggagtgttgtggggagcgttctaccactccgggcaattgtgcgaggccggttcgcgtttgctggtaccgcacgccctccacgatacgctggtcgagcggctggtcgaacgggtgcgcgggatgcggatcggtgaccccatggatctggagaccgacatcggcccgctgatcagcgaacggcagcgcgagaaggtggagtactacattgcagttggtcgtgaagagggagcaactgtcgttatcggtggtggcagaccgataggcgaagcctttgccaatggccattatgtcgagccgaccatttttaccggtgtgcgccctgagatgcggatcgcccgtgaggagatctttggcccggtgctgtccgtcattgcctacgacgagatcggtgaggcgattcggatcgcgaatgatagcatctacggcctcgccgcttcagtctggtcacgcgatctccagcatgcgttgtcggtagtgcgacgcatccgtgccggtaccgtctggatcaacgaacaccacgtcctgaacccacgggcaccgtttggtggctatcgccagagtggttttggccgcgaaatggggcgctacggcctggacgagtataccgaagtcaagcacattcacgtcgatctgatgcag

SEQ ID NO: 32719 - DNA, 1257 bp, Chloroflexus aurantiacus
ctggaagcaattggccgccgggcaaagacggcggctcgtgcgttggcgaagctctcaactgaacagaaaaatgcagccctgtgcgcaattgctgatggattgctggcgagacaagataagattctggctgccaacgctgccgatgtcgccgatgcagaaaagggtgggacgccaccggcgattgttgatcgcatgctgctgacgccggcgcgtctggcggcgattgccggcgattgtcggcaagtggcatctttgcctgatccagttggtgaaatctttgatcggcgtgaactgccgtccgggttgcgcctctataaacggcgggtgccgattggggtgatcggtgcgatttacgaagcccgcccaaatgtgaccgttgatattgcgtcgctctgtctgaaggccggtaatgccgttattttgcgtggtgggagtgatattgcgcgcagtgtggcggcaacaacagaggtgattgcgctggcgttggaacaggccggtttgccggcgtttgctgtgcaaagtattatcgatcccgaccgtgaactggtgcggcaattgctacgcctcgaccgttacgttgatatgattatcccgcgcggcggtgccggtctgcaccgtttctgtgtcgaaaacgcgacggtgccggtgattgttgggggaatgggggtcagccatatctatgttgagccgagtgccgactttgcccgcgctgtaccggtgattgtcaatgccaaggtgcaacgtccgggtgcctgcaatgcacttgatacgcttctggtgcatcgggcggcggcatcgacctttctgccgctggtagccgctgccctcgctcagcacggcgtggagttgcgctgtgatctggaagccctggccatcctcgccgatgcgcctgggcacgaagcctggaacctgaaaccggccagcccaaccgattttggctgcgagtttctggccttgatcgttgcaatcaagattgtaggcagcattgatgaagcacttgatcatatcgctctgtacggcggtcattccgaagccattctgaccggcgatccgatcagtgctgagcgctttacccgtgaagttgatgccactgctgtctttgtcaatgccagcacgcgcttcaacgatggtggtcagtttggtctgggtgccgaggtggcaatttcaaccaatcgcctgcacgcacgtggcccgatggggttgcaggaattgacgacctatacctggattggtgaaggcgattatctggtgcgagcc

SEQ ID NO: 32720 - DNA, 504 bp, Chloroflexus aurantiacus
cagattctgtcggctgatgagattcggcgggcgctggtacgcattgcgcacgagattgatgaacgcaatggcggtctgcgcgatgtggttttggttgggattcggagccgtggtgtgccgctggcggagcgcatcgcagccgcaatcgccgattttgaagggacgcgcataccggtggggcaactcgatattacgctctaccgtgatgatttgaagctgcgtgggccggcgccacgggtgcgtaagaccgatttgccgattgatattaccggtaagacggtggtgttggtggacgatgtgctgtttaccggtcgcacggtgcgggcagcactcgatgcgattgccgatctggggcgtccggcccggattcagcttgctgttctgatcgaccgtggtcatcgtgaattgccgattcgggccgattttgtggggaagaatgtaccaacctcgctctccgagagggtgatggtgcgtttgcgcgagaccgatggggttgatgaggtt

SEQ ID NO: 32721 - DNA, 903 bp, Chloroflexus aurantiacus
cgtcatgcaatcgatctcgataactttagtgcgactgagatcgaggagattctggaaacggctgagagtatgcgcgaggtgctgagccgtgaaattaagcaggtaccggcactacgcggtaaaactgtggtcaatatgttttttgaggagagtacgcgcacgcgcatctcgtttgagctggcagcgcgggctttgtcggcaaatgtggtcgcctttaccgcacgggggagcagtgtcgagaagggtgagtcgctggttgatacggtgcgcacgctgcaagcgttgggtgccgacatcattgttatgcgccacagtcagtcgggtgcgccttatctggtggcgcgtcactttcgtggctcgcttatcaatgccggcgatggccgccatgcccatcctacgcaggcactgctcgatctctatacgatgcagagtcgattgggacaaatccgcgatctgcacgtcgttattgtcggcgatattctgcatagccgggtggtgcgctccaacttgtggggcttgacccgtctcggtgcgcgggtgacgctctgtggccctcccaccctgatcggcccggcggcgttctggacggcgacctggccgcaggtgcggattgcgtatgaactcgacccactgctgccggaagcggatgtggtgatggcgttgcgtctgcaaaaagaacggatgcaaagcggattgctgccggcgttgcgcgagtacactcggatctatggcctcaccagcgaacgcctggcccgcctgccgtcacatgcgattgtgatgcatcccggcccgatgaatgaagggatcgaaatctttcccgaagtggctaccgcatcaccggcagtgattgaagagcaggtcaccaatggcgtcgcagtgcggatggcgttactctatcgaatg

SEQ ID NO: 32722 - DNA, 1632 bp, Chloroflexus aurantiacus
ctcggtttgggtgagaagaccggacgcctgaatcggaaagggcgggattttatcttgtggaataacgatgtactgagtccgcatggtgaagccgaattcgccgtcggtcgtgatcccgccgatccgcgcacgaagaataccagcacggagttcgatccctattacatctcaattccgtttttctaccatctcgatcagacggggaatgctgccggtttttttcttgacaatccataccgggtgcatgtcgatttttcgcctgccgagacctacggcatctgtgcgttgggtggtcaatacacagagtatgtgctggccgggccacggattgccgatattctcgaaggattcacctggttaaccggtcggctggcgccgccaccaatctgggcgcttggctaccatcaatgtcgctggcaccgctatagtcaggctgacatcctgactctcgcagcccgacatcgtgaacgacgcatcccgtgcgatacactctggctcgatatcgagcatatggatggctatcgcgtattcacctggaatcacgaattgttccccgatccgacagccctcgctcgccagttgtacgaacagggctttcgcctgatcacaattgtcgatcccggcgtgaaggtcgatcccgattttgcgttattccgcgagggggtggcgcacgatctgttctgtcgagcggccagtggtgagttgtacatcgggcaggtctggcccggtcgcacggcgttccctgattttgtgaaaccggaagcacgtacctggtggggcgagcagaatgcacgtcacgcgcagttgggcattgccggtatctggaatgacatgaacgaaccggcaaccggtgatattccgccgtatgcgatgcgcttcaacggtggccgcgaaccgcacgaacgctatcacaatcagtacgcattgttgatggcgatggcgacggtggaaggattacacactgccttccccaaccagcgcacgtttgtgctgtcacgggccggctttgccgggattcaacggtatgccgctaactggatgggtgacaattgtgcgcgttgggatcatctctggatgagtatgccgatggccatggggacagcgctatccgggcaggcatttatcggcgctgatattggcgggtttgccggtgacacccaacccgaactttttgcccgctggatgcagtgtgccgcgttgacgccattctgtcgcaatcacagcgcctacggccacatcgatcagtatgtctggtcgtttgggccggctatcgagcagattgcccgcaacgcgattgaattacgctatcgcctcatgccctatctggtcacggccttcatgcgaaccgtggaaaccggtgaaccggtacagcaaccgctggtcttcgcctatcaatacgaccgcttaactctcgagatagacgatcaatttctggtagggcgcgacctgctggctgcgccggtgtatacaccgggcacgacgtcccgacagctctacctgcccgccggtgagtggtacgattggcataccgacacgcggtacgccggtgagcaatttgtggtgataccggcaccgctcgaacggctaaccctcttcgcccgtggcggggccgttattccactctggccggat

SEQ ID NO: 32723 - DNA, 1146 bp, Chloroflexus aurantiacus
gagtttatcatgccggcacagatgatcattggttcaggtgctgtcgatcaggttggtgcacagtgcgcgaagcggggctggaagaaggcactcatcgtcaccgatcagatcatgcagaaactcggcatcgtcggccaggtcgaacagaatctggctcatcacggcataaacagtgtggtgtatgccggtgtcaacaccgaaccggtggtggaatatgtgcaagaggggttgacaacattccgggagggtggctgcgattttgtgctggcagttggtggtggcagtccaattgataccgcaaaagcggttgctgtgctcgtaaccaatcccggttccatcgagcaatacaaggggattggcaagattggcgctcccggtgtgccgctggtcgctatccccactacagccggcaccggtagtgaagcgacaatctacaccgtcattaccgatcaaaagaccgatgtgaaaatgttgatcggtagcccctatttaatgccgaccatcgccatcgtcgatccgatgttgaccatctcatcgccacccagtgtgaccgcagctaccggtgttgatgcgctggtacacgcgattgaagcctatgtgtcggtcaaacgccagccgatgactgatgtattatgtttgtcggccatcgagctaatcgccggtaatattcgtcaggcctgggccaatggcaacaatatcgaagcccgcgagaagatgatgttgggggcaacacaggccgggattgcgttcagtaattcgtcagtagcgcttgtccacggcatgtccagaccgattggcgcttacttccacattgcccatggcgtctcaaacgcagccctccttgccgtagtgactgaattcagcctggttggtgatccacagcgctatgccgatattgccagagcaatgggcgagccgaccgagggtctatcgctgatggaagcggctgatcgagcggtcgttgccatccgtcgtctggtgcgagacatcaagataccctcgcttcgccagttaggcgtggagcgcgagcggttgatggaactggcgccggcaatggccgatgccgccattgatagcggtagtccggcgaataatccgcgcaagcccaccaaacaagaaattattgaactgtatgccagggcctac

SEQ ID NO: 32724 - DNA, 1140 bp, Chloroflexus aurantiacus
gacatgtttctcggccccgaacacgagatgttgcgccagacggtgcgcaactttgccgagcgcgaagtcgcaccgcatattcgcgaatgggatcggagtggcgcagcggctgaggggccagaagatcggcctcatctacgtccggtgctgaagcggatgggtgaattggggctgttgggtatctgtattccacaacgctacggtggcgccgggatggattacctggcgctggcggtagtctgtgaagagcttgagcgagtcgacagtttcttgcgggtggtcatgagtgtccacaccggtctgaattcgctctcgatcttccaatggggaacggaagagcagaaacagcgcttcctggtgccacaggcgcggggtgaaaagctggccgccttctgtctcaccgaacccaacagcggtaccgacgctgccgctatgcaggcgaccgcccgccgcgacggcgaggactatattctcaacggcgagaagatatggattagtctggccgatctggccgataacttcctggtattcgcaaaaaccgaccccggtgccggcccgcgcgggatcacagcctttatcgtcgagcgttcgatgcccggtgtcagcagctatcccattcacggcaaactgggagtacgcgccggtaataccggtggtgtcgtctttaacgatgttcgcgtgccgcgctcgcaccggctgggcgaagagggtgaagggttcaagattgcaatggcagcgcttgataatggccgttacactgtagctgccggcgctaccggtctgatccaggccagtctcgaagccagcattcgttacgctcgcgagcggcaaacctttggcgtacccattgccgagcaccagctcgtcaagcggatgatcagccatatggtgcgcaaacttgacacctcacgtctgctggtctatcgagcgggatggatgaagaataagggcattcgcaacacccgtgaaacgacactggccaagtggcacgcgacggttagcagctttgaggctgccgatgatgccattcaaatccatggcgcctacggctacgccgatgaatacccggttgagcgttatctgcgtaatgcacgcggtgctatcatctacgaaggtacccgcgaactacaagagttgttg

SEQ ID NO: 32725 - DNA, 225 bp, Chloroflexus aurantiacus
ttgattgatgtacgccagcctgaagaattcgcctacgacggccacgtctccggtgcccgtctgctccccctgccggtgctggcctcgcgcctgaacgaactaccgaaagatcagccgattgtctgcatctgtcgttcaggtaaccgcagccaggtagcctgtgaaatgcttcagcgccatggcttcaccaacgttaccaacgtcgttggtggtatggttgcctgg

SEQ ID NO: 32726 - DNA, 807 bp, Chloroflexus aurantiacus
atggatataactgcttatctcaaccgcatcaattatgctggcccgctggcacccaccgccgagaccttgcggcggttgcacctagcgcacctgctctcagtgcctttcgagaaccttagcatccactggcatgagcctatcgtcctcacagatgaagcccttttccagaagattgtattgcgccagcgcggcggcttctgttacgagctgaacgggctgttcgcttccttgctgcggaccttaggcttccaggttgagatgctctcggcaggcgtgatgaataagcgcggtgagttcgggccggagttcgaccacatgaccttgatggtcacacttgcggagcgctggctggtagacgttggcttcggtgactctttccgtgagccgctgcttctggatgcgcgtacggagcaggtgcagggtcggcgcgcttaccgcattgaggaggtcggcgacgggcgtttaatcctgatggagcgccgagagggcgacgagtggcaggcgcaataccgcttcagcctggagccgcacgtctacgctgattatgcagggatgtgccgctatcatcagacctcacctgagtcacacttcacgcagcgacgaatctgttctttggcgacagcggatgggcgggtgacattgagtgagcggcggctgattatcacgcgagggggtgagcggcaggagcgggagttggggagtgcggaggagtatggggaggtgttgcgcacacactttggtatcgaagccgcgccgaaccaggggatgcagccgaccgcaatgaggaggtctgttattctcgaaaca

SEQ ID NO: 32727 - DNA, 921 bp, Chloroflexus aurantiacus
gctatcgttgaaaccaaaaatctcacccgctactacggcgccatgctcgccctcgatcatctcaatctgcacattcccgccggtgcggtctatggctttattggcccgaatggtgccggtaagacaacgacgatgcgcatcctgacgaccctgctgacaccatcgggtggcgaggcatgggtcgccgggttctcggtcacccatcaacgaaccgaggtgcggcgggcggtgggatttatgcccgattcgtttggtttctacaacaacatgacggctgccgaataccttaagttcttcgccgatgcgtatcacgtgccacccgcccgtcagcttggattgatcgaggatttgctgaccctggtcgatctggcccacaaacgcgatagtgatgtgatgtcactctctcgcggcatgaaacagcggctcagtctggcccgtaccctgatccacgatccgcagttgttgatcctggatgaaccggccagcggcctcgatccgcgggcgcgcgtcgagctgcgcgagctgctcaaagagctgcgccggttgggcaagacgatcatgatcagctcacacattctgaccgaactggccgagatgtgtacccacattggcatcatcgagcggggcaaactgctggcatcaggcgatgtcaccacgattatgcgttcgctgcaaccgcaccgcacgtttgaggtacacgtcatcagtgatcttgagcaggctgcggcagcggcggcgaccgccgaccacgttctggccgtgcgcaccatcaccgacgacgaaccgccacggctcgaaattgatgttgacggcgataatcatgcggtgagtgcgttactggcccatctgatcaatcacggcgtcgaagttgttcactttacggcgcagaccagcaatttagaagaagtatttctcaaggtg

SEQ ID NO: 32728 - DNA, 621 bp, Chloroflexus aurantiacus
ttacgcgatctgaaagccgtcgtcaccggcggcagccgtgggattggccgggcaattgctgaagcgctggcccgtgccggtgcgcaggttattatctcatcaaccaatccaaccaaccttactgaagctgaacgcgcgttgcaggctgctggtttgaacgtcaccggtattcgctgcgatgtcgccaatcgcaacgaggttgaagccctggcaagtgccgctgtggaaaggatgggacggatcgatctctgggtcaacaacgccggcatctcagggccattcggctatgcactggacataccgcccgatgcctgggaacaggtgatcagggtcaatctgctcggtacctattacggttgtcgggcagcattgccgtacatgatcaaacaacgtaacggtcagatcatcaatctctccggtggtggggcaaaacgtgcccagcgctttctctcggcatacagcacatcaaaagcggcgattgtacgtctgaccgaagcctttgcccgcgactatcaagaccacccctacctgcgcttcaacgtgctcacccctgggatggtgccgacagacatgatcaatcattttgaaacggttggccccggtggtgaggcgatcaagcaa

SEQ ID NO: 32729 - DNA, 852 bp, Chloroflexus aurantiacus
agcgcacgcatcctcgatggtaaggcactggcgcaagagctacgggccgaagccgcagcccagattgctgaattgcgcactcagattgatcgtccacctacaatcgccgtggtgcaggtcggtgatgatccggcggcaacccgctatgtgcggagcattgaccgcctgtgtcagtcgttgggagctgcctgccgggcaattgcacttccggcagaaacggcgcaggccgacctggaagcgaccgtggcgacgctgagtgcagatgatcggattgacggtatcttactgcaattaccgttaccggcgggtttaaccctcgatggtgtgctaagccggcttgccccggaaaaggatctcgatggtattcacccgatcaacgccggcttgctggcgcaggggcggccaaccctcacacccaacaccccggctggtggcattgaactcatgcggcgttatggtatcgacattcgcgggcggcgtgccgcagtggttggccgctcggcaattgttggtcgacctatggccctcctgctactacaagccgatgcgacagtgacaatctgtcattcccggacacccgatctcggtgcagttttgcgcgagtgcgatattatcgctgcggctgccggtcgtcctggtctgatcactgccgatatggtcaaacccggtgcaaccgtaatcgacttcggtaccaatgtgttagccgatggaagtatggttggcgatgtcgattttgctgccgtggccgaggtggccggggcaattacgccggtacccggtggtaccgggccggtgaccaacatcatgttgatgcggaatctgatcacggcaacgcgcactcgtctcggcatc

SEQ ID NO: 32730 - DNA, 690 bp, Chloroflexus aurantiacus
gtgcggtacagtgctcgaacggatgttgggcagcgacgggaagtaaatcaagatgcatacggcagtgccgagatcgatcagggcacactgctcgtagtctgcgacgggatgggggggcacctggccggcgaggttgccagcaggctagccgtggaaacgatcattacctcatttcgggctgacaatgaccccgcagaaggattgcgccaggctctcatcagcgccaaccagcgcgtatatcaagagggccgtggcacgatgggcaccacggcggtagccgcctttttctggcataacatgctctacgttgccaatgtcggtgatagccgggcctatctggtgcgcgaagggcttatccgccaactgaccaacgatcactcattgattggcgatcaggttgccgccggtttactcacacctgaacaggcacgcacatcaaccatccgcaacattattacccgcgccattggtcatcagtcccatgtcgaggttgatattttccgtgagccactgttgccgggtgatacggttgttctttccaccgatgggatgcacggtttactaaccgatgaagagattgcggccattgccagcatgcatccgctcgatgtcgcgagtcgacgtctggtcgatgaggcgaatgcacgcggtgggccggataacattaccgtcgtcgtggctcaggttgat

SEQ ID NO: 32731 - DNA, 1890 bp, Chloroflexus aurantiacus
ctcgatgaaaccattgccgcgcaaatcgctgccggcgaagtagttgaacgaccggcgtcagtcgtcaaagagttgctcgaaaatgccatcgacgccggtgcgcaacggatcgtgatcgaggtacggggtggcggattgcgcgagattcgcgtgcaagacgatggctgtggtattccggctgacgaaattgaactggcctttgcccgccacgcaaccagcaaattgcaatctgctgacgatttgtgggctattcggacactggggttccgcggcgaagccctgcccagcatcgccagcgttgctcaggtcatctgtatctcgcgggttgccgatgctgaactcggtgttgagttgcggattgccggtggtgaagttcaatcccgattgccgtgcggttgtccggttggtacgacgatcacggtacgcaacctcttttacaacacgccagtccggcgggaatacctccgttctgaagcgacggaaaccggagccatcagcgcaattgtccaacaatacgcactggcttacccggaagtgagctttagtttgttgatcgatggccgtatggccttacagaccagtggtgatggcgatctccggacggtggtcgtcgagctgtacggcctcgaagttgggcgagcactattgccggtacaggcagaagctggcgtagacgaaacatgggtcgcggtcaatggtctgatttcgccacctgaattaacgcgcagttcacggaattatctttcgctctttgccaaccgccgtgcgctgcaaccgcggggggcactggctgcggtggtcgagaatgcgtaccatacgatgctgatgaagggacggtttccgattgccatcctcgatgtgcgcgtccatccagccgccatcgatgtcaatgtccatcctaccaagagtgaagtgaagtttcgctacgctgctcacgttcacagtgtcctaggacgtgccattcgtgacgctttgctgcgcggcgccgatattccaacctgggatgcccctgatccggcaacggcccagcgacgctttgagttacgtcggctgggtcaggtagcaaccacaccctcctctggctggagtgttggagcctcggcgtgggatcgtgaacgctcgcgctgggatgtcggttcgccggcaactgcgctgaacacgccccttcccattgtgcccgaagcaccacagtcaccgccatcgccaacgcttgtgcccgaacctgcccggcaaaccccaggcgagccgataactccagcagttccggcagcggcaccctcggcactacccccgttacgggtagttgggcaggtcggcctgacctacatcgtggctgaagctcccgaagggatgtatctgatcgaccagcacgcagcccacgaacgcatcacctacgagaaattgatgaatcagtatgcccaacacgcggttgagtcgcagcagttgttgattccacaggcggttgaggttagcccggaagcaagtgccttgttgttgggtaatgcagagcggctggcagaatggggctttgtcctcgaaccgtggggcaccggtgtgctggttcgcgccatcccggccaccttaccgaccgatgaactgacgcaagctatccacgagatagccgaaaagctggccggacgtgggggcagtgatccgctggaatggcgtgaagcgatgttgattacgctggcctgtcacacctcagtccgcgccggacagccactttcccacgaagagatgcggcaattgttgcgacaacttgaacagtgtgtcagtccgcgtacctgcccccacggtcgtccgacgatgatcttgatgacaccggctcagctcgaacgccagtttgggcgacgggtatagcccggcctgaaggcacaacgccgcaacgga

SEQ ID NO: 32732 - DNA, 927 bp, Chloroflexus aurantiacus
atgcgcaagaagattagtattatcggggcaggatttgtcggttcgacgacagctcactggctggccgctaaagaattaggtgacattgttctgcttgattttgtcgagggtgtgcctcaaggcaaggctctcgatctctacgaggcatcaccaattgaagggtttgatgttcgggtgaccggcacgaacaactacgccgatactgccaactcggatgtcatcgttgttacgtcaggtgctccgcgcaagccgggcatgagccgtgaggatttgatcaaggtcaacgccgacatcacccgtgcctgtatcagtcaggctgccccgctctcgccgaatgccgtgattatcatggtcaataatcctctggatgcgatgacctatctggcggcggaggttagtggcttccccaaagagcgtgtcattggtcaggccggcgtcctcgatgcggcccgctatcgcaccttcattgccatggaggcgggtgtttcggttgaagatgttcaggcgatgctgatgggtggtcacggcgatgagatggtaccgctgccccggttttcaaccattagcggtattccggtgagcgagttcattgcgcctgatcgtctggctcagattgttgagcgcacccggaagggtggtggcgagattgtgaatctgctgaagaccggcagtgcgtattatgctcccgccgccgccacagcgcagatggtcgaagcggtgctcaaagacaagaagcgggtcatgccggtggcagcctacctgaccggtcagtacggcctgaatgatatttactttggtgtaccggtgatcctcggtgccggtggagtagagaaaattctcgaattgccgctcaacgaagaggagatggcactgctgaacgcatcggcgaaagcggtacgtgccaccctcgacacgctgaagtctctc

SEQ ID NO: 32733 - DNA, 1020 bp, Chloroflexus aurantiacus
atggttcgcgtcgctatcaacggtttcggccggatcggacgccagagcttcaaggcaatgctggagtattaccccgaagagttcgagatcgtcgctatcaacgacctgaccgacgcgcaaacgctggcccatcttctgcgctacgattcgacctatggtgccttcgatggcgaagtaacggtgaccgagaaggcgattgtggtagagcaggacgatattcgctacgagttgttgacgctggccgagcgcgacccggcagcattgccctggaaggagctgggggttgacatcgtgatcgagtcgaccggccgtttcaccgatgcggaaaaggccaaggctcacctcgcggcgggtgcgaagaaagtgatcattacggcaccggcgaaaggtgaggacatcaccatctgtctgggtgtgaacgacgcgaaatacgatcacgagaagcatcacatcatctcgaatgcatcctgcacaaccaactgtctggcaccggtagcgaaggtgctcaatgatcgcttcgggatcgagcgtggtctgatgacgaccatccactcgtacacgatggatcaaaacttgcaggataacgtacacaaggatttgcgccgggcgcgggctgcggctatcaacatggtgccaacgaccactggtgccgcgaaggcggtggcgctggttattcccgaattgaaaggcaagttccacggttatgccgtgcgcgtgccgacgccgacggtgtcgatggttgacttctcggtgctgctgagcaccaagacctcggtcgaggagattaaccaggccttcatcgaagccagcgagagcgaagagcttgagggcattctcggcgtgagccacgatccgctggttagcaccgacttcatcggtaccacctacagcagtgtagtcgatttaccgctcacaatgagcatgggcgacgatttcttcaagatcgtggcctggtacgacaacgagtggggctattcggtgcgggtcgccgatctgaccgcactggtggcagaccgcttc

SEQ ID NO: 32734 - DNA, 2763 bp, Chloroflexus aurantiacus
agcgggcgaagcatgaatgaatggaacggcttctatggcccaaatgccggctatctgatcgaattgtacgagcgttattgcgccgatcccaattcggtcgatgaggcaacccgggccttttttgcgcaatgggcgccgcccagcgacagtgcggcgccggctggcgaggccggccaaccgccgttggatgtgacgcggattgttggtgcagcgcgattgatccgctacatccgtgaattggggcatctggcagcacggattgatccgctcggcagtgatccacccggtgatcccggtctggagctggcaacacacggggtgacgcaggccgatctggctgcactaccggcacacatcgtccgggggccgattgctactcaggtacgcaatgctgccgaaggtgtagaacgtctgcgacaggcctattccggttcgattggctacgagaccgatcagattcaggattaccttgaacgtgcctggattcgtgaggcggccgaggatcgccgtttcttcggcgggcttgatgcagaccgtcagcgcgaactactcgaccggctgacggaagttgagtgttttgagcgctttctacacaagacattccccggtcaaaagcggttctcgattgaaggctgcgacatgctgatcccgatgatcgacgccatcattcggaatgctgcggtcaatggtaccaaagaggttgttattgggatggcgcatcgcggtcgtctgaacgttctcgcgcatattctcggtaagccctattcgatgatcttgaccgaatttcattcgcccgactataccaaagatacctatgaaggctggacaggtgatgtgaagtatcatctcggtgcccgcaaagcctaccgcgagagcgggattgccgagatgccgattacgctggcacccaatccaagtcatctcgaatttatcaatccggtggtcgaaggtcgcgcccgtgctgcgcaagagcaccgtaatcggcctggcttcccggaagaggacgagaaggagtcgctggcgattctgatccacggtgatgctgctttccccggtcagggtattgtcgctgagacgctgaacctctcgcggttgaaggggtatcataccggcggaacgattcacattatcatcaacaatcagattgggtttacgaccgacagcaacgactcgcgttcgaccctctacgccagcgatctggcgcgtggtctggaaattccggtcgtgcatgtcaatgctgatgatgttgaagcctgtattgctgcggcccggatggcttcagcataccgtgagaagttccagaaagatttcctcatcgatctggtaggttatcggcggtggggccacaacgagggtgatgagccggagtttacccaacccaagatgtacgagcgaattcgcaatcatccgacggtgcgcgagatttgggcgcgcgagctggaacggcgcgggatcatcacccgcgaggaagcccaggctcgcgtcgatgcggtaatgaatcggctccagcaggcatttgagaaggtgcgtgaacgtcagcgtctggcagcgtcgttgccacctgcaccaccgccgcccgtccaaccgctgcgtcgtccaccgatctttacccgcccggtttcggcgaaaacgctgatcgagctgaacgaggcattgttagatcggcctgaaggctttacggttcatcccaagctcgaacgcaccctgcaacggcgccgacaggctatctttgaggaaagcggtatcgattggggccacgccgaggcgttggcgtttgccagtatcctcgccgatggcacgcccatccggttgaccgggcaggacagcgaacggggtacatttagccatcgccatgctgtcttgcacgatgtggtgaccggcgagcgtttcattccactgcaccacattccgcaagcccgcgcctcatttgccgtctacaacagtccgctttccgaggcgtcggtattgggttttgagtacggctacagttgtcacgcgcccgacacgctggtgttgtgggaagcgcagtttggcgattttgctaacggcgctcaggtgatcatcgatcagtttatcgtcagtgggcacgccaagtgggggcagaacccatcgctggtgatgctgctgccgcacggttatgaagggcaaggcccggaacactcaagcgcacgtctggagcgatttttgcagttggcagccaatgacaatattcgcgtcgcgaattgtacgactgcggcgcaatacttccatctgctccgttaccaggcggcatcgctgtatgccgaccccaagccattgattatcctgacgcccaagagcctgctgcgccatccacgcagtagttcgtcgttgcgcgatctcaccgaccatcgcttccagccggtgcttggtctgggggcagaggcgccagcgccagaaggggtcacgcgcctcatcctgtgttcggggaaggtagcgattgatctgctctccagtgccgaatgggaaaagactgctggccgggttgatgtgctgcggcttgagctactctatcccttccctgccgaagagttgcggatggccatgcagcgctatccgaacctgcaagaggtggtctggttgcaagaggagccgcagaatatgggagcctggagctttgtctggccccgcttacaacagctcttacccgaaggggttacactccgctatgtcggacgtgccgagtcggccagtccggcagaagggttgcatagcattcacgtgcgtgaacaggctcgtatctta

SEQ ID NO: 32735 - DNA, 1335 bp, Chloroflexus aurantiacus
gaaattcgcgtaccgtcactcggtgagtcgattgttgaggcgacggtagcacgctggcttaagcgtgaaggtgaaccggttgcggttggtgaaccggtagttgaattggagaccgataaggttaatctcgaagtagccgccgatcagagcgggattctgaccagcatcgcatgtccagaagggactacggttggtattggcgatctgctgggtacgattgaagccggggcattgcctaaagaagcaccggtggcggcagccagtacaacaacggtagcggcccctgtcgctgaaccggtagctgctactgcggtcaatgaagtgctggcgacaccggttgcccagcgcatggctgccgaacacgctatcgatttgcgcacagttcccggcaccggccccggcgggcgcattactaaagaagatgttatgcggctggtgtcgggtaccgggccgagtgaagcaaccgctaaagcggatgaagcgcgggtccacgtcagccatccgaccccggctgtggtagagcgcccacagcccgctcagccgtcacctgcgccagctccggttgcgccgccaccaccagcaccggccccacggccaacgccacctgcagccccggcagtagtcagtacgaatggtgaccgtcgtgaagaacgccagcgcctgagtcggcgccgtttaaccatcgctcgccggctggtggaagcgcagcacaccgcagcgatgcttaccaccttcaacgaagtggatatgagcgcggtgatggcgttgcgcgcccgtcacaaggactcgttcaaagagcggcatggggttggtttgggctttatgtccttcttcaccaaagccgtggtcggagcgctcaaagcttttccgatggtaaatgccgagattcagggcgaagaggtcgtcatcaagtactactacgacatcggcatcgccgttggtgttgacgaggggctggtggtgccggttgtgcgcgatgccgaccgtaagaccttcgcacagatcgagcgcgaaatcgcccaactggcgaagaaggcacgggaaggaacgttgagtctggccgaacttcaggggggcacattcacgatcacgaatggcggtgtctacggttcgctcatgagcacgccgattctcaatgccccgcaagtaggcattctgggcatgcacaaaatcgaagagcgtccggtcgtcgtcggcgggcagatcgtcattcgcccgatgatgtacgttgcgctgagctacgaccatcgcttgatcgatggcagcacagcagtgcgcttcctggtgaaagtgaaagagctgattgaagacccagaggcgttgctgctggaaggg

SEQ ID NO: 32736 - DNA, 1488 bp, Chloroflexus aurantiacus
tggcggtatgcggaggcggtggctctggcgcggcgggctgccggcgtactctacgatctcggggtacgtccaggggatcgcgttggtttgatgatcgggaacaatcccgattatctctgggcgtggttcggctgtgcctgccttggcgcggtcacggtaccgatcaatctgcatctgaaaggtgacgtactgcattacattctcgatcatgccggggcaactgttttgctcatcgaagcgcatctgtacgagcggattgcggcgttgcgtgcccaattaccgacgttgcgacatctggtagtgcgaggaagtgatacggcgccgccagatgccgtccactggcacaccgccctcagtggggcgcgaccggtcgatccctcaccggggagtgcgaccgacctgcacagtattctctacacctctggcacgaccggcccacctaaaggtgtgatgctcagtcaccacgcctatctccactcggcggccctcttcgctgacgtgatgattggcgcgacagccgatgatgtgtttggcaccagcctgccgctctttcatatcaatgcgcaggcgcatacggtattaccggccatctatcgcggcacgacgattgccttgatcgagcagtttagtgcctcgcgctactggcgccagctcgccgatcttggggccactatctgcaatttgctggcagcgatgatcccgatactgatgaagcaggcgccttccgccgatgatcgggcgcatcgcgtgcgcattgcagcctgtgcggcgacgccgcctgatttgtggcgcgcctttgaagagcggtttgggttgacgattatcgaagggtatggtctgaccgagaccaccggtttttgtgtggctaatccacgcgatgccgtgcgggttggtacctttggcaaggcgatgccggggttcgagctggcagttgtggacgccagcgatcagccactgccggcgggcgtgcccggcgagatagtgattcgtccgcagcgtgaccatctgatgatgatgggttactatcgccagccagaacagacggcgacggcaatgcgtggtgggtggtttcacaccggcgatctggggcagcttgatgaagccggctatgcgatttttattgatcggctcaagcaatcgattcggcgacgtggcgagaacatctcatcgtgggaggttgagcgggcggtcaatgcccatcctgccgtgttagagagcgcagcggttggtgtgcccagcgaactcggtgaggaagaggtgaaggtggtcgtagtgttgcgccccggtgcgactctcgatccgattgatctgatacgctggtgtgaagagcggctggcttactttgccgtaccacgctacgttgagtttcgccagagtttgccgaagacggcgaccgagcgggtcgagaagtataagctcaaagccgagggtgtgggaaacgcctgggatcgcgaggctgccggttatcgggtgaagcgttcgtgagtg

SEQ ID NO: 32737 - DNA, 3419 bp, Chloroflexus aurantiacus
ggtgtcttctcgtttttacaatcgttcatggcagagcagacttcgcacggtctggctttcgatctacgcaatgcaatcttcagcaagattcaacgcatgtcgtttagtttctatgatcgcaatcagaccgggcaattaatggtacgtgctaccgatgatgttgaacgggtgcgcacattcgtggctcagggtctggtgctggctgcccaatcgtttctactgttaatcggggcgttgattgtgctggcctttaccaactggcaattaacgctggttattctgcctttgttgccaattgcgcttgctgtgttctttgtctttggtcgcatcagccagccactcttcctggaagtgcaaaatcggctttcccgtctcaacacgattttgcaagaaaatatcgccgggattaaggtcgtgaaggcatttgcccgcgagccgtatgaagaacaacggtttgatcaggcggctactgcgctgatggagcagcaaattcgggtgaaccggatttttgccttcctcttcccggtgatatttttaattgcccaattaggccaggccgccattctctattttggtggtcaacaaattctaaacggaacgctggaactcggtgaatatcagaagtttagtctctatctggtgtatgtcttcttcccactcggtcagctcggtttcattatcgcattgctggcccaggccggcgcctcagccgggcgcatctttgaagtgctcgatgcgcagagtgagattgtcgaacgaccagacgctatcgtgctgccaccgttgcaggggcgggtagagtttcgccatgtcactttccgttacttcaacagcagcgctcccgtgttgcaagatgtcagttttgtggtcgagccgggacaaacggttgctctgctcggcgcaaccggcagtggcaaaacgtcgatcatcaatctcatcccgcgtttctacgatgtcagcgagggggctgtgctcatcgatggctatgacgtgcgcgacgtcactatcgacagtctgcgcagccagatcgggattgtgttgcaagagagcaatctgtttagcggaacgatccgcgagaatattgcctttggccgccctgatgccagtgatgacgagatcattgccgcagctaaggccgcggctgcacacgatttcattatgagttttcctgatggctacaacacgcgggtgggtgaacgggggatgacgctttccggtgggcagaaacagcggattgcgattgcccgtgcgctcttgctcgacccacggctgctcattctcgacgatagcaccagcaatgttgatgtggcaaccgaagcactgattcagcgggcgctcgaccgtctgatgcgtggccgtaccagtttcgtgattgcccaacgaattagcaccgtgcgcaacgccgatctgatcctcgtcctcgacaaagggcgactggtggccagcggtacgcacgccgaattgcttgaacaaagcccaatctacgccgaaatctacgcttcgcaactgattgaagacgccccgctaccctctacgaatggtcagggtgaagaaggagtgacaggacgatgatgggaggactgggcggccaaggccgcatgctgaacactgatgtccagaagccgaagaatgtactggcgacgattgcccgcttctggccctactttcgcccctactggccggtcgtggtgctcaccttcgtcttgatcaccgccagtgcccagttgcaggtcactgctcctgaactgatcggtcaggcggttgactgctacctcttcccgcgggccgatgcctgctggtacaccacggtcgatgccgcagcaacgaatgccgaccgtctgagcgggctgaccggcctggtcggttggttgctggttgtgtttgtcggtggtgcttttctccagggcctggccttcttcagtatgaactgggttgggcagcgagcactccggcagatacgagaggatgttttcgcgcacattcatcggctctcgctgggttattttgctcgtaacgaagccggtaatgtgatgagccggatcaccagtgacaccgatacgattcagcaggccctgagttttgccttgctgagcgttgtcagcggcttcttgcagattggtttgaccatcaatgcaatggttctaagcaatctgccgtatgcgctgatcagcctgagtgtggtgccatttatggtgttggcgaccttctatttttccacccaggcccggcgagcgtttcgcgccagtcggcaacaaatgggcaatgtgaacgccggtttgcaagagagtattgccggcgctcgcgaagtacaggccttcaaccgtgaggcagagagcattgcccagtttgagcggaccaatgccgccaaccgcgatgcaaatattcgagcagccagtttcaccagtgccctgaacccggtgctggaagccctgggatatgtggccatcgccatcgttgtggttgtcggtgcgctgagtgcgctgcgcaatgtgcccctcttcggtaccgggatcatttcactgggaacgatctttgccttcattcaatacgtgcaacgcttcaatcagcccattcagcaaattgcttctctctggacaaatgtccagaacgcgattgccggtggtgaacgcatcttcgggctgcttgatgtgcaacccgatctggttgatgcaccgaatgcgtatccgctaccgccgatccagggtcgggtcgtcttcgatcacgtctgggccgaatataaaccgggtgagccggtactgcgtgatgtaagttttatcgctgaaccgggacaaaccatcgctatcgtcggcccgaccggtgccggcaagaccacgctggtcaatctcatcccgcgtttttacgatgtcagcgccgggcaggtgacaattgacggtcacgatgtacgtgcggtgaccgccgccagcctgcgttcgcagatcggcattgtgctgcaagacaccttcctgtttgccgatacggtgatgaacaatatccgttatggacgcctgtctgccaccgatgacgaggtcatcgctgcggctcaactggtcggcgcgcaagagttcatcgagcggttacccgacggctaccagacgatcctcggcgagcgaggtaccggccttagtcaggggcaacggcaactgatcgcgattgcgcgcgcagcgttggccaatccccgcattttgatcctcgatgaagcgaccagtagcgttgacacccgcaccgagcggatcattcagcgcgcgtttgatcagatgctggcggaacgaaccagctttgtgattgctcatcgcctgagcacaatccgtaatgccgatctggtgctgatggtcaagaatggtcagatcgtcgaacgcggctcgcatcaggagctgttggccttgcgcggcgcgtattacgatctgtatcaacagcaattt

SEQ ID NO: 32738 - DNA, 1314 bp, Chloroflexus aurantiacus
atcaaaatgcctcagctcggtgagagtgtcaccgagggcacagttgggcgctggctcaagcggcccggcgatccggtcgctaaatacgaaccgctgctcgaagtggtgacagacaaagttgacaccgaagtgccggctcctgaagccggcgtactccacgagattctggtaccggagggggagacagtgcgggtcgggacggtcatcgcgcgcctggccccggcaggcgcaacggtacctgcaacaccggcttcggcaccagccgcaaccaccgtcgccgcaacggcatcagctaccaccaccgtgacggctaccgtagctccaccggtagcagatgggcgtaacacctatctttcgccggtggttgcccgcttactgtccgagcacaacctcgatcccggccagattcgcggtaccggtcagggtggccgtatcaccaagcaggacgtgttgcgcttcctggccgaacgacaacaacaaccgtctgcgccggtggcggcgccggtcgctcccacccctgtcgcaccctcgccggccccggcaccagcccccgcaccggtaagtccaaccccggcaccgaccccggcaccgaccccggcaccagcccctgcaccggcaaccttcgatattcctgcggatgcagaattggtgccactcaccccgatgcgacgcagtattgccgaacatatggtacgttcggtgcgcacctcaccccacgtgaccacggtgatggaggtcgatctgagtcgcgtcattgcccatcgcgccgcccaccaggaagcgttcagtcgccagggtgtgcgtctgaccatgaccccctattttgtgatggcagcagttgccggcctccaggcagtgccggtgttcaacggcagtttcaccgaccaggggatcatcctgcatcggcggatcaacatcggcgtagcggtcgcgctgcaggaaggcttgctggtgccggtaatccctgatgccgacgagaagaatctgctcggtctggcccgtgccgtcagcgacctcgccgagcgcgctcgcaccaaacgattgcgcccggaagagacccagggtggtaccttcactatcaccaatcacggtgtgaccggcagcctcttcgccaccccgatcatcaaccagccccaggccggcatcctcggcgtcggcgcgattgtcaaacgcccggtcgtgatcacgcaaaacgggcttgatgcaatcgccattcgtccgctctgttacctctcattcaccttcgatcaccggattgccgatggcgcgaccgccgatcagttcctggcaacggtgaaaaaacgccttgaagag

SEQ ID NO: 32739 - DNA, 984 bp, Chloroflexus aurantiacus
atcgacttcagcagcaacatcaaccccttcgggccaccagaatcggttctacaggcgctgcgtaccctcaatccagccccctaccctgatcgcagttgtctgcacctgcgcaggcatctggcagccatccatcactgtcagccggaggccgttctggtgggaaacggggcgaatgagctgatccacctggtagcccgtgccctcggtgaacccggtgccacagctctggtcgtagccccaacctacggcgaatacgcctacgcctcacacctggccggcatgcgggtgatcgagatacggagcaccgttggcaacggcttccaacccgatctcgccgaactcctgctcaccatcgaacgactgcgtccacggctgatctggctgtgctcccccaacaatcccaccggggtcaatctgtcggtaacgacgatcacagaactggctcatacctgcgcacttcatcaaggctggctcatcctcgaccgggcctatctggcgttgggtcgtgacgagaccggtcacgatccactcgaccacaacagcccgtcgcgcctgatccgtatctactcgctcaccaaaagctatgcggttgccggcctccgcattggctacatgattgccgatcccgacgtgatagccgcaactgcccgcttccaaccggcgtggagcgtgagcagtgcagcgcaggctgccgccgcagcgatgctgcacgataccggctttcttgccaccacgctcccggcgctatgggatgccagcagcgaactggcccaaaacctgcgccagatcggcctgaccgtctggcgcgcccatctgccgtttatgcttgtccattgcgacaatgcggcactgacccgccagcaactgctggtgcgcgggtgcgttgtgcgcgactgtacatcgttcgggttaccggaatgggtgcgggttgcgccccgacgcccatccgagaatgcccggttactggcagcctggcgcgatgtc

SEQ ID NO: 32740 - DNA, 1206 bp, Chloroflexus aurantiacus
gaggatggtatttaccactcgttctgcggcctggtcagtgtcggctggctctatcagaagatcaaagacagcttcttcctcatcctcggcacccatacctgcgctcatctgctgcaaaatacgctcggcgtgatgatcttcgcccgaccacgttttgcggtctcactgctcgaagagtctgacctgagttcatcacaacccgacatctcggcccagatcgaggagatcaagcgcgagcaccatccctccgtgatctttctgctctcgtcgtgtacgcctgaagtgatgaaggttgagtttgaaggactggcagcttcggtcagcacaccggaagtgccggtgctgtttgtgccggcctctggcctcgattatacgttttcgcagagcgaggattcggtgttgcaggcgctgatccccttctgcccaccggcaccaccggacgataagcgggtggttttccttggctcggtcaatgatgcgattgccgatgacttttcgctcgaagcggcacgcctgggcattccggtcgccggtttcttgcccgccagccatttcaccgagttgccaccaattggaccggggactgtcattgccccgctccaaccctatctgcacaagaccgcgacccaattgcgcaatgaacgtggctgcacggtgctctcttcgttgttccccttcggccctgatggaacccgtcgcttctgggaagatttggcagctcagtttgggatgcaggtcgatctgagtgagcgcgaggcggcagcctgggagcggattaaacatcataccgatctgctgcgcggtaagaagattttcttcgccagtgatacgctgatggaattgccactggctcgttttctcaaggcgtgtggagccgaagttgtcgagtgctctaccccctacatcaatcgccgcttccacgccgccgagctggcggcactcgatggagtccgtctcgtcgaacaggccaatttccatcgccagttgcgcacaattaccgagacaaagcccgatctgattatttccaacatcatcaccaccaatccgctggtcggtcagggaacggttgccaagtggggtactgaatattgttttctccccattcacggctgggccggcgtcaataatctggtgacatcctttacccgcgctctgcaacgccatgcccgtctcgatccactcggctccgatccgatctggctgacc

SEQ ID NO: 32741 - DNA, 1623 bp, Chloroflexus aurantiacus
atgcggctggcttactggatgtatgaagggactgctcaccacggtgtgggccggatcgccaacagtatgcggaatgtgcacgccgtctttcacgccccccagggtgatgattatgtcaatgccatctttgcgatgctcgaccgcacacccaattttccggccatgacgaccagcgtggtcagcggtaccgaccttgcgcgcggcacgatccggctgcccgatacgctgcgtcaggtggaagaacgagtccaccccgatctgattgtcgtggttgcctcgtgttccaccattttgttgcaagagaatcttgaaatcgcggctcagcatgccggcttgcagtgcgaggtgatggtgtacgatgccaatccctaccgtatgcaagagatagttgccgccgagagtctgtttaccgatctggtgaagcgctttgctaaaccgcagccccgcaccgaacgtccgacagtgaatatcctcggcccggcgtcactcggttttcacgcccgccacgacctgatcagtctccggcgtatgctgaagacgttagggcttgaggtgaacgtggttgcaccctggggcgcgagtatcgccgatctgcgccgtttgccggcggcatggctcacgattgctccctaccgcgagcttggtctgcgtgctgccatctatctcgaagagcagtttggggtgccggccctcctcgatgcaccgattggtgtccaacccacgctacgctggatcgaacgtctccgtgagctactggcccaggccggggccgatgtgccaatgccaccgctgaccgccttctcactcgacggtatgtcggcaccatctgctgtgccctggttcgcccgtaccgctgatatggatagcttttccggcaagccggcctttgtcttcggcgatgccacccacgtggttggagtcacgcgctttttgcgcgatgagctgggcatgccgattgccggcgccggcacctatgtcaagcatcaggccgattgggtgcgtgagcagttgaccggctatgtcgatgaggtgctggtaaccgatgagtttcaggtggtggcagaccgcattgctgccctgcgccctgaattggtgtgcggcactcagatggaacgccatacctcacgacggtacgatctcaactgcatggtcatctcaccgccaacccacatcgagaaccatctcctcgcctatcgccccttcctgggtttcgacggtgctgatgtcatcgccgatgaggtctacacgacctgtaccctcggtatggagaagcatctgatcgatctgttcggtgatgccggcctcgatctgcccgagaaaaccgagcgcactcctgtcgctgaaccggctccagtagcggcaacggtcgagagtccccaaccgcagaacgaaccggctatcgccgtggcatctgctccatctctcaccagcgcacccgcgacacccacacctgccgccgtcgttgatccagtgtgggctgccgatgcggaagctatgctcaagaaagtgccattctttgtgcgtggccgggtgcgcgggaatgtcgagaaatatgcccgtcagcgtggtcacgcggtcattacggcagaggtgctgctggccgcgaaggaggagcttggcgca

SEQ ID NO: 32742 - DNA, 942 bp, Chloroflexus aurantiacus
tctcgcttacaagggttttatcagcttaatccatttgagcgactgcaaatggtgaaatcctttgatggattagtcgatgaagacttacgcgccttgcacggcggccatggtggtgcgctcacgattgagcgtgccgataaaatgattgagaatgtgatcggtacctataatctgccgctcggtatcgcgaccaacttccgtatcaatggccgtgattatctgattccgatggtggttgaagagccgtcaattgtggccggggccagctacgcggcgcggatggtgcgagacgggggtgggtttgagacgagcagtaccgaaccactgatgatcggtcaggtgcagttggtcaatgttcgcgaccccgatcaggcccggcaaacgattttgtcgcgtaaggaagagattcttgccctggccaatgcgcaaagtcgttcgctggtcagtctgggtggcggagcacgcgatgttgaggtacgattcttccccaccagcccgatggggccgatgctggttgtgcatttgattatcgattgccgcgatgcgatgggtgccaacgcggtgaatacgatggccgaggcggtcgcaccgctgctggccgagatgaccggtggtaaggtctatctgcgcattctctcgaatctgaccgaccgtcggctggctcgtgcccgttgtgtggtgccggcagcatcgctggcccgcgatggtttgagtggcgaagaggttgttgaaggcattctctgggcctatgcgtttgctgcggtcgatccctatcgggcggcaacccacaacaagggcattatgaacggcattgacccggtgctggtcgcaaccggtaacgactggcgtgcggtagaggcgggtgcgcatgcctacgccagccgcaatggtcactatacgtcactctcccattgggagcgtgatgcgcagggtgacctggtt

SEQ ID NO: 32743 - DNA, 1665 bp, Chloroflexus aurantiacus
cgtccatggcttcgccattacgatccgggtgtgccggcaacgcttgacctgaaaccagagccgttgccggtgctgttgcaacaggccgccgagcgctttgcagacgccactgccatcgccttttacggtcgcacgctcagctacgcccgactatgggcagagaccaaccggtttgcccgtggcctgctcggtaccggctttcaaccgggcgagcgggtggtcatcctgttacccaatattccccagtccgtcattgcctacttcggcgtcctgcttgccggggggattgtggttctggctaatccgatctttgacgccgaaggctttgcccacgaggtgcgtgactcgggggcgacaacagtgattgcgctcagtatgtttcatcggctggttgagcaggtgcgggctgaactacactttcctcggctgatctacaccaatctgaaggaatatctgccatcgagccagcgtctgctctttaccctgctgcgtcaggagcaggaaggccaccgggttcccgatgctcaggcaagccaggcgctctggtttcaacatctggtggctgccggtcaggacggcgagttgcccacgctcgacgccggcgatccggctgttattctgtataccagtggcacaaccggcgccgccaagggtgtgttgcaccgccacgccagcctgtacatcaatgcgtatcagacacgaatgtggtacgccgatgccgaagagggcaacgagcgggtgttgtgcgtcatacccttctcgcacgcttacggcatgactgcctgtatgaatgttgggatcgcgctgggcgcaaccctgatcctgctcccaactttcgagacgcacaacgtgctgcataccatccgccgtgaacgaccaacgatctttcccggcgtccccccgatgtacgcggcgctcaacgaagtgcgcgaggtgcgcaaatacggcctctcgtcactcaagagttgtctgagcggtgccgcacccctaccggtagaggtgcaggaaggcttcgagcgcatcacccgtagccgcctggttgaagggtatggtctgactgaagcggggccggttacccacgccaatccgttgcgcggcgcacgacgtgccggcactatcggcctgccaatccccgacaccgaagcgcggatcgtcgatctggaaaccggtcaagacctgccgccgggcgcaatcggtgaactgctgatacgtggcccgcagcttatggccggttactggaacaacccggaagcaactgccgaagcgctcacggctgatggctggttgcgcaccggcgacattgcccggatgttgcctgacggctactttcagattatcgagcgcaagaaggagatgatcatcgccggcaactacaatatctaccctcgcgatctcgaagaggcgctgtacgaacatccgacggtgatcgatgccgcagtcgttggggtgccgctgcccaatggcaagacagaagtgcgcgtcttcgtcgtcacccgacccggtgaacgggttagcgaagctgaggtgctggcatttctccgcgagcgcgtcaatctgccggttgttcccgacaaaattgagtttcgcgaagcactaccgcggagcttcattggtaaattgctgcgccgccggttagttgaagagttgctttcacgcgaacaacgg

SEQ ID NO: 32744 - DNA, 993 bp, Chloroflexus aurantiacus
atggcccgtgtcggtatctatggcgcaaccgggtacaccgggattgagctgatcaaactgctctcccgccacccggaggttgagataggctttgcaaccgctcgctctgctgccgggcagcgcctgagcgaggtctttccgatcctgagcgatctgcgattgaccgcggtggaggaggtcgatccggcgacggttgatctcgtctttacctgtctcccccacaacacccccgatttgattcccatcgtgcaacgagcgctggctgcgggtgccagagtggtcgatttctccgacacctttcgcatcagtgatccgcaggtctacgctgcgcggcgcggaaaggaacatccggcaccggagttgctcgcccaggccgtgtatggattgcctgagctgcatcgcgagcgaatccggcaagcgcggttggttgccaataccggctgttacccattgaccgccattctgccgctggtgccactggtgcgcgccgatctgctcgccgactcgacggtgattgttgatagtaagtcaggcgtctctggcgccggtcgctcgctgtcgctcaagacccacttcggcgaaacccacgaaacgttcagtgcctacaatgttgggcgtgtccatcgccatctggccgaaatggagcaggagaccggcctgcatatcatcttcgccccccatctcctgccggtcttccgtggcatcctttcgacaatttatgtcaacttaaagccgggggttgacgaggcaacgctggccgcagtctatgccgatgcctatgcggctgagcctttcgtccatgtcttgccgggcggacggttgccggagctgcgccacgtgcaacacacgaatcacgtggtgatcggttatcagatggttgagccagggcgggcgattctggtggctgtgatcgataatctggtgaagggggccgccggtcaggcagtgcagaatatgaatttgctgctggggtttgctgagacggtggggttg

SEQ ID NO: 32745 - DNA, 1329 bp, Chloroflexus aurantiacus
gttatgaagcagattgtcgtgattggcggtggggctgccggtgtggaagcagcagttgctgccgcccagggcaacacaaaggtaacactggtcagcgaagggccaattggcggtcgtaccggttgggatagcctgctaccgagcaaagtatggctccatgccgctgaggttgccggtatcgcgacggcggcagccggcgagggcgtggcggttaacggggtgcaggtcgatccgacagccgtcttacaacggatcaaacacgttgcaacgcgatggagtgatcacgagcagcagcggttgcaggcggctggcgtaaccgttatgcagggggttgccgccttcagcagtcctcacgaattgacaatccagactcaggcaggccagcagacgataaccgccgatgtcatcattattgcgaccggttctgttccccgcttccccccgacgatgaaaccggacgggcagcggatcatcgcgccgcgctttgccagccatctccatacccttcccgacgacattatcgtaatcggtggtggcccgaccggcagcgaatttgcctcgctcttcagtcggctgggtgtcaaagtgacctggctggtcggtagccctggcgttttgccgatgtttgccaccaacgcccgttcaaccctggccgcagcgatgcaggcacacggtgtcgagatacatcaggttgatgtcgaacgggccgagcgcacggaagagggggtaagcgttctcgcggcagatggcactacctatacggcggccatggcattcctggcgattggccgcacacccgatctgagccggctcaacctcagtgccgccggcctgaccgttgaggcgaatggtcagctaaccgttgacaactacggacgcacgccagtcaaccacatcttcgcggtcggcgatgcggcgggcgggccgatgctggcgaaccgtgcgctggcgcaggcgtggatcgccgggcgcaccgctgccgatctgccggcaccggggtattgcccgcacaccatcgtgcatgccgtctacactgtgcctgaagttgcccaggtgggactggtcatggatacagagctgtcacgtatccgcgctgaatatggctcgtcgctcaagtcctaccttggtgcagagacatctggctggatcgagctgacctttgatccgatcacgcgccaggttcgcggtggggtagcagtgggcgatcatgctgccgatctactggccccggttgccctggcgatccagaccggggctaccctggccgatctggcagccgtctttgccgcctatccaacgttaagcgagactgtttttgccgcagcgcgc

SEQ ID NO: 32746 - DNA, 2018 bp, Chloroflexus aurantiacus
ccgcgcaccctgtttgagaaagtctgggaagcacatctggtacgaccagaaaccgctgaaacgcctgccgtgctctacattgatctgcacctcattcacgaggtaacctcaccgcaggcgtttactgaattacgccagcgcgggctgcgggttcgccgacccgacaagacgctggcgacgatggatcacagcacaccgacaacgccgcgtaatcatctgggcattattcccgtcgttgatccaatggcaatcagccagcttgaacaattacgaaaaaactgcgccgagtttgggattccactgtttgaattgggtgacgagaatcagggcattgtgcacgtcattgggccagagcaaggattgacgcaaccggggatgaccatcgtttgtggtgatagtcacaccagcacgcacggcgcttttggtgcgttggccttcggcattggcacctcggaagtcggccatgtgctggcaacccaatgcctgctccaacgcaagccaaagacgtgtgcggtacggattgatggccggctggggccaggggtcactgccaaggacatcattctggcgttgatcgccaaatacggcgtcggcggcggtacggggtacgtctttgagtacatgggtgaagcgatccgtgcgctgtcgatggaagagcggatgacgatctgcaatatgagcatcgagggtggggcacgggccggtatggtcgcacccgacgatacgaccttcgagtatatcgccggtaggccctttgcgccgaagggggccgatttcgaggccgctgtggcacgctggcgaacactccccagtgacgagggggcaaccttcgatcacgagttaaccctctcggccagtgaactgaaaccaatgattacctacggtaccaacccgggtatgggcattcccattgacgccccagttccacgcccggaggatatgcccgatgcacggagccgggcggcactcgacaaggcgctggcgtacatggggcttgaaccgggcaaaccgctcctgggccacccggttgatgttgtcttcatcggttcctgcaccaactcgcgcctgtcagatttgcggcaggcagcccagtttttccgtggacgcaaggtagcccccggcgtgcgagtaatggtggttcccggatcgcagcaggtcaagcgcgctgccgaggccgaagggttagatcgcatcttcaaagaagccggtgccgaatggcgtgaagccggttgcagcgcctgtctgggcatgaacgacgacaaagtgccaccgggtaaatacgctgtcagcacctcgaaccgcaactttgagggtcggcaggggccgggagcacgcacgatgctggccagtccactcaccgcagcagcggcagccatcacaggcgtggttaccgatccgcgcacgttgttgaactagaagaggctctcgtggaaccagtttcaaccattaccggcaaagccgtcgtgttaccggtagagaatattgataccgatcagatcatcccagcccgctttctcaaagtgaccgaccgcagcggtctggctgccggtctcttcgaggcgtggcgctaccaggcggacggcacacccaatcccgattttccgctgaaccgaccggaagctgccggggcaaccattctgatcagtgggcgtaattttggctgtggcagctcgcgcgagcacgccccctgggcattgcaggactacggattcaaagccgtgctggcaccatcgtttgccgacatctttcgcagtaattcgctcaagattggcttgctgccggtaacgattgaccaggcggtctacgatgaactggttgcccgttatgcggctgatccgcagatgcatctgacgattgatctggcaacacagacggtgacattaccggatggccgacaggtgcattttccgattgatgccttcagcaaatactgcctgctgcatggggtcgatcaactcggcttcttgctccaacaggaagaggcgattatcgcctacgaagccagccatccgcagccg

SEQ ID NO: 32747 - DNA, 2451 bp, Chloroflexus aurantiacus
atgccagtgtatcgtccggcagatcgcatggtcttaccaccggttgatgccgaaaaatatcaaacggtatgccactactgcattgtcggttgtggctatcacgtctacaagtggccagagggacggtcaggtggcttgttgcctgatcaaaatgcgttgggggtagattttacaaagcaagtagcaccgttaagtggtgattggattgctccggatcaccatacggtgatcaccgagcgggatggtcgccgcttccacattgcgattgtgcccgataaggaatgtgtggtcaacaaaggtcatcactccgggcgtggtggtacgctcggttccagtctgtaccggccagatggcccgactcacgtgcgcctgacccatccgctggtgtatcgggcaaccgagcagtcgccaacgacctgggacgacgccattgatctggcggcgcgggtgatctatggcagtattctgcgcgatgggaataactctatcttcatgaagattttcgatcacggtggtggtggtggcggtttcgagaataactgggccgttggcaagttcttctttaatgcggtacagacgatcaactgttcgatccacaaccgaccggcctacaattccgaggtacacgcctcgcgtgatatgggtgtacctgagctgaactttgcctacgttgatgccgaactatccgatacgattgtgctctggggagcgaattcttacgagacccagaccaacttctatctggtacacatgctgcccaacctgcaaggcaccacggtcaaagccaagcaggatgcccggcccggcgagcaggttggccctggtcgcatcattgtgatcgacccacggcgcacggcgaccgttgtggtgagcgaacgggctgccggcaaggatcgggtactccatttgcagctcaaccccggtacggatattgcgctggcgaatgcgattgcgcgggtggtgtacgagcgtggatggcatgacaaagattttgtcgccaatcgggttgaagccgagacggtacagcccttccttgagcagagccttcagattgggaagagccttgatgaggtgctggctgaagctgagcagattaccggtctgtcgcgggcgcagatcgagcaggcggcaagctggatcgccgagacgaagagtgatggtagccgaccacgatccatcttcctctacgaaaagggtgtcatctggggcatgaagaattaccagaatatcggcagcattgtcaaccttgctttgctgaccggtaactttggtaagcccggcaccggctgtggtcgtctgggtgggcaccaagagggttatgtgcgccccggctatcccggtccgcgtccggcaccctacatcgatgacctgctgagccaggggcaggggaatgtgttctacgttgtcggttgcaatccggcggtaacgacgctcaatgcgcagcgcatgcgcgagacgttgcagacccgtggtaagctggttcgcgatgcaatcgatgccagctttggtgcagataatgcaacgaaagcgcaagcgatacttgatgcaatcagtcagggtggcctgttcatcattgtgcaagatatctatcccattgagacggccagatatgcgcatgttgtctttccggcagcagcctggggtgaaagccccattacctcgatcaacggtgagcgtcgcttgcgtctgtacgagaaatttatggatccgccgggcattgctgagccagactggaagattttcggtatgctggcacagcggattaaggcgctcgcgcaggctgatggtaacgccgacattgcccagcgcttcagcggctttgaatggcagacggctgaagaggtcttcctggagggtggtcaatcgttcgccgatggtgtgaaggccagtaccgaacggtacaagggagtggattacgccttcctcaaggctgcaggcaataacggtattcaaacaccggtgacgattgtcaatgggcaaccgcaggggcgggtgcgttatttcgagaacggcgaaccattctacaccgagagcggtaaggccaagatgctacccacgccgtggcccggtttcccggccattgtgcaggagcagatcaacaaatatccgtacttcctgactaatgggcgcaacaacaactggcagaccttctacaacgatcttaacatcccattccacgccgaacgggtaccactatcctatattgagatcaacccgcaagatgcccaacgagaaggtatccagcccggcgatattgttcaactgtataacgactatggtgagacgaccgcatatgccgttgtgagcaatagtgttaaacccggtttgatcttcatgctgtttgcccacccacgctcgacggccaacagtctaaccacaccctacgttgatccagaagtgattattccgtactacaaagggagcgcggtcgggttgcgacggctcggacga

SEQ ID NO: 32748 - DNA, 747 bp, Chloroflexus aurantiacus
atttatgcgatggtcatgctctggcagcaatatgtggactggctcgacgtgacgttgatgctggtgctgtacgtgatttctggtctgggcattaccatcggcttccaccgcatgctcacccacaagagttttgaaaccagccgcccactcaaggccctctttttgattatgggatgtatggccctggaaggtgatcccacatcgtgggcttccacccatattcaacaccatgcccactctgacgacgaagatgatccgcatagcccgcttgagggtctctggcattcgcatgtcggctggctcttcacccacaagaacaatatcgaaatgtatggcaaatggctcaccaaggatccgacagtggtctgggtaaccaagacgtggtacgtgtgggcagccctcggcattattattccaaccctgatcgccggttggagcggtttaatctggggtggtctggtacgtatcttcctgacccaccacattacctggagcgtcaattcgatttgtcataccttcggtcgccgcgactacaacacacgcgatgccagccgcaacaacttcatcgttgggctgctcgccttcggtgaaggctggcacaacaatcatcacgccttcccccgctcggccttccacggtctgcaatggtggcaggttgacatctcggcctatatcattcgggcactagagaaggttgggctggtgtggaacgtgcaccgtgtgaagccagaggatttgcgtaagcgc

SEQ ID NO: 32749 - DNA, 1401 bp, Chloroflexus aurantiacus
gaactaatcgcagagcttgagcgtatcctcggcccacgcggtgttgtggctaaccctgatgcgttgcttacctacgacgccgatggctgtgtgatggatacgcacgagccgcacgtagtgaccttgccaaccagtgccgagcaggtggcggcgattgtccggctggctgcgcgtgctggtatgccgattgttccccgtggcgccggtaccggtctggccggtggtgctacaccaatgcagggtggcatcgttatctccaccgctcgcatggacaagattttgcaggttgatactgccaatgggcgcgtgctctgccagcccggtgtgattaactgggagctgtcacagtatctgaagccgtttggctatcaatttgctcccgatccctcttctcagaaagcctgtacgattggtgggaatattgccaataattcgggcggcccacactgcctgaaatacgggattaccgctagccacgtgctggccgtgcaggttgtgttgcccgatggttcgattgtctggacgggtgatggcagtgcgcatacccccggttacgatctgaccggtgtgatcaccggttcggaaggtactatcggttttgtcactgctgcctggttgaggctcacccgcctgcccgaagcggtgcgggttgtgctcgctctgttccctgacattgccggtgcctcgaataccgtttcgcaggtgattgccagtggtttattaccggcagcgcttgaaatcatggatcgcctggcgattaaagcagtgaatgatatgtaccggctgggtctgcccgaagcagccggtgctgctctgctgattgaggtggatggtgtcgaagacggccttgatgagctgttgaacgatgtgacagcgatttgctggcgcaacggggccatcgatgtacgcccggcccgtactctggctgagcagaatcaggtttgggctgcgcgcaaaaatgcctttggcgcgatgggacgcctcgccccaacctactatttggttgatacggttgtgccgcgcacgaagttgccccaaaccatggacgaagtgggtcgcatttcgcgtgaattccggctgccgattgccaatgtcttccatgccggcgatggcaatctccatcccattattctctttgatcgccgtgaccgctcacagaatcagcgtgcgctagaggcagcgaccagtgtgatgcaggtgagtattgattttggcggggtgatcagcggcgagcatgggattggggtcgaaaagcaggattatatgacgctgctcttctcgaccgatgatctggctgcgatggccggtctgcatcagagtttcgatccgcacgatttgtttaatcccggcaaggtgtttcccaaaggccgtggttgtggtgaactggcagcgttgcgacgt

SEQ ID NO: 32750 - DNA, 1440 bp, Chloroflexus aurantiacus
accccggttgtcgtgccggataaacttgttgccgagttgcgagctatccttggcgctgatgcggtagtgactgcgccagaggcattgctgacctacgactccgacggcagcatgattgtctcccatccgccacagcttgtggtgctaccgaaagatgctggccaggtcgcaactgctgtgcgtctggccgtccgcgaagggttggccgtggtagcacgtggtgccggtacgggtattgcaggtggggctgtgcctctctgtggtggcctgctgatcagtaccgctcgcatgaccgacatcacgaccgttgatgttcgttcgcggctggccgtcgttcaacccggtgtggtaaacgccgacttgaatgcccatcttgccccccttggctatcagtttgcccccgatccctcatcgcagcgtgccagtacgattggcggcaatatcgccaccaacgccggtggcccacattgtctgaagtatggggtaaccagcaatcacgtactcgccgttgaggtggttgatcataccggtcagcgttactggacgggtgatggggtgatcgatccggtcgggtatgacttgaccggtctgcttgtcggaagtgaaggaacgctgggggttgtcacggcggcgattgtgcggctaacgccactccctgaagcggtgcgcgtcgtgctggctctcttcccaacagttgttgctgcggcggcagcagtgagcgccgtgattgcctctggttcattacccacttcgctcgaagtcatggatcacaatgcaattcgggcagtgaacagtgcgtatagcctggggttacctgaaacgaccggtacaaccgccctgattattgaggtcgatggcgttcaagatggcctcgatgaccaactggatcagattattgccatctgtcgcgatcacggcgctttcgacctccgtccggctcgtgatccggcgacgcaggccagggtctggatggcgcgcaaatcggtggccggggcaattggtcgactggcgccagcctactatctggttgataccgtcgtaccgcgtaccagattaccgctgatgatggagcacgttgaacgtttacgggccgaatacggtatggaagtatgcaacgtcttccacgccggcgatggtaatttgcacccactggtgctgtacgatcctcgtgatcctgatcagcgtcagcgcgcacacgcaattgctgccggagtcctcgagttgagtattgagcacggtggtgtggtcagcggtgagcatgggatcggcctggaaaagtgtgaatacctgccccgtttcttctcgccggctgaattgcaattgcacgccacgattcatcaggtctttaacccgaccggttgcttcaacccggctaaaatctttccatccgatacgccaccggctgatctggccgcggctcgggcgatgcggctgcaacag

SEQ ID NO: 32751 - DNA, 1011 bp, Chloroflexus aurantiacus
attccggttgcagtgcttggtgccaccggtgcagtgggccagcgctttattcaattactcgaaggacatccattgtttcaggttgttgcattgaccggtagcgagcgcagtgcagggaagaaatatcacgaagtgtgccgatgggtactcgacaccccgatgccggcagccgtcgccaatctcaccgtgctcgatgccgatgccgatctaccggctcagctcgtcttttctgctctccccagcacggtcgccggcccgattgaacagcgtctggcagcagccgggcatattgtctgctccaatgcttcgaatcatcgcatggagccggatgtacctctgattattcctgaagtgaatcccgatcatctggccctgattccggtacagcgccggcgccgtggttggtcaggggcgattgtgaccaatcctaactgtacgtccacgccggcaacgatggtcttacgcccactgcttgatacgtttggcgtgcggcggatgctgttggtaagtatgcaggctctctctggtgcaggctatccgggtgtgcccagctacgatgtggttgacaatgtcatcccctatatcggtggggaagagccaaaactggaaattgaacctcaaaagatgctcggtcggttagagggggagacgattgtgccggctgggttcacgacctcagcccattgcaatcgggtaccggtgttagagggacatctggtctgtctctcaattgagctggagcgcaaagctgatccggcagagattgcgacggtgctaagtaatttccgtgctctaccccaggaattgcggctgcctaccgcaccagagcaaccgattatcgtgcgccacgagccggatcggccacagccacgccgtgatcgcgatgccggacgtggtatggcaacggttgtgggccgcatccgtccatgctcattgttcgatatcaagctgattgcactgagtcacaatacaattcgtggcgccgccggtgcctctattctcaatgccgaa

SEQ ID NO: 32752 - DNA, 1032 bp, Chloroflexus aurantiacus
tcagcagcgccgcgagcgctatagacaataacacctatgacactccgttttgctattccttccaaaggttccgggtacgaggcaaccgttgcgttgctggaaagttgtgggctgcgggtgacccgcgccaatccgcggcagtatactgcggtgttgcgtggcttgcccgataccgaggtgttgctccatcgtccggctgatattgtgcttaaggtggccgagggcgccatcgatttgggggtaaccggctacgatttgctccacgagctacgcggtgacgatgacgatgatgtgttgacgatcattgatgatctcggtttctggcgggtcgagctggtctttgccgtgccccaaagctggatcgatgttacatcgtgggccgatctggccgatctggcggttgagtttcagtcacgtgggcggcgcttgcggatcgcgaccaaataccccaacacagtccggcgtttctgctatgcgcagggaattaatgtcttcgagctggttgagtcgcagggcgcgaccgaggcggctcccagtttggggtatgccgacatcattgccgatattaccgaaaccggtacggcaatccgggaaaatcagttgaagattgtcggcgggccattgatccgttcccaggccattttgatcgggtcgcggcgggcattgcgtggcaatcgtcatcggctggagctggtgcggcagctctgtgagttgattgaggcgcggcggcggggacgcctgttctattcgctgacggccaatctgcctggggcttcggtggaagaggtggggcgaaaagtcaccgcacgccacgagctggcaggcttgcaggggccaactatcgcgccggtctggagtaagttttccggtgacagtggctggtatgctgtcaatgtggtggttccgcaagaggaattactgccggcgattgattatttgcgcgctatcggcgcgagcagtgtcacaaccgtgcaggtacaacacgtcttccgggctgaaagtgaggcgtttgcgcgcctctgcgcacgtctt

SEQ ID NO: 32753 - DNA, 774 bp, Chloroflexus aurantiacus
tcgggtgcgaccggatgggccggttcggcacttgcccgtgcgattgcgcaaactgacgatattgtgctgagtgctgcgctaagccgccgcgctgccgggcagtcgctggccgatgtgttgggtgaaccacgactgacgtgtcctgtctacgcgaccgctgctgaagcattgacgcagccgtgtgatgtctttttcgagtatacccgtcctgacgttgcgaaagccaatgtcttgaccgccctgcaacacggatgtcacgtggtgattggtacttcggggctgagtgatgacgactatcgcgagattgatgcagtggcaacagcgcagcaacggggcgtgctggcagcaggcaactttgctttgactgccgtcttgctgcaacggtttgccagtattgctgcccgctacatcgaacagtgggagatcatcgattatgcccgcgatagcaaaccggacgcaccgagcgggacagcgcgtgaactggctgccaggctggggcagattcgctcgtcgcatctgagcgtaccgcttgagcaaacccagggtgttccggcaacccgtggtgcccgcctaaacggcatgcaagtgcattcggtgcgtctaccgggctacacaatcgggctggaaatcatctttggcatgcccgaccagcggctgagcattcgccatgatgccggtgccagtgccgaaccctatgtcgccggagcactgttggccatccggcgcgtggggaaactggttggtctgcatcggggacttgatagtgtcttagag

SEQ ID NO: 32754 - DNA, 1410 bp, Chloroflexus aurantiacus
ccatgtatcgtttttgaccaacatctgatcacctatgccgatctggcccgggcagtggccggctgggcaggtcgctttcacagtctgggtattaatcgaggtgatcggattgccctcgcgctacccaacacgccggcgttcatcgctgcctatttcggtgcccaactggccggtgcagcagtcgtcctgataaatccacagtatcgccacaccgaattgagtcatctgctgtccgactcagagccggcaattgttgtggccacgaccgagaatgaagccttcatcacggcagcaatgccagaatcgcgaccacatctgctcaaaccattggcagagctatgcggtgcgccacctgccgaccctgggctgttcacaccacccgccgctgatgaaatggcactcatcgcctatacatcaggcacaaccggtcgagccaaaggtgcagtccatacacacgccagccttgccgcaaactgcgctgcaattagcacagcctggcgctggactgaacatgaccgcttgctcttgatgctcccgctctttcatgtccacggcctgggtgttggcgttcacggtaccattcggaacggcgccagtctggaactgcatagccgtttcgatgctgatgttgcgctccaacgcatgcacgatccggcgatcaccctcttctttggcgtacccacgatgtatatccggttgatcgaagctgcccgccaccagggagtgccggaacatcgcctgcgcctctttgtttctggatcagctccactcagcccgcagacatttgccgattttgccagtcttttcggtcaaccgatactcgaacgttacggcatgaccgaaaccggaatgaacctgaccaacccttacgctggcgagcggcggcccggcagtgttggcatgcccttccctgggcaggaagcgcgcattgttgaccggacaacaggtcaaccactcccaaccggtcagatcggtgagattcaggtgcgtgggccacacctctttcgcggctactggcgaaatccggcagccaccgcagccgctttcacggctgatggctggttttataccggcgatctcggctttgtcgatgacgatggctatttccacatcaccggacgcagtcgcgacctgatcattagtggtggctacaacatctatccacgcgaggttgaggaggtgcttgcccaacacccggcagtagctgaatgcgcagtgtacggcgaagccgatcctgacctgggtgaagtaccggtagcagcggttgtgaccaacggccaggcagttacagcggctgaccttattgagttctgtcgaatgcatctggctgcgtacaaacggccacgacgcattcacttcgtcacgtcgttaccgcggaacgcgctcggtaaagtgcaacgacatctgctg

SEQ ID NO: 32755 - DNA, 1104 bp, Chloroflexus aurantiacus
gttgtgatggccggcggcgagggcactcgcctgcgaccacttacgattaatcgccccaagccaatggtgtcgctggtcgatagaccggtgatgcagcatatcattgaattactcaagctccacgggattaccgatattatcattacagtgcagtatctggcgaatgttatccaggactattacggtgatggtagcgcgtatggcgtcaatatcacctattcgctggaagaagtgccgctcggtactgccggtagtgtcaaaaatgccgaacatttattgaccgaaccatttctggttatctctggtgatgcactcaccgatttcaatctctcgcaaattatcgaatatcacatggcctctggcgctacagccaccgtcaccttgacccgtgtttccaatccgctcgattacggcgttatcatcaccgatgaacaggggcgcattcggcagttgctcgaaaaaccgagctggggagaagtcttttccgacacggtcaacaccggtatctatgtcttcaatcccgacatcttcagctacatcgaacgcggcaaagtaaccgactggtcaaaagatgtctttccgcgcatgcttcatcgtggtgaccggctccagggctacatcgcaaacgggtattggacagatgtcggcactatcgaggagtatatgcgagcctgcggtgattacctgtcgggcaaggtaaatctgccgcgcgtcgggcacaacatcggtggtgacatctgggttgaccgcgatgccgaaattgcgcccgatgcccaattacacgggccaatctatctcggccatggcgccaagatcaagggtggcgtgatcattcacgggccatccgtcattcgcgattacaccattgtcgatagtcgggccaacatcgaccgctcgatcatctggcgcaattcgtacatcggtgaacgggcggaattgcgtggggcgattgtgcttcgtcagtgcaacattcgttcacgcgccatgatctttgagggcgccgttatcggtgacggcgtgcaaattggcgcgggcaccgttgtccaacccaacgtcaaaatctggccctcgaaagaggttgacgaaggcgcgacagttacctct

SEQ ID NO: 32756 - DNA, 1326 bp, Chloroflexus aurantiacus
agcattatctggggtagtcaaggccggcgcgtcctctttgggcgctacggcattaccggcctggtcaacattgagatcaccccagaaatgtgcgcccgccttggtgcagcctacggtgccaccctgccgcgtggcgccacggtaaccatcaatcgtgatgcgcacttcacgccacggatgctgaaacgggcgattattgccggcctgccttcggctggggtgaatgtctgcgatttgcgtaatgtgccgatcccgattgcccgctactacacccacgccagtggcgccgccggtggcgtccatgtgcgtatttcaccattcgacaatcgggtcgccgagattaagtttttcaatcaccttgggttggatattaacagtgcaaccgaacgcaaaatcgagagcaccttcttccgggaagattaccggcgagcctatcttgatgaaattgggcgtatcttctacggtgaagacgttgaagagacctaccgggccgcatttatgcgcgcactgggccagaatgccgcattcgggaaaggctttcccatcgttatcgattatgccaacaccagtaccagcaccgtcatggccgaaatcttacggcgcatgcaggccgatgcggttgagctgaatgtctatctcgacgaacggatggtctttcagacgagtgctgattttgaagcggcgatgaatcggctgaccaagatcacaccggttgtgggagcacaatttggtgtgaggctcgaccctggcggcgagaagatttttctgatcgatgatcagggccggcgtctccatcccctgcgagcactggcagcaattaccgcgctggcaatgcgggcaaacggtggcggagtggttgctgtaccggtgacagcaccacgcgcctttgagcagatcgccgcccgttacggcggcagcatcattcgcacacgagccaatctgggcgcattaatgaatctggcggctgaacgcgccgatctcctgctgctaggtgatggcaccggtaattatatctttccccatttctatcccgttgccgacggtatgttcgctattgcacgcctgatggagctgctttcgcttaaccagacgactctaagtgaggtactggcggatttgccgccgtactacctctggcaaacccgcgttccgtgtcgctgggaaagcaagggtaaggtgatgcgcattctcaaccagcaataccacgagcgccacggcgagcagattgacggcatcaagattgaactgggtgaggaatgggtgcttatcctgcctgacccggatgggccattcttccacgtcattgccgagggagttagcgaagac

SEQ ID NO: 32757 - DNA, 1263 bp, Chloroflexus aurantiacus
tctctggtaggtcaaaccataggtcggttcgaaatactctctgaattgggacgcggcgggatggcggtggtttacaaggcccgacagaccgacctggatcggattgtggcactgaagattttgccgccgggtttaaccaatgatgagagctatatcgctcgtttccggcaagaggcgcgtagcgcagcccgtctggaacatccgcacatcatgccgatttacgaagtcggtgaagtggcgggctatcactatatcgcgatgaaatacattcagggacgtaccctgaagcagttgttgcaacaagagggtgcattgccggtggcacgagcggcccagattctcgctcaggttggcgaagcactcgattatgctcatcgccaggggattattcaccgcgacattaagccctcgaacgttatgatcaccgatgaggggtggatctacctgactgacttcggcctggcacggggcacgggagccaatagtagcggtctcaccatggccgggacagttatgggcacgcctgaatatatgtctcccgaacaggcccaggggctgcccaatgtcggcccaccaaccgatatctatgcgctgggagtcatgctttatgagctgctcacgggggcatttccgttcaaagcggaaacgccgatggcgatgctggcggcacgacttgtccacgctcccattccaccccgtgacgtgcgtggcgatttacctcccgcagtcgaggatgtgattatgcgggcgttagcccgtaagccggaagcacgtttcgcttcagcggcggaaatggtcgccgctctgcgccaggccgttggtttgagcgagcgtgaactgagccgcccgctcactccacagcgcggtatgccggctgtttccaatgcaggttctcagacaccacccgcttacggcccaaccacaccggcatctcaaccgccagcctacggcccaaccacaccggcatctcaaccgccagcctacggcccaaccacaccggcatctcaaccacccgcttacgcaccgacaacaccggtaacgccaccaccagtttacgttcaaacacctgccgcaccggcaacacatccgtacagtgccagcccatcggcaccgaccccacacccgtttaacgtaccggcaacaccagcgccaaccgccggcaaacgaacaccggttggcctgattgtgggcttgattgttggcgttctgctcatcggtggtggcctgaccaccttcttcctgctgcgtccgacgacgccaccg

SEQ ID NO: 32758 - DNA, 2872 bp, Chloroflexus aurantiacus
  unsure (1)..(2872): unsure at all n locations
atggctactattgagttgcacgcctggtatcgacagtatcgtaagctgaaggaggaggccgctgatgcgatccttctttttcggtttggtgatttttatgagacgtttgatgatgatgcgaagttgattgctgaattacttgacataacgctgacgcgcaaggagtatgcggttgataagcgtttgcccaaggatcagcagaagttgtatgcgcccatggccgggatgccttatcacgctgtggatcgctatgtttctgagttgatcgcgcgcgggtatcgggtcgctatcgctgagcagttgagtgagactgaggcgatgcgtaatgatacacgaccgcgctcggtctatgccgccgggctgacgccggtcgagagtagcgggaagatggtgcagcgggcgattgtgcgggtgattacgccggggacggtgattgatccggctatgctgcccgaccgtaccaataattatctcgctgcggtgattgttgaacagggtaaggtcggtctggcttatgctgatctttctaccggtgagttcgctgcggcagagtttaccgatgcccgggcgttgatgcagttgcaggccgagctggcccggctgtcaccggctgaggtgttggtgcctgatgatgaggcactgcgcttgcctaatctggagccggtgcaggcccgccttagtcaggatttggcacccctgacgaaggaggagcgtgaggctctgttgccccacgagcgggtcgctcgccgtctggaaggtgcgagtgcggcgagttggacgcaggggtatgtgacggagtggccgctttggcgttgggagttggcgacgacgactgaggtgttgtgtgagcatttggcgctgccgtcgctggcggtgtgcggtctggacgggcgtccacttgcgacccgggcagccggtgcgttgttgcagtatgcgcaggtcactcagcgccagcgcgtgagtcagttgcgtgctttgcgggtgtatcataccggcgcgtatatgctgctcgatccacagacccgccgtaatctggagctgcttgagagtggtggtcgccagggagcgaaggcgtcgttgattgcggtgcttgatcgtacctgtactgcgatgggggcgcgtttgttgcgccgttggattacgcagccgttgattgtgatcgaaccgcttcaggtgcgtcagcacgccgtcgctcgtctggtggctgagacgatggctcgtctggaggtgcgttcggcgctcgccgatttgcccgatatggagcgggcactcaatcggattgcgcagggtatcacggtcgctacgccgcgtgatatgacgcagttgcgggcggcgttgcgtaagttgcccgctgttgcgcaggcggtgcaggcgctgttgcccgatttgctcgctgctgagatgcccggtgagccgccgctggtgttcgatgtctgcgccgatgtgcttgacctgctcgaacgggcgcttgatgatgatccgccggcgttgctcggttcgtcgaattatttgcgcgcagccgaagagggtggcgaacggccccggcgggtgattcgccccggttttgatcagcgtctcgatgcgttgattcgggccagtcgccacgctcaggagtttattgatcgtctggagagtaaggagcgcgagcgaaccggtatccgttcgctcaaagtgggctataaccaggtgtttggttactatatcgagatttcgcgcgctgttgatgcgaagttgatcccggcccactacgaacgtaagcagacgctggtcaacgccgagcgctatgtcaccgaagagttgaagtactatgaagggctgttgagtgatgcccgtctgaagctggtcgatcttgagcgtgatatttttcagcggctctgcgatgagttgcaaccgcatcttgatcggttgcgcgctacgattgcggcggttgcgcgtattgatgcgctggcagcgctggccgaggttgctgtgcgtggtcgttatgtgcaaccacgattgcgcactgatcgggtgttgcggattaagcaggggcgccacccggtggtggaacgtactctgagtgagccgtttatcgggaacgatattgatcttgatggcgaacaggcacagattttgattatcaccgggccgaatatggccggtaagagtacgtttttgcgtcaggtggctttgattacgctgatggcgcaaantggttcgtttgtgccggctgatgaggctgagattggcctggttgatcgcatttttaccncggattggtgctcaagatgatattgcaaccggccagagtacgtttatggtcgagatgaccgagacggcagcgctgctgatgcaaagtacgccgcgctcgttgatcattctcgatgaggttggccgtggtaccagtacttacgatgggatggcgattgcccgtgccgtcgtggagtatattcacgatcatccgcgcctgggctgtcggacgctgtttgcgacccattaccacgagttgatcgcgctcgaacgtgagttgcctcgtgtccgtaattatcatatggcggcggtggagcgtgatggtcgggtggtctttttgcatgaattgcgacccgggggcgctgatcgctcttacggcatccacgtcgctgagctggccggtattccgccagaggtgattcggcgggccagtgccttgctggccgatcttgagggtcagcgcccgccatcctcacctgcccaaccacctgccccaccggcaccggtcgttgtgccggcgcaggaaaccggtcaggggatgcaattgtcgttttttgatctggcaccgcatccggtggtagagtatttacgtcggcttcgcatcgaggagctgacaccacttgaagcgttaaaccggctggcc

SEQ ID NO: 32759 - DNA, 1422 bp, Chloroflexus aurantiacus
gtcagtcactacattgatggtcagttcgttgacggaggatcgcggtttgatattctctatccggccaccaaccaggttattggatcggcaccagaggccggagccgatgaggtggacgcagccgtcgccgccgcttcccgcgcctttcgccaatggagccggatgccggctgccgaacgccgcctgattctcaagcggtttgcccaattgatccgcgatcacgaagcagaactggcggccatcgaaacctgggatgtcgggcgtccaattaccgagaatcgatccggctacatcccccgtatcgcggccaatatcgaattttttgccgattttgccgttacccacggcagtgagtcctatccgatggataacggctatatcaactacgtgctgcgccagccggttggcgttgccgcgctcatcgcgccctggaatattcccctcctccaggcgacctggaaaatggggccagcgctggcttttgggaataccgtcgtactaaagccggctgaactgaccccaatcggtacctggcggctggcgcaactggctcatgctgccggggtgccggcgggggtgattaatgtgattcacggcttcggtcccaactcggcaggtgcgctgctaacccgtcaccctgatgtaaagctcatctctttcaccggtgagaccaccactggcaagatcatcatggctactgcggcaccaactcttaaacgggtctcgtttgaattgggtggaaaaggggcgaatattatcttcgccgatgctgatcttgatcgcgccgttgcgattagcctgcgctcctcattctttaatcagggagagttctgtctcgccgggccgcgattgctcgtacaacggccaatctacgaagcatttctcacccgctttcagagggctacatctcagcttcaggttggcgatccctttgacccccaaacgcgggtgggggcactcatttcgcgtgaacattacgaacgggtcaccggttttattgatctggctcgcgccgatggcgctcacatcctcaccggtggcacagatcccgtcttgccggaaccattcgcccaaggcaactttctccagcccaccatcattaccgacgtcaagccgcatgatcaggtttgccaggacgagatttttggtccggtcgtcacggttgtgccctttgacgatgaagaggaagcgattgccatcgccaatggcgtcagctatggactttccgccgtggtacagactcgtgatgtcgggcgagcagtacggatgggatcggccctggaagccggaacgatctggatcaacgacttttttgtgcgcgatctgcgcgtacctttcggtggtatgaaacagagtggaattggccgggaaggtgggcactacagccttgagttctacacggaggcaaagacgatatgcctg

SEQ ID NO: 32760 - DNA, 1230 bp, Chloroflexus aurantiacus
cagcgcattgtggtgaccggtctgggcgttatctcgccgtttggggttggtgttgagccattttgggctggtctcgttgccgggcgcagtgcgattggtcgcatcacctttttcgatccgagtgattatccctgtcaactggcaggccaggtaaacgattttcatccacaggagttcatggatgcgaaagaggcgcgccggatgtcccgcgccagtcagatggccgtagccgctgcccggatggcccttgaccacgctcgcctgcctctcgaacgtatggcacgcgatgagatcggtgttctgatcgccagcgggactacctcgatgcccgatgtagaacaggcagtcaccacactgatccagcgtggtggcatgaaaattagtcctttcttcattccggcagccctgccgaatatgccatccagccaggtcgccattcacttcggtttacgcggctacacaactgcgatctgtaccgcatgtgctgccggcgcgcaggcaatcggtgaggcggcagagatcattcggcgcggcgatgccgaagtgatgctggccggtggcgccgaagctcccattactgccctcagcctgggtgcattctgtgtcatgcgcgctttgagtacgcgcagtaaccacgagccgacacgggcatcgcgtccgtttgatgcgctgcgcgatggctttgttcccggcgaaggggcagccgtgctggtgcttgaacgtctgagcagtgcccagcgacgtggcgcgccaatcctggctgagttgatcgggtatggcgtctctgccgatgcctatcacgttactgctcccgatccagatggtgaaggggcggcgctggcaatccggcgggcattgcaacaagcccgactggcaccgcaacaggttgattacatcaatgcccacgccaccagtacaccggcaggtgacattgcggaaaccagagcgattaagcaggtgttcggtgaatatgcatacagtgtgccgatcagttcgatcaaatcgatgatcgggcatctcaccggtgctgccggcgcagttgaggcagcagccaccatcctggcactgcaccacggtcagattccacccaccatcaacctcgaacatcccgatcccgaatgcgatctcgattatgtgccgaatgttgcccgtcaggcagccattcaggtcgcaatctcgaattcgttcgggtttggcggggtgaatgcggtgctggccttccgcaaaatg

SEQ ID NO: 32761 - DNA, 2040 bp, Chloroflexus aurantiacus
tgcgacggctgcgcgttgggaacagccgggttgcgtgatttcacaatgaaaggtgtgcatctctgcacggtgcgactcaatctgctgcgcctgaacacgatgccaccgctcgacattcatcgtttgcacgatgtagccgacctacaacgcctgaacggacgtgaactgcgtgctttgggccgtctcccgtacccgatgctgcgccgacgcggcgaagccgggtttcggcggatcagttgggatgatgcgctcaacgagattgctgcccggttgcgtaacaccgatccgcaccggatggcgttttacttgacatcacgcgggattacgaatgaaacctactacgtagcgcagaaggtggcgcgttttctcggcacgaacaacgttgacaacgccgcccggctctgccacgcaccgagtaccacggcgatgaagcaggcgctaggggtagctgcatcaacctgtagctatcgtgattggattggtaccgatctgctaatcttcatcggcagtgatgcgccgaacaaccagccggtaacgaccaaatatctctactatgccaaacaacacggcacccgtatccttgtcatcaatccttaccgcgaaccgggactggaacgctattgggtgccaagtgtctttgaaagtgcattgtttggcacccgactggctgatcgcttcttccagattcacaccggtggtgatattgccttcctgaatgggaccctcaagcacctgatcgagcgcaactggctggattgggacttcatttcagcgcatacgcgcgactttgagagggtgcaggtggcactggctcagcagtcgtgggacgatctggagcgggcgagtggggcaacgcgcggcgagatgctggccttcgccgaggcgctggctcaggcgaagagtgccgtattcgtgtggagcatgggcattacccagcacgagtacggggtagagaatgtgaaagcgattctgaatctggccctggcccgtggcttcatcggacgtgagtattgtggggtgatgccaattcgcggccacagcggggtacagggcggcggtgagatggggtgcaccgctaccaccttccctggtggtaaaccgatcacacccgataccgcgcactggctcggcgaacagtggggattcgcagtgccggcatggaaagggctgagctgcggtgacatgctcgatgtcgcctacaacggcgaactcgatgtcttctacgcggtgggtgggaattttctcgacacgatgcccgatcccgcttacattcgtaccgcgctggctcgaccggcactgcgcgtacaccaggatattgtgctcaccacgcagatgctggttgaaccggcagacaccgtcatcttgctaccggcggccacccgctacgagcagcgcgatggcggaaccgaaacctcaaccgaacgcgaaatcatcttttcaccgtacattgccccaccaccagccgaggcgcgtagtgagtgggagattttgctgagcgtggcggaacgaacgaagccagaacaggcgcatctgatccatttcgccgacggtcagcagattcggaatgaaattgcccgcattgtccctgaatacaacgggattcagcatttgcaccagaccggtgatcatattcaatggggtgggcgcatcctgtgtcgcgatggtcggttcggtacacccgatggaaaagcggtgttcacaccgctgaagccacctgtaactaccttaccgccggctatgttcgtgctaaagacccgccgcggcaagcaattcaactcgctcatccacgatgaacgtgatccactcaatggtgcgctgcgcgatgacgtgctcatcaaccctgttgacgcggccacactcggtgttcgcgaaggggactgggtcatcttgcgttcagcagttggtgaaatgcgggcacggatcaagtttgcaccgctcaaatcgggcaacatccaggtccactggccggagggtaacgtcttgattgatgcccatcagcgcgatccaggggcgggtgtgccgtcatacaaggcgctggtc

SEQ ID NO: 32762 - DNA, 1737 bp, Chloroflexus aurantiacus
ggtgcgaccgaaagtcgcgaccaggggtactatcagaatgtcaccgtcagcgcacgggtattcaacgaaacagtgacgattaacaatacttttgagagcggtgaagccggcatccgactgattccagtgtcgttcaacggcccggttagtggcacgatacagaccgatctctctggcattgcgaccttcagcggcccgcccggcacctacacggtaagcatcgttagcgatccttccggtttcactcgttcgccgggtaataccggcacggccagcactggcccggttttgagcgggcaaacagcagcagtaccgtttggttactaccgcacagcccagatcagtggcactgtctggttcgataccgacagcgatggcctgttcgacagcggtgaacctgggatggaaagtatcagcgtcaggttgatcggaagtagcagcggccccggtactccggttacgactgacgtgaacggtgcattcgccatcaccggcatcgaaccgaccggtctgactaacacgacataccagatctgtatcacgcttccaaccggctttacgccaacaacccagggtagcacactcacgaccgacaataacagtgatattgactcaagcggttgtactgctacctttaccgttgcctcagcggcaaacattacctacattgatgccggtctgcgcggtacgctagccattggtgacctggtgtgggaggacaccaatgccaacggcatccaggatagcggcgagcaggcgctcgatggtgtaacggtgacagttctcgtcacgacgaccggtaatgtcattaacacaaccaacccatcgttcacattgagcaccgtctcgaccactgccagtggtttgaatcctaactacaccattggcaacattccacccggcagcacagtaacgatccagacagttgagcggttcggttatctcttaagtgcagctaaccagggtggtaacccggccaccgatagcaatgccgttggcagtagtgtcacgctcaacgccaacaacacgacaattgactttggcctctatcgcacaacggctgttggcgataccgtctggcttgatgtcaacggtaacggactgttcgacagtggtgaacctggcctgcctggcatcaccatcacgctgcgtgatggtggtggaacagcggtggcaaccacacagactctggcaaatgggagctacacgttcagcaatctcaccccaggcagctattcgttgcagttgagcctgcccgccggctacgcgaccaccaacaacggcagcggttccatcaccgttgacaacgacaacgatttccgcaatgatggcacaaccgcgaccttcactctcaccagtggacaggcgttggcaggcatcgacgctggcttgcgcggaaccggcaacgtgaacggtatcgcatggttcgacaccaatgaaaacaacatccgtgatccatcggaaaccaaccgtgccagcagcgtcagagtcaccgtcatttacacgccaaccctgacgccaacactgccgcagacagttgaagtcgccaccgataccaatggtacctactccgtagccggtttaccgccgggtcaggttactgttatctttgtcaatcggctcggttacctgtcggcacaacccaatgtcggcgatgacgctaccgatagtgacggacctgaagtaaccttcacgctcaatgccggacagagtgtcaccatagatatgggttactac

SEQ ID NO: 32763 - DNA, 1924 bp, Chloroflexus aurantiacus
ttgttgtgggagccgccggaagacctgcgcgccaattgcacgatgcgtgcgtttatgcgttggttagagcagcgcagcggcttacacttcgctgattaccaccagttgtaccgctggtcggtcgatcgccttgaggacttctgggcagcattgtgggagtattaccagatcaaggctcatacaccctacacgacggtgctgtcgagtcgcgagatgcccggcgcacgctggttcaccggtgcccatctcaattacgccgaacacgtgtttcggcacgctaccgatcagcgaccggcagtgatattcgcttccgaacgccaggaaccaacacctctgagctgggcgagtctgcgtgcgcaaacggcggccctggcacagaccctacgcgaggctggagtcgggccgggggatcgcgtcgtggcctatgtgccgaatacgccacacgccctcatcggttgtctggcaaccgcgagtctgggcgcgatctggtcgagctgttcacccgatttcggcagccccagcgtcatcgaccgcttcagtcaaattgcgccgaaggtcttgatcgcggttgacggctatcagtatggtggcaaggcatttgaccgccgggccgaagttgcggcgattcaggcggccctgcccgatctggagctgaccatctttatcccctacctcgatccaaccgacgaagcaagcggactgcgagggcgcgtcatccgctgggaagacgccttacggcaggaagccgaacttcacttcaccccggtggaattcaacgacccgctgatgggtgctctattcatcgggcacaaccggactccccaaaccgattgtccatagccagggcggtatcctgctcgaacatatcaaatccctcgatctccacttcgacatgcgagcgggtgataccttcttctggtacaccaccaccggctggatgatgtggaacttcttgatcggtggcctgctgatcggcgcgataccgatcctctacgatggcagcccggcctatccagatatgggcgtcctatggcgcctggccgaacagacacggattcgttacttcggcaccagcgccggctacatcaccgccctgatgaaaagtggggtcgaaccgggcactcagttcgatctgagcagcatcaaagccatcggctcgaccggctcacccttaccgccagaagggtttgattgggtctacgaacacatcaaacacgacgtctggctggtctcgtacagtggcggcaccgacgtatgcagcggctttgtcggtggttgtcctctcctgccggtgtacagcggcgaaattcaatgccgcatcctgggctgccgggcagaagcctacgataccgatgggcagagtgttaccggcgtcatgggcgaactggtcatcaccgcgccaatgccgtcgatgccgatctacttctggaacgatcccgacaacgctcgttacaaggccagctacttcgagcactatcccggcgtctggcggcatggcgactggatcgtgattaacgagcggggtggcgtgattatttatggccgttcggacagcacgatcaaccgccagggtgtgcgcatgggcaccagcgaaatctaccgggcggtagagacgatccccgaagtgctcgacagtctggtcatcgatctcgaaggattgggtggacggtcatacatgccgctcttcgtcgtcttgcgcgaaggggtcaccctcgacgacgatctgcgtcaacggattaagcaggtcattcgccagaccctctcgccccgccacgttcccgacgacatcttccagattccggcggttcccctgaccctgagcgggaagaagctggaggtgccggtgaagaagattctgatgggtgtaccggtcgagcgggcggccaatcccgactcgttgcgcaaccccgaatcgcttcagttc

SEQ ID NO: 32764 - DNA, 888 bp, Chloroflexus aurantiacus
attgcaattctcggcgttcccatcgatcttggagccggacggcgtggcgtcgatatggggccgagtgccattcgctacgccggtctgagccgaagactgggcgagttgggctatcaggtggttgatttcggcaatctgacggtgccgatggtcgagacgaccccaccgccaccacctgattcacgcctgcgctatcttgagccgattgccgatatgtgtgggcggctggcccggcaggtggccgatattgtccagcaggggatgctgcccctcattctgggtggtgaccatagtttaactatcggttccgccagtgggagtgcgcggcagcgacgacttggtctgatctggattgatgcccacgccgattttaacgatgaacacacgacaccgagtggcaatattcacggcatgccgctggctgtgttaaccggacgcgggcatccgacgctcaccggttttgccggtcgcataccggctttcgatccggcgcacgtcgtattgattgccgtgcgcgatctcgatccgctggagcgggaagcattgcgcgcttcgccgatcaccgtctttaccatgcacgagattgatcgctgtgggatggcaacggtgatggagcgggcgctggcaattgccacgaccggtactgaaggatttcatctcagttttgatctcgatgttgtcgatccgcgcgaggcgcccggtgtgggtacaccggtaagcagtgggatttcggctcgcgaatcacatctggcgatggaactgatcgccgagagtggtgcgctgcgtagtctggatgtggtcgaagttaatccgatcctcgatgagcgtaacgcgactgcgcagttggccgtcgatctggttttgtcagcgttaggtaaacgtattttg

SEQ ID NO: 32765 - DNA, 717 bp, Chloroflexus aurantiacus
aacagaacagcgatggcgacgggggagtccatgagcggaacaggacgactggcaggaaagattgcgttaattaccggtggcgccggcaatatcggcagtgaattgacacgtcgctttctcgcagagggagcgacggtcattattagtggacggaatcgggcgaagttgaccgcactggccgaacggatgcaggcagaggcaggagtgccggcaaagcgcatcgatctcgaagtcatggatgggagtgatccggtcgcggtacgtgccggtatcgaagcgattgtggcccgtcacggccagatcgacattctggtcaacaatgcaggaagtgccggtgcccagcgtcgtctggccgagattccactcactgaagctgaattaggccctggcgccgaagagacgcttcatgccagcatcgccaatttacttggtatgggatggcatctgatgcgtattgcggcacctcatatgccggtaggaagtgcggtcatcaatgtctcgaccatcttttcacgggctgagtactacgggcggattccgtatgtcacccctaaagctgctcttaatgctctatctcaacttgctgcgcgtgagttaggtgcacgtggcatccgcgttaatacgatctttcccggcccgattgaaagtgatcgcatccgtacagtgttccagcgtatggatcagctcaaggggcggcccgaaggcgacacagcgcac

SEQ ID NO: 32766 - DNA, 1299 bp, Chloroflexus aurantiacus
ccagttgcaattcgcaacctacagcaattgcgtcgcgaaccgctgacgctactggaggaactggctgctcgcggcgatgtggtgccatttcgggttgggccgcaaatgatggtgctggtgaaccatcctgatctcatccgggaggtgctggtgacacagcatcgctcctttgtcaaggggcgtgtgctggaacgggcaaagcgcctgctcggtgagggattgctgaccagtgagggtgagttacatctgcgccagcgacgcctgatgcagccggcttttcaccgccagcggattgccgcttacggcgatgcaatggtcgcggtggccgaggcgcgcagtgcgcgctggcaagatgggctggtgctcgatgtcagccgcgaattcatggcgattacattgcagattgttgggataaccctcttctcggctgatacggaagccgatgccgatgaggtgtttgcggcaatgcatgatctggttgctatgttcgatctggcggtattaccgtttgccgactggctgtttgccttgccgttaccacctgtgcgccgctttcaggctgtgaaagcccgcctcgatgccatcatataccggttgattgcccagcgccgcgccaatccggttgatcgtggcgatctgctctcgatgttgctgaccgctgtggatcatgagggtgatggctaccggatgaccgatacccaactgcgtgatgagctgttgacgatctttcttgccggacacgagaccaccgcaaacgctttgacctgggcgctctacttgttagcgcaatatccatctcttgccgcacacctggccgccgaactggatactgtgcttggtggacggaaaccgactgtcgccgatctgccgaagctgacctatacctcatggttttttgccgaagccctgcgtctctatcctccggcgtggctcatcgggcggcgggcaattgcaccggtgacactcggtgatgtgcggattgcgcctgataccatcgttctgttgagtccatggctgatgcaccacgatccccggttcttccatgaaccgtaccattgtgatcccctccgccacacgccggaagcccaggctcagcgaccaaaatttgccttcttccccttcggtggtgggccgcgcacctgtatcggcgaaccgtttgcctggatggagggtattctcgtgctggcaacgctggcgcaacgctggcaatttctgccggtcgccgatcatccggtcgtcctccagaccggtattaccctccgtccacggtacggcatgcaattacagctcagagaacgt

SEQ ID NO: 32767 - DNA, 1065 bp, Chloroflexus aurantiacus
ccgattgatgtcctgtttgcgatctctgataccggtggtggtcatcgtagtgctgcggtggcaatcagtgctgcccttgagcagatgtccggtgcgagcatcacctgggcaattgaagacctcttgcaggcgacgaatgttcccggtgtgcgcagtgcgcccggtctctacgatcaactctcaacccgctggttaaagctgtacaatttctcgttccaactgaccaattcccaatcaacggtcagctttctatcgcggattgtctacctgattgcccgccagaacctcaatcgtctgctgaccgagcggcggccacgactggtggttgtcacccatcccctcgttcatcgcctggtatgtgcggcccggcggcgacggcagcattcgttccgcgtgctgaccgtcgtgaccgatctcgtcaccctgcatgcctcgtggagctatcctggtgttgatctggcattgaccccaaccgacgaagcgtaccgattaatgcacaaacgcggcatgaaacccagccagctccagcgctgtggttttccggtacatcccaaatttgctgccgagcaacgcgatgccccaactgcccgccgcgatcttggactggaaccggatcggttcaccgtcctattgactgccggtggcgtcggctctggtcgtcttggcgagctggtgcaaaccctcgaacaacagatgcccgacaaacaattcctggttgtgaccggcaagaaccgggcgctctacgaagagctacgcagtgggccacggctaccgcatacccatgtgtttggtttcgtcaacaacatggaagagctgatggcggccagtgatgtggtggtcaccaaagccggccctggcacgttgatggaagcgttagtcatgcgcaaaccggtcatcgtcactgaggcggtgggtttacaggaacacgggaacattgattttgtgctgaactacgagttaggcttcttctgccccaccaacgaacggattgtagccgcaatcagccagctcgaagacccggtgcgctacgccgaaaccgtcgaacgactcaaacatgccgtaccg

SEQ ID NO: 32768 - DNA, 1116 bp, Chloroflexus aurantiacus
cgggtgttaatcttgcacgcatcggttggaaccggccataagcgtgctgctgaagcattggctgctgcttttagtcgtcgccaaccgggtgaggtacgggttgaagacgtacttgaccacacctcacgtctgtttcgccttgcctacgcacgctcgtatctcgaattgaccgaccgggcgccgctagtgtggggctatttttatactcaaaccaatgccgatccgaacctggccgagataacgaataatatccgcaagctggttgagggcattggtacgaatggtttgaaagaggtcttgcgggcatttcagccagaggtcatcatctgcacccattttctcccgatggagctgctggtcagttataagcgcagtgcgcgcctgaccgaaccgatctactgcgtgattaccgactacgcagcccataccttctggacgtacaccgagatcgatggctattttgtcggtgacgaacagacacgcgctcaactgatcgaacgcggtgttagtccacagcagatcgtcgtgagtgggattccgattgacccggcctttgcccagcccaacgattgccgcgaagcacggcaacggcgcgaactcccgcttgacgggacggtcattaccctcttcgggggcggggttgatgatgaacacgtgcgattgatcgtcagcggtctcatgcagagttcgctcaaggcaaccctgatcgtggttgccgggcgcaatacaaccctggtcgagtcgttaagcgattttatttccacgccgaacattgatctgcgtgtgttggggtttgtcgattatgttgacgatttgatcaccgccagcgatctggtcatcaccaaagccggaggtctgatcgtgagcgaagttctggcccgcggtacaccgatggttatcattgaccccatcctcggtcacgaggaatggaatgccgattacgtcgtcagtaccgggagcggtatccagctccgtatgtgcgagtcgacacctcgggctgtggtgaacctccttaaccatccaaccatgctggttgaaatgcgccgctgtgcgcaggcggcagcgcatccgcgggcggcgcttgacattgccgaaaaggtgattgccgatcttgag

SEQ ID NO: 32769 - DNA, 1011 bp, Chloroflexus aurantiacus
cgggcttttattgtggccgataagggagtggtacaggccggcctggcacctatagagctggtcggtattttcgacgatgtaccggccaattcgtcggtggcaaaagtcgcagaaggcgctgaactggcacgtgtagccggtgccgacctgttgattgcagtcggtggcggtagccccatcgatacggccaagggtatccgtatcgtccttacgctgggcggatcaatccccgattacgaaggctacaatgtgattgaaactccgctcacaccgctgatagcaatcccaacaaccgccggtaccggtagtgaggtgacaccaattgctgtgattcttgatgaagaaggtcaacgtaaaataagtattgtgagccgttatgtgactcctaccctggccattctcgatccgctcatgacccgcaccttaccgccgcgcctgacagcggccacgggaatggacgcgctctcgcacgcgattgagacgtatgtttcaaccgaaaacaaccccttgagcgatagtctggcgctggcagcgattgacatgattgccacctatctacgcgatgcagtccacgacggcgaaaatatggaggcccgtagccagttgttgattgcggcgacgatggccggtattgcctgtggtaatagcctgtttggggttgtgcatgcgctgtcacacgcactgggtggcaaattccccgttcatcacggcacggcgaacgcgatcttcttgccgccgggtatgcgcttcaacagcgaggtagtgccggaacggtatgtccgcatcgcccgggcaatgggagtcaatgttggtggccggagcaacgccgaggtgattgctgatggtattgcggcggtacgcaccctgactgccgactgcgggttacccactacgctccgtgaagtcggtgtcccacgtgaagcgctgccggagctggccgaactggcggcagttgaaccggccattttcaacaatccccgtccggcaacgcctgaagagttacttgctatg

SEQ ID NO: 32770 - DNA, 607 bp, Chloroflexus aurantiacus
ccgaaaacccgccatccatcgccaaactgcggtagactacaaagaggaagcgattacgtagacaaggagattcggtatgcctctggagacagctacgctggctggtggatgtttctggtgtctggaagcggtgtacgatcaggtgagcggcgtgaaggacgtggtgtcgggatataccggggggtatgtgcccaacccgacgtatcgccgggtgtgtgatggcaataccggccacgcggaagcggtacaaatccagtttgatcccgaacagatcagctatcgcgaattgctggaaattttcttcagtattcacgatccgacgacgctgaaccgacagggagctgatgtcggcacacaataccgttcagccatcttctaccactctgaggagcagcgtcaggtggccgagcaacttgtgcgtgagctgaccgaacaacaggtatttcgcgatccgattgtgacgcagatcgtcccggctaccactttttatccggctgaggagtatcaccaggagtattttgcccgcaatccctatcagccctattgtcagtttgtggtggccccgaaagtggcgaagtttcagaaactctttgcccatcgggttgcc

SEQ ID NO: 32771 - DNA, 906 bp, Chloroflexus aurantiacus
attgaactccacgaccttacggtctactatgggcggcggcgtggtattgaagggcttgatctggcagttgaggcgggtgaggtgttcggctttcttggcccgaatggggccggcaagtcgaccaccctgcgggtgctcctcgatctgatcaggccggtacgcggtcgggcgcttatctttggtcaggattgccggcggcacgggccggccattcgccggcaggtggggtatctccctggcgagctgaatctgccaccccagcagactgctcgtcagtatctggcaatgctcgatgcagtgcgtggccgggtcgttgagccggcctatctgaaacaactgtgtgatcaactcgaattagatctggatcgtccgctgcgtacctattcgcgtggaaataaacagaaagtgggcctgattgccgcttttatgttccgtccacgcttgctgatcctcgatgaaccaactggtgggcttgatccgctggcgcagcaggcagtgatcgagctggtacgggccgcacggagtgagggacgcaccgtcttcttttcttcgcatgtgttacctgaagtccaggcagtgtgtgaccgggtagggattattcgtgagggtcgactggtgacggtagagcgcatcgacacgctgctgcaacggcaacaggtgcatcgcatgcggctgcgctttgcccatcaattgccacctaccgtgttttccttgcccggtgtcacgatactggcgcacagcggcaacgacatcatgcttgaagtacgatcagggttggcggatgtgctacggatcgccgccgagcaagcagtgatcgaactggagacgatcccgcttacgctggaagaggtctttctggcctactacggtggacaaggagaaaaccatgctcagcctgttttggca

SEQ ID NO: 32772 - DNA, 1407 bp, Chloroflexus aurantiacus
gcacgcaagcagaccgagatagagttgcgcctggctcgccagcaggccgaggcggccaatcgagctaagagtgcgtttctggcgaatgtcagtcatgagttacggactccgctccacgccgtgcttggttttgcccagttgatgagccgtgatgataatttaacggcgactcagcatgagtatctggcaattatcaatcggaacagcgagcacctcttacatctgatcaatgaagtgcttgatctggcgaagattgaatccgggcgctacacctacacaccaaatccgctcgacgttcgacgattactggccgatctgcaagcgttgtttgggccacaagcagaagcgaaacaattacaacttatcgtcacctgtgaagaacaagttccgccgatgattgtgagcgacgaagccaagattcgccatattttgatcaatttactgggaaatgcgatcaagtttactcatggtggcagtgttcgtctgcgagctgataccgataaacaacagatgtactttattgtagaagataccggtgttggcatttcgccccttgagcaaccgtacctctttcggccattctttcaaggaaaacagactgccaatgcgtcttcagatactggggttggtttggggttgagtatcagttatgagtttgcccgtttgatcggcggtgatctctcggtgtacagtgcgggcgaggggcagggtgctcgatttacgctcacattgccattgcgtacccccgtcacctcatcatttgtattgccggcagagccggtcaagcgcgctattcaggtacgtgccgatcagccggtctaccgcatgctggtggccgatgatcaaccaacccatgccttactgctgatttcgttgttgcgacgattgggctttgcggttcaatcggtcactgatggtgagcaggcgctggccgtctggcgtgagtggcaaccacatatgatctggcttgacctgcggatgccgcagatggatggattgacggtggcgcggcagattcgcgcaatctgtgcgactgaaccaggattattgcagccggtgattattgcgctgtcagcccatgtgctgggtgacacggcagcgagtgtactggctgccggttgcgatgaatttctggcgaaaccgtttcctgagcacgaggtggttcgactgatcgaacaacatctgaatgtgcaatttgagtatgccagtgtagtgatacgtgaggtgccggaaacagcaattcacgatcaggggtatcacccggcgtggtgtcaggcgttgcgtcaggctgtccaggttgcgcattttcagcggttgcaggaattagtgggaatgattgaggatcaacgtcctgatgatgcgcggcagctccgcaactggatcgagacgttcgattacgaggcagtg

SEQ ID NO: 32773 - DNA, 1134 bp, Chloroflexus aurantiacus
atggacgttgaattaaccccagaacagcagtttattcggcaaacggtgcgtgaattcgccgaaaaagagatcgcgccgaaagcgcgatatgtcgatgagcatagtgcatttccaagcgaaaccttcgccaaaatggcccagctcggcctgatggggctgccttttcccgaagagtacggcggtgccggtgccgatagtgtcagcaccgctatcgccatcgaggaagttgctcgctgctgtggcagcacggcgcttgcctacgctgcccatctcggtctgggtagtgccccaattgcgatgttcggcactgaagaacagaaacggcgctttctcgtaccggctgccaaaggtgagtatctggcagcgttcggtctgaccgaaccgcacgccggttcagacgccggtgccacacgcaccactgcccgcctggtcggcgacgagtgggtgatcaacggccagaagatgtggatcacgaatgcccccatcgccggccacatcatcgtgaccgccgtgaccgaccccgatctgggtaagaagggtatctcggcgtttatcgttccccgtggcaccccagggctaagcttcggcaagcacgaaccgaagatggggttacgtggttcggtaagtactgcggtgatgcttgacgatgtgcgtgttccccgggaaaatctgctcggtgagcgcggacgcggattcatccagtttttacaggttctcgacggtggtcggattgggatcggggcgatggcgatcggcctggctcaggccgcctacgaggctgcggtagcctatgcccgcgaacgaacggcgtttggcaaaccgattggcgctcatcagtcggttgcgaatatgattgccaatatggcggttgatctggccgcagcacgtgcgctggtctacggcgcggcccgcctgaaagatgccggtcgcccctatacccgcgaggcagcgattgccaaactctttgcctcggaagcgtcagagcgtatctgtcgcgatgccattcaagtctttggtggttatggctacagccaggagtatccggtggaacgtctctaccgtgatacccgcctgttgaccattggcgaaggaacgtcggaaatcttgcgtggagttatcgcccattccgttctt

SEQ ID NO: 32774 - DNA, 1014 bp, Chloroflexus aurantiacus
gaaatttacgcacaacccacagttattagtgaactacttgaacatgggttggtacaggcataccaattggccgctaaaattcgcaagcatgatatccgttatgtgtatgcagccggtcggggaacttctgaacatgccagtatttacggtcagtatttgttcgggacgctcaatcggttaccggtagcgctagctgcgccatcacttttcactatctatcagcagccaccaaacctgcgccacgcattagttatcggcgtttcgcaatcggggcaatctccagacattctggcagtgattgatgaagcacaacggcaaggggctctcacgctggctataaccaacgatccagcttcgccattggctcagcacgctgccctccacttcgacatcgctgccggcccagagttagcagtagccgcgacgaaaacctacacggctcaactgaccgctttcgcattgctggcaatagcgctggccgatgatcaggcaagattaactgaattgcgccgacttcctgtagcacttactgaagccttgcaactcgaagaagttgtagcaactgctgccagccattttcgcacgatgtcatactgtgtagtacttggtcgtggatttcaactggcaactgctctggaatggtcgctgaaactgaaagagatggcctatgtcgtagccgaacgctactctaccgccgagtttcaacacggcccaattgctctgatcgagccagggtttccagtgctagctgtggctacccgcgatgctggcagtatgtacatcgccaatctgctcgaccgcttacgagccgctggcgctgaattgctcgtactcagtgatgatcgcacactctttgcgcacggtgttaccggcttgctcatacccgcaggtattcccgactggttaacccccatcgttaccatcgttccggcacaactattctgttaccatctagccctggcacgaggcgtcgatccgttgcatccccgcgggttacgaaaaataacacgcacc

SEQ ID NO: 32775 - DNA, 933 bp, Chloroflexus aurantiacus
atgcgcgccgtctattatgaagcgtttggtcagatgccatggatcgccacgctgcccgatccagccccaacgccagatggtgtcgtgctcgcagtacgcgctaccggcctgtgtcgtagcgactggcatggctggatggggcatgatcccgatattaagctgccgcatgtgccaggccacgaactggccggcgagattgttgccgtcggatcacaggttcggcgctggcgaatcggtgatcgggtcactgttcccttcgtgtgtgcctgtggtttttgccctcagtgtcaggccggtcagcaacaggtgtgtgacaaccagtttcaaccgggattcacgcattggggatcgtttgctgaatacgttgccattgatcgcgccgatctgaatctggtgcgcttgcctgccgatatgagcttcacgactgccgccagtctggggtgtcgttttgcaactgcctttcgcgccgtcgttgatttgggccaggtacgtggaggcgagtgggtggcggtttacgggtgtggtggcgttggtctctcggcgattatgttagcctctgccctcggtggacaggtgatcggaatcgatattaacctggaacggctggcactggctcgggcggtaggggcaacggcggtgattgatgccactaccgaaccggatgtggtaagcgtggttcgcgatctcagccgcggtggggtacacctcgcgattgatgcgttgggtagtcctatgacctgcgccaatgccattgccagtctgcggaagcgcgggcgccatgtgcaggttggtctgctgctggccgaccaacggatgcctccgttgccgatggatatcgtggttgcgcgtgagttgacgattatgggaagccatgggatgcaggcttaccgctatgatgcgatgctcgacctcatccagtctggcaaagtacaa

SEQ ID NO: 32776 - DNA, 1230 bp, Chloroflexus aurantiacus
cgacgggtggtggtgaccggaatgggggcaatcagcccacttggtctcagcgtagccgaactctggcaggggatcgtcgcagcgcggagcggcgtcggtccgatcacattgttcgattcgaccggttttgatacccggtttgccgctgaggtgaagggcttcgatcccacgaattatatggatcgcaaagaggcgcgacgcaccgaccgcttcgtgcagtttgcggtggctgcgaccagagaagcgttacgcgatgccgagcttgagatcacgcccgccaatcgtgatgagatcggggtctttattgccagtgggatcggtggcattggcaccctctcggagcagttagacgttctgcgcagtcgcgggccggggcggatcagtcccttcctcattccggcgatgatcaccaatctggccgccggtcaggtttccattgtcaccggtgcccgtgggccgagctactgtgtgacatcggcctgtgcgagttcagcccacgccatcggcgaggcggcagagaccattcgccgtggatgggcaaaggcgatcattgttggtggcagtgaagccagcattacccctattggcgtcgccggcttcaatgcgatgcgtgccctctcgacgcgcaacgaagactatgcccacgcctcacgaccatttgacgccgagcgtgatgggtttgtgatgggtgagggtgcagcggtactcatcctcgaagaccttgaattcgctcttgcccgtggtgcgcgtattttagccgaggtggtggggtatggtgcaacatctgatgcctaccatatctcgaatctggccgaggatggcgaaggtgtcgcacgggcgattcggttggccctgcagcggggtgctctggcaccagaggatgtggattatatcaatgcgcacgccacctcaactccggctggtgacccggttgagacaaccgctatcaagcaggtcttcggcggacgcgagaaatcaccgccggtgagtgccagcaagtcgcagttcggtcatctgctcggtgcagccggtgctatcgaagcagttgtgactatcctggcgatgcagaacaatctcctgccggcaaccatcaatcttcagcaaccagacccggcctgtgatctcgattttgtgcccggtcagccgcgtccggctcggattgaggtggccctaagcaactcgtttggctttggcggacacaatgtgtgccttgcctttcgtaaataccac

SEQ ID NO: 32777 - DNA, 918 bp, Chloroflexus aurantiacus
gcaatcgagacaattgatctggtcaagcgctatggcaacctcacggcccttgatcatgtcaatctacaggctccctctggcaagatatatgcgttgcttggcccaaacggcgccggcaaaacaacactcctcagcatcctgaccacattgttgccacccacggcaggcacggcacgtatcctcggctatgatgtcagtcgcgaggctgccgaggtgcgccgccgcatcggcgtaacatttcaagagatggtactcgatcctctcctgaccggtcgtgagacgcttgattttcatggtcgcctctatcggttgccggcagcggtgcggcgacaacggatacgcgatctggtggagctggttcagttgaccgacgcgattgatcgtccggtcaagagctattctggcggcatgaagcgtcgccttgagctggcccgtggtttgatgaccgatccgcaggtgttggtgctcgatgagccgacgcagggtctcgatccgcaaaaccgggtgaatatctggcagtacgtgcgtgatctgaaccggcagcgaggtatgaccatcttgctcaccacgcatgcgatggacgaagccgaagcactggccgatctggtgggaattatcgaccacggtcgcctgattgttgaaggtcaaccaaccgacttgatcgcatctctcggttcggacgtgattcgggtgcgcgggcagggtgactctcaccatctgaccagcgcgatatgtggtattgacggtgtgcagcgggttgaaaccgatccgacagaaggattgatactcatctacaccgacaatgggagtcggcgtttgccggtggtcttgagtgccgtaagtggcaacggctttgcgattgaagatgtcaccctggcgcgaccatcgctcggtgatgtctttctgcactataccggc

SEQ ID NO: 32778 - DNA, 1692 bp, Chloroflexus aurantiacus
acggatacacccaggctttcaaaagttgagcagatcaaactggccagccggcatttgcgagggccggtagatcacgagctgcacgacggaaacgatcacttcagtgatgaagggtatcagattctcaagtttcacggcatttatcaacaagacaatcgcgatgtgcgtaaagcccgcaaagcgcggggattggggccggagtattcatttatgatccgggtggctattcccggtggccggcttagcccggaacagtatctgaccctcgaccggctggcggatgagttgggcaataccacgttgcgttttactactcgccaggccattcagtaccacggcgtgcgcaagggtggcctgaagccactgattcgcacgcttaaccgtcatctgctgactacactctcggcatgtggtgatgtggtgcggaacattgtggcctgccctgcaccttttgttgatcgtcagcggatcgagctgatgcagtatgcgaaagctctttctgatcggctgaagccaaagacccgtgcctactacgaaatctggctcgatggggaaaaggcggcgagtctggaagaggatgaaccgctctacggtgcaacctatctgccgcgcaagttcaagattgcctttgccttccccggcgataactgtgttgatgtctatacccaggacattggaattgtgccgtggattgaagagagtctgcaagggttcaccattctggttggtggtggtctgggccagagtcatggggttaaggaaacccatccggcactggcaaagccgcttaccactgtagctcccgcccagctttttgaggttgtggaagcgattgtgaaggtgcaacgcgatcatggccgacgtgatgaccgcaagctggcccggatgaaatatctggttgagagttggggcatcgagcggttcaaagctgaggtcgagcgctacgttggctatgcgttgcctgaacccagaccgctcacgtggctcagcgccgatgatcacctgggatggcacgaacagggtgatggccggctcttctttggcctgtttgtcgaaaatgggcgggtcagagatcatctccgggcagcaattcgggatgttgtgcagcgtttcggcctcgaagttcgcctgactccgcagcagaatatcctgttcgtgaatattcaaccggctgatcgtgcggccatcgaggcaatctttcgccagtatgatgtcgcgctacccggtaccatcccgctcgttgttcagaatgcgctggcctgtccagctctccccacctgtggtctggcaattaccgaaagcgagcgggtcatgccgcaggtgattcgtgacatgaacgccctgctggatcggctgggactccacgatggcccggttccgcacgtcagaatgaccggctgccccaatgggtgtgcccgaccctataccgctgaaatcggattggtaggacgcagcctgaattcttacaccatttatctgggtggcagtcctttgggaacccgcctgggagaagtctatctcgataatgtcaagcgcgaggagattgtcgcgcggctggaaccgatattgctactctatcagcgcgaacgcaacccgggcgagtcctttggtgatttctgccatcggctgggcagtgcaaccttgcaacaccttgccgggcagaacgaataacaaaccatcgggggtaacagc

SEQ ID NO: 32779 - DNA, 1116 bp, Chloroflexus aurantiacus
tctctcccgaagccgcacggtggtgttctggttgagcggattcgggttgcacatccacgcgaatatgaccatctgccggcacttgagcttgatgaacgggcgtatgccgatctcgaactcattgccaccggtgtctattcgccgttagaaggttttatgggccaggccgattatctgagtgtgctggaagagatgcgcctgacgaatggtctgccgtggagtatcccgatcaccctgggggtgtcggcacaggatgcagcttcctatcgaaaaacagttcgtttgacgaaggatgggcgaacggtaggcttgcttgatgtcgaagagcagtatcgacctgataaagagcatgaagcactggcggtctatcgcaccacggatctcgcccatcccggtgttgcggcgctgtttgcgcgaggggatgtctatctggccggtaaggtgcaattgctgaccctggatcgggggccattccccgaacaccactatacgcctcgcgagacgcgacaactgtttcaagagcggggctggcagacaattgtcgctttccagacccgaaatcccattcatcgtgcccacgagtatttgcacaaagtcgcactagagtcgctcgatggtctgttccttcacccgctcgtcggctctaccaagtcggatgatgttccggccccggtgcggatggcggcctataaagttctcctcgaacgctactacccgcaaaaccgggtgttgttgggtgtctatccggcagcaatgcgctacgccgggccacgtgaagcaattctgcacgccatcagtcgcaaaaattacggctgcacccatttcatcgtggggcgcgatcacgccggggttggcaactattacggcccgtatgaggcgcaggccatctttgaccatttccgtccagaggagattggcatccatattctcaagtttgagcagaccttctattgcgtaacctgcgccgcagttgtctcgccgcgtacctgccctcacgatacccaacatcaccttgttctttcaggcacgcgggtacgtgaattgttgcgcgcaggatcgccattaccgccggagtttaccagacccgaagtagctgaagtgttacgcgctgcttac

SEQ ID NO: 32780 - DNA, 675 bp, Chloroflexus aurantiacus
ggtgagtcaccaatgacaacacaatactgggacgcgaacaccgaccctcgtgatgtcattcgctgggcacttgccggttatcccgatctgctgatgaccagtgcattcaatcttaacggggtcgtgcttattgagctggcagctcaggccggttttgcgggcgaggtggtttttgtggataccggctaccattttccggagacccttgccactcgtgaccatctgatcacgcgctatccccagatgcagtttgtcaccctaagtgccgacctgccacctgaaccgtggggggaagagcaatttcggagcgatcccgatgggtgctgtcgcgtgcgaaaagttgctcccctgcgtgaatatctggcgcgcaagaatccttctgctcttttaaacgctcgcagtcgtgatcaggccgcaacccgccgggatctgggttttgtcgagattggtgagcgggtgcggatcaatccactggcctactggcggcgggagcagatagaggcatttgcgcaagcccatcacctgccggtgaacccattgtactgggccggtttcaagagtatcggctgctggccctgtacacgggccgtgcgccctggtgaagatgtgcgggccgggcgttggtcggggaagggcaagattgaatgtggcctatggatcggtgaacaatcgctg

SEQ ID NO: 32781 - DNA, 501 bp, Chloroflexus aurantiacus
cgatcaggacttgtcgtctggtttaccgggctttctggcgccgggaaaacaacgctggcacgggcgctggcgacgctgttgcaagaggccggctacccggttgaacagctcgatggcgatgtcgttcgtgaacatttgtcgaaggggttagggtttagccgcgaagatcgtgatacgaatatccggcggattggttttgtagccaatttgctggccaaacacggtgtgatcgtgttggtcagtgcgatcagtccctaccgggaaacacgtgctgaggtgctggctgccgcacccagaaaacttgaggtgtttgtggaggcaccgctagatgtcctcattcagcgtgatgtgaaggggctgtacgcgaaggcgttgcgcggcgagattgcgcaatttaccggtatctctgacccttacgaacctccgttgcatcccgatgtccatctgcgcaccgatctgatgagtttgccggagtgtctggatcatctgctggctgcgctg

SEQ ID NO: 32782 - DNA, 813 bp, Chloroflexus aurantiacus
gggtatgatgctgctcaggttgtgattctcggttgtccacaggacatcggcgtgctgcgtaatcgtggtcggcccggtgctgcgcaggggccgaccgcaattcggcgttgtctataccgcctgggtattaccggtttgcaacatcttacgatctgcgatctcggtgatgtagataccaccggcgacctcgaaacgattcatgcgcgtcagcaggctctggtagcgcgtatcattgccgatggaaagttgctcatttcgcttggcggagggaatgatattagctttcccgatatggcggcgatggcagtggcagctccgccgccgccgctggcaattaatgtcgatgcgcattacgacgtgcgggccgatcaaccggcaaatagcggtaccccctatcggcaactgattgaagcaggtctgattgcaccacaacgctactgggtatgtggggtgcaaccattcgccaactcacccgcgtatactgaatacctgcgcacacgaggtgcgacgattatcgagttgaacactgcccgtcactatggggttgccgatacgatgcggtctctactcgctacgagtgatgccgggagtatcggctggggttttgacctcgatgtggtacaggttgccgaggcgcctggagtcagcgcccccaacccgctcggtatgcgcggtgatgaactggttgcgctggcaacgctggccggtgctgagccacgcacgcgcctgatcgaattcagtgaactcaatccccaatacgatattgatgatcgtactgcacgcctggcggcagttgcgatctggcacgctctg

SEQ ID NO: 32783 - DNA, 1389 bp, Chloroflexus aurantiacus
cacaatagaactactgtagtacggcctccatgatgtcgatcacagtgcggtagcactgatgtatcaatggcgatgcagtcgcagtgagcatgaaagagcatggctatgaccaggaacactctcaccgtaaccgacaaccgcaccggtaaaacgtacgagattcccatcgagaacaacaccattcgggcaaccgatttacgccagatcaaagtatcggaagacgattttggtttgatgtcctatgatccggcttacctcaatactgcatcctgtaagagtagcatcacctacatcgacggtgataaggggattctagagtatcgaggttatccaattgagcaactggctgagcagagttcgtatcttgaggttgcgtacctgctgctgtacggggaactcccctcaaaggaacgcctggcctggtgggaataccggatcagtcggcatcttttcctccacaacagcctggtagagctgattcaagccttccgctacgacgcccatccaatgggtattctcatcagctccgtagcggcaatgtccacgctataccccgaagccaagaacatccacgatccggctgtgcgcgaaaagcaaatctggcgtattatcggccagatcccgacaattgctgcctttgcctaccgccaccgcatcggtcgtccattcaatttgcccgatagctcgctcagctacaccgccaacctgctgtacatgatggactatatgaatcagcgcgagtatgaagtaaatccagtgctggccaaagcgctggatgtgctcttcattttgcatgctgatcacgagcagaactgctctacctcggtcatgcgtagtgttggctcaagccacgctgatccgtacaatgcgctggccgctgccgcagccgctctctacggcccactccacggtggtgccaacgaggcggtactgcgcatgttgcagcagatcggccatccaaagaacgtgccggcatttatcgagcgggtgaagaagggtgaaatgcgtctcatgggctttggtcatcgcgtttacaagaattacgatccgcgggccaagatcattcgtaagatcgctcacgaagtctttgcggctactgctgccaacccgctgctcgatgtcgcgatggagcttgagcgaactgcattggaagacgagtactttatctcgcgcaagctctatccgaatgtggatttctacagcggtctgatctatcaggcactgcgcttcccaatcgagtacttccccttcctgttcgcaattccacgcgcttcaggctggctggcacagtggatcgagatgctcgaagaccccgagcagaagattacccgtccacgacaggtctatgttggcccacagcggcgggattatgtgccgattgatcagcgc

SEQ ID NO: 32784 - DNA, 1251 bp, Chloroflexus aurantiacus
atcgttgcccgtgaggtgcttgattcacgaggcaatccaaccatcgaagtcgatgtgcggctggaaagtggtgatgtcggacgggccatcgtacccagtggtgcctcaaccggcgcccatgaagcgctggagttgcgcgatggcgacaaatcacggtacaacggcaagggggtgctgaaagccgtacaggcggtcaacgaagacattgccgaagcgttgatcggcttcgacgctgctgaccagattgcccttgatcaggaactgatcgcgctcgatggcacgcccaacaagagcaagctcggtgccaacgccattctgggtgtctcgctggcggcggcgaaggcggctgcggctgcgtttggcctgcccctctaccgctacctgggtggtgtgtacgcccacgtactgccggtgccgatgatgaacatcatgaacggcggtcagcacgccacgaacagcaccgactttcaggagtttatgattatgccggtcggtgccgagagcttccgcgagggtctgcgctggggtgccgagatttatcacatgttgaagaaggtcattcacgaccgcggcttcagcacgacggttggcgacgaaggtgggtttgcccccagcctgcctaccaacgacgccccactgcaactgatcatggaagctatcgagaaggccggctatcgccctggcgagcagatcgttatcgccctcgacccggcgacaaccgagatttttgaggatggcaagtatcatctcaagcgcgaaggccgttcgctttccagcgccgagatggttgactactgggttgatctggtcaatcgctatccgatcatctctctcgaagacggtctggccgaagacgactgggaaggttgggcactgttgcgagcgaagctgggcgaccgcgttcaactggtcggcgatgacttcctggtcacgaatgtgcaacggcttcagcgggcaatcgaggccaaagcagccaactccattctgatcaagctcaatcagatcggttcgctcaccgagacgctgagtgcaatccaactggcgcagcgcagcggatggacggcagtggtatcgcaccgttccggcgagagcgaagacgttacgattgccgacctggtggtagcaacaaatgccggtcagatcaagacaggagcaccggcacgtaccgaccggattgccaagtacaatcaactactgcggatcgaggaagagctgggaagcgctgcccgttatgccggtcgtagtgcgttt

SEQ ID NO: 32785 - DNA, 1464 bp, Chloroflexus aurantiacus
ctgatccgcgatatttctgacacaagtagctactggggagcgtcgtgggtgtttggctgcttccccgatgtgcatatcgtctgcgatgcaccaatcggttgttacaacctgctcggcatggcggtcaccgattataccgacgccttgccacacatggccaacctgaccccaacctcgatccgcgaggaggatgtcatcaacggtactgccaaagcgctgattcgcaccatcgacgatctgcgcacgatgggtatgctggacggcaaacgcttactggtcatctccacggctgagagtgagatgatcagcgccgatcacgcccaactggtcgctcggattgatcccgacgcccgcttcttctggagccaatctctggaacaggacgaatggatagggcgtgaacgcgctctgcgctttgcctgggaacagtacggcaagccgtttgttgacgcggatgtccagcctcgtccgcgcacggtcaacattatcgggccgtcccttggctgcttcaacgcgccaagcgacctctacgaactgaagcggttgatcaccgggattggtgccgagatcaatctcgtttacccctacgaaggcagcattgctacgacacccaaactggctgaagcggcagtgaatgtggtgatgtaccgcgaattcgggcaggggttggctgaagatttgggacgaccgtatctctttgcgccgtttggtgtgtttgggacgacggcctttttgcgcgaattggggcagctcctgggcattgatccggcccaagttgacgccttcattgagcgcgagaagcgcaccaccctgcagccggtgtgggatttgtggcgtgggccgcagagtgactggtttgccaccgtggattgcgctattgtcgctgcccgcagctatgccgatggtctgcgcagctttctcggcgacgagctggggatgaagattgcctgggtatcgggccgcccgcgccgggaagatgaacccgacaatatcgagattcgcaaacggttacacgccaaagcgccggccttcgtcttcggtagtatcaacgagaagatctatctggccgaagctaacgctcgcggtacccatttcattcccgcaaccttccccggcccggttgtccgtcgcaccaccggcaccccgtttatgggctatgccggcgccgccaatatcatgcaagaactggtgaatcggttctacgaaacggtgatcaacttcctaccggtcgagaccatcaatcccggccctgccggcccacccaaaccgacctctgcggaaacgatgccctggacgaaagaggcaaccgagcggctgaacgcagcccttgaggccgtcccttaccttgcccgcatcagtgccagccgcaccttgcgtgccgccgccgagcaacttgcaaaggcacgtggtctgaacgaggttggcatcgagattgtcgaagcggcaattgctcagagtggcgcg

SEQ ID NO: 32786 - DNA, 1251 bp, Chloroflexus aurantiacus
tcagcgacgctcgccgagaaggcacgtgtccgcttccccggtggtgcaacccacgacggtcgttacgccgatccctttcctctcttcatggaacgagccagcgggccgtataagtgggatgttgatgacaatcggatgatcgattactggtgcggacacggagccttactgctcggtcacggccatccaaccattgtcaacgctattcagcagcaagcccccatcgccacccatctcggcgccaatcatcgccttgaactggaatgggccgatctgatcgccgatctcattccggcggctgagcgcattcgcttcaccgcgtcgggaagtgaagcaacaaccctcgctctgcgcattgcccgcgcagctaccggcaagacgacgatcatccgcttcgcgggccattttcacggctggcacgacgcgcttgcacccggtgccgatcccgatgatccccaccgcggagtattgccggcaaccctctcaagtttgctgatcttgccgaccgatcttgatcaggtggctgcgacgctggctacgcataccgacattgccgcggttattctcgaacctacgggtgcttcctacggttcgatcccgctcccggatacgtttctgatcggcttacgtgagcttactcagcaatacggtgtgctccttattgccgacgaagtcgttaccggctttcgggttgcgcccggtggtgcctgcgcacgtgccggagtacgccctgatctggtctgtctggccaaaattgtcgccggtggattgcccggcggggcgctagtcggacgggctgacctcctcgacctgctggcccatgacgagaatggcccccgtggacgcatccgccaacagggaacattcaacgccaatcctctctctgctgctgccggcattgctatgctacgtgccgtcgctaccggcgaacctggtgctatcgccgccgcacgtggcacaatgctcatccaaatgctcaacgaactgtttgcttcgtatcgtttgcgtggctggacagccttcggtgatggatcgatctttcacctgtttgtcgatccggcaaccgacctgatccccggtgagattccgcgcaatctgccacttgccacgcttaaacgcgggggtgatccgcaaatcctgcgccggctgcggatggcgttacacctgaatggtgtcgatttgatgcgggggcgcagtggttttgtgtcggctgttcatagcgaagaggacattcgggctacggtggctgcg

SEQ ID NO: 32787 - DNA, 1755 bp, Chloroflexus aurantiacus
ttacgcaatgttcccgcagccttccgcctggtctggcaggctgatcgcacccatacgattgcgatggcatgtatcacgctgctggccgcagggttgccactggcgcaggcgtatatggctaaacagattgttgataccgttgttgcggctgtgcaacagggtcttaccgcgttgagtggccttgagcaaacgttgccgtggttgttgggtgaattcgggctgattacgctgggagcagtgctgatgcagatgcgaacgctgagtgaacacatcttgaatgcccggctgagcaatatggtcaacgtcatgattatgcaaaaagcgctgctcctcgatctgcactattttgaagatgctcagtattatgacaagttgcaaaacgcacgtcgcgaaaccaactggcgggccatggcaatggtgaacaccgcattcagcgccattcaacaaatattgacccttggctcgtttgcggccagtctgctctggtttagccctctcatagcgttgatcttgtttggcgcaaccattccggcctttctcgctcagactcattttagccagttacggtttcgcttactgacctggcgcgcaccagaatttcgccgcatgcagtaccttgaacatctgctgaccgttgatactgcggcgaaagaggtaaaattgttcgcacttggtttgccactgctgcaacgccatcaggaacagtatcaacgcttcttcactgaagatgcagctctggcccgccgccgttcgctgatcagcatggtgtggggggtcgtagccagcgccggttattacgtcgcatacggatggatcatctggcaaacagtggctggcgcaattaccattggcggcatgaccttctatttgaccctgtttcgccaaagtcagtcagtcgtgcagaccttgttcggcaatctggcgcagctctacgaaggtggattgtttttgggaaatctattcgattttctggcgctggagccacagatgcgcagtggtcgcaatctcccggtaccacccatcatccgccacggcattgagttccgtaatgtcagttttcgttatcccgaccgggaagattgggcattgcgctcgatcaatctgcacattgcaccgggcgagaagatcgccctcgtaggcgcaaatggggccggcaagacgaccttaatcaagctgttgacccgactgtacgatccgactgaaggtcagattctgctcgatggtgtcgatctgcgcgattatgatcttgagcaattacgccagcggattggcgtcatttttcaagactttgttcgctatcaggccactgcgcgcgagaatattgggtttggtcagattgatgatctggctaacgaaccgcgcatccgttcggcagccgagcggggcggggctgatgaagtgctgcgtcatttgcctgacggctacgagacgatgctgggacgctggtttgaaaatggggccgaactgtcgggtgggcaatggcagaagatagcgcttggccgcgcctttatgcgtgatagcgaaatcctggtgctcgatgagccaacggctgcgctcgatgccgagcgtgaatacgaaatctttcagcgctttcgtgatttaactgccggacggattgcggtgttgattagccatcgcttctcgacggtacggatggcagaccggattgtggtgctcgaacacgggcagatcaccgagatgggtacccatcaggaattactggcccgtgatggcacttacgcacggctgttccac

SEQ ID NO: 32788 - DNA, 1503 bp, Chloroflexus aurantiacus
tggtcgcatctcctggcacaattacgatctgttgtaccagaggcctttaacagtgaagggcacgttctcaatttgatcgagggaacgtggggatggccggggcatggtaagcattacagtacgcccattgatggcacggaattgggccgcatgcccatgattgacctcgaaacggcaaagcgggctgtgcgttttgccgctcgtgaacatgagacctgggcacgaactgatctcgatgagcgacggcgacgggtgcgggagacggttgatggcttacgacagcaccgcgatctgatcgcatatctgctgatgtgggagattggcaagccataccatctggcgtgtgatgatgttgatcgctgtcttgatggtgtcgaatggtatattgatcagatcgaatggatgctgagtaaccgccagccgctcggtctgatatcgaatattgcctcgtggaactatccgtactcggtgttagtccacgcggtattggtgcaggcactggccggtaatgccgtcattgccaaaaccccgtcagatggtggcttgttcgcgttaacgctaggttttgcgattgcccgtcgggctggcctgcctgtctcgctggtcagtggatcgggtggtgcgctcagcgatgctctggtacggaatgccgatgtagcgtgtctggcgtttgtaggcgggaaaactaacggacgtgatattgctgcgtcgctctacgaccgcaacaaacgctacatgctggagatggaaggggtgaactgctacggcatctgggatttctctgattgggcgagtctggctcagcagattaaaaagggctttgcttacggtaaacagcggtgtacggcctacatccgttatgttgttcagcgccgactctttcccaagttcctggatgtgtatttgccggttctaaagagcttgcagatcggcaatccggtactggttgatcgggctggtgatccgttgccacggctcgattttggccccctcatcaatgcgaggaaggttgaagagctacgtgtgctctacagcgaggcgctgggtgccggtgcggtttgtctgtacgaaggcgaattgaacccagagctgtttttacccgatcaggacatttcggcctatatggcgccgattgcgttgttgaatgtgccacggaattgccgcctgcaccacaacgaaccgtttggcccgattgatacgattgtgattgttgatagtatcgaggagctgatcagcgagatgaatatctcgaatgggaatctggtgtcctcgattgcgaccgatgatctcaggttgggccagatgattgcaagtgagttgcgtgcattcaaggtcggcatcaaccgtatgcgctcgcgtggtgatcgcgatgaggtgtttggcgggatgggcgcatcctggaagggttgttttgtgggtggtaagtatctggttgaagcagtgacagtcggcgcgccgggagagcggttgtacggtaattttcccgattacacgctgctgcca

SEQ ID NO: 32789 - DNA, 2538 bp, Chloroflexus aurantiacus
gagcgtgaagtgatattgccaatcaccgggatgacctgtgcaagctgctcggcgcgggtcgagaaggcgttgcgtaaggcaccgggtgtgctggctgccgaggtgaatctggccggtgagcaggcgctggtgcgctacgatccggggctggttcagcccgaagcgttgcaggcggcggtggagcaggccgggtatggggtggttgtcgatgagatcacgctggcgatcaccgggatgacctgtgccagttgttcggcacgggtcgagaaggcgttgcgtaagctgccgggggtgttggcggcggaagtgaatctggccagtgagcaggcgctggtgcgttatgtgccggggatggttgagcgcaccgatctggtggcggcggtggagcaggccgggtatggggtgattttgccgtctgctaccgatgaggccgctgaagatgtggaggcgcgggcacgtgaagcagagatgacggtgcggcggcggcgattgctggttggtgtggtctttgggctgccgctcttcgtgttgtcgatggcgcgtgattttggtctgattgccccctggttaatcggtgagggggcggcgatgatggcgacaatgcgtgatgcggctatgggtgagattatggccatggtcgctgcccgcgatgacctgctcaactggctctttctggcgctggcgacaccggtgcagttttactccggtcgcgatttctaccggcatgcgtggcgggcattgcgtgcccgtaccgccactatggatacgctcattgccctcggttcgtcggctgcctatttctacagtctggcaatgttgctcagcggtgcgcccggccatgtctatttcgagacggcggcattgatcattacgctgattctggttgggaagtatctggaggcgcgtgcgaaggggcagacgagtgccgcgattaaggcgttgatcgggcttcagccgaagaccgcacgagtggtgcggggcggtcaagaagttgatgtgccgctcaccgaggtgcgggtaggtgagatgattattgtgcgaccgggggagaagattccggtcgatggggtgattgtctccggtgagtcgacgattgatgagagtatgctcaccggtgagagtttgccggttgagaagcgcagtggcgatccggtcttcggggcgacgattaatcgcagcggtagttttcagatgcgggcgacacggatcggtaaggattcggcgctggcgcagattattcgtctcgtgcaagaggcgcaaggctcgaaagcaccggtacaggcgctggttgatcgggtttctgctgtctttgtgccgatagtgattgtgattgcgttgattacctttctcggctggttgtgggccggggtggggttgacccaggcgctcatttttgcggtggcggtgctggtgattgcctgtccgtgtgcgttgggattggccacgccgactgcaattatggttggcaccggtaccggtgcgtcacacggtattttgatccgcaatgccgaggctctggaacgtgcggcaagtctgcacgcggtggtgttcgataagaccggtaccattacgcatggtcgccccgcagtgaccgatgttgtgatggtggccaggccggtgctggcgcagggaacccagtccgacggcacgggagatcaggtgttgctacagattgcggcggcggctgagagtcgcagcgagcatccattaggggtggcaattgtgaaggcggcgcaggagcgtggtctggctgtcgagcgaccgacgcgctttcaggctgtcagtggtgccggggtggaagctgaggtcggtgggcagactgtgctggtgggaacgctgcgctggttgcgtgagcgaggggttgagatacacgctttagaggctatcgtcgatcagttgcagaatgaagggaaaaccgcgattgcggtggccgttgatagtgaggcgtggggtgtgatcgcgctggccgatacggtcaaaccaaccgctgcggaggcggtagcaaagctgcatcaggccgggattgaggttgcgttgctgaccggtgataatcagcgcacggcagcagcgatagcggcggcggtcggtattccggcaacagccgtgtatgctgaagtgaagccggatgaaaaggcggcgattgtggctcgcttgcagcagagtgggccgcatggcaaaccacgccgggtagcgatggtgggtgatgggattaatgatgcgccggcgctggcccaggctgacgtggggattgcgatggggagcggtaccgatgtggcgatggagacggcggatattacgttgatgcgcagcgatccgcggggcgtggtgcaggcaattgccctcagtcgcgccacagtacgcaccattcgctggaatctcttctgggcgtttgcctacaatgtgttgttgatcccggtggcggcgggtgtcttctacccgttgaccggctggcagttaagcccggtgctggccgcggctgcaatggccttctcgtcggtctttgtggtgactaattcgctccgtctgcggcgtgtgcgg

SEQ ID NO: 32790 - DNA, 1222 bp, Chloroflexus aurantiacus
gatggccgtttgtggattggcggctgcgatacggttgcgctggccgaacagtttggaactcctctgtatctgcttgatgatctgacgctgcgcggtgcgatgcgtgcctatcggcaggcatttgccaccgcctaccctggcccgtcaatcgtccattacgccgggaaggcgctgttgaatacggcgctggcccagatcgtggcgcaagaaggactggggttggatgtcgtttcagcaaccgagttgttggtggcgcagcgagcgggtctaccgatggatcgggttcacctgcacgggaatgcgaagagtgatcaggaactggagcgggcgattgcgtggcgggttggggcgattgtcgttgataaccttgacgaattgcagcgactctgcgcgcttacatcccatctcaccacgccgcagggcgtcttgttgcgagtggcgcccgctatcgaagcggatacgcacgcgcatatcgctacagggagcgccacggcaaaattcggcctgcccctggaggcgcttgatgaggctgtcgctcaaaccctggccgcacccagcctgcgctggttgggattgcatgcgcatatcggctcgcaactctttgcgcttgaacaggtgacggcgaccgttgaggtgttggtggcgctggctgcgcggatacgggatcgctttggtgtggcgccggttgaactcagtcctggcggtggtctgggtgtgccgtacactgctgatcagccggcaaccgatattggtcgttatgcgcaggtggtgagtgcggcgttgtgtgcagcctgtgaacgataccggttaccgttaccacgcttgaccgtcgaaccaggccgttccatcgttgcccgggccggtgtggctttgtaccgcgtggtaggtcgtaaaggcgagcactgggtgcatattgacggtggtatggccgacaatattcgtccggccctttacggggcgcgctatagtgcggtgctggccaataagccggcttcgccgccagcgatgacggttaatgtcggtggacgttactgcgagtcgggtgacgtgttgttacgcgatattgcgctgccgactgtgcagccggatgatctgctggcagtggcaaaaagcgggtgcctacacgctgagtatgttcccagtacctattacctggtaccgcgtccggccctcgtcctggttgccgatggaacaggcacgtctgatccagcgtcgggaacag

SEQ ID NO: 32791 - DNA, 2550 bp, Chloroflexus aurantiacus
tttcaattgctcaatatcgccgaggaaaacgcagcagtgcagcagcgccgggtcgctgaccgcgatccgaatatcccgccggaattggggcgctggcgagatgccttgcagaagctgcaccaaagtggtttgaccggcgaagagattgctgcggcgcttccccatgttcacgtcgagccggtgctcacagcgcatcccactgaagccaaacgggcaacagtgctcgcacattatcgtgagctgtacttgttgctggtacggcgcgagagtcagcgctggtcgccagcagaacaggcagagatcacggcagatattgagaccctgctcgaacgattgtggcgtaccggtgatgtctttctgagcaagccgggtgttcctgccgaagtgcgcaatgtcctgcattacctggtcaatgtctttcccgatgttttgcccgttcttgataatcagttgcgctacgcctggcaggaagccggtttcgatcctgcgctgctgagcgatacctggccaaagctcagttttggttcgtgggtcggtggtgatcgcgacggtcatcccctggtgactgccgaaattactgcacaaacccttcgtgagatgcgtctgcaagccttgcgtctcctgcggcgtcgaattcgacaggccgccagccatctcagtatttctgatctgctcgttccaacgccaccggggttgattgaccagattcggcggttgtcgagtggtttaggtagtcgtggtgcgcaggcagtggcgcgtaaccccaatgaaccgtggcggcaggcgctgaacctgatgctggctcgtctgccaatagacgatgcgccggctgaagcagcacggctggtcgacgatcctgatcgttatcgttgtgccgatgaactgctcaatgatctgcgcgagtttgccgggtatttacgtgcagtaggggccgggcgactggccgatgccgagattcgtccattgatgcaactggttgacacctttggctttcatctggctacacttgatgttcgccagaacagccagtttcatgatcgggccctggcgcagttattggaagctgctggcttgtcgtctgacgatctgattggtggtgatcctgagcgacggcgggcactgttagaacgcgaggttgcttcaccacggccatttgctcaccccaacacaccgcttgactatgaggcagcggcagtcgttgacagctatcgtgttcttgccaatcacattgctcgctacggtacagccggccttggtccgctcatcatcagcatgacacgcgatgtaactgatgtcctggtcgtgtatctgctggcgcgtgaagccggtctggcatatgctaccccagagggtctggtgtgtcgattgccggtcgttccattgtttgagacaatcgaagatctcgaacatagcccccgcattctggctgatattctcgaccacccggtgacgcgccgtagtttgatcgcccaggctcagggtggggagttagtgcagcaggtgatgattggctatagcgatagcaacaaagacggcggcatcctggccagtcaatgggcattgtatcaggcccagcgggcaatgacagaagtgggacgggcacgtggaatacggattcgtttcttccatggccgtggtggcacgatcagtcgtggcgccggacccaccagccgcttcatctcaatgctgccaccgggaagtttgaatggtgatcttcgtcttaccgagcaaggcgaggtcatttcgcaaaagtatgccaatcgccttaccgctgcgtacaacctggaactgctcattgccgggacaaccaagcatacattactccagcaacggcaacccgaagagccgcatccgctggagccggtgatcggctggctggctgagaagtcacgtattgcctaccgcgaactggttgaacgcgatggcttcattaccttcttccgtcaggccacgccgattgatgtcattgaacaaagccggatcggctcacgtccatcgcggcgtaccgggcaggcgacgctggccgatctgcgagccatcccctgggtctttagctggaatcaggcccgcttttatctgccgggctggtacggggttggtagtgcattgacggccttgcaagaacaggaaccggcgttatgggagcaactgcgtgcagagcagtggcggtggccgttattgcgttacctgctggccaatgttgggacgagtttgcaaacggcacaccgcgagacaatgcatgcgtatgccggcctggtcgaagatgacgagatacggcgacaattcctcaacctgattgatgcggagtttacccgtacagaagcggcattgacagctattttcggtatgccgattgagcagcggcgcccacgggttaccgcgacactggcccggcgccaaattggcctggcccctctgcatcgccggcagatagagctgctgggtcggtggcgtgcccagcgggcggctgatgatccggcagccgaaaccacattgatcgatctgctactgctggtcaacgcgattgcagccggcctgcgcacaaccgga

SEQ ID NO: 32792 - DNA, 870 bp, Chloroflexus aurantiacus
gtgagcattctgatcgatgccaacacccgactgttggtacagggaattaccggtaaagagggtgaatttcacacccgccagatgatcgagtatgggacaaatgtcgttgccggcgtcgtccccggacgtggtggtcagaaggcgattgatggccgagtgcctgtcttcaatacagtagcggaagcagtcgctgcaaccggcgccaacactgcggttatctatgtgcctgcaccctttgcgcccgatgccattcgcgagtcggcagccgcccgtattccgctcatcgtgtgtattaccgagggcatcccggcactcgatatggtcagtacctacgcctttgtgcaagagtgcggcgtgcgcctgatcgggccgaactgtcccggcttgcttacgccaggagcagccaaagtgggcatcattcccggtaacatcgcgatgcccggcccggttgggatcgtgagcaaatcgggtaccctgacctatgaagcggttgatgcgctcacccggctgggcattgggcagagcactatcgtcggcattggcggcgatccgattatcgggacaaatttcattgatgtattaagcatgtttgaggctgatccacaaactgaggcgattgttctgattggcgaaattggtggtaccgccgaacaagaggccgccgcttacattaaggcccatgtgacgaagccagtggtaggcttcattgcgggccagacagcgccgcccggtaaacgcatgggacacgccggtgcgatcatcagcggtggcgaaggaaccgcccaggaaaagatcgccgcgctggaaagtgttggggtgcgcgttgcccggatgccaaccgatattgccggcctggttaaagaggcgctt

SEQ ID NO: 32793 - DNA, 882 bp, Chloroflexus aurantiacus
atgacgcgatttgatgctatcggcgtgggaattgccagttgggatcttgtcggcgtgactgcaacgtcaccggtgttaggtcagaagcaaccgcttgccggatatacggagatgggtggtgggccggtcgcgactgcgctggcgaccatggcccgtttcggtgctcaggtagcgctggtcagtgctgttggcgatgatcactacggtatggcgatcaaggccgagttgaccagattcggggttgacacctcgttcgttgtgaccggtcgtggctcttcgcatattgcgttcgtgttggccgaacccgggagtgatcggcgaacggtatggtggtacaacgagccgacggtgtttgccgatctctcatttcctgccgaactggcaggacaaacccgtgcgttgttgattgactctcacctaccggcggctctctctgcggctcgtcaggtacgggctgctggaggacgaataatgattgatgccgagcgggtcaatccaacagtgctggaattactaccactctgtgatgatattgtcgtctctgccaattttgcccgtgcagtcaccggcctttccgacatagtaatggcaactcaggcattggctgaacggtatcgtacactggttgtcgttaccgccggtgaagccggtagctgggcctgtcacaatggtgaactcattcacacgccggcctttcccactacgccggtggacacaaccggttgtggtgatgtctttcacggtgccttactgttcgcgttgttgcgcaatgatccattgccggcagccttacgcttcgccagcgcagcggctgcgctcaagacacgcggactcggtggtcgaactgcgttaccatcgctcgccgaggttgaggccttggtt

SEQ ID NO: 32794 - DNA, 1012 bp, Chloroflexus aurantiacus
atgctagtagtcatggaagcacatgccacggcggagcagatcgaagcggtctgcgctgaaatgccgggcgatgggattcactccacatccgatgcctgggccaacacgcacagccatcggaattacaggaaatcaaggcccaattgaacaggccggacgattacaacggttgcccggcgtgagtcaattgatccgggtcacagcaccctacaaacgggtgagccgggaattcaaagagctggacaccgttgtcgacgttggtggcattcccatcggtggatcgggcattaccatcattgccgggccatgtacggtcgaaagccgcgaacagaccttcaatgtagcaagagcggtacaggccgccggtgcagtcatcctccgtggtggggcctataaaccgcgcacctcaccctattcctttcagggattgggggaggccggcttacaaattctggctgaagcacgggcgttaaccgggatgccggtggtcacggaagtgatggacaccgagacactaccgctcgtcgtgcagtatgccgacatgctgcaaatcggtgcgcgcaatatgcaaaactactcgctgttgcgggcagttgggcgtacccgccacccggtactactcaaacgcggctttgcggctaccgtgaaggatttgttgctggcggcagagtatattctggccgaaggtaacccaaacgttgttttgtgtgaacgaggtattcgcacgttcgatgacagtctgcgctttacccttgatctgggagcggtgcccttgatcaagcagctttcgcacctaccggtcattgttgatccgtcgcatgccagtggtcgggccgacatggtgattccgatggcgcgagctgccattgctgccggcgctgatggtttgatcattgaggtgcatgacaatccagcttttgccgtttgcgacgggacacagtcactggtgcctgagagttttgccgatctgatgaagcaattgcatcgggtagcagcagccatcgagcgacct

SEQ ID NO: 32795 - DNA, 453 bp, Chloroflexus aurantiacus
atggaacgtgcactgttaatcttgaaacctgacgccgtacaacgaggattgatcggcgctatcatcagccgctttgaacagcggggcttgaaatttcagggcctcaagctgatgcaggtcgacgaggctctggcgcgccgccactacgccgagcacgaaggcaagagcttcttcaacggtctggtcagctacatcacctctgcaccggtcgttgtggcagtcgttgccggaaagccgggcaccgtggagctggtgcgggcaatggtaggcgccacaaatccggccaaagcagcaccggggacgatccggggcgactttggagtagacattggtcgcaatctgattcacgcttcggactcgccggaaagtggtgagcgcgagacagcgatcttcttccaaccgcacgagctaattggcgagtggaatcgtgcgctcgacaactggatctacgaa

SEQ ID NO: 32796 - DNA, 735 bp, Chloroflexus aurantiacus
ttgagtgggcgagtcgcaattgtcaccggtggcagtcgtgggattggccgggcgactgccgagcggttggccggcagcggcgccgccgtagtcgtcaattatcgcgggaacgcagcggctgccgaagcgacggtggccgccatcactgctgccggcggcaccgccatcgccgtgcagggtgatgtcagtcaaccggcagatgtagagcagatggtcaagaccacccttgaacggtttggtcggatcgacattctggtcaacaatgccggcatcacccgcgacacgttacttctccgcatgaaggaaagcgacttcgatgaggtgatcgccaccaatctgcgcggggtctttctctgcacccgcgccgttctccgcccgatgaccaaacagcggtttggtcggatcatcaacattacatcggtggttggcttgaccggtaacgttggtcaggctaattacgctgcggcaaaagccggtattctcggcttcaccaaatcgacagcccgcgaaatggcgagtcgggggattaccgtgaatgccattgcgccgggcttcatcgaaaccgagatgaccgaggcgctcaacgaagaggcgcgcaaggcgattctggcaactatcccgctcggtcggtttggccagccggctgaagttgcgggacttgtctgtttcctggcctctgatgccggcgcatatatcagcggtcaaacgctgactatcgacggtggaatggtgatg

SEQ ID NO: 32797 - DNA, 1356 bp, Chloroflexus aurantiacus
atgattcgcaaagtattagtagccaaccgcggtgaaattgctgtacgtatcattcgggcctgtcaggagttgggcattcgcacggtagtcgcctacagcactgccgaccgcgactcactggccgttcgtctggccgatgaagcggtatgtatcggcccaccaccggcagcaaagtcgtacctcaacgctccggctctcatcagcgctgccctcgtatcgggatgtgatgcgatccatcccggctacggttttctctcagaaaacccctactttgccgaaatgtgcgccgactgcaaactgaccttcatcggtccgccgcctgaaccgatccggctgatgggtgataaggcgattggacgtgagacgatgcgcaaagccggcgtcccaaccgtccccggctctgatggcgaagttcgctcgctcgaagaggccatcgatgtcgcccgccagatcgggtatccggtactgctcaagccctctggcggtggtggtggtcgcggcatgcgcgtcgcttacgacgaagccgatctccagcgcgccttccccactgcgcgtgccgaagccgaggcagcgttcgggaacggtgcgcttctactggaaaaatacctcacccgcgtgcgccacgtcgaaatccaggtcctggccgaccagtacggtcatgccatccacctcggcgaacgcgactgctcggcgcaacgtcgtcaccagaaaatcgttgaagaggcgccatcaccggcagtcacccccgaattgcgcgagcggatgggggccgatgctgtgcgtgggatcaaatcgattggctatgtgaatgccggcacgctcgaattcctgctcgatcaggacggcaactactacttcatcgaaatgaacacccgcatccaggttgagcatcccgtcaccgaacaggtgaccggaatcgacctcgtgcgctggcagctactcatcgccagcggcgagcgcttgacgctgcgccaggaagacattaaaataacccggcacgcaatcgagtgccggatcaatgccgaagacccggagcgtgactttttaccggcaagtggtgaagttgagttctatttgccgcccggcggccctggagttcgagtcgactcccacctctattccgggtacacaccacccggaacctacgactcattgttggcgaaaattattacctttggcgacacacgcgacgaagcgctcaaccggatgcggcgagcgctcaacgaatgcgtgattactggtattaaaacaaccatcccgttccagttggcgctgatcgacgatccggaattccgggcaggtcgcattcataccggttacgtggctgaattactgcgccaatggaaagaaacactc

SEQ ID NO: 32798 - DNA, 213 bp, Chloroflexus aurantiacus
atggaagagcgcctgcgcaagattattgtcgatcagctcggtgtcgagccagagcaggttgtaccttcggcatcgttcaccaaagacctgaacgccgactcactcgatctggttgaattgattatgtcaattgaagaagagttcggcgttgagatttcggatgaagaagccgagaagattcagaccgtcgctgacgcgctgaattatctcgaa

SEQ ID NO: 32799 - DNA, 2424 bp, Chloroflexus aurantiacus
ctctacagcaaatttaccaagcgcgccaagcaagtgctgcaactggcagccgaggaagcacgtgcgttcaatcacccatacattggtaccgagcatattttgctgggcttgatccgcgaaagtgaagggattgctgcgcgcgtcctcgatgagctgggtgtgaaattgccccaggcccgtagtgcggtcgagtttatcgttggccctggcgaaagcacaatggttaccgaccaggagctgacggcacgggcgcagaaggtgattaagtatgctatcgaagaggcgaatcgcctcaaccatcactacatcggcaccgagcatctgctgctggggttggtgcgcaacggtgagggggtggcaaccggtgtcctcgatattctcggtgtctccctcgaacaggtgcgcaatcaggtaatgcgtgtcttgcgccacggcacagccggcgcaactgctgaaggacggactgctcccggtacgacgccgacgcagcggcagtcgaagaccccgtatctcgacgcactgggtaccgatttgaccgagatggccgagcagggtcgtctcgaccccatcattggccgccaacacgagatcgagcgcgtcattcagattctctcacgccgcacgaagaacaatccggccctgattggtgaaccgggtgtcggtaagacagccatcgtcgagggcctcgcccagcgcatcgttcagggtgatgtgccagatagcattaagggcaagcgagttgttacgctcgacatgggtgcgctggttgccggtaccaagtaccgtggtcaatttgaagagcggttgaagcgcgtgatcgacgagatcaaggagtcgcgctgtattctctttatcgatgagttccacaccatcatcggtgccggtggcgcagaagggacgctcgatgcggccaacatcctcaagcccgctctgtcgcgtggagagttgcaaaccatcggggccacaaccctcgatgagtaccgcaagtatatcgagcgtgacgccgctctggaacgccgcttccagccggtgatggttgatgagccgtcgattgaagataccatccagattttgcgcgggatcaagtcgcgctacgaggatttccatcagttgcagatcagtgacgaggcgatccgggcagcggcagtactctcggcacgctacgtccctgaccgccagctccccgataaggcgattgacctgattgacgaagcggcgtcacgggtacgcatgtaccgctcggcgacaccgccgcgcctgcgcgatgccctgcgtggcctggaggcgctgcgcaaagagcgcgaagccgccctcgaagatcagcagtttgaacttgccaacgatctgcgcgagcgcgaagagcgtatgctcagccgcatccaggagatcgaggccgagctgggtacccgcagcgacgaacgctacgagcgcccatacgtcaccgaagaagacattgccgaggtcgttggcatgtggacgggcgtgcccgtgacccggctgaccggtaatgaaacccagcgcctgatgcagatggaggagttcctccatagccggatcgtcggtcagcacgaagccatcgtcaccatctcgaaagccgtgcgtcgcgcccgtgccggcctgaaagacccgaagcgcccaatcggaagcttcatcttcctcggcccaaccggtgtcggcaagaccgagctggccaaggcactggccgagtttatgttcggcaccgaagaggcgctgatcaagatcgacatgtcagagttccaggagcgccacacgacctcgcgcctggttggctcgccgcccggctacatcggctacggcgaaggtggtcaactgaccgatgccgtgcgccggaagccgtacagtgtcgtgctgtttgatgaaatcgaaaaggcgcaccccgatgccttcaacctgctgctccaggtgctggaggatggtcatctgaccgatggtaaagggcgacgggtcgacttccgcaataccatcatcatcatgaccagcaacgtcggcaccgaacacattcgccgcgcatcgcggattgggtttggtagcaacgccgccgagatcgatcagaacgatatgcggcgcaaggtggatgaagcgctcagaatgctcttccggccagagttcctcaaccggatcgacgcgaccatcatcttccacccgctcaccaccgaggagattcaatcgatcacccggctcatgctcaagcgtgtccagacccagctcgacgagcaccagatcaagctggaggtgcaacccgacgccctcgaattcctggcccgccgcggctacgatccggcgttcggtgcccgccccttgcgccgggtgatcaccaacctgatcgaagacccgctggcggaggggctgctctctggtcagttccgcgacggcgatacagttatcgtcgatacctttgaggat

SEQ ID NO: 32800 - DNA, 708 bp, Chloroflexus aurantiacus
gttgagtgccgtgatctgaccaaacagtacggtacattcactgccgttgacggcctcaatctgactgtgcgtaaaggtgaaatttttggtctgctcggcccgaatggtgccggtaagaccaccacgattctgatgctgctcggcttgactgagccaaccagcggtagtgtgcgggtgttgggcttagacccggcccggcaaccgttgagtgtcaaggcgcgggttggctatctgcccgaccaggttggcttttacgataacctgacagcacgcgaaaatctgaactacatcgcaaagctgaatggcatgcgtgagccggagatgagcaagcgtattgccacagcgcttgagcaggttggtctgagcaatgttgctgatcggcgggtgaagaccttctcgcgaggtatgcgccagcgtttaggggtggcagaggtgctgatcaagcaaccacaactgatcattatggacgagccgacactggcgctcgacccggaggcagtgcgcgaattcctcgacctgatccggaaattgaaggagagtgggattacgatgctgctctcatcccacttgctgcaacaggtacaggcggtatgtgatcgggttggcctgttccacaaaggccggatggtgttggaagggacagtcagtgagctggcgcagcgcgtgcttggtggagcctaccgcattcacctggaggtagagggcggt

SEQ ID NO: 32801 - DNA, 1732 bp, Chloroflexus aurantiacus
aatttggaaaagatttggttgtcgtactacgagccgggtgttccgcctacgctgacgtatcctgagattacgctcagcgatatgttgagcaacagtgccaaaacgtatgccgaccacaccgctaccaatttcgtcttgcgctacttgctcggtggtcgcttcacggttggcgggaagcttacctatcgacagttgaacgaaaaagttgatcggatggcaacggcgctctaccagcttggggtacgtaaaggggatcgggtggcggtgatgttgcccaattcgccgcactacattatcaccttctttgcctgtatgcggttgggggccatcgttgtcaataccaatccgacgtacaccgggcgcgagttgcagcatcagttgcacgattcgggtgccgagacgattgtgttgctcaatatcttctggccccggctgcgcgaagtgcgtgccgagacgccggtaaagcgggtgatcgttgcccacgtcttcgataccctgggcttcccatccaatttgctggtgaagagtgcgcaaaggaaaactccggagtgggttgatgtgatgccagagcaggatatcttcttcttccaacacctgcttgagaagtatggcccaaccccaccgcgggttagtgtaacccctgatgatattgcgctcttccaatacaccggtggtactaccggcctgcccaagggccgcgatgttgacccatcgcaatctgatcgccaatacggtacagattgcagcctggttgacccgcggcgaacccggtggcgagaagatgatggccgccatccccttcttccatgtgtatgggatgacggtggcgatgatctacagcatccacatgggcgccgagattgtgattgtgcccaacccgcgcccaatcgataatgtgatgaacgtgatccagcgcgaacgctgcacgctcttccctggggtgccggcaatgtatatcggcattatcaatcaccccaaggtgaatgaatacaatctgcgcagcgtgaaggcctgtatcagcggttcggctccgctgccgatggaggtgcaggagaagttcggtcaattgaccggtggccgccttgtcgaagggtttgggatgaccgaggccagcccggtaacccactgcaacccggtcttcggcgagcgccgcgccggtagcatcggaattccggtgcctgataccgaagcaaaggtgatcaatctcgataccggtgaggagatcgaaccgggcagcgacgagacgggcgagctatgtgtgcgtgggccacaggtgatgaaggggtactggcagcgccctgaagagactgctcagaccatcgatgccgatggctggctgcacaccggcgatattgcccgtgttgacaaggatggctacttctacatcgtggatcgcaagaaggatatgatcaatgtcggtggcctcaaggtgctgccccgcgatgtcgaggaagtcctcttcatgcaccccaaggtgatggaggccgtcgttgttggtattccgcatccgcagcgtggtgatgatacggtgaaggcctttatcgtgccgaagccgggtgaaaatcccacggctgaagagatcaaggagttctgtaagctgcaccttgcaccgtataaggtgccacgcgaggttgagttccgcagcgaattgccgaagacgctggtcggtaaggtgctgcgccgggtgctggttgaagaagagaaggccaagcagaaggcggcaatggcaacc

SEQ ID NO: 32802 - DNA, 1007 bp, Chloroflexus aurantiacus
atgaaagccgctgtggttcacgacttccatcaaccattgcgcatcgaggaagtcccaagccggagccgggttttggtgagattgtagtcaagatcgaggcatcgggactctgtcatacagatatacacgcagcgcatggtgattggccggtaaaaccaaaactcccattcattccggggcacgaaggaataggcattgttgaaagcgtcggtgcaggggtaactaacgtaaaggaaggtgatcgtgttgcaatcccctggctggggtacgcctgtggcgagtgtaaatattgtgcttctggatgggagacgctttgtgagcgtcaactgaatactggctatttccttgatggggcgcatgctcagtatgcaaaagcgtatgcgaagtatgtgggtattgttccggctggggtttctgcccttgacgccgcaccgttaacctgtgctggcgttaccacgtacaaagctgttaaggtctccggagctcgtccctcggagctggtagctatctttggtgttggtggattaggtcatctggcattgcagtatgccagaatcgccggggccacggtagcggctattgatctcctggatgagcgattacagacagcacgcgaacttggtgccgatattaccatcaatgccagcacccaggaccccattgaagaattgaagaagtggggcggtgctgatgcagccatctgtttagctgtttcaccgaaggcttttgagcaggcttatcgatcattgcgacgtggcgggcgactggttttcgttgggcttccggctgataacatgattcagttgccaatcttcgagacagtgctcaacggtattcatgtcatgggttcgattgttggaacccgcgccgacctggcagaaacatttgcgttacatgccgcgggcaagacgcgagtgctctttgagacgcgaaagctggatcaggtaaatgaagctttcgaggaggttgagcacggacgtaataaggcgccacgaatcgtcttctcc

SEQ ID NO: 32803 - DNA, 1194 bp, Chloroflexus aurantiacus
atgaacaagaagaccatccgtgatgtggattgggccggaaaacgtgcgctggtacgagttgatttcaacgtgccactcgatgatcagggtcagattaccgatgatacccggattcgggcggcattaccgaccattcgctatctgctggaacacggtgccagtgtggtcttgatgtcgcacctggggcgtccgaagggtaaacccaatccgaagtacagtttacgtccggttgttgagcgtttgtttgaattgctgcccgaagcgaaagaggtcaagaagaccgaggcgatcaccgggccggcggctgaagcggctgtggcgatgctgaaaccagggcaggtcctggtactcgaaaacacccgcttcgatccccgtgaagagccaaacgatccagcgatggccgctgaactggcgaaattgggtgatgttttcgttaacgatgccttcggcaccgctcaccgggccaatgccagcactgagggtgtagcgcactacctgccggcagttgccggttttcttatggaaaaggaactgacgtacatcggtggcgccctgaataatccgcagcgtccattcgtaaccgtcatcggtggtgcgaaaatcagtgacaagatcggcgtgatcgaaaatctgctgggtaaggtcgatgcactgctcattggtggtggtatggccaacacctttctgcttgccaaagggctgaatgttggtgattcgctggtcgaaccggacagtgtaccggtggcccagcagttgatggcccgtgctgaagagcggggtgcccggctgcttttgccggttgacgtggtgattgccgatgcgtttagtgccgatgcccagcgccaggttgttgatgtaagtgacattcctgccggctggcgtgtgctcgatattggccccaagaccatcgaacgatacagtgccgagattcgggctgcccgcacggttatctggaatgggccaatgggtgtctttgaactagagccgtttgccgtcggtacacgcgctatcgcccaggcaatggccgaagcggctgccaatggcgcaatcacaattgttggtggtggcgatagtgtggccgcagtggaacaggccggcctggccgataagatgtcgcatgtgagtaccggcggtggtgcctcacttgagttacttgagggacgagtcttacccggtgtggctgcgttgcaagat

SEQ ID NO: 32804 - DNA, 948 bp, Chloroflexus aurantiacus
ccgctcgaataccgtgatcttccggtgccaacaccacagcccgaagaggtcttgattcgggttgaggcgtgtgctgtctgtcgtaccgatcttcatattatcgatggggaattaccagcgccgaacctgccacttgttccaggtcatcaaattgtcggtactatcgagcgtctcggcgagcgggtcacacgctggacggttgggcaacgggttggggtgccctggctgggctggacgtgtggcgagtgccgtttttgccgtgatgggcgcgaaaatctttgcgatcaggcgcagtttaccggctatacccgacccggcggctttgccgaatataccgttgccgatcaacgtttctgctttgctctacccaccgactacgacgcaaccgcagttgcaccgttgctctgcgctggtctgatcggatatcgggcactccgcctggccggtactggcgagcgactgggtatctacggcttcggtgccgcagcacacctgatgacgcaggttgcacgctggcagggtcgcgaagtcttcgccttcacccgtcccggtgatactgaagggcaacgttttgcccgcgaattaggcgcagtctgggccggcagttcaaccgagctgccgccggtgccactcgatgccgcaatcatctttgccccggtaggcgatctcgttccgtatgcgttacgtgccgtcgagaaagggggcgttgtcgtctgtggcggcattcatatgagccagattcctgccttcgcctacgaattgctgtggggcgagcgcgtattgcgctcggtcgccaacctaacccgtgaggacggcgaggcattcctgcagatcgcgccacaaatcccggtgcggacaaccgtccagacctttccactcaccgaactgaacacagccctgaacgcactccgccaggggaagttacagggtgccgccgtgatccagatt

SEQ ID NO: 32805 - DNA, 687 bp, Chloroflexus aurantiacus
gaagtcgtgcttattaccgggagcagccggggcattggtcgcttcctggtcgaacactttctggcacggggagcactggtcgaaggttgcgcccgcaatcctgtcgactgggaactacccggctacacccaccaccaggttgatgtcgccaacgagggacaggtcaaggcgatgatcagttcgatccaacgccggcatggtcgcctcgatattgctatcaacaacgccggcattgcggcgatgaatcacgcgctccttacaccgagcgaaacggccggtcgcattctcaacattaacgtcctgggcagttttctggtctgtcgggaagcagccaaactgatgcgtcggcgcaactatggccgcatcgttaatttcagtaccattgctgtgccgttacggcttgagggtgaagcgctgtacgccgcatccaagagcgcggtcgagaccatgacccgtatcctcgcccgtgaatttgcacccttcgggattaccgtgaacgcgattggcccgacgccaatcgagaccgatcttatccggggcgttccgcaggaaaagctccagcacatcatcgatgcactcgcgattcggcggtttggcacctttcgcgatgttgcgcatgtgattgatttcttcgtcaacccggccagtgattatgtcaccgggcaggtactttaccttggtggtggt

SEQ ID NO: 32806 - DNA, 1416 bp, Chloroflexus aurantiacus
cctgactggctggctcgcagagccgcattgcatccacaccgtccggcactgatctacgccggcacaacatacaccttcgccgaacttgatcgctgggccggtgcagttgcatcccacctgcgccaactggttacacccggcgcacgagtcgccctactgtcgcgtaatcgccccggctttgtagccattgtccacgccgcaccacgcacagcaatcaccctggtgccactcaatacccgcctcacagcagccgagctagcgttccaaatccaggacagcgacccggcattgttgatcatcgaacacgacctgctaccggtcgcacgcgaagcggcgggtaaccgtcccctgatcgtactcgaagaactcaccgccgcaacgacagcaccgacggcaccggcacctccaattgacctggacgcaatgcacaccatcatctacacctccggcaccactggccgcccgaaaggcgcaatcctgaccgccggcaaccactggtggaacgccatcggttccatgctcaaccttggcctgcacgaagatgatcgctggctggcagtactcccgctgtttcacgtaggcggcctgagcatcctgctgcgcggtgctatctacggcataccggtgatactccacgaacgcttcgatccggcgctggtacggcacgacctcgacgcacagcgcatcaccattgtctcactcgtcgccgtcatgctccaacggctgcttgccatcgaccccagccccttcccgccccacctgcgctgcgtcctgctcggtggcgggccggcaccacagacactcctcgaacaatgtgccacccgtggcattccggtaacccaaacctacggcatgagcgaagcggcatcacaggcggcaaccctctcccccgccgagtcgctaatccgactcggttcagccggcaaaccactgctaccggtcgaactatccatcgtcaccccatccggtcaaccggcagcacccggcgaagtcggcgaaatctgcctgcgcggcccaaacatctcgccgggatacctcggcttaccgcctcgatcccccaccgactggtttcacaccggtgatctaggctacctcgaccaggaaggatacctctacgtcgtagaccggcgcagcgacctgatcatcgctggcggcgaaaacatctaccccgccgaaatcgaagccattctcctcagccatccggcaatcgccgaagcgggagtggtcggcttacccgacccggaatggggccagcgcccggtggccgccatcgtcgcccaacagcccaccactgccgaagaactcatcgcctactgccgtagtcgcctggccggctacaaagtaccgcgcaccatcgtattcctgcacgaattgccacgcacggctgccggcaaattgcgccgccacgaactgcgt

SEQ ID NO: 32807 - DNA, 1566 bp, Chloroflexus aurantiacus
gtcattcttgatggcgaaagcctgaccatcgaacaggtactggccgtcgcttacggccagcccggtacccctgtcgtgcgcctggccccaattgcccggcagcgagtcgaacgggccgcgcaggcggtgcaagacttgctggcacgcggtgtggttgcttacggcattaccaccggttttggtgcatttaaagatcgggtcattgcccccgaccaggttgaacgcctgcaatacaacatcctggtcagccacgctgtaggggttgggccggtctttgatattcctaccacccgcgccatcatgctcattcgcgccaacacgctggcccgtgggcattcgggcgtgcgtttgcagacggttgaacgtctgcttgatatgctcaaccagggcatacatccccggattccctgcaagggatcactgggcgcgagtggcgatctggcgccactggcccatatggcgttgccgctcatcgggttgggcgaggtcgaatggcagggtgaggtattgccggcggcaacggctttggaacgactgggctggcaaccgcttcatctggccgctaaagaggggctggccttaaccaacggtaccgcggtcatgtgtgcgctgggcgtgatcgaaaccgcccgcgccgagaccctgagcgccactgccgatattgccggctgcctcagcttagaagcgctctacggcacaccggcagcgttcgatgcccgtttgcacgcactgcgccccttcccccgccagatcgaatgcgctgcccatctgcgccgcttactggccggcagcaccttcgtccgcaacaacgacccgcgccacgtccaggatgcctacaccctgcgctgcatcccacaggtacacggtgccgtgcgcgatgcaattgcctatgcccgttgggtctttgccattgaactgaatgccgtcaccgacaacccgctcctgttcgttgacgacgatggcaacgtcgaagtcatctccggcggcaattttcacggcgagccgctggcaatcgctctcgattacctgggcctggctgtagccgaactcggcaacatcgccgaacgacgcctaatgcggctcaccgatgaagcatccaacacccatgtcttgccggccttcctgaccagggccggtgggctgaattcgggcttcatgatcgtccagtacacggcagcggctctggctaccgaaaacaaagtgctcgcccacccggccagtgtcgatagcattcccacatcggcaaacgttgaagatcacgtcagcatgggtgtcactgccggcctgaaactgcgcagcatcatcgacaacgtcagccagattctggcgcttgagctattcgctgcggcgcagggcatcgacttccgccgccaggaactgggcagtcaggcccgactggggcgcggcaccgggccggtgtacgaactgattcgtcaatacgtaccattcatcgccgaagacaccctcctccacccctacatcactatcatcagtgaactcgtcgctcagggcaagatcgccgctgccgctgccgttcacgacgacgcggatgcgtaagcatcgctc

SEQ ID NO: 32808 - DNA, 924 bp, Chloroflexus aurantiacus
atcgtcgagcaactgctggcacgtggtgatcatgtgcgcgtgattggacgtggtgcctatcctgaattgcaatcactgggggctgagacctatcaggccgacctgaccttacctgagtcggcgccggtgctggcacgggcaatgcgcggggtaacgaccgtatttcacgttgctgcgaaagccggattatggggtagctacgacgacttctaccgggccaacgtcagtgccacccagcgggtggtcaaggcggccattcgggccggcgtgccaaaactggtctatacctcaaccccttcggttgtgattggacacgaggacatccacggtggggacgaacacctgccataccccaggcggtatcttgcaccgtatccgcacaccaaggcgattgccgaacggtacgtgcttgcccagaccgacattgcgacggtttcgttgcgtccacatctgatctgggggccacgcgatccccacattctgccgcggctgctccgacgcgcacgacggcgaatgctcttccaaatcggtgatggaacaaatctagttgacgtatgttacgtcgaaaatgctgccactgcgcacatccaggcagcttcagcgctgaacgaacgctcgccgctccgtggtcgcgcctacttcattggtcaggaacgtccggtcaacctctggcaatttatcggcgaaattctgaaagcggccaactgtccaccggtacgcggtcggatatcagcgtcagcagcaacaatcctggctaccggcttagaattgctttacaccatactccgccttcccggcgagccaccactcacgcgcctgatggtacacgaactcagccattcgcactggtttagccatgctgctgctgaacgagattttgggtacacgccgcggatcagcattgaggaaggtttagagcgcacg

SEQ ID NO: 32809 - DNA, 1332 bp, Chloroflexus aurantiacus
agacagagctttgccggtttacacgcggccagtgatcggctggcgtgggggctgacggcttatgggttacggaagggaatgcgggttttgctgatggttccggcgggtgtgccgctgatcagccttacctttgcgttgatgaaggccggttgtgtgccgattctgattgacccggcaatggggcggcggaatctggctcagtgcattgccgaagtcgaaccagaggcattcatcggggtaccgcgggcgcatctgttacggctgatctttccccgctcctgtgcgaccattagatatgccgtctcggtagggccagccttgcccggtgctgctgccttacgcgagcttgacataccgatgaagacagcgtttccgctggcggatatgcgatctgatgatccggcagcaattgtctttaccagtggtagcaccggtaccccgaaaggtgtgctctatacgcacgggatgtttgaggcgcagattcatacgctgcgcgatctgtttgggattgccgcgggtgaggtcgagatgccggccttcccgctcttcgccctgttcaatgttgccctgggggtgacatcggcaattccgcccatcgatccgacccgaccggcgcagtgcgatccggcagccgtggttgagtttatccgtgatctcggcgtaacatcgaccttcggttcaccggcaatctgggaaaaggtgacagcgtattgcctgacccacggtattcaactaccgtcgctccggcgggtgttgatggcgggagcaccggtgccaatccatctgcacgagcgtttgcatcgcattctatcacctacggctgatagctttaccccttacggagccaccgaagcgttgccggtaacttcaatcagcggtcgtgaggtactggcagcgcataccgaatacccctcaccactggccgggacatgtattggctatccggttcccggcgttgaggtcgcgattattccgatcaccgatgagccaattcacgcctggcaggatacgcaccgcttgccgcccggcgtcattggcgagatttgtgtgagtggtgccaccgtcacccatacctacgtcgggcggccccaggcgaccgcgttagccaaaatcagtgatggcaaccgcatctggcaccgcatgggtgatctcggttatttcgacgagcgagggcggctctggttttacgggcgtaaaagtcagcgcgtgattacggcgcatggaacgctcttcaccgagccggttgagcgcctcttcaaccagcatccggcagttgcccgttcggcgctggtggggatcgggaagcccggcacacaattgccggtcgtcgtt

SEQ ID NO: 32810 - DNA, 285 bp, Chloroflexus aurantiacus
acccgtcgctttgaattttcggcagctcatcgctactggcgcgatgattggagtgcggaagaaaatgagcgcgtcttcgggccgtacaccagcccatacggtcatgggcataactatacactcgatgtcagcattaccggtgagcttgacgagcgcaccgggatggtgatgaatatgaccgaactgaaggctatcgtgaatgaggtgctcgaagagtttgaccacaagcacctcaattacgatacaccttactttcgcgatcaagtgcccacgaccgagaatctg

SEQ ID NO: 32811 - DNA, 1212 bp, Chloroflexus aurantiacus
cataccacgcctaacggcatccgcgttttaatcgaagaactgccacacacccattcggttgcagttggttgcttcattgacatcggtgcgcgctacgaatcggcagaactggccggtgctgcccacttcattgaacatatgctcttcaagggagccggtgcctatccaaccgcccatgcgatctcgctggcaattgaggggattggtggctatcttaacgcttccactggctacgagacaactgttttttatgcgaaagttgccgctatccatttccaacgagcactgcacgtgttgagcgagatggtgcaacggccactcttcgatgctaccgaattagaaaaagagcggcgggtgattatcgaagagattcgcggcatccaggataatcccaccgagcttgtccacgaactgctgcaacgcacaatgtggggcgatcatccgtttggccgcgatattgctggaagtattgctaccgtcagcgccattgcccgccacgagctgttgcaatttttcgctcaggggtatcacgccgggaatctggtcgtatcggtcgccggcaagattgctgccgaagaggccattcccgccatcgaacgcgcttttgccgatctccctgccgcgcagcgtccggcggcaattgccgcgcctcccttaccgcaccagcccaaactcagcctgctcacacgtgacatcgaacagggcaacttttgccttggcatgcccggcgtctcgtaccacgatcctgatcgccgggcagtgcatgcgctcgacgccctgctcggtggcggtatgtcgtcgcgcctgttccagacgatccgtgaagaacacggtctcagctacaatatcggttcttatcacaacgaattttctgataccggtatgtgggttatttatgctggggtggagcctgatgcattgcgtgacgcggtggcaatgacccgcgctatagtgcgcgatgtggccgaaaacggccctacaaagcaagagctggcaaccgtgaaagaacagctcaagggcagcttgttactctcgctcgaagatacctggtcgattgcctcgcgtaacgctaccagtctgctgcgttatcaaatggtgccgccggttgaacagattattgccgagattgatgcattgagtttagccgatctccagcgtgctgcccgccggttactcactgccaatcaacagtggctggcggttgttggccca

SEQ ID NO: 32812 - DNA, 925 bp, Chloroflexus aurantiacus
ctgtcgcgtctcagccgggggcttggtgcattgccggactccgaacgcccactggtcggtcagcgggtcaatgactatgcgcgagcaactcgaagcagcgttcagcgctgcgaaagagcgcctggaagcacaggccgttgctgctgagctggacgccgagcgcatcgacgttacaatgcccggtcgtcgccctgccgtcggttatgtccatctgaccaaccagattctgcgccaggttcagcatatctttgccgagatggggtttcaggtttgggaaagccctgaagttgagtacgacgcattcaatttcagtttgctaaacttccccgatgaccatccggcccgcgatatgcaggacacgttttatgtcgagatgccggctggcgcaccttccgtactcttgcgcacccacacctcacccggtcagatccatgctatgcgccgcaatgcgcccaatccgctgcgcgtactcatccccggcaaggtctaccgcaacgaacaggtaacggtacgcagcgagatgatgttccaccagttcgagtttctcgcggttgggcggaatgtcacgatggctgatttgaagggcacgctcagctttttcgccgaacgcatgtttggtccaggcacccgggttcgcctgcgccccagtttcttccccttcaccgaacccagtgccgagatggatgtgacctgcttcctctgcggtgggaagggctgtcggatttgcaaatatgccggctggctcgaaattggcgggtgcgggatggtacatccaaacgtgctgcgcaacggcgggtatgatccggcagagttcagtggtttcgcgggtgggtttggccccgaacgagtagcgatgctcaaatacggtatcgacgatattcgctggttctatagcggcgaccaacgctttgttgaacagttcgga

SEQ ID NO: 32813 - DNA, 414 bp, Chloroflexus aurantiacus
ctcgtcttacatggccccaacctcaacatgttgggccggcgcgaaccacacatctacggcgccaccacactggctgaaatcaacgaggcacttgaacagcgcgggaaagctgcgggagtagaggttatctgcattcagtcgaaccacgagggagtgctggtcgacgccgtgcaaacccacggctggacggcaagtgggatcattattaatcccggcgcactcacccactacggcctttccctgcgtgatgcactggcgatggtatctgcgccgattattgaagttcatctctccaacgtctaccagcgggaagcatttcgccatacctcagtggtagccccgattgcccgtggtcagatcacaggtctgggctggcgcggttacctgctggccctggagtggttactcgccgag

SEQ ID NO: 32814 - DNA, 702 bp, Chloroflexus aurantiacus
cctgcgatgcacttgatgtgcgcttgagtaccgtcatggcggccaacatcgagaaactgcgacggcgttacccggagggatttagcagtgagcgaagtcagcagcgtagtgaatagaatccggcgggcgaccattgagcgggtgaccggtgagacaaacattacccttaccctcaccatcgatggtagtggacaggctgatgtgcagaccggtatcggttttcttgaccatatgctgacgttgtgggcacgccatggcttgttcgaccttcaggtgcgggcgcagggcgatctccacattgatgagcatcacactgccgaagacgtgtgtatttgcctgggtcgggccattgatcaggcgctcggtgagcgggccggcattgtacgtaccgcacacagctttgtgccgatggacgaagcactggcgctggttgctgtcgatcttggtggccgaccgtactgtgtggtacaggctgattttgttacaatgcgcgtaggacagctcggtaccgatctggtggcccatttgtttgagagtgttgccttcaacggtcgtttcaatctccacgcacaggtgatgtacgggcgcaacgaccatcacaagatcgaggctctgttcaaagcgttcgggcgggcactcgatgccgctacccgcattgatgcgcgtttagggggaaccataccgagcacgaagggtgtccta

SEQ ID NO: 32815 - DNA, 1149 bp, Chloroflexus aurantiacus
gaactgattcaagccgatcaccaatatctgttgcagagctatgtacgcgccgatttcgtcattgaacgtggcgaaggggtgtatctttacgatagtgaaggtcggcggtatctcgattttgtcgccggcattgcggtgaatgcgcttggctatggtgatcgtgacgttctgaaagcgatcaatgatcaggctgaacgcctcatccacgtttccaatctctaccacacgcaaccggcaattgaactggcaaagctcctggtgcagagcagcccggcgtttgccaaggcgtttttctgcaacagtggagctgaagcgattgagggggcgattaagttctcacgtcgctacgctcgtgcccatgttggcgaaggcaagacaacgattgttgccttcgacggcagttttcacgggcgtactatgggagcagttgccattaccgcccgtgaaaaataccgggagccgtttatgccggtgatgcccggtgtgcgctttgctcgctacaacgacctggactcactggcagccgtgatgggcgatgatgtctgtgccgtggtggttgagccggtgcagggcgagggtggcctgcgtgccgctgaaccggcctttatgcagggagtgcgcgaactgtgccagcgctatggcgcattgctggtctttgatgaaattcagtgcggggttgggcgtaccggcacgctctgggcacacgagcagctcggtgttcagccagacatgatgacggtagccaaaccgttagccggtgggctgccgattggtgcggtgcttatgggccaacacgttgccgataccattcatccaggcgaccatggcacaacctttggcggtaatccgctggcaactgcagttggcaccgtcgtgttccgcaaaattagcgatccggctttcctggcccatgtccagcaggtaagtaattatctcgatgaagcgttgcaggatttcgctaatgaacacgccgatcaggtgatcgaattgcgcggacgtggcctgatgcgtggtgtgcgcattgccggttctgcgagtgctgtacgtgaagcggctcatcgccatggtctgttagtcgctacggctggtgaagatgtcattcgcctgctcccgcccctgatcatcgagccgcagcacgttgatgaggca

SEQ ID NO: 32816 - DNA, 1290 bp, Chloroflexus aurantiacus
atgcctgtagttgcattaattggcgctcaatggggcgatgagggtaaaggccatctggtcgatctgctggctgcgcgggcgcggctggtcattcgctacggtggcggcaataatgccggacatacggttgtcaaccatcttggtacctttaaactgcatctggtgccttctggcatcttcgatccgggcatcgtcaatgtcatcggccctggcgtggtggtgaatccggaagtactcatcaaagagattgaggagcttgaagcacggggtgtttccacggctaaattgtttgtcagtgatcgcgcgcatgtgatcatgccgtatcacattcagctcgatcagttgcaagaggaagcacgcggtgaagggcggattggtaccaccggtcgtggtattggcccggcgtatgccgacaagatgagccgctccggcatccgaatgggtgacttgttgcacgaagagacgctgctaaaccggttgcgcacagtactggaagagaagaatcgactgctgaccaaactctacaatgcccgtccgctctcactgcacgatacctatttgacctatctggagtatgggcgacggcttgccaatcatatcaccgatgttcatccgatcatccaccgggcattagagaaggatctgccagtactactagaaggtgcgcagggtgcgttgctcgatattgatcacggcacatatccattcgtgacttcctcacctccaggtgctgccggtgcatgtcagggtagtggtattggtccgacgcatatcaattcggtgatcggggtggtaaaagcctacacaacccgcgtcggcgaagggccgttccctactgaagttgatgggtcggtggctgatgtgctgcgtcagatcggtacaccctgggcagaagttggcaccacaaccggtcggctacgacgggtaggctggtttgatgcggtgatggcgcgctatgcagtgcaggtaaacggcgtcgataccctggcaatcacgaaacttgatgtgctcgatggcctggagacactcaagatttgtacaggctataaactgcacgacgccctgttggaatatccccctaccacgacagcgctgtttgatcagatcgaaccggtttatgaagaactgccggggtggagtgaaccaacgcggcatgttcgtcgctttgccgatttacccgaagctgctcaggcgtatgtggcgcgcatttgccagttggttggtgcccgcctgggcattatttcggttggcccaggtcgcgaccagacgattatggtggctgatgtgttt

SEQ ID NO: 32817 - DNA, 798 bp, Chloroflexus aurantiacus
ttattgatcggcgacccggtagcacactcacgttcaccggcgatgcacaatgcggcactggcagcattagggattgcagctcgctatcgggcagtacagactactgctgctgaattacctgatcgtctcgccgcgctacgtcagcctcacttcctgggtgcgaacgtgacgttgccacacaaacaggcggtcatccccttactcgacgagatcgaaccggcagcagcgcggattggggcggtgaatacgattgtgcgtcagcctgatggcaggttgttgggtgtgaacacggatgctcccggtttactggccgatctggcggctgccggttggacaccggtcgaacaagaggttgtcatcctgggtgcatcaggggcagcgcgtgctgccactttcgcactggctgatgccggagtgaacggaatcacgattgttaatcggagcctgatgcgtgctattgatctggccgcagccgcagccgccaatcagccggctctgcgtattcgtgccttgtccctgagcgatccggcagtaacagatgtgattgcacattgcacgcttttgatcaatgccaccgccctgggatggcacgatgacgaaacgcctatcgctgacccaccggtaggggcacattgtctggtctacgatatggtctatcgagaaacagctctcttacgcgccgcagtcgctcgcggcgcacgggtgcgcgatgggcgtgggatgctggttgagcagggcgcactggcttttgagcgttggacaggccgtccggcgccacgtgaaattatgtggcaagcc

SEQ ID NO: 32818 - DNA, 1524 bp, Chloroflexus aurantiacus
catctgcttaccggttggccgccaccgcccgccaatcagcggcagagcggaatgccgctcaattcgccgcgtgcgctcaatccacaggtgtcggtattggccgaacaactcacgctgcgcgcgctggagatgaagccggcgaaccggtatcagcgggcaagcgagatgcgtagtgcgctggagacggtgcgcctgatggcgggcaggccaatgggggctacggcaccgattgaaaagccggttgcgccgtccgccaccgttcctgccgcacctccaccacaacccgcgacgattgccacggctgcaccggccacgacattaccaccggcaccaccaccaacgacgacggcagcaccggcggcaggagtagccgcgcccaccgctccgccccgcccgttgatcagtacctcgtgtctgctggcaatcgtcggtggcctggcagtggttgcggtaggggtgtgtgtgctgctggcggtgctggtgggtctgtacatgacgaatgcttcgttgtttggcttacccggtaatacggtcgcaacgcaatcgactgttgcgcctgcgccgacgacaaatgaagcgccggcggttgatttgttgcaacaggtcaacgcgattactcaaacggcgcaactgcgggaagatagtctgggggcagcggcttacagtcctgatggcttgctagtagcggtggcggtaggatcggcgattcagttgcgcgatgcttcctcttttctcgttcaggcgacgctgagcggtcacgagggcgatgtcagttcgctggcatttagccccgatggggcaattctggcttccggtgctcaggatgacccggtggtacggctgtgggataccggtactggccgtgaaattgcacaactccgtggacacagcgactggattcgctcactggcgtttagccccgatggtcgcttgctggcgtcggctagcgttgaccagacgattcggatttgggaagtgacaagcgggcagacaacagccatcctgcgtggtcacaccgatctccccggcaacgttgcgtttagccctgatgggcaatggctggcttcagcctcacgcgatggtacggcccggttgtgggatgtgagcagtggacagcagattgatgcttttagcttcagcgcaccggttgatcccacaactaacgcccccttctggctgaccggtatcgctttttctggcgatggccgccaaatcgcagttggctcagtcaatggcaatgtctatctgctcgatgcagcaaccggcaatgtccagcgcgagttgcgggggcatgatggttgggtagtaattcgcggggttgcgtacagtcctgacggtcgcctgctggccagcgcgagtcttgatggtagcgttcgtctgtggagtccgacgagtggtgctgagcgtggggtgttgcagcagcgtggtttgcgcttgcttggactgagctggagtccagatggcacccgcatcctctcgtcgagtgatatgggcgggaatctggtcatctgggacgtcgaatcc

SEQ ID NO: 32819 - DNA, 1422 bp, Chloroflexus aurantiacus
ttgattggcggcgaattcgtgcctgcgcagagcggaaagacctttgagcgtcgtaatccggcggatacccgcgacgtggtaggcatctttgccgatagcgatgagcgcgatgtgcacgcggctgttgaagcagccaaggcggcatttccccaatggagcaaggtaccggcgcctaagcgcggcgagattctgctccgggcagccgaactcttacaggcgcgcaaagagcagtacagtcgcgacctgacacgcgaaatggggaaaccgttgtttgaagccggcggcgatattgttgaagccatcgggatggcccaatacgccggtagcgaggggcgtcggatgcatggtgtgacgaccccttccgaattacccaacaagtttcagatgagtatccggcaaccgattggggtggtgggcctgattacgccgtggaacttcccgatggcaattgcatcctggaagatgctgccggcgattgtctgtggcaacacagtggtcattaaaccgggagaggatgcctcggtcagcacctacaatctggtgcaatgtctgatggaagccggcctgccccctggcgtggtcaatatcgtcaccggatacgggccacgagccgggcaaccactggttgaacatcccgatgtgccggtgatctcgtttacgggtagcactgaaaccgggcggctggtgtacgaattaggagcacgacggatcaaacgggtaagcctggagatgggtgggaagaacccgttgatcgtgatgcctgatgccgatctcgatctggctctcgatggcgtattgtgggccgcttttgggacgaccggccagcgctgtacggcaaccagccgtctgatcgtccatcgtgccgtggctaaagagctggtcgaacggattgtagctcgtgcgcaatccttgcgggtaggtaacggacttgatccggcaaccgaaatgggtccgctggtcaacgagaagcagttgcagcgtgtgctgaactacattgacatcggaaagcaagagggggcaacgttgttgtgcggcggctatcgcctgaccggtggtgactacgattatggctacttcattgcgccaaccgtatttaccaacgtcacctcccagatgcgaattgcccgcgaagagatcttcgggccggtactgagcgtgatcgaagttgatagtctcgatgaggctgttgccattgccaacgatgtcgcctacggcctcagttcggcgatctacacccgcgacatcaacgccgcgttccgggcaatgcaggcgttgcaggccgggattgtctacattaacgcaccaacgattggcgccgagatccatctgccttttggtggtgtcaaagccaccggcaatggacaccgcgaagccggcccgaccatgctcgatgtcttctccgaatggaagagtgtgtacatc

SEQ ID NO: 32820 - DNA, 924 bp, Chloroflexus aurantiacus
atgcgcgttatgatcctgacagccggcctcggtactcgcctgcgcccacatacctttgtgcgtcccaagccattggtgagtgttgccggaaagacggtgttggctcacattatcgattatctggccccccttcagatcgacgaactgatctgtgtggttggttatctgggtaaccagatcgaagagtttatgcgggccaactacacctatccaatgcgcttccttgaacagaaggtaatgcgcgggcaggccgatgctattgctctcgcccgcgagctgaccgggccgctgctggtggtgttcggcgacgggttgctggagtttgatattgaacagctcaatcagcatcccaattacggcattatctactgcaaggaagttgacgatccgcgccgtttcggtgttgtggtggtcgaacaaggccgtatcgtgcggctggtggagaagccgagtgagccgatttccaatctggctgtggccggtatctattatgtaccagaggctgcccggctgatgtcagcgatcgactacattatgcagaacaacattcaaaccaagggcgagttctatctggcagatgctcttcaggtaatgatcgaccgcggtgaggaattacgtgctgaaacggtgcgaacctggtacgattgcggtacgatagaggcattactcgataccaatcgttatctgctcgatcacgggcacaatcaggctgctgagtatcccaatgccgttattgtgccgccggtgaatattgctccgacagcagtcatcgaacatgcagtcattggcccgtatgtctcgattgctgatggtgccgtcgtgcggcatgcgattgtccgcgactcgattattaacgcaggcgcacaaattcagtcggttattctcaatcgcagcctgatcggtgaccgtgcttccgttaatggt

SEQ ID NO: 32821 - DNA, 2436 bp, Chloroflexus aurantiacus
ctgaccgacattgcccgtactgtgctcaaaaagcgctatctgttgaagaatgagcacggtgatgtgatcgaaacccccgaaacgatgttttggcgggtggccgagaccatcgccgccgtcgatgctcgctacggggcgtcagccgagcaggtcgaggagcgtgccgaacgattttatcatctgatgacccagggctattttgaaccaaacagcccaaccctgatgaatgccgggcggccattggggcaattgagtgcctgcttcgtcctgcctatcgacgacaatctgaccagtatctacgagacgctcaaacatcaggcactgatccatcagagtggtggcgggaccggctttagcttctcgcggctgcgtccgcgcaacgatgtggtgcgcagtacgatgggggtggccagcggcccggtgagttttatggatgtctataatcactccaccgaggcgattaaacagggtggaacgcgccgtggcgcaaatatgggtattctgcgctgcgatcatcctgatattcttgagtttattacctgcaaactcgatacaacgaaaatcacgaatttcaatatctcggtggcgattaccgatgcgttcatgcgtgccgttgagcgcgacgaggagtatgacctgatcaacccgcgcaccggtctggggcagattgcgtcgcgtgatggtctcaagcatccgctcaccggcgaggtgctcgttcccgccggtcaaccgatgcgcttgcgggcccgcatggtcttcgatctgattgtgcagtgcgcccacgccaccggtgaacccggtctcttcttcatcgaccgggccaacgagtacaatccggtaccccaccttggcgaatacgaagcgaccaatccctgcggtgaacaaccgttgctggcctatgacgtgtgcaacctcggttcgatcaatctggggaaattcgtcaccgatgccggcaccattgattgggaatcgctgcgtgacgtggtgcatgagagcacccgctttctcgataatgtgatcgacgccaatcactatccgctcgaacagattacgcagctcagccagcggattcgccgcatcggccttggggtgatgggatgggccgatatgctggtgcgtctgggcattccgtacaattcagcgcaagcgattgatctggcgcgacaggtgatgcgctttatcgacgaagagagcaaagtggcgtccgagcagcttgcccgcgagcgtggtcccttcccggaatgggagtacagcatctggggacctgatgcgacctgcgcccgtcgccccgatggatcgcgcattcggccccaacgcctgctccgcaattgtaacgtcaccaccgttgccccaaccggcacgatcagcattatcgccggctgctcatccggcatcgagccactgtttgcgattgcgttctggcgctaccaggccgacacccgcatgctcgacatcaatcaggactttgtcgcccaggccaaacgtgagggatggtacagcgatgaactgatggagcggattgcggacaccggtcatatccatcacccggaagtaccggcctcggtgcagcgggtgtgggtcactgcccacgatattgccccagagtggcacgtgcgcatgcaggcagcgttccaggagtacaccgatagtgcgatctcgaagacgattaacttcccgcacgaagcaacccccgaccaggttcgcgaagcctacgagctggccttccgccttggctgcaaggggatcaccgtctatcgtgacggatcgcgcgcaaaccaggtgctctcaaccggctcaaccggtaagagtgcggagccggcgccggcctccgatcaaccggtggagctgaagccgcgcccggtcccggctgagggattgcccagccactccttccctgttgttacgccactcggcaaactgcgcctcttcgtgaccgagctggacgggaagccgttcgaggtctttgccatcatcgggcgcgccggcagcgatgttaccgccttcaccgaagccattggccgcctgatttcactcgccctccggtgtggagtcccggtgaaactcattgccgagcaactgcgcggcatcggtggttcgcgctcggcgggcttcggcccggatcgggtacgttcggtgcctgacgcaataggcaaggtattgctcgatcattacgtgaaaaacgggaacgggaatggcaatgggaatggcaacggtaatgggcatgactacgagtacggcaacggcgaaaccgatacgagtcggacgtacaccaatggagccagcgaggctacagccacaacaccggtaagccatccccatagcgatcatggtcacggcacaattgaagccgccgagatttgccctgaatgccagaatgcgaccatgctgaacgaagaagggtgtcggaagtgccactcgtgcggttatagcgagtgc

SEQ ID NO: 32822 - DNA, 671 bp, Chloroflexus aurantiacus
tgttgtgggcgactgacccggtggcggggcgctgctccagccgtggtatcacgtgctgaatgggttgccttacacgcgcatcatgtgtgtgtcgcgcggtgtggagtgcggcagccatgctgccgcgccagccgcgctctcgatccggcgcgtggcatactgttacccatcctggtcacgggggtgctggatgggatcgtgccgatcatcgcgtccgtcaggcatgcatgcgatccctgcgcgtagacgggtatgttgcaagagatttgtgcctgcgcaccagcggccacggccagccctgacggcggtctatgcattacccacaactggtgttaaccacgtgcgtatcagcgggtgtgtatcgctattggtgctggtttgagcgactggcccggtggcagtgcgctgctccagccgtggtatcacgtgctgaatgggttgccttacacgcgcatcatgtgtgtgtcgcgcggtgtggagtgcggcagccatgctgccgcgccagccgcgctctcgatccggcgcgtggcatactgttacccatcctggtcacgggggtgctggatgggatcgtgccgatcatcgcgtccgtcaggcatgcatgcgatccctgcgcgtagacgggtatgttgcaaaagatttgtgcctgcgcaccagcggccatggccagc

SEQ ID NO: 32823 - DNA, 1137 bp, Chloroflexus aurantiacus
ttggaagagttgcaagagcgcaatatgcgcgccggtcgcttgcgcttcaccgatgattatgccgtcggtattcccgatgctgagtttatcttcatcacagtcggtacccccatgggcgaagacggctcggctgatctaacgtatgtcaaagccgccgcacgtagcattggtcaatacttgcgttcgggttcaatcattatcgacaagagcaccgtgccggtaggcaccggtgatatggtcgaaaacatcattgccgagtatgccggacctgatgtgaagtttgatgtcgtgtcgaacccggagttcttgcgcgaagggagtgcgctgagtgatttcttcaagcccgaccgcattgtcctcggtgcgaagaatcgcgaggcggcacaacgggtagctgcgctgcatgaaacattgggcgcgccgattatcatcaccgatctgcgcacagccgagatgattaaatatgcatccaatgcctttctggcgacccgcatttcgttcatcaatgaaattgcgcaaatctgcgagcgtctgggcgctgatgtgcgtgaggttgctcgcggtatgggtgccgacaaacgcattggcccccactttctggaagccggcgttggctacggtggctcctgtttcccgaaagatgtgctggcgctgtaccacatggctgcctctgccggttgccacccgcagttgcttcaggcagtgatggacatcaacagcgatgcgcgcaagcggtttgtgaagaaggtcgaaacagtcctgggtgatctcgaaggccgcgttattggggtgctgggtctgtcattcaagcccaatactgatgatatgcgtgaggcaccgagcgttgatattatcaattccctcctgaagaagggggccagggtcaaggcgtatgacccggtagccatggcgcgtgccgaagagctgttgccaacagtaacctttaccgcgacagcgtatgatgtggcaaaagatgccgatgcgttgctgctggttactgaatggaatgagttcaagcagttggactggcaacgcatcaaacgctatatgcgccagccggtcgtaattgatggccgtaatctctacgatccgcgtgagatgcgcaatttgggcttcatctattggggggttggtcgc

SEQ ID NO: 32824 - DNA, 1091 bp, Chloroflexus aurantiacus
ccggcttctgatggattaccggtaggctggcggttgtcgcggactgagctgttggcgatgtttgcaatcgactcaggcgttgtttgaacggtacctcgcaggctaaggaggaaggaatgggaagccgcttcgacgagatgcggatttttgccggcaatggtaatctaccactggccagggccatcagtgagcgcctcggcgttccgctgggtgatgttaccattgtgaagtttagcaatgagaatatctttgtcaggcttaatgaaagtgtacgtgaaaaggatgtcttcgttattcaatcactgtcaatgcccgatctcagtgatcggattatggaattgctgattttactcgatgcctgtaagcgtgcctctgccgggcggattaccgctgtcattccttattacgcttacgggcgtactgataagaaagaccagccccgtgtaccgattaccgcccgcttgctggccgatatgatccaggttgccggcgcgcatcaggtgatgacgattgacctgcacgccgggcagattcagggctttttctcgatcccgatggatgaactgacagccatgaatctgctggtgcgctattttgccgataagggctggaacgatctgattgtcgtctcgcccgatgttggctttgccaaacgtgcccgcaacttcgccgaagccctgaatgcgccgctggcgattgctgaaaagcgccggctgcaacactttgatcggaaagacggttcactcaccgttccggaaattctgaatctgatcggtgatgtacgcggcaagcgttgtctgattgtagacgacgagattgccaccggtagctcgatcctcgaagtcgtgcagttgctcgaaaaggagggcgcgagcgagatttatgcctgctgcgtccacccggtgttcgccgggaatgctatcgagcgcctgcgggcaagtccgatccgcgagcttgtggtgaccgatacattaccggttgctccggaacgacgctggcccggcctgacaatcctctcggtcagtacgttgattgctgaagtcatccagcgcatccatagcggtgtgagtgtcgatacgatatttcaacat

SEQ ID NO: 32825 - DNA, 768 bp, Chloroflexus aurantiacus
ccgctcttgcaggtagccggcgcatacagtgatgttgggcgggtgcgcgatcacaatgaagatagcctgttcaaacttaccctctgcctggaaaacaacggtcaacgacagagctggggattgtacatcgttgctgatggtatgggtgggcacgccgcaggtgaagtagccagcgggctggcagtacggcatgcggcccagacaattattgactcgtatctgcaacaaatgctggccggccctcgtctgtatcacgaagccgacatgcaatcactggtacgtcaggcagtgctggcagcgaatgaggcgatttacaacgaaggccgtgcgcaggcaaacgatatgggttcaaccttaaccatggcgctggtggtcggtgatcgggcagtggtagctaacgtcggcgatagtcgcacctatctctttcgcgacggtaagctgcaacggatcagtcaagatcactcgctggtcatgcggctggtcgaacttggacatctcagcgaagacgagatctattcgcatccacagcgaaatgccgtcttgcgatcactcggtgatcgcgctgagccggagatcgatctgtttcaggttcacctgcgtcccggcgatgcgctcttgctttgttcagatggtcagtgggaaatgacacgtgatccggtcatggaacgtatcattactgaggaagccgatccacaagaagcctgcaaagcgctggtagcagcggcaaaccaggcaggtggtgaagacaacatcgcggttatcctggtg

SEQ ID NO: 32826 - DNA, 678 bp, Chloroflexus aurantiacus
attctgattaccggtgcttcacgcggtatcggtgcagctacagcacttgcattggccgggcctgacactcgtttaacgctggcggcgcgtgatcgtactgccctcgaagcggttgcccgacaggctactgcggctggtgcccaatgccttgtcgtaccgtgtgatgtcaccgatccagcccaggttgccccaaccgttgctcaggctgctggagaagggacacttgatgttgtggtgcatagtgttggtggggctttggtagcaccgctggccgacattgaacttcccgcctgggaagaacacatgcggactcagctcaccagtctcttcctggttgcgaaagcgactacagcccgcatggatcgcggtagcctattcatcaatattgcctcagttgccgctcgccaggcattcccaggctggtcggcatatgtagccgctaaacacggcgcacttggctttatggctgccatccgtgaagagctgcgcccacgcggtattcgtgtctgttcgatcctacccgccgccaccgataccgcgatttgggatgccatacccggtgactggtcgcgtaccaatatgctacaaccgggcgatgttgctgcggtcattgccgcccttgttgcacttccaccatacgcgacggttgaggatttgacgattggtcatgtcgcaggg

SEQ ID NO: 32827 - DNA, 2331 bp, Chloroflexus aurantiacus
ccggtcttgccactgctggacagtgttttgtttccgcagatgctggccccgctgtttgtcagtgatgagcgggcaatcaatgcggttgagcaggcagtggctgaggatcgcctggtgctggcggtggcggtgcgcggcccggttgatgagctgacgttaggcattgatgatctctacccggttggggtagaagcgactgtacagcgtgtgcgccgactgcccgatggtacactgagcgtcgtgttggaagggcgtcagcgcatgcagattgtcagtgtggtgactgaacatcccgccttgcgtgtgctggcgacgccgcttgaaacaccgccgctcgatgaggatgctgcgttgatggtcgaggcattgagccgtaccatcttgaccaccttcgagaagatcgttcgcctctcgcgcaatcttcccgatgacgcttacctgtcggcgctcaacagtgccgaacccggtgagctggccgatattattgctgcactgctgcctatctcagttgaagatcgccagcgtattctggcgttagctgatattcagcagcgcctgcgtcagttggagattctgcttgctaaagagttggatttactagagctggaaaatcgtattcatagtcaggtgcagcaagaggttgatcgcagccagcgcgaactctttctgcgcgagcaattgcgggcgattcagcgtgaacttgggcaggaagacccctcacggcgcgagattatgctcttgcgtgaacgggcggcggcagccggtttgcccgcccatgcgatggcccgctttgaagaggagctggcccggctggaactcatctcaccaatgtcgcctgaacacggcatgctgcgcacctatctcgactggctgatttcactgccgtggagtaatgccagccctgaaaaccgtgatctgcgagcggcagcggcagtgctcgaacgcaaccattatggtttgcggaaggtgaaagatcgcatcctcgaatacattgcagtgcgccaactggccgggccgtcgcggcgggcaccgatcctctgctttgtcggcccacccggcgttggcaagaccagtcttgggcagagcattgctgaagcactgggtcggcgctttgtacgcctcagcctgggtggtgttcatgacgaagccgagattcgtggtcatcgccgtacctacattggggcgatgccagggcgcatcttgcaacggatgaaagttgccgggacgatcaaccctgtctttatgctcgacgaggttgataagctgggcagtgattttcggggcgatcctgcggcagcattgctagaggttcttgatccggagcaaaacagcaccttcagcgatcactatctcgatctgccttacgatctcagtcaaaccctctttatcacgacggcaaatgttgctgacgacattcccgatccgttgctcgaccgcatggagctggttgagttgcccggctacaccgaagatgagaagctccatatcgcccgccgatttctcattccccgccagatgaccgacagcggtttgccgccggcaaccattcgtttcggcgatgcgaccattcacacaattatccgcaactacacctacgaagccggtgtgcgtaatctcgaacgcgagattggcgcgatctgccgcaaaattgcccgtcggattgcggaaggaagacgttacccccgtcagattacaccgcgtgcgttgccgaagctgctggggccaccccgctttgagattggcaagattgatcctcgcgaccaggtaggggtagcgattgggatggtctacaccagtgccggaggcgacatcatgccggttgaggtcgtcttgatggatggcaaaggcaacctcctcctcaccggtcagctcggcgaagtgatgcaagaatcggcgcaggcagcgctctcgtttgcgcgggcgaacgcgagtcgtttggggatcgaaatccgccatttcgacaaactcgatattcacgttcacgtccccgaaggcgctaccccgaaagatggcccttcagcgggggtgacgattgcgacagcgctgatttcggccttgaccgggcgaacggtacggcacgacattgccatgaccggtgaaattaccctgcatgggcgtgtattaccgattggcggggtaaaagaaaaggtgctcggtgcgtatcgggccggcattcgccagatcattctgccgcggcgcaacgagcacgatctggttgagataccggttgccttgcggcgacaactgaccattcacctgatagagcgcatcgagcaggcgcttgagctggtgttagggccgccaccgccgaaagagccgcgccgggcgcca

SEQ ID NO: 32828 - DNA, 369 bp, Chloroflexus aurantiacus
aacactccatccgatctacggtacagcaaaacccacgagtgggtacgacaggagggtgatgaggtcgtgattgggattaccgattatgcccagcacgcgctcggcgatgtggtgtacatcgaactgccggcagtcggctcgacgattaccgtcggcgagagcttcgggattgtcgagtcggtgaaggccagttcagatctgtacgccccagtaagtggcgaagtggtggcggtgaatactgcgctcgaaagcgatcaggcgccgatcaacagtgatccgtatggtgcgggctggatgttgcgcgtgcgccccagtggcgaatcggctgaattgctcgatgccgaggcgtatgctgcgtttgttgccgaa

SEQ ID NO: 32829 - DNA, 1197 bp, Chloroflexus aurantiacus
cgtgtggccctctttacgaatgagtacccaccgtatatttatggcggagccggtgtccacgtcgagtatctgagccaggcgcttagccggatggtaccggttgaagttcgttgctttggcgaccaacacgttgacacagccaacctgaaggtgcgcggctatccccgctgggaagaggcacgccagaataccgatccccgctttgccggtgcggtcgacgcagttgcccgctcgctggcgatggcaaaagatacgctcgacgccagcgtggttcattgtcatacctggtacaccgacctggcgggtctgttcgccagcaagctatgggggattccctacgtattaaccatccactcgctcgaaccattacgcccctggaaggttgaacaactgggcaacgcctaccatcttagctcgtggatcgaacgcacggcgattgagcaggcccatgccgtgatcgccgtttccaaagagacccgcgccgatattctgcgcctgtttaatatcaatccagagcgtgtccacgtcatctacaacgggatcgatctcaacgagtaccggaaaaccagcgcaaccgatgcccttgaacggtacggcgttgatccaacccgccccttcgtgctcttcgtcggacggattacgcgccagaaagggattatccatctggtgaatgccatcccgcacatcgacccgacagcgcaaatcgtgctctgcgccggcgctcctgatacgaaagagatcgggatcgagatggaggaacgggtcgccgccgtgagcgcccaccgtcccggtgtgatctggattcgcgagatgcttccccgccaggatgtgattcaattctactcgcacgccgccgtcttctgttgtccgagtgtgtacgagccgttcggcattatcaatcttgaggcgatggcctgtgagacggctgtggtggcttcggcggtcggtggtatcaaagaggttgtcattcctgaagagacggggttgctggtcgatcccaatcttaagccgggcagtttcgatcccgtcgatcccgccgcattctcggcagatctggcggctgcgatcaatcgtctgctggccaatcccgacctgcgttatcagttcggtcaggctggtcggcgtcgggtcgaacaggtatttagctgggacgcaattgcccgccagacgattgagttgtatcaggcggtgattgag

SEQ ID NO: 32830 - DNA, 1701 bp, Chloroflexus aurantiacus
tatcttgcgtggcatatctttgccacgaagtaatctggatatgtgaaacggaataccatgacgacttttgctgagttgggcctgagtgatgcgctggtgagcacattgagcgggcttggctacgacgaaccaacacccattcaggcccaggctattccattgttacttgccggtcgcgacgtgatcgctcaggcccagaccggcaccgggaagacggcagcatttgcgttgccgatgattgaacgtgtcaccgacgcgctggtggtgcaggcgcttgtcctggcccctacccgcgagctggccgtccaggtggcagaggcgatccatcgctatggtcgccaccgttcgttgcgcgtgttaccgatttatggcggccagcctatcgagcgccagttgcgcgggctggctcaggggacgcaggtcgtggtcgggactccaggtcgggtgctcgatcatctgaagcgtggcagtctgcgctttgatcacctgcgcatggtggtgcttgacgaagccgatgagatgctcgatatgggcttcgccgaggagttggaggcgattttgcagttgacgccaacggaacggcagaccgctctcttctcggcgacgttgccgccggcagtgcaaaacctgaccctgcgttatacccgccagccggtgcgggtgagcattgctgccgagcaattaacgaccccgcgtatccggcaaacctactacgaagtgctggcccgcgacaagctcgatgctctctgccgggtgctcgacgccgagatgcctcagttggcgattgtgttctgccgaacacgccaggaggccgatgatattggtgaacggctgcaaggccggggctacgctgccgagtcgctgcacggcgacttaagccaggccgcccgtgatcgggtgatgcggcgtttccgcgaagggcaacttgacgtgttggtggcaaccgatgttgcggcccgcggccttgacatcgccgaggtgagtcacgttatcaactacgatgtgcctaccgaccccgaaagctacgtacaccggattggtcgtaccggacgggccgggcgtgaaggggtggcgatcacctttatcaccccacgcgaacgccgcatgttgcagatcatcgagcgggtgacacgcacccggatcgagcgctgccagatgccgacgctggccgatgtagcggcccgccgtcgttcggcgctggtcgatcaattgcggacggcgatggccgatcctgcgcttgccggctacaccaccctggtcgacgaactggctggcacaggtgatctgcgcacggtagctgccgctgcgttgaaattgctcttgaacgaagatcagaccgatcaggtggatacgattacccggctcgacccaccgcctgctgagcgtccgcagcgcgaacgctcggaacgatctgcgcgttcgccacgcaccaaagccgacacacgcagcgagcgtgttgagcggacgatggtgcgcttgcagatcaaccttggtcgcaacgatcagattcgccctgctgacatcgtcggcgccattgcaaacgagtccggtttgcccggacgcagcatcggcgagatcgaaattcgggcacggacaagcgtcgtcgaagtaccgcgtcgggcagcccaacaggtgctccaggcgcttaatcggacaacgttgcgcggtcagcgtgtccgggctgtgctcctggcagaggcg

SEQ ID NO: 32831 - DNA, 924 bp, Chloroflexus aurantiacus
aatccgataactgctgcacttgcccaacgcccacttctaatcctcgacggggcattggctacggagctggagcggcgtggttgcgatctcgccgatccgctctggtcggcgaaggtgttgatcgaaaatccatcgttgatccaggctgtgcacgccgactattttgcggctggtgctgatgttgccattactgcgagttatcaggcaacgattcccggttttatggcgcgtggaatcgctcctgatcaggcaattctgctcttacagcgctcggtcgcattggcgcaggctgcgcgtgatcaattttgggctgacccggcgaatcgcgaagggcgtctacgaccactggttgcagcctcggtaggcccgtatggtgcatttttgcacgacggctcggaatatcgcggcaactacggcttatccgtggctgaattgattgagttccatcgacctcgcatggctgctctggcggctgcccggcctgatctctttgcctgtgaaacgatcccctgtctcgacgaagcacgggcattagttgcgctcctgcccgaatttccgcacctgaccgcatggattagtttcagtgctcgcgatggtgctcacaccgctcagggtgaaccaattgccgaatgtgctgctgagattgctgctcatccccaggtggccgcaattggagttaactgtacagctcctcgcttccttcccgatctcattcgcgctgtacaggctgttaccgacaagccgattgtggtctaccctaattcgggagaagtctatgacccggttgggcaatgttggattggtacgactgagattgacgattttgtagcccaggccaggcaatggtacgctatgggggcacggctgatcggtggttgctgccggactactcctgaccacattcgagcgttggctgcctgggcc

SEQ ID NO: 32832 - DNA, 831 bp, Chloroflexus aurantiacus
atgcaaggcaagacggtgattgtcaccggtgctaattcgggtattggttacgttacggcacgcgagcttgccgcgatgggagcgcgcgtgatcatggtttgccgttcgcagagcaagggtgaagcggcccggcaacggatcatgcaagaagctaaaggagcaccagaaccagagctagtactggccgattttgcctcactggcatcagtacgccgtgctgccggtgacattctggagcgctgcccacggatcgatgtcctggttaacaatgccggtctgtttgtatcagaacccctggccagcgccgacggttacgaaatgacctttgccgttaatcatctggcacccttcctgctcaccaacctgttgctcgaacggattatcgccagtgcgccggcccgtattatcaacgtttcttctttcgcgcatgtcgccggcagaatcgcaatcccacagatcgcttctccccagcgccccaacattgcccaggcttacagtgactccaagctgtgcaacattctgttcacaaacgaactggcccgtcgcttgcagggcagtggggtgactgcaaacagcctgcaccccggcgcagtcgctaccaattttgccgccgactcccgtggcctgtttgccttcttcttccgccttgctcgccccttcatgctctcgccggaacatggagcagcgacctcgatttacctggcttcatcaccagaagttgctgagatcagtgggcagtattttgtgcgcaagaagcctgtcaaaccatcagccgcagcgcaaggtgcagccctggcgaagaggttatgggagtttagcgaacaactggtg

SEQ ID NO: 32833 - DNA, 1467 bp, Chloroflexus aurantiacus
gtgcgggtgcgctttgcacccagaccaaccggtagtttgcacattggcggtgtacgcactgaccttttcaactggctctgtgcccgccactacggggggcaatttattctacggatcgaagataccgacgaaaagcgattcgtgccgggcgcggctgacgacattagcgcctcactgcgctgggtgggtatcgattgggacgaagggccagatgtgggtggcccttacggcccttacgtgcaatcagaacggtttgagcagggaatctatcagccattcatcaaccagcttctggaagccggtcttgcctacatgtcgtttaccaccgaagaagaactggctcagatgcgggccgcagcggaagctgctggcatcaaggcatttcgcttccgtggcccggagcgtgactggccgcttgagcgccagcgtgaagaggcggccagtggcaagccgtacaccatccggctcaaaacgccccttgaaggcgaaactcgctttcgcgatctgatccgcggtggtgacgagattgtggtgcagaataatcagttgcaagacattgtgttgatcaaatcgaccggaatgccggtctaccacttcgcccatctggtcgatgatcacttgatgaagatcactcacgttatgcgtggcgaagagtgggtacccagtaccccgtaccacgttctgctttacgacttcttcggctggccgcgcccggtctttgcccatttgccggcgattctgcggcaagatggccgtggcaagttgtcgaagcgcaaagacgatgtagcgacacagcgatttcgtgagcgtggctacctgccggagacaatcttcaactatctcgccttgcagggatggagctacgatggcgtgaccgaaattatgacgcgcgacgagttgattgcgcgtttcacgcttgagcgaatacaaccctcgccggcgcgctggaaccctgagaagctgcgcgacatgaacggtatctacatccgtaaactgacgacagagcagttggccgagcgcgtgctgccgttcatgcaacgagcgggtctgatcggcgatccggcaagcgagacggaacgcgcgtatctcatcagtttgatcccattgattcacgagcggctggaagagttgcaggaagcgcctgatctgctggccttcttctaccaggatgtggtacccggcgagacgtacaaccctgccgatctgattccaaagaagcacgacgcggcgcaaaccgtcgccttactgcgggctgcgcacgaagctctgagtcagcaaaccgattggacaccacccgcgctggagacaacgctgcgcgccctctgcgaacaattgcaggtgaagccggggccgctcttcggggcgattcgcgtcgccattaccgggcgcagcgtggcaccaccgctgtttgatacgctcgccggtgtaggacgcgaacggagtctctcgcgactggcggcggcgatt

SEQ ID NO: 32834 - DNA, 1779 bp, Chloroflexus aurantiacus
ttcagtggcagaccaggtgacacagcggtatttcggctccgtatggccgcagacgcaccggtcagtggggtcttcctccgcacctgcccggatggggaacagcattttacgccactgcgcgatctgggagtgcgcggggtgtgccggtggtgggaaggtgagctaccgatccgcatgctccgcaccaattaccgcttcctgatccgcgcagatgactgttcgcgctggtacagcgctggtggcatcacccgtcactaccccaccgacgcaaatgatttcgtggtactggccaactatcacgcgccagcctgggtacgtgatgcggtcttctaccagatttttccggatcggtttgccgatggcgacccgacgaataatgtccgcgatggtgcgtatctctaccacggacgaccggttgttgcgcgccgctgggatgaacgacccaaccgggcgaccggatcgatagagttctacggtggcgatttgcaagggatcgcgcagcgcatcgactatctgaccgatctgggagtctcggcactgtatctcaatcctatcttccgagcaccatcgaaccacaaatacgatgtcgaagactataccagcattgatccacacctgggaggtgaagcagggttactccgcttacgtgaggtactcgacgagcgagccatgaagctggtgcttgacatcgtaccgaaccattgtggagtgacccatccgtggtttgtcgctgcccaggccaacccacgagcaccaacagccgagttcttcatgttccgtcgtcatcccgacgactacgagagctggctgggggtcaagaccctgcccaaactcaattaccgcagtgtccgcctccgcgacgtgatgtacgcaggccaggatgcgattatgcgctactggttacgaccaccctatcggatcgacggctggcggattgatgttgccaatatgctggggcggttggggacagacaaccttggccacaagattggacgcgggattcggcgggcagtgaaggcagagcaaccggaagcctatctgctgggtgaacacttcttcgacggtactccccatctgcaaggtgaagagcttgatgccacaatgaattatcaaggcttcacctttcccatctggcgctggttgggagggtttgagttcaatccgcagcggcctgaagccgatccacgaccgattgcaaccgagacggtcgttgcgcaatggacggcatttcgggcagcgataccgtggcagatcgccagtcagcaattcaacctgttgggaagtcatgacaccccgcgtctacggacaatcgtaggcgatgatctggcgcgagtgcgggtagcgatgacgttactcttctgctatccgggggtgccgtgtatctactacggtgacgaaattggactgacgggcggcggtgatcctgattgtcggcgaccgatgccgtgggatgaacgagagtgggatcacgacctgcgggcgttcgtgcaacggctggcacgcttacggcgtcagtcgccggcgttgcgctggggcggctttcagcagctctacgcaaacggggaaacgattgccttccagcgcgaagcacctgaggagcgcatgatcattgtggtacggcgcagtgatgatgggcaacgcctgctgccggtgcgtcacggcgggctggctgatggggttcacctgcgggaactcttcagtggtgccgagacggttgtacgcaacgggatgctggacattgggaatttgccggccaccggtgcgcaaatctggcaaacc

SEQ ID NO: 32835 - DNA, 1173 bp, Chloroflexus aurantiacus
atggacgatgtcgtcattgttggtgcagcgcgtaccccaatcgggcgcttcaacagcgcctacagcggattgagtgccatcgatttaggtgcagccgccgtgcaagcggctgtccaacgggccggaattgaggcagactccatcgatgaatgcattatgggctgcgtagtcaccgccggcctgggacaatcaccggcacgccaggcagctctgcgtgcgggcttgccgcatacaattggcggcctgaccatcaacaaggtctgtggcagtggcctcaaggcagtcatgatcggcaccgccctgatcaaagccggcgaagctgatgtcattgtcgccggcggtatggagcacatgagcggtgcgccatacctgcttccccaggcccgccacggctaccggctcggccacggccagatcatcgacgctgtcgttcacgatggtctgtggtgcgcttttgagcatcatcacatgggagtggccgctgaatggattgcgcgcaccttcaatgtcactcgcgaacagcaagatgcttacgcattgcaatcacaccaacgcgcagtagccgctcaggacagcggcgccttccaggccgaaattgcaccggtaaccgtcccagggccgaaaggccaggtcaatctggtgacgactgacgaaggccccagacgcgacacctcgctggctgcactggcaaagctcaaaccggcatttgtcaccgacggcaccgtcactgccggcaatgcccccggcattaccgacggcgcggcagcagtcgtactaatgcgagccagccgggcagcccaattgggggtgcaacccttagcccgcatcggcacagccgcccaggccgccgtcaagccgcttgaactcttcaccgcaccggcgtttgccatcgaacggctgatgaagcgggcaggccgtaccctcgacgactacgacctgttcgagatcaacgaagcctttgccgcccaggtcattgcgaacctgcgtgccctggccctcgatgcagaccgggtcaatgtccacggtggcgcgattgctctcggccatccgataggagccagcggagcacgtgtcctggtgacactcatctcagcgttacgccagcgcggcggccagcgcgggattgccgcactgtgtctgggaggtggtgaagcggtcgccctcgaagtcgag

SEQ ID NO: 32836 - DNA, 1353 bp, Chloroflexus aurantiacus
cgttttccatctgattttctttggggtgcagcaacggcggcgtatcagatcgagggagcctggaatgaagacggcaagggcgagagtatttgggatcgctttgtccggcgacctggtgttattgctaacggcgataccggtgacattgcctgtgaccattaccatcgctacgaagaagacctcgatcacatggcagcgttaggattgaaagcgtaccggttcagcatatcgtggccacgtatcttcccaaccggctctgggcagcccaatcagcgcggtctcgatttctaccggcggctcattgatggtctgcaccgacgacatattctccctgtggctaccctttaccactgggatctgccgcaagcccttgaagaccgtggcggctggacgcagcgcgacacagcactgcgtttcgccgaatatgccgattacctcttccgcaccattggcggtgaagtagccttatgggcgacgcataatgaacctttcattcaggcattttacggctacggcaatggcgagaatgcaccgggaaagcgtgtgccgtggcgagtgctggctgtagtgcatcacttactgttatcacatggcctggcggtcagtgcctttcgcgccgcccgcccccaagcggtgcgcagtgatatgccatcgcctcagatcgggattgtgttgatgatctggccgcagtatccggccagccagcggattgccgatcagaaagcagcgcagcggatcgatgggattatgaatcggctgtttttagagccgctcttctgtcggcgttatcccgctgatatgatcgatcactttgcccgtcggctggtgtttgccccaattcagccgggtgatttcgagattatcggtcagcctatcgattttcttggtatcaatacgtacacccgcttgctcaatgcctttacctggcgggagccgtttactatggcaaaacaggtaccaggaccactgccgaagacggcgatggggtgggagatttaccctgactgcatcgttgaggcattacagaaggcgcgctcgtacacctctctgccgctgtacatcactgaaaatggcgcggcgtttgacgatccggcacccggtcccagcgatcaggttgtcgaagacccgcaacgtgtggcctatttgcagtctcatatcgaggcatgtagacgagcaatcgccgcagggattgacctgcgtggctatttcgtctggacactgctcgacaattttgagtgggcaaagggctacagcaagcgcttcggcatcatctataccgactacaccacgcagaggcgcgtgtggaagcgcagcgcatttgtctaccgtgacattatcgctcgcaatggtctg

SEQ ID NO: 32837 - DNA, 738 bp, Chloroflexus aurantiacus
gggaaggttgcgctggtcaccggcgcagcagccggtattggtcgtgcttcagcactggcgtttgcccgtgagggtgccaaggttgtcgttgctgatgtgaatgtcgagggcggggaagagacgattgcgctgtgtcgggctttgaataccgatgcaatgttcgtgcgttgtgatgtttcgcaacgcgatgaagtggagcgattaattgctctggcagttgacacgttcggtcggatcgactttgcgcacaacaacgccgggattgaaggcgtgcaggcaatgctggccgattatcccgaagaggtctgggatcgggtgatcgagatcaacctcaaaggggtctggttgtgtatgaagtacgaaatccggcacatgctcaagcagggtggcggtgcgattgtgaatacctcatcggtcgccggtctggccggatcacgtggcgtttcggcgtatgtagccagcaagcacggtattgttggtattaccaaagcggcagcccttgagtatgcgcgtaacggtattcgtgtcaacgcaatctgtccaggtacgattcatactgcgatgatcgaccgctttacccagggtgatccccaactgcttgcccagttcgctgagggtgaaccgattggtcggctcggctcgcctgaagaggtcgccaatgcggtgatctggctctgctcagataaggcttcgtttgtgaccggagcgacactggcggttgatggtggccgcctggcg

SEQ ID NO: 32838 - DNA, 879 bp, Chloroflexus aurantiacus
cctacgattgtggttgtcggtagcctgaacatggatctggtagtgcgcgcaccacgccatccacaaccgggagagacggttattggtagtgattttcaaacctttccgggtggtaaaggggcaaatcaggcggtggccgcagcccggttgggagcacgtgttcaccttgtcgggcgggtgggagtagatgcgttcggtcataccctgctggcgacagcccaagagcacggcgtcgataccacctttgtccagcgtgacccgacggcacctaccggtgttgcgctgattaccattgactctcacggtcaaaatacgatagttgtcgcgccgggtgcgaatatgcaggtaacggaagcggatgtgctacgtgcagagtcggtgctggccacggctgatatgctgttgatgcaacttgaatgtccgcttgaggtcgtgattgcggcggcccgcctggctcatcatcacggtgttccggtggtgttaaatccggccccggcccgtccgttaccggttgatctgttggcgctggttgatttcctcattcccaatcagcttgaattgcaagcccttgccgaaggtgaagccgatctgcgcaccgcaattcgctatctgcaacaacgtggtgctcgcaatgtggtggttaccctggctgaagccggcgcggtcctggccgaagccgatcagatcatccacgagccggcgttcgaggtaccggttgtcgatacggtggcggcgggtgatgcgtttgttgctgctttctgcgttgccagcgccagcggcaaatcgccgcaggaggctgtacgttggggaaacgcagccggtgcgctggcagtcacccgtgaaggtgcgcagccgtcattgccggcctatcgagaggtg

SEQ ID NO: 32839 - DNA, 1278 bp, Chloroflexus aurantiacus
gttcctggcccacgagcgcaggagctggtggctcgcgatcacactgtaattgccccactcggacgggtgtaccccctggtgattgaccatgcgcagggctgcgaggtctgggatgtcgatggcaatcgcttcctcgatatgaatgcaggcattgcagttttggctgccggtcattgccatccgcgtctgatccaggttgcccaggaacagcttcaacgcttcacccacatggcaggcaccgacttctacaacgaaccaatggtgcgcgctgccgagaagctggtctcactgatgcccggcggcaaggactggcaggtttttttcacgaacagtggcacggaagcagttgaagccagtattaaactggcccgttatgcaaccggtcgccagaacattattgccttttacggcgcatttcacggtcgcagctacggcagcctttcgctcaccgcgtccaaaccacgccagcgccaggggttcttcccgctgctacccggcgtcagccatacctactatcccaattgttaccgctgcccgatcaatcttcgttttccagagtgtgacattgcctgtcttgatctgatcgagcgcacgttgttcaagaccacaacccccccggaagaagttgccgccatcattatcgagccgatccagggtgagggtggctatgtagtgccgcctcccggagcgctggctcgtctgcgctcgatctgtgatcgttacggcattctgctcatcgttgatgaggtgcagagtggtgtgggtcgtaccggtaagatgtgggcttttgaacacgagggtattgtgcccgatattgtggcttcggccaagggactgggcggtggtttaccgctgggtgccatgatcgcccgcagcgagctggcccgcaaatggcaacccggttcgcatggcaatacgtatggcgggaatggtctgacctgtgcggtcgcgtatgaactgctcacgatggttgaagaggagttgatggacaatgccgccacggttggtgcctatctcctcgaacaactgcaagcccttcagcagcgattcccgcagatcggagcagtacgcgggcgcggcctgatgatcggtgtcgagtttgtcgatagtcagggcaatcccgccggtgcgctggccgaggcagtgatggtcgagagttttcgcaaaggactgctggtactcacctgcggtgcctcaacaatccgcttctgcccaccattgaccctgacgaaagctcaggccgacgaggccgtagcccggtttgcactggcaattgaa

SEQ ID NO: 32840 - DNA, 609 bp, Chloroflexus aurantiacus
atccatgccctcatcttcgacttcgacggcctgatggtcgataccgagacacccgccttacaaagctggcaagagatctatgccgaatatggtgttaccctaagcgtccacgattgggcgatcacccttggcgcaaacgccggatttgatgctcatgcccatctcgtcgcgttactccggcaacgcgatccccaattggccgaacaagtcattgcggcacgcgatacgatcctcgctcgccgacaggcccgcaaggatgaactaagcgcgccacaaacgcttctgcccggtgttgctgagttgctagccgaagcacactcaaagggcttaccctgtgcagttgccagtagcagtagccggcgctgggttgaaggctggcttgaacgtctaggcatacgccccttcttcgcaacagtcgtcacggctgatgatgtagcagcaacaaaaccggcacccgatctcttcctggaagcagctcgccgcctgggtctgccgccagcaacctgcctggtactcgaagactcccccaacggcatccgggctgcccgggcagccggctgcccggtcgtcgccatccccggcgcgatctccgggcaggttccgctaccg

SEQ ID NO: 32841 - DNA, 775 bp, Xylella fastidiosa
ttagcgaccgggggtagccgcgccgccctgccagcatgccggtggatggtcaggtggtgatcacctcggaacaagccatcgctttgacccgggtgcccgaacatcttattgtgattggttccggggcggtggggttggagttggcctcgatctgggtgcgcttaggcgcccaggtatcggtgatcgaggcccagccagaaattttgcccggttgggatgccaccgtggcccgtaccgccaagcgcagtttgcgccaacaggggatcacctttttaaccgatcatcgggttgagaccgtggtacgcagtggtagccgcgctgcggtgacctgccttaacagtaagggggagaccctgatgctggacggtgatcaggtgttggtggcagtggggcggcaggcccaactttgtgtggcaggcattcaaaatttggagttacaacaggacgagcaaggacggctgtgggtcgatgcgcattatgccacctcactggcggggctctatgcggtgggggacctgattgccggaccgcaactggcccaccgcgccaccgccgaaggattaagggtggccgattatttggcgggtcggcctctatcgcctatgggacccataccctcggtggtctacaccgatcctgagttggccatggtgggcttgacggaacagcaggccaaggttgccgggtatgcggtcaaatgtggtcaatttccttttatggccagtgccgcgcccgtgcccaagagcagaccgaaggcttgattaaaatgtgatgg

SEQ ID NO: 32842 - DNA, 999 bp, Xylella fastidiosa
cgtatggtaatcaatgacattgaatccctgacagcccaagcattggctgacgcggcggctgcgcagaatttagatcatttggaatttttgcgtgtagctcttcttggtaaaaatggcagcatcaccttgcagctcaagcaactgggtaaattgccagttgagcagcgtaaggcgattggcgaaaagctcaaccgcgtccgggatcttatctcggacgcattaatggatcgcaaagctgcgttggaaagtgcggcgttgagcaagcgcctcattgatgagcgcgttgatgttaccctcccagggcgccgaggtgaacgagcaggcttgcatccagtcacccgtactttggagcgtattaccgagatttttgcccggctgggttacgagctggttgaaggtccggaaattgaggacgactggcataattttgaggcgctgaacttcccattgcaccatccagcgcgtgctatgcatgacaccttttattttggtgacggccgtttgctacggactcatacttctggtgtacaggtgcgttacatgagtgaccaccggccgccgctgcgtatgatcgctgctggcaaggtttatcgcagcgatagtgatcagacgcactcgccaatgttccatcagatagaaggattattgattgacaagcatgccacttttgttgacttgaaagggaccttgtccgagttcttgagagcgttttttgagcgtgattttgaggtgcgttttcgcccaagttatttcccgtttgtcgaaccgggtgcggaagttgatattgcttggcaacagtccgacagcagcgttcgatggctggaggtgctgggttgcggcatggtacatccgaacgtgctgaagaatgttggcattgattcggaatgttatacaggctttgcatttggactaggtgtggaacgttttgcgatgctgcgttacggcgtcgacgacttacgtgcttttttcgagaatgatgtgagatttttacgccagttt

SEQ ID NO: 32843 - DNA, 1002 bp, Xylella fastidiosa
atgatcgattctaagcagaaaattgctgttcttggtgccggctcttggggaactgctcttgcggcattggttgcaaggcatgactatccgaccatattgtggggtcgtgatgtgcgagtgatacagagcatcaatatccagcaccagaacttccgttatttacctagcattatgcttcctcagacgctgcgtgccactaccgatttggctgcagcggtctcaggtgccgactgggttttggtggcggttccctcttacgccttcactgaaactctatgtcgattggctccattgctgtcaatcggcgttggtgttgcttgggcaaccaaaggatttgaaccggggtctggtcgtttcctacacgaggtggctcgtgaaatcctgggaggtgatgcaccattggcagtggtgacgggtccttcttttgctaaagaagtgactctgggcctgcctacagcggtcaccgtacatggtgaagatgcgtgttttactcagatggtggccaatgcgatgcatggcccgatgttccgtgcctataccggcaacgacgtgattggtgctgagcttggtggggcaatgaagaacgtactggcagtggctattggcgtggctgatggcatgcagttaggcatgaacgcgcgtgctggtttaattactcgtggactgaatgaaatgttacgtttgtctgcggttatcggtgctcggccggaaacgctaatggggttggctggtctcggtgatctagtattgacttgtactggtgacttgtcgcgtaatcgtcgcctaggctttgctctggggcgaggacagagtttgtcggatgcaatacgtgagattggtcaagtcgttgagtctgtacaaacttccgacgaggtaatgcgccaagctgaacagaatggtgtcgagttgccgatttccgaagctgtgcgtgctgttctacgtgaagagataactccatatgctgggatgaaagtcttgcttgcacgagagcaaaagcctgaa

SEQ ID NO: 32844 - DNA, 1962 bp, Xylella fastidiosa
ctcaattctcctcaacgtgctgcggttttataccgtgaaggtcctctgctggtgcttgcgggtgctggcagcggcaagacgcgtgtgattgtggagaagattgcgtacttgatcacctcagattgttatcctgctaaacgtattgcagcgattacatttaccaacaagtccgcgaaggaaatgcgtgaacgtgtggcgaagcagatcaaaagtagtcgtgctgatggattgacgatctgtacctttcatgcattgggactgaagtttttgcagattgagcatgaggccgttggactgaagcctggcttctcggtgttcgatgcagatgatgctgatgcccagatcaatgacctgttgcatggagccaaacaggatgtgattgatgatacgaaaagacggatatcccgtgctaagaatgctggcttgtcacctgaacaagcacttgttgctgcacgtaccacgcgtgacatggaggtggcaacgttatatgcacgctatcaagcacgcctgatagcgttcaacgccgttgattttgatgacttgattcgcctgccggtacagatccttgaaacgagtgatcaggttgcgatggcttggcgtgaacggattggttacttgttggtcgacgagtgtcaggataccaacgatgcacaatatcgattactaaaggtgctggccagtccgcgtggcaacttcacctgtgtaggggatgatgatcagagtatctatgcttggcgaggtgctaatgctgagaacttaatgcaactggagagagattacccacaattgaaggtcatcaagttggaacagaactaccgttgtcctaaccgtgtgctgcgtgctgccaatgcgttgattgcacataacccacatgcgcatctgaagacgttgtggagtgaccagaaagacggtgagcgcatccgtatttgggagtgccgagacagcgaacatgaggctgaaaagatcgcagcggaaatctcttatttgggggatgccaagcaggtaccgtggagtgatttctgcatcttgttccgaggtaactttcaatcgcgtccgctggaaaaggcactgcaattattgcgtatcccttaccacttgacgggtggtaccgcgtttctggaacgtcaagaagtgaagaacctgttgtcttggctacgattgttggttaaccctgatgacgacgccgcatttctccgtgcagtgcagtcacccaagcgtgaggttggttccacctcattggctaaattggctgaacttgcggcgacaaagcaaatgccgatgtcgcgtgctgctgagtcgctgggcgcgttgcaacaattaccggcgcgcgcagccaatggcctgaataaattcactgatatcttgcgtgagttgcgccagcaagtatcacgtgtgtcgtccgctgagttagtacggcgccttgctgaagtttctggtttacttaccgaattgcgtgagcagtccaatgatgaagcgagttaccaacggcgtaagcgtaatgtagaggaactggccgaatggtttgaaggcggccctttcggtgccagtgttggcgatcttgtttcgcagctagcattgctatcacgaaatgataaggacgatggcggtaaccaggtgcgcatgatgacactgcacgcttccaaaggatcggagtttcgttatgtcttcatcgctggttgcgaagatggcgtgctaccgcatgaagtcagcttggaagaaggcaatgtgcaagaggagcggcgcctattatatgttggtatcacccgagccaaagagcagttgtggatgagctatagcaaatgtgcgcgccgcttcggtgaacgtgtgcggtttaaacccagtcgctttttcgatgaactgccagctgaggaattacagcgagatggtgctgatcccgcggttgatgccgaacgtaaacaggagcgtgctaaggctggtttggcagcaattcaggcgctattg

SEQ ID NO: 32845 - DNA, 729 bp, Xylella fastidiosa
gttgagttccgtatgttgcgtctgcatggtgaacgcttggctgatatcgtcttgacccctccggaagaagattatgaattgccggaaatgcagctaccgaaaaaagaaccagatattgaagtggaaggattgtcgttccgttatggtgaagacgaaccatgggtgctgaaagattgcagcttcaaggttgccgctggcgagtcggtggctattatcggtgcttctggttgcggtaaaacgacactgatgaagttgctgcttgggttgctcaaacctaccgcaggtaccatacgtatcagtgggcgtgatttgcataaattcggtacacgcaatgtgcgttcgattgttggtgcggtgatgcaagatgaccaactctttgcagggagtgttgctgataacattagtttttttgatcctgatttcgacctggagcgtattgaagcggcagcgaagctagccgcgattcatgaagacatcgccgcgatgccaatgggataccacgcgttgatcggtgatatgggcagtgctctatccggtggacagaagcaacgtgtgattttagctcgtgcgctttatcgtcagcccaagttgctgttcttagacgaggcaacgagccacttggatgttatgcgagagcgtttagtgaatgatgcagtacaccagttaaaactaaccaaagtcatcgttgcacatcgccccgaaaccattgcgagtacggatcgtgtcgtg

SEQ ID NO: 32846 - DNA, 906 bp, Xylella fastidiosa
acacccgctctgcacgtgtataacctgcacaagacctatagcaatggtacgcaggccctcaaagggatcagtctggacatcacaccaggtgactttttcgctttacttggccccaacggagccggcaagtccactttaattagcatcgtcagttctctagtgaatttaagcagcggtagtgtcgaagtattcggcattgacttggtacacgagcgtagtgcggccatacgattgatcggcctggtaccacaggagatcaacttcaacctgttcgaaaaacctttagacattctgatcaactacgctggcttctacggtataccgtacgccaaagctgaggcactggcagaggttgaactcaaacgcgcgcacctgtggggaaaggcacatgtaatgagtcgcactctgtctggcgggatgaaacgacgtttgatgattgcccgtgcgatgatgactcaaccgcgtttgctcatcctggatgaacctacggctggtgtggacgtggagattcgccgggatatgtggcgtgtgttacaggagatcaatgctaacggcaccacaatcatgctcaccacacactaccttgaagaagcagaaagcctatgccgtaacttagcgatcatcaacggtggtcagattatcgaaaagggacctatgcgtacactactcgccaaattggacgtggagggattccttcttgatatcgacggaacattaccggcgcagctgccaagcattgaggacacgacgctgaatgctttggacgatcacacgttggacttaagcatgccgcgcgcgatgaacctgaaccatgtgttcgctgcactgagcgctgctaacatccaggtacgttcgatgcgtacgaagagtaatcgtctggaagagctgtttatacgtttgaccagc

SEQ ID NO: 32847 - DNA, 1707 bp, Xylella fastidiosa
aagcatttggcgttggatcttaagctggattttgataagaagacgctggctggtaccgcgacctattcgcttgactggaaggacaaggatgcgaagcaaatcgtgcttgatactcgtgagctgagcattgagaagattgaagttgacgacggccaagggcacttgaatcagcttaagtttgttttattcccagccgacaaaatattgggtagcaaactggttattgagactccttcgcagcctacccagatccgtgtcacttaccggactgctccgagtgcttctggcttgcaatggatggagccggcgatgacggagggcaaacgcttgccttttatgttcagtcaatctcaagcgatccatgcccgcagttgggtgccgctccaggacactccaggtgtacgttttacctataaggcccacatcgtttcgcgtccagatgtgatggtgttgatgagtgccgacaacgaccccaacgcagtacgcgatggcgattaccgcttcaaaatggctgagccgatcccctcttatctgttggcgatcgctgcaggtgatttggtcttcaagccgatttctgcgcgttctggtgtttgggccgagccggttatggtggataaggcggcaaaggaatttgaggataccgaaaaaatgatcggtgccgccgagacgctatacggtcagtatcgttggggacgttacgacatgttggtattgccgtcgtcgtttccatttggtgggatggagaatccgcgtctgacctttgtcactccaacggtgattgtgggtgacaaatcgctggtttcgttgattgcacatgagttggcgcatagttggtctggcaatttggtgactaatgcttcgtggaaggatatttggctcaatgaaggtttcacgacctatgtgcaagcgcgcattactgaggcgctgtacggtcagacgatggccgatatggagcgtcaagtcgatcaaatggatatttttgcagcgttgaaggatattcccaaagccgatcaaaaattggtgctgtcgacgttgaccaatcgtgatccggatgatgcactgagtcctatcgcttatgtgaaaggggcatggttcctacagtttcttgagcaacgtgttgggcgtgaggtgttcgatccgtttctacgtggttggtttgacagccatgcgtttcaaagtgcgacaagcgaagattttatcgtttatctgaagcagtatttgttatccaaagttcccaatgcgattactgccgaggaattggatagttggctgaacgcgcctggtattccgacaattgctcagaaggtgcgttcgctgagtttcgccaatgtggatggtgcacgtattgcttggagtggtagtggtctcttaccgaataggcaggtgactgatggttggggtacccagcagtgggtctattttcttagcagaatgggtgagacgctcaagcttgagcagctcaagcagcttgacgaagcttaccacttcaccggtacgccaaatggcgagattgcgatgcgttggtatccattggcgatccgtagtggttatactgctgcgtggccggaggcgggtgccttcatagggcgtgtgggtcgactcaagctgatattaccgatttacgctgagttgtcgaaaaccccaaagggattactttttgctaaacaaatttttgcaaaatttaaatctctttatcatccaatcacc

SEQ ID NO: 32848 - DNA, 2016 bp, Xylella fastidiosa
atgagtaacccactcctcgatttctcagaccttcctcgcttcgacgcgattctccctgaacacgttggcccggccattgagcagttgctcgcagaggcggaggcagccgtcgcccacgcggaacaggtaacgcctgtgacatgggagaacttcgtagtaccgctggacgatgccaccgagcggttgtatcgcgcatggggccaggtggcgcatttggaggcggtggtcaacacgccggcgctgcgtgaggtgtataacgtcactctgccgaaagtcactcgattcagcagtacgctcggacagaacctggcgctgtatgcgcagtacaaagcattagcgtgtgcgccggaatgggaccgtgataacgcagtacggtgcaaggttgttgataacgctttgcgtgatttccgtctcggcggtgccgagctggatgccgccgggaaagtccgtctggcagagatcaagcaggagctgtcggcattgtctgcaacgttttcgcaaaatgtgcttgatgcaacagaggcatggtcctacaccaccgaagacgccgctgtgttatccggtctgccgacagagactgtcgctaccgcgcgggcggccgcagaaaagaagggggtatcaggctggacgttcacgttacagatgccctgctatctgtcggtccaaagcgatgctgacaaccgcgcgttacgagagcgctcatatcatgctagtgcgatacgggcttcggaatttggcgatgccgctttggataatagtccgcacattcatcagattctcacgctgcgttccgaattggcagcgctgcttggtttctcctgttacgcggcatactcggtcgcaaccaagatggcagaggatccggctgaggtactcagcttcctgcatgacttggcaggacgtgccaagccgcatgctcaacgtgatcgccgtgaactggaaacgttcgcacgcgaggtgctggggcttgagacgctggaagcctgggacattgcatatgccagtgagaagctcaaacaagcccgttacaatttctccgagcaggaagtaaagcagtatttcaccgaacccaaggtcctggctgggttgttcgaggtgatccgctccctgtatggactgcgaatcgaagaagacgccgcgccggtctggcatccagatgttcgcttctaccgtctcattgatacgaatgggcaacgcgtcggccagttttatctggatctgtatgcacgggagggcaagcgcggcggggcatggatggatgattgccgtaaccgccgtgacaaaggcaatggggtgcaaactccggtggtctatttggtgtgcaatttcggtcgtggtaacgacggtgtgctgcctacgttccgtcatcaggaggtcattactttatttcacgaaatgggccatgggctgcatcagttactgacccggattggggaactgggcgtggctggtattaatggtgtggaatgggatgcggtggagttgcccagtcagttcatggaaaacttttgctgggagtgggaacgcgttcaagccatgacggcacacgtggagaccggtgcaccgctgccacgcagtctgttcgatcggatggtctgcgcacgcaattttcagagcggaatgttcaccgtgcgccaacttgagttcgcgctattcgacatgctgctacatagtaacttcgatccagcacaggacagcgtactgggactgttagaacgcgtccgtgatgaagtggccgtcaaccggttaccggactggaatcgttttccgcaccagttcagacatatttttgctggtggttatgcagcgggatactacagttacaaatgggccgaagtcctcagcgcagacgcttatgctgcatttgaagaggctccggatcaatttgccgaaataggggcgcgctttctcgacgaaatcctaagtcgtggcggcagtcgcagcgcagcagagaatttccaggccttccgcaaacgcgcgcctcgcattgatgcgttactgaagcgcaacgggata

SEQ ID NO: 32849 - DNA, 795 bp, Xylella fastidiosa
atcgcattcatcggcggcggcaatatggcgcgcagcctgatcgcaggcatgatccgccaaggcgcccccagcacgtcaatatgcgtcatcgaaccaatcgccgcactgcgcgatgcacttatcgctgacttcaacatcaaggccgtcaccacagccacagaagcggccaccgacactagcacctgggtgctggccgtgaaacctcaagtgatgcctgacgtgtgtgccaccctgccacttccagtacaacccaacacaccactggttatctcaatcgctgcaggcatcaccacctgcaaactcaaacactggcttggcgacacctgtgcgattgtgcgcgccatgccgaataccccagccctgctaggtgccggcgtaaccggactattcaccacctcacaaaccacgggcacacaacgcaccatcgctgaagaactctttaacagcgtaggcaagaccctatggatcaccgaagaagcgttaatggacgccgtgactgccgtatcagggagcggtccagcctatgcgtttttgcttgccgaagcgatggaaacagcagccatcatgcaaggcctctccaccgcaaacgcacgcacactcgtccagcaaaccctattgggtgccgcacgcatgatgaccgagtcaggggaaacacctgccgcactgcgccaccgcgtcacctcaccgcatgggaccaccgaagcggcaatcacaacatttcaagaaaacgacttccaagcacttgtcgcaaaagcgatagacgccgccacccggcgcgcacgcgccctcggaaag

SEQ ID NO: 32850 - DNA, 738 bp, Xylella fastidiosa
aaacttgtattgctacgccatggacagagtcaatggaactcaatgaaccgttttactggctgggtggatatagggctgaccgaacaaggtcatcaagaagccactatggctggtcatctgatgaaaaaagaaggactagagtttgatgtcgctcatacttctttacttaagcgggcgatccatacattacaagacgcacttaaagcattggaccaggactggttaccaatttataaaagctggcgtctcaatgagcgtcactacggtgctctacaaggccttgataaaatagataccgcagctaaacatggtgaagagcaagtcaatatttggcgccgctcctatgacatccagccgccgccgattgatctagatgacccaagccatccaatgcgagaccgccgttacgctgctttggaccgcaaagtattacctgtgagggaatcgctgaaaaatacactcgaacgagtattaccgtactggaatgatgccatcgcaccacaactaaatgacaacaagacggtacttattagcgcccacggcaactcattgcgtgcgttgtacaagtaccttaataaagaaagtgatgagaaaatcctaaatgtcaatatccctactggcattccacttctatttgaactgagcgatacactacaagtagtgagttaccgttaccttggcgatccagatgcagcacaacgcgctgccgaaatggtagcaaaccaaggtaaggcgaag

SEQ ID NO: 32851 - DNA, 933 bp, Xylella fastidiosa
cttatgcattcagtcgtcgtcgtcggctccttcagtattgatcatgtttggcgctgcgacacattgcccacacctggtgcaacaattgccggccgctatagccgtggtccaggaggcaaaggcttcaaccaagccgtagcggcttgccgcgctggtgcgcgcacctatttcatatgcgcactcggcaatgacaccgacggcaatatggcacgcgacatcgccacaaaagacggcttcacactgatcggcgaatccagcaccgaacccactggtaccggagggatctatgtcgacagccacggccataacactatcgtcactggcgctggcgccaacgcagtactgagcacccacttcatcacagaacaacgcgccctaattacctcagcatggatcgtcttggcacaactggaatcaccgatagaaacactcgaaacggcgctcagcatggcgcgcgaagctggccgcttgaccatactcaatgctgcccccgccaatgcaaccgccacgatcaacctgctcaaattggccgacgtgctcacactgaacgaaacggaattcgtcgccttgctcagccgtcacgtcggtgaaaggatcagtcccgacaacgtcgccaccaccgatggcaacacactacacgccttatgcaacaaactactgtccggcagtacggttgtcattacattaggctcggctggcgtattcgtttcacactcggaagaaaacctgcatggtgacacccagccctactatcgcgtggccgccgaacaggcccacaccgtagacaccaccggagctggcgacgcatttaatggtgctttggcagcatccctggcacagcaaccaaacacagcgtttatccagcacgtacgcctcgccaatagctatgcagcgcgctcgaccgaaacagaaggtggagccgtatcaatgcca

SEQ ID NO: 32852 - DNA, 723 bp, Xylella fastidiosa
atgtccagctacctttttacatccgaatcggtttcggaaggccatccggataaggttgccgaccaaatttctgacgcagtgctcgatgcaatcttggttcaggatccgcgtgcccgtgttgcttgcgagacaatggttaagactggtgtagcgatcatcgctggtgaaattactacaagtgcctgggttgatctggaagcgttaacccgtaaagtgattgttgacatcggctataacagttccgacgttggtttcgatggtgctacttgcggcgtgttgaacttaattggtaagcagtccccagatattaatcagggagtggatcgtaaaaaggctgaggaacagggagctggtgatcagggcttgatgttcggatatgccaccaacgaaactgataactatatgccagcggcaattcacatatcacaccggctagttgagcagcaagcaaaaattcgtaaaaaaagcaactcgctattgccgtggttacgtccggatgctaaggctcagattactttgcgttatgaggacggtgtggccagtgcgattgatgctgttgtgctatcaacccagcacgatcctggtatcaaacagaaggatcttgttgaagcagtgcgtgaggaaattctcaagcctgtgttgccttccaagtggttgcacaaaggaaccaaactccacattaatccaacggtaaatttgtgattgtgtccggtgggcgattgt

SEQ ID NO: 32853 - DNA, 2571 bp, Xylella fastidiosa
atgcggatggataagcttacttcgcgtttccagaatgcgttggctgatgcgcaatcgctggccgtcggccgtgaccatactattattgagccggtgcatgttttttcggcattgcttgatcagcagggtgggagtacacgttcgttgctcgtgcaggccggtgtcaatgtgccattgctgcgtgagcggttgaccgagatacttgaggcattgccgaaagtgagtggtcagacggttaatgtctcacccagcaatgaattgagtcgtttgtttcatcggactgataagttagcgcagcagcatggtgatcagtttatggccagtgagtggttcgtgttggctgtggtcgatgatagtggggggctgggccaggcgttgcgtgctgctggtgcggaaaaaaagaagattgaggctgcgattgataaattgcgtggcggtgaaactgtccagactgagaatgcggaggagcagcgtcaagcgttggaaaagtacacgattgatctgactgccagggctgagagtggcaagcttgatccggtgattggtcgtgatgaggaaattcgccgcacgatacaggtattgcagcggcgtacaaaaaataatcctgtgctgattggtgagccgggtgtgggtaaaactgccattgtagaagggctggctcagcgcattgtcaatggtgaggttccggaagggttgcgcagtaagcgtctgctctcgctggatttgggggcgttgattgctggggccaagtttcgtggtgagttcgaggagcgcttgaagggggtgcttaacgatctcgctaagaatgaggggcgggtcattttgttcattgatgagctgcataccatggttggtgccggtaaagccgatggtgcgatggatgctggcaatatgctcaagccggcgttagcacgtggtgagttgcattgtatcggtgcgactacgttggatgagtatcgcaagtacattgagaaggatgcggcgttggaacgccgtttccagaaggtgtttgttggggagccgacggtggaggataccatcgcaattcttcgtggacttaaggaaaagtatgcgttgcaccacggtgtggaaatcactgatccggctattgttgctgcggctacgctgtctaatcgctacatcactgatcgtcagttaccagataaagcgattgacttgatggatgaggctgccagtcgtattcgtatggaaattgactccaaaccggaagagcttgatcgtttggagcgtcgcttgattcagttgaaaattcagcgtgagatgctgaagaaagaaaaggatgaggcgagcaagcagcgtttagtcgatcttgagcgtgatattgaggttctggaccgtgaattttccgatctggaggaggtgtggagatcagaaaaagccgcgctacagggggcgactaagatcaaggagtcgatcgagcaggccaagcttgatttggaagccgcgcagcgccgtcaggactacgccaagatgagcgagattcagtatggtgtactccccgcgttggagaagcagctagtggcagcaagtcaggcggaacagcacgattttactttggtgcaggagaaagtgactgctgaggagattgccgaggtagtcagtcgttggactggtattccagtgagcaagatgcttgagggcgagcgcgataagttgttgcgtatggaagctgatctaggtcgacgtgtggttggtcaagatgaggctatcaaggtggtatcggatgcggtgcgccgttcgcgtactggtttgtctgatccaaatcgaccgagcggctcgttcctctttctgggtccgacgggtgttggtaagactgagttatgtaaggcgctggctgaatttttgttcgacagtcaagatgcaatggtccgcattgatatgagtgagttcatggaaaaacattctgtggcgcgcctgattggtgcacctccgggctatgtgggttatgaggaaggaggttatcttactgaattggcgcgacgtcggccttactctctgattcttttggatgaagtggagaaggcgcatagtgatgtgttcaatattctgctgcaagtacttgatgatggacgcttgactgatggtcagggccgtactgttgattttcgcaataccgttattgtgatgacatcaaacttaggttcacatcagatccaagaactcagtggagacgattctccggaggtgtatacgcaaatgaaggcggcagtgatgggggtggtgcaggtgcattttcgcccagaattcattaacaggttggatgatattgttgttttccacccgttggacaaggcgcaaatcaagcagattgcgcggattcaactgcgggggctagagaagcgtctcgctgaatctgagttgaaactagatttggatgatcgtgcgctggaattgcttggtaatgtcggatttgatcctgtatatggtgcccgtccgctgaagagagcaatccaatctcagctggagaatcccttagcgcagcagatcttagctggagcgttcgtcagtggggatactgtgcaggtgggtgttgatggagggaagcttgta

SEQ ID NO: 32854 - DNA, 1305 bp, Xylella fastidiosa
gtatttttgagtggcatggttgctgataagcaaggggagctaacgttggcgcgcatcgccgtggttggactagggtatgtgggattgccgttggcggttgcgtttggtcgacagcgtccgacacttgggttcgacattgatatatgtcgggtacagcagttgtgtgccggtcatgacattacttgtgaaattgagcttgaggaactccaagctgcgcgacatttgcgttatagcagtgatcctcgggaattgagtgactgtcagattttcatcattacggtgcctacccctattgatgtggttgagcaaccggatttggggccgcttcgttcggccagcatgttggttgcgtcggtacttaagcctggggatttagtgatctatgagtccacagtttatccgggcacaacggaggaagtctgtgtgccattgctggaggctgggtctgggttgcgctttaatgtcgattttcattgtggttacagtcctgagcggattaaccctggtgatcgtaagcgtcggctacaggacatctgcaagattatttcaggttccacccctgatattacagctgtcgtggacgcgttatattcgcagatcatcgttgctggtacttggtgtgctccgtcgatcagagttgccgaggcagctaaggtggttgagaacattcagcgtgacgtgaatattgcgttggtcaatgagttggcattgatctttgatcggctaggtatcgacaccttggacgttctcgaagcggcagaaaccaagtggaattttttgcctttccgcccgggtttggtgggtggtcattgcatcggcgtggatccttactatttgttgcacaaatccgagagtgtggggtattacccggatttgattcatacggcacgtcgcgttaacagtcgtgttagtcggcatgttgtggaccgtgttgtggctttacttggtgagcttagtgtgccgatgacacgtgccgtggtgcttgtgttgggtgttaccttcaaggaagattgccccgatttacgtaacagccgcgctttggatttggtgcgcatgttcaggactttaggtgcgcaagtcgatgtttgcgatccttgtgctgatccgcagcaagcgttggagcatgaggctgtcacgttgtgtacggagcccaaggccggtgcttatgatgcaattgtgctcgcggtggcgcatgcccagtaccgaatgtacgatgtagcgactattgcagctctaggtaagtcgcaggcggtggtttatgatgtcaaatcagtgtggccgcgtgcagcggtaactgatcgtcta

SEQ ID NO: 32855 - DNA, 1824 bp, Xylella fastidiosa
atgatctctctacgtcattttgcaatgcgccgcggtgggcggttgttgctgtccaatgttgatatcaccttgcatgcgggggatcgtgttggcgtggttggtcgcaatggtgttggcaagtccagtctgttcgcagcgatacgtggagaattggaagcggacaaaggcaatgttgagttacctggaaaattacgtattgccagtgttgcgcaggaaaccccctccttgtcggatctggccctggactttgtactcagtggtgatgatgtggttgccgaggtcctgcgtgtcgaggcagaggcgaatgcacgcgaagattgggaggcggtagccgctgcccatcagcgcttagccgagatcggcggttacgacgccgaagcacgtgcaggtaaattgctgcatggcctgggttttctcacacagacgcagcggcgtgctgtctcgacgttctctggtggctggcgcgtccgcttgaacctggcacgtgcactgatgatgcccagtgatctgttgttactggacgaaccaaccaaccatctggatatggatgccgtgttctggttagaacaatggttgcagaagtaccctggtacgttgctgctgattagtcatgaccgtgagtttttggataacgttgccacccatatcctgcatttgcatgatggtaacgccaaactatacgtgggcggctacacggacttcgagcgtcaacgtgccgagcaactacgccagcaacagattgcttttgagaaagagcaggccgagcgtgttcacttgcagagcttcattgaccgtttcaaggccaaagcatcaaaagccaagcaggcacaaagccggatcaaacgcttagaaaagttggctggaacggaggctgtccgtatggagcgtgaattccgtatcacgtttgcaccgccaaccaaacaaccacattccttgattacgctgcgccaggtgaattgcggttattcggtattgtccccgtctacaccctccgatcctccacctgttgatattcatgcggcagcaccttcgcagcctgccgtgattcttcatcgtgttgattttggacttgaggcgggagaccgtattgggttgcttggtcccaatggtgccggaaaatcgaccctggtcaaaacattggtgagtgacctggcccctttgacgggggagcgcatcgctcatcctgatgtgcgtattggctattttgcacagcacacggttgaatcactgcacgagggacaatcgccgattgatcatttccgtacccttgcgccgcaagcaccgatccaatccatacgcgactttttgggtaaatggaattttcctggagatcgtgcctttgaacctgtggatggtttttccggaggtgagcgtgcgcgcttggcattgtcgttgattgcttggcggcagccgaatgttttgttacttgatgaacccaccaaccacctggatctagagatgcgcgaagccttggctgaggcgctgagtgattttgatggagcgattgtgatggtctcgcacgaccgtcacttgattggcttagtgtgcgacacgttttggcgtgttgctgatggtgtggtcgagccgtttgctggtgatcttgaccaatacgctgcttggctgcggacacggcccgcggcacgtggtgtgcgcgccaagacagaggaggtcaatcagccacaggcttcgttgactgccaaatcgcttgcttctcaactcccagtgaaaaagtcggtcaactcacaaaagctattggttgcggaaaagcatgtgagcgaattggagacgctcttggccgaattggatcgcaagcttgccgatccg

SEQ ID NO: 32856 - DNA, 483 bp, Xylella fastidiosa
accattgtggacggtgagccgagtccacaagatattttgcgtttacttggtatcgagccgttagctgcttacttggttaaagaaatacaggatgtgtatcgtttgcagggtgtgaagatcaatgataagcatattgaagtcattacacggcaaatgttgcgcaaagttgagattgttgatcagggaaacagtaagttcctcaatggtgagcaagttgaacgtcagcgtgttatcgatgaaaacgcgaagttaattgcgcgcaatgaattaccagcaaagtacaatccagtgttactaggtattactaaggcttctttggcaacggaatcgttcatttccgcagcttctttccaagaaacgacccgtgtcttaactgaggctgcggtacgagggaccagggataatttgcgtggtttgaaagaaaatgtcatcgttggtcgccttattccggctggtactggccagacgtatcatagccagcgt

SEQ ID NO: 32857 - DNA, 1344 bp, Xylella fastidiosa
ctcatgtcactacccgccttcaaggcctacgacatccgcggccgcgtgccagatgaattaaacgaggacttggcccgccgcatcggcgtcgcactggcggcacagttggacagagcagcccctgtggtcctgggccacgatgtacgcctgacaagcccatcactacaagaggcactgtcagccggcctacgtgccagcggccgcgaggtgattgatatcggcctctgcggcaccgaagaggtctatttccaaacacaatatcgcaatgcggctggtggcgtgatggtcaccgccagccacaacccgatggattacaacgggatgaaactcgtacgcgagcaggcacgtccgatcagctcagacaccggcctattcacaatccgcgatgctgttgccgccgacatcgcaaccattacgccccccactgccgccgaacatcagtatctggacaagtcggcctacattgcacacctgctgagctacgtcgacagcaacgccctcaaaccactgaagctggtcgtcaatgccggcaacggcagtgccggcctaatcgttgacctactcgccccacatctaccgttcgaattcgtgcgtatattccacgaaccggacggccactttccaaacggcattccaaacccactgctgcctgaaaaccgcgatgccaccgcacaagccgtcaagcatcacggtgcagaccttggtatcgcctgggacggagatttcgaccgctgctttttctttgatcacaccggtcgttttattgaaggttactatctcgtcggcctcttagcctcagtgattctgtccaaacatcctggtggaaaaatcgtgcatgacccacgtctcatctggaacaccgtcgaaatggttgaggctgccggcggcatcccggtactgtccaagagcggccatgccttcatcaaagaaaaaatgcgtaaagaaaacgccgtatacggtggcgagatgagcgctcaccattatttccgcgaattttcctacgccgactcaggcatgatcccatggttactgatcgccgaactgatctcacgcagcggtcgctccctggccgacctggtcgaaagccgcatgcagcaattcccgtgcagtggtgaaatcaactttaaaatcaccgataccaaaaccgccaccgcacgcatcatggaccattacacagcacaatctccgacgatcgaccataccgacggaatcagcgccgactttggagattggcgtttcaacctgcgcagctccaataccgaaccgctactacgcctgaatgtggaaacccgcaacaatgcggcactgctaaaacaacgtactgatgaaatttcagcactgctg

SEQ ID NO: 32858 - DNA, 1017 bp, Xylella fastidiosa
cttgtgaccggtggtgccggtttcatcggcggtaattttgtattgcaagcgattagcctcgggcatcgtgtgattaatcttgatgctctgacgtatgcgggtcatttggagacgctcgctgcgcttgatgggtgcgcggagcatctttttgttcatggtgatattggcgaccgtgcgttggtgagccgtttgctggatacgcatcgcccggatgcagtgctgaattttgctgctgagagtcacgttgatcgttcgattgatgctcctgctgcgttcattcagactaatgtggttggtacgttgctgttattggaggcggtgtgtgggtactggaaggcgttgccggaggcggcgcgtgctgcgttccgttttctgcatgtatccaccgatgaggtttacggcagtttgggggagacgggcgcatttacagagaggacggcgtatgcacctaattcgccttattcggcgtcaaaggccgcgtctgatcatttggtccgtgcgtttcaccatacgtacggattgcctgtgctgaccacgcattgttcaaataactatggcccatatcattttccggagaagctgattccgctggtcatcaccaaggcgttggcgggtgagccgttacctgtgtatggcgatgggcggcacgtgcgtgattggctgtttgtcggcgatcactgtaccgcgctgtgtgctgtattggctggagggcgggtgggtgaaacgtacaatatcggggggcaggccgagcgtgagaatcttgaagtggtccgcatgatttgctgtttgcttgatgagcgccgcccgcgtgccgatgggcagagttatcaaagccagattgttcatgttgcagatcgtccggggcatgatcgccgttatgcgatcgatacgtccaagttggtgagtcagttaggctgggcgccggtgtatcgctttgagcagggacttgcgttgactgtggattggtatttgcagcatcaggattgggtacgtgcggtgctccaagggcgtgaccgc

SEQ ID NO: 32859 - DNA, 1695 bp, Xylella fastidiosa
aatccatcttctacgccgctgctgtttgcagatctcggcctctccgatgctgtgatgcaagccgtcacaaaaatcggctacgaaactccgtcgcccatccaggcggcgaccatcccagccttgcttgctgggcgcgatgtgctgggccaagcccagaccggcactgggaagactgccgcattcgcgctaccgttgctcacacgcaccgttctgaaccaggtcaagccgcaagtgctcgtactggcacccacccgcgaactggctatccaagttgccgaagcattccagcgctacgctgcctcaatctctggcttccgtgtcctacccgtgtacggcggccaatcctatggccaacaactggccgcactgaaacgtggtgtccatgtgatcgtcggtaccccgggccgggtgattgatcacctagagcgcggcaccctggatctatcggaattaaaaacgctggtcctcgacgaagccgacgaaatgctgcgtatgggtttcattgaggacgttgaagaagtcctacggaagttgcccgcttcacgccaggtcgctctgttctcagcaaccatgccaccacagatccgccgtatcgcacaaacctatctacaagatccgattgaagtcaccatcgcaaccaaaaccacgaccgcggccaacatccgccaacgttactggtgggtcagcggcctccacaagcttgatgcactcacacgcattcttgaggtggaaaccttcgacgcaatgattatcttcgtgcgcaccaaagctgccaccgaagaattggccgagaaattgcaggcacgtggtctgaccgccgcagcgatcaatggcgatatgcaacaagcgcaacgcgaacgcaccattcaccaactcaaagatggcaagctggatatcctcgttgccaccgacgtcgccgcacgtggtttggacgtagaacgtatcagccacgtgctgaactacgacatcccttacgacgttgagagctacgtccaccgtatcggacgcactgggcgtgccggtcgcagcggcgaagcaatcctctttgtgactccgcgcgaaaaaggcatgctgcgccagattgaacgtgccactcaccaaccgatcgaagccatgcaactgcccagtgtggatgcagtcaacgacacgcgcgtgaccaaatttttcggacgcatcagcaatgctctggtggtcggcgctgaaatcgacttctaccgcaaactgctgcaacgtttcgagagcgagcacaatgtccctgccattgagatcgctgctgccctggcacgactccttcagggggatagccccttcctgctgagtgtcccgacgcgcccccaacgcgagcgcagcgagctggcatccgagcatcatgtcaaacgcccctcatccttcaagcagacagagcgtccaaacaacactgaacaccccaagcgcccccaacgcaacgcacctgcccgcaatgtcccagagttcggtatggagtcttaccgcatcgaagtcggccgcatgcacggtgtgaagccagccaatatcgtcggcgctatcgccaacgaagctggattagagagccgctacattggccggattgacatccgtgacgatcactcggttctggatctccccgcagaaatgccacacgagatcctgcaacacctaaaaaaggtctgggtatcaggacagcaactacaaatgcgt

SEQ ID NO: 32860 - DNA, 1791 bp, Xylella fastidiosa
atgacggtgattgaaatcaaagttcccgatatcggcgattacagcaaggtcccagtcatcgaagtgctggttaccgttggcgaccacgtggtcaaaaaccaagggatcctcacactagaatcagacaaagccaccttggaagtgccatcaatgaataatggcattgtcaaagaactgaaagtcaacgtcggcgatttgctttcacaaggcgacgtgatcctcctgctggagaccgaagacaccaccgcccccccctcaccaagcaacgcggcgacatccgacaccacctcaccgcccccgccatccccccaaccagccgcttccaaggcgacagcacccgatcaacaacactccgacatcaagtgccgcatggtcgtactcggtgccggtcccggcggctacaccgcagcattccgcgccgctgacctcggcttggatacagtgctcgttgaacgctatcccaacctaggtggcgtctgcctcaatgtcggctgcattccttccaaagcattactgcacgcagccgccgtcatcgacgaagctgcacatgccagcacctttggaattgattttggcaaaccaaaaatcaccctagacacactgcgcgaatacaaacaaaacgtagtcaacaaactgactgccggcttggccgggatggccaaacaacgcaaggtacgcaccgtcaccggcatcgcgcacttcgtctctcccaacacactggacattactgctgctgacggcagcacccaacgactccatttccaacaatgcatcattgctaccggctcacacccagtgaagctaccaaacttcccttgggacgacccgcgcatcatggactccactgacgcactggaactggccgaagtgccaaaaaaactgcttgtcgttggtggcggcatcatcggcctagaaatggctaccgtgtacaacgccctgggcagccacgtcaccattgtcgaattcatggaccagatcatccccggcaccgacaaagatctagtgaagccactggcggaccgcatgaaaaaacagggcattgaaatacatctgaacaccaaagcaagccacgtcaaagccgacaaaaaaggcatcaccgtctcattcgaagcacccacccaaggcacacaacccacattaaaaacatcgacctatgatcgcgtccttgttgccgtcggccgtacaccgacaggcaacaacatcggcgctgaaaaagcaggcgtcaacgtcaccgaacgcggcttcatcccggttgatcgccaaatgcgcagcaacgtaccccatatctttgccattggagacattgttggtaacccaatgctggcgcacaaagccacacatgaaggcaaactggccgccgaagtcgccgctgctgaaacagaatcaggcaaacatcgggaatgggttgcccgcgtgatcccatcagtggcctacaccaacccggaaattgcctggatcggtatgactgaaaccgaagccaaagcgaaaagcctgaatatcggcgtcgccaaattcccctgggctgccagcggtcgcgctatcggcatcggacgcactgaaggcttcactaaactcatcttcgacgaagacacacaccgcatcattggcggagcgatcgtcggtgtccacgcaggcgacctcttggctgaaatcggactcgccatcgaaatgggtaccgaagccgaagacatcagccacaccatccacgcacaccccacactaagcgaatcgattgccatgagcgccgaagtctacgacggcaccatcaccgacttgtatctccccaaaaaa

SEQ ID NO: 32861 - DNA, 1122 bp, Xylella fastidiosa
acttccgcggtgcgtgctgggatcgattccgacactgctcatggggcagtgacgccaccgattgtgctttcatccaacttctcgtttgaacgtttcggtcataagcgtaagtacgattacacacgtagtgctaatccaacgcgggatttgctcggcgaggcgcttgcggagttggaggggggtgccggtggtgtggtcacggcgactgggatcgctgcgattacgttggtgttgcacgcattgctccggccgggtgatcgtttggttgtgccacatgatgcttacggtggcagttggcgtttgttcaatgcgttggctcaaaagggacattttgaattgatcactgtcgatttgacggatgcacgatcactggttgaggcattggcactaccaccgaagttggtattgatcgaaactccttccaatccattgttacgtattactgatttgggtgcggtgattgaggcagcgcaccgtgtcggtgctttgactgtggtcgacaatacgtttatgtctccggtgttgcagcgtcctttagagttcggcgctgacttggtattgcattcgaccacgaagtacatcaatggccacagtgatgttgtcggtggcgttgttgtggcacgtgatgttgcgcactatcagcagttggtgtggtgggcgaatgcgctgggtctgaccggctcgccattcgatgccttcttgacgttgcggggtgtgcgcacgctggatgcgcgtttgcgtgtgcatcaggagaatgcgcagatgattgcagcgttactggaggggcatggtgtggtgaagcacgtgcattacccaggattagcttcgcatccggggcatgtgctggcggggcggcagcaaaaagggttcggtgccatgctcagtttcgagttgcagggtggggaagaggcggtgcgggcttttgtcagtggcttgcgttatttcacgctggctgagtcgctgggtggggttgagagtttgatcgctcatccggcttcgatgacgcatgctgccatgacgcccgaggcgcgtgctaaagcgggtatctctgatgggttgttgcgcttgtcggtggggattgaggccagtgaggatttgatcgttgatctggtggctggtttg

SEQ ID NO: 32862 - DNA, 627 bp, Xylella fastidiosa
atgacgtcgcaacgcgtccgagaccgcctggtcgaacgactacgcgaatgcggcatccaagacgaacgggtactcagcaccattcgcatcgtgccacgccatttattcattgatgaagccttggcactgcgcgcttacgaagacaccgcattgcccatcggccatggacagaccatctcgcaaccctgggtcgtcgcacggatgaccgaagctgtcatgcaggttgtcccaaaaaaaatactcgagatcggtacaggttccggctaccagagcgccattctggcctcactaggattggaggtgtacaccattgagcgtatcggcaaactactgcgtcaagcacgtaagcgtttccgccagcttggcataaaaatacgcagcaaacacgatgacgggagcaccggctggacagagcatgcaccttacaacgccatcttggtcacagcagcagccccgacactgatcgacactctcatcgaacaacttgcaataggcggacgcctggtggctcctgtcggcaccgcttcagagcaagccctagtgcagctcacacgaacaatcgacggtagcatcacacacgagattttagaaccagtcacatttgtatccctgctaccagggatgttg

SEQ ID NO: 32863 - DNA, 1677 bp, Xylella fastidiosa
ctgatccctgcacccgttcaaatacaacgcggtcacggccaaatccacattggcccccacaccctgatctccatcccccccaacgataccgacgcacaacacagcgccacctacctagctacactgctacagcacacccgcaacctgacattacacatccacaccgaaaccacccccaaaccagacagcatccgcctacaacgcgacccacaatcacccgtcactcagacagaaggctacaccctgcaagccctccccaaccaaggcatgcatatcacggcacgagacggagcaggactgttctacggcgcgatcactgcatggcaactactgactgccgacagcaaccaaggcccaaccgaaatccctaccgtcaccattcacgactggccacgcttcaaatggcgcggccaactcctggacgtcgcccgtcacttccacgacgtagacaccgtcaaacacgtgattgacgccatggcacaacacaaactcaacgtcctgcacctgcacctcaccgacgaccaaggctggcgtatcgaaatcaaacgctaccccaaactcactgcaatcggtgccgaacgcatcccaccgggcgccggacgccacggcaccccagaacgctacggcggcttctacacccaagatcaaatccgcgaactcgtggcctacgccaccgaacgacagatcaccatcctccccgaaatcgatatgcccggtcatgcacaagccgccgtggcagcctaccccgacatcatcggagtcacccgcaccaccccacccgtcagcatcgactggggcatcaacccctacctcttcgacaccagcacacccagcctggacttcatccgcaatgtactcgacgaagtactcaccctattcccctcccaatacatccacatcggcggcgacgaagccgttaaagatcaatgggaagcctcacacaccatccgcgcccaaatgcgcaaactgggcgtgaaagacacacatgccatgcaaggctggttcaacacacaactttcccaatacctgacaacacatgaccgacgcctgatcggttgggatgaaatcatccaaagcggcctgccagacaacgccgcagtgatgtcctggcgcggcgtcgaaggcgccattaccgccgcacaacaaggacacgacgtcgtcctcgcccccgctggctggatgtacctagacaacctgcaaaccgaacgcaacgacgaaccaaacggccgcctcgccacactgcccctctcccgcgtctacgcactggaccccgtccccaaagaactgacccccgaccaagccatccacatcctgggcctacaaagcgccctgtggagcgaatacatcccctcacgctggcacatcgaccacgccctattcccacgcctcgccgccgtcgccgaagtcgcctggtcccccatgaccgcacgcaactgggacaacttcctcaaacgcctccccccacaactacaccgctaccgcaccctgcacatcgactacagcgacggcgcattcgcccccgacatcatgctgcaacaccgctcagcctacgtccttgctggcgccccccctcacatcacactcagcaaccaaaccaacaccggccaaattcactacaccacaaacggcaacgaaccgaccctacattccccccgctacaccgccccatttcccatc

SEQ ID NO: 32864 - DNA, 947 bp, Xylella fastidiosa
acaaacatactgacgtacgctggtatcaatcttcctggcccggaattcagcccaagcaataaaccaggtgttctctataaggactatctttatccaagtgcatctgactacgcttacgtggccaaaaagggcatgaacatcgtgcgcctcctgtcctttgggaacgcgtccagcccacactgaatgatgcattggacgccacgcaactcaacctgattcttaacgccgtcgagcaagcgaaagcccagaaattacatatcattctagatatccataactacgccaaatataacgatgagctgatcggcagtgacaatgttcctatcagcgccttcgccgatctatggaaacgtctgtccctacagtttgccaacgacaaagcagtcatcttcgggctgatgaacgagcctcatgaaatcacctcaaccacttgggctaaggctgctcaagcatccatcaacgcaatccgcagcactggcgcacgtaaccttgtattagtgccgggtaccgcttacagcggcgcacacagttggctgagcagctactacggcatccctaatggagaagcgctgctgaacatcaatgatcctgccaaacacatggcgttcgaagtacaccaatatctcaatgaaaatagcaccggcacgacgggcgaatgcatcagcaccaccatcggagccgagaagctagaagcattcaccaactggctgcgcacctaccacaaaaccggtttccttggcgagttcgctactggcaacaacgatacttgcaaccaagcattggaaggcatgctcagctatattgaggaaaacgcagacgtctggttgggactgacgtggtggggatctaacccctggtttagtcccgattatccattcaacctgcatccaaacagtgacggcaacgacaagccgcagatgagcatcctggaatcacacacacgtaag

SEQ ID NO: 32865 - DNA, 1077 bp, Xylella fastidiosa
agcgataaaccgttgacaaatttaaatttttcttcatttgatctgcatccagcgttgcttactgggctgacaagagcagcatttacactctgtactccgatccaggcgcttactcttccggttgcactggctggtcgtgatattgccggccaagcccaaacgggaaccgggaaaactttggcgtttttggtggtggtagttaaccgtttacttagcagtccggggctagtcaatcgtaacccagaagatccgcgtgcgttgattttggcgccaacccgtgagcttgcgattcaaatctataacgatgcagtgaaatttggtggcaatcttgggttacgttttgcgttgatttatgggggcgttgattacgataagcagcgcgaaatgttgcgcaaaggtgcggatgtggtcattgcgacgccggggcgcttgattgattaccttaagcagcacgaggtggtttcgttgcgcgtttgtgagatttgcgttcttgatgaagcagatcggatgtttgaccttgggtttatcaaggacattcgctttatattgcggcgcttgcccgagcgttgtagccgtcagactttgctgttctcagccactctcagtcaccgcgtgttggagttggcctatgagtatatgaatgagccagagaagctggtggcggagacggagagtgtcactactacgcgtgtccgtcaacgtatttatttccctgctgaggaggagaaaatcccattgctcttgggtttgctctcgcgtagcgaggggatgcgtactatggtatttgtcaatacaaaggtgttcgtcgaaggtgttgcgcgcgcgctcgatgaggctggttaccgtgtcggtgtgctgtctggagatgtgccacaaaggaagcgagagactttgcttaatcgtttccagaaagggcaattagaaatactggttgccacagatgtggctgcacgtggattgcacattgatggcgttaattacgtatacaactacgacctaccgtttgatgcagaagattacgttcaccgtattggccgtactgcgcgtttgggagctgatggtgatgcgattagtttt

SEQ ID NO: 32866 - DNA, 652 bp, Xylella fastidiosa
tcttggaaggcgcacgttggtaactggttattgcgtccggaaatgcgggatttgtcttccttcctgcgtgcgagaaaggttgctggtgtgagtgtctacccaccaggatctcagatatttgcggcgttcgaagcgaccccattccagcgggtcaaggctgtaatccttggtcaagatccttatcacggtcagggccaagcgcatggtttgtgtttttcagtgcggccaggtatgccgttgccgccttctttgttgaatatttataaagagctcgaagaagatcttgggttgctccgcccctgatcatggctgtctgcttccttgggcaaagcgtggtgtattgctacttaatgcggtactgacggtggaggatggtcgtgcaggtgcgcatcagggtaagggctgggaaggctttaccgaccatgtcgttgataccttgaatcgcgagcgtgaaggacttgtattcatgctctggggtagttatgcccaagccaagggtaaggttattgatacgcgtcgccaccttgtactcaaggctccgcacccttcacctttgtcagcgcatcgtggttttctgggttgccgtcatttttctctctgcaaccagtacttgagccaacatggcttggggatggtggattggagcttgcct

SEQ ID NO: 32867 - DNA, 1272 bp, Xylella fastidiosa
tcccgctctcatgccctctttgtccaggcccaaacacgcatccctggtggcgttaattcaccagtccgtgcgttccgctcagttggcggcgaaccgttcttcgttgcacgtgccgacggcccttatctgtttgacgtcgacggccaccgctacattgattatgtcggctcttggggaccgatgatcgtcggccacaaccatccagcggtgcgtgaagcagtgcaagtggcgattagcaacggcctgtcctacggtgccccatgtgccgccgaggtgaccatggcagaaaccattgcgcggctcgtgccatcctgcgaaatggtgcgcatggtcaactctggcactgaagccacattgtcagcgatccgactagcgcgcagtgccactggacgcaattacatcgttaaattcgaaggctgttaccacggccacggcgactcattcctagtcaaaggcggcagcggcatgctgacccttggcataccaagctcaccaggggtgcctaccgagctgagcaaactaacaatcacgttgacttacaacgatttcgatgcggccacggcactgtttgaggagatgggacaccacatcgcgaccgtcattgttgaacctgtcatcggcaacgccaactgcattccaccgcgaccaggctacctacaacatttacgtaccctatgcacccagtacggagtgctgttgatctttgatgaagtcatgaccggctttcgcgtcgcacttggcggcgcgcaagcgctgtacggagtgacaccggacctgaccaccttcggtaagatcatcggtggcggcatgccggtcggtgcctatggtggccgccgcgatctgatgcaacacattgccccaaccggtccaatctatcaggcaggcaccctctccggtaacccagtggcaatggcggctggtctggccatgctggagctaatacaggctccggatttctatacgcatctgagcaacgccgccgcggccctgtgtaccggtttgcaacaagcagccagccaggcaggcattgcaatgaccacacaacagattggcggtatgttcggactgttttttaccgatcaacaggtggaaacctatgcccaagcgaccgcctgcaataccgaccgcttcaaccgcttcttccacgcgatgctgcaacgcggcgtgttttttgccccatcagcgtatgaagcaggatttatctccagcgcccattcaccaaacatcatagaggccacgctggaagctgcgcgtacagccttccaaacaatc

SEQ ID NO: 32868 - DNA, 990 bp, Xylella fastidiosa
gcctatccacattaccgtccacggcgtatgcgccgtcatccctttattcgacgactgatacgcgaatacaccttgactgtggatgacctaatctggccggtcttcgtgcatggcctacccgggcggacacccatcgcatcaatgcctggtgtagagcggctctcaatggatgcactgctccatgaggccgaacacgcattaactttaggtattccactcatcagcttattcccggtcattgatccggcattgaaaagctttgacgccgccgaagcatggaacccagatggcttggtacaacatgcagtacgtgcacttaaaacacgcttcccagagatcggcgtcatgacagatgtcgcactagatccatacaccacacacgggcaagacggaatcatcaactcacaaggctacgtactcaacgacatcaccgtagaagcactggtaaaacaatcactctcgcatgcacaagcaggtgcagacatcatctcaccctctgacatgatggatggccgcatcggtgcgattcgcaaagccctagacactcatccaaacttcgtagataccagcatcatggcttattcagccaaatacgcatcggcattctacaacccgtttcgggatgcagtgggcagcgcggccaaccttggtaaagccgacaaaaaaacctatcagatggacccggctaacagtgacgaagcactccgtgagattgccttggacatcgaagaaggcgcagatatggtgatcgtcaaacctggactgctttgcttggatgtagtacgccgggtaaaagagacattccggatgcccacttacgcctatcaagtcagcggcgagtacgccatgatcaaggctgctgtatccaacggctggttagaagaacgcagcggtgtgctggaaacgttaatagcattcaaacgtgccggtgcagatggcatattgacctacttcgcaccacaagtagcaagctggttgcgtgaaggtaaa

SEQ ID NO: 32869 - DNA, 573 bp, Xylella fastidiosa
atgaaattgaccgtccccacttggttaacgctgctacggatcgtgatgatccctgtgctcattgtggtgttctatctaccttatcaatggagcaatattgtcgctacgggagtgtttgcgatcgctgcaattaccgactggcttgatggatggatcgcacgtcgttacgcgcaacattcgttattgggtgcgtttttagacccagttgcggacaaattgatggtggccatcgcattatttctcattgtgcaaggtcacccgacaccgtcgatggcattttgggcagcagtgatcgttagtcgtgaaattgcagtgtcagcattgcgtgagtggatggccgaaattggtcatcgtgccaaggtccgtgtagctgtccttggcaaagtgaagacgacggctcaaatgattgcggtactgtgtctgctctattcggtgacacccgagaagaaggcgatccatcaaatatggtttggccacttgatcttccaagtcggttattggacattgctgatttccgcgttactgacactgtggtctggtttccagtatttgcacgctgcctggcctagttta

SEQ ID NO: 32870 - DNA, 1280 bp, Xylella fastidiosa
atgacgttgtgggtactcggactgaaccatcaaactgcgccaatggagctacgcgaacgggcctctttcgtcggtgatgcattgccacacgcacttgattcactgcgcaacctccccaatgtgaacgaagccgcactgctatccacctgcaaccgtaccgagttatacgccgagaccacaaatgcgcaaatgctgctgaactggctcgaacaacacagaccaggattacaaaaccacttatatcaatatcgcgacgcagcggcagtcaggcacctattcagagtcgccacaggcctagactcaatggtcctcggggagtcacaaatcctcggccaagtcaaggattcctggtccatggcacgcacccacggcacccttggcaacacacttgaccggctattccaacatagcttctccgtcgccaagcacgcacgcaccaatacacggattggcaccaacccagtctcaatagcctcaaccgcagtgcgactagcacaagacgccttctccccgctgaacgaatcgaccgtattgctcatcggcacaggcgagaccatccaactggcagccaaacacctgagcgaaggacgagtacaacgcctgttaattgccaaccgcacccacgccaaagcgcagatgctggccagccagcatggtggctacgcactccccctgaccgaactaaacctccaccttgccgaagccgacatcatcttctcggccactgccgcacctacccctatagtcacccaatccaacgtcgaaagcgcactacacatccgaaaacgaaaacccatgctgctatttgacctagcaataccacgcgatatcgagaccgaagtaggaacactcaccgacgcctacctatacaccattgacgacctggagcgcgccgtggaagaaaaccggcacagccggcgcgaagcagccgaaaccgctgaggccatcattgaattacaagtgaaacgctacatggatacacttcaagcgcatgcacaccaagccccactacggcgcctacgcaccttcggcacaacgacacgggatgaactgctgacacgcgcacggcgacaactagcaaacggccgtcccgccgaagaagtcctggaacaacttgcccatggcctgaccaaccgcctgttacaccctccaactgccgcactgcgcgaagccgcactcgccaacaacaccgagctagtccatgcagcagaacaactctttccagagaaacccggctaccaccaccccacccttcagacaacgattgtgaaaaccgatga

SEQ ID NO: 32871 - DNA, 810 bp, Xylella fastidiosa
tggccggcacctgccaagttgaatttatttttgcaaattaccgggcgacgtgttgatggttaccatgaattgcagactgtttttcgtctgcttgattggggtgatacgatccatctgcgggtgcgtgaagatggtcagattcatcgcattggtgagtcagtgactggggttgttgaggctgacgacttggtggtgcgtgcggcttatttgctaaaacatgcgactaatgtctatttaggggcagatatctttgttgaaaagcgaatcccagttggtggcggctttggcggtgggtcctctgatgcggcgactgtgcttcttgtgttgaatgcattgtggcacaccaggcttgacgttgcggttttggcggctttggggttacgtttgggggccgatgtgccggtatttgtacatgggtgtaatgcgtgggctgagggtgtcggtgagtgcttaacgccgatgattcttcctggagcagcctacctgctattggatccaggggtgtgtgtgccgacacgggagctgttccttgatccggatttgacgcgcgatgcgtcccccgcgacaataggcgacttcatcgctggtgctgcgtttggtaatgcattcgagcccgttctgagacggcgcgagtctgcggttgcgggtgctcttgatgtgctctcagaggttggttttgcaagggtgactggctctggcagcggttgctttgtggaattcagtacgcgcgatgaggctgagtgtgctttggagcggctgccgtacgggttgtgtgcttgggttgctgatggcgcttcccgttctccgctg

SEQ ID NO: 32872 - DNA, 936 bp, Xylella fastidiosa
aatttgatggtcttttcgggcaatgccaataaaccactgactcaaagtatttgtaaggagttaggggtgcgtatgggtaaatcgttagtgtcgcgtttttccgatggagaggagcaggtcgaaattgaggaaagtgtgcgtcgtcaggaagtatttgtggtgcagccgacctgtgcgccaagtgctgaaaatttgatggaactgttggttatcattgatgcgctcaagcgtgccagtgtttctagtgtcactgccgtgattccgtacttcggttattcgcgtcaggatcgccgcatgcgttctttgcgtgtaccgattaccgcaaaggttgcggcaaaaatgatcagtgcgattggtgctgatcgtgtgttgaccattgatttgcacgctgatcaaatccagggtttttttgatgtgccggtagataacgtttatgcttcgccgctgttactggctgatatttggcgtgcttatggcactgacaatataattgtggtttccccggatgtggggggggtggttagagcccgtgccatggctaagcgtttaggcgataccgatctggcaatcattgataagcgccgtcctcgcgccaatgttgctacggtaatgaatattatcggggaggttaacggtaagacctgtgtactggtcgatgatttagtggatactgccggtactttgtgtgcggcggccgtagcacttaagcaaaatggtgctactaaggttgttgcttatatcacgcatccggtgctgtccggtcctgctgtggacaatattaataactctgagcttgacgagcttgtggtgacggataccattccgttgtctgatgccgctcgggaatgccgaaaaattcgccagcttagtgtggctgaattgcttgctgagactattcggcgtattgcttttggtgaatcagtcagttcactgtat

SEQ ID NO: 32873 - DNA, 1404 bp, Xylella fastidiosa
atcatcgttggtagcgggcttgctggtctgatcgcagcactgaccatttctcctgaaccctcagtgcttgtcacgcgcagcgccttgggcgcagaaacatcaagcgcatgggctcagggaggaatgtcggtcagccttagccccgatgacaaccccagcctgcatcttgccgacaccttggcggctggcgatggtctgtgtgatgcagtagctgcagagagcatcatcttggaagcgcttgacgcttttcatgtcctacaacactttggcatccacttcgaccaagatagcaacggccatctggcgcttggactggaagcagcccattcccgtcgccgtatcgtgcatgttgggggcgatagatcgggcacagcgtttgtacaagcattgactgcctgtgttctcaacgatccctcaatcaccgtgcttgagggcctcgaagcacgacacattctgatagctgataacgtggtctgtggcttgctgcttgccaacccgacatccgagattgtgttgccctcctcaagaattcttctggcgacaggcggcattggtgggctttatgacgcgaccaccaacccggtgagcaactttggtcaaggcatcgcgatggctgcacgtgctggcgccgtactggctgatatggaattcgtacagttccatccgacggccctccattgccacaaccgccctctagcgctcgtcagcgaagctgtccgtggtgaaggtgcagtcctcattaacgaacgtggcgaacgctttatggcggatattcctggtgccgaacttgcagctcgtaacatcgttgcacaggcaatcagcgccgaaataactcgcggcggccaagtatttctcgatgccaggcaagcattgggagcacgcttcagcacccgctttccaaccatcaccgcactctgccacaaagtaggtattgaccctgtacacatgccgattccagtctgtcccgctgctcattaccacatgggcggtatcgcaaccgatcgccaaggccgcagcagtattcctggcttatgggttgcgggtgaagcagcgtctacaggcttacatggagcaaatcggcttgcgagcaattcactgcttgaggccgtcgtcatggggacacgtgcagcccgagatatcacatcccacaacacaccccaccccctcggaacaatccctatcacccctaaaaagcctgataccacacttatccggccgattgtctctcagtgccttggcgtacttcgccatgccgcggatatgcatcgtgctattgctgccctcttgccttttgtggaaggcgaagaagagtcttccgatcccgccatcgttgcattgctgatcgccatctttgcacatcttcgcaccgaatcacgcggtgcccatgcacgcaccgatttccct

SEQ ID NO: 32874 - DNA, 777 bp, Xylella fastidiosa
ttttttaatatgaaaatgcgtattgcaagttggaacgttaattcactcaatgtgcgtttgtctcagttgcagcagtggctggtggaggctgcgcctgatgtgcttggccttcaggaaacgaagttggaggaccatcagtttccagaagccgcgttggcggcattgggctatgtcagtgtgtatgcggggcagaagacgtataacggtgtcgcacttctggcgcgcgtggcgttggaggatgtgcaagtcggtatcccggagttcgaggatgtgcagcgacgggtgatcgctgcaactgtggatgggatacgcgttgtcaatctatacgtggttaatggtcaagaggttgggacagacaagtacgcttacaaattaagctggttagatgcggtgtaccactggctggccgaggagctgcaacgctatccccgccttgtggttctgggtgatttcaatattgctcctgatgcccgggacgtctacgatccgcaggtatggaatgaggatcatattctcacttcgaccacggaacgtgcggcactggataagctgttaggactggggttgcatgatggttttcgcttgcatcaccaggatgcggggatattcagttggtgggattaccggcaagctagtttccggcgcaataggggcttacgtattgatctcacgcttgtttcggaggcgttgcgcgcgcaggcggtggcttctggaatcgaccgcgtgcctagaggctgggaacgacccagtgatcatgctccagcgtggattgaatta

SEQ ID NO: 32875 - DNA, 1986 bp, Xylella fastidiosa
acacgccgccagttggccaacgcaatccgtttccttgccgctgatgcagtacaagctgctcattctgggcacccgggcatgccgatgggaatggcagatatcgctgaagttctttggaacgatttcctacgccataaccctaacaacccgaactggtttaaccgtgaccgcttcattctttccaacggtcacggctcgatgttgcaatatgcattgctgcatttaagtggctatgacctgccgttagatgaactcaagcaattccgtcagctgcatagcaaaacagctggtcatcctgagcgtagcgagaccccagggattgagacgactactgggccgcttggtcaggggtttgctaacgcagtgggttttgccttggccgagaaacttctagcgcaacgctacaaccgtccggaacatctcattgtcgatcaccgcacctgggtgttcatgggcgacggctgtctcatggaaggtatctcacatgaagcagccgcgctggcgggtacctggaacttaggcaaattgatttgtttctgggatgacaacaatatttctattgatggcaatactgcgggttggtttaccgaagacactccagcacgattcgaagcctatggttggcatgtaatccgcgatattgatggccatgatgcggaaaaaatcgcaaccgcaatccaagccgccgttgctcaagagaacaagccctcattgctatgctgccgtaccgtgatcggatttggctcaccaaataaagctggtaaagaatcttcgcatggtgccccactaggagcggaggaactggaggccacgcgtaagatgttggattggccatacggcccgttcgagattccgtccgagatttacgatggttggcgtgctaacggcacaggcatgctacgtcaagctgagtgggagcaggcgttcgacaactatgcccgacagtatcctaaggaagcagctgaattaacccggcgctcccacgctgagttacctactgattttctcagccaattggatgcttacattgccaaagttcacgctgtggggccctgcattgcttcccgtaaagcatcgcagatggcgattgaagcatttgcacctttacttcccgagttaattggtggctcggctgacttggcacattccaatctaacgttgtggaaagggagccaaacagttgttggcgacgcccccaacgccaactatgcctattacggcgtacgtgagtttgggatgagtgccatcgcaaatggacttgcattgcatggcggctttatccccttcgacgcgacatttctagtattcagtgattacgcccgcaacgcagtgcgtatgagtgcattgatcccagcacatgtgattcacgtttacacacatgattcaatcggacttggcgaagacggtccaacgcatcagcctgttgaacacttagccgcactgcgctatatccccaacaatgacgtgtggcgtccctgtgacgcagttgaatctgcagtggcatggaaggcggcgatcactcgcaataacggcccgagctgtttggtgttcagccgccaaaacttgccgcaccaaccgcgccatgatgcacaacttgagcagattgcacgcggtggctatatcttggctgacgcggcgagcagcatcccagacatcattttgatcgcgaccggctcggaagtcagcctagcgatcgaagcgaaaaagacacttgatgcgatgcagctaaaaacacgcgtggtctcgatgccatcgaccaatgtgtttgaacgtcaggaccccacctaccgtgagtcggtcctcccatcgaaagtccacaagcgtgttgcaatagaagctggcgtcactggtttttggtggcaatacgtagggttacatggtgccgtgattggcctggacacctttggtgcatcagccccagcggatgtgttgtacaaacattttaatatcactgcagaacacgttgtcgaagtcgcaaaggcactt

SEQ ID NO: 32876 - DNA, 1110 bp, Xylella fastidiosa
ttttccaagttattcctcaatctgatcttcatgctgattgtgcccttgatgttctcggcactcgtggtcggcgtggccgaaatgggggacatcagcgcactcggtcgcatcggttggcgtaccctgggttataccgttgtgctctcatccgtggctgtgttaatcggattggtgcttgtcaacgtactcaaaccaggtgtgggtgtcgatccgcagttggcgcagcagctgcttagtgaaaatgcggagcgtagccgccagatcgtcgattccacagatacccaaatccacggcatggatatgctgttatcaatcgtaccgagcaacgtagtcgcagcggcttccagcaacgatgccattttatcgctgatgttcttcacgatcatgtttggcattggtatggttctggtgccgcaggagaaggtagagacagtgaagcgtgctattgagggtgtatttgaagtttcgatggtcttgattggactggtgatccgtcttgcaccctatgcagtagcctgctttatgttcaacttgacgtcgttattcggcctagagttgttgatacggttggcggcttatgtcggtgttgtggtcctggggttgtcgctgcatatgtttgttacctatggtttagcagtatggtgggcggggcgttcaccgctgcgttttttccgcgaaactcaagaagcaaccttgatggcgttctctacagcctctagcaatgccactttgccaaccgcgctgcgtgttgctgacgatatgaagctaccgaaaaaaatttcgcgtttcgtactgaccattggtgcaactgctaatcaaaatggcacggcattgtttgaaggtttgaccgtcattttcctggcgcaattttttggtgtggacctcagttttagtcagcaagcgatggtcatggcagtatgcatcctgggtggcatcggcaccgctggtgtaccgtccggctcgcttccagtggtggcactcatctgtgccatggtcggggttgatcctgtcggtattgggctgattttgggggtgaaccacttcctggacatgtgccgcactgcattaaatgtgactggcgatctagcattgactacattggtgtgcaga

SEQ ID NO: 32877 - DNA, 591 bp, Xylella fastidiosa
ggacgtactgaaccattgccattggataatcgccattacgtcaatggccatccactatgcgatgccttcccgggtttggcgctgatccaatttggattaggctgtttttggggtgcagaacgtctgttttggcaattgcctggagtattcagtacagcagcaggttatgctggcggcggggtgccatatccgacttatcgtgaagtctgttctggggagacgggtcatgcagaggttgtcttggtagtgtatgaccacactgttatttcatttgagcagttgttgcagacattttgggaatcccatgatcccacacaagggatgcgccagggcaatgatatcggtacccagtaccgttctgtgatccattgcactacatctgagcaatatgctgcagcatcagccagccgagaggtttaccagcaacaactaaatactgctggttacactgcaattacgacagagatactccatccggcaccacctttctactatgctgagaatgagcaccaacaatatcttgcaaaacatcccaacggctattgcggactgggagggactggagtgacctgcgcgattcgcttgcaggtt

SEQ ID NO: 32878 - DNA, 2052 bp, Xylella fastidiosa
gttactaccagcaatccactgttaacggccagttccttaccgttccaagcgccaccgttcgataaaattaaggacagcgattatttgcccgcgttcgaggagggaatgaagcaacatctgggtgaaatcaccaagattgctgagaatcccgatgcaccaaccttcgaaaacactatcgaaatgctggagcacagcggcacaaccttggatagggtctcacgaatttttttcggtctagtacatgctgacaccaatgatacgcgccaaaagattcaggaagaaatcgcgcctaagctggctgcacaccaggatgagatttatttgaatcccaagctgttcactcggatcaagtcaatttacgatcagcgtgacacgcttagtttggacccattacagaaacgtttggtcgaacgtgattatgaaggattcgtacatgccggcgctcagttgcctgaagcagataaaacaactttacgtaaaatcaacgtagaagagagtactctgtccacacagtttcacgctaagctagtcgccgccacagcggcaagtgccattgtggttgatgaaaaaaataaacttgatggactgagcgagggcgacattgctgcagcagcggaggctgccaatgcgcgtaagctcaatgacaagtacgtactcgcattacaaaatacgactcaacaacctatatcagcttcgctgaaggatcgtgatttgcgtgctcaggtgttacaagcgtcagaaactagggccgaaaaaggcgacgctaacgatacccgtcaaatcgtgcagcgcctaactcagttacgtgcacaaaaagccaagttactcggtttcccgaactatgccgcttataacttggcagatcagatggcaaagacccctgaagcagcgctaaaactactcaacgataccgtgcctgcggctactgcgaaagcacgtaaagaggctgccgaaattcaaaagttgattgataagcaacgtgtcaatacgaaagcgaatcactttgagttggttgcctctgactgggatttctatgcggagcaggtgcgcaaagccaagtacaatttggatgaagagcaaatcaaaccgtattttgagctcgacaacgtgctgcaaaacggtgttttctacgccgcaaatcagctatacgggatcacttttaaggagcgcaaagatataccaacttaccatccggacatgaaggtttacgaggtatttgaccatgacggcagctcgttggcactgttctacactgattactttaaacgtgacagtaaatccggtggtgcgtggatggatgtgttcgttgaacaaaatgcgatcaccgggaccaaacccgtggtctacaacgtttgcaactttactaagcctgcgcctggccagccggcactattgagcttcaaagacgtgaccaccctcttccacgagtttggccatgcgttacacgggatgttttcgaaagtgaagtatccttcgttggcaggcacctcaacatcacgcgattttgttgaattcccgtcgcaattcaacgaacactgggcctctgatccaaaggtgttttcacattatgccaagcactaccaaaccggtgagtccatgccacagagtttggtggacagtattcgcaaggcaaaaactttcaaccagggttacgcaactaccgagtacctttcagccgcacttctagacttggcttggcataccttgccagccgatgcgccactggaggatgtggagaaattcgaagccgatgcactgaagaagtataaggtcaatctgaaagaagtgccgccacgctatcgcactagctattttgaccatatttggagtggcggctattcggcaagctattacgcttacttttggtctgaagtgttgagtgatgacgcattcgagtggtttaagcagcacggtggtctagaccgtaagaatggcgatatattccgcgacaaaattctctcgcgtggcaacagcattgagttgggcgatttgtatcggcagttccgcggccagaatccgagtgtgcaaccactgttagataaccgtgggtta

SEQ ID NO: 32879 - DNA, 978 bp, Xylella fastidiosa
aaagcactttttcgtgttgctgtgaccggcgctgcaggccaaatcggctactcattgctatttcgcatcgctgccggagaaatgtttggcaaagacaggccagtgatactccagatgctggaactccccgacgagaaagcacaggctgcacttaagggcgtgatgatggagcttgaagactgcgcgttcccactactggctgacatggtcgttaccgataatccagacatagcattcaaggatgccgacgccgcattgctggtaggcgcccgcccccgtggccctggcatggaacgcaaagatctgctaatggaaaacgctaaaatttttaccgcccaaggtgcggccttaaacaaagtggctcggcgcgatgtcaaagtgctggtcgttggtaatccagcaaacaccaacgcctacatcgcaatgaaatcggctccagatctaaacccgaaacactttactgcgatgctgcgcctcgaccacaaccgcgcattgagccagttatcgaccaagctaggtaagcctgccgccaacattgaaaaactcattgtatggggcaatcacagtccaaccatgtatccggattaccgtttcgccaccgccgatggcactccaatcattgaggcgattaacgaccaagcatggaacgctaacagcttcattcccaccgtcagcaagcgtggcgccgcaatcatccaagcacgtggcttgtcttcagcagcttctgcagccaacgcagccattgagcacatgcgtgattggctgcttggcagcaacggcaagtggatcacaatgggagtgccatcggacggttcctacggcattccggagggaatgatatttggtttcccagtcacgaccaccaatggcgaatacagcatcgtcaaagatctgcccattgacaccttcagcaaaacatacattgacaaaacgctggcagaactggaagaagagcgtgccagtatcgcgcatctgtta

SEQ ID NO: 32880 - DNA, 537 bp, Xylella fastidiosa
atgcccgaggcggtgatcttcgacatggatggtctgatgcttgatagcgagcgcgtgagcatcgaatgtcggtgtcgtgctgcgtttgatcttgagcagcaaattgagccggattactggttgcagatggtcggggtgagcgatatcgcttgtcacgcgcagctgagcgcacgcattggtgctgtaccagcgacagcgttgttggcacgcagtgatgcgttatatgaggcggtggttacgaagggggtgccgcatcggcccggcatcgttacgttactggagtggctgttcgcacgtggtattccgtgtgcggttggtacgtctacgcggcgtccgttggcgctgcgtaaattgaatacggcaggcttgttgtcgcgtttcgatgtggtgtgtactgcgagtgaagttgcgcaagctaagccagcgccagatatttatttattggctgcgcacacgcttggtatcgttccggggcgctgcttggtggtggaggattcaccgattggggtacgtgccgcattggctgcaggtatgacg

SEQ ID NO: 32881 - DNA, 975 bp, Xylella fastidiosa
attattaacgggaaaaccagcggcatcctgaattggaacgacatcccgtacccatccttctaccgggcgtacaaagagttgtcgaccaacttttggatcccggacgaggttgatatgaagatcgacaagcgccaatacggtgaactgtcggcacgcgagaaaaacgcttatgacgccatcatcggtttgctagctacattggattcaccgcagacacgtttcatctacaacgttgctgagtacatcactgatccggcggcacatgccaatgctgcgattattgggcagcaagaagtcattcacaacgagagctacagctatgtgttggcctctatcactgacttggccaaccagaaccgtgtgtttgagatcgctcggacccatcccaccattctcaagcgcaacgccccaatcatgcaggcctatgacgacttcatgcgtgagaaaactgctgagaccttgctgtattcgctgattcaatcctcgattcttgagggtattaatttttattctggctttgcctatttctacaacttggtgcggcagaaccgcatgactggcactggaaaaatcatcagctttatcaaccgcgatgaattggctcataccaaattcatcagcgaagtgattcgtgccattgttggtgagaatccggaattgcaaaccgatgcattgaccgattacgtgcatcaagcatttgcccatgcgattgagctagaaacacagtggactggtgaggtacttgatggcattgacggtattgacgtagaggagatgatccgctacgtgaagtaccgcgctaataaaatggctggcatgcttggtatccagacgctgtacaccgagactactgataacgtcatgccctggatcagggcttatgcagacaattttaccgagacaaaaacggatttctttgagatgcgtaatgccagctataagaagaccaatgtagacaactgctttgacgactta

SEQ ID NO: 32882 - DNA, 2229 bp, Xylella fastidiosa
attcaccaagaattcccacaattggacgtggctgaatataagcgcgcggtgttcgggttcgtcgaacgtaaggatagcgttaatgctgatgacttggttgatctgttgatccgtgaggctgagtcacgtgttgacctgactgcgccggagtgggagtacttcgctgcacgtttgtatctgcgtcgcttatacaagcgtgccagccgcaatcgcttctacgatgccagccagaaatacggctcgtttgtcggtttacaggagagtttggctgaccgcaatatctattccaacgatattttgcgtagctactccaaggaggagttgatcgaggctggtcagatgattgatcctgagcgcgataagctgtttacttataacggcttgtacttattggccacacgttacttggcgaccgatgcttcttgcggcgtgtttgaattgccacaagaacgttggcttaccatcgccttgtatttgatgcaagacgagtatggccccggtaaaggtggacgtgagcgccgcatgcaactagttggcgaagcgtactgggcactgtctaacttgtacatgacggtggcgactcccaccctgggcaatgcaggaaaaatcaatggccagttgtcttcgtgcttcatcgataccgttgacgacagtttgcagggtatttacgactccaacaccgatattgcgcgtgtgtccaagcatggcggaggcgttggtgcttatttgggttacgtacgctcctctgggtcaatgattcgtggtgtagctaactcttctggtggtgttgtgccgtggatcaaacagctcaacaacaccgctgtctctgtggatcagcttggtcagcgcaagggtgcgattgcggtttatttggatatttggcaccgcgatattgaagcgttcttggatttgcgtctgaataacggcgatcagcgtttacgtgcccatgatgtgtttacctcggtctgcattcccgatttgtttatggaagcggtcgaacgtcgcggcgattggtatttgttcgacccatacgaggtaaagcgcgttaaaggttggtacctgcaggatttctatgacgagaagagaggtgaccccaacggtagcttccgccgtaagtacgaggacgttgttgctgacgagcgtatcagccgtaagacggtcaaggccattgacatctttaaacgcatcatggtcagccaattagagacgggtaatccattcatgttctaccgggatgaagtgaaccggaagaatcccaacaagcatgttggcatggtgtattcgtctaatctctgtactgagatcctgcagaacatgacgccaacccggctcatacaggagatgatcagtggcaatcagatcgttacgaccaagcatgctggtgatttcgtcgtgtgcaatctgtcttcgatcaatcttggtcgtgcaatcacggtacaggctgatttgcttggcgccgatgtattggagcgtctgatcccgattcaggtgcgtatgctcgataatgtcattgatctgaatctgttgcccgtcccacaagccacgattaccaatcagaaataccgtgcgattggtttaggtactttcggttggcatcacttgctggcgcagaaggcgattcactggaattcgcaggaagctgagcaatacagcgacgcgttgtatgaacgcattaattacctgacgattcgagcaagcatggagttggctaaagagaagggcacctatgcagtgtttcccggcagtgactggcagaccggcgagtatttccgcgcgcgtgattacaacagcccacaatggcttgaactagctgcccaggttgctgtcaatggcgtgcgtaatgcctatatggtggcggtagcgccgaacatgagtactgcgcagattgccggttccactgcgtcaatcgaccccatctatagcgcgttttactacgaagagaagaaggattaccgccgcccggttgtggcacccggattgtcgctggatacgtggccgtattatgaaaagggtgcttataagctcgaccagttcgcgagcatacgccagaatgcccgccgccagcgtcacgttgatcaatcgctcagtttcaatttctatgtgccaagtaccatccgtgctagcacgttgttggatcttcacatgaccgcttggcgtgagggcttgaagacgacttactacgtgcgctctaacgacattgacatcagcgaatgcgagtggtgttcaagc

SEQ ID NO: 32883 - DNA, 2352 bp, Xylella fastidiosa
atgactcagtcctctcaaaaagcccttgatctgcaggtattgccgctgcgtgacgtggttgtattcccttacatggtgattccattgttcgtaggtcgtgaaaagtcaatgcgggcacttgaaaaggcaatggacgctgataagcgcatcttgttggttgcacaaaaaacggctgacattgacgatcctggtgcggttgatttgcatgccatcggtacttatgctcaggtgctgcagttgttaaagcttcctgacggcacgattaaggtgttggtcgaaggcctaacccgtgtgagtgtggatcaagtagtcgagcatgatggtgcgttacgaggttgtggtatcgaaattgcctctactcaggagcgcgaagaacgtgaaattgaggcaattgttcgatctctgttgtcgctcttcgagcagtacgttaagaccaatcgcaagctccctccagaattgttacaaactttgagtggtattgatgatccaggtcgtttagccgataccattgctgcgcacctgagtgtgcgtttggcgcataagcagcgtctgttggaaactatcgaaattggtgaccgacttgaaatactcattggactagtcgatggtgaaatcgacgttcagcagatggaaaagcgtatccgtggtcgagttaagtcgcagatggagaagagtcagcgtgagtactatctcaatgagcagatgaaggcgatccagaaggagttgggtgacttcgacgatcttccgagtgagttggaggagttggctcgtaaaattgccgaaatcgggatgccaaaatcagtccagagtaaggctaagagcgaactcaacaagcttaaacagatgtctccaatgtcagctgaggcagcagtagtgcgtaattaccttgactggttgttgggtgtcccttggaggaagtgcactaaggtacgaaaggacttgaaagtcgctcaatctacactggatgatgaccactatggtcttgataaggtgaaagaacgcatccttgagtatcttgcggtccagtcacgagtcaaacagatgcgaggtccgattttgtgtttagttggccctcctggtgtaggtaaaacttccctcgctcagtctattgctaaggcgaccaatcgcaagttcgtacggatgtctttggggggtgtgcgtgacgaagctgaggttcgggggcatcgacgtacttatgttggctcaatgccgggccgggtcgtacagaatctcaacaaggttggcagtaaaaaccctctgtttgtgcttgatgagatcgataagatggctatggacttccgaggtgatccttctgcagcgctcttggaggtgctcgatcctgagcagaataatgcgttcaatgatcattaccttgatgttgacctggatttgtccgaggttatgttcgtggcaacctctaattcgctgaacattcctggtccattgcttgatcgcatggaagtgattcgtataccaggctatactgaggacgaaaaactcaacattgctacccgttacttggtacctaaacagattagagccaatggtttggctgttgaggaattggcgattggagaggacgcgattcgcgacattgtgcgctactacacgcgtgagtctggagtgcgtaaccttgagcgcgagatctctaaaatttgccgtaaaattgtcaaggagattgccttagttggtgtgaagccttttgctaagaagtcaaccaagtctaaggtattattcgcggtgacttcgaaaaatcttgaaaagtatcttggggtgcgctgctttgattttggccgtgctgaggaagctaacgagattggcctagtcactggtttggcttggacagaagtcggtggagatttgttgcaaatcgaatctactcttgtcccgggtaagggtaacctgattttgactggtcagcttggtagcgtgatgaaggagtcggcgtctgcggcgttgacggtggtccgttcgcgtgctgatcgcttctgtattgacgtggactttttgcataatcaagatgttcaccttcatgtgcctgacggtgccacgccgaaggatggtccaagtgccggtattgccatggtcacatccttggtgtcaatgcttaccaaggtgccagtgcgtgctgatgtagcgatgactggtgagattactttacgtggccgagtttctgtgattggtggtttgaaggagaaattgttggctgcattacgtggtggtatccgaacagtattgatccctgaaggaaatcgtagagatttggctgatatcccggctaatgtgacacgtgctttgacgattgttccagtaaagtggattgatgaagtgttggatttagctcttgaaagt

SEQ ID NO: 32884 - DNA, 1017 bp, Xylella fastidiosa
atgtgtaataaaagcgtggtcattacgggtattacaggacaggatggggcttatttagcgcagttgctcctcgaaatgggttatgtggtttatggtacgtatcgtcgttctagctcattgaatttctggcgtattaatgaacttgggattgcacagcatcccaatttacatctggtcgaatatgatttgaccgatctgtcttcgagtgtgcgactgctcgaattggccgctcctaaagaggtctataatcttgccgcacagagctttgttggcgtctcttttgaccagccattgaccacgacggatattaccggagtgggtgcggtcaacctgttggaagccattcggattgttaatcctaagattcgcttctatcaggcatcgacttctgagatgtttggaaaagtccagcagactccgcagattgaggaaacgcctttctatccgcgtagcccatacggtattgccaagttgtatgctcactggatgacggttaattatcgtgagtcgtacggtatctttgctgctagtggtattttgtttaatcacgaatcgccgttgcgagcgcgtgattttgttactcgtaaaatcactcatgcgattgccatgattaaattagggaagctagacgtattagagcttggtaatttggatgccaaacgtgattggggttttgcgaaggaatatgttgagggaatgtggcgtatgcttcaggctgatgagccagatactttcgtgctggcaaccaaccgaactgaaactgtccgtgatttcgtcagcctggctgccagtgccgttgatatccagttggagtggaagggacaagccgaacgggaatgtggtgttgatgttgcatcgggaaaaactttagtcacaatcaatcctaagttttatcgaccggcggaggtggatttgttgatcggtaatccggccaaagctagaacgaagctgggttgggaaccaaagaccacacttgaggagctttgtcacatgatgatggaagcagatgtgcgccgc

SEQ ID NO: 32885 - DNA, 1933 bp, Xylella fastidiosa
ctgacctatcgcgatgccggagtcgacatcgacgctggtaatacacttgtcgaacggatcaagccgttggtgaaacgcagcttccggcccgaagtcatgagtggactgggaggctttggtgcattgttcaacctagcaggcaaatacaaagaacctgtgttggtctccggaacggacggagttggcaccaaattgaagttggcacagcaactgaaccgacacaatacgatcggcattgatttagtagcgatgtgcgttaacgacgtcctggtacagggcgccgaacccttgttcttcctggactactttgcaaccggcaaacttgatatagacaccgccacggcagtcatcagcggtatcgcactaggctgcgagcaatccggctgcgcactgatcggcggtgaaaccgccgaaatgccagacatgtatccacccggagaatacgatctagcaggcttctgtgtcgctgctgtcgaaaaatctcaactcctggatggcagccaagtacgcgaagacgatgtcctcatcggcattgcctcctcaggtccacactcaaatggctattcattgatccgacgtatctatgagcgtgccggatcacctgccgacctggatatccacggaacccgcctaatcgacacattaatggcgcccaccgcgttatacgtcaaaccaatactgaaacttctacacacccacagcgacgcaatccacgcaatggcccacatcaccggcggcggcttgacagagaacatcatccgcgtgattccacccaacctgggtttgcgcattgatgccaacgcgtggacacaaccgcccgtgttccaatggctacagcgcgaaggcgcgctagccgataccgaaatgtggcgcacttttaactgtggcatcggcttcgtattagtcgccacacccaaccaggtagcccccctgggacaagcacttgacaaccaaggcttggcacactggcagataggccgggtcgttacccctgttgacaatgagcgggtacacatcggctgaagtgacaacaacagagacatccacaccacaccccactgaggtatccctgctgcctcagcatcgacctcatccctacctcacaacaacacgtgatcttgcttgcactaaaataatcctgatcgtcacaccaacggtactcatccatacctgcttgcgttcccctgcatcaacgcagctgaagttgcctcaagccattgcgttgctgccttggtgactgcaacaaccagcaaagcccttactggacacacactggcacactaccaaccacacttggctactcttaccctttaccctaactcaggaaatccactgtttgacctcaccctcctcccctttacgcctcgccatcctggcctcaggacgcggcagcaatctgcaagccatccttgatgccatcgcgaccgacagactgcatgccgaagtggttggagttttttccgatcgccccgacgcacccgcactcaccaaagtgttacctacgcaccgttggagtgcagatccacacgactcccctgatcgcatcaccttcgacacaacgctcagcgcagcgatcgccgccgtaacaccacactgggtcgtatgcgcaggctacatgcgcatcctcagcgcagcatttatagaacgcttccccaagcgaatccttaacatccacccctcactgcttcccaaacaccgcggcttacacacgcatgcacgcgcactggcagcaggcgacaccgaacacggtgccagcgtccatcttgttataccggaactagatgctggaacggtactggcccaggcagtagttcccatccttaccaatgacaccgccgaaacgttggccaaacgcgtgctagtacgcgaacatccactgctcgtcgccaccttagaactacttgcaaacggtcgcctgacggtcgacggacca

SEQ ID NO: 32886 - DNA, 459 bp, Xylella fastidiosa
tatgacatctttgatagtccgattggaatactgacaattgtcgccgatacaaatgcactatgtcgcgtgatgctcccaagcaacgatcacacaacacaagagcacgaatgctggcactatgctccgagtacaacgctattaaagcaagcacgcacccagttactcgactatttgcacggcgagctccacacattctcgctaccgttacgaccacagggcacaccattccaatgtgcggtatggaaggcactagcccacatctcattcggccagacttggagttatgcgcaattagctgctcacattgggcgaccaagtgcaagccgtgccgtaggagccgcaaacgctcgcaacccactgcccatcgtattaccttgccaccgtgtgattggcagcaatggcgcgctcaccggcttcaacggcggactacatatcaaacgctccctgctgtacctggaa

SEQ ID NO: 32887 - DNA, 1081 bp, Xylella fastidiosa
cggaaaaaccctagcatccgcactttggacagctagcttgcgctcccccttttcagttcgggattcaactctcatgacgcaaacaattacggtgatccgcggtgatggtattggcccggaaatcatggatgccaccctgtcggtattaaacgcgttacaagcgaatctgaattacgaattcgcagatgcaggcttgagcgcacttgaaaaacacggagacttgctaccggaagccaccctaaattcaatcagcaagaacaaaatcgcgctaaaaagcccgctcacaaccccggtaggtgaaggtttcagctcgatcaatgtcgccctgcgacgtaaattcgacttatacgccaacgttcgccccgcaaaatctttcccaaataccaagtcacgctttagcgataacgtagacctgatcaccgtacgggaaaataccgagggtgcctacctgagcgagggtcaaaccatctctcctgacggagaagttgccacttcaagggcacgagtgacccgtaaagggtcggaacgtatcgtccgttacgcattcgacttagcccgaacaacgggccgcaaaaaggtcaccgcagtacacaaagccaacatcattaaatcaacctctggactatttctgaaaaccgcccgagacgtcgcaagccagtacccagaaatcgatttccaagaaatgatcgtcgacaacacttgcatgcaacttgtaatgcgcccagaacaattcgacatcattgtcaccacaaacttgttcggtgacatcctctcagatttgtgcgcaggcttggtcggcggtttaggcttggctccgggcgccaacattggtaatgaacaagccatcttcgaagccgtacatggctcggctccagacatcgctggacaaggtaaagccaatccatgcgcgctgctgctaggtgctgtacaaatgctggatcatatcggtcaaccacaaaacgccgaacgcctacgcaacgcaatcgtggccacactgaatgccaaagattcgctgactcccgatctggggggtaacggcaacaccatgggattcgccaaggcaattgcaagcagactctaa

SEQ ID NO: 32888 - DNA, 1284 bp, Xylella fastidiosa
atgaccgctattgccaaaatttatgctcgtgagattcttgattcccgtggcaaccctactcttgaagcggaggtcactctggagaatgctgtctgtggccgtgccgcagtcccttcaggtgcttcgactggtaccaaggaagcggtggaattacgtgatggtgacaagacacgttacttaggcaagggggtgcgtgcagcggtggataacgtcaatggtgttattgctgcggcgttggtgggtttcgatggagctgaccaaacaggcttggaccatcgtttaatcaatctggacggcaccgagaataaggggcgtttgggggctaacgcgctgctcggtgtttcgttagcaaccgcacatgcggttgccgccgcgcgtaaacagccgctatggatgtatttgtccacccttggtgaatccaagttatcgttgccggtgccaatgatgaacatcatcaatggtggtgcgcatgcggataacaacgttgatttccaggagtttatggtgttgccggttggttttgcttcgttttccgaagcactgcgtgccggtaccgagatctttcatgcgctaaagtcagtgctgaagggacagggtttaagtactgcggtgggtgatgaagggggctttgctccggacttccgcagtaatgttgaggcactggatgccattcttgaggcaatcggtagggctggttatattgctggagaggatgtgttgttaggtttggatgttgcttcttccgagtttcgcgacaacggtaagtacaacttggttggtgagaacaagcgtctgaccagtgggcagtttgttgatttcttggatgatttggttgcgcagtacccaatcatcagtattgaggatggtttagccgaggatgattggttgggttggaagcaattgactgaacgtatcggccataaagtacagttggtgggcgatgatctgtttgtgactaatcctaaggttttccaggaaggcatcacttctggcatcgcgaatgcgatccttataaaacttaaccaaatcggtacgttgacggagactctggaatcaattgcgatggctcaccgtgctcagtacgctgctatcgtctcgcatcgatcaggcgagactgaggatacatcgattgcggacattgcggtggcaaccacggcaactcaaatcaagactggctcgttatgccgttctgatcgtgtcgccaagtacaaccagttgttacgcattgagcaggcgcttggtgttggtgcgcgttatgctggtcgtgatgcgttcgtttccctg

SEQ ID NO: 32889 - DNA, 810 bp, Xylella fastidiosa
gtgatgaagctttgtggttttgaagtcggtcttagccagccacttttcctgattgccggtccttgtgtgattgagtcgctacagttgcagttggatactgccggtgtactgaaggagatcacttctaagcttggtttgaactttatctttaagtccagttttgataaggcgaaccgaacttcagggagtagttttcgtggccctggcttggaagaggggttgaaggtactggaggcggtgaagacgcagattggggtgccagtactgacggatgtgcacgagtacacgccaatagacgaggtagccactgttgttgatgtgctgcaaacgccagcgtttttggtacgtcagactgatttcatacggaatgtctgtgcggttggtaaaccggtcaacatcaagaagggacagtttttgtcgccatgggatatgaaacctgtggttgagaaagcaaagtcgacgggtaattcgcagattcttgtatgtgaacgcggcgcttcgttcggttacaacaacttggttagcgatatgcgttcactggcggtgatgcgtgagaccggctgtccggtggtattcgacgcgactcattctgtgcaacttccgggtgctcagggtgctcgttccggtgggcaacgcgagttcgtaccggtgttggcgagggcagctgtggcggtgggtatttccggattgttcgctgagactcacccagacccaccaaatgcattgtctgatggccccaatgcttggccgttgcgcacaatggcgatgttgttggaaaccttggtggagttggatgcggtcaccaaaaaa

SEQ ID NO: 32890 - DNA, 1350 bp, Xylella fastidiosa
acacagatacagcaaagcatccgcatcggtaaccggaccctaagctacaaagccatcattggtgctttaccggtacaagacgacaaaggcaagacgatcggcgaggtgatgttcaccgcctacatcatgaaaggcaacaaccgcccggtcaccttcgctttaaacggcggtcccggagcctcctcggtttacctcaatatgggcgcgatcggccccaaggtggttcacttcggcacccagggcaccagcccatccgaccccgcgatactgcacgacaaccccggcacttggctggactttacagatcttgtgttcatcgacccaatcggcaccggcttcagccgtgcccgtattgaaggcgaggaagccaaaaaacaattcttcaaccccaaagccgacgtcgactacttatcacgcacgatctatgactggctggtcgccaatggccgtctcctctcccgcaaatatttggtgggtgaaagctacggcggcttccgcgctccacgtattgcacacaccttacaaacccagatgggtattgcactcaatggactggtgctggtctcgccctacctcaacccgaccctggacgacaatagcgatgtttcaccgttagcctggataatgaccctgccttctatcgccgccgcacacctggaacgccaacatcagttaagcgaagcaaagatgcgcgaagtgattgagtacacgcgtggcgactatgccagcacactgatgaaaggccgctctgatcctgcggccaccgaaacgatgctacagcaagtcatacacctgaccggattagatccgacttatgtacgccgtgctggcggacgtctggaaacgcaggcctacctacgtgaagtattccgtgatacaggcgaacttgggagccgctatgacattaacgtcactgcattggacccgtttccctacgattccgagcaacgcaccaacgacccgttactagacagcatcatcgccccaactactacagccatggtcgacttcgtcacccgaaccgttgggtggaaagtacacgaacgctatcaagccctgaactacgatgtaaatcgacaatgggactggaacgaagagttgcgtaaaggctcagtcacacaactacgccaatcggtggccattgacccaaaactacgcgtgttgatcgcacatggctggaacgacctctcctgccccttcatggcatcggtgttgaccatcgaccagattcccaaaatgggcagcgatccaacccggatacaagtgcgcgaatatcctggcggccacatgttttacaaccgccccgacagccaatcatcattccgccaagacgtacaagcgatgtacgaa

SEQ ID NO: 32891 - DNA, 1845 bp, Xylella fastidiosa
ttaaccaaaaatgtgttgctgtgggtggtcgtcgccgtcgtgctgatggtggtatttcaaagtttctcgccacgtattggtggagtgataggcaacgaaccaatcacctatacacaatttctgaatgaagtggatagcggccgtatcaagtcggtgaactacaccgatgagagtggcctgactgtcaacgcgattcgcttcaaacgcaccgacggtagcgagggtttggtctacggaccacgcgacgacaaattggtcgacgtgttatacagcaagaacattgagatgacccggcaaaagccttccaccggcccaggcttttggtctctagtattgaattttctaccagtcatcctaattattggattctgggttttcatcatgcgccagatgcaaggtggtggggctaaaggtgcgatgtcgtttgggaaatcccgtgcaaaattgcaaggcgatgaccagatcaaaatcacttttgctgacgtcgccggttgcgacgaagccaaagaggaagttggtgagctggtcgattttttgcgtgaccccactaaattcaccaagcttggcggcaagattccacgtggagtcttgatggtgggtcctccaggcaccggcaagacgttattagccaaagcaatcgctggggaagcaaaagtgcctttcttttcgatttctggatctgacttcgtcgaaatgtttgttggggtcggtgctagccgtgttcgtgacatgtttgagcaagccaaaaagcatgccccatgcattattttcatcgacgaaatcgacgcggtaggccgtcatcgaggtgcaggcttaggcggaggccatgacgaacgcgaacaaactttaaaccagctcctggtcgaaatggacggctttgaaggcggtgaaggcgtgattgtgatcgccgcgacgaatcgccctgacgtgctcgaccctgcgctgctgcgcccaggtcgcttcgaccgtcaagttgtggttgctctaccagacgttaaaggccgtgagcagatcctaggtgttcatatgcgtaaattactgttagccaatgacgtcgagccgctcgtgattgcacgtggaacccctggtttttctggagctgacttagccaatctgtgcaatgaagcagcgttattcgccgcgcgtagcaacgaaaaggaagtcagaatgaaccatttcgacgctgcccgcgacaaaatactcatgggcactgaacgtcgctcaatggcaatgagtgaggaagaaaaaacccttactgcttaccacgaagctggtcatgccatcgttggccgcttagtacctgagcatgaccctgtgtacaaagtcacgattatcccccgtggccgtgctttgggcgtcaccatgtatcttcctgaaggtgacaaatactcaatcaataaagtggctattcagtctcaactatgctccttatatggtggccgtgttgccgaagaattaatcttcggtgaggataaagtcacaactggcgcttctaatgatattgaacgtgtgaccaagatggcacgcaatatggtcaccaagtggggactctcggatgaactgggtccggttgcttatggcgaggaagaggatgaagtttttcttggccgttctgtgactcaacataaaaatgtctcagatgaaacggcccgcaaaattgatgaggtagtgcgctctatcttggacaaagcgtacgctcgtaccaagcggattttggcagataacttagataagctccacgcgatgtcccagctgctgctgcagtacgaaaccatcgacgcacctcagattgatgccattatggagggtcgtgccccccccccgccggttggctggggtaaacct

SEQ ID NO: 32892 - DNA, 1902 bp, Xylella fastidiosa
  unsure (1)..(1902): unsure at all n locations
ccatgcactgacctgcacacctatgtcaatggcaactggctgaaagccaaccctgtacctagcgaccgcacgagctggggcgcattccaaatgctggacgaacgctctaatgcgatccagcgtcaactgatcgaacacgccgccgccgaccctcaaagcagcggcatcaagaagatcctcagcgacctatggaacactggcatggacgaggccaagatcgaaacccaaggcatagacccactgaaaacggacttggctgcaattgatgccatcaccaaccaggacacattggtaaattacctacgcagcacagctgccaaaggacagggcgagctattcacgctcagcgcataccccgatttcaaggaccccacccgcaacatcgcctacatcagtcaaggcggactgggccttccagatccggagtactacaccaaaccagccaacaaagacaaactcctcgcctacaaagcacatatcgccaaggtattggaattatccggaatggctgccgccgatgctgccaaacacgccgataagatcatcgcgtttgaaacgcgtttggctaaggtctccaaaacaacacaacaaatcgcacgtgacgtgacgctgcactacaacccagtcaccccaacccaggcaaacaaactcactccacactggtcatggactgaagcattcaaggcccaaggcgtgccactaccagacatgttctcgctggcgattccagcgttccacaaagaagtagaccggatgctggctgataccgacgtcgccatatggcgcgcctatctacgcttccataccgtcgataatgcctcgccctacctgagtcggccattcgtggatgaacacttcgcattctggaacaacaccatgcgcgggcagaaagaaatcaaaccacgctgggaacgagtgttggacaccatcaatgagaaaacgggtnnnnnnnnnnnnnnnnnnnatgtcaaggccgccttccccactgaatccaaagtcaagatggaagcattggtcgcccagttgcgtaccgcactcaaagcacgtattgagaagctggactggatgagtccagccactaaatccaaagcactggccaagtgggaaagcttcacagctaagatcggttacccagatcaatggcgatcctgggataacctccataccagccgcgacagttatctaggcaatgtactgactgcaaagcaattcaactacacatggaacctctccaagatcggcaaacctgtagacaagactgaatgggggatgccgccacaaatggtcaatgcctattacgacccgcagaaaaacgagatcgtgttcccagccgctatcctgcaaccaccgttcttcgatccggacgcgccattggaaagcaactacggtggcatcgtggcaataatcggccatgaaatgacccacggctacgatgaccaaggcagccgctttggaccaacaggcaagttcgagcaatggtggaccaaagccgatgccaaagcgttctcggcacgtaccacaaaactggtcacccagttcaacagctaccgcactgaggatggtaaacaagtcaacggctcactgaccttgggcgagaacattgccgatttgggagggctaaatacagcctacgatgccatgaagaccgctaccgccggtcaaacggacccaaaaaccgacggtattacccgtgagcaacgtttcttctataactgggcaacagtgtggcgtgcacaatacaccccagaagagcaggcaatgctactgaaaaccgatccacatgccccgccgcatttccgtacgatcggtccgccatcgaatatgcccagcttcgccgaagcattcaattgcaaaccaggcgacgcaatggttcgccataatgatcagcaagtcgtgatctgg

SEQ ID NO: 32893 - DNA, 900 bp, Xylella fastidiosa
tctgatactgctttactgattgttaatcttggtactcctgaggcgccgactgcggcggcggtgcgccgttatctaggcgaattcctgagtgatcgccgcgtggtatccattccgccgttgttttggaagccattgctgcatacggtgattttgccgattcgcggcccgcgttcagccagaaaatacgccaaagtgtggttgcaggaaggctctcccctcagcgtgtatacccgccgtattgctgaagggctgacgcaacatctgcctgattggcgtgtggcttgggcgatgcgttacggtgctccagcattgacaaaggcgctagatgcgctgcaagcgcagcaggtacgccgcatcgtgatactgccgttatatcctcaatattcgaccaccaccacggcctcagtacaggatgtggtggaagcgtggtgtaagcgtactccccaagtgcaggttgaatgcattcaagactatgccgaggacccagcgtgggtcgctgcggtggctgcttcgatccgtaggcattggcaagcacatggccgcagtgagaagttgatgttctctttccatggactgccgcagcgtgtggccaataacggtgatccctatccgcagcgatgccaggtgagtgcgtctttgattgccgcagcattgaatttgaatgagagtgagtgggtgctcggttatcagtcgcgctttggtgctgagcgttggttacaaccatatgctgagccaacgctctgggcgcttgctgagtctggcatacgtcgctttgatcttgtctgcccaggtttttccgttgattgcctggaaacattggaggaagtggcgctcggtttttcagaaacgctggcagcgcgtggtgcaacgatgcgctacattccctgtctcaatgatgac

SEQ ID NO: 32894 - DNA, 657 bp, Xylella fastidiosa
ttgagaatttccagttttaatgccaatgggttgcgatcggctcttagtaagggtttttttgattggttttctactcaggacattgatgtgctgtgtgtgcaggaaaccaaggcgcagaggcaccagttagttggaccggatttttttccggttggctatcatgtgtgttttcgggatgcgacgattaagaaaggttatagcggagtggcaatttacagtaggtgtgagccggatgagcttcgcactacgctgggttggaccgagtttgacgaagagggccgttatgtggaggcgcgattcggaaatttgagtgtggtttcgttttacattccttctggttcttcaggggagaagcgtcagaattataagtttgaggtcatgcgttggttgcgtccgattttgtgtgagtggttgctcagtggtcgggattatgtgttgtgtggtgattggaatattgtgcgtagtgcattggatatccgtaattggaaatctaatcagaaaaattccggttgtttgccgttggagcgcgattggctcaatggtttatgtgccgattctctacatgatgttaattcggctcaggggcgaggctgggttgatacttaccgtgtgttgcatccgcaaggtgaggattacacgtggtggagtaaccgcggt

SEQ ID NO: 32895 - DNA, 1356 bp, Xylella fastidiosa
agtcttttccatgaagacgatatccacggtgtggtccctggcgagttgaacgcaggtgtggcgaagttgatcggtcaagcgatcggcagtgcgatgcaggccaaaggtttgagtgacattgtgattggccgtgacggccgcgtgtccagttctgagttgtccgcggcattaagtgatggtctacgtcatgccggttgcaatgtggtagacatcggcttggtgccgatcccggtagtgtatttcgctgcctgccatcttggtgttgggagttgcgttgcggtcacagggtggcatcatcctcatgattacaacggtttcaagatcgtgcttggtggtgagtccttatccagtgaggcgatgagcgatttgtatcaatgcatcaccaatggtcgcttatatgcgtccgttgactccggcagtttgagtgagcgtgatgtggttgacgattacattcagcgtattgccgatgatgtgcagttgaatcgtccgctgaagattgttgttgatcctggtcacggtgcggctgaagagatcctgtcacgtttatttaaggcgattggtgcggatctggtgtcactgtacggtgatattgatggtgtttcccttattgtccatcctgattcggacgagccagggaatctgcagaagctgattcagcgggttgagcaggccgatgccgatttgggtcttgcttttgatggggatgcggcaagtctcagagtggtgactcgagaaggtgaggtcattttatcggatagcgtgttgatgttgtttgcgacggatgtgctacagcggaatccgggtgctttggtggtctatgatgctgaatgtactagaaatttgtctgattatgtattgcgcaacggcggcagcccgttgatgtggaagaccgggcattcctccatcaaagctaagatgcgcgagaccggtgccgagttggctggtgaaatgagtggctatttcttcttcaaagaacgctggtatggttttgaggatgctctgtatgcggcggcgcgtttgctggagatcttagcgcagcgcgaggataatccgtcccaggtgtttgctgcattgccccatgcttatttcactgcgcaaatggagcagtctgtcgagggtgatgcgcaggcatgtgtgcagtcctttattgaggaagtgcagcgtagcgttgagggcggtgtgttcgatggtgctcgtttgttcgcatttgatggtttgcgtgctgatttcactgatggttgggggctagtacgcgtttctgacactgcatctgcactggtgttgcgttttgaggctgacacgcaggctggattggagcggattcagagtgcattccgcacgcatctgcaggcatta

SEQ ID NO: 32896 - DNA, 1866 bp, Xylella fastidiosa
acctggtctcaagatctggcccacaagacgtattcgatccggcattgggctgatgggtatttcgaggtgaacgatgctgggcacatggtggtgatgccgctcggtggggatggtgtgcggatctcgctcccagaggttgtggatgctgcgcgtgctgcaggtgccaagttaccgctgctgctgcgtttccctgatattttggggcatcgtctgggtaaattgcaggcggcgttcgctcaggcacagtccgagtgggagtatgcaggtggttacactgcggtttacccgattaaggtcaatcagcatcgcggtgtggcgggtgttctggcgagtcaccagggggatggtttcggtttggaagccggcagcaaaccagaattgatggcggtgttggcgttatcgcgtccgggtgggttgattgtttgtaatgggtataaggatcgggagtacatccgtcttgcgttgatcggacgcaagcttggtttgaagacttttattgtgattgagaagccgtctgaattgagaatggtgcttgaggaggcgaaaacgcttgatgtattgcctggtttgggcgtccgggtgcgtttggcgtcgttgggtgccggaaaatggcagaacagcggtggcgataaggcaaaattcggtttgtcgccgcgccaagtgctggatgtatggaaggtgctgcgtggtactgagtatgccgattgtttaaatgtgatgcactttcatatggggtcgcagatttctaatgtgcgcgatattgctaaggggatgcgtgaggcgacccgttactttgtcgagctttcgcgtttgggtgcgaagatcacgcatgtagatgttggtggcggtcttggcattgattacgagggcacgcgttcgcgtagtgactgttcgatcaattatggtttgcaggcgtatgccagtcacatcgtgcagccgctggcaagtgcgtgtgaggattatgatttggtgccgccacgcatcgtcacagagtgtggtcgtgcaatgacggcgcatcatgcggtgctgatcgctaatgtgaccgaggtcgaagcggtgccggagggtcgggtgccaggggtgtgtgatgatgagcctgcggtggttcgccacatgcgcgagatttacggggagttggatgcgcgtccggcaatagagttgttttatgaagcacagcactttcatgctgagggattggcggcttacaccctcgggcagattgatttggtgcatcgcgcacgtattgatgatttgttttatgcgatttcgcatggggtgcgggagcgtctcagtcacgaggagaagagtcaccgtccggtgttggatgagctgaatgagcgcttggttgataaatattttgtcaatttcagtgtgtttgagtcgattccggatgtgtgggctatcaatcaaatttttccgattgtccccattgagcgtttgaacgaggcaccgacccgacgtggtgtggtctgtgatttgacctgcgattcagatggtacggtcaagcagtatgtggaaaacgagagtctggacagtgcgttgcctctgcatgtgttgcgtcatggcgaggcttacaggattggctttttccttgtgggtgcttatcaggaaatccttggcgatatccataatttgtttggcgataccgatgcggttgaggttgcagtcgacggcagggggtatcgtattgcgcagcagcgttgcggtgatacgaccgatgtgatgttggactatgtcggttatgcgcttgatgaggtgcgcagggtttatgcgcaacgtattgcggcggcggggatgtctgctgcggagtccaaggcattgagcgatatgttggaagccggtctgacgggttatccctatttgtca

SEQ ID NO: 32897 - DNA, 1827 bp, Xylella fastidiosa
atgtgcggtattgtcggtgctattgctggccgtgacgtggttcctgtgttgattgagggcctcaagcggttggaatatcgagggtatgattcttccggtatcgcggtgcttgagagcgggtcaatccggcgggtgcgtcgtactgggcgggttgctgaaatggctgtcgccgcaacgcaagagggatttacagcatcgcttggtatcggtcatacgcgttgggcaacgcatgggggagtgaccgaggccaatgcgcatccacatgtgagccacggtgttgtgttggtgcacaacgggatcattgagaattacgaggtgcagcgcgagcgtctgtctgcctttggctatgtcttccagtcgcagacggatacggaagtcattgcgcatctgattcattactacatgcagcaaggtggcgatcttctgggggcgttgcagtgtgcggtcaaggcgctgacggggatctatgcgttggcggtgatgagtcaggctgaaccagagcgttttgtctgcgctcggatgggatgcccgttattgattggtataggggatggtgagagttttgttgcttctgacatctctgcgctcatccaagcaacacgtcaggtgatttttttggaggatggcgatactgcggagattcgtcgtgatggaatcagtattttcaatgcggaacagtgtccagtggaacgttcattgcatctgtcgaatgtgtcgctgtcttcgttggaattgggggagttccgtcatttcatgcagaaggagattcatgagcaacctcgggtgcttgccgatacgatggaggcggcgattgatgcggctggatttccacccatgttgttcggtgcgcaggccgagtcggtgttccgcggcattacgggtatccagattttggcgtgtggcaccagttactacgctggtttgaccgcgcgttattggattgaggcgattgctggtttgccatgtcaggtggagattgctagtgagtaccgttaccgtaaggcgtatgtcaatccacagcatttggtggtcacgatttcccagtctggggagacgctggatacattggaggcgttgaagtacgccaaagcattaggtcaccgtcatacgctgtcgatttgtaatgctcctgacagtgcgattccgcggatcagtgagttgatttgctatacccgtgcaggcccagagattggtgtggcttcgacgaaggcattcaccactcagctggtggtgctgtttcagttggctgtggcattgggggtgctgcgtggggctgttgatgccgaggatgaagcggcgtatttggagcaattgcgccaattgccttgcagcgtacagcaagcactcaatctggaaccgcagattgctgggtgggcggagtgtttttcgtcgcgtcatcatgcgttgtttcttggtcgcggtttgcattatccgattgcgttagaaggtgcgctcaaactgaaggaaatctcttatattcatgctgaggcatatccggcgggtgagttgaagcatgggccacttgcgttagtggatgctgatatgccggtcgtggtgattgcaccgaacgatagtctgttggaaaaggtgaagtccaatatgcaggaagtgcgtgcgcgtggtggggagctgtttgtgtttgctgatcaggacagtcactttagtgaatcggaaggtttacatgtgattcgtacgctgcgccacacgggggtattgtcgccgttagtacacacgattcctgtgcagttgttggcttatcacactgcgttggtacgtggtactgatgtcgataagccacgtaatctggcgaagagtgtcacggtggaa

SEQ ID NO: 32898 - DNA, 1143 bp, Xylella fastidiosa
caacatcagcgcgaagttgccgagcgggcctcactggctaaaacgcagtttttggcgacgttgggtcacgaagtacgcaccccgatgaccggagtgcttgggatgagcgaattgttattggaaacaccgcttgatacgcgccagcatggctatgcgacctcgatccaagcggcaggtaagcacctcttgcgtttggtcaatgatgccctggatctggccaaaatcgaggctggaaaactgtcgttggaacggcgtgattttgattttcatgccttgttggaacaggtggtggcaatgatccggccgatggtggagcgtaaaggattgcgttttgtctatcgactggatccagaggtgccccagtatgtccatggggatgctgatcgactacagcaaattttgctcaacttgttgatcaacgccaccaaatttaccgagcacggagaggttgtattacaggtcgcgcctggacaggaacaagcctgccttggtgtgcgtattgacgtggccgataccggccctgggttgagtgaagaacaatgccagcgcttattccgtcgttttgagcaagtcaatggtgcatccaccgtagcccgctatggtggcagcggacttggtttggccatttgccgcgagttggctaccgtgatggagggggagatccacgtagatagcgagcttggcaaaggcacctgcttccgtgttctgctgcctcttccatgggtgttggcggtgcaacctgaggttgccgttatggatatggaaccctcaccctgctccaatccgttgcacttgctgctgattgaggacgatccgacagtggcggaggtgatcgtcgaactgttgcgtgtccgtgggcatcgggtgactcatgctttacatgggttggaggccttggtggaggtgacgctgacacgttttgatgtctgtttatgcgatctagatctcccgggattggatggtgctggattgattgtgcaactgcgcgcacaggggcagtcctttccaatcgtcgtggtcactgcgcgtactgatgccgatgcccagaggcaggcgttccacgttggctgcgatgcgtttttacgcaaaccggtcaccggcgagatgctggagcaggtgctcacccaggtgctgagtgcgcct

SEQ ID NO: 32899 - DNA, 1059 bp, Xylella fastidiosa
ctcaaaaacgatcgcctactgcgcgccctacgacgcgacaccgtggaccgtaccccaatctggctgatgcgccaggccggacgctatctgccggaataccgtgctgcccggcaacacgccggcagcttcctcaaaatggcaaaaactcctgaactggcctgtgaaatcaccctgcaaccactgcgccgcttcccactagacgcggcgattctgttctccgacatcctcatgatccccgacgcgatgggcctagaactgcacttcattgaaggtgaagggccacgcttgggcaaaccaatccgcgacgccgcagccatcacacaactcgccgtgccggatatggaaaccgaactacgctacgtcatggacgccgtgcgactgatccgtaaagaactggacaacagcgtcccgctcattggtttctccggaagcccatggacactggcctgctacatgatcgaaggaggaagcagcaaagaatacgcacgcattaaggccatggcattcaacgcaccggacttactacatcaactgctaaacaccgtcaccgacgcagtgatcagctacttggcagcacagcgcgccgctggcgcacaagcactacaggtcttcgatacctggggaggcatcctgtcgcccaggatgtaccgaacattctcgctgccctacttaacgcggattgcacgcgaactagaacgcggcaccggtaccgaacatacccccctggtgttgttcggcaaaggcaacggaccttacatcgcagaactcgccatgagcggtaccgaagccgtcggcgtggactggaccatcgaattagaagacgccgcacgccgcagcaacggccaagtggcattacaaggcaacctcgacccagccacactgtacggaaccccaaacaacatcgcgcatgaagtacaacgcaccctggacagctacgcagccggtaacggtggctcacgcgagggacatgtcttcaaccttggccacggcatgagacctggcatgaacccggatcacgtcagcgcgcttgtcgaagccgtgcagcgcttgagccgtcgt

SEQ ID NO: 32900 - DNA, 1041 bp, Xylella fastidiosa
tataccatcaccattggtcccggcctattgcacgatcctccacgcctggccgccaccatccgcggcagacatgcactcattctcagtgattctgaagtcgccccccgttatgccgcacaactgcatgaaacgctactgcgcgcccgtcccgatctacacctcaacgtattcaccgtgccagccggcgaaacatccaagtccctagagaacttcggcgccgcaatcggccaactcgccacactgggcgccacgcgtgatgcctgcctctttgcactgggcggcggtgtcatcggggatctggccggctttaccgccgcctgctggatgcgtggcatcgactacgtacaagtgccaaccaccttattggcgatggtcgactcttccgtcggcggcaaaaccgccgtagacatcccccagggtaaaaacatggtcggtgccttccatccgccacgtgcagtgatcgccgacaccaacacccttgccacactcccgctacgggaactacgcgctggtctgagcgaagtcatcaaatacggcgcaatccgcgaccccgtattcttccactggctccaaaccacacgcgaagcacttctagcacgtgaccccgccgcactggcccaagcaatcgcacgtagctgcgaacacaaagccgatattgtcggacgtgacccactggaaaaaggggaacgcgtcctgctcaatctcggtcataccttcggccacgccatagaaacaacacagggttacagcacaccaggaagcaacaacctcaaccacggtgaagccgtcgccgtcggcatggtacttgccgcacgcttgtcaaacacattaggtctggcacccgcagaagacaccgagacactgaaaaacctactggatgcctacggcttgcccactgtcctgccctcaggtctaacacctgaaatgctcctggagcgtatgcgcctggacaaaaaaaacattgccggtcgcttacgcttggtcctatggcacggtattggccacgccgaagccgtccccgacgttgatgaagcagccgtg

SEQ ID NO: 32901 - DNA, 498 bp, Xylella fastidiosa
atgaatcccgctcccaatcttgtgatgatcggcccgatgggcgccggaaaaagctccatcggacgacgcattgccaaacacttcaacctacacttcgcagatacagatcacgccatcgttgaacgcgccggtacgagcatctccactattttcaaatattccggcgaaccagaatttcgacgcctggagcgtgaagtactgcacgacttgctgaatcacgaaaaccgactcatcgccaccggcggcggtacgatcctggatccagagaaccgccaccgcatgcaaaaacgcggcttcgtcgtatttctaaagatcaacgtgaacacccaattggagcgactggcacatgaccgctaccgaccattactgcaacaaatcgaccgcaaacaggtactgagcgatctctacgccacacgccaaccgctctaccagaaaatcgcagatatgattgtgaccaccgaccacatgtcccctaacacagccaccgcccagctcatt

SEQ ID NO: 32902 - DNA, 1719 bp, Xylella fastidiosa
accgacgcccaagcccaacctgagaagaaagactttatccggcagatcatcagagaagacttagcccacggcacacacactcacatccacacccgttttcccccagaacccaacggttacctgcacattggccacgccaaagcaatctgcctggattttggcgtcgccgcggaattcggcggacactgcaccctccgcatggacgacaccaatccgagcaaagaagaccccgccttcgccgctgcaatccaggaagacgtctcttggttaggcttccattggaacgcactacgacatacatcggattatttcgaagtactgtacctagctgcagaaaaactcattgccgatggaaaagcctacgtctgtgacctcaatagccaacaggtacgcgaataccgcggcaccctgacagaagcgggccgtccctcaccatggcgtgaacgcagccctgatgaaaatttagaactattccgacaaatgcgcgccggcacgtttccagacggaacacgtaccctgcgtgccaaaatcgacatggctagcggcaacatcaacctgcgggacccagcgctctaccgcattaaacacgtcgaacatcaaaacaccggcaacacctggccgatctaccccatgtatgacttcgcacacgcactgagcgatgcgatcgaaggcattacccattcattgtgcaccctcgagttcgaagaccaccgccccctgtacgactggtgtatcaaccatgtcgacctaccaaacaactcacacctactcaaaccgttactggacaaaggcttccctcaagagcccagccaacctcggcaaatcgagttttcgcgcctgaacatcaactacaccgtgatgagcaaacgcaagctcaccgcactggtggacgaaaaactcgtcgaagggtgggacgacccccgcatgtacaccctgcaaggcctacgccgccgtggttacaccccagcagcgatgcgcctattcgtagagcggatcggcatcagcaaacagaactcaatcattgatttttcagtactagaaaactgcttacgcgagaacctggacaccattgcaccacgccgaatggcaaccattgcaccactgaagctcgtgctgaccaacctacccgaagaccatgaagaacaactgatcttccccaaccatcccaaagacgacacacaaggcacccgaacagtgccgttctcacgcgaactatggatcgaacgcgatgatttttccgaagtcccccccaagggctggaaacggctggttccaggcggagaagtacgcctacgcggtgccggcatcgtacgtatagatgaggtggtgaaaaacgcagaaggccacgtcatcgcactacacggctggcttgatccgacctcacgtcccggcatggaaggcgctcaccgcaaagtcaaaggcaccatccactgggtcagcgcaccacacgctgtagcagcggaaatccgcctgtacgaccggctgttctccattgaaaaacccgacgacaacaccgacgggaaaacctaccgcgacttcctcaacccagactccaaacgcgtcgtgcatggctacatcgaaccagcggcggcacaaaccgcaccagaacacgcattccaatttgaacgcttgggctacttcgtcacagaccggcatgaccacgatgccacacaccccgtctttaatcgcagcgtcacgctgcgcgacacctggcagcgc

SEQ ID NO: 32903 - DNA, 960 bp, Xylella fastidiosa
atctacgctagaatcgcaggcacaggcggttatttgccggaaaaagtgctaactaatgacgatctggcccatatcgtcgataccagcgatgaatggatccgcactcgcaccggtatccgtgagcggcatattgctgccgaaggcgaaacgaccagcgatttggcttatgaggctgcgatacgtgcacttgaagctgctgaggtgcggtctgctgatttggatttgattgttgttgggaccacaacgccggacttgatttttccgtctactgcttgcttgttacaggcacgtcttggagctgttggttgtggtgcgttcgacgtgaatgctgcatgttccggttttatatatgcgttgagcgtggcagaaaaatttgtgtcttcgggttgctccaaaacagtgttagttgtgggggccgataccttgacccgaattatcgactggagtgaccgcacgacttgcgtactattcggggatggtgccggagcggtggtgctcaaggctgatgaagatacagggattctcagtacccatctgcatgctgatgggagcaaaaaagaattgttgtgggatcctgttggtgtgtcagttggttttggtgaaggtaaagattgcggcgcgctgttgatgaagggaaatgaggtgtttaaatatgccgttaaagcccttgatagagtggttgatgagacgttggaagcgaatcatctggataagcacgaactcgattggttaattcctcaccaagcaaacttacgcattatcgaagccaccgcaaggcgtttagatatgtcgatggatcaggtggtggtcacggttgatcgtcacggcaacacttccacggcttcggtgccactcgcgcttgacgaggctatccgttctggtcgtgtgcagcgtggtcagttactgctcctggaagcattcggtggtggttttacttggggatcggcgttactgcgctat

SEQ ID NO: 32904 - DNA, 1014 bp, Xylella fastidiosa
ggttaatcttcccgcctctacactgataataatgctgacatttttatgaaaatcctcgttaccggagggagtgggttcctcggcgaagcactatgccgaggattacttaagcgtggctaccaagtagttagtttccaacgtagtcactaccaagcactgcaagcactaggcgttgtgcagatttgcggcgatctgagcgattttcacgcggtgcggcacgcggtgcgtggtgtggatgcggttttccataatgctgccaaggtaggtgcatggggttcctacactagttaccaccaaatcaatgtgatcggcacacaacacgttctggatgcctgtcgtgctgagaacattaacaagttagtgtacacctcaaccccgagtgtgattcatcgctcaaactacccggttgagggtttagatgcagatcaagtgccatatagcaacgccgttaaagtgccatacgttgcgactaaagcaatggctgaacaggcggtgttagcagccaacagtgtcgacttaaccaccgtggcactacgcccacgcatgatatggggcccaggcgaccctcacttgatgcctcgcttagtggcgcgcgcccgcgctgggcgactgcgtctgataggcgatggtcgtaacttagtagatagcacctacattgacaatgccgcacaagcacatttcgatgcgtttgagcatctcatgcctggagcagcgtgtgctggcaaggcttatttcatctccaacggtgagccgttgcagatgcgcgaattgatcaacaagctactggccactaccaacgctccaccggtgactcaatcactgtcatttaagacgggttactgcattggtgcattttgcgagatgctatggtcgttactacccctccctggagaaccactactaacgcgttttctcgttgagcagatgtctactcctcattggtacagcatagaaccagcgaagcgtgacttcgggtacgtgccgcgcgtgtccattgaagagggcttggtacgt

SEQ ID NO: 32905 - DNA, 1407 bp, Xylella fastidiosa
ttgccatcgtttctaaagcgcaagtccattgatctaatcaccgtgcatgaagaaggacgacgcctggtccctacactgagctggccacatctgatcgcatttgggattggtgcaatcgttggcactgggatctacaccttaatcggggtcggggcagaaaaagcggggccagcagtcctcctctcattcgtcatcgctggggtcatctgtgcctgcgcagcgctggcatatgccgagatggcgacaatgatgccagtggcaggcagcacttatacgtacagctatgtggccctcggtgaggggattgcctggatcgtggggtggagtctcatcttagagtactcactggtggtcagcactgttgcggtgggatggtccgggtacatgactgggtttctcaagagcgtaggggtcgatatgccgctggcgctcaccgccggaccgtatgctggcgggataatcaatcttccggcggcagtgatcacctgcgttgtggctggactgctgatcgtcggcacaaaagaaagcaccacagtcaacgcggttctggtggtggttaagatcattgcgctctctgtgttcgtcgtgatcgcgctaccacattttgatatggctcatctgaaaccgttcatgccctatgggtttaccaagtcaatcgacaccggaggtgtggaacgcggggtgatggccgctgcagcaatcattttttttgctttctatggtttcgatgcaatctccaccgcagccgaggaaactaaaaatccaagccgcgatctgtccatcggcatcatcggttctatgatcggatgcaccttaatttacgtattagtggcactagctgcgatcggtgcaatgcactacaccgtgttcggtcccagtactgaaccgctggcgctgattctgcggcaacttgaccagggcaacaccgccaggctcatcggagcagctgcgattatcgcgctacccactgtactgttggcctttttatatggacaaagccgcattttgttcgtgatgtctcgggatgggctgctgccacgtgtattgtcgacggtgaatgaacgcacaggaacaccgatcgccacgacactgttcaccgcaattctcgtcgcaacggcagcagggttggtgccattgggcgagattgccgcgctggctaatgctggcacgctgactgcgttcatcgcagtagctttatgcctgctggtactgcgggtacgtgaaccacagcgcgtgcgtgcattccgtacaccactggcttgggtcgtcgggccaatcgcaattgctggttgtttgtatctgttctggagtctaccaaagatgacacagtctctttttctgctgtggaacgcactgggattgtgtgtgtatctggtctatgggcgccacaccagcctgctatcaaag

SEQ ID NO: 32906 - DNA, 2184 bp, Xylella fastidiosa
gtgaacgtctctcatgtgcttgatcacttaaatcagaaccaacgcgaggccgttgctgcagctcccggccactacctgatcctcgccggtgccggatcaggaaaaacccgcgttctcactcatcgcatcgtttggctcaacgaggtaaatggagtacccacccacagcatgatggccgtcaccttcacgaacaaggccgccggggaaatacaacaacggattgatctacaactgcgccacggtaaacgcggcatgtggatcgggaccttccatagcctggcgcatcgcttactgcgcctgcattggaacgacgcaacattacccgaaaacttccaggtcatagacagcgacgatcaattgcgcctcgtcaaacgagtgatccagtccttgggattgaatgacaccctcttccctcccaaacaggcgatgtggtggattaatacacagaaagatgaaggacgccgcccagagcacatccaacccgagtcacacgacgactggatcgagacgcagcgccgcatctataccgagtatcaggagcgctgcaaccgcgctggtttggtcgatttttcggaactgctgctgcgggcacatgaactgctacgcgatacccctgcactactgacacactaccgttcgcgcttccgtgagattctgatcgacgaattccaagataccaacgccatccagtacgcgtttgtgcgtgtccttgccaatgacactggccacatcttcgccgtcggcgatgacgaccaagccatctacggctggcgtggtgccaaagttgagcatgtacaacacttcctgaaagattttccaaacgtgcagaccatccgcttggagcaaaattaccgctccagcgccaatatccttgacgctgccaacgcaatcattgcccataacccagaccgaattggcaaacgcctctggactgaatccggtgttggtgaatccattgatctatacgccgcctacaacgagattgatgaagcccgctacatcgtcgaacgcgcccgccagtgggtacgcgacggcggcagctacggcgagatcgcagtgctttaccgtagtaacgcacagtcccgcgcatttgaagaagtgctgcaatccgaacatatgccctaccgtgtttacggcggtatgcgcttcttcgagcgtgccgaaatcaaggatgccctagcctatctgcgcctgcttgccaatcgtagcgatgatgctgcgttcgaacgcgttgtaaatacccccgtacgcggcatcggtgagcgcaccttagatgaagtaagacacctagcacgtacccaaggcttagcactatgggatgcggcaatggcatgtacccaatcaaccacgctgaccgcgcgcgcgcgtaacgccttggcgagtttcctcaatttactgcaacaacttgcgctggaaaccaaccagatggatttagccgaacgaattgaccatatgctgcagcgttcggagttacgccagcactggaagaaagaagcacgtggttctctggatgccgaatcacgtcaagaaaacttagacgaacttgtttccgtcgcttcacgctttgtccttccgcaaaacgacgaagacacacccatcatgaccgaattagacgcgttcctatcctacgcgtgcctggaaagtggtgatggtcaagtccaagctggggaagaaggcgtacaactgatgaccctacactcagccaaaggcttggaattccccctagtcttcttggtgggcttggaaaatggattattccccagcgcgcgttgcctggatgaacacggccgactagaggaagaacgccgcttagcgtatgtcggcatcacccgcgcccgtcacaaactcatcctcagctatgcccaagcacggcgtatccacggtaaagataactacaacgtcccctcacgctttttacgcgagatcccgcaggatctattgcatgaagtacgccccaccatccaggtctcacaccagcccccattaggagcagcgcaacgtccagcccatgatgaacgcgacgcagcacctatcaagctcggcgtgaacgtcatacaccctacatttgggtgcggcgtggttgtcgactacgaaggcagcggcgcccacacccgcgtacaaatcaaattcgatgacgccggtacaaaatggttggtcatggcatacgccaaactcagcgtggta

SEQ ID NO: 32907 - DNA, 1332 bp, Xylella fastidiosa
atgttagacaaagtcgttattgccaaccgtggtgagatcgcgttgcgtattcttcgcgcatgccacacgttgggtatccgcacggttgcggtgcactctaccgttgatcgtaatctgaagcatgtcgcgatggctgatgagtcggtgtgtattggtcctgcaccatcggcggagagttatctcaatattccggcgctgattgccgccgctgaggtcacggatgctcaggccatccaccctggctatggttttttgtcggaaaacgctagttttgctgaacgtgtggaacagtctggcttcattttcattgggccacgggcagagacgattcgtttaatgggcgacaaggtgcaggctatccatgcgatgaaagcggctggtgtgccgtgtgtccctggttcggatggtccattgggtgatgacattgtcgctaacgtcaaaattgcacgtgagatcggttatccggtcatcattaaggctgccggcggaggcggtggacgcgggatgcgtgtggtacataccgaggccggtttagaggcggctatcgagaccacgcaatgtgaagctaaagccgcttttggcaatggccaggtgtatatggaaaagtttctggagaatccgcgtcacgtggagattcaggtgctcgccgatggtcaggggaacgcgatccatttgggggagcgggattgttcgatgcaacgccgccatcagaaggtggtggaggaagcccccgcaccaggtatcactgaggcgctgcgcaatgaaatcggtcaagtgtgtgtagatgcctgtattcgtatcggttaccgcggtgctgggacgtttgaatttctgttcgagaatggtcgtttttacttcatcgagatgaatacgcgcatccaggtagagcatccggtgacggagcgtatcactggtattgacttggtatgcgagcagttgcgtattgccgctggtcagccattgagtatcaagcagagcgatgtggtgttgcgtggccatgcgatcgaatgccgtatcaatgctgaggatgcggagacgttcttgcccaatccgggtttgattactgcgttccatccaccaggtggtccgggtgtgcgtatggatacgcatatctacagtggttacaaggtgccgccgaactatgattcgatgatcggcaagctcatcgtgcatggtcctgaccgtgagacggcgattgcgcgcatgcatttggcgctgagcgaaatggtcgtggatgggatcaagaccaatatcccattgcagcagcgcattatgtgcgataagggtttccagtccggtggacagaacatccattatttggagaagtgtttg

SEQ ID NO: 32908 - DNA, 432 bp, Xylella fastidiosa
atggctcatttgctgctgttacatggtcctaatttgaatttacttggtacccgtgaacctgagatctacggccgtatcacgttgccgcagattgatgcggccttagccgaacgcgctgcgactgctggtcacggactgagtagtttgcaatcgaatgccgagcatgtgttgattgaacgtattcatgccacgcgggaggatggcactgcgtttatcttgataaatcctggggcgtttacccatacctcagtggcattgcgtgatgcgctgcttgcagtagcgctcccgttcgtcgaaattcacctttctaacccgcatacacgtgagccgttccgccatcacagctatctggctgacaaagccttgggcgtggtgtgtggttttggggtggacagttaccgtattgctttggagggagtgattgccagactt

SEQ ID NO: 32909 - DNA, 1185 bp, Xylella fastidiosa
ttatttacagatgtggaattggttccgggtgatcccattttgagcctcaacgatgcttataacgccgatacgcgtaccaacaaggtcaatttgggtattggtatttattgtgacgagagcggttgtatcccgctgttgcgggctgtccagcaggttgaagagcaacttgcgaagcatccgaaaccgcgcggttatctgccgattgatggtttgccagcctatatcaaagccacacaacaattgttgtttggagttgactccctcttgttgacggctggccgtgtggcgacttcacagactgttggaggttctggtgcattgcgggtggctgctgaggtactgaagcaggtgctaccgcatgccactgtggccattagccgtccaagctgggagaaccaccgtgctttgttcaccgctgctggcttcaagattgaggactatacctatttcgatacgctcggccacgcggtggactttactggaatggtggcggacttggcgaagctgcaaccaaagaccgtggtattacttcatggttgctgtcataacccaacgggtgccgatctcagcagggatcagtggaagcagcttgttgccttgttccaggaacgtcaattgctgccatgtattgatctggcttaccaaggattcaatcagggcattgatgcggatgcttatgccatacgtttgcttgccgaagaaggtattagtaactatgtagttgccaactcctactccaaatcgttctcgttgtatggcgagcgtgttggggggctgtcgatcgttgcttccaatactgagcaagctcaagcaatccagtcacaagtaaagcgtatcatccgtacgatttattccagtccgccggcacacggtgcctacttggtcgcgagcgtgctgaacagtcatgaattgcgcacgctgtgggagcaggagttagctcagatgcgtgaacgtatccacgggttgcgtgcgggtttggttactcgattgaaggcgctgggtgtgccggagtttgatttcatacaacgtcaagcaggcatgttttcgtattcggggttgagcaagatccaggtggatcgtttacgcgacgagttcgggatttatgcggtcagtagtggacgtatctgtctggctgcgttgagtcagcacaaattggaatacgtggcccaggctgtggtgaaggtg

SEQ ID NO: 32910 - DNA, 1032 bp, Xylella fastidiosa
gacgacctccgtatccgaaaaattgaaccactgacacctcctaacaagctcctcttgcaactaccatgcgatgagcaggcatcgctgactgttgcaacctcacgcaacgcactgcacgatatcctgcacggccacaatggccgtttagccgtcgtgataggcccatgctcaatccatgatccaattgcagccattgattactcgcaacgtctacgcccattgcgtgagatgtacaaggatgcactagagatcgtgatgcgagtttactttcagaaaccgcgcaccactattggttggaaaggattggtcaacgatccggatcttgatggcagcttccagatcaataagggcttgcatatcgcgcgcaacctgctgcgcgatatcaatcatctcggcttacccgctggtgtggaatttctagacacgatttcgccgcaatatctggctgacttagtcgcctggggtgccattggtgctcgcaccactgaaagccaaatacaccgtgaaatggcttcaggtttatcgtgcccgattggctttaaaaacagtaccagtggtgatgtgaagattgctgctgacgcgattaaagcagcttcgcatccgcaccatttcctttcagtgacaaagacaggtgttgccgcagtcgtcgccacccagggtaaccccgattgtcacgtgattctgcgtggaggcaaggtcccgaattacgacgcaatcaatgtcgaagctgccagccaaacattgcttaaatccaagctaccggtgcgactgatgattgatgcgagccatgccaatagcggcaaaaatccaaacaatcaacctaaggtgatcgagaacatcgtagaacagcttaaagccggtgaacgccgcatcatcggtgtcatgattgaaagccacattgttggtggccggcaagaattagtccttggaaacacacttacctatggacagagcattaccgatgcttgcatcgactgggatacctcggtcgcaatgttagaacagctcgctcaggccgtacgcgtcagacag

SEQ ID NO: 32911 - DNA, 876 bp, Xylella fastidiosa
gtccgcgattacctgactgccctacaagatcgtatttgcaatgtggtcgagaccatcgatggtcaatcgcattttcacgaagaccactggcagcgtacggaagggggcggtggacgtacccgtctcttgcgtgatggtgccgtcttcgaacaggcaggtattggcttctccgatgtctgcggtacacatttaccaccatcggccagcgtgcgccgtcctgaactggctggtgccaattggtgtgcctgtggcgtgtcactggtattccatcccaaaaatcctttcgtccctaccacgcatctcaatgtgcgctactttcgtgctgagcgtgatggcaaacaggttgctgcttggtttggcggtggttttgacctcaccccgttttatccctttgatgaagatgtcgtgcactggcacacagttgctcgtgacctatgcgccccatttggcgacgaacgttatgcagcgcataaacggtggtgtgacgaatactttgtactgcgtcaccggaatgaaacacgcggtgttggcggcttgttctttgatgaccttgataaggattttgagcgcgattttgcttaccagcgtgcggtgggggatggcttcctcgacgcttattttccgattgtgactcgtcgtcatgacaccccctacggtgatcgcgagcgcgcgtttcagctgtatcgacgtggtcgctacgtagaattcaatttgttatttgatcgcggcacattattcggcttgcagagtggcgggcgtgctgaaagcattttgatcagtctgccgccgttggtacgctgggaatatggttaccaccctttaccaggcagtgccgaggcgcgtttggctgactatctattgccgcgtgactggctg

SEQ ID NO: 32912 - DNA, 2517 bp, Xylella fastidiosa
ttgtgtcccggcgcttacgcggcgttgccatatgtcgctcgcgtgtatgcagaaaacgtgttgcgccgcgccgcgccggatcagtggcctgcgtatctgggccagctcattgggcggcgctgtgatactgatatcccgtggtttccagcgcgtatcgtctgccatgacatccttggcctgacagcactggttgatttggctggattgcgtgatgcgattgcggcccagggaggggatgccttccaggtcaaccccacggtgccggtacaactgattgttgaccactcattggcggtggaatacggcggcagcgatccggaggcggttgccaaaaaccgtgcgattgaagcacgccgcaacgcggatcgatttcattttatcgagtggacccgacacgcttttgaaaatgtcacggtgattcctccggggtacggcatcatgcaccaaatcaacctggaggcactgtcgcctgtcgtcgcagtccaggatggcgtggcgttcccagatacctgtatcggtacagatagccataccccgcatgtgaatgctctgggtgtggttgccattggtgttgggggcttagaggcggagagtgtgatgctgggccgtgcggtgtggctgcgctgtccagagagtgtgggtgtggagttacacggatgcccgcgccccgggatcaccgcaacggatattgtgctggcgctgacagcgtttttacgccaggcgcgtgtggtgggtgcgtatctggaattccgtggcgaaggcgtcgctgcgctcaccgtgggtgaccgtgccacgattgccaacatggctccggaatatggcgcaactgcggcgttgttctttattgatgcgcagaccgtggagtatttacggctgaccggacgtgacaaggcacaggtggcgttggtcgatacctacgccaaacaggccggactgtggtccgatacgcttgatggggcacagtacgcgcgcctgctgcatttcgacctctccagcgtcgcacgcaccatggctggcccgtccagcccacatcaccaattgcccacatccgcgttgacggagcgcggcattgctggcggcttggcgcaagcgcgtgcagaggaagccgccgggcatctgcccgatggcgcagtcatcattgcggcaattacctcatgcaccaatacctctaacccgcgtaacctcatcgctgccggtttattggcgcgtaatgctcatgcccggggactacgctgtaaaccttgggtcaaaacctccctagcgccgggttcccaagcggtgccattgtatttggaggcggccggactattgtccgcgctacagcagcttggctttggcgtcgtcggttttgcttgcaccacctgcaatggcatgagtggtgcactcgatccgctgatccagcacgccatcatggcgcgtcatgtacacaccgtggctgtgttgtcggggaaccgcaactttgacggacgcattcatcctgatgccacacaagcttttttggcttcgccgcctctggtgattgcctatgcaatcgctggcaccatccgttttgatattgaacgagatgtgctcggtcatgatgccgatggtaccccggtgatgctcaaagatatttggcccagtgatgccgacattgatgcactggtgcgtcgcagcgttcacccggagtaattccgtcatgtgtacatgccgctgttgcaagcgtctagacagcggcgtgaatgcgtcccgccgttatacgcatggcaccccgggagtacgtacatccgtcggcccccttattgggaaggggtcttagccggtgcgcgcaccttgcgcgggttacggccgttggcggtgttgggcgataacatcaccaccgatcatctgtctccgtcgaatgccatcctgcccaatagtgcggctggagagtatctggcccgcatgggggtgccccaagaggactttaatagttatgcaacccgccgcggcgaccatttgaccgcccagcgcgccaccttcgctaatccgatgctgttaaacgagttggtgcgtgatgctgatggcaaggtgcgtcaagggtcgctgacccggcttgagccggatggcaccgtgatgcggatgtgggaagccatcgaaatctacatgcagcgcagccaacctttgatcatcattgctggtgcggattatgggcagggatcctcccgtgactgggcggccaagggcgtgcgtctggctggcgtggaggcgattgtggccgaagggttcgagcgtatccaccgcaccaatgtcattggcatgggcgtgttaccgctgacgtttcaccctggtaccacccgcatcacgttgcgcattgatggcacggagttgttcgatgtatgcggcgtgccgagtgtgggtgcggtgttgatcctgcgtatccagcgccgtgatggcagcgtcgcggaagtgccggtcacatgtcggctcgataccgctgaggagctgtcaatttatgcggccggcggcgtgttgcagcgtgttgcgcaagagatgctt

SEQ ID NO: 32913 - DNA, 2472 bp, Xylella fastidiosa
ctgccaattgatgcgctactaccagctataacaacgagcttatccaatcatccacgcctgattttggaagccccaccaggggcaggtaaaaccacccaagtaccgctggccttacttgatacgccgtggctgaacggacgcagcatcatccttttggaaccacgccgggtcgccgcacgcaatgcggcactgttcatggcccgccaatgcggtgaagaggtcggtgggcttgtcggctatcacatccggtttgaaagtaaagtctctgcacgcacccgcattcacgtcgtgacggaaggaattctgacccggatcatccaggatgacccgctgctggatggcatcggcgcgctgttgttcgacgaattccatgagcgccatttggccagcgaccttggcttggcgttggcactggacgtgcagacacagctacgtgaggatctacgcattgtcgtgatgtcagcaaccctgcaagggcaacgcttggcgcaatttctcgatgcaccacgtctgaccagcgaagggcgtgcctaccccattacgatcactcactttcctgcgcgccgtgatgaatcacttgaaacacaggcacgccgcgccattcagcatgctctggacacacaccaaggtgacgtgctgaccttcctccccggccagcgagagatcgccaggttacaagccatactggagaaaacactctccccagaattgcacgtgatgccactgcacggtgaactaccgctgcaagagcaaacacgtgtgctggaaccagatcaacatggcaggcgacgcatcgtgctagccactaatgtcgctgagtcctcaatcaccttacctggaatatcggtggtgatcgacagcggattagcacgtgaacctgcctacgatccgaataccggcttcacacgcctggatgtggtgaacatcacgcaagcttcggctgaccaacgtgctggacgtgcaggccgcctcgccccaggctgggcctatcggctgtggccgcaatcacaacgactggaagcacaacgccgaccggaaataatccaaaccgaattatctggtctggccctggaactgacagcttggggcagcagcacactgcgcttcatcgacccccctccctctggcgcgttgagcgctgcacgcgaattactacaacgactgggtgcgatcagtaacacctgcaccctcactcccctgggtaagcgcatgctggcactgggcattcatccacgtctggccgccatgttgctggccccacacgatccgcaggaacaggcgctggcctgcgatttggcagcattacttgatgcgcgcgatccactgcgcggcagcggcgacgcgctgattagtcgctggcgtgccttagccgaattacgcagcggctgtctccctcacgacaccaaacgcagcacactaaaagccatcgacgccacaacgcaccaatggcgaaggcgcatccgctgtgacgccacaccaccggatgcgatagaagcgcataccctcggcaacctactcacacatgctttccctgaacgcatcgccgcacgtcattccagtgacccactgtattacgtattagcgaacggccgccgtatgcgcctgttagacaacagtgcgctgcatggcgaaccttggatcatcgccagcgagttacatcacgggatcaaagacatccaactgctctgtggtgcccctttggatgagagaaagttgcacgctgatttccccgaacgcttcatccaacacgatgtcatacgctgggaaacagataaacgcgccttggtggcgcagcgtgaatcctgcttcgaccgcatcgtcctcgacgtacgccccgccggacgcattgatccagtacaggctgcaaacgtattaaccggagccgtacgcacgctcggcctggataccctctcgtggacagaacacctacgccagtggcaggcacgcgctgtagcactgcgtcactggatgccggagcttgaacttccagacctttccaatacaacgttactagcaacactggacacgtggttaagaccagcattcgcagggaaaaccagactggatgcactggatgaagcggcattcgagcaagcagtcaaatcgctactatcgtggacacaacacgcactcatcgaccgtcatgtacccgcccacatcatcgtaccgtctgggatgggacgccacattgactatggattagccgacgatgggacgccgcagccgccagtgctttctgtcaaactacaagaattatttggtcttcccgataccccacgcatcgcaaaaaaccgtatccctctcactctacacctactctcacctggcgggcgcccgctgcaagtgactcaggatttaaagagtttttggactaacacgtatccggaagtgaagaaagaaatgaaaggacgctatccgaaacacccatggcccgacgatccatggactgcaaccgccacccaccacacgaaa

SEQ ID NO: 32914 - DNA, 1449 bp, Xylella fastidiosa
ctgcgcatcttggctgaagctttgacttacgacgatgtttcactcgtcccttcccattcgaccgtcctgcccaaggatgtcaagctcgaaacccggttgacacgcaatatcaggctcaaattgcctatcctttcagcggcgatggacaccgtcacagaagctcgtttggcgatcgtcatggcgcagcttggcgggattggcatcatccacaaaaaccttaccatcgaacagcaagtcgctgaggtcactaaagtcaagaaatacgaatctggcgtcattcgtgatccgattacagttgatccagagacatcaattcgcgatgtgttagcactgacccgtgccaagaacatttctggtgtccctgttgtcgataaaggtcaattaattggtctcgtgactcaccgcgatatgcggtttgaaagggagcttgatgaccccgtgcgccatatcatgactaaaaaagaagccctggtgacagtcaaagaaggggccgactcccaagaggtactccaactgctgcataaacatcgcatcgaaaagatattggttgtgaacgatgcttttgaactgcgcggcctcattactgttaaagatattcaaaaaaaatccgactatcccaacgcagccaaagatgcagtgacccgcttgctggttggtgctgctgtgggtgtagggggagagactgaaaagcgcgttgagacattggctactgctggagtggatgtgatcattgtcgatactgcgcatggttattctcagggtgtgcttgatcgtgtggcttggatcaagcgttacttcccgcaactacaagtgattggcggcaatattgtgactggtgatgctgccttggcactgatggatgtcggtgccgatgcagtgaaggtgggtgtcggtcccggctccatttgtacaacgcgaatggtggcaggtgttggtgtgccgcagatcaccgctgtgcagatggtttccgacgcgctgcaagatcgcattccgctgattgctgacggcggtatccgctattccggtgatattggcaaggcattagctgcaggcgcatcaaccgtcatgatcggtggtttgtttgcagggactgaggaagctcccggtgatgttgagttgttccaggggcgcacttacaaaagctatcgcggcatgggttccttggcggcgatggaaaagggctccaaagaccgctatttccaggaagcgagcgacgttgacaaactggtcccggaaggcattgaaggacgtgtgccttaccgtggttcagtcagtggcatcgtgcatcagctgatgggcggcttgcgtgccaccatggggtatgttggctgcgcaacaatcgaacagatgcgtaccaaaccccagtttgtgaaaatcactggggccggtcaggttgagagtcacgttcatgacgtgcaaatcaccaaagagccgccgaattatcggatg

SEQ ID NO: 32915 - DNA, 840 bp, Xylella fastidiosa
gctcgtattctcgacgggcgtcgtattgctgatgacctgcttgatgctttgaaaacacgcgtggatgcacgtgtgtcggcaggtaaactgcctccaacgttggccgtagtgctcgtcggttccgatccggcatcagtggtgtatgtccgcaacaagcggcgtgctgcagagaaggtggggattaaagcttatgacttcgatcttccagaagcgacgactgaggctgagttggccgcgttgattgaccggcttaatgccgatccaaagatccacggtatcctgatccaattaccattgccgggcatccctgatgcgcatcgattgattcaacgtattgacccgcgcaaagatgtggatggtttccaccctcaaaatgttgggcacttagcattgcgtgagtttggtctcagaccatgcacgccacggggtattgtcaccttgctcggccataccgaccgaccgctccgagggcgtaatgccaccattgttggagtgagcaaccatgttggccgaccgatgggactggagttgttgatggctggttgtactgtcaccagttgccataaattcaccccaccacagatgttggaaacagcagtgcgtcaagccgatattctgatcgttgcagtgggccgtccgggagtgattcctggagagtgggtgaagccaggtgcagtcgtgattgatgttggcattaatcgacttgatgatggtcagttggtgggtgatgttggttttgagagtgcagttaagcgtgctagctggattaccccggtacctggcggagtaggaccgatgaccgtagcgacgttgatgcaaaacaccctggaagccgccgaa

SEQ ID NO: 32916 - DNA, 942 bp, Xylella fastidiosa
atgattaagcgtattcgcaaggctgttttccctgtggccggtcttggtacacgttttttgccagcgaccaaaaccatccccaaggaaatgctgccaattattgataaacccctcatccagtacgcggttgacgaagcgatccaggctggatgcgatacccttgtgtttgtgaccaaccgttacaagcatgcggtggccgattacttcgacaaagcgtatgaattggagcagaagcttgagcgtgccggtaaatatgagcagctggaattagtgcgtcatgtgttgcctgatggagtgcgtacggttttcgtcactcaaactgaagcgctcggtctaggccatgcggtgttgtgcgccaagcctgtggtgggtgatgaaccatttgcggtgttgctgccagacgatctcatgtggagtcgtaatggaggtgcactgaaacaaatggctgatgttgctgaagtctccggtagcagtgtcattgcagtagaggatgtccccgtcgataaaaccgttaactatggcatcgtcggaacggatgtgtttgatggatgcaagggccgcattactcaaatcgtcgaaaagcctaagcccgacgatgcaccgagcaatcttgctgtggtggggcgctatgtcctgagtggcaagatattcgagatgcttgaaaacacctctatcggtactggcggcgagattcaattgactgatgcgatcgctgaattactgaaatacgagagagtggatgcataccgcttccaaggtcgccgatttgattgtggtgcacacattggtctgattgaggctaccctgcatttagcccttgaacacaagaaacatggtcaggcggtgcgtgagatcctgcgtgacacattacttacggtcgacaagagataattatcagtatttgcttaggtttgcgtaaagatgcttatcgtacgtcgttct

SEQ ID NO: 32917 - DNA, 666 bp, Xylella fastidiosa
ctagaaatgctcaacgtccacctagaaacgctgagtgctgaaaatcgcgtgcgctgggcactggagcacggtcctgaccaccctgcactgtcttccagcttcggcgcgcaatcggccgtcatgctgcatctactcacccggtttgcaccggatatcccggtcattctggtcgacaccggctatcttttcccagaaacctaccgtttcgccgacacgctgaccgaacgactcaagctcaatctgaaggtataccaaccgctgcgtagcggcgcttggacggaagcccgtcatggtcgactatgggaacaagggatcgacggaattaatcaatacaacaccttgcacaaggtcgaaccgatgcgccgggcattagaggaattgcaagtcggcacctggtttacaggcctacgtcgcggacaatccagtacccgtacccaaacatcaatcgtgcaacgacgtgacgagcggtacaaaatcagtccaattgtcgactggaccgaccgtgatatctgggaatacatgaaacaccatgatctgccctatcacccgctttgggaacagggctacgtttcaatcggtgacattcacacgacacgccccttggaaccagacatgcgcgaggaagacacacgcttcttcggattcaaacgtgagtgcgggattcac

SEQ ID NO: 32918 - DNA, 1677 bp, Xylella fastidiosa
agttcctcctccattgaagacatcaagggccagagccaccgcctgcgggggtctctgttggagagtctcgcaaatccaaccaccggcgcgctcggcgaaagcgaccaaacgctgattaagtaccacggcagctaccagcaggatgatcgcgatctacgtgaggagcgccgtcggcaaaaactcgaacctgcttaccaattcatgatccgcacccgaacacctggcggcgtcatcacgccgcagcagtggctgcagttggatgccatcgccacgcgctacgccaaccactcattgcgcgtcacaacacgtcaggcattccagttccacggagttatcaaacgcgaattgaaaacaacaatgcaggcaatcaacgcggcattgatcgatacacttgcggcctgcggcgatgtcaatcgcaacgtacaggtcgctgccaatccattgatctcgcgtgcccatgcagacctttataccgacgcagcacacctgtctgagcatctgctacccaacacccgcgcttactacgaaatttggctggatgaaaaaaaggtcgctggtgccggtgaggaagaggaaccgatctacggcccgcactatctaccgcgtaaattcaaaatcggttttgccgcaccaccaatcaacgatgtcgatgtattcgccaacgacctggggtttatcgcagttatcgttgacaacactttgcttggctataacgtcactatcggcggcggaatggggacaacgcatggtgaccccgacacgtggcctcgcatcggcaacatcatcggcttcatcacccgcgccgatctgatcataatcagcacggccatcgtgaccacgcaacgcgacttcggcaatcgaacgctacgcaagcgcgcccgcttcaaatacaccattgatgaccgcggtctagattgcatcgtcggcgagatccagcagcgcgccggcatcatactgcaaccagcacgaccgtttgtattcgaacacaatggagaccgttacgggtggattgaaggtgaggacgggcactggcatctgaccttatcgctaccagccggacgcatcgccgataccgaaagcagccccctgctgagtggcttccgagcaatcgcgcaactcggcatcggccaattccggatgacaccgaatcagaatgtcgtgattgctggcatctctcccggacagcgcgccgcaatcgacgcactggtcacccagtacggtctggataccggcaaccgtgcgcccacagccctcgcacgtcacgccatggcgtgtgtcgcactcccgacctgcggtctagcgatggccgaagcggaacgttatctgccggacttcaacgcgaagctacagcccatcctggaaaaatatggacttgctgagacacccattctgctgcgcatttccgggtgtccaaacggctgctcccgcccctatctcgccgaaattgcgttggtcggtaaagcccctggacgctataacctcatgctcggaggcgatcaacgcggccagcgcctcaacacgctgtatcgggaaaacatcaccgaaactgaaatccttacggcactggaaccattgctgggtcgctatcaacaggaacgtattccaagcgaaggctttggcgattttctacatcgcaccggcatcatcgcacttcccccatatcccacccaccgacac

SEQ ID NO: 32919 - DNA, 1812 bp, Xylella fastidiosa
tacttgaagcagcaggagataaagcctctgctacgcttcatcacatgtggcagtgtcgatgacggtaaaagcacgctgattgggcatctgctgtatggcagtcagtgcttggctgaagatcagttggctgatcttacggtggatagtcagcgttacgggactcagggcgagcatattgattatgcattgttgttggatggcttggccgcagaacgtgagcagggtattacgatcgatgtggcttaccgttactttgatactgagaaacgtaaatttatcgttgccgattgtcctggacatgcgcaatacacgcggaacatggccaccggtgcctccactgcggatgcagcggtggtgctggttgatgcgcgtaaagggttgttgacccaaacgcgcaggcatagttatatcgttgcgttgttggggatccgccatgtggtgctagcggtgaataagatggacttggttggctacgatcagcagatatttgaagcgattgcctccgattacctggcgctggctgccaaactgggtatcaatcaggtgcagtgtattccgctgtcggcattggaaggcgacaatctttccaagcgttcggcaaggatgctgtggtatgtcggccccagtttgcttgagtatctggaagcgttggagccagccgatgtcgatcttgcggctgcaatgtgcttgccggtgcaatgggtcaatcgtccggattctcagttccgcggcttcacggggacgttggccgccggtcgcgtgcgctctggagatggggtcgtcgtgttgccttcgggctgtgtttcacgtgtggtacgtgtcttcaatggtgatactgaggtacacgaggctgttgccggccaggcggtgaccttgaccctggccgatgagattgacatcagtcgcggcgatgtcattgccgctcttgatgatccccccgaggttgccgatcaagtcactgcttacgtgttgtggatggacgatactgcgttgttgcctggccgacgttattggttaaagttgggcgcgcggatggtcgctgccagcgtgagtgacatcaagcaccgggttgatgtcaatacacaggaacagcgaatagcgcagcgtttacagctgaatgagctgggttactgccaactgtcgctagatgcgcctgtggcgtttgtaccgtatgcgcgcaaccgtgtgttgggcagttttattctcattgaccgtcagtccaatgctaccgttggtgccgggacgttggattctggggtgcatcgtgccagcaatgtgcattggcagcctctggatattgatcatgtcgctcgtgccaggatcaaggggcagacacccaaggtactgtggttcaccggtctatccggtgctggtaaatctgcaattgcaaacattgtggacaagcgtttgcatgccttgggttaccacacgtttattttggacggtgataacgtgcgccacggtttaaaccgtgatttgagtttcacggcagaagatagggttgagaacattcgccgtgttgccgaagtcgccagactgatggttgatgctggtttggtggtgctggtgagttttatttctccgttcagggatgaacggcagttggcccgcgagcgcttcgccgctgatgagtttgtagaagtgtttgttgatgtgcccttggcggtggctgaggcgcgcgatgtgaaaggcttgtatgcgaaagcccgtgcaggcttgatcaccgattttacggggattgattccccttatgagccgccgcagcacccagaactgcatctgcgtgccgaccaaggaacgcctgaacaattg

SEQ ID NO: 32920 - DNA, 1362 bp, Xylella fastidiosa
agaattgaacacgacagtatgggtgatctacgggtgccgatcgatgcgttgtggggtgcgcagacgcaacgtgctatcgagaactttccgatttccgggcggtcaatgcctcagggatttatccacgcattggggtttatcaaggcggctgcggcgaaggttaacgctgagctggggctgttaccaaagtcaatggccaaggagattgaggccgctgcattggatgtcgctgcgggccgttatgatgcggaatttccagtcgatatttaccagactggctcaggaacctcgtcgaatatgaacgctaatgaggtgattgcgacgctggctatgcgtgccaccaaggggcctatccaccccaacgaccatgtcaaccttggccaaagttctaatgatgtggttccaacagcgattcggatttccgcaacgttggcggttcagggacgattattaccggcgctcaagcatttacgcaaaatgattaacaagcgtgcccgtggtttgggcagtgtggtgaagaccggccgtacccacctgatggatgcgatgccgctgacgttcgctcaagaattcggtgcctggtcggcacaaattgtctctgcagaggcgcgcttgaatgacaccctgaaacggttgcatcggctgccattgggagggacagcaattggtaccggcatcaatacggatccacatttcggccgtaatacggtgaaggtactgtcagcattgacagggattcactttgagagtgcgaacaataagttcgaaggattggcagcgcaagatgatttggttgagttatccggccagttcaatgcgttagcagtggcgttgatgaagattgctaatgatctacgctggatgaacgctggaccgcttgctggcttgggagagattgagttgcccgcgttgcagccgggaagttcgatcatgccaggtaaggtaaacccggtgattccggaagcagtggtgatggtcgcctcgcaagtgattggccatcacactgcagtgaccgtggctgggcagagcggcaattttcagttgaatgtgacgttaccgctgattgcttacaacctattggagtctgcgacgttgcttggaaatgtggtgatgctgttggctgataaagtcatcgttggcctgaaggtgcgtcaggatcgagtgcaggaggtgctggagcggaatccgattttggtgacagcgttgaatccgatcattggctatgagaaagctgcggtgattgctaagcgtgcttataaggagcaccggccagtgcttgaggtcgcctgcgaggagagcaacctaaaccctgtggagttggcgcgcttacttgatccggctgcgttgactgagggtgggatt

SEQ ID NO: 32921 - DNA, 2775 bp, Xylella fastidiosa
ctaatcaagcagtttacccaatcctctcctctggccggcggcaatgccgcctacattgaagatctttacgagcaataccttgtcttgcccaatagcgtcgatcccaagtggaaagcttacttcgacggttttaagggacgtgatgcaggtgacatcccacactcggcggtcatcgctcatatcaccgacacagccaagcaaagtatcaagcagggcgcaagcgacgaacgggaacgcaacatcggccgtctcatcaccgcttatcgctcacgtggccatctcggtgcccgaatcgatccactggcgctgactccgccaagtaacccgcctgatctagatctgccatttcataatctatcgcaagccgatctcgacaatgaattcagcacgggtggcatcggtggccagccacggatgaagctacgcaatctgctcgcacacttaaaagcaacctataccgataccatcggcacagaattcatgcatatctctgaattcgaacagcgccagtggatctatcggcgtctggaaaatgtcggtggcaaaattgctagtaacgcgaccaaccgcaaacgcatcctcgagcgtctgaccgccgcagagggcctggaacgttatctgcatacgaaatatgtagggcagaaacgcttctctctggagggaggtgatgcattgattccgttgatggacaccttggtgcgtcaagccggcagcaatgatgtcaaggatatcgtggtcggtatggcccaccgcggccgactaaacgtgctggtcaacacgttgggcaaaaatccacgcaaattgttcgacgagttcgagggcaagttcgagcacgcccatcacgaccgcgctcacaccggtgacgtgaaataccatatgggcttctcagctgacatcgccgtcggcgatggcaagcaagtacatttggcactcgccttcaatccatcgcaccttgaaatagttgatccagtcgttgcagggtcagtacgttcgcgtcaagagcgcttcggagacatagaacgcaaaaccgtgctaccaatcctgatccatggcgacgctgcattcgccggccaaggtgtggtcatggaactgctccagatgtcacaggcacgtggcttcgcagtgggcggtactctgcatgtgatcattaataatcaaatcggcttcaccacaagtgcgcgggatgacgctcgctccactccatactgcactgatgtcgccaaaatgatcggtgcaccagtgttccacgttaacggtgacgatccagacgccgtcgttttcgtagcgcaactggcctacgaattccgccagcaattcaaaaaagacgtagtcattgatctagtttgctaccgccgctggggacacaatgaggcagatgaaccggctgcaacgcaaccagtgatgtaccagaccatccggaagcacaaaaccacccgcgagctttacgcaaccaagctagagggcgaaggcgtcattgctgcaggcgaagccaaagcaatggtagatgactaccgagccaaactggactcaggcaagttcaccactgagcttgcaagcaaacacacggatgaattcgtcatcgactggtccaagtacctgtccggaaaactggaggatacggtcaagaccagcgtgaagcgtcagacgctgaacaagttggccgcactcatcaataccattccacccactgtggaattgcacccacgtgtcgccaagatttatgaagaccgcatcaaaatggctgctggcgaacagccgtgtgactggggctttgccgaaaatctggcctatgccacgttgctggctgaaggccacaagctacgcttggtcggccaagacgccggacgtggcacctttttccaccgccacgccatcctgcacgatcaaaaaaccgacagctattatctgccgctgcgccaactggtcagcaacccggacgatgcgacggtaatcgactcgctgctcagcgaggaagccgttatgggctttgagtatggttactcgaccaccgatcccaacacgctgtgtatctgggaagcgcagttcggcgattttgccaacggtgcacaagtggtcattgatcaattcatcgctgctggtgaggtcaaatgggggcgaattagcggcctgtcgctattcttaccgcacggttatgagggccaaggtccggaacatagttccgcacgtttagaacgtttcctgcaattgtgcgcactggaaaatatgctggtctgcgtgcccaccactccagcgcaagcatttcacatgatccgtcgacagatgcgcatgtccacgcggaaaccgctggtcgtcatgacgcctaaatcactgctacgccacaaactggcagtctccactttggacgaactggctaacggtaagttccaacacatcatcccagacgatgcagctgaccctaaacacgtcaagcgcatcgttatgtgtgccggcaaggtctattacgacatattcgaaaaccagcagaaacgaagccaaaacgacgtagccatcatacgtatcgagcagttgtatccgttcccgcgtgcgttgctggccagcgaactaaaacgcttcaacaaggctaccgatgtcgtttggtgccaggaagagccgcaaaaccaaggtgcgtggtaccaaatcaagcatcacctacaagccgtattggcacatgctcagaggcttcactatgccggccgctcaagttctccatctccagccgttgggcacatggcagaacatatggccgagcaagaaagcctcgttgccgatgcactg

SEQ ID NO: 32922 - DNA, 1155 bp, Xylella fastidiosa
atgagcaccgaagttaaagtcccggtattacctgaatccgtttcagacgccaccattgccagctggcacaaaaaagccggtgagattgtcaaacgcgatgagaacatcgtcgacctggagaccgacaaagttgtattggaagtcccctcccctgtcgacggcgtcttgaaagaaatcaaattcgacaccggcagtactgtcaccagcaatcaagttctggcaatcattgaagaaggcagcatcgttgctgcaccctctcaggtgattgatcagaaaccggttgctgtatccgctccagccgccaaatccaacgttgacagtctgcctccaggtgctcgtttcacggcaacgaccgaaggtattgacccagcccatatcgaaggaagtgggcgccgtggtgccgtcaccaaagaagatatcatcaactttgctaagcaaaatggagccgcccgctccagcggtacgcgtttagaagaacgcgtcccaatgacccgtatccggcaacgcatcgccgaacgcctcatgcagtctaagaactccactgcgatgctaaccacctttaatgaaatcaacctggccaaagtctcaaacatacgcaaagagttacaggaagaattccagaaagcccacggtatcaaattgggcttcatgagctttttcgtgaaagccgccgccaatgcactacagcgcttccccttggtcaacgcatcaattgatggtacagacatcatttaccacggatatagcgatatttcgatcgcggtatccaccgataaaggcttagtcacgccagtactgcgcaacgtcgaacggatgtctttcgccgatattgagcatcgcatcgccgattacgccaagaaggcacgcgacggcaaattaagtctagaagagttgcagggaggcaccttcaccgtcaccaacggtggcacctttggctcattgctctcgactccaatcgttaacccaccacaaagcgcgattttagggatgcataccatcaaagagcgccccattgctgagaacggccacattgtgattgcgccaatgatgtacgtggcactgtcatatgatcatcgcatcattgatggcaaagattcggttcaattcttggtggacatcaaaaatcaattggaagcccccgggcggatgctgttc

SEQ ID NO: 32923 - DNA, 1434 bp, Xylella fastidiosa
atgagtgaacattacgacgtcgttgttatcggagccggtccagctggctatcacgctgcaatccgcgccgcccaactgggtctgaaggtcgcttgcgtcgatgcagcactcggcaaggacggtaagccagcgcttggaggcacgtgtctacgcgtgggatgcatcccttccaaagcactgctggactcctcccgccagtactggaacatgggacatctattcaacgaacatggcatcagtttcaaagatgccaagatggatgttgccacgatgatcgcccgcaaagacaaaatcgtgaaacagttcaccggtggcattgcgatgctcttcaaagcaaacaaaatcactccctactatggatttgcccaattgcaacctggcaacgtggtcaaagtgaaacaacacgagggtaagaacatcgaactgaaaggcaccaacgtgatcctggcatcaggctcggattccgttgaactgccatttgcaacgttcgacggtgaaacgattgtcgacaatatcggtgccctggactttacaaaagtcccaaaacgcttggcggtgatcggtgccggagtcatcggtctggaattaggcagcgtatggaaacgcctaggtgcggaagtcactattcttgaagcaatgccaaactttctagctgcagttgacgccgatgtctccaaaaccgccgccaaggaattcaagcaacaagggctggacatcaagctcaacgccaaggtctcccgaaccgaaatctcaagtaaaaacaacaaaaaagaagtcattgttacctacactgacgcctccggtaagcagacactcactgtcgacaaactattagtggctgtcgggcgcaaggccgcaaccaagggattgcttgcagatggcacgggggtacagctcaacgaacgtggccagatcatggtggacgaacactgtcataccggtgtcgacggtgtttgggccattggcgactgtgtacgcggcccgatgttggctcacaaaggcttcgaagaagggatcgcagtagctgaattgatcgcgggcctaccaggccatgtgaactttgaaaccatcccatgggtcatctacacagagccggaaatcgcctgggttggtaagactgagcaagaactcaaagcagacagcattccttacaaagctggatccttcccgttcgccgcagtcggccgcgccgttgcgatggccgagccatctggttttgtgaaagtcctagcacatgcagaaactgaccgcgtgttaggtttacatctgatcggtgtgaacgtctccgaattggtacatgaaggggtattggctatggaatttagtggctcagctgacgatctcgcacggatctgccacgcccacccaaccttatcggaagcaatccacgacgcagctatggcggtcagcaagcgcgcaatccataaagcaaac

SEQ ID NO: 32924 - DNA, 1290 bp, Xylella fastidiosa
atgggtcagtcagttgtcgtgctcggtgcccagtggggcgatgaaggaaagggcaagatcgtcgaccttctcaccgaggaaattggtgctgttgtgcgttttcagggaggtcacaatgctggccacactctggttatcaatggtaagaaaaccgttttgcatcttattccatctggaattttgcggaatggtgtgctctgcctgattggcaacggtgtagttatctcgccagccgcattgcgaaaggagattgaggagctggaagataccggtttggaaatacgttcccgtttgaagatttcgccagctgcgccgttgatcatggaatatcacattgcactggatcaagcacgcgagaaagcggctggcggtagggctattggtacgaccggtcgagggattggtccggcgtacgaggacaaggtcgggcgtcgtggtattcgtgtcgctgaccttcattacccagaccaattggcggaaaagctacgtgctgcgttggattaccacaattttgtgttgactcgatattttggtgtggatgggatggatttccagcggatctatgacgagatgttagtgttcgctgaatacgtcgagccgatgaaatctgatgttgcgggtatcctccatgacctgcgcaagcaaggcaagcgagtgctctttgagggtgcccaagggacattgctggatatcgatcacggcacctatccgtacgtgactagctccagcacgacggttggtggtgctctcagtggtgctggtgttggtgtccaggatatcgactatgtgttgggcattgctaaggcttatgcaactcgtgttggaggtggtccatttccaaccgagttggatgataaaattggtcagggtatccgagatcgtggtgttgagtatggtgcttccactggtcgtccacgccgctgtggttggatggacattgttgcgctcaagcgtgctgttgccatcaatgggattaccggtctgtgtattaccaaattggatgtgctggacggaatggataagcttaagatctgtatcgcttatgagtaccacgataaacgaagtgagtacgctccgttggatgcgcaaggttgggaagaatgcaccccagtgtacttggaatttccaggctggaatgagagcacgcatggcattacttcgtgggagaaactccctccagcagcccgcgcttatctgtgtgcgctggaagagctggctggctgtccgattggtatcgtgagcactggcccagaccgagagcacacgatcatgttgcatgatccttttgct

SEQ ID NO: 32925 - DNA, 933 bp, Xylella fastidiosa
atcaacggtttcggtcgcattggacgcaacatattacgctctgcagtacaaaacttcggcagtaacattgatatcgtagccattaatgacctgctagaaccagattatttggcatacatgttgcagtacgactcagtgcatggacgctttaaaggagagatcgcaattgagggaactgcactcatccttaacggcaagaagattcgcctaacagccgaacgtgatccaggcaatcttcaatgggctgatgccggtgctgaaatagtgatcgaatctaccggactattcctgacgcaggaaagtgccgggaaacatctggcagccggcgccaagaaggtcatcatctcagcaccttccaaagacgaaacacccatgttcgtgtacggcgtcaatcacaacagctacaacggggaaccaatcgtctcgaatgcttcatgcaccaccaattgcttggcaccactagctaaagtcatcaacgacaaatggggcattacgcgcggtttaatgaccactgtacatgcggccactgcgacacaaaaaactgtcgacggcccatccaataaagactggcgcggtggacgcgggattcttgagaacatcatcccatcttcaactggagcagcaaaagctgttgggaaagtgatcccatcactcaacgggaaactcaccgggatgagcttccgcgtccccacctcggatgtttctgtcgtggacttgactgtccaattaaacaccccagcaacttacaaagaaatctgcacagaggtgaagcagcaaagtgaggggccgttgaggggcatcctgggctatacagaagacaaagtggtagccaccgacttccgcggtgaaacctgtacctgcgtattcgatgcggatgctggcattgcactagatccgacatttatcaaactcattgcttggtacgacaacgaa

SEQ ID NO: 32926 - DNA, 423 bp, Xylella fastidiosa
atggtgcttgagcgtactctttcgattatcaagcctgatgccgttgcgaagaacgtgattggcgatatctatagccgttttgagaaggctggtcttaagatcgttgctgctaaatataagcagttatcgcgtcgtgaggctgaaggtttttatgctgtgcatcgtgatcgcccgttttttaacgccttggttgaatttatgatctcagggccagtaatgattcaggtactggagagcgaaaatgctgtggctcgtcatcgtgagttgttaggagcgaccaatccgaaggatgccgctccaggtacgatccgcgctgattttgctgagtcgattgaagccaatgctgcacatggttcggattcggtcgagaatgctgcgattgaagtggcttactttttcgctgctaccgaaattattttgcga

SEQ ID NO: 32927 - DNA, 2262 bp, Xylella fastidiosa
ccagaacactgcgttcaatataacgatggccgccccatcatctacgtgctggaagactatggcctgtgcaatacactgatcctggacaaagcctgccgcaaaaccaagttgccatccccattgataccactgtcaggcaatccactacagcgcaagcgtgcttacttagccctgtcgcgacgtagctccagcaactcactgatccctaaccagcgcggcggcaaaacacactccgactcgctagccaatctactccaagcacaccgtatacgtgacacccttgatgtgcatttagtgcccgtatccatcttcattggacgtacaccagatcggcaaagtggctggtttgcagtgcttttctcggaaaattgggcgctcgttggtcgctttcgacgcatcctggcgatactactcaatggacgcaacaccattgtgtgcttcgcaccccccatctcagtacgtcaaacactgaacgaaggtttgccacctgaacgtactctgcgcaagctacaacgtgtattacgcacccacttccgccgtattcgggaaacagtgatcggtccagatctgtcaacccgtcgcttactggtagacaatgttctggcaacagaagcagtgcgtgaagccattggcgcccaagccaagcgcgacggtaccgatctgtcggaaacctggcgcaaggcgcaagcttacgcctgggaaatcgctgccgactattccagtcctgtcatacgttcggccgattttttgttcagccatgtctggaaccgcatctatgccggtgtactggtacaccacgtggacagcttcaaagagatatcaccagggcacgagattgtgtatgtacccagccaccgcagccatatggactacctgctcctgtcgtactgcctgtacaaatgcagcatcgggttaccacacatcgtggcaggcatcaacctgaatcttcctgtcgtgggcacactgctccgcaaatgcggcgcatttttcatccgtcgatccatcaaaggcaacatgctgtattcagtagtgctcagcgaatacgtagcgcagctggtggccggtggttattccctcgaatactttatcgaaggcggccgctcacgtactggccgcctgctgcaacccaaaggcggcatgatcatgatgacgctgcaggccttcttgcgccaaccacgcaggcccgtactgttccagccaatctatatcggctatgagaaactgatggaaggcaccagctacctggatgaactgtccggcgaacccaaaaagaaagagtcgatctggagggtgttctggaatattcccaaagtactcaaacagaagtatggccaggttgtggtgaacttcggcgagccaatcgcactcaacgacgtactcgccgaactagccccagaatgggaaggtcaagcactcaacgaaaatgagaaaccagcctggttatcaagcaccgtcaaccatctcgctcggcaaattcagactcgcatcaacagcgccgctgacgtcaacccaatcaacttattggcacttgcactactatccacacctaaacatgcgatgggtgaagctgacttgatcgcgcaaattactctgtgcaaaaaaatactgcttgaattgccctattcaaaccgagtaaccatcactccacaccccccagaacgcatcattgcccacgccgaacaaatcaacatactcacccgtgtccaccatccacttggcgatgtattgagagtcgatggagacaatgcagttctgctcagttacttccgcaacaacgtgttgcatctatttactgcctccgcgtgggtggcctgttgcttcaaaaacaaccgacgcatgagccgcattgctctgatccgtctgggggttggtatgtatccattcctacaagccgaattattcctaccatggactgaggaccaatttgcccaacacatccaacaggtcattgaattatttgtccgggaagggcttctcctatcagccggcaatgaggaagaagacccactcacacgcaacacaagccagaccgacgaagtcttccgcctacgggcgatcagtcattcattgcaacaagcatttgagcgctactacatcaccatttcaatattggtgaaaaacggccctggaaccctcagtgcatccgaattggagagcctgtgccagctcgctgcacaacgtttaagcctgctctatgcgtcgaccgcaccggagttttttgataaaggactgttccgaggcttcatccaaaaacttcgcgaa

SEQ ID NO: 32928 - DNA, 1404 bp, Xylella fastidiosa
tacaaaatcgcagacatttccttggccgactggggccgcaaagaaatcgacattgccgagcacgaaatgccgggactcatgtccattcgccgcaaatatgccagcaaacaaccactcaaaggtgtacgcgtgaccggctcgcttcatatgaccatccagacagccgtactgatcgagacactaaaagatatcggcgccgatgtacgttgggcctcatgcaacatcttttccactcaagatcatgctgctgctgcgatcgccaccagcggcacacccgtgttcgcctggaagggagagacattagaggaatactgggattgcaccctgcaagcactcaccttcaccctggcggatggcacactgaccggcccagaattgattgtggatgatggcggcgacgctaccctcctcatccacaaaggctatgaattagagaacggatcaacctgggtcgatgaacccagcgactcacttgaagaacaggtgattaaacgcctgctcaaacgcatcgccattgagcgccccggctactggacccgagtcgtcaacgactggaagggcgtgtctgaagaaaccaccacaggtgtacaccgtctgtaccaaatcgctgcaaccggcaggctgctcgtacctgcaatcaacgtcaatgattcggtcactaaaagtaaattcgacaacctatatggttgccgcgaatcgctggctgatggtttaaagcgtgcaatggacgtgatgttggccggtaaattagcggtggtatgcggctatggcgatgttggcaaagggtcggcacatagtttacgcgcctacggtgcccgcgtgattgtgaccgaaatcgatccaatctgtgcgttacaagccgcgatggaaggttttgaagtcacaacggttgaggacacactcggtcaggccgacatctatgtcaccaccacaggtaacaaagatgtcatccggatcgaacacatgaccgcaatgaaagaccaagtgatcgtctgcaacatcggccactttgacaatgaaattcaagtcgatgcactcaataccctgactggggtacaaaaaatcaatatcaaaccgcaggtggataaattcatattacccaacggcaatacactctttcttcttgcagaaggacgcctcgtcaacctgggctgcgcaacgggtcatcccagcttcgtcatgtctaacagcttcgccaatcaaactctggcgcagattgatctgtggcaaaacaaagacgtttacgaaaaaaatgtttaccgcttgccaaaaaaattggatgaagaagtcgcacgccttcatctggagaaaatcggcgtgaaactcaccacactcacggctaaccaagccgcctatttaggcatatcagtagaaggaccattcaaacctgagcactatcggtat

SEQ ID NO: 32929 - DNA, 435 bp, Xylella fastidiosa
ctggaattaccaatcgatatcattaaaatccaagcattgctgccacaccgctatccctttctattggtcgaccgaatactggaactagaccagaagcaaaagcgtatcgttgctcagaaaaatgtgtccatcaacgaatcattctttcaaggacatttccctgaacatccagtcatgccaggcgttcttatcattgaagcacttgcgcaagccggcggcgtgatgacccaactaaaccttagccataatgggcattccagcctcttgttttatatggttagagtcgacaatgcccgcttcaacaaacaggtggtgcccggcgacatcctgatcctggatatgacgatgaaacgacggatccgcaatatgggctgctactacggcgaagcgcgggttaacggcgaagtcgtcgcttgcgctgatatcatgtgtgct

SEQ ID NO: 32930 - DNA, 1377 bp, Xylella fastidiosa
aacaccctcttattgtttggcgccaccggcgacctcgcccaacgctatctcttcccctccttactgcaactgtttactgatggcttattgccacaagacttccgcattcgtgctctggccttgtcgccccataacaccacacaattccgcgacatcctgcgcccgcgcttggaacaagcactacccatcgccaacaccgcacacatccaagccctactacaacgtgtcgactacctttccgtagacttgaacgacccaacatcaatcgccgaagcagtccgagatctgacggaacatccctgcatcagctacttggcaatcccaccaggcctgtataccaacaccgccctaggattggcacaaggaggggcactgcagacaccacaccgattgatgctggaaaaaccgatcggacgcgactcaataaacgcacgcgaaatcctaaacaccatcggcacactgattgacgaagatcgcatcttccgcgtagaccactatctaggcaaagcagcagtgcagaacctcgtcgcactgcgcttcggaaacaccctgctagaagcggtatggaaccgaaaccacattgagtccgtacacatcctcatcgccgaaaccgaaggcgtcgatggccgcaatgcttactacgcacgtgctggcgcactacgcgacatgatgcaaagccacatcctgcaactcctatgcctggtcgccatggaacccccggcctctctggaagccgaccgcatacgcgacgaaaaagtcaaagtcctgcgcgcactacgcccactgaacgcccaaaacgccgcaatgcacagcgtgcgcggacgctacagcgcgggcaccattaacagccaaccagtgccagcctatcaaccaccggaaggcagcaatgtagagacctttgtcggtgtcaccgcatacatcgacaactggcgctgggcgggtgtaccgttccatctatgcacagggaaacgcttggccgaacgctcaacccagatcgtcgtcaccctcaaacccgtcacacactggctatttgaacgtccaaaccggaacaatgcagcaccaaaccgcctgtgcttcaaactacagccccaggaaaatatcgaactaaacctgatgagcagcctggccggtcccgaatggggaaccctagaactgcaaccgctggaattggagttatccgtcccgaccgggaaacatcgccacatcgcctatgagcgcctgttcctcgacgcattcaacggcaaccctgcgctatttgtacgtcacgacgaagtcacagccgcctgggcttggatcgacagcatcagcaatgcctgggaactgtccgacttaccactgcaaccctaccccgccggcggctggggcccacctcaagcc

SEQ ID NO: 32931 - DNA, 1788 bp, Xylella fastidiosa
atgtccgcttatacaattaccgaacacaaatatgacatggttgtcgttggtgctggcggtgctggtctacgtgccacgttcggtttggctcagaaaggcttacagactgtctgtctgacaaaagtattcccgacgcgttcgcataccgtcgctgcgcaaggtggtatctccgctgcgcttggtaacatgggagaggatgattggcgttaccatttttatgacaccatcaaagggtcagactggctgggtgaccaggatgcgattgagtacatgtgccgtgaggcaatcccggctgtgatcgaactagaacactatggtgttccgttctcgcgtactgcacaaggcaagatttaccagcggccatttggtgggatgacgacacgttacggtgaggggccgcgggcagagcgtacctgcgctgcagctgatcgaaccggccatgcgatgttacataccttgtaccagcaagcattggcgcacgacgcgcgtttcatgattgagtactttgcacttgatctgatcttcgacaacgagggtttgtgtcgtggcgtgttggcgttggacatggccgagggatccttgcacctgtttcgtgcccatggagtcgtgttggcgaccggtggctacggtcgcacgtacttcagtgcaacttctgctcatacctgtactggtgacggtggtggcttggtgatgcgtgccggtttaccgatgcaggatatggagtttgtgcagttccatcccacaggaatctatggggctggctgcctcatcaccgaaggagtgcgtggtgagggaggaatcttgcgtaactctaacggggagcgctttatggagcgctatgcacctcactacaaggatctggcctctcgtgatgtggtgagtcgctcaatgattattgagatcagggaggggcgcggcgttggtgaacacaaagaccatatattgcttgatttgactcacttgggtccgagcatgatccaagaaaaattgcctggtattgccgagagtgcgcgtatcttcgctggcgtggatgtgaccaagcagccgattccggtgttgccaacagtgcattacaacatgggtggtattccaaccaattaccatggcgaagtggtgcgtaaagttggtaatgatcctgatgcagtggtgccggggctatatgcggttggtgaagcggcctgtgtatcggtgcacggtgccaatcgtttgggatcgaattcgttgcttgatttggtggtattcggtcgtgcggttgccaatcgttgtgccgaaacaatcaaaccaaatcagccgcataaggtattgccctcggatagttgcgacaaggcactgggcttgcttgataaacttcgtcatgctgatggttccacgccgacagcggtgattcgtgacaggatgcaacgtaccatgcaatctgatgcttcggtgtttcgtacgagtaagaccttgcaagaagggtgcgaaaagatgaatgaaatctttgccttgtttgatgacgtcaaggtttctgatcgttcacttgtttggaattcggatttgatagaaacctacgagctccacaatttgctgttaaacgcactggctacgattaactcggctgaacagcgcaaagagagccgtggtgctcatgcccatgaagattatccagatcgcgatgacgagaattggttgaaacacacattggtcagtgtcgacgaaaagggcacatgcagttttgactaccgccctgtgcacatgtacacgctcagcaaagacgtggatgtgatacctcctaagccgcgcgtctat

SEQ ID NO: 32932 - DNA, 687 bp, Xylella fastidiosa
tttaaggtctaccgttggaatccggatgatgatgccaatccgcgtaccgatacctacgaaattgatctagatacatgcggcccgatggttttggatgcgttgatcaagattaagaatgagatcgacccgactctgacgttccgtcgttcttgccgcgagggtatttgtggctcatgtgcgatgaacattgatgggaccaacacgttagcttgtaccaaggcgattagtgcatgcaccatatctgagatcccgatctatccactgcctcacatgaacgtgatcaaggatttgatccccgacttgactcacttttatgcgcagtacgcttctattaagccctggatacgtactcagaccccgccgccgcctgatcgtgagcgattgcagtctcctgtggaccgcaagaagcttgatggtttgtatgagtgcattctatgtgcctgttgctcgaccagttgtccgagttactggtggaatggtgatcgctatttgggtccggcgatcttgctgcaggcttaccgctggattatcgattcacgtgatgaagatactggcgcgcgcttggatgatctcgaggatccattcaagttatatcgttgtcataccatcatgaattgcacgcgaacctgtccgaagggattgaatcccgctcaggccattgccgagatcaaaaaactgatgatgctg

SEQ ID NO: 32933 - DNA, 1620 bp, Xylella fastidiosa
tctacctttctggcgttgatgaaacccatcaccaacgaaacctttatcgagcgaaaccgtgaggtggccctgtggctgcctcttggaattgtcggtttgtttttgttacgcggtattgctggctatatcactgatatggcgatgggccgcgccgcgcgtagcattgctcgggattttcgtgtgtgtgtcctgaccaaatattttcgtttgcctggtagccgttttgacggtgagccagtggcttcgatgttggtgcggctcggttcagacagtgagcaagttgcgcatgcggttatcgacgcgatgaaggtgatggtgcagcagacgcttcaggtgattggtgcgttggttgtgatgttgtggtacagctggacagtcacgctcgccatccttttggtcgctccgttgctggcttgggtcatgcagcgggttgctaagcgttaccgtcgtatcagccatcacatccaagagagtaatgcgcagctcatgcaagctgccgatcaagcgttaagcaactaccaggacgttaaagtgtatgccgcgcaagagagcgagttggagcgctatgctcggttggccaatatcaatttgggtttggcggtaaaggttgagtcgacacgtagtatctcttcggcggcggttcagttgcttggtgcggttgggttggcaatgttgttgctcattgctggccatgaagctttggccggtcgcctcagtccaggcgattttgtctcgctgatgacttcaatgatcgcggttattcccgcgttgaaacagttgaccaatgtacagaacatgttgcagagcggtattgcttctgcacaacgtctgttctcggtactagatagtcctgatgagcttgatactggcagacgaccgttggggcgtgccagaggattaatcgagttccgcgggatcaccgcacgctatcctggtcggtctgctcctgtgctggatagtgtcagctttgttgctgcaccgggcacggtcactgcgattgttggtcgttcaggaagcggtaagtcaagtttaatcaagttgattccgcgtttttacgagccggagtctgggcagatattgttggatggccatccattacaggattatcttttagctgatctgcgccgtcagattgcattggtagggcagcagatcatgttgttcgatggcagcatcgcggaaaatattgcttatggtgagatgcgtcaggtcgtttctgaggagattgaacgtgtcgtggttgatgcaaacgctcaggattttgtgaatcaacttccagagggattacagtttcaggttggggttaagggggggcgtctttctgggggacaacgtcagcgtttggccattgcgcgcgcgatgctgaaggatgcgccgattcttattctggacgaggccacggctgcgcttgataacgaatctgagcgcttagtgcaggatgcgttgcagcgcttgatgccggagcgcaccacacttgtgattgcgcatcgactgtcaacgatcaagcatgcggatcaggtgttggtgatggaccaggggcgcatcattgagtctggtacccatgtcgatctgttggcacgtgatgggttgtatgcttatttgtacagcatgcaatttcgc

SEQ ID NO: 32934 - DNA, 1851 bp, Xylella fastidiosa
atgccaatccgtcagctacccgagattttgattaaccagattgccgccggggaggtggttgagcgtcccgcctcggtggttaaagagttggttgagaatgcaatcgatgccggtgcgacgcgtgtggacattgagttggaagcagcaggggtgcgcttgatccgcatccgtgacaacggccacggtatggctgctcaggaattgccgttggcagtcttgcggcacgctaccagcaagattgcctcattggatgatttggaagcggtcgccacactgggtttccgtggtgaggcactgccttcgattgcctcggtgagtcggtttaccttgatgtcgcgtcgtgccacggatgaacacggcgcggtattgcagattgagggaggtacgctgggcgaggtgatcccgcatgcgcatgcaccggggaccaccgttgaggtgcgtgagttgttctataacgtgccagcgcggcgtaagttcctccgcgctgagcgtaccgagctggggcatattgaggaatgggcacgttctctggcgctggcgcatccagatttagaattgcgtctttcacataacggcaaactttcgcgtcgctataagccgggtgactggtattcagatgcgcgcttgatcgagattctgggagaagattttgcgcatcaggcattgcctgtagatcacagtggcgcggggttacgtctgcatgggtgcattgtgcagccgcattactcgcgtttgaatgcggatcagcaatatttgtacgtcaatggacgtccagtccgtgatcgtagtgttgctcacgccgtcaagcaggcttacagcgatgtgctctatcaggggcgacatccggcgtatgtgctgtttctggagctggacccggcacgtgtggacgtgaacgtacacccggccaaacatgaggtgcgtttccgtgatgcacggctcatccatgattttgtctaccgtactgttcagggcacgttggcacagacgcgtgcgggtacgccgccgctggcggtgggtgtgggtgatgtggagggggagggggagggtgcaaggcctcctggccgtcatgcggtgtcgttttcagggcggcgtggtggtgcctcgcatgtgctggggagctactctgccagcacggctcctctgatgcagggtgtgccaagcgtgtctgtcgctgacgcgcccgcagcgtatgcagccctgtatgctgcgccaccgacacaggtaatggatgcagtgccacagatgcagacggggctaccgctggctgctggggcgggcgacgtaccgccacttggctatgccatcgcacagctgcatggcatttatatcttggctgagtgtgccgatgggctgattgtggtggatatgcatgcggctcacgagcgtattggttacgagcgcctgaagcgcgcccacgatggtattgggttacgtacccagccactgttggtgccgatgacgttgatggttgccgagcgtgaggctgatgttgctgagtgtgaagctgagacgttggccaatcttggctttgaagtgacccgcagtggtccgggttcgttacaggtgcgtagcatcccggcgttgctttcccaagcggagccagaaatgttactgcgcgatgtgctcagcgatctgagtgaacatggccacacccggcgtgtggccgaggcacgtgatacgttgcttgcgacgatggcttgtcatggtgctgtgcgtgctcaccggcgcttgagcatttccgagatgaacgcgttgttgcgtgatatggaggctacggagcgctccggtcaatgtaatcacggacgtcctacctgggcgcgttttagtttggctgagatcgatcgttggttt

SEQ ID NO: 32935 - DNA, 816 bp, Xylella fastidiosa
ctttccgggattattactgcgctggtcactccgtttgatcgagatggcgcgtttgaccgtgatgcgtggattcgtctgctggatatgcaattagcgggtggcgtgcagggcgtggttattgctggttccaccggcgaagcagcgacgttgaccgatgctgagtatgacgagatgctgtgctcggctgtggtccgagttggtgggcgtgtgccggtgttggcgggtactggtttgtctgggactgcgaaaacgatttctcaaactaaacgcgcggccgacaatggtgcaggctatgctttggtggtgacccctccgtacatacgtcccaaccaaggtggtctgaaggcgcattatttggctgtggctgagcaggggggattgccagtcgttctgtacaatgtgcctagccgcaccggctgtgatctgttgccggagactgtcgctgatttggcggggcaccctagtattgtcggcattaaggaggcgtgcgctagtcgtgagcgtgtccaggcgctgcttgctttgcgtcgtccaggctttgctgtattcagtggtgatgacagcagtgctgcgcgttcgatgttggacggtgccgatggtttggtttcggttgcttccaacgtattgccgtccgcttatcgtcatctatgtgatcttgctcgggcgggtgagcgtggtgctatcgatctgtggaatgcgcgtctgtctgattttcacgcattttgtggtctcgactccaatccgattccaattaaggcattgttacagcgtatcggcattggttatggattgcgtctgccactgctacccttgtcg

SEQ ID NO: 32936 - DNA, 771 bp, Xylella fastidiosa
acccaatcccgttggcgtttggatggtcgtacggctttgatcacgggggctagtacaggtatcggtctggctgttgctcgtgagttgttgggcctgggtgccgatgtgctgttggtagcgcgtgatgctgatttgctggggcgagtacgcgatgaactggcagaggaattccctgagcgtgagttacatggattggctgctgatgttgctgacgatgtggaccgccgtgcgattctggattgggtcgaagattgcagtaatggtttgcatgtgttgatcaacaatgctggtggcaatgtgacgcgtgcagcgcttgaatatacagaagacgagtggcgtgagattttcgagatcaatctgttctctgcgttcgagttgtgtcgttacacgcagccgttgttggcgtgtcatgcaagtacggcgattgtcaatattggcagtgtatctggcttgacgcatgtgcgcagcggagtgccgtatgggatgagcaaggcggcgttgcaccaaatgacccgcaatttggctgtggaatgggctgaggatgggatccgtgtcaatgcggtagcgccttggtatatccgtacgcgtcgtacgtcggagccgctctctgatctgtactattacgagcaagtcattgaacgtacgccgatgcgccgcattggagagccggaggaagtggctgcggcagtggcatttctttgtttgccagcgtccagttatgtgaccggcgaatgtattgcggtggatggcggttttatgcgctatggtttc

SEQ ID NO: 32937 - DNA, 2511 bp, Xylella fastidiosa
gcagcccgtaccggccgtgttgatcgtgcgttgcaattgcttgagaccggtgctgatccacatgcactgccattcgaaaacgcacgtgatcaacgtagtttgatggtgttggctgcaattttgccggacctgcgtttgctgcgtgagctcatcgtacgtcgtgttgacgttaaccagcgacaccgagggatgacagcattattagccgccactcgtgacagttggcatggtcggtctgaggcggtacagacgttgctggcaaatggtgctgatccacgtgttgtcgatgctgatcgtaatacacccttacatcatgccgcccgcagttctgatcctggggtggcggcgttattacgtgatgcggcggctgagttggatgcgctcaactgtgatgggttatcgccgttggctgcggcttgtcaagtaggtaattggcgcttggccaagttcttgcttgaacgtggtgctcagacagagccgattggaggcactccggttttgttggctgcggctggtaccgatgaggatgatccaaccggcgtactgttgctgctgaagcataaggctcgggtagatgcgcgtgatcgtttacgtcgcactgcactccatgaggctgccgaagcgggccacagtgagattgtcaaagcgctgctggaggctgccgccaacctggaggtgcgggatatggcgggacgcacgcccttgctagaggcagcccgacaggcacgcattgtagtgttggagtgcttgttgtctcacaaggccgacaggttggctgttgatagtgagggccgtaatgcggtgtttttggcttgcttgtctgagcgggtgactctgccgctgatccggcgtttgctcgaaattggcgtgccagtcgttgcggataagcatggtcaccgtcccgttgacattgctgccaaggttgggtgctggtcgatcgtatctctgcttgatcctgactatcctcttccggtggtcgtcagtgaacctgtcagtgtcggtggggtgctggatctccccccactgacgttgctgcgtgatggactacagttgggtagttttggcagtttgtcggaattaattgagctgtgtagtgcagaggagctggggacgcttctgcacgatccacactttgcgttgaatcccgatgtggtggattggttgctcattcatggagcttcaccaacggtgcccaatagctctggtaacgtgccgatgttttcattattggcgcgtggtattgaggcagtaccggtcctgaaggtgttcttgcgtcatggtgtatcgcccgctggtgtcggtgggttggggctgtggttggctgcctgtatgcagtgtgatgcggcctcccgtagtctggagcagtttgcctgcgagttgttggagcatggtgctgatccgttgatgccttcaccagatggcgattctccgttggtgcttacagtgcggttgggctggttacgtttgcaacaggctttactggaagctggcgtgaattgtgaggtccgtgacagctacggtatgacagcgttgcaccaagcaacggtccttggtcgtgaagcggctttgaagctcttggtgatgcatggtgcaaatccggatgcacgtactccagacggccagacttcgctgggtatggccctatccagtggtaggcgtgatttagctacatggttggactggcgtatttggcccctgccgcgtcgtccattacgacatgcggatgttccggatgcagcgatgaggggagatacggaggcggttcgtcgcttgcttgatttggggttgcctgtagatgcggttgatacgcaggggtgtactgcgttattgcgtgctgccggtggcggccatttgcaagtggtgcgtctgttgttgatgcgtggggccgatttacagcgtgccgccaacaatggcgccacgccgttgtcggcagcggtaagcatgcgtcagaacgagatcatccctgctcttttggacgcaggtgctccacttgaataccgttttccggaggagatgacggtactgatgttggccgctgcgcttggtttccccgatattgtaatgcgtttgattgcggctggtgctgatgtgcatgccagtaacgtgcagggttttgctgcacttcattgtgcagcgttatatggttttagtgctcgcgataaaacgaggttgttggcgttgttggatgcgttgcttttggctggagcgaatccgggacagcttgctgacggtaaaatcactccattgctcttgttgcttggtgcgcgtgctgaacgaggcgcggtttgtgatgagcaagtggtactggctggagtggagcgtctccttgaagagggggagactttagacgtggtagacacacggggttttggtccacttcatttggctgcgctacatgggttgccgcttttagtgaaatgtttgttgcgtgctggcgctgattcagagcgtcgtgacgcgttaaatcgttccccgcgtgagattgcaatcatgcgcggttttattgatgtt

SEQ ID NO: 32938 - DNA, 924 bp, Xylella fastidiosa
acacggcatggaaaaacacagatggcggtgatcatgggcacctcgacatccagcatcggcgcaagtgaagaggcgtatacccgactggaatacgatgccgagggcgcacgcttcccaaacgatctgcaaagagccgtcatccacgctccgcattcactaggcaactttgtacaacacgccacggacctgagcggtccctgcgttaccgtagcgaccgcctgctcctctagcgccaaagtattcgcacaagcagcacgcctaattacctcaggcgtagtgagcgccgccctagttggtggtgtggacacactatgtggcagtgtgctgtttggcttcaacgcacttcaattagtttcaccagaaccatgccgtccgtttgatgtacatcgggccggtctgtcactcggtgaagcaggaggctttgcactactggaaagactcgacctagcacccgatgcggatctgttgctgtgcggttacggcgaatccagcgatgcccaccatatgtccgcaccacaccctgaaggattaggagcccgcatggccatgcaagaagcactggccagagccaacgtagatgccagtgaagttggctatctgaatttgcatggcaccgcgagtcctgccaacgacagcattgaagccgtggcaatagccgcactgttcccaccgacattgcatgccagttcgaccaaagcctggaccggccacaccctcggcgcttctggcatcgttgaatcgaccattgcactcttggctttgcgaggaaacatcctgcccggcaccatgaatagcgaacagcttgacccggtgtgcggaccgcagatccgttgcgaaaacgcacatacaccaatcctgtacgcgatgaataactctttcggtttcggaggtaataattgcgcgttgttattcaaaagagcggac

SEQ ID NO: 32939 - DNA, 900 bp, Xylella fastidiosa
ttacttcgtattgctactcgcaaaagtttacttgctatgtggcaaagcgagtatgtcgctgcgcgtttacgtatgctgtgccctgatttagatgtggtgttggtgccgatgagcactcgtggcgatgagatcctggaccgctccctggctgcaattggtggtaaagggctgtttctcaaggagctggaactggcgatgttacgtggtgatgctgattgcgcggtgcattcgctgaaagatgtgcctatggatttggagcccccatttatgcttgcggctgttttgagtcgtgatgacccggccgatgcgctgatttctaatgtctacctttcgctagagtcactcccaattggggcgcgtgtggcgacttcttcgctgcgccgacaagcccagttacgcttttatcggcctgacctgcggttgtttgacttgcggggtaacgttaacacgcgcttggcgaagcttgataacggagattacgatgcgatcgtgctggcttgtgcggggttacgtcggctaggattggagcaacgcatgacggctcggctagcaccgccagaatggttacctgcgccaggtcagggggcgattgcggtggagtcactgaccgaggatgctcggatcgctacgttgttggctggtcttgacgatctgccaacgcgccaatgcgtggttgctgagcgtacgatgaatcgtgctcttcatggtagctgccatgtgccagtgggggcttatgcatcctacgaagttggtggtatgcgattacagggcttggtgggttgtgttgccgatggtcgtctcgtgcgtgcggagctgtgttcggcaaaggatgagggcgatatgctcggcagggcagtcgcacagtgcttgttggatgctggtgcggctgagttgctagcc

SEQ ID NO: 32940 - DNA, 660 bp, Xylella fastidiosa
atgctggaaacgatagagcacgagactgcccctatgccgcagtggagtgtgttgtggttacatggtttgggggcggatggtcatgatttcatgcccatcattccagagttggtgcgtccacactggccagctttgcgttttgtgtttccgcatgctccggtgagaccgatcacgattaataacggtgtaccgatgcgtgcttggtacgatcttgttagttttgatttcaatcaacgtgccgaccagactgggattgaagctgcagttgcgcaggtccaggcactgatgatgcgcgagcagcagcgtggcattgcgtctgaacgcttgtttcttgccggattttcgcagggaggagcggtggtgctcagtatcggtttgcgttgtaaggcctccttagcaggcttgattgcattgtctacgtatctaccggatcctaacgttgtcactaccactacagggttgctttcaggcagcaatgcgcaacagttttttattgcccacggacattccgacccagtggtgccactggtacatggtcagtgtgctgctgaggtgttgcgtaagctaggtttcgctgtggaatggtatacctacacgatggcgcatcaggtttgccaagaggagatccaggccttgggagactggttagagcgccgtttt

SEQ ID NO: 32941 - DNA, 981 bp, Xylella fastidiosa
aagaaaacgattctttgttttggtgaagcattgatcgatatgttggcgcagcctccggtaaagaagggaatgccacgtgcgtttctgcaatgtgctggaggtgcaccggccaacgtcgcggtggcggtcgccaggttaggtggtgcggtgcagtttgttggcatgcttggtagtgacatgttcggtgattttctgttcgacagttttgccgaggcgggtgtggtgactgatggcattgtgcgtactaatacggcaaaaacagcattggcttttgtggcgctggatgcacatggtgaacgtagtttcagtttctacaggccgccagcggctgacttgttatttcgtgctgagcattttcaagatgcgagtttttccgatgcactgatattccatgcgtgttccaatagcatgacggatgcagacattgccgaagtgacttttgaagggatgcgacgtgcgcaggccgctggtgcaatcgtcagttttgacctgaattttcgtccgatgttatggccgaatggagaaaatccggcatcgcggttgtggaaaggtttgtctttagctgatgtggtcaaactatctagtgaagaattggattatttagccaatacgctcgctgcagatgcgaatgcggtgattcagcaattatggcagggcagggcgcagttgctgttggttactgatgccgctggtccggtacattggtacacgcgtaccgcgggggggcaagtaccgacattccgtgtccaggtacaggacagtaatgcagcgggtgatgctttcgttggaggcatgttgtacacgtttgcacagcagtttgatgatgccgccgcgctgattgatttttgccatgatcccgagtcgattgcgagtacgttgcgttttgctgctgcagtgggtgcgcttgccgtgactcgtcaaggggctttcactgctatgccgatgctttctgaggttctttctttgattcaagagcaatca

SEQ ID NO: 32942 - DNA, 786 bp, Xylella fastidiosa
cgcatgcgtcgtctgtatgcgccttttaaccgtaatcatgaccgtattgttgagatggatgtgcgttcggccgaactgacaaaatatgcggctaatgcaatgttggccactaagatcagttttatgaacgaagttgccaacattgctgtgcatgtgggtgctgacattgaatatgtgcgtaaaggtatcggttctgacccacgcatcggttggcactttatctatcctggtgttggctatggtggttcgtgttttcccaaggacgtcaaggcgttggcacgtactgcacagcaatatggtgtggatccgaagctgcttaacgcggtggaagatgttaatcatgcacagaaggggcatctgtttgaactcatgctgcgtcactatggatgtagtggtgagagcacgatgttggctgggaaaacattcgcagtgtggggattggcattcaagcctaataccgatgatatgcgcgaggctcccagttgccgattgttagtgcaattgtggaaggcaggtgctcaagtgcgtgcttatgatcccgaggccatgcaggaggcgcgcaggatattcggtgaacgtgatgatctggtgttttgtgagaccgcgtatgcggctttgcaatgtgctgatgctttgattgtagtgactgagtggaagcagtttcgcagcccggatttttttgttattcgagacgctttgaaagacgctgtgatctttgatggccgtaatctttatgatccgcaggaaatcgaagaagcagggttggcctactatgggatcgggcgg

SEQ ID NO: 32943 - DNA, 4320 bp, Xylella fastidiosa
atgacccgtgatcgtggcaggttgctgggcctatggtcgcgttggcagagtcagccgcatgatcatgaggcgcgtgctaacttccagcgtgtgttatctgcatcacgggcacagcgtcaggtccgtgagaataatcagccagtggtcacggtggatacccgtttacctattgcacaggaagcagagcgcattgtcgcgctgatccgggcgcatcctgtggtaatcattgctggtgaaactggttcgggaaagaccacgcaattaccgaaattgtgtctgtccgctggacgtggcattgccggtacgatcgggtgtacgcaaccacggcgtattgcagcgcgtgcggtggcaacgcgggtggctgaggagctgcaaacgcccttgggaatggtggtgggctttcaggtgcgttttaccgagaaggtcagtgatgcctcaaggatcaagttcatgaccgacggtattttgctggcggaggttgccagtgaccgttggttgtcagcctatgacacgatcattattgatgaagcccatgagcgcagtctcaatattgattttttactcggttatctcaagcagttactgaaaaagcgtgctgatttgaaggtgatcgtgacctcggcgacgatcgacacggcacgcttttccaagcattttgatgatgcgccggtgattcatgtggctggacgcacctacccggtggaggtgcgttaccgtccgttggatgcgatgtgggcttctgataatcgccttggggaagcctacggcggaactgagtccctggctgtgaatcgttgggcgggaggatctggaggtgacggcgcgctgtcaaagcccatcgtggcggtgcctcaagaggatcagcgtactgtcaatgatgcgattgtggcggtgatcgacgagatcacccgtgaggacccgcacggtgatgtattggtgtttctgcccggtgagcgtgagattcgtgagctgtatcgggtactggagcggcgtaagtatcgtgagacggaactgctgccgttatacgcgcggttgtcggctcgcgatcaagatctggtgttcaaccccggctctgggcgtcgcctggtgctgacgaccaacgttgctgaaacatcattgacggtgccacggatccgctatgtgatcgatccgggctatgcgcgcgtgaagcgctacagtgcgcgccagaagttggaccggttatacattgagccgatcagtcaggccagtgccaaccagcgtgccggtcgttgcggccgcattgccgatggtgtttgttaccggctctatagtgaggcagactttcttgcgcggccggcattcaccgatcctgaaattcggcgctcctccctggccggggtgattttgcgcatgttgcagttgggcctgggacggattggtgggagtgctgcttccttgagcgagcctgtttcagggccggagcagcagcgcacctcctggatcattgaaagtttctcgtttctggagccgccggatgaacgggcggttgccgatggctggcaacaattggtcgaattgggggcggtggatagtcagcatgcattgactgcgatcggccgcgagatggcacggttgccggtggacgtgaagttggcgcgcatgctggttgctgcgcgccagcacggctgtgtgtatgaaatgacggtgatcgccgcttttctgggggtccaggatccacgcgagcgtcctccggatgcgcgtgaagcggccgacaatgcgcatgcgaagtttgccgatgcacgttcggagttcgttggtatcttgcgtttatgggaggcttaccgccagatccgtgggcatatgactcagtccaagttacgccagtggtgccagcgtcattttctgggctttcttcacatgcgcgagtggtgtgagttgcagctgcaattgtcgctgttgtgtgcgggggagcaggcggagcagccacgcaaggggcgagtggcggcggcctttccgaaggagggatgcttaccgtctcagcgatcaaagccaggggccgaggcggggaaggtcaacgagttaccttcaagtgcaaccgtgttgcaggcactgttagcggggcaggggacctctactcagagtgaacatcgtggtaatacaccgagtcgtggtcagctgcatcgtgcggcgcgcttggcgcgcgagcgtagcgcggttctcaaggttactcacaacacccagagtgtgaaggcggttgcagggcagagtgtttctaatgccggtatgcaggcacagtttgcggtggcgcctaatgatgtaccgcatatcggtgagcgtgagcgtgcggctgcctatcaggcgttgcatcgtgcgttgctgactgggttgccgatccagattggccatcgtaccgagaagggagattttcaggcgccgcgccagcgccgttttatgttgtttcctggttcgatgttggcgaagaagccgccaccgtgggtgctcgcagcgaacttgctggatacacagaaggtgtggggcttgacgaatgctgcgattgagcctgattgggtgattgctgaattgccgcatttgttgatgcgcaagcatttcaatccgcattggtcccgtacccagggccgagtgttggtgtctgagcagattagtttgtttgggttgctgttggcgccgaagaagccgatgcactatggccgcattgatcccgtggcagcgcatgatctttttgtacgccaagggttggtgacgggggagatcaacacgcgtgccggttttgttgctgacaatctcaaggtgttggagcaggcgcacgaggaggaggctaagttgcgtcgtgccggtattgtcgccgatgaggattggcaggcgcgttggtattttgaccgggtgccgagtgacatccatacagccgatgcactggattcctggtggaaggggctgtcagtggagaagcggcacggtctgtattggtcattgatcgacttgttgcctggcgaaggggggggggaggatcgttatccgaagtattttgcactcggggatgtgaggttgccgctgcactattcgtttgatccaggtgcagtggatgacggtgtcactttggatgtgcccttgcatctgcttaatgcgctggatccggtacggttgtcgtggttggtgcctggttttgttgccgataaagcggcggcgctgatccgttcgctaccaaaggcgttacgccgcagttatgtgccggcgccagattttgcccatgcatttgctcaagcgttccagcagccttcggccgatgagatgcgtggtgagttggcacgctttttgtcgcgtattaccggggtacgggtggcggcgattgattttgatgaacagacattggaaccttatctgcatctgcgtgtgcgtttgcatgatgagtctggtcaggttttggcggagtcgcgggattttgatgcgttgcgtgcccgttttggtagccactcgggcgaggcgttcgtagcccgtgccgggcgcgcgctcatcatggaggagctacgcgagtttcctgctgtgtcgattccgcttcagcttaccggtgaggctggggttccgatgtaccctgcgttggttgacgatggtgagatggcggcgttacggatttttgctgatcccactgaggccgcacaggtgcatccccatggcgtacggcggctcttggagatcaccttggccaacaagatcaagcaggcgcgcaagcagttgccggtgtcttccaagagtgggctgttatatgcggccattgagtcaaaagaatgtttgcgtgatgaccttgtcaaggcggcattgaatgcggtgttggctcatggcttggagtcgatccgtgatcctgttgcgtttgcgcagtgccgtgatgtggcggcgcagcagcttttttctgaggcgatggcgcgactcagtttggccgaggagattttggctgccgtggctgagctgaagccgttgctggaagcaccattgatggggtgggcgcgtggcaatctggatgacatggaacggcagttggcgcagttggtgtatccaggttttttgcgtcaaacacccgccgatgtgttgacgcagtatccgcgctatctgaaagcgatgatgatgcgcagcgagcgcgctaagcgcgacccgtcgcgtgatcaggcgcgtatgctggaactcaagccatttttggatgctctggaagtggcaatggcgcagggtgtttccgacacaccggggtgggagacattgcgttgggatgtggaggagttgcgggtttcactgtttgcccaggaattgggggtacgctcggggatttctgtcaagaaattggcgcaacgtttg

SEQ ID NO: 32944 - DNA, 603 bp, Xylella fastidiosa
cgtatcaagttttgtggtatgacccgcgttggagatgtgaggttagccagcgagcttggtgtcgatgcggtgggactcatttttgcatcgggcagctcgcgtctgctgacagtttccgcggcatgtgcgatacgccgaaccgttgcgccgatggtcgatgtggttgccctcttccaaaataacagcgcagatgagatccacactgtggtgcgcacggtacgtccgaccttgctccagttccacggtaaggaggaagacgcattctgtcgtaccttcaacgtgccctacctaaaggcaatcccaatggcgggtgctgaagcaaagcgaatctgtacgcggaccttatatttgaagtacccgaatgctgctggtttcattttcgacagtcatctcaagggtggtaccggccagacgttcgattggtcgcgtctccctatcgatctgcaccatccctttctacttgccggtggtattactccggaaaacgtgtttgatgcgattgctgctacggtcccttggggcgttgatgtttctagtggtatcgaattgcagccgggcatcaaggatggcgacaaaatgcgtcaatttgtcgaagaagtacgg

SEQ ID NO: 32945 - DNA, 1005 bp, Xylella fastidiosa
cgttgttttaacattgccatcgttggcgctactggcgcagtgggcgaggccatgctttcgatcttggaagagcgtcattttccagttgcgaagctgattcctcttgcttcggcgcgctcggcgggttctcagatcaccttcaagggcgagagcatcaacgtattggagctggagcactttgatccgcatggtgtagatattgcattgttttctgctggcagcagagtctctgaagcgtatgcgccacaatttgcggctgctggtgtggtggtcattgataattcttccgcgtttcgttacgaggaggatgtgccgttagtcgtatcggaggtgaaccctcatgcgttgaagcagcggccgcgtggcatcattgctaacccgaattgttcgaccatgcagctcatgccggtgctggcgccaatccacagggaatatcgcattgagcgtatcaatgttgccacctatcaatccgtgtctggcggtggccgctcggcgcttgaagaattgggacagcagactgcacagttgttagcctttcaagagatcaacccaaagcgatttcctgtacaaattgctttcaacttgattccgcatatcgacgattttcagtctaacggctataccaaagaggagatgaaattggtttgggagacaaagaagattcttgaggacagcagcattcaggtgaatccaacggcggtgcgtgtaccagtgttttttggtcattccgaagcggtcaatatcgaaacgcaaaagaaagtcacttctgagcaggcacgtgtgttgctagccagtgcaccaggtgttgaggtcgttgatgagtggcagcctggcggttatccgactcctgtgacccacgcttccggcaaagatcctgtgtttgttggtcggattcgtgatgatttatcacatccacgcggcctgaacctgtgggtagttgccgacaacatccgtaagggggctgcgcttaatgcaatacagcttgctgaactagtgacgggcgag

SEQ ID NO: 32946 - DNA, 1083 bp, Xylella fastidiosa
atgggggcgaacacgtttggaaagttactggctgtcacgaccttcggcgaatcgcatggccctgccattggctgtgtgattgatggctgtcctcccggattggaactcgctgctgaggagtttgcccacgacttgcagcgtcgcgctaccggtaggagccgtcatacctcggcgcggcgtgaggccgatgaagtcgagattctctccggcgtctacgaaggccgtaccacgggcactcctattgcactgttgatccgcaataccgaccagcgtagtaaggattatgcgacgattgcccggcagttccgtccggggcatgccgattacacctattggcagaagtatggcatccgtgatccgcgtggcggtgggcgttcttcggcccgtgagaccacaatgcgtgtggctgctgcggtggttgccaaaaagtggctgcagcagcgttatggtgtgactgtgcgcggttttttatcccagcttggtgagatacgtccggaaggttttgcttgggatgcgattgaggataatccttttttttggccgcatgctgctcaggtgccagagctggaggcctatatggatgcgctacgcaaatctggcgattctgttggtgcacgcgtggatgtggttgccgaaggcgtgccgccagggtggggcgagccgatttacggcaagcttgatggtgaacttgctgctgcgttgatgggtatcaacgcagtaaaaggtgtggagatcggcgctggtttcggcagcgctgtacaaaaaggaacggagcaccgtgatttgatgacaccgttaggtttcctcagtaaccatgctggcggcatcatcggtggtatcgccactggtcagccgattattgtctcgattgctctgaaaccgacgtctagcctacgtttgcctggcgagacggtggatgtggatggctgcgctgttcaagtgatcaccaagggacgtcatgatccttgtgtggggattcgtgcccctcctattgctgaagcgatggtcgcgttagtactgatggatcaggcgctgcgccaccgtgcccagtgtggtgatgtcggtgagatgtctccgtgtatc

SEQ ID NO: 32947 - DNA, 828 bp, Xylella fastidiosa
aatttcgtcaccaccctgacctatcttctgccacatcgcatgctgtcctcgctggcacgccacgtcgcctattgccagcatccactaatcaaacagtggttgatcgacacagtcatcgcaaaattcgacgtcaacctgagcgaagcggcggagccggatgcccatgcctacccaagctttaatgcctttttcacccgatcacttaaagccggcatacgcccccctgatccgaatccggacacattgctcatgccagccgacggacgcatcagccaactcgggccaatccgcgaagggcgcatctttcaagccaagggccagtccttcactgcaaccgagttattgggcgataccgctgctgcttctgccttcaccaacgggctgtttgccactgtctacctatcgccacgtgactaccaccgcgtgcatatgccttgtacgggtcagctgctcaaaacagtgcatgtaccaggccgcttattcagcgtcggcccagatgcagtacgccaaattccacggctgttcgcacgtaacgaacgactggtatgccattttgacactacattcgggccgatggtcttagtgatggtcggagcgctgcttgtctctggtgtggaaacggtttggggtggtgtggaaatccccgcttatggcgatcgcatcacacgcaaggactaccaaggacgcaatatcgccatagagcgcttcgcagaaatggcacgcttcaactatggttcaacagtcatcgtgctattgccaccaaatgtcttcaccctcgcccctcacctcacagcagaaagcccggtcacactcggtcaagcactagca

SEQ ID NO: 32948 - DNA, 1134 bp, Xylella fastidiosa
gaacgcatactgtcattacgcaaactgcgtctagcacaatgccgcacacgcacacgacgcacgatcgaaaggcgtaacggcgttcggctcgaaatcaacggaagctggctggtcgaattctgttccaacgactacctaggactcgcgcaacacttcgaaatcatcgcagcactacaggatgcagccgcccgcaatggcatcggtgccactgcttcgcatctgatctgcggccaccacgcaatacataaggcactggaatatgaattagccgaatggttgggctacccacgcgcattactgttcggtagcggcttcaccgccaacctggcagtgcaacaagctctgctcaccaaagaaaacgacatctgcgttcaagaccgactcaaccatgccagcctgatagatgctacccgtctggcaggctgccgcctacgccgctacccgcaccttgatgtggatggagcggcacatcaactcaagaacgcacccgaaggtgcagcaatgctagcaaccgatggcatctttagcatggatggcgacatcgctccattacgcgccctcagcctggtcgcacgcacccaacaagcactgatgtatgtcgatgacgcacacggcatcggagtgaccggaccccaagggcgtggctgtatcgcagctgcttggctcagcgtagaggaagtccccttgcaattagtgaccctcagcaaagccctaggtggctacggtgcggccgtactcggctctgccacactgatccaacacttggccgaaaccgcacgcccctacatatacaccactgcactgcctcctgcccaagccgccgccgcactgacagcaatccgtattgcacggcgtgacgaatggcgccgccagcgcctacaggaacttgtggagcgtttccgcgagaatagccgccgtcacggcctggagatcatggattcagagacacctatccaacccttgcaatgcggagatgaaaccacaacgatggcgatgtccgcggcattggaacgcgaagggttcctagtcaacgcaatccggccacccaccgtacccgaggggaaatcacggttgcgcgtgaccctgtccgcactgcataccactgaacaaatcgacacattagtgcaagcgctt

SEQ ID NO: 32949 - DNA, 1267 bp, Xylella fastidiosa
atgtcgttttccaaacacttcggcaaactcatgttggccacgtgcctatccttatctgcggcaccagcattcagttacagcatcagtcacgggaaggtcgtcgatgacaaaggcaaccaaatccaattaaggggcgtcaactggtttggttttgaaaccggagatcatgtggtaaatggactgtgggcacgtaattggaaagaattcatcacacagctacagggcatgggattcaacgcgatacgtttaccgttctgcccagccaatctaaatagcaacacatcaccaagcagcattgattacagccgcaatccggacttgcaaggcttgagctcgctgcaaatcctggacaaggtcgtcaaagaattgagcgatcgcagaatgtatgtgctgctagatcaccatcggccggactgctcagcaatctctgagttgtggcacacggattcatacagcgaaaaacagtggattgatgatctacgcttcgtcgcacaccgttacgccaacgtacccggcgtcatcggcttggacgtaaagaacgaaccacatggtagagccacttggggcaccggagatttccaaactgactggaacaccgcagtcgagcatgcggcagcagcgattttggaggccgcacccaaatgggtgatcggaatcgagggcattggagagaatcccatctgctccagcaccattgggcatttttggggcgaaaacctggaaccgatggactgtacgccactgaaagtccctgccgaccatttgctattgatgccacacgtctacgggccagatgtctacgtacagccgtacttcaatagccccgatttcccaaacaacatggcagcgatctgggataaacacttcggacattttgcgaaagccggctacgcgatggcgattggtgagttcggtggcaaatacggtgaaggtgatccacgcgatatcgcttggcaaaatgctttcgtggattacctcatcagtatcggcgtgacggatgccttctattgggcagcaaaccagaacagcggcgataccggcggcatggttggcaatgactggaccaccccacgcgatgacaaggtgaagctgctgaataagctgtggaatgccggtggtggtgccagtggtggttccggcagtggtgctggcggaggctccggcggcggtgctggtgctggttccggcagcggtgctggcggcggctccggcggcggtgctggtgctggttccggaagtggtgctggcggcggctccggcagcggtg

SEQ ID NO: 32950 - DNA, 1383 bp, Xylella fastidiosa
atgacgtgccgcacccgctttgcccccagccccaccggttacctacacattgggggcgcccgcaccgcactgtattgctggctggaagcacggcgccgcaacgggcaattcctactgcgcatcgaagacaccgaccgcgaacgcagcacacaagccgcgattgatgccatcctgcatgcaatggactggctgggactggactacgacgaaccccctgtctaccaaacccaacgcatcgaacgctacaaccaggtagctgcgcgtctgcttgccgaaggcaaggcgtactacgcttacgactccaaggacacattgaacgccatgcgtgaagcagctctgcgcactggcgaaaaaccacgctataacggcgctgcacgtgaagccaacctgccataccgggatgatcccaaccgggtcatccgcttcaaaaatccgcacaccggcaccgtggcgttcgacgatttgatcaaaggtcgcatccagatcgccaacagcgaactggacgacatggtcatcctgcgtcccgatggctacccaacctacaacttcgcagtggttgtggacgactgggacatgaacatcaccgaagtgatccgcggcgacgaccacatcaacaatacgccacggcaaatcaacctctatcacgccctgggcgcaccactacccacatttgcgcatctaccgatgatcctggacgaacaaggcgccaagttatccaagcgtaccggcgcggctgatgtgatgcagtacagagattctggttacctgccccatgcactgattaactatctggtacggctgggctggtcacacggcgaccaagagctattcaaccggcaagcgctgatcgacctgttccaaatcaacgatgtcaactccaaagcagcgcgccttgacatggcaaaacttggctgggtgaaccagcactatctgaagaccgatgacccggcgacgcttgccccgccattggtctggcatctggaacaacgcggtattgatgtcagcgccggtcctgctccgacggacgtaatcctggccctacgggaacgcgtccagacactgaaagaaatggccgagaaagcagaaatctggtattgcccattacagcgctatgatgaaatagccgttgccaagcatctcaaaccaggtgccgaaacagccctactgcacgcacgtacgctgttagccgcacttcccgcgtggactgtggacaacgtggataccgccttgcgcacgactgcgacaacactagagatcggcatgggcaaagtggcacaaccattgcgggtagcgatcaccgggacccaagtcagcccggacattgcctataccgtttacctcaccggccgcaacgaagccttgaaacgcattgatgcggcactg

SEQ ID NO: 32951 - DNA, 1170 bp, Xylella fastidiosa
atgtccatcgtccgcatgactgatctcgctttatccggtaaacgcgtactgattcgtcaggacttgaatgtaccgattgatcagggtcgtattacttccgagcagcgcattattgcttcgcttccgacgatccgtgtagcgctggagcgtggtgcggcggtcatggtgacttcgcatctgggccgtccgaaggagggcgtgtggagtgaggaggattcattggcacccgtggcgaagcgcttgtctcaattgttggggattgaggttccgttgcgtcgcgattgggtggatggcgtgcaggttgcgccagggcagttggtgttattggaaaactgccgaatgaatgtcggtgaagctcagaatgacgaggcgttggcaaggaagtatgcggcgttatgtgatgtgttcgtgatggatgcgtttggcactgcgcaccgtgcccaggcatcaacgcatggggtgatctgttgtgctgcgattgctgctggcggtccgttgttgatggctgagttggatgctttgagccggggattgaagcatccggtgaagccgctgctggcgattgtggggggcagtaaggtatcgacgaaattggagttgctttccaatttggtgaataacgttgagcaattgattacggggggaggcattgccaatacgttccttgccgcagccggttattccatcggtaagtcactgtatgaggcggatttgatcgagactgctcgggagattattattgtggcgaaagcgcgtggcgctgagattccgttacccacggatgtggttgttgccaagcagtttttgcctggagtcacggcaacggtgaagacggtggatgcaatcgttgccgatgatcttattttggacattggtccgcagacggcacggcactatgctgccttgattgaaacggcggctacggtggtctggaatggtccagtgggtgtgtttgagttcgatgccttcagcaaggggaccgaggtgttagcgcgggccgttgctgcctcgtctgcgttttcgattgccggtggcggcgataccttggctgctattgataagtatggtgttgcggaccagatcagttacatctccacaggcggcggtgcttttctggagtttttggaaggtaagacgttgccggcggtggctgcgttgcaggcgcgcagc

SEQ ID NO: 32952 - DNA, 1428 bp, Xylella fastidiosa
atgtctgaacgccagcgccgtaccaggattcttgccactcttgggccagcgacagatccgcccggtgtgcttgatgcgctgtttaaggcgggagttaatgtggtgcggctgaatttcagccatggcgatgtttcggatcaggccaggcgtgttgctgaagtgcgtgcggcggcggcgcatgtgggcgttgagattggcattcttgcggatctacccggtccgaagatccgtattggacgttttaccggggggaaagtgcggcttgtggctggtgcgcgctttgatctgcttgccgatagcaatgcgtcgctgggggatgcgactcaagttggggtcagttatctggggttgccgcaggatgtcgccgccggagatgtgttgttactggatgatgggctcatgcaattgcaagtggtgcaagtgcagggtgcgcggattgtgacgacggttcttaacgatggtgtgttgtccgaccgtaaggggctgaataagcaaggcggcggtttgtcgctgggtgcgctgacggatcgtgatcgcgaactgattcgtatcgttgccaggatggggatcgactttattgcagtttcgttttgtcgtcatgctgaagagatgcatgaggcacgtcgcattgctcgggagtgcggctgtgatgctgcgttggtgtctaagatcgagcgtgctgaggctatcgtgaatctcgccgagattgttgcggcttcggatgtggtgatggttgcgcgtggtgatttaggtgtggagattggtgacgctcaattgccgggcttgcaaaaaaagatcatcaaagaagcgttgttacagaacaaggtggtgattactgccacgcagatgctgcaatcaatggttgaaagtccgatgccgacccgtgctgaggtgctggatgtggccaatgcggtgattgatgggaccgatgcggtgatgctgtcggctgaaacggcgacaggtgattatccagtcaaggcagtagaggcgatggcgcgtatctgtctgggagcggaacaccagtttgagtttgatactgattatgagatggcgcagcgtaatttgcagcgtgcagatcatgcgattgcaatggcaacgatgttcttatctgagcacatttgccttggtggtgtggttgcgttgacggagtccggtacgacgccgcggtttctctcgcggttccggtcgcacgtcccgatctatgcgtttacgcgtcacgaggatgtgcggcggcgcatggttctgatgcgtggtgtatttccgatgcgttttgacagccgtggtttgacgccgcgtgaggcagctagggcgacaatccgtcttttggtggaatgtggttgtatgagtccgggtgatcgtgtggtgttcacgagcggcgagcatatggaaacgcttggcgcaaccaatacactgcgtttacttgaagta

SEQ ID NO: 32953 - DNA, 1032 bp, Xylella fastidiosa
gaacagcttgcagaaaccgctcaagcaatggtcgcctcgggtaaggggatcattgcgattgatgagtccgccggcaccattgctaagcgtttttccagtgtcggtatcgaaaatattgaagagaatcgccgtgcttaccgtgagttgctgctgacgacccctaaattgagtgattacatttctggggcgattctatttgacgagaccattcgtcaatccacgaaggccggtgtcccgtttccgaagtacatggccgagcatggcatcatcccagggattaaagtggataagggcgcatatccgttagcagggtgtcctggtgagttggtcacggaggggttggatgggttgcgtgcacgactggaggagtattacaagcttggcgcacgttttgccaagtggcgtgctgttatcaacattggtgatgatattccgtcagggatgtgcatcgatgccaatgtacacgcgctagcgcgttatgcggcgttgtgtcaggagcagggcttggtgccgatggtggagccggaggtcattatggatggtaaccatgacatctcggctgcttatgaagtgaccgaggcgacgttgcgttccctgttcaatgcgctgtatgagcagaatgtggtgcttgaaggaaccattctgaaggcgtctatggtgatccctggtaccgactgtgaggagcaggccagtattgatgaagtggctgaatccacggtgatgtgtttgaaatcgacagtgcctgcgatcctgccgggtattgtgttcttatctggtggacagacggatgcgcagtccacggcacatttgaatgcgatgaatcaatttgatcccttgccgtggccgttgagcttctcttatggccgtgcgatgcagcaggcggcattgaagttgtggtcacaggatatgaagggcaatttcgccaaagcgcagcaggttgtgtacgagcgggccaaggaaaatggtctggccgctcttggtaagtggaaggggtgagcttctttgctcattgtggcgaaggcgctggctgtg

SEQ ID NO: 32954 - DNA, 1716 bp, Xylella fastidiosa
atgctgcgtcacctgctcacgttgtcgctgatattcgcaatcgcgctgcccattggagttagcgctgcgccttggcctgctttttcaactcggggaacgcaattcatccgtgatgggaggccgtatcagttgatctcgggtgccatccacttccaacgcatcccgcgggcgtactggaaggaccgtttgcaaaaagcccgagcaatggggttgaacacggtggaaacctatgttttctggaatctggttgaactccgtgaaggtcaattcgacttcacagggaataacgacattggtgcttttgtgcgtgaagcagcgtcgcaaggtctgaacgtgattctgcgtcccgggccatatgtgtgtgcagaatgggaggcaggggggttcccagcgtggctgttcgccgatccgacgctacgggtgcgcagtcaggatccgcgttttcttgatgccagtcagcgctatctggaggcactcggtacacaggtcaggccgctgctcaatggcaatggcggtcccatcattgcagtgcaggttgagaatgagtacggctcttatggggatgatcatggctatttacaggctgtgcacgcgctattcatcaaggccggtttgggaggtgcgctgttgtttaccgccgacggggctcagatgcttggcaatggcacgctgccggacgtgctggcggcggtgaattttgcaccgggtgaggcgaaacaggcgctcgacaagctcgccacattccatcctgggcagccacagttggtgggcgaatattgggcgggatggttcgaccagtggggcaagccgcacgcgcagaccgatgcaaagcagcaagctgatgagatcgaatggatgctgcggcaagggcattcgatcaatctgtatatgtttgttggcggcaccagttttggttttatgaatggtgctaacttccaaggtggtcccggtgaccattacagccctcaaaccacaagctacgattacgatgcggtgttggacgaagcaggacggccaatgccgaagttcgcactgttccgcgatgtcatcacccgtgtgactggtctccagccgccgccattgccaggggcaagccgttttatcgatctgccggacacgccattgcgcgcatccgcttcgctctgggacaacctgcctgcagcggtcgccaccacagcagatccgcagccgatggagcgctataggcaggcctacggttacattctgtaccgcaccacgctccacgggccacggaagggcaggctgtatctgggtgaggtgcgggatgacgcccatgtctacgttgatcgtctcttcgtgggtcgggcggaacgacgtcggcagcaggtctgggtggaggttgacattccctccggtactcactgtctggatgtcttggtagaaaacagtggacgggttaactacggtccgcacctggctgacggccgcgccgggctgattggtccggtgatgctcaatcatgaacgcgtcaacaattgggaaacgtttctgctgccgttgcagacgcccgaagcgatccacggttggacaaccgcaccgatgcaaggacctgcttttcatcgtggcacgttgtttatccgcacgcctggagacacatttttggatatggaggctttcagcaagggagtgacctgggccaatagtcacatgcttggccgctactgggacatcggcccgcagcgggcgctttacttc

SEQ ID NO: 32955 - DNA, 2268 bp, Xylella fastidiosa
atgacaattgtgaccaacctgggtttcccgcgcatcggcgcacgacgcgaactcaagcgcgccctagaaagccactggcgtggcgagaccgatgccacacaactccaacacactgcacgcgaactacgcgcacggcactggcgactacaacgtgatgcgggcgtggacctgccacccagcaacgacttcagcctctatgaccacgtcctagataccgcattcctgttcgatgccattccacagcgctaccgcggcctggtagatgctgatcctctggccggttacttcgcgatggcgcgtggccgccaagctgacaacattgatctgcatgctctggagatgaccaaatggttcgataccaattaccactacctcgtcccagaactgcaccgtgaccaacacttcgcactacgcggtaacaaacccatcgccgagtttgaagaagcactggcactgggcatcactaccagaccggtgctccttggaccagtcagctttctcctgctgtctaagacagtggatggcagcaaccggctcgacctactggaacgtttactgccggtctacacccaattgctgcgccaattgcaggaaagcggtgccgaatgggtgcaaattgatgagccaacacttgtgctggacctggatgcacaaacacagcaagccttccgtaaaacctacgccacactcaatcaaggaccacgcccaaaattgctgctgaccagctactttggtccgctcggcgacaacatcgaactggccttgcaactgcctgccgatggcttacacatcgacttagtgcgtggcaccgaacagttggatgcggtcctcaacaccttgcccgcgggacgggtactctccgccggactggtgaatggacgcaatatctggcgtaccgcactggacaacgcactgacactggcgcgctacgcgcaaggcagcgttgataaggatcacttatggctggcaccgtcatgctcactcctgcacgtccctgtggacctggaacaagaaaaaaacctggacgccgatgtacgcaattggctcgcatttgccaagcaaaaacttggcgaactgcgcgtactggctgacgcactggacaacaagccagaagcagaaacagcactgacccaaacacgccaagcattggaggcacggcgccaatcacccaaagtccaccgccccgacgtggcacagcgtctggccgcactcacaccggacaccatccggcgcaacacggcctacccacaacgcagccaggcacaacaacacacactcaacctacccgcttacccaaccaccaccattggctccttcccacagacgctagcagtccgtgaggcccgcgcgcagttcaaatccggcaagttgtctgaaagcgactatgaggcgtttttgaaagcggaaaccgaacgttgcgtacgtacccaggaagagatcggattggacgtcttagtccatggcgaattcgagcgtaacgacatggtcgaatacttcggggagcaattggacggcttcatcttcaccaagctcggttgggtacagagttacggatcacgctgtgtcaaaccacccatcatttatggtgatgtagtacgtccagcaccgatgaccgtcacctggtcggcttacgcacaatcactcaccgacaaaccaatgaaagggatgctcaccggtccggtgacaatgctgcaatggtcgtttgtacgcgatgatcaggaacgcgcgcagacatgccggcagatcgcactggcacttcgcgacgaagtccaggatttagaaaaagccggaatcaaggtgattcaaatcgacgaaccagccatccgcgaagggctaccgctgcgccgtggtgaatgggcagactatctgaactgggctgtggagagcttccgcattgcctcttcaaacgtccatgacactacacagattcatacccacatgtgctactcggaattcaacgacatcattgaagccgtggctgcattggatgcagacgtgatctcgattgaaacatcccgttcacgcatggaattactggatgccttcgtgaaattccgctatccaaacgccatcggcccaggggtgtacgatattcactccccgcgtgtcccaaaggaagaggaaatggtgctgctattgaaaaaagcacgcgcagtacttccctcggaacaattgtgggtcaacccggattgcggcctgaagacgcgcggttggaaagaaacacgtgctgcattgcaaacaatggtgcatgccgcgcagcggctacgt

SEQ ID NO: 32956 - DNA, 1482 bp, Xylella fastidiosa
aaatacatactggccattgaccaaggcaccaccagctcccgggccattctgtttgaccacaaaggccgcatcaccgggatggcacagcgagaattcacccagatatttccccaacctggctgggtcgaacacaacccgcgcgacatcatgaccagtgtgtacaccacgatcaccgaactgctcaacaacacccagattgacgtgcgcgccatcgccggaatcggtattaccaaccaacgcgaaacaaccgtcatctgggatcgtcagactggccaaccgatctacaacgcaatcgtttggcaatcacgccaaaccaaggacatctgcgaccaactcacgaccgccggataccaagatctggttcacgccaaaaccggactcctgatcgacgcctatttttcaggcaccaaggtgaaatggattctggaccatgtcgaaaacgcacatacacaagcagcgcgcggagaactggcattcggcaccatcgacacctggatcatctggaacctgaccggcggccaagtccatgtcaccgattacagcaacgcctcacgcaccctgctgtacgacatccacgccctgcgttgggatccagacctgctgacaatgctagacataccagcggcgatcctgccggacgtccgttcatccagcgaaatttacggcctcacccaaaccccgtatttccacggagaacagataccgattgccggaatcgccggcgatcagcaagccgcactcttcggccaagcctgtttcgaacctggcatggccaaaaacacctacggcaccggctgtttcatgctcatgcaaaccggcaaaaaagccgtggaatcccaaaatggactactcactacgatcgcttggggcctgaatggagaaatcgagtacgcactagaaggatcgatcttcgtcgctggctctgtggtgcaatggctgcgcgatggattacgcatgttcggcaaagccagcgattcacaagcctacgccgaccgtgtcagcgacaacggcggcgtgtacgttgtaccggccttcgttggcctgggtgcgccctactggcgtagcgatgtccgcggcgcagtgttcggactgacacgcagcaccaccaaagaacacttcgtccgcgccgcactagaatcgatggcctaccaaacccgcgacgtcctgagcgcaatgcaggcagatgcagacatcgaactcaaagaactacgcactgacggcgcggccatcaccaacgacttcatggcccaattccagagcgatatcctcgccgtgccagtgctgcgctcgcagatcgccgaaaccacagcactcggtgccgcctacctggctggacttgcgaccggattttggtccagccgcgaagagatgacgcaacactgggcgatcaatcgctgcttcaagccacagatggataaggaacaacgcgagcacctatacgcaggctggaaacaggccgtcgcagccacattaggcttccgt

SEQ ID NO: 32957 - DNA, 1476 bp, Xylella fastidiosa
ttcgacctactggtggtcggtggcggtatcaacggcaccggcattgcccgtgatgccgccggacgtcatctctcagtgtgtctgtgcgaacaacacgacctggcctcccacacctccagcgccagcaccaaactgattcacggcgggctgcgctacttggaatattacgaatttgcgttagtcagcaaagcattgggcgaacgcgaaatcttgctacgccaagcaccgcacattgtcaggccactgcattttatcctcccgcaccaaccccatctgcgccccacctggataatccgcgcgggcttgctgctgtacgaccaccttggctttagccgacgcaccctgcctcgctcacgtcgcttgaacttggccaaacatcccactgggcaaccactcaaacaggagctgcacaccggcttcatgtattgcgacgcccaggtccaagacgcacggctggtcgtgctgaatgcaatggatgcagcacaacgtggcgcacgtatcctcacccgcacccgctgcgtgagaacgcgccgtgacggcgcacattggttgactgaactggaagaccctcaaggaagacagcaacaaattcgtacacgggccatcgtcaatgccgccggcccctgggccgtcacgtttctggatcacatcgctcaacagccacatcagcacacactgcgtctggtgaaaggcagccacattgtagtaccccgtctgtttgaacatgagcatgcctatatcttccaacaaccagacagacgcatcgtctttgccattccttacgaacaacatttcacactgattggcactaccgacgtcaactacgtagctgatccggcaaatccacacattgacgctgcagaaaccatgtacctgtgcaatgcagtcaatgcgtatttcagacaacaaatcacaccggaagacgtcctctggagctacagcggagtccgtcccctactgaacgatggacacaacaatgcatcgaaagtcactcgtgattaccaattagaaatacttggaaacagcgcaccattactcaacgtgtttggtggcaaactcaccacctatcgcaagctttccgaagaagcagtgaaccagctatgcgtagcattggaccacccctaccgtgcctggactgccaatgggccacccctgcctggcggcgaacaccacgacatcgcagcgctacaaaacacactgcgccaacaccgcccatggttacctactgccactgcgcaacgcctgatacacaactacggcacctatgccgaaacgctgctcggcaatgccaccaacctacacaccctgggaattcactttggcgccgacctgtatcaagccgaagtagactacctgcgcacccacgaatgggcatgcagtgccgaagacatcctctggcgccgcagcaaactcggcctgcatttagatgcgcatggcacacagcgcctggaagactatctacgctcctgctcacgc

SEQ ID NO: 32958 - DNA, 1911 bp, Xylella fastidiosa
ccgatgttggccaaagatgcgcacgtagaccgtgcgcactacaaaacgctttaccacgaatccatcgaacaaccagaagcattctggagcaaagtcgcacagcgcctggagtggtttaaagcgccgaccaaaatcaaaaatgtcagctaccaacttgaagatgttcacatccgttggttcgaagacggtgaactcaatgccagcgtcaactgcctggaccgccatctcaccttacgtggcgacaaaacagcactcctgtttgaacctgacgccccatacgccccatcctcacgcatcacctaccgtgaactatacgagcgcgtctgccaactcggtaacgcactgcgccacctcggcatcgaaaagggcgaccgcgtcaccatctacttaccaatgattccagatgcagtcgtcgccatcctcgcttgcgcacgcattggagcaatccactccgtcgtcttcggcggttttgcagcaaactccattgccgaccgagtgaatgactgcggtagcaaactcatcatcaccgcagatgaaggcctgcgtggtggcagaaaaattccattgaaagccaatgtcgatgccgcattaaaaatccacggaacccagtccgtcgaaaccgtactcgtcgtgcgtcacaccggcagtacgatcaacatgcataccccgcgcgaccgctggttccatgacctcgtcgacatccaagcaaccgaatgcgccccagaacgcatgaacgctgaagccccccttttcatcctctatacctccggctccacaggcaaacccaaaggagtcctgcacaccaccggcggctacctggtgtacaccagctacactcatgaaaccgtgtttgacctacgcgaaaacgacatctactggtgcactgccgacatcggctggattactggtcacagctacatcgtttacggccccctagccaatggcgccaccgtcttgctgtttgaaggcaccccccactacccaaccgtgtcgcgcttctgggaagtgatcgacaaacatcacgtcaccctcttctacaccgcgccgaccgcaatccgtgccttgatgcgcgaaggcgacattcctgtaaaaaaaacctcccgcaaaagcttgcggttacttggcagcgttggcgaacccatcaaccccgaagcctggcactggtactacaccatcgttggcaacggacgctgtcccattgtcgacacctggtggcaaaccgagacaggaggaatcctcatcaccccactgatcggtgcaaccgaccttaaaccaggctcagtcaccctccccttcttcggcatacgccccgccctagtggataccaacggacaaacactggatggccccgcagcaggtaacctagtcctgctcgattcctggccgggtcaaatgcgtaccctctacggtgaccaccaacgttttatagacacttactttcgcacctaccccaatacttacttcaccggcgacggctgccgccgcgatgccgacggctattactggatcactggacgtgtggatgacgtcatcaacatctccggccatcgcatcggcaccgccgaaatcgaaagcacactcgtcgctcaccccaaagtggctgaagccgcggtcgtcggcttccctcacccgatcaaaggccagggcatctacgcatacgtgacattaattaccggcgagacacccagcgaagcactgcaccaagaactgctcacctgggtacgcaaagaaatcggagcaatcgccatacccgatcacgtgcaatgggcacccaacctccccaaaacccgctccggaaagatcatgcgccgcatcctgcgcaaaattgcagaaaacgcaccagaccaactcggtgacacctccacactggctgatccgtctatcgtcgacttattgctcaacgaacgactg

SEQ ID NO: 32959 - DNA, 1845 bp, Xylella fastidiosa
gattccacttgttatccacgtttgtcgcgtatccaaactccagaggatctccgcgcttttcaggagtcggagttgcctgcggttgccgatgagttgcggaattatctgatcgaatcagtaggcctcagtggtggtcactttgctgctgggttgggtgtggtcgaattgacgatcgctttgcattatttgtactgcactcctatcgatcagcttgtctgggacgtgggtcatcaaacgtatccgcataagatattgaccggtcgccgtgacaagattagtacggttaagcatcaaggtggtttggcaccgtttcctaagcgtgaggagagtatctatgacacgttcggtgtcggtcattcttctacttctatttcagctgcgcttgggatggcgattgtggcgcagcgtaatggggatgagcgtaaggtggtggccatcatcggcgatggtgcgatgacagcggggatggcttatgaggcgcttaatcatgctggcgggatgagtcctgcaccgaatcttcttgtgattcttaacgacaatcgtatgtcgatttccgaagcggtcggtgggcttaccaagatgcttggtcgtgcgactggcagcaaagcattgaatgcgatccgtgagggtggcaagagaatttttggggataagaaaaccaatgcaaccgcgcgttttttacgtcgctgggaggagcattggaaggggatgtttgtgccgtcgacgttgttcgaagagatggggttccattataccggcccgatcgatggccatgatttgccggcccttcttggtgcgttgaagacgttgcgtacgttgaagggtccacagttgttgcatgtgatcacaaccaaagggaaggggtatgagctggctgagggagaccagattggttaccacgccgtcgccccgtttgatccgcaaaagggtctgattaaggcgggagcaaagaagcaaacatatacggacgtgtttagtgagtggttgtgtgatatggcagcggtggaaccacgtttgctggctattacaccggcgatgcgtgagggatcggggttggtgcgttttagtcaggagtatccgcagcgttattttgatgtggccattgctgagcagcacgcgataacgttggcggctggtatggcgactcaaggtgctaagcctgtggtggcgatttactcgacctttttgcagcgtggttacgatcaattggttcacgatgttgcgttgcagaagttggatgtgctttttgcagtagatcgcggtggtgtggttggtccagatggtgcgacgcatgcgggtaatttggatctgagtttcctgcgttgcgtgccaaacatgatgttgatggctcctgccgatgaggcagagtgccggaagatgttgagtaccggtttccactattctgggccagtagcggtgcgttatccgcgtggtacgggtcctggggtggtgccgtccgctgagttggatgtgttgccggttggtgtggcgcagttacgtcattctggtacacggatcgctctacttggttttggggtgtgcgttgctcctgctgaacaggtggggcgtaggcttggtttgactgtggtcaatatgcgttttatcaaaccgttggatcgaacgttgctgttggagttggcgcgtactcacgaggtgtttgtcacgattgaagataatgtagttgctggcggagctggctcaggggttgcggaattacttaacgctgaaggcatcgttttgccgattgtgcatcttggtcttccagatgcgttccagcagcacgcttcccgtgaggatttactggctgaggcgggtattgatgcggctggtgtgtacgctgcgctg

SEQ ID NO: 32960 - DNA, 1155 bp, Xylella fastidiosa
atgaatttccacgaataccaggcaaaacaactatttgccgaatacggcatccctgttccggccggacgcatcgcgtcttcagccgatgaagcggtcacagccgccaaatccttgggcaacggcccctggatggtaaaagctcagattcatgcgggcggtcgcggtaaggccggcggcgtgaaattctgcaagacaaccgacgaagtgaaacaggccgcagcaacaatgctcggtaccaagatggctacttaccagtcagcaggtgtcgctctgccggtgaatctggtcctggtcaccgaagccggtgaaatcactaaagaactctatctgtccgtgttagtggatcgcggcacgcgttcaatcacctacatcgcctcatccgagggtggcgtggacattgagcacgttgcagctgaaacccctgaaaaaatccaaacgctcaacgtcgactttgtcgaaggcctacagccataccaaggacgcgatattggatttcacctcggcttagaagcaaaacaggttaatcagctgtccaaaatcatgattagcctctatcaattgttcaacgacaaagatttgtccttgatcgaattaaatccattagcaatcctgagcaatggggatttgtacgcactggatggaaaaattaattccgacgacaacgccacattccgccataaagaattggccgcaatgcgcgataaaactcaggaagacgaaaccgaggttctagcttcagaaaacgatctgaactacgtcaccatggatggcaacatcggctgcatggtcaatggagccggacttgccatggccacgatggatgtgatcaaactcaatggcggcgaaccggcaaacttccttgatgtcggtggcggcgctaccaaagagcgcgtgacgaccgcattcaaactgatcctttcctcaaacaaggtcaaagccatctttgtcaatatcttcggtggcattgtccgctgcgacatgattgccgaaggcatcatcgctgcagtgaaggaggtgggtgtcaaagtgcctgttatcgtacgcttggaaggcaccaatgtagacgctggcaaacaactgctagccacatccggcctcgccatcatcccggctgacgacatcaacgacggcgccaaaaaagccgtggccgctgtc

SEQ ID NO: 32961 - DNA, 870 bp, Xylella fastidiosa
atgtctgtactggttaataaaaatacgaaggtgatcgtacaaggcttcaccggtcaacaagggaccttccatgccactcaaatggtggaatacggcacccaagtcgtcggcggtgttacccccggcaagggaggaaatactcatattgatctaccggtattcaatactgtgcgtgaagcagtccagaacacaggtgccgacgcctcagtgatctacgtaccaccaccgttcgcagcggatgcaatcttggaagcagctgcagcaggcatcaaagtcatcgtagcgattactgaaggtatcccagttctggatatgctacgcgttaaaaatgtacttaaagcatcacctgaaatcaccttgataggaccaaactgcccaggcgtcattacaccaggagagtgcaagataggcattatgcccggccatatccacaagccaggtcatatcggtattgtgtcccgctccggtaccttgacttacgaagcagtgaagcaaaccactgacgtcggcctcggtcaatcaacctgcatcggtatcggtggggatccaatcaacgggctgaacttcgttgatgcgctaaaactgttcaataacgacccgcagaccaaaggcatcatcatggtaggcgagatcggcggggatgctgaggaagccggggctgaatatattaaacaccatgtgaaaaaaccggtggttggctttatcgctggtgcatccgcaccgaaaggcaagcgtatgggtcatgctggcgccatcgcctcaggaggctcaggaacagctgaaggcaagtttgctgcaatggaaaaagcaggcatcaagacagtacgttcaccgggagatttaggtgcagcgattgctttgctcgtaaga

SEQ ID NO: 32962 - DNA, 3492 bp, Xylella fastidiosa
atgcgcctgtccacgatcaagctgtccggtttcaaatcgtttgttgatcctgccacgctccatctaccaaccaacatgaccggtatcgttggtcccaatggctgcggcaaatccaacattattgatgcggtgcgttgggtgatgggtgaaagctcagctagccggttacgaggcgattcgttgacggacgtgattttttccggatcttccgcccgtaaaccggtggcacaggccaccgttgagctgatctttgataacagcgaccacaccatcagtggagaattcgcggcattcaacgaaatttcggtcaaacgtaccgtgagccgtgatggctccagcgtctactccctgaacggcaccaagtgccgccgccgcgatattaccgacttgttcctaggcaccggcttggggccgcgcagttactccatcatcgaacagggcatgatcagtcagattatcgaagcgcgccctgaagatttgcgtatctacctggaagaagccgccggcatatccaaatacaaagaacggcgtaaagagaccgagagccgcatccgtcatactcaagaaaatctggatcgcctgaacgatttgcgtgaagaaatcggtaaacagcttgaacacctcaagcgccaagcgcgccaagctgagcaatatcagacattgcaagaagaacgccgtgttaaagatgccgagtgcaaggccttgcagttccgtgaactggacacccgtctccaaggattgcgccatgcattacttcaagaggaaacccgcttacagcaattgcttgccgaacagcgtgaagccgagatgcggatcgaaacctcccgcgtacggcgtgaagagtctgccgaagccttggcaaccgcacaggccgatgtctatcaagtaggtgccacactggcccgcatcgaacaacagatccaacatcaacgtgaaatgtcgcagcgtttgcacaaagcacgcgatgaagcacagaaacaactgatcgacctgacccgtcacatgggggacgatgccgccacactggcggtgttacgtgaggccgtcgagaacaacgaacctcagttgcacgtgctgcgtgagcagagcgaatttaaacaagacgcactgcgcgacgccgaagcagcgttgacagactggcagcagcgttgggacagccacaaccgagagaccagcgaagcatcgcgtgctggtgaagttgaacgtacccgtgttgactacttggaccgtcagaccctggacgccgagcggcggcgtgacctattgcttgccgaacgtgccggacttgatctggacgcattggccgaagccttcgagcagatcgaagtgcaatacgaaacccagaaagccgcactggacggcctcaacgaccaacttgaacaacgtaaacagacattggcggacgtacagcaccagcagcgtactgcgcagaccgaactggccgatgtccgtaaacatgcccagaccgcccgtggtcgcctatcttcacttgagaccctgcaacaggccgcccttggccaggaacaaggtgccgccatgacctggttgcaggcccatggattgagttcggccgcccgcgtaggagaacgtattcgtgtcgagagcggctgggaaaacgcccttgaaagcgcccttggtcacatgattgaaggcgtccttgttgatgacccgcagaccttggttgaagcattgaacagccttaacgaaggccacatcgcattggtggctgacacccagacacagatccaagtggcccccacatccctggccgctaaagtccagggacctgttgcgatccgccgtttactgacccatctgcacggcgctgaagatttagtcgctgcccgcgccctgcaagaaacactgggcgagggcgactgggtgatgacccgcaacggtgaatgcctgggtgaaggatggctacgcgtatcccgttctggagccgctgagcaaggcgcattactgcgtgaacgtgacattcaaaccctgcgcgcccagattgagaccctgcaagagcgcgaagctgaattggaacatcgcttgacgcacttccgcgaccacctattgatggccgaacagcatcgcgaagatgcacaacgccaactctacattgcacatcgtggcgtctccgaactggccggccagcgccaggcccaccacggcaaactagaggcctcccgtggccgtatccagcacattgaagccgagattgcccagttattagaaaccttggataccagccgtgaccaagcccgtactgcgcgcgccacactggatgaggcagtcacccgcatgggtgacttagagagccaacgtcaggcattgcacgctgagcggcaacaacttaacctgacccgtgaccaagcgcgtgaagccgcacgcagcgtccgtgaagctatgcatgccttagccttgaccttagagtcacagcgtacccaaatggtgtccttgagtcagacattgcagcgcatggacaaccagcgcggccagctcgacgcacgcttagaagaactgatgaaccaactcagtgaaggtgattccccggtggagatcctggagcaacaacatcaggcggccctcagcgaacgagtccgtaccgaacacctcttggtccaagcacgtactcatcttgacggcattgatgccgaactgcgccaattcgaacacacccgtcagcagcgcgatgaacaggccttgtcccagcgcgagcgcatctctcaatgccgccttgaccaacaggccctcgccttgggcgctgaacagcggcaggctgcggtggagaaagccggcttcgtcttacagcaccttgtggatgccctgcctgaagctgccaacccggctgactgggaggccgcgatagaacaactggatatacgtatccgtcgtctggaacctgtcaatctggcggccattcacgagtacaacgaagccgcacagcgtgtcgaatacctccaagcccaacatgaggacctgaccgttgccctacagacacttgaggatgccatctccaaaatcgaccgtgaaacccgaggccgctttaaagagaccttcgatcgcgtcaacgcagggttacagacactctatccccgtttatttggtggcggtcacgcctacctggagctgaccagtgaagatttactcgacaccggcatagcgattatggcccgccccccaggcaagcgcgtctccagcatctccttactgtctggcggtgaaaaagccatgacagcagttgcacttgtgtttgccatcttccaactcaaccccgcacccttctgcctgctcgacgaagtggatgctcccctggacgaagccaatgttgggcgcttggccagcatggtgaaagaaatgagcgagaaagtgcagttcctgtttgtcagccacaacaaatccaccatggaagccgcccagcaactgtccggtgtcaccatgcgtgaacccggagtgagccgcctagtcagcgtggatttggccgaagcgacccgtttggtt

SEQ ID NO: 32963 - DNA, 1023 bp, Xylella fastidiosa
atgtattcccttttccgtcccctcctgttcacctgcgacgcagagcgtgcccatgacatcagcctgcgcaccttagatatcgcctaccacagtggagcattacctctactgacacgccacacacgaccgttacccaccacagccttcggtctgaactttcccaaccctgttggcttagccgccggactggacaaaaacgggactcacattgacgctctattcgccttaggttttggctttattgaaatcggtaccaccaccccacgtccacaagcggggaatcccaagcctcgccttttccgcctgacgcaacaacaagcagtgattaaccgcatggggtttaacaacctaggtgtagatgcgctggtacgtaacgttgcaggcgcgcggcgacgcaacggcccgcttgggatcaacattggcaagaacaaagacacccctaacgaacaggccagtaacgactatcggtattgtctggaacgggtctatgcactggcagactatgtcactatcaatctctcctcaccaaatactgctggtctacgagcgctgcaagaggaacagacattgcgtcgcttgatcggagaattacgtgaaacacaagaaacgctggcagcgaaacacggccggcacgtacccatgctcatcaagatggcaccagatctcagtgacagcgacattgatgcagcagcacgtgtactcaacgagatgagcgtagacggagtgatcgccaccaataccaccgtgacgcgcccgcttctaagacaacatccgctggcaagcgaagcgggggggctgtccggtgcacccctcctgggacagtccaccttggtgctacgtcggctacgtacccacttacctgaaactattgatctcatcggcgtgggcggcatctgttgcggtgccgatgccggcgccaaaatggctgctggtgccagcctagtacagtgctacaccggattgatattcaaaggcccacagttgattggagaatgcgtggaagccattcgccgccgcctcgaa

SEQ ID NO: 32964 - DNA, 1491 bp, Xylella fastidiosa
gagaagatcatcaccgacctgcgtagccagttatacgcacacctcataggattggatgccagctttcacgatcgtaatcgcagcaacgagctggtgtcgcgtctggccacagacagtgaactgctacgctcaatcattggatccacaatgtcagtagcgacgcgtagcaccgtgactgcaatcggtagtctcatcatgttattcatcaccagtccacgcctcgccagcctttccctggtggtcatcccactcgtgatacttcccattgtcttaggcgcacaacacctccagaaagccgcccgtaccagccaggatcgcattgccgacaccaatagcttcgctgctgaaacattacgtgctttacgtacagtgcaagcctatgcacgtgaacattacgaacgtacacgcttcgaccgcacactggaaacgagtttgcaggccgcgcgacaacgcattcacatccaaacatgggtcaccgctgcaagcatcgtgttgatattcagtgcaatcgtcggagtgttatgggcaggtgcacatgatgtcattgctggccgtatgagcgcgggcacactcggtgaatttgtcctatacgcactgatcggcggtggttccatcggcgcccttgccgaagtgtggaacgaactacaacgtgccgctggtggcatgggccggattttcgaattactcaaagagaaaaacacgctcagcgtaccagccacacctaccttgccaccccatccattgcggggagaaatccgctttgaacgtgtcggcttccactacccacaacgcccagaaacacctgcacttgatggcattgacctgcatatacgcccgggggaaaccatcgcttttgtcggcccatccggtgctggcaaaagcaccctgctatcactattactacgcttctatgatcccacccatggacgcatcctgattgatggtgtggacctacgccaaaccgatccgaaagtattacggacacacattgcactggtacaacaacaaccaacactgttcaccgcgagcgcaatggaaaatatccgctatggacgactggacgccaccactgccgaaatcgagatcgccgcacgctcttccgaagcagatggtttcatccgcgccctgccacagggttatgccaccgagctaggcgagcacggcctgtccctgtccggcggccagcagcaacgtatcgcaatcgctcgcgcactcctcaaggaggcgccgattctactcctggatgaagcgaccaacgcacttgatgcacaaaacgagcaagcagtacaacaggcactggaacgactgatgacagggcgcaccacattgatcattgcacaccgcttggtcaccatcttgaaagctgaccggatcgtggtgatggaccaaggccggatcgtcgctcaaggcacccacagcgaactcatcgccgctggaggcctatacgcaaagctggcacgcctacaattcatagaataaacaagtgatcgg

SEQ ID NO: 32965 - DNA, 1533 bp, Xylella fastidiosa
ctcaacccttccgaaataagcgaattgattaagactcgcatcgaacaggtcaaactatccgcagaatcccgtaacgaaggcaccgtgaccagcgtttccgatggcattgtgcgcatttttggcttagcagatgcgatgcaaggagaaatgatcgaattgcctaacaaaacctatgcactagcactgaatttggagcgtgattcagttggtgccgtggtactgggtgattacgaacatttacgtgaaggagacgtcgctaaaacaaccggacgcatccttgaagtgccggttggcaaatccctgttgggccgcgttgtcaatgctttaggtgaaccaatcgatggcaaaggtgcactaggacccactcaaactgcaccagtggagcgcgttgctcctggtgtcatctggcgtaaatcagtcgatcaaccagtacagaccggttataagtcagttgatgcgatgatccctatcggccgcggccaacgcgaactcatcatcggagaccgccaaactggcaaaaccgcaatggcaatcgatacagtgatcagccagaaacacaccggtatcaaatgcgtttatgtagcgataggccaaaaagcttctactatcgccaatatcgttcgaaaactcgaagagaatgatgcgctggaccacactatcgtcgtagccgcaaccgcatctgaatcagccgcacttcagtacatcagtgcctacgctggctgcaccatgggcgaatacttcatggaccgtggcgaggacgcactcatcatctatgacgatttgtcgaaacaagccgttgcctatcgccaaatctcgctactcttaaaacgtccccctggccgagaagcttacccgggcgacgtattctacctgcactcgcgtctgctggagcgtgccgctcgtgtgtctgaagaatatgtcgaaaaattcacccaaggtgaggtgaaaggaaaaacaggatccttaactgcattaccaatcatcgaaacacaagctggcgacgtgtccgcctttgtaccaaccaacgtaatttcaattactgatggccagatcttcctggaaactgatcttttcaatgctggtatacgtccagctgtcaacgccggcatctccgtatcgcgcgtcggtggctcggcacagactaaaattatcaagaaactgtcagggggcatccgcatctcactggcacaataccgtgagctggcagcattcgcgcagtttgcatctgacctagatgaaacaacccgcaagcaactcgagcgcggccaacgtgtcactgaactgatgaagcagaaacagtacacctcaatgtccgtcgccaaccaagcgttatcaatctacgcagtcaacgaaggctaccttgacgacataccagtgcacaaagtactcaccttcgaagaaggcctacacgcccatttttccaacactcaaggcgcgctgatcgacaagatcaataactccggcgactgggacaacaacattgaagctgctttcaagcagcacattgaagaatttaagaccacgggcagctgg

SEQ ID NO: 32966 - DNA, 861 bp, Xylella fastidiosa
atggcaagcggacgcgaaatcaaaagcaagatcaaaagtgtgcagaacactcgtaaagtgacacgcgcattagagatggtctcggcctcaaaaatccgcaaagcacaggagcaaatgaaaatctcgcgcccgtatgcgcaggcaatgaaacaaatgattggccatttagctcaggcaaatactgattacctgcatccatttctgatcacacacaagcaagttaagcgaataggctatatcgtgatctcatctgaccgtggcttggctggtggtctcaacaacaatctgttccgcaagatgcttggcgaaatgcaccagtggcaagataatggggccgaagtcgacatcgtcacgattggtcagaaagcatccgtattctttcgcaggattaaagtcaacatactcggcagcgtgactcacctaggagacacaccacgcctagaacagctcattggtgtcatcaaagttatgcttgatgcatatactgaagaaaagcttgatcgcgtctatttggtctataaccatttcatcagcacaatggttcagaaagcgagcttcgaccaacttctgccactgctagcagctaaagacaaggtcgcgccccatgattgggattacttatacgaacccgatgccgcaacagtgcttgagcacgtgatgacacgctacatagaatcgcttgtataccaagcgatgctagaaaacatagcatctgagcatgcagcgcgtatggtagcaatgaaggctgctagcgacaacgcaaacaagctgattggcacactacaactggtctacaacaaagcacgtcaggcagcgatcacccaagaaatttcagaaatcgtcggcggtgccgccgcagtc

SEQ ID NO: 32967 - DNA, 1392 bp, Xylella fastidiosa
atgaatcagggtaagatcgttcagatcatcggcgcaattgtcgacgtcgaattcccacgaaacaatgtccccaaagtatataacgcgctgaagatcgacggcacagccatcatcttggaagtgcagcaacagcttggcgatggcattgtacgcaccatagcacttggctccacagacggcttaaaacgcaacctcattgccaccgacaccggccatgcaatcacagttcccgtaggcactggcacattaggtcgcatcatggatgtactaggcaacccaatcgacgaagcaggtccgatcacttatacagatcaatgggaaatccatcgaaacgctccttcctatgaagatcaagcctcaaccaccgaactgctggagaccggaatcaaggtcatcgaccttatgtgtccatttgctaaaggcggcaaagtcggattattcggtggtgccggtgtcggcaaaactgtcaacatgatggaattgatcaataacatcgccaaggcacatagtgggctgtccgtattcgcgggtgttggcgagcgaacccgcgaaggtaacgacttctatcacgagatgaaagactccaacgttctcgacaaggtagcaatggtatatgggcagatgaacgaaccaccgggtaaccgtctgcgcgttgcgctcaccggtctcaccatggccgagtacttccgcgatgagaaagacagtagcggcaaaggcaaagatgtacttctattcatcgacaatatctaccgctacaccttagctggcacggaagtatccgccctactcggtcgcatgccctcagcagtaggctaccaaccaacccttgccgaggaaatgggcgtactacaagagcgtatcacctcaaccgcaaatggctcgatcacctcgatccaagcagtgtacgtacccgccgatgatctgactgacccatcacctgcgacgacctttggacatctggactccacagtgacactatcccgctcgatcgccgcattaggcatttacccagcagtggatccactggattcgagcagtcgccagatggatccgctgatcatcggcgaagaacactacaataccacccaacgtgtccaacaaactctgcaaaaatataaagatctgaaggacatcattgcaatcttaggcatggatgaactttccgaggacgacaaactatccgtgtcacgtgcacgcaaaattgaacgatttttcagtcaaccattccatgtcgcagaagtattcactggtgccccaggtaaatacgtcccattaaaagacacaatccgtggtttcaaagcaatcgtagacggcgaatatgaccatcttcccgaacaagccttctatatggtcggtaacattgaagaagtcatcgaaaaagccaacaaaatg

SEQ ID NO: 32968 - DNA, 1029 bp, Xylella fastidiosa
ggcttcgctgctctatcggctactggcccgcttgaacggttcgctttcggacggagagctcccagaccggatgacgtcgtcattgatatcctttactgcggtgtctgccacactgatctgcatcttgcccgtaaccacagcggctttactacttatccaatcgtgcccggccacgagatcatcggttgtgtacgcgagatcggcaagacagtcacccgctttaagcggggcgatctggttggtgttggttgcatggtcgattcttgccagcactgccagccttgtctcaaagggtgggaacaggactgcattgaaggttcgatcttcacctataacagtactgatcggcgggatggcagtatcacctatggtggctattcagatgtcattgtcgtgcgtgataagttcgtgctgtcgttgcctgatggtctcgatccagccggagccgcgccgctgctttgtgcgggcatcacgacatggtcgccgttgcgtcgctggaatgtcggcaaagacagcaaggttgcggtggtcggtcttggcggcctcggacacatggccttgaagctggctaaggctcttggagccgatgtgacgttgttcacgcgttcttccggcaaagagggagatgccttccgtcttggagccgatcgtgttgtgttgtccagcgatctggagcagatgaaagctgtctacagccgctttgacgttatcatcgataccgttccttatgatcacgacgtcaatccctatatgcccacccttgtacttgaaggtgtgctcgtactcgtcggctatttgggaccgctcagtatgcctgtgaacgctggaggtgtggtacgtggccgtagggccatttcgggttcgttcattggcggtgcgcatgaaacccagcaaatgctcgatttctgtgggcagcacggcattgtctcggatgtcgagatcattcccatccagaaaattaacgaggcctatgagcgtatgttgaaaagtgacgttaagtatcgtttcgtcattgacatgacttcgctg

SEQ ID NO: 32969 - DNA, 1095 bp, Xylella fastidiosa
atgagagatgaagagggcattggtccttgctacgtctaccatttgccgacagtgcgcgaacgtgcgcggcaattgaatgcagtagctgccgtggatcagtgctactacgccatcaaggccaacccgcatccggctattctccgtaccctgattgaagaaggctttggactagagtgcgtgtcattgggtgaattgcgtcacgcatttgaagtagtgccacacttggttccgtcgcgtgtgttattcacaccaagtttcgcctcacgtgtggagtacgagcaggcattcttactaggtgtcaatgtgaccttggacaatgtcgaggccttgcgcttatggccggaggtattccgtgaacggacgttatggttacgtatcgatttgggttacggcgatggacatcacgagaaggtcaccaccggtggtaagacatctaaatttggcctttcggtcaagcggattgatgaatttatagatgttgccaagacactgaacataaccgtgaccggcctgcatgcccatcttgggagtggcgtggagagaggcaaccattggtctcgcatgtacgatgagttggctggttttgcctcccgcatcgggagtgtgtctaccctggatatcggcggcggcttaccgatcccgtaccggcctgatgatgaaccatttgacgtgggggcgtggggagccagtttggctgaagtcaaagccttgcatcccaaatttcaattggtgattgagccgggccgcttccttgtagccgaagcgggcgtgctcttgaccagggtcacccaagtgattgaaaaagatgacatccttcgggttggtctggaggctggcatgcataccctgattcgtccggccctttacgatgcctggcacggcgtggagaacctcagccgcttggatgagacaccccatgtactgtgcgatgtcgtgggtcctatttgcgagtcatccgacgtgtttggccgtcgccgtcaccttccagccgccaccgcctccggtgatttaatgttgattgcagatgctggcgcctatggtttctcgatggccagcacttacaatctgcgcggcctgccggccgaggtcgtgctt

SEQ ID NO: 32970 - DNA, 1353 bp, Xylella fastidiosa
atcgttctaaaatttggtggtacttccgtatcgcgtcgtcatcgctgggacaccattgcgatggtggtgaggaagcgccttgaagagcatggaacacgtgtgctgatcgtggtttcggcgctgtctggcgtgaccaatgaactgacggcgattgctcaaggtgtcgtggacagtgccaagcgcgtcactgcattggagcagcgtcatcgcgattttttggttgagcttgggttagatgtgcaagctgtgctcggcacgcgtttcgccatgttgtcggatcttctgcaagatgcgcgtgcggtgacgcggtcactggattggcaggctgagttgttagggcaaggtgaactgttgtcttccacactcggtgcggcctacctgggtgcttcgggtattgatatcggttggatggatgcgcgtgactggctgaccgctttaccaccacagcccaaccagagtgaatggtcgcaacgtctttctgtctcctgtcaatggaagtctgatgtggagtggcgtacacgtttcgatgcccaacgtgctcaggtattgatcactcaagggtttatctcacgtcatcaagatggtggtaccgccatcctgggacgtggtggttcggacacgtcagcagcatattttggtgcgctacttggtgcggcgtgtgttgagatctggactgatgtaccagggatgttcagtgcgaacccgaaggaggtccctgatgcgcgtttgctgacgcgcctggattactacgaggcacaggagatcgccacaactggcgcgaaggtgttgcatccgcgttcgatcaaaccatgccgtgatactggcgtgccgatgctgattctagatactgagcggcccgatgtattggggactcgtattgatgctgaagttgagccggtgcttggggtcaaggcgattagccgtcgtgatggcattgtattagtgtcgatggaagggatcggcatgtggcagcaggtgggttttcttgctgacgtatttacattgttcaagaaacacggattgtcggtggacctcatcggatcggcagaaaccaatgtcactgtgtccttggacccctccgagaacctggttaacaccgacgtactgactgcattgtcaaccgatttatcacagatctgcaaagtcaaaattattgtgccttgcgctgcgatcactttggtcgggcgtggtatgcgttccctgctgcataaactctctgaggtatgggctacgttcggtaaagaacgtgtccacatgatctcgcagtcttccaatgatcttaatctcacctttgtgattgatgagactgatgcggacggattattggcggtgctgcatttcaaattgatcgaa

SEQ ID NO: 32971 - DNA, 3225 bp, Xylella fastidiosa
atgccaaagcgtactgaccttcgtaccatacttatcatcggtgctggcccgattgttatcggtcaggcttgtgagtttgactattctggtgcccaagcctgtaaggcgttgcgtgcggaaggcttccgtgtcgtcttggtgaacagtaacccggcgacgattatgaccgatcctgatatggccgacgctgtgtatatcgaaccgattcactggcggacggttgagaagatcatcaccaaagagaagccagatgcgctgttgccaacgatgggtggtcagacggctttgaactgcgccttggacttggcggatcacggtgtgctggagaaatatggtgtcgagttgatcggggccaagcgcgaggcgatccgtatggctgaggatcgtgagttgtttcgtgtggcgatgcaggagatcggcttggagtgtccgaaggccgaagtggctaaaagtttggagcgagctttggagatccaggccaaagtcggttttccgacgatcatccgaccgagcttcaccttgggcggtaccggaggggggattgcttacaatcgccaggagttcgaggaaattatcaagcgcggtcttgagctttccccagtacatgaggtgctggtggaggagtccgtcctaggctggaaagagtttgagatggaggtggttcgtgacgcctcggacaattgcatcattgtctgttcaatcgagaatttggatccgatgggggtacataccggggattcgatcacggttgctccggcgcagacattgagtgataaggagtatcagcgtttgcgtgatgcttcgattgcggtactacgtaagatcggtgtggatactggtggttcgaatgtacagtttggtattgatccacagaccggccgtgtggtggtgattgagatgaatccgcgcgtgtcgcgttcctcagcgttggcttccaaagcgactggtttcccaatcgctaagattgcggcaaaactggcggtgggctacacccttgatgagcttaagaacgagattaccggcggtaaaacgcctgcttcgtttgagccatccattgattacgtggtgactaaaatcccgcgttttgctttcgagaagtttccgcaagcggatgcacgtctgactacgcagatgaaatctgtgggtgaggtgatggcaatggggcggacctttgcagagtcgttgcagaaggcggtgcgtgggctggagactggcaaggttggcttggagccgactggtttggatttgagcagcgaagatgatttggttgtcctcaagcgtgagttgaaagcaccgggggctgagcggctattttatgtagccgatgcatttcgtgctgggttcgcagtcgctgatgtttacgcgttgtcttatatcgatccatggtttttggatcagattgaggagattgttgctgctgagggccgactggttaccgatggtcttggttcgatagatggggcacgtttacgtcagctcaagcgtataggtttctctgatgcgcgtatcgcgcagttaaccggcacgaatgaggttgcggtgcggacgttgcgccgtgtgctcaaggttaagccggtatataagcgtgtcgattcttgcgctggtgagtttgccactggcactgcttacctgtattcaacatatgaggaagagtgtgaggctgcgccgagtgatcgccgcaaaattatgatcttggggggggggccgaatcgcattggccaaggcattgagtttgattactgttgcgtccatgccgccttggcgttacgtgaggatgggtttgaaaccatcatggttaactgtaatccggagacggtatctacggattacgatacctctgaccgcctttactttgagccattgacgttagaggacgtgttagaaatcgttgaggtcgaacaccctgttggagtgatcgtacagtacggtggacagactcctctgaagctggctaaagcgttggaagccaacggtgtgcctgtgatcggcacctctccggaatcgattgacttggccgaggaccgtgaacgcttccagaggttggttcagcaacttggtttgaggcagccgccaaactgtacggcgcgtaccgctgacgaggcattggtattggcccgtgagattggttatcccctggtggtccgtccgagttatgtgcttggtggccgtgcgatggagattgtctacagtgaggccgatttggcgcgttatgtgcgtgatgcggtgaaggtatccaacgattcgccagtgttgcttgatcgtttccttgacaatgcggttgaggtcgatgtggacatcattgctgatccggagggtcaggtactgatcggtggagtgatggagcacattgaggaggctggtgtccactcaggtgactcctcatgttccttgccgccctattcgttatcggtcgcgactcaggacgatttacggcgccaagtcatcaggttggcgcaggcattgaacgtcattggtttgatgaacacacagtttgcgatccaatccaatgatgatggtagtgacatcgtctatttgctggaagtcaatccacgtgcttcgcgcaccgtgccgttcgtctctaaagcgacgggggtgccgcttgccaagattgccgcgcgttgtatgactggcaagacattggccgagcaaagtgtgacttgtgaggttgtacctgcatattatgcggtgaaggaagcgatctttccgtttgctaaactacagggcgtggacccgattctcggtccggaaatgcgttctacaggtgaagtgatgggggtgggccgtagttttgccgcggcgttcgcccgcgcgcaggaagccggcgatatccgtgccccgcaaccaggcagggcgtttgtttcggtgcgtgatcctgataaaaagcgtgtgttgccagttgtcttggccttggtggagcgcggcttcggtgtggttgctactgctggtacttatgcttggttgcagcagaatggagtggcctgtgaggttgtgaataaagtggccgaagggcgtccgcacattgtcgacttgattaagaacggcgagattgtttacatcatcaatactacggaaggacgtgcggcgattgccgactctttctcaatccgtcgggaggcactgcaacattgtgtgacctactcgactactattgctggcgctaaggcgttggtgaattcactcgagttccgcggtaccggcccggtttggtcgctacaggaactccac

SEQ ID NO: 32972 - DNA, 1113 bp, Xylella fastidiosa
gtgacagaacccgcaatcctagttctcgaagacggtaccgtattcgagggcgatgctgtaggcgctaatgggctttccgttggtgaggtggtatttaacacagccctcactggttatcaggagatcctgaccgatccttcgtatgcgtatcaattggtcaccctgacttatccgcatattggcaatacgggttgtaccgatcaggatgatgaggcgaataaggtatgggcggctgggctgattgtgcgggatgtgccgcgtcgtccaagcaattggcgcagtcagatttcgttgtcagattggttggccgcacgcggtgtggttgctattgctgggatcgatacgcgcaaactgacccgtattcttcgtgagaaaggcgctcagcatggtgcgttgatggctggtgagattgatgttggcaaggctcaggatgcggcttgtcaatttgcaggtatcaaaggtatggatttagccaaagtggtcagtaccaaacaggggtactcttggtacgaaggccagcttgacttggatcgtaacgaatgcaagcgcgccgcgccgcaatataaggttgtggcctatgattacggtgtgaagctgaatattctacggatgttggcggagcgtggttgtgatcttacagtggtgcctgcgcagactccggctgacgaggtgttggcgctctgcccggatggggtgtttctttccaatggcccaggtgatccagagccttgtgattatgccgttgcggcgattaagacgttcatcatgcgacggattccaatcttcggtatttgtttgggtcatcagttgctggcccaggctgttggtgccagggtcgtcaaaatgagccatggtcaccatggtgcgaatcatccggtgcaggacttgcgcagcgggcgggtaatgattacgtcgcagaatcatggctttgctgttgacgaggcaacgttgccaaacaatgtcagggtgacgcatcgttcgttgttcgacgggaccaatcaggggattgagttgcttgatgtgccggcattctcgtttcaagggcatccggaggcttcccctggtccgcacgatgttgatgtgttgtttgacaggttcattacaatgatggcg

SEQ ID NO: 32973 - DNA, 693 bp, Xylella fastidiosa
agacttcttattcatggtgcttccgggcgcatgggccagtcgctgttgcgactggcctcagaagacccttcgtttcaggtgactgctgcggtggtcgggaatgcaccgcatcgccatgtgagcgatggtgtgccattttttgcggccgctgaattggcagctgtgccggcgtttgatgttgcgattgatttcagtttgccacaggggttttcgtcgttgctggcattgtgtgtagcgcgcgctgtgccgctggtctctgggacgactggtcttgattcgaggcagcatgaggctttggtcatggcaggggcgcggattcctctggtgtgggggtccaatttcagtgtgggtatggcggtgttggtgaatttggttgaacgtgccggtgatgcgttgtcaggttgggattgcgacatcgtcgagtcgcatcacgtccacaagcaggatgctccgtctggaagtgcgctgacgttaggtgaggcggttgcctgcaaggggatcgcgccgcgctatacaagcttgcgtgctggcgacattgttggtgaccatctggtgcagtttacgggcttgggtgagcgcattgagttagtacaccgtgccagcaatcgtgatgtttttgcacgtggtgcgttgtgcgtagcccggcgtgtggtggggcgtgtgcctgggtgttatcgggtgcgtgacttgatt

SEQ ID NO: 32974 - DNA, 1623 bp, Xylella fastidiosa
atggctgccaaagaaattattttcagtgaaaaagcccgttcacgtatggtgtacggagtgaacctgcttgctaatgcagtaaaagccaccttaggtcccaaaggccgccacgtggtgcttgataagagcttcggctccccaatcattactaaagacggcgtctctgtcgccaaagagattgagttggccgacaagtttgaaaacatgggcgcacaaatgcttaaagaggttgcgtctaaaacaaatgaccatgcaggcgacggcaccaccactgcaacggtactagcccaggcgttgatccgtgaaggatgcaaagcagtggccgctggtatgaatccaatggatcttaagcgtggtatcgataaagcagtcattgctgcggttaccgaactgaagaagatctccaagccaaccagcgacgataaagcaattgcccaagtcgcaaccatctctgctaactcagacgagtctatcggcaacattattgccgaagcaatgaagaaggtcggtaaagaaggagtgattaccattgaggaaggcacaactctagaaaacgaattggatgtcgtcgaagggatgcagtttgaccgtggttactcttcgccatatttcatcaacaaccagcagtcccaaattgttgagctggataatccctacatcctccttcacgacaagaaaatttccagtgtgcgcgatttactcaccgtgcttgacgccgtcgccaaagaaagcaagccgttgctgatcgtcgctgaggaagtcgaaggcgaagctttggcaactctggtcgttaacaacatccgcggcatcatcaaagtctgcgcagtcaaagcacctggcttcggtgatcgtcgcaaagccatgctggaagatatggctgtgctgacaggcggcaccgtcatctcggaagaagtaggtctgtctctggaaaaggccacgaccagccaccttggcaaggccaagaaagtacgcgtgtctaaagaaaacaccaccattattgatggtataggtgacaacgatgcgatcaatggtcgcgtcaagcaaatcaagacccagattgaggaaaccacctcggactacgaccgcgaaaaactgcaggaacgtgtagccaagctcgccggtggtgtagccgtcatcaaggtcggtgctgcaaccgaagtggaaatgaaggaaaagaaagcacgtgttgatgatgctttacttgcaacccgtgcagccgttgaagaaggagtgattccaggtggcggcgtggcactgatacgtgcaatcacggcaatcagcaatctgaagggtgccaatgaagatcagacacacggcattcaaatcgcattgcgcgctatggaggcaccattacgcgaaattgttgccaacgccggtgaagagccatcggtcatcttaaataaggtgaaagaaggcaaggacaattttggctacaacgccgctactggcgaattcggcgatatggtcaaacttggcatcctggacccaaccaaggtcgcccgtacagcactccagaacgctgcttcaatcgctggcctgatgatcaccacagaagcaatggtcgccgaggctccgaagaaagacgagccaaccccacctgctgctggtggcggcatgggtggt

SEQ ID NO: 32975 - DNA, 810 bp, Xylella fastidiosa
tttgctgtgtttggtcatcctattgctcactcgctatcaccgcgcatccataccgagtttggccgtcagatgggtgtcgtgctggactatcttgcatttgatgttgcgccagatgcgtttcgtgtttcgctggagcattttgttgccgagggtggatgtggtgcaaacgtgactttgcctcttaaggaggctgcatttgaggtgtgcacaactttaagtacacgtgcacgccgtgccggtgcggtcaatacgctatctcgcgttgacggtgtttggcatggtgagaataccgatgggacaggtttagtacgtaacttgacggagcggcatggtttggatttgcgtggtcgccgcgctttgctgcttggcgctggtggcgctgcacgtggtgtggctcctgcattgctagatgccggcattactgagatggtcatcgttaaccgctcccctgagcgtgccgatatgctgtgcgatgcacttggtgaacctggcagagtcagtgcacgctactggggtgacttgggtgatcttggaaattttgagttaatcgttaacgcgacttcgatcggaaacacatccgatatgcgcactttctctctgccgcgttcgttgttggacagtatgactgcggcggtagacctgaattacggtagtgcagcagtccccttcctggcctgggcgcatgcggttgagacccgctatgcgatcgacgggttaggtatgttggttgagcaagcggctgaaagtttctctctctggcacggtcggcgcccggatactgatccagtgtatacggtattacattcagag

SEQ ID NO: 32976 - DNA, 1248 bp, Xylella fastidiosa
tggttacggattccgttctggcaacgcgtggtcgcgggttttgtactcggggctctagttggttgggtgatgggaccggccgccaaaacttggtttggaccattgggcacactgtatgtcacgttgatcaagatgatcgcaataccgctggtgttcttcgcggtgattaacgcgattgcggcgctgcacggacaacgatcggtcgccatgttgggcggacgcacgtttctgtggtttatcgtcaccgcagccttggcggtgtgtgtgggattgggtgtgggcacgttgctgaaacccggtaatggtgacttcactgtgagtgtggatgcggcatgggcgccaccagatgtaccgagtccggtgcatgtgttgctggatgtggtgccatccaatccgttttatgcattgaccggcatcgggactcgcagtaataacacgggggaaacgacgttagcggccggacgtggctcaattcttccagtaatctttttcgcggcgctgttgggcttggccattgtcaagcttggggaacgcgtgacggaggtacgcaagctgatcgggcagatgagcgagatcatgatccaaatcactcgctttgtgctggagatgacaccactggggacctttggattaatcgctgcgttggtcgggagctatggttttcagaagttgctgcctttcggtcactttgtattggcactttatttggcatgtgcgttacacattgtggtggtgtacagcgggcttctgctggcacatggtttgagtccattgaagtttttcaggggtgtcgcgccagggatgcaggtcgcttttgtgagttcttccagctttgctgcgatgccagtggcgttacgcgcgattacgcacaatctgggggttaacaaggactacgctgcatttgctgtgccgctgggtagtagcatcaagatggacggttgcggggcgatctttccagcgttgtgtgcggtgttcatcgctcagtacaccggggtgccgctgaccgcgaatcaatatttcgtcatttttatcgcatcggtactcggcagttttggcacggccggggtgccaggtacggcggtggtgatggcaaccgtagtgctgagtgcagctcatttgccgctggaggtaattggttatctgtatgccattgatcgcgtgttagacatgatgcgcacaatgacaaacgtcaccggacagatgttggtgccggtgctggtggcaaaagaaacgggattactgaataca

SEQ ID NO: 32977 - DNA, 873 bp, Xylella fastidiosa
atcccagtgagcaaagcgctgttcacgcgctggtgccaacgcaccgacagctacttagaacgaacgttatccatccccacccaagcgccacagcgactccacgccgcgatgcgatacaccgtactgagtggcggcaaacgcatccgtcccttacttgtttacgctgccggccacctgtttcatgtcgatgaacccctactcgacgtaccggctgcggccgtggaactgatccatgcctattccctggtgcatgatgaccttcccgccatggatgacgacctcttacgccgagggcgtcccaccgtccatatcgccttcgacgaagccactgcaatcctcactggcgacgccttgcagaccttggcgtttgaatgcttagccgatgccccagccgacacctccctgcgtatcgcctggttacagacattgacacacgccgcaggagttgccggcatgtgtggcggccaggcactagatattgacgccactggccaatcccagacactcaaagcactggaagtcatgcatgcgttgaagagcggcacattgatgcgagccgccgtgagaatgggtgccctggctggcgacccttccgcggaggatctgcactccctggacacctttgcggccacccttggattagcattccaagtgcgtgacgacatcctggatatcgagtctagttccgaacaacttggtaaaaccgccggcaaagatgccatacagcagaaatccaccttccccgccctgctgagcgtagaaggtgccaaatgctatttacaagaattggcagaacgcctgtacacccaattgcatccttacggcgaacgtgcagcccccctgaccgcactggcacgcttggctgtagaacgt

SEQ ID NO: 32978 - DNA, 915 bp, Xylella fastidiosa
ttcgctttcgtttttccaggtcagggttctcagtctcttggcatgctttccgagtttgctgtgctctatccggagattgtcgatactttcgctgaggcatctgagggagctggtgtggatctttggacgttgtcgcaacgtggccctgaggagatgttgaaccgtactgagtacactcagccagcgttgttggccgccagtgtggcgctatggcggctttggcaggctcgcggtggccgtgcaccggatctgcttgctggtcacagtttgggggagtacagcgctttggtagtggctggtgcattgtcattgaaggatggtgcttatttggtaaggttgcgcggtcagttaatgcaggatgcggttgctgtgggtgtcggtgcgatggccgcggtcctgggtgctgaggatgctttggtggctgaggtctgtgcgcaggttgcgggaagcgaaattgtcgtcccagccaattttaattcgccggggcaggtggtgattggtggtcatgccacggcggttgatcgtgtgctggtgttgttggcagaacgtggtgtgtctaaaacagtcaagttggcagtgagtgtgccgtcgcatacgccactaatgcgtgatgttgcgcatcgtctcgctgaggcgatgcttgggttggtttggaaggtgccgcagattccggtagtgcagaatgttgatggcagagtgcatgacggtgttgaagcgatccgtgaggctctggtcaagcagctttatctgccagttcagtggacggattgtgtgagagagttggctacgtgtggtgtggtacatatcgctgagtgtggtcctggtaaggtgctgatgggactcattaggcgtatcgataaaacattggatgtgcgttcgttggcgactccaacggggttctctgatgtcttggac

SEQ ID NO: 32979 - DNA, 726 bp, Xylella fastidiosa
ttacagggtgaggttgcgttagtgactggtgctagccgtggcatcggtgctgcagtggctgatattttggctgatcatggggctaccgtgattggtacggcaacgtctgcttctggtgcgcagttaattggtgatcgtttggccttgctgggtggtcatggtcgcgctctggatgtgaccgatactgctgcagttggtgcattggtagaggagattgctgaacaattcggttcggtctcgattctggttaataatgctggtataacacgagacaatctgttgatgcggatgaaggatgaggattgggagtccattgtcgacactaatctgagcagtatttttcgtaccagcagggcggtggttcgcgacatgatgaaggcgcgcaagggccgtatcatcaacattgcttcggttgttggcgtgactggtaatgccggtcaggcaaactatgctgcggccaaagctggtgttattggatttaccaagtcactggctaaggaagttggcccacgtgggatcactgtcaacgtggtcgctccggggtttatcgataccgacatgactcgtgtgctgtctgagggtctacgcaatgatatccttaaccacgtcccgcttggtcatttaggtgatccggtggatattgcgcacgcggtcgcttttctggctgctccagcagcacgctacattactggtgagacattacatgtcaacggtggtatgtatatg

SEQ ID NO: 32980 - DNA, 219 bp, Xylella fastidiosa
atgagtgacatcgaagcgcgcgtcagaaaaattgtcgccgagaaactcaatgtcgatgaagaaaaagtaactaatacctcgacgttcgtcgatgaactgggtgcggattcgttggataccgtcgagttggtgatggccttggaagacgagttccaatgtgagatcggtgacgaggctgctgagaagatgacttcggtgcaacatgctatcgactacatt

SEQ ID NO: 32981 - DNA, 1227 bp, Xylella fastidiosa
cgtcgggttgtcgttactgggatggggatggtgtcgccattgggcaatgatttgaccacaagttgggatggcatcgttcacggacgttcgggtgtcgctcccatcgtccagattgatgcttctaagttctccactcagattgctggcgaaatcaagggattcgatccaatgaagttcgtatccgcaaaggatgcgaagaaaatggattcgttcatttactatggtataggcgcagcatttatggcgctggatgatgctggtttggagattaatgagatcaatgctgagcgtgttggtgccttgattggttctggtattggtggcgtgtttggcattgaagagcagaccatcaagctctatgaggggggcgcacgcaagatatctcctttctatgtgccagcgacgatcatcaacatgctcccaggacagttgagtattttgaaaggcttgaaaggcccgacgttctctgcggtatctgcctgcgcgacttcaaaccactccattggtatggcaatgcgtatgatccagtatggtgatgctgatgtcatgttggctggtggttctgagcgcgcttcttcgccaactgcgattggtggcttttgtgcgatgagggcgatgtctacgcgtaacgatgatccaaccggcgcttcgcggccgtgggacaaggggcgcgatggctttgtgcttggtgatggtgccggcattctagtgctggaagagtatgagtatgctaaagcgcgaggcgcacgcatctatgctgaattggctggtttcggcgccacttccgatgccttccacatgacgatgccggtcgaggatggtgaaggtgcagcgcgttgtatgcgtatagcgttgcaggatgcgaaggtcactccggagcaaattgatcatctcaatgcacacggtacctcaactcctttgggcgatctgtgcgaaaccaacgcgatcaagacggtattaggagatcatgcctacaaagtgatggttagctcgaccaaatcaatgaccggacatctactcggtgcggccggtggtgtggaagcaattttctcagtgatggcgttgcatactggcatcgttccgccgacgattaatctcgaagaaccagacgaaggctgtgatcttgattacgtgccgcatgtggcgcgtgaggccaaactggatgtggtggtttcaaacggttttggttttggtggtactaacggcacattagtgttcaagcgtata

SEQ ID NO: 32982 - DNA, 1542 bp, Xylella fastidiosa
ctgtcctcatccgatctttccgagccggtatctgtgaaaacgctatggggcgaggtgcaacgtcccagcctacctacccacgtgtgtacggtattgcctgcgcgcctgactcctaaacatggctccattgacgcacttgatgccaatccaaaggtttccaagcctgataccaagcgtttacaggatgccattgatgattgtcccgccggtagcgcggtcaaactagtgatcgacagtcatcgcaaatccggctttttgagtgggccgttgcacttgaaatctggggtgacgttgtggattgacgatggtgtcacgctgtttgcatcgcgcaaccccaaggattacgacaaaggcaatggtacgtgcggtactgcaacgtcaactcatgagttcagttgtatgcctttgatctccgcgatcaacaccaccggtagcggtatcgtgggtgggggtgtgattgatgggcgtggcggtagcattttgactggcggtaagtatgctcggcagcgtacctggtgggacctggcctatcagaacaagcgccatgcactgcatcaacaggtaccacggttgatccaaatcaggggcggtaacgacttcacgttgtaccgtgttgccatcgaaaatgcacctaacttccatgtggttgctgatacggtcagcggtgtcaccgcatggggcatccgcatcctgaccccaagcttggtctataccacgccggggtaccactgtccgcccggtaccacgccggatgttgtgacgccggcgacatgctttacccccgacacggtcaagaacaccgatggctttgatcctgggcaatcaaaccacgtgctgctagcgtactcctacatcagcactggggatgaccacgttgccatcaaagcgcggggcaagatgccaagctacgctctgagcttcttacacaaccactttggctatggacatggcatgtccatcggtagcgacaccgagtcaggtgtacacgatatggaagtcagtgatttgagtatcgacggctttgacagccctaacagcaatggcttgcatatgaaatctgatgccgatcatggcggagtggtcgaccatgtcacctactccaaaatatgcatgcgtcgtctgaaacgtccgctggcgtttgacaccttctacaaaccttccaacgggaattcttatccactcttcaaaaatattgtgttgcaagatattcatgtgcttgaaagccctgtctttggtgctggtcagctgcttttcatggggatcctgggcagtgggaataatctgccaatgacgctgagcatggataacgtcgtattcgacggttttttgccaacattgatagcgcctcccagcagtatcgtattcgccaatccgcaggcagcgcattttcacttcggtcccggtccggtcagtttcgctcctttgattaccccctctgttgcttacgatgtgactgtgagtggaagtccaggtgtgggcaacccatacgattgttcggcggcatttatcaatttttccagcatatttcctgattcgcctatc

SEQ ID NO: 32983 - DNA, 720 bp, Xylella fastidiosa
tctccaagattccgtgcactagtgactggcggaagtggtaatttgggtactgccatttgccgtcaattaatcgcagatggtgcgcatgtcatcgtccatgcaaaccaccatcggtctcgtgctgataccctagtggaatgcttatgtgccgaaggggggagcgctgaggtaattgttttcgacgtcaccgccgcacaagccagcaaaacggcactggaaaacctgttacaggctggcccaatccagatcataattaataatgcaggcatccacgacgacgcaccgatggctggcatgtcatctacacaatggcatcgtgtcattgatgtctctctgcacggctttttcaacgtaactcaaccgttgctgctgcctatggcacgcacccgttggggacgtattgtatgcatatcatctgttacggcagttttaggaaaccgcggacagagtaactacgcagcagccaaagcagggttacacggtgcagcacgctcattggcccgtgagatggctaatcgtggcatcaccgttaacgtcgtagcaccaggtgtgattgaaagtgagatggtggggaaaacgtttactccggaaatgatcaagcaattgataccaaccggtcgtcccggtcgtcccgaggaagtggctgctctgatcggatttctatgctcagagaaagcaggttatatcaacggtcaagtcatcggcatcaatggtggaatg

SEQ ID NO: 32984 - DNA, 387 bp, Xylella fastidiosa
atgagtgatatccctggcgacctcaagttcctcaaatcccacgaatgggtccggatcgaagacaacaatcgtgccatcgttggcgtttccgaccatgcacaaaatctgctcggtgatctggtgtatgtcgaattacccaatattggcgatcacctggacgctggcgccaccgctgcagtcattgagtcggtcaaggcagcctcagatatctacagtccagtcaccggcaaagtgattgaagtcaatactacgttaagcgacaaacctgagacgatcaatgaagacccctacggtgaaggctggattatggtcattgagatgcaggcccccgaggagatcagtaatctactttctcccgatgattacaccgaagtgctggaaagtgac

SEQ ID NO: 32985 - DNA, 1365 bp, Xylella fastidiosa
cgacaacgcgatttgcgcgtcctgtggcatccgtgcacgcaaatgcgtgagcatcccgacacactgccattagtgcccatcgtccgtggtgagggtgtgtggttggtcggtcacgatgggcgtcgttacctggatgctgtcagcagttggtggacaaatcttttcggtcatgcagatccccgtatcagtgcagcaatcgccgcacaggccaggacgcttgagcacgtgatgttggctggtttcagccatgagccggcggtgcgtctggccgaggccttgttgcggctcgcgccgcgccaggacgggcgtgagcccttgtcaaaggtgttttacgctgacaatggctcggctggggtggaagtcgcgctgaaaatggctttccattacttccgtaatcgtggtgaagagcaacgtacgcgatttatcgcgttacataacgggtatcacggagaaaccattggtgctctcgcggttggcgatatccccttgtaccggcgtgtttatgctccattgctaacggaggtattgtttgctccctctcctgatgcctatttggccgaaccaggtcaaagcgccgcagaatatgcattacaggccgctgaagcgttggaagcgctgttcaaacgttactcggggcaaatctgcgcgctgattttagagccacttttacaatgtgcaggtggcatgcgcatgcaccatccggtgtacctacatcgtgtgcgggaactatgcgatgcacacggtgccttgctgatttgcgatgagattgctacagggttcggacgcactggcacgctcttcgcttgcgagcaggcttgctccgccatctcaacggatactgatgacaagcagcttggcatcatgccggacttgttgtgtctttccaaggggctgacggggggggtcctacctctggccgcagtgctgacaacgcagcaattgtacgaggaatttctcgatgacagccgcgaacgcgcttttctgcattcacacagctacacaggaaatccactggcttgtattgcagcgctaacgacactcgatatcttcgaaaatgattgcatcatcgaacgcaaccaagtcactgcagcacgtatgacgcaattggctgcgtcactgtccgggcatccgcacgttgctgacgtgcgccagaccgggatggtcgtggcatttgagttaactcgtgacggcaacaagcggacaccattcccgccacaggcacggcttggcttgcacgtttaccgtgctgcgctggcgcgtggagtgatcctgcgtccgcttggcgatgtggtgtattggatgcctccctattgcgtggatgaggagcaactgcatctgcttgctgagaccacgcgtgtggcaatt

SEQ ID NO: 32986 - DNA, 1266 bp, Xylella fastidiosa
atgaacttcgaaactttgggattgttgccttccttacttcgtgctcttagcgagcaaggttacgaaataccgaccccaattcagcagcaggcgattccattggcattagctggccacgatttgcttgctgccgcgcaaacagggacaggtaagacggctgcgttcggcttgcctgtattgcaacgattgatggccgcttcatctaatgttggtgccggtaagccgcgtgctttggtgctgacaccgacccgtgagctggcgactcaggtccacgacagcctacgtggttacgccaagtatcaacgtgtatcaagtgcggtgatttatggtggtgtggggatggggaatcagttggatgtgctgcgccgtggcgtagatttgttgattgcctgcccgggtcgtttgattgatcatattgaacgtcgcagtgtggatttgtcaggcgtcgggattttggtattagatgaggctgatcgcatgcttgacatgggtttcctcccctcaattaaacgtatcctcggcaaactaccgcggcagaatcgccaaactctgctgttctctgcgacatttgctgagccgattaaacagttggcgttagagtttatgtgccgcccacgcgaggtgatggtggcgtcgcataacaccgttgctgagaccattacgcatcgtgtgcatcctgtcgatgttagccgcaagcgtgaattgttgttgtatctgttggctcaagatagcagggagcagacactggtgttcgtgcggaccaagcatggcagtgacaagcttgctacgttcttggagaaatacggaatcaagacagcagcgattcacggtaataagactcagggccagcgtctgcgtgcattaaacagtttcaaagcagggcgagttaccgtgctggtggccactgacattgctgcgcgcggaattgatattgaccaattgccaaaggtgatcaattacgatttgcctatggtggctgaggattatgtgcatcgcatcgggcgtactggacgcaatggtgtgcagggagaggcaatttcattagtcactcaggaggacgctaagttattgcgtcagatcgtgcgtttgcttgatcgtgatatggatattcgcgatgtaccggatttcgaacctcaagtcccgatccgttggggtaacagtgctccgggaaagagtaagcagcctgctggacagcacccaccacgtaagagtcaacatcggcgagcattcggcaaagcatctgtgcatacgacgcctgctttaaaa

SEQ ID NO: 32987 - DNA, 1692 bp, Xylella fastidiosa
atttcagtgaatgggggtgctgcgcgttacgtgcaggttggagatttggtgatcgttgctgcgtttgcacaaatgagtgaggacgaggcagcagttttcagaccgaatttggtatacgtcgatgctgccaatgcgatgactcataccaaccacagtattcctacacaggtcgcatgacacatgcacaatgggttcgatgctttgcagcttcatgccaatcgcttgcggggggtgacaattccagatctgttggctgctgagctaaaaagaccagagcaatatgccagacaagttggtccgttgtatttcaactttgctcggcagaagtatgactgtgtggcgttggaagcactgtttgcattggcgcgaaaccataatgtgactggtgcgttccagcgcatgttttgtggggagcaggtgaatgtgaccgaggggcgtgccgtgctgcatactgcgctgcgtggtgatcttagtggtacttcggtggcggttgctgcttacacggcggcggctaaagtgcgcgagcgaatgtatgcgttgattgccgggctggatgccagtgaggtgaccgatattgttagtgttggcattgggggctcggatcttgggccacgtttagtagttgatgcgttgcgtccgatttcccaaggacgtttccgagtccattttgtctctaatgttgatggtgctgctatgcggcgtactctggatatgttggatccatcacgtacggcaggcattctcatctccaagacctttggtacgcaggagacgttgctcaacggtcgtattttgtacgattggttaggcggcagtgagcgcttatatgcggtcagtgctaatccggaacgggccgctcatgcgttcgacattgtatccacgcaggttttgccaatctgggattgggtgggtggacgctattctttatggtcagcagttggtttcccgattgcgttggcgattggttctcaacgttttgaggagttgctggctggtgcggctgagtttgatgcgtatgccctgagggtgccgttagaagaaaatgttgcggtgttgcatgggttaactgcggtgtggaaccgtaacttccttggttgcgccacgtatgcggtgatggcttatgaccagcgcttggcattgctccctgcctacttgcagcaactggtgatggaaagtttgggtaagcgggtcaagtgcgacggaacgccagtggatagggatactgttccagtttggtggggtggcgtggggactgatgtgcagcatagttttttccaggcgctgcatcaggggacaaatatcgtacctgctgactttatcggtacgatccgcaatgatgatctgtacactgagaatcattttgctttgaatgccaacttgctggctcagattgaagtgttagcgaacggccagcttagcgataatccgcatcgtgtttatccaggagggaatccgagtacgttgattttgcttgatgcattgactccacaggcattggggggattgattgcgatgtatgagcatagtgtgtatgtgcagtcagtgatttggggtattaatgcgtttgatcagtttggtgtggagttgggaaagcatttagccgttcaattactacctgcattaaagggggagagtgttgaagtggcggatccagtaacgcgtgcggtgttgctgcgtttgcgtggttgagtg

SEQ ID NO: 32988 - DNA, 2661 bp, Xylella fastidiosa
actattcgtaagcttgccgagctggtcaacacgccggttgagaaactgctagagcagttggctggggctggtatgaagttcagtggtcccgaccaggtcgtgaccagcactgaaaagatgaagctgctcgggttcttacgccgcacacatggtaagtctgatgtgtcggttgggactgtccgtgaggcaccgaaaaagatcacgcttaatcggcgtcggctacaagaagtgaccgttaatgctggccgcaacaagactacggtaaacgtggaagtgcgccaaaagcgcacttatgtgaagccccccgagagcgaatatcatacgccgacaaaaccatccatagagctggctgatgccgagcgtgttgaaatattgcgtaaactcgaagaatcacgccagcgaaatcttgctgagcagcagcgtttagctgaagttgaccgtcagcgtgttgaggagcaggagcgaaagcgccgtgaagaagaacaagccgagcttgagcgccagaagactgaaagtcgcgtagttgaggagattcttgtcaagacagattccaattcagtcaaaccggtgtctaaaccaatctctgaagagcgcacgcgtgcgttgccacgaacagtccggccaacacctgctgcgcgcccttccgtatcgcgttcggatgaccgtaatagcaatggtggggtgcggcataaggctcgtggttcgcatgtgattgtttcggacgaggatgattctgcacgccgttttgctggtcaaatgcacctgacggctgctgaacgtgctcgccgtggtagcaacacacgaggcaaaggaggtggttctcaccgtggcgctactcatcgaggtaacgagaacagtattcgttctagtggtgctcatggtttcgagcgtcctactgttgcagtggtgcgtgaagtcgctgtcggagacaccatcaccgtagctgatttggctcagaagctcgcgctgaaaagtggtgatatggtgaaggcgttgtttaagatgggcgtgatggtgacaatcacgcagaccattgatcatgacactgcagtactggtaagcgaggaactgggtcacaaggtgactcgtgccagcagcagtgattttgaggatgctttactggcccataccgaggaagtgcatggtgagccggttccgcgtccacctgtggtgacgatcatggggcatgttgaccacggtaaaacttcgttgcttgattacattcgtcgtaccaaaattgcagtgggggaggctggtggcatcactcagcacatcggtgcttaccatgtggagaccccgcgtggagtgatcagctttttggatacgcctggccacgccgccttcacctcaatgcgcgcgcgcggtgccaaaatcacggatattgtggtgctcgtggttgctgccgatgatggtgtgatgccacagaccaaggaggcagtacaacatgctagggcggctggtgtgccgcttattgtagctgtcagtaaaattgataagtctactgctgacccgcagcgtgtaaaaaacgagttgttaaccgagagcgtcgtagccgaggaatttggtggagacacgcagtttgtcgagttgtctgctaaaactggtgttggggttgatgcgttgttggacgcaatttcgattcaagccgaggtgttggagctaaaggctgtgattgaaggtcgtgcgaccggtactgtgatcgagtcttcgctagacaaaggacgtggtccggtagcaacggtattggtgcagcagggacgtctgaaaaagggcgattacttggtatgcggtactcattatggtcgtgtgcgtgctctgttcgatgaagttggtcaccaaccacttgctgcatctccatcaattcctgtacaggtgctgggattgtctggcgtgcctgatgctggagacgatttcgtagttgttgatgatgaacgtcttgctaaagatgtagcgcagcagcgcgaggctaagcgccgtgagtctcgtctagttacttctgctggcaatcgcatggaagacatattggctcagatgggtaaaggcgagaatcagcaagtgcttaacttgttgattaaggccgacgttcaaggttcgctagaagcgcttaaacaggcattggtcgcactgtcaaacgacgatattagaattaatgtaattcatgttggtgttggaggtattactgagtcggatgccaactctgccgtgacctctaaggctactgtgattggcttcaatgtccgtgccgatgcatctgctcgtaagatcattgaggcgaatggcgtagatttgcgttatttttctatcatttacgatgttattgatcaggtgaagcaggtcgcttctggtttgcttggagttgagattcgtgaggagatcatcggtgttgccgaggtacgggatgtgttccggagctccaagttcggcgctgttgccggttgcatgatcattgagggtgttgtcaagcgttccaaaccaatccgtgtgctccgtgataacactgtggtgtttgagggtgaattggagtcattgcgtcgctttaaagagaatgttgacgaggtgcgtaacagtactgagtgtggcattggagtgaaggcttacaatgatgtcagggttggtgatagcatagagtgcttcgaacgtattgaggttgcacgtacgttg

SEQ ID NO: 32989 - DNA, 1224 bp, Xylella fastidiosa
ctgcatggcgtcctgagtatccccggcgataaatcaatctcccatcgtgcagtcatgtttgctgcccttgcggatggcacgtcacgtattgatggctttcttgaggcggaggatacccgctctacagcagcgatcttggcccgattgggtgtgcgtatcgaaactccctcatccacgcagcgcatcgtccatggtgttggtgtggatggattccaggcatcggatattgccctggattgtggcaatgcaggcactggcatgcgcctgctcgctggtttgctggtagcgcagccttttgacagcgtcttagtcggagatgcatcactgtccaagcgaccgatgcgacgtgtgacggatccgctatcacagatgggcgcacgtatcgataccagtgacgatggcactccaccgctgcgtatttacggtggtcaattactccgtggtatcgattttatctccccagtggccagtgctcagatcaagtcagcggtgttgctggctggattgtatgcacgtaacgaaacggtagtgcgtgaaccgcacccgacgcgtgattacaccgagcgtatgctcactgcgtttggtgtggacattgatgtttccacagggtgcgcgcgcttgcgtggtgggcaacggttatgtgctaccaatattacaatcccggctgatttttcctcagctgcgttttatctggttgcagccagcgtgattcctggctctgatatcaccctgcgtgctgttggactcaatccacgtcgtattggtttgttaaccgtgttgcggctgatgggagcagatattgttgaatccaattgtcatgaacagggtggtgagccggttgctgacctacgtgtgcgttatgcgccactccagggcacgcgtgttcctgaagatttagtgcccgatatgattgacgaattcccggtcttgtttatcgctgcagcggcagccgaaggtcaaacggtagtgagtggtgcggctgaactacgcgttaaagaatcggaccggttggctgcgatggtgacaggcttgcgcgtgcttggcgttcaggtggatgagaccgccgacggggcaacgattcatggagggcccatcggtcatggcaccatcaacagccatggcgatcaccgcatcgccatggcgttttcaattgcaggtcagctttccgtcagtacagtacgtattgaagatgtcgccaatgttgcgacttcttttccaaactat

SEQ ID NO: 32990 - DNA, 1062 bp, Xylella fastidiosa
cgtatttttaatttcagccccggtccagcgaccttacctgaaccagttttgcgccaagcgcaggctgaaatgcttgaatggaatgcagtgggggcttctgtgatggaaattagtcaccgaagtgctgaatttatagcgctggctaaaggtattgagagcgacctgcgttgtttgcttggagtaccagatgactatgcagtattgttcttgtccggtggtgcgacaactcagcaagcgttgttaccgcttaattttgccgcccaaggacagactgctgattatgtggtcaccgggcattggagtaagaccgcactgaagcaagccagcccctatgtgaatatcaacgtggtggccgatggggaacgtgatggttttcaggatattccaaaccgtgctggctggcgtttgtctaaagatgcggcgtatgtgcacatgactgcgaacgagacgattcacggcgtcgagttccgccagacgccggacgttggcgatgtgcccttgtttgctgactttagctcttctattgctgctgatctgatcgacgtatccaaatacgatttaatctatgctggtgcgcaaaagaaccttggtcctgtcggaatttgcgtggtgatcgtacgccgtactctgcttgaacgtaccggtcagccgcgtgctgatatttttacttacgcctcgcatgccgaacgtgattcgatgctcaatacaccgccaaccttcaattggtacctgcttggtcttaccgtcaagtggatgcttgctgaggggggagtgcaggaattcgcgcgtcgtaatcaggccaaggcgcaattggtttatcagacgattgatcaatctggcggtttttatcgtaatggagttgctgcggcagtgcgttcgcgtatgaatattccgttctttttgccgaatgttgagcaagatgctcgtttcgccgccgaggctaaggccgctggtttattatccttgaaggggcataaagcggttggcggcatccgtgcttccctctataacgccatgccactggctggtgtacaggcattagtggcatttatgcatgatttt

SEQ ID NO: 32991 - DNA, 492 bp, Xylella fastidiosa
atgattgtttccttaattgcggcgttagatcgttaccgcgccattggtcgtgataatgggttgccgtggcacttgccggacgatctgaagcgtttcaaagcattgactttaggtcgaccggtgctgatgggacgcaagactgcgcattcccttgggcgtcccttaccagggagaaccaatctggtattgacgcgttctggacacgtgccattttctgaaatgcgggcggtggattcgcttgacgcagctatcgtccaggcggctgcggagggtgccgacacgttaagtgtgattggtggaggtgaactgtatgcactgactttgccgcacgccaatgcgatgtacttaactcacgtggatgtggctgttgcgggcgctgacacgtattttcctattttcgacgccgtcgattgggagatcaagaagcgtgaaccccatcagggcgatgggcgtcatgcctacccgttcaccttcatagactattgccgccga

SEQ ID NO: 32992 - DNA, 1086 bp, Xylella fastidiosa
atgagtaaacgtgattactaccaagtgttgggtgtgcctcgcactgccagcgaagatgatctgaaaaaagcgtatcgtcgctgtgcgatgaaataccacccagatcgtaatcctggtgatgcagctgcggaggcggcctttaaggaatgcaaggaagcttatgaggttcttgccgacacgaaaaaacgaaagttatacgatacgcatggtcatgccgctttcgaacatggcgtggggagcggaaatgcccccgacatgaacgatatcttcggtaacatttttggtggcgcgcgcgcttcgcggcgtggtgccgatgtcggttacatggttgagctggatttggaagaagctgttgctggtgttgagcgacagatccagatacccactttggttgaatgtacccactgccatgggagtggatcagaagacggtcacgtcgagacgtgcggtacgtgccgcggtagcggtcaagtgaggattcaacgcggcatctttgccatgcagcagacttgcccgcattgcggcggacgaggcgtgattattcgaaatccgtgtaaggtctgcaatggtgctgggcgtgttgaggatcataagacgctgtcagtgaagatccctgctggtgtagacaatggtgatcgtattcgcctcagcggtgagggcgagcagggtccggatggggtgcccccaggggatctatatgtggaagtgcgtgtgcgtgagcatccgatcttccagcgtgatggtgatgatttgcactgtgaagtgccggtgcgtatttcacaggctgcgcttggcgacattgtgcgtgtagctacgcttgatggggaggcagaaattcgtattcctgcggagacccagtctggtaaactgttccgcttgcgtggcaagggggtacgctcggtgcgtagtcgtactgaaggcgatttgtactgtcgtattgtggttgagactcctgtgaacttgactgctgagcagcgtaatctgttagagcaatttgaaatgactttcgctggtgaggatgcgcgtaagcattcccctaaatcggctacttttcttgatggtgtaaaaagcttctgggaccggatg

SEQ ID NO: 32993 - DNA, 1911 bp, Xylella fastidiosa
atgggcaaaatcattggtatcgacctcggcaccacaaattcgtgcttagcgattattgaaggcggtaaagggcgtgtcatcgaaaactcggagggtgatcggaccactccttccattgttgcttacaccaaggatggtgaaatccttgttggtgctgcggccaagcgccaagcggtcacaaatccgaaaaacaccttttatgcggttaagcgtttgattggacgtaagttcggtgatgcagaggtccaaaaggaccttgatttggtgccgtataagattactcagcatgacaatggggatgcctgggtggccactgctgatggtaagaagctggcgccgcaggaaatctctgccaaggtgctggagaaaatgaagaagaccgccgaggatttcctgggcgagaaagtcaccgaagcggtgattaccgtgccggcatattttaatgacagtcagcgtcaggcaacgaaagatgctggtcggatcgctggcctggatgtcaaacgtattatcaacgagccgaccgctgcggcattggcttacggtttggacaagaagggcggagatcgcaagatcgctgtatatgatcttggcggcggtacctttgacgtctcgatcattgaaattgctgaagtggatggtgagaagcagttcgaggtattggcgaccaatggtgataccttcttgggaggtgaggatttcgacaagcgtgttattgattatctggttgatgaattcaataaggatcaggggattgatttgcgcaaggatccgcttgcgttgcaacgtttaaaggatgctgctgagcgcgctaaaatcgaattgtcttcctcccagcaaaccgaagttaacctgccatacattacggcggatgcttcgggtccgaagcacctgaatatcaaactgactcgtgccaagcttgaagccttggtagacgacttggtccgtaagtcaattgagccatgccgcattgcgttgaacgacgctgggttgcgtaccagtgatgttcaagaagtgattttggttggtggccagacccgtatgccgaaggtccagcaagcggttgccgacttctttggtaaagagccgcgtaaggacgttaatccggacgaagcagttgcattgggtgctgcaattcagggtggggtgctggctggtgacgtgaaggatgtgttactgctagatgtgaccccgttatcccttggtattgaaacgatgggtggtgtgtttaccaagattatcgagaagaacacgaccattccgaccaaagcgtcccaggtgttttctactgccgaggatggtcagtccgcagtgactgtccatgtgttgcaaggtgaacgtgagcaggcgcgtttcaataaatcgcttgctaaatttgatttggcgggtatcgaacctgcgccgcgtggccagccgcagattgaggtgtcttttgatattgatgccaacggtattttgcatgtctctgccaaggacaagaaaaccaataaggagcagaaggtcgaggttaaagctggttctggactttcggatagtgagattcaacagatggttgccgatgctgaggcacatcgtgaggaagacaaaaagttccaagagttggtgcaggcaaggaaccatgctgacggtttgatccattcaactcgttcggccattaaggagcatggtagtaaggttgggggtgagctgattgggcgtgtcgaagcctcccttgcagagcttgaggctgccgtcaaaggtgatgataaaaaccagattgaggcgaaatccaaaactcttgaggaagttgcacagtcgttgcatatggcagcaacagcagagcagcagtcaggaagcacgggggctggtgcaggcgcttcagccaaggttgacgatgtggttgatgctgaattcacagaagtcaaggccgacaaa

SEQ ID NO: 32994 - DNA, 507 bp, Xylella fastidiosa
ttattggtagaccgtcccagtattgatgtagctattgcgcatatcgccgatgacatcgtcagggactatcagggggatgtgccgttgtttgtcaccatcatgcatggtgggttgccgtttgcgggtcaattagcattggagctgggtcagcgtggtcaggacatagagttggattccttacatgcgacgcgttaccgtggtgagcagactggcggtgcattggtgtggaggcattatccggtcagtgccatgtctggtcgtcgtgtgattctggttgacgatattctcgacgagggtcataccttgtctgagatacgtcagtggtgcctaaagcggggggctaccgatgtgtcgctagtggtgctgatgatcaaatgtcatgatcgttgtatacccaatatgagggcagattattatggcgtggaggttccggatcgctatgtgtttggttttggaatggacatagcggggcagctgcgcggtatcccggcaatttatgcgatgagg

SEQ ID NO: 32995 - DNA, 2249 bp, Xylella fastidiosa
atggccggtaagaccctgtatggcaaattgtgggacattcatgaggtggcccgtcgcgacgatgggtcttcgctcatttacattgatcgccatatacttcacgaagtgacttcaccacaggcttttgaaggattgcgtttagctggacggccgttgtggcgagtcaatgccaatattgcgactccggatcataatgtcccgacgaccaaggcggagcgtcaaggcagtttgctatcgattgccgatacggtttcgcgtttgcaggtacagacgttggatgaaaattgcgacgatttcggtatcttcgaattcaagatgaatgatgtgcgtcaagggatcgtccacgtgatcggtccagaacagggagccaccttgcctggtatgacagtagtgtgcggtgattcacacacctccacacacggtgcctttggtgcattggcgcatggcattggtacctctgaagttgagcacgtgttagccacgcagtgcttagtcacccagaagatgaaaaatatgcaagtgcgtgtggaaggcaccttgccatggggggtgacggccaaagatatcgtattggcgttgattgggaagataggcactgccggaggcaacggttatgcggtggagttttccgggagtaccatccgcgcgttgtcgatggaagggcgcatgaccatttgtaatatggctattgaggctggtgcgcgcgtgggtatggtggcggtggacgagaagaccatccagtatgtgcatggccgcccgtttgcacccaaaggatccgattgggatgctgctgttgcattctggcgtggtttggtttccgatccagatgcgcactttgatcgtgtggttgagttatctgctgaagagattaaacctcaggttacttggggaacctcgccagagatggtgtcggcagtggatcaatcggtgccagacccagagcgcgaaactgatccagtcaagaaggagtctttaattcgtgccctgaaatatatgggtttgcagccgaatgatccgatcccttcaataaagctggaccgtgtatttattggctcctgtacgaattcccgtattgaagacttacgtgctgctgcggaagttgttaaaggccgtaaagttgcttccacggtgaagcaggcgatggtggtgcctggctcgggattggtaaaggcacaggctgaagttgagggcttggacaagatattcattgaggctggtttcgagtggcgtgaacctggatgttcgatgtgtttggcgatgaatcccgataaattgggcagtggcgagcattgcgcatctacttctaatcgtaacttcgaggggcgccagggcatcggtggtcgtacccatttagtcagccctgcgatggcagccgctgcggccgtggctggtcactttgtcgatgtccgcgaaatgatgcggtgatgaaccttatgttgtctttgtagatgcttggaaataacgtgctaatgaaggtttatattcaatgccgttttttgattgtttcaatacttctagctcatgcttaaagtgtctctaaacggttatttttttcgatttcagcagcgtaataaaacggttctgcgatctatgatcgcagcgtacatagaatatttaagcactggtgaagcttgatgaaaccctttacccaacacaccggcttggtctgtccacttgatcgcgtgaatgtcgataccgatcagattattcccaagcaatttttaaagtcgatcaagcggacaggtttcggccctaatctgttcgacgaatggcgctatttggatgcaggtcaacctgggcaagacaatagcaagcgtcccattaattcagattttgtgctcaattttccccgttatcgtggggcgagtgtgttgctggcgcgcgacaattttggctgtggttcctcccgtgaacatgctgcctgggcgcttgatgaatatggcttccgcacagtcatcgcgccaagctttgctgacatttttttcaacaacagctttaaaaatggtttattgcctcttgtgttgaataaggttgaagtggatgcactgtttgcacagtgtcaagtgactgagggatatacgctaactgtggatttggcggcacagcaagtgattaccccggacggtactacttacgccttccagatcgatacgttccgtaagcattgtctacttaacggcctggatgatatcggtctcaccttacagcatgctgaggccatccgcgcttttgaggccacgcatcgtata

SEQ ID NO: 32996 - DNA, 1041 bp, Xylella fastidiosa
atgtttatcaatgcttacggtgcacacgctggggataaacccttggaatccatgcagattgcccgtcgtgccccgggtgcgcatgatgtgcaaattgatattcattactgtggcgtgcgccattccgatattcatcaagtacgggctgaatgggcgggcacgcttttcccgtgtgtaccaggacatgaaattgtcggtcgggtctctgccatcgggacgcatgtgcagggctttaaggcgggagatcttgtcgctgttggctgcatggtcgatagctgcaaggattgccaggagtgcgatgcagggttggagaattactgcgatggcatgattggtacctataacttcccgactcaggatgctccggggcacacattgggtggttattctcagaagatcgttgtgcatgagcgctttgtgttgcgcatccgccaccctgaggcacagcttgccgcagtcgcaccgttattgtgtgccgggattacgacgtactcgccactgcgccattggaatgctggtccgggtaagaaagtcggcattgtcggcattggtggcttgggtcatatggggattaagttggctcatgccatgggggcgtatgtcgttgcgttcaccacgtctgaatctaagcgacaggatgccaaggcgctgggagcagatgaggtggtggtgtcacgtgatgaggaaaggatggctgcccatgtaaagagtttcgatttgattttgaatactgtggctgcctcgcattctcttgattcgttcctgactctgctgaagcgggatggcacattgaccttggttggtgcgcctgttacgccgcatccttcaccggaagtcttcaatctgatctttaagcgtcgttccattgctggatcgctgatcggtggtattgcagaaacacaggaaatgctggatttctgtgcggagcatggcattgttgcggacattgagttgatccgtgccgacggtatcaatgaggcctacgaacgaatgatgaaaggcgatgtcaagtaccgttttgtgattgacaattccactttg

SEQ ID NO: 32997 - DNA, 1170 bp, Xylella fastidiosa
tacgtgatgtctaatagcccgcaaacgccgcttgttacgcgccagcgcctgtccgaagtccgctatgagatccgaggggagttggcgcgccgtgcgcgtgagcttgaggcggagggacgcaagcttatcaagctcaacatcggtaatccaggcgcgttcggttttcgggcgccagagcatctgcaacgtgctattgccgatgatatgggacgtaccgatccttatacgcatcagcagggtttgccaatcgcacgtgaggcgattgctgctgcttatgcgcgacgtcactatccagatgttgatgcagatcgggtctttgtggggaatggggtttctgagttaatcgatttgtcgttgcgggcgttgcttaatccaggcgatgaggtgttggttccttcaccggattatccgctgtggtcggcggcgacgattctcaacgatggtcggccggtgtattaccgttgtgcgccggagaacggtttccagccagatgcagttgagatcgaaacgctggtgtcttcacggacacgtgcgattgtgttgattaatccgaataatcccagtggtgccaattattcgcaggagttattggagcggattgtggcaatcgcagtgaaacatcatttgctgttgttggttgatgagatttacgatcagattttgtatgacggtgcggtgtttgttccagtggctcctttggcggggacgcatccatgtatcactttcagtgggctgagtaaggtgcatcgtgcgtgcggttggcgtgtgggttgggcgttgctgtccgggagtagcattcaagttgataatctgcgcaatgcgatggatttgctgggtgcgttgcgtttgtgtgcgaatgtcccagggcaatatgcgattgatgcggcggtcaatgggccagatacgattactccgttatgttcgcctggtggtcctttgtacgagacgcgccgtgcggtgattgatgcatgcgcggcgagtgagcatttgtcgttggtggtacctgctggggcgttatacgcgttcccatcggtcgtgggaccggctgcgcggcactttgatgattatgcttttgcgctagagttgatgaatgaggagggggtgctggtggtccctggatcaagttttaatgtgccatatcgggatcacttccgcgtgacgttgcttcct

SEQ ID NO: 32998 - DNA, 2106 bp, Xylella fastidiosa
gcttccaatccacagcctgacagcgcactccacggcttagtgctccttgcccaattccatggcattgcggctgaccccgtacagatagcgcatgacttcgggcgcagtggcgaaccattcgatgaaacaaccttgctactggccgccaaaaaacttggactaaaagccaaagtcgtcacccaaccggtcacccgtatcgcaatggccgcattacctgcactcgcactgatccctggaggaacggcatttatcgtcgccaaagtaacaggcaaccagatactgatccacgacctggcagatcaacggccacgcacaatctcacacgatgaatttaccgcacgctacgccggccgcttactccaagtcgcctcccgcgcatcggtcctaggaaatctggctaaattcgactttagctggttcatccccgcagcggtcaaatatcgcaaactgctggctgaagtctttgcagtgtccttatttatccagatattcgcactggtgacacccctgttctaccaagtcgtgatggacaaagtgctcgtacaccaagcactcagcacccttgaagtcattgtcgttggcctcatctccctggccttattcgaagtactactcaccgcactacgcacccatgtcttcgcacataccaccagcaaaattgatgttgaactcggcgcacgcttattccgccatctattagcattaccgttagcgtattttgaatcgcgccgcgttggcgacaccatcgcccgcgtacgcgaactagaaaacatccgccacttcctcaccggccaagcactgacctcagtcttagacctcctattcaccgtcgtctttttgtccgtcatgttttggtacagcagctggctcaccctgattgtggtgatctcattacccctgtatgcactgatctccgcattcatcaccccagtactccgcaaacgtctggatgaaaaatttgcacgcggcgcagacaaccaagcatttttagtggaaaccgtcagcggcattggcaccgttaaagcaatggccgtagacccacgtgtcacccgcacctgggacaaccaactggcgggatacgttagcgccagctttagcgttaccaaaattgccaccctcggccaacagagcgttcaattagtacagaaactgaccaacgtcgccgtattattttggggcgccaaactggtaattgacggacaactgtccctcggacaactaattgccttcaacatgttgtccggccaagtcactgcccccatcatccgactcgcccagctatggcaggattttcaacaagtcggactctctgtcgaacgactcggcgaaattctgaacacccgtaccgaactccccggcagccgcatgacattgccgcccatccaagggcgcatcaccttcgagcgcctcatcttccgttaccgtccagatacccccgacgtactctccggaatcgacctagacatccaacctggcgaagtcatcggcatcgtaggacgctccggctctgggaaaagcaccctgacaaaactcgtacagcgcatgtacgtcccagaacgcggccgcgtcttggtcgacagccacgacctctcattggccgatcccgcctggctgcgtcgccaaattggcgtcgtactgcaagaaaatttcctgttcaaccgcagcgtccgtgaaaacatcgccatggccgacccgggaatccccctggaacgcgtcatccacgcagcgacattagccggtgcccataccttcatttctgaactaccagaaggctatgacaccaagattggcgaacacggtacaggactctccggcggccaacgccaacgcatcgccattgcccgcgccctgattggcgacccacgcatccttattttcgatgaagccaccagcgcactcgactacgaatcagaacatgccgtcatgcaaaacatgcgagccatttgcaaaggccgcaccgttctcatcatcgcccaccgcctctccacagtccgtaatgccgatcgtatcgtcgtcattgataaagggaaaatcgtagaaagcggctcccacgaaacactcctcaaccgcaacaacggtcattacgcccacctctaccgactccaa

SEQ ID NO: 32999 - DNA, 1329 bp, Xylella fastidiosa
ggcccggaaggctggcgccttgatgccatcagtcgccgccagtacagcgaagacgactcgcagtgctttgcctgtgccgatgcagtggcgctgccacgtgacctcaacgaggtagtggcaatcgtacgtgcctgccgtcaacatcgcgtgccagtgatcccacgaggtaccgggactggcaccgtgggtggtgcagtgccgctccatggcggcatcgttctgtcattgggacgtatgaaccgtatcgtcgcactgttgccagatgatcgctgcgcagtggtacagcctggggtgatcaacaatgacttacaacaagcactggcaccacatgggcttttttggccaccagatccgtccagtacagcgatgtgcagtatcggcggcaatcttgcaacgaatgccggtggcccgcgtacggtgaagtacggtgccacacgagataacgtgcttggcgtcgtcgcagtgaccggtgtcggcgatgtaatccgctgtggcggtgcttatacgaagaacgccaccggttacgatctggcacatttgttgattggcagtgaaggcacattagcaatcatcgtcgaggcaacgttaaagctggcaccacaaccacaagctatcgctggactgcgtgcgttctatcaagatacggccgctgccgctgccgcagtgtcacgactgatgtcacaaccggcaataccagcaacgctggagttcatggaccacaaagcaatcgagctgctgtatcgcaatggcagcaatattcctatggccggcgcgatgctgctgattgaaggagacggcaatcacgacacgcttccctatgtattacaagcactggcgcaggccgcttcgggtgaggggctgatagaccttgacatggccatggatggagccgcacgcgatcagctatgggcagcacgcaagtcactatcgccaatgcttcgcacgattaaacctggaaaactaaacgaagacgttgttgttcccgtctcgcgtattcctgatttggttgctggcatagaagtattggctaccgagagcggattacccattgtcacctttgggcacgccggtaacggaaatctacatgtgaatatcatgtatgacgatcaggatgcggaagacattatgcgggcgcaggcaacgctaccaaagctatttaagttagttttgactcttggaggcaccctgtcaggtgagcacgggattggcgtagccaaacgtgacttcatgacacaagcattcgacacaccaacgctagcagcaatgcgtgcgatcaaggccgcattcgatccagagggtattctcaatccaggtaaagtgctacccaga

SEQ ID NO: 33000 - DNA, 864 bp, Xylella fastidiosa
atgcaattcaaggactattacgcgactttaggtgttgaaccgagtgcgggtgaggctgagatcaagaccgcttaccgtcggctagcgcgcaaatatcatcctgacgtcagtcaggagccgggggcggaggagagattcaaggccgtcaacgaggcttatgaggcattacgcgatccgaacaagcgtgcggcttatgaccagctccgtgcacaagggtaccggcctggagatgaattccatgctcctcctaattttggtggtgggcatggttttaactttgaagaggtgtttggcaatgcgtcgggggggcatttcagcgatttctttgagagcttatttgctggagcccgtgccggtggtcgtcatgcaggtccaggggggggcgccaaatcgcaacacggtgatacgcgttccaagttgactgtgccactggaagccatttacagcgggggaagtgtgcgggtcacggtcaatgggcgtcagcttgatgtgcgtgtgcctaaaggtatccaacctggcaaggtgattcggttgaacggacaggggagctacgctcgtcatctcttgttagagatcgaatatgctccgcatccgcaatttgaagttgatgggcacaatattctgcacactgtgcaagtgacgccatggcaggccgcattggggacttcgatcagcgtgccgactctcggtggatctgtggagctgaaggtgccacctgattccgatgcgggacgcaagttgcgtctgcgcggtcgtggtttgcctggtcctccgccaggagaccagatcgttgagttggaaatcactgctcctttagctacaaacgatacacagcgcaaggcatatcgggcgcttgccaaagcg

SEQ ID NO: 33001 - DNA, 2198 bp, Xylella fastidiosa
gaagggactcacaataaagactggtggcccaatcagttacgtgtggatttgctgcatcagcattcgaataagtctaatccactaggtgaaacgttcgattacgccaaagagttccagaaactcgattacgctgcgttgaagcgtgatttacatgcattgatgaccgattcgcaggattggtggcctgctgactttggtcattacggcggtttgtttatccgtatggcttggcatagtgccggcacctatcgtatcggtgatggtcgtggtggtgctggccgtggccagcagcgcttcgcgccgctcaatagctggccggataatgtcagcctggacaaggcacgtcgtctgctttggccgatcaagaaaaagtatggtcagcagatttcttgggccgatctgattgtgcttgccggtaacgttgcgttggaatcaatggggtttaaaacctttggcttcgctggtggtcgtgtggatacttgggaacctgatcaggatgtgtattggggccgggagacgacctggcttggtggggatgttcgttatggagctgtctcggaaggtgtacaccatccagatgaacacaggggagcaaaggagaaggctgccaagaatagcgacttgcgtgtgttggaaaatccgttggctgctgtgcagatgggattgatttatgtcaatcctgaaggtccggatggctgtccagatccgctcgcttctgctcgcgacattcgcgaaacgtttgctcgcatggcaatgaatgatgaggagactgtggcgttgatcgccggtggccacaccttcggcaaaacacacggcgcggctccagcagacaacgtcggtcctgagccggaagccggggagttggagcagcagggcttggggtggcacaaccgcttcggtagtggcagggcgggggatacgattaccagcggtttggaggtgacatggactaagactccaacacaatggagcaacgatttttttgagcacttgtttggttacgaatgggagttgaccaaaagtcctgccggcgcctatcagtgggtggctaagaatgctgcagcgacgatcccgcatgcgcacgatccgtcgaagaaattactgccgatgatgctgacatcggatttagcgttgcgttttgatccagtctacgaaaagatttcgcggcatttccatgcgcatccagaccagttcgccgatgcgtttgctcgggcttggttcaagttgacgcatcgtgatatggggccgcgtgtccgttaccttggcccagaggttccggctgaagaattgatttggcaggacccagttcctaaggtcagccatgtgttagttgatgcgcaggaccttcttgcgttgaagcagaaaatttctgcttctgggttaggaatctcgcagctcgtttcgacggcttgggcatcggcctccacgttccgtggctcggataagcgcggcggcgccaatggggggcgtctttgcttggctccgcaaagccagtgggaggtcaatcagccgcagcaactgagtgtggtgctggaaacattgcggcgtgtccaggctgaatttaacgcgcaagcgggagacaaacgcatttctttggcagatttgattgtattggctggcggtgtaggcgtggagcaggcggcgaagcgtgccggtatcgtggtggaggtcccttttgtgccgggacgtaccgacgctttgcaggagcaactgatgtcagttcatttgctcctctggagccgtttgctgatggattccggaactatgtcaaggaaggttgtgttgttccgtctgagcatcttttgattgatcgtgcccagttactgacattgactgcaccggagatgacggtattgatcggcggtttgcgggtcttgggtgccaacgttggcggtgtgaagcacggtgtgtttacagatcgtctggggacgttgagtaacgatttctttatcaatctactcgacatggggacggagtgggctcccgtttccaaagagcgtcatgtgttcgaaggacgtgatcgtcgcaccggtgcgctgaaatggacgggtacccgtgttgatctggtctttggctccaatgcactgttacgtgcgctagcagaagtctatgccgcagtcgatgctcaagagaagtttgtacgcgattttgtcgcagcttggagtaaagttatgcatttggatcgctttgatttggtg

SEQ ID NO: 33002 - DNA, 921 bp, Xylella fastidiosa
atgcaatttgattcaaatggacgtttgcgtcacctgctcactttggaaggactgtcgcgtcacacactgctgcagttacttgactgtgctgcccagaactgtgcactcggggttgaccctatgggcaagcgcaacgtgttagctggtatggcagtatgcacactcttttttgaaccatccacgcgtacccgtcattcattccacctggccgcgcagcgtttgggagcggatgtattaaatttcgatgcttcgatgtcgtctacgagcaagggtgagagtgcctgcgacacattgaagaatttggaggcaatgggggtgcgcggttttatagtgcgccatcctgaagagatcgtcatcgcacagttggctgcagtcgttggtgagggtaccgtgctgatcaatgccggtgctggccgtagtacccatccgacgcaggggctgctggatatgctgaccttatgtcaggccaagggcaacgatttttccaagctaaagctactctttgtcggtgacatcaaacattcacgcgttgcacgctccaacctgcatgcgttgcgcaccctgggtgcaggacagatccgggtgtgcggtccgactacattattgccccatgacggcctcctctctggttgtgttgtcagtcaagattttgatgccatgcttgaaggtgtggatgtactgatgatgctgcgtctacagcgtgagcgtatggaggaaggattggtgccctcgttggagcactaccacgccaactatggtttgaccgcagcgcgcctggcgcgtgcagctccggatgcggtggtattacatcctgggccaatcaaccgcggcgtggagattaccgatgaggtggccgatggcccgcagtcatggatcctgcgtcaagccagcaatggtgtgatggtccgtatggccgtgctg

SEQ ID NO: 33003 - DNA, 2496 bp, Xylella fastidiosa
tcatcgtctgctgtccggttgtccaccgttgaaactcctgtctacgttccgcgtaccgtcgttcacaaattcggtggcacttcggttgccgatgcggattgctatcgccatgtcgcgcgtctcctattagcacgcgaagagactgtgcaggtcaccatcgtttctgcgatgaaaggggtgactgatacgttgattgcactggccgaacaggcagccaatcattctcccgactggcaggcgttgtggcagcaaacccgcacgcgtcattgcgacgccgctcaggcattgcttggagagcatgccgctacgctgcaagattggttgaatacccattttaatgaactgcatgaaatgctggtggccttgtccgtcatcgggatgcttccatctgaagtgctggaccgcttacaaggcttgggcgaggtgtactccgcacagttgcttggggagtatttgcaattccagggtgaggattgtgtcgttctggatgcccgccaagtccttgtggtgagtcctggtgaatttggcgccgaagtcgattgggcaaccagtgcccagcacttggcccattggcgtatgcagcatccacagcggcgtgtggtggtcaccggtttcgttgcctctgatcgtactggacgtgccatcaccttgggtcgcaacggcagtgattattccggtgccatcttcgcggcgttgtttgaggccgatgagcttcacatctggacagatgttgatggagtcatgtccgccgacccccgggtcgtcccggatgcggtgcaactggatgccttgagttacgacgaagcatgtgaattggcctatttcggcgccaaggtagtgcatccacaaaccatgtcgccggtgatgaaacgcggagtgccgatcatcattcgaaacaccttccaacccagacatccagggactcggatcaccgctgatagcgtggtgagtggatctgttaaaggcctgaccctgagtccaggactggccgtgctgaacctggaaggcacggggctgatcggagtccctggtaccgctgaacgcgtgtttgccgccctgcgtaatgcacgtttgtctgtcgtgatgatctcacagggatcttcggagcattccatttgctgcctcgtgcaccaaaccgaggccgagcgtgcacgtgatgcgttgttgtatgcctttgcccatgaattggccatagggcatgtccagcgcgtacaactgaccaacaatatcagcgtattggcggcggttggcgacggcatggctggtcacctgggtgtagcggcgcgcttgtttgaatccttaaggcgcgcccatgtcaacatcctggccattgcccaggggtcttcagagcgcaatatttcggtggcaatcgacagtcagcaggcgacgaaggcactgcgcgctgcacacgctgctttctggttatcaccccagacattttcgattggtgtgattggtccgggtcacgttggtgaggccctgttggaccagctatgtgctgcacagcagcaattactgtccaaggcaaatctggatctgcgtttgcgtgcgatcgtttcacagcggcgtatgttattggatgagcgtggcctggggagtgactggcgccacgccttcgccgccgtaccagaggcggtcgatctggatgcttttaccgcacacttacaggccgcccatctgcctcatgcagtcatcattgactgtagcggcagtgctgaggtggctgatcgctatgccgactggctggcagccggtatccatgtcgtgacaccgaataaacaggctggctccggccccctgcatcgctaccacgcgattcgtgcagcagcagatgccagcggcgcacgctttcgctatgaagccacagtgggcgcaggcttaccggtgattacgacattgcgtgacttgatggataccggtgatagcgtcacctcaatcgaagggatcttttccggaactctggcgtggctattcaataaatatgatggcagcgtcccattctcccaattgatcgcccaggcgcgagcgatgggatataccgagcctgatccacgcgatgacctgtctggggttgacgtggcgcgtaagctggtgattctggcgcgcgatgcggggcgtgatatcagcctagaagatgttgcggtagaaagcctggtcccggagacattgtgtcaactcagcgttgccgatttcatggaacgactcaatgaaattgatgccacctttgcagagcgtttggctgcggccaaacagcgcggttgcgtattgcgttacgtcgcacaactgtcccctggacacgtccctagtgtcagcttgattgaattgccttctgaccatgccttcgtcaaccttcgtttgaccgataacgtagtgcaatttacaactcgtcgttattccgaaaaccccttggtcgtacaggggccgggcgccggtccagaggtcaccgcagccggtgtctttgcggatttacttcgagttgcagcgggcgagggcgca

SEQ ID NO: 33004 - DNA, 876 bp, Xylella fastidiosa
cgactgcgtattgcgattcaaaaaagtgggcgtttgacagaaccggcccgccgcctcctgacggcttgcggactgagctggcgtcagagtcgcgacaaactgttttgctacggtgaatcgctgccggtggatctattgttggtgcgcgatgacgacatccccggcttgattgcccagggcgtgtgcgaccttggcatcgtgggtcgtaatgaactggatgaacaggcagcctcacggcgccgcaacggccttcccgttccctaccaaaccctacgtggactgcactttggccaatgccgactcatgcttgcggtgcctgaagaatgggagtggcaagacatatcgcaattgacaggcaagcgcatcgccactagctaccccgccatcttggccgactggctacagacacatcacattgctgcacagatcgtcgaactctccggctcggtcgaaatcgccccacgcctgggtaccgctgacctcatctgtgatttagtgtcctccggcgccacattggctgctcaccaactcaaacccgtcatccagatcatggagagccaagccgtgcttgccggcatgatctgccaacctgccgatgcccgtgccggactcttggccatgctgctgcggcgcattgatggcatggtcaacctgtgtgacagcaacttactgatgttccgtgccttccaagaacacctggacgccttgacccgcttactgcccgatgccgacccattggtacagctccccgatgacggcagcggcaccctacgcgtgcagaccatgtgtcatggcgccatcacctggcagcgtttggaagaactggaacgtgctggtgctcagggcttgatggtattgacagtagagcgatccctc

SEQ ID NO: 33005 - DNA, 1275 bp, Xylella fastidiosa
atcattgattggaaccaacttgatactgcggcccaggcccagacactgacccgtcccgcgcagaccatcgccacacaaacccgtgaggccgttaccgccttaattgaacaagtgcgtcgcggcggtgatactgccttgcgtgacatcaccgcccgctttgatggtgttgacctggccacgtttgaggttactgcggccgagctggccgctgcggccacggccgttgccccagaactacagcacgccatgcagacagccgcagcccggatcgaagccttccaccgtgccggaatgaccaacggctatcgtgtggaaacggcgcccggcgtggtgtgtgaacgcctggtacgtccgatcgcccgcgtgggcttgtacgtccctgccggcagcgccccgttattttcaactgctttaatgctgggtgtccccgcacggctggccggctgccgtgaagtcgtcttgtgtaccccaccctctaaagatggccgcgccaatccggcggtcctgcttgccgcacgtctcaccggagtcacccgggtcttcacactgggcggcgcccaggccatcgcggcgatggcttacggtaccgcaagcgttcccacctgtgacaaagtgtttggccctggaaatagctttgtcaccgaagccaaacaacagcttgcacaagccggcgtcgtcgcaatcgacatgccggcaggcccctcggaggtcctggtgatcgctgatgccgccgccaatcctgcgtttatcgctgctgatctcctctcccaagcagaacacggcccggattcccaagtcctcctgttgtctgacagtgatgcactaatgacagcggtacagactgcccttgctctccaattgcagcagctatcccgtgccgagatagcgtgtcaggccttagcgcagtccaggttcattaaagtggccaccctggagactgcctttgacatcagcaaccgctatgcgcccgaacatttgattttggcattgcgccaaccgcgtgcctggctgcaccgcgtcgcagccgccggttccgtcttccttggcgactacacccccgaagccctgggtgactattgcagcggtactaaccacgttttgcccaccggcggtgcagcccgcgcctatagcggcgtgagcgtctccagcttccaaaacatgatcagcgtccaagcggccagccgcagcggtattgctgaaattggcgactgtgcattgaccttggcgcgtgccgaaggattggatgcacacgccaatgctgtcgccttacggatg

SEQ ID NO: 33006 - DNA, 1065 bp, Xylella fastidiosa
acggtccttgacctggtacgtcaagaactacgcaactttgctggctactcctccgcgcgcagtgtcgctttgaccggtgacttctggctcaatgccaacgaatcggcctggcccaatcccgctgactcccacgccaccatgcgacgttatccagaaccgcaaccgcccaagttgcgccagatgctggcggcactctacggctgtcttcccgagcaactattgattggtcgtggcagtgatgaagggattgatttactggtgcgtaccgtgtgcgaaccgagacgtgatcccgtcctggtcacccccccggtgttcggcatgtatgccgtttccgcacagttgcagaacgccccattgatccaagtccctttggttgatgacgctgcgggcttccatgccgacgtgcctgcgatcatcactgccgcacagacttcccgcgccaaactcgtgttcttgtgctcaccctccaatccggtcggtgccgcgatcccgctacagcagattgagaccatcttgcagacacttgccggcactgctctcgtcgtggtggatgaagcttacggagaattctccgatgtcccttccgtggtgcccctgctggcccgctacccacatcttgtcgtgctgcgtaccttgtccaaagcccatgccctggctgccgtgcgtatcggcagcgtgatcgccgatgcccatttagtcgcggtattacgtcgctgccaagcaccgtatcccttgcctaccccctgcgtgagcttggctgagcaggggctgtcagccgccgcgttacagatcactgcgcagcgtgtggccgagattcgtgctgagcgtgagcgcctgcgtgccgccctggcctgtctgtctggcgtgcgccgcgtctatccctcccaagggaacttcctcctggtgcgctttgatgatgccgaggccgcgtttcaggcgctgtacgccgctggcgtcgtcgtgcgcgaccagcgtgccgcaccgcagttgcatgatgccttgcggctgaccgtgggaacccccgaacaaaacacacgtctcctggccgtgttgcgtgacatccag

SEQ ID NO: 33007 - DNA, 1113 bp, Xylella fastidiosa
gtgtttattgaccgtgacggcacgctcattgaagagccgcctgattttcagattgatgcctacgaaaaactgcgccttgtcaacggcgtgatcccggcattgctgaagctccgtgatgccggctatcactttgtgatcgtcaccaaccaagatggattgggcagccccacgtatccccaagccagctttgatggccccaatgcgttgatgctgcagatttttagtagccaaggcatcgtcttccgcgatgtgctgatcgatcgtagctggccggccgacaacgcgcccacccgtaaaccaggcatcggcttgatggtcgcctaccttcaagatcgcgacattgattgggcgcgctcggcaatggtgggcgaccgccccacagatctgcaatttgccgagaatctcaacattcgcggattccaattacgtaccccgcaatttggtggtgactgggattgggacggcattgctcacaccttggccgatgcgccgcgtcgcgccgtggtacagcgtcacaccaaggagacaaacatccgtgtcgagattgatttggatggcgtaccccaggcgcggatcaccaccggattaccgttttttgatcatatgctcgagcagatcgccaaacatgccggcatttccctacacatcagcgctgttggggatctgcatatcgacgaacatcacacgatagaagataccggcttggcgctaggtcaggcagtgcgccaagccttgggggataaacgcggtattggccgctatggattcgatccgccccagctgccgtggcaggtgagcggcgcggcggcacacggtggctttaccctaccgatggatgagacccaagccagcgctgtgttggacttcagcggccgcccgtattttgtctttgaaggaaccttcgtccgtgagcgcgtcggcgatatgcccaccgaactggtaccgcactttttccgctccctgtgcgatgcctccgggatgaacttgcacttgagcgtgcatggcgacaacgaccatcacaaagtagaagcgtgtttcaaggcgctggcgcgtgcattgcgtcaggcgttacaacgccacggccacgtgcttccttctaccaagggggcgtta

SEQ ID NO: 33008 - DNA, 765 bp, Xylella fastidiosa
atgttgagccgccgcatcattccatgcttggacgtgcgtgatggacgtgtggtgaaaggcgtgaagtttcgtgaccacgtggatatgggcgatatcgtcgaactggccttgcgttaccgtgatcatggcgctgatgagttggtgttttatgacatcggcgccagtccacaagggcgttctgtggattaccgttgggttgaacgcgttgcgcgcctgatcgacattccattctgtgtggccggtggtatcggcgaggttgagactgcccgtgctgttttgcatgccggtgccgataagatttcgatcaactcaccggcactgcgccaacctgcgctgattagcgccttagccgaagcctttggggtgcaatgcgtcgtcgtcggtattgactcgatccgtgaggctgatggtcagtggcgcgtccgctgcaataccggggatccggacaaaacccaggccttgccgctgcgcaccctggattggattgttgacgcgcagcgcctaggggcaggggagatcgtattaaattgcatggacagcgacggggtgcgctgtggttacgacattgcacagctgtctcaggcgcgcgcactgtgtcaggtgcccttggtggcttctggcggcgccggggacatgcagcactttgcggatgtatttcacaaggctgatgttgatggtgcattggcggccagcgtatttcatagcggcgcgatttcgattccgggtttaaaacagtttctgcgtgagcagcaaatcgaggtccgc

SEQ ID NO: 33009 - DNA, 573 bp, Xylella fastidiosa
ctggattgggccaagggtgatggcttgttgcccgtgatcgtgcaggacgccgatacgctgcgtgtgctgatgcttggctatatgaacagccaggcattagaggtcacgcagcgcagccgcttggtgacgttttacagccgcagtaagcagcgtttatggaccaagggggagcgttctgggcatgtgctgcatgtggtggccattgatgccgattgcgatgccgatacgttattagtgcaggcccgaccccgtggacccacgtgtcatctgggcaggactagttgttttcctgcagcccctggacagtttcttggtgcgctggatgcgctggtggcggagcgcgaacgtgagcggccacaagacagttacaccaccgcattgtttgagcagggcgtccgccgcatcgcgcagaaggtcggtgaggagggggtggagaccgcattggctggcgtggtccaggctgatgatgcactccttgatgaatcagcagacctgctttaccacctgattgtgttgttgcgtgcccgtggtttatcgcttgccgatgccgttaccgtattagaggcacggcat

SEQ ID NO: 33010 - DNA, 1371 bp, Xylella fastidiosa
agcctgcaacgcgtccttggagtgtgggggttaactgcactgggtatcggtgcggtgattggcggcggcatctttgtcattaccgggcaagccgcggccaatcacgccggaccagccattatgctgtcgttcgcactcgcggcgatctgctgtacgttctgtgcgctggcgtatgccgaattcgcggcgatggtgccggtctctgggagcgcctacacctatacctatgccactttcggtgagctggcagcctggttcatcggttggatgctggtattggaatatggggtttctgccgcggcggtggcggtgagctggagcggctatttcctcagcttgttacagcatctgggcatccatctgcccgcagcactagtgaatgcgccattggacggcacgctgcacgccactggagccattgccaatctgccggcagccaccatcgtgctgctgctgacttggttgtgctacttcggcatccgtaagtcctcgaagatcaatatcgcaatggttgcactcaaaagcgggctgatcttgctgattattggcgtcggctggaaatacgtgaaccctgattactggcaaccgttcatcccgaccaatcaagggccgggcaaatacggatggaatggtgtgttacatggcgcgtcaatggtgtttttcgcctacatcggttttgaagcggtgtcggtggccgcgcaggaatcgcaccgtccacagcgcgaccttcctatcagcatgatgagtgcgttagcgatctgcaccgtgctgtacatcatgatggccgccgtcatgactggattagtcccttacacgcaactgggcacagatgagccagtcgtcaccgcagtcgccgcacacccccaactgggctggctgcgcgtcgtggtcgaaatcggtgcattggtcggactgtcttcggtcgtgttggtgatgctcatcggacaaccgcgcatctttatgatcatggccggtgatggcctgctgccaccgatattcagcacaatccactccaagcaccgcactccgcacatcaacacggtgatcaccggactaggtattgcgttgctcgcagcgttgctcgcagcggtgttcccactggatgtactcggcgaactcacctcaatggggacgttgattgcctttaccgccgtctgtgccggcgtgctgattctgcgctgtactcggccagatctgccacgcccattccgaatgccggcagcatggttattttgctccgctggtgtactcagttgcattaccttattgtcagcaatgaccaggcacaattggatgctgatgagcgtgtggactgttcttggtttttccctgtacttcagttacggatatcaccacagcaaactgcatcaa

SEQ ID NO: 33011 - DNA, 1485 bp, Xylella fastidiosa
ctcaaaaaacatttattcatcgtcaaaccgatcgagccgacaaatcacacagggacaggtaaaggcggaacgcaactcaaaagatcgctaacggcaggacagttagtgatgctcggcatcggggccgtgattggcgctggtattttcgtgctcagcggacacgctgccgccgagtatgccggcccagccgtggtactgagctacattctggcgggaattgcctgtgctttggctgggttgtgttatgcggagttcgcggcaatgctgccggtctccggttccgcttactcttatgcctacgcgacgctcggggaattcacggcttggttcatcggttggaatctgatcctggaatatatgttctctgcctcaaccgtggcggtcggctggtccggttatctcaatagtttcctgagcagtttcggttatgggctgccagcctcgctatctagtgcacctctggacgtagtcgatgggcggctgatttatagcggtggcctgatcaatctgccggcagtcgcgattgtggccgcgatcagtgggctgtgctacgtcgggatcactcaatcggccttcgtcaactccatcaccgtggcgatcaaggtcagtgtcatcgtgctgttcatcgctttcgccgcacgctatgtcaacccggacaactgggtccccttcgtcccggacaacgtggcaccaggcaagtacggcattgaaggggtgatccgcggtgcagccgtggtgtttttctcctatatcggctttgatgcagtctccaccactgcgggggaagccaagaatccacaacgtgacatgcccatcggcatcctcggctcgctcgccatctgtacggtgatctacattgccttctccggtgttctcaccggcctgatgcactactcgcagttggatacgcccaaacccgtggccaccgcgctggaaacctacccaacgctgtcatggctcaagcatgtcgtagaaatcggcgcgattgcagggctgagttcaacgatgctgatgatgctaatggcacaaccgcggattttctacgcgatgtcgcaggatggcctgctgcccaagttgctttctaaagtgcatccaaaattccagactccccacgtaggtacgctcatcgtcggtgcctgtgcctgtgctttagccggactgtttccaatcagtctgcttggcgatctggtctccatgggcacgctgctagcattcgcgacggtctgcattggcatcgtggtactacgccgtacccgcccggatctgcctcgccccttccgggtccccatgtactgggtgatcgcccctacaggtgcggcagcctgtctgtacctgttctggcagccgttcaccgagcactggccgctgatggtcggttggacggtactcggcttggtgatgtatggcttatacggctatcaccacagtaaattacgacatggtggctaagcaataagcactcaggaggccggcgcaacgccggcc

SEQ ID NO: 33012 - DNA, 1317 bp, Xylella fastidiosa
accgaacctgccgacttacagcactatggccgcgactggacccggcgcttcacaccggcacccttagcaatcgcacttcctgccactgtccaagaagtccaggccattgtgcgttgggccaatgatgcccacattgcgatcgtcccttccggcgggcgcaccggcctatccggcggtgccatggccaccaatggcgaactggtgctcagtctggagcggatgaacaaaatgctccagttcgaccccatggatcgaaccatgaccgtgcaagcaggcatgccattagaagccgtccaagccgtcgcccgccaacacggcctcctgtatcccgtcgactttgctgcccgaggctcatgctccattggcggcaccattgcgaccaatgcaggaggaatccgcgttgtccgttacggcaacacccgcgaatggatcgctggcctcaacgtagtgactgggactggcgaactcctcaagttgaatcatgccctgatcaaaaactccagcggctatgactttcgacatctgatgattggttccgaaggcacattgggcattgtcgttgaagccaccttgcgtctgaccgacccaccgccaccgaccaaagtcatgctgctggcattgcccacctttgacgttttgatgcaagtatttgccgcctttcgcgcacaactacagattgaagccttcgaattttttacgcagcgcgcactgccccatgttatagcccacggcgcccaagcaccgtttgaacatccctatccgtactacgtcgtcaccgaattcccctgcgccgacgcagcccaagaaaccaccgcactcactgtctttgaaacctgcatggagcagggctgggtcttggatggtgtcatcagccagagcgacgcacaggcagcccaactatggcgactgcgtgagagcatcaccgaaagcattgccccatataccccgtataaaaacgatattgccgtgcgcattgccgccatgcccgcatttctagaacaagcacaaacattactgagccaagcctacccagaatttgaagtcctctggttcggccatatcggtgacggcaacctacacattaacgtcctcaaaccgcacacagtgccccagactgacttcatccacacctgcgaacacgtcaccgcactgcttgctgacctcctacaacgtttctgcggcagcatctccgcagaacatggcattggcctgataaaaaagccctaccttcacagcacccgcagccctgctgaaattgcattaatgcgtcaactaaaacgcgcattcgacccaaaatggatattgaacccagggaaa

SEQ ID NO: 33013 - DNA, 756 bp, Xylella fastidiosa
atgcgactgactccactccccgcattcgacaacaattacatctggacattgattgcccctgacggccgagcaatcatcgtcgatcccggacaagccttgccaatattagaagctcattccaaaggactcatccccactgcaatcctattgacacaccaccacgccgatcacatcggcggagtgccagaactgctagaacgctggccaacacttcccgtctatgccccacacgacacacgcatcgcactgaattaccaccgcattggcgagggagattcattgaacatccttggtatgcgattccaagttatccacaccccagggcatactcacagccacttaaccttcataggtaacgatctactgttctgcggtgacacactattcagcctaggttgtgggcagatctttgaaggaacccccacacagatgctcgcatcattgcaacgattggctgcactgcccatacagacccgcgtatgctgcggtcacgaatacacattgtccaacgctgcattcgcactgcacgtcgaccccaccaacaccgccttacaaaaacgtcgacaacaagcaaacgccatgcgtctcgcaggcctccccacattgcctatttcactcgaaagcgaactaaacaccaacccattcctgcgtacggctgcacctaccatccatgcagcaacatctactcacctgcaacgaacaccaatagatgaagtagaagtattcgctacgctacgccactggaaaaacaacttc

SEQ ID NO: 33014 - DNA, 756 bp, Xylella fastidiosa
acaaccccagtcaaaattgctacacgtaaccttgagttctactacggtacgttccaggcactaaagcaaattaatttggaaattcctgaaaagcgtgtaactgccctgattggcccatcaggatgtgggaagtcgacgctactacgcattttcaaccggatctatgcgctatatccaaaactggagacacgcggcgaggtgttcttagacggcgaaaatatcctatcgccgaaatactcgataaaccggctgcgcagcaaggtaggcatggtgtttcaaaaacctgtgccattccccatgacaatttatgagaatgttgcctacggcatccgtcaccatgaggtgatgtccaaaagtcaaatgaatgaccgcgtcgagcaagcattacaacaaagtgctttgtgggaagaggtcaaggacaagttgaatcaaaatgcactgggcctgtccgggggccaacaacaacggctatgcatcgcacgcgcagtcgcactaacaccatcggtactactgcttgatgaaccgacttcagcattagacccgatctcaaccagccgcatagaacagctgattgaggaactaaaaaccaaatacaccatcgtgatcgtcacccacaacatgcaacaagctgcacgcgtatccgattacactggcttcatgtatctaggcgacctgatcgagcacgaccgcaccgaaaccatcttttcacggccatccaaacaacagaccgaagactacatcactggtcgattcggc

SEQ ID NO: 33015 - DNA, 1296 bp, Xylella fastidiosa
catacaggcattgcccctgccgaatatgggcgtcgtcgccgtcaattgatgaagatggttggtccccagggcatcgttgtgctgcctgctgcgcctgagcgggtacgtagccgtgatactcattatccgtaccgtcaggattcggatttttggtacctatgcggtttccccgagcccgatgcggtattggtgctggtgccagggcgttgccatggtcaagtcctgctgttctgccgcgaacgcgatcctgagcgcgaggcatgggatggtccacgttccgggtacgatggcgcaatcgagcagtacggcatggatgatgcgtatccgattgatgatttggacgaaatcttacccggtctgctcgaaggtaggtcccatgtctattatcatttcggtcgtgatgttgaatttgatctaaggttgattggttgggtcaatcgtgtgcgtgatcaggtgcgttacgctgcggattctccacacgagttcatagacctggggcatctgctgcatgagcagcgtttgttcaaatcttatgatgaaattgtgttgcttcagtgtgcagctgatatcagtgtcgaagcgcatcttgccgcgttgcgctatgcgcatcctggcgtctctgaatatgtgttgcaggctgagcttgagcgtgtgttccgagctgctgacagttgtccggcgtatacaagtattgttgctgctggcgctaatgcgtgcgtattgcattactgtgccaatgcggaatgcagtcgtgatggggatttagtgttgattgatgccggtgcagagtaccgcggttatgctgctgacattacccgtacttttcctgtcaacggtcgtttcagtcctgcccagcgtgcgctatacgatctggtcggtgctgcttatgatgtcgcattagcccaggcgcggcctgggttgccatatgaggctggtcatttgtctgcggtgcagacattgactgaggggttgctgcggcttggtctgttgcatggcacgttggaggataatttggctgatcagagttacaagcgcttttatcgtcacaagactgggcattggttgggtttggacgtgcatgatgttggtgactatcgcattgatggtaagtctcgattacttgagcctggcatggtatttacgattgagccagggttatacgttcttccggacgatacgactgtccacccgaagtggcgcggcattggtatacgtaccgaggatgatgtattgattacggaagatgggcattgtgtgctgacaggcgtgttaccacgctcagctgatgaaatcgag

SEQ ID NO: 33016 - DNA, 585 bp, Xylella fastidiosa
atcatggaccattccaaacaacaaaacgcatccatcacccaagctcaggcagaagaggccgtacgcacacttctacgttgggccggcgaagatcccactcgtgaaggcttgctcgacacaccacgccgtgtcgttgaagcatacggagattggttcagcggttaccgcgaagatcctcatgactacctgcaacgcactttcgaggaaatctccggctacgacgagatgatcgtactacgtaacattacctatgaaagccactgcgaacatcacatggcacccatcatcggtaaagttcacgttggatacttaccaaacggcaaagtcgtcggcatcagcaaattagcacgcgttgttgaatcctatgcgcgccgcttccagatacaggaaaaaatgactgcgcaaattgcagcatgtatccaagacacattgaccccacgtggcgtcggtgtcgtgattgaaggtgcacacgcatgtatgactacccgaggtatacacaagcgtggtgtatcaatggtcacctcaaagatgctcggcaccttccgcgaagacgcacgcacccgcgccgagttcttacagttcatc

SEQ ID NO: 33017 - DNA, 924 bp, Xylella fastidiosa
cttgagcggattggcattaaaagcgatgtcttcgccgatattgtcggcatcaatgcacgccggttgtggaataccaacgtacagacctctgatgttgcaacgatggcagcgcgtaaagcattgcaggatgcaggggtggctgtggaccgtatcggcttggtggtcaacacttcggtgagtcgcgattacctagaaccgtccactgcttcgattgtctccggcaaccttggtgttggcgagcaatgcattgccttcgatgtggccaatgcctgcctggccttcctaaacggcatggacattgcgggacaaatgctggagcgtggggacattgattatgccttggtggttaacgccgagactgctaaccgtgtttatgaaaaaacgcttgagcggatgagtgccccaggtgttaccgagcaggagttccgcgaggaaatggcggccttaaccctggggtgcggtgcggtggcgatggtactggcgcgtaccgctttggtgcctgatgcacctcaatacaaagggggagtgacccgctctgcgactgaatggaacaagctatgttgcgggaatctggatcgcatggttactgacacccgcttgatgctcattgaggggatcaaactagcaaagaaaacctttgttgtcgccaaacaagtgctgggttgggcggtggaagagttggatcagtttgttatccaccaggtcagccgcccacacactgaggcgtttatcaagtcattcggcattgatcctgccaaggtgatgaccattttccgtgagtacggcaacatcggccccgcttctgtgccgattgtgctgagtaagctcaaggaactgggccgtctcaaaaaaggtgaccgcattgccttgctgggtattggttcggggctgaattgttctatggcagaagtggtgtggtgattc

SEQ ID NO: 33018 - DNA, 1680 bp, Xylella fastidiosa
atgagtcaaacacgtccttggctgcaacactatccatcgggaatctcaacagagattgatactgacgctttccgtactatcgctgatgtcttcaatacatcagtcatcaaatatcgtcattgtcccgcctataccaatttcgggaaaacacttacctacggcgaagtcgatctattaacaaaacaattcgccagctatctgctcaatgtgttgaaactcaaaaagggcgaccgaatcgcactgatgatgctcaactgtttgcaatatccagtagcgaccttcggcgcactatgcgccgggttaactgttgtcaatgtcaaccccctctacacagcgcgcgaactcaagcaccaactggttgacgcagggagcactgtattggtggtcatggacaacttctgtacaactgtgcagcagatcattgctgacaccccaatcaaacaggtgattacgactgaattaggcgacctgctcgatttccccaaaagatcactaatcaattttgccgtcaagcacatcaaaaaattagtaccagaataccaactgcctcgctcaatccgcttccgtgaagcactcgcgctgggaagcaagcattccatgcctccaatccacatcgccagcgacgatttagcttttctacaatacaccggcggcacaacggggacacccaaaggcgcaatgctgacccacagaaatatggtcgcgaatatgcagcaggtgtcgcagtggctccaaacaagcaacagtctcaaagaaggctgtgaaacagtgctcactgctctaccgctgtaccacatttttgcgttaaccgcgaacagcttagtctttatgaaaatcggtggttgcaaccatctgattagcaatccacgcaacatgcgagcattcgtcaaagagttgcaacgcgtccgcttcactgtcatcactggagtcaacacactgttcaataaactccttaacaccccgggcttcgacaaacttgatttctcttctctgaagattgccctgggtggcggcatggtgatccagcgctccgtcgccgaacagtggaagcaagttactcatgttccgctgattgaagcttacggacttaccgaggcatcaccagcggcatgcatcaatccgctgaatctgcaagaacataacggttcgatcggtatgccgatccctagtactgatgtctgtattaaagatgacaccaacggcgtattacctataggcgaaatgggcgaactgtgtattaaaggtccgcaagtgatgaaaggctactggcaacgcccagaagaaacttcagaagtgttagatgcagacggttggctgcatactggggacattgtcaaaatggacaaacaagggtttctgtacatcatcgaccgtaagaaagaaatcattcttgtctctggcttcaacgtctatccgaaggaaatcgaagaagtcatcgcaatgatcccaggcgtggctgaagtcgctgcggtcggagtcccggacgagcagtccggcgaagtcgttaaggtagtgattgtcaaaaaggatcccatgctgaccgctgaggaagtaaaggcgcatgctgcgaccaacctgaccagatacaagctaccacgcatcattgagttccgtgcgacactccctaaaaccgatgttggcaagattttgcggcgcgaattgcgagacgcagcaccggca

SEQ ID NO: 33019 - DNA, 2703 bp, Xylella fastidiosa
atgcgcgattcgttctccacccatcgtcaattacacgtcgggaaccagtcttaccactattacagccttacgaaactgggtgagcacttcgacatatcgcaccttccctactcaatgaagatcttgctggagaatctgctccggcatgaagacggcggcgtcaccgtcagcaccgcgcatattgaggcagtgaccaaatggaatcccaaagccgagccggacaccgaaattgcattcatgccagcccgtgtggtgctacaggacttcaccggagttccctgcgtagtcgacttggcagccatgcgtgacgcagccatcagactcggcggcaccgcagagcagatcaacccacacatcccatcagaacttgtcattgaccactccgtacaggttgacgtttttggcaaaccggaggcactagaacacaacggcaacattgagttccaacgcaacaaagaacgttacggcttcctacgctggggccaaaaagcattcaacaactttaaggttgtaccgccgaataccggcatcgtccaccaagtcaacttagaacaccttgctcgcgtggtcatgacgaccgaaaaagagggcgccacctgggcctatccagacaccgtgttcggtaccgacagccataccacgatgattaacgggatcggcgtactcggctggggcgtcggtggtatcgaagccgaagcggcaatgctgggtcagccctcttcgatgctgatcccccaagtggtcggcttcaaactcactggcaccctccccgagggcgccacagccactgatctggtgctgactgtcacccagatgctgcggaaacacggtgtggtcggcaaattcgttgagttctacggcgacggtctggcgcatctgccactggctgatcgcgccaccatcggaaacatggcaccggaatatggtgccacctgcggcatcttcccgatcgacacagaatcattgaattacctacgcctgtcaggacgcagcgaatcgcaaatcgcactggtccaagcctacgcaaaagcacaggggctgtggtatgcacccaacaccccgcctcccagttacagcaccacgctggaactgaacatggacgacatcaaaccatcgttggccggtcccaaacgtccccaagaccgtgtgctactgcaagacgtgcaaaacaactaccgcgaacacgttcgcgcactgaccgcacatcgcaccaccaaagccaacgatcacgacacacaccccatcaagggacaagttgacctcgacatcaacggacaaactctgcaactcaaagatggtgccgtcgtcatcgcagccatcacttcctgcaccaacacctctaatccggcggtgatgttcggcgctggcctgctggcacgcaatgccgttgccaagggactgcaacgccaaccctgggtcaaaacctcgcttggccctggttcgcgtgttgtcacggactacctggagaaagccggcctgctcaacgatctggagacactcgggttctacgtggttggctacggctgcactacctgcatcgggaattctgggccactgcccccagaagtgagcgcaggcatcgccaagggcgacttggtagccgccgcagtactgtcgggaaaccgtaactttgaagggcgcatccatccagaagtcaaaatgaactatctcgccagtccagcactggtcgttgcctatgccatcgcaggcacggtcaatagtgatctgacctccgagccattgggcaatggcaacgacggacagccggtttacctgcgcgacatttggccaagcaacaaacagattggagatgccatcgccgccacaatcggtccggagatgttccaacagaactacgccgacgtgtttaaaggtgacacccgctggaacaccatcgcctcaccaaacggagcgttgtacgcctgggacgcccactcaacttacatcaaaaatcccccatatttcgatgggatgacgatgcaaacagagcctgtcaaggacgttcgcggcgcgcgcgtgcttggcctgtttgctgattcgatcaccaccgaccacatctccccagccggcaacatcaaacaggattctcccgccggacgcttcctgcaagaacatggcgtacagcctaccgacttcaacagctacggcagccgccgtgggcatgacgatgtcatggtacgcggcaccttcgccaacatccgcctcaaaaacctcatgctcaacggcgaagaaggtgggaacacatggtatcgcccccaagccggtgggccaccggagaaaatgtcgatctatgacgccgcaatgaagtacaacacagacggcgtcccgctggtggtaatcgctggaaaggagtacggcactggctcctcacgcgactgggcagccaagggaaccaaactccttgggattaaagccgtcattgccgagagtttcgagcgtatccaccgctccaacctcgtcggcatgggcgtactgccactgcaatttctcgacggccagaacgcacagacactgggtctggatggatcggaaatgttcgatgtgaccggtttggagggcactatcagcaaacatgccaccgtgagtgcaaaacaatccgatggcagcatcaaacagtttcaagtcaaggtcctactgctcaccccgaaggaagtggactacttcacacatggtggactgctccagtatgtgctgcgccatctg

SEQ ID NO: 33020 - DNA, 741 bp, Xylella fastidiosa
atgcgccccaagattgtggctgggaattggaagttgcatggtagccacgcgttcgcacaagcattggttgcgcaggtcgctgctggtttgccgctgcctggagtcagtgtgattatcttgccgccattgttgtatctgagtgatttggtgcagcgcttcaaaggggaaggtttggcgtttggtgcgcagaacgtcagtcaccatgataaaggtgcttacactggggaagtttcggcggcgatggtggctgatgtcggtgctcattacactttggttgggcattctgaacgtcgggagtatcaccatgaggacagtgagttggtggcgcgtaaatttgctgctgctctgagtgctgggttgcgaccaattctatgtgttggggagagtttgccccagcgtgaggctggacaggcagaggttgccattgcgatgcagcttgcgcctgtgttggatctggttggcccgcagggtgttgcccgtggcttgattgcctatgagccggtttgggcgattggtactggccgtcatgcggatccgagccaagttcaagcgatgcacgcttttattcgtggtgaaattgcgaggcaagatgctagaatcggcgattctctgttgattctatacggaggcggcatcaagccttgcaatgctgctgagttgttttcccagcaggatgtcgatggtgggttgattggtggtgcttcgttggttgctgatgatttcttggctatcgctcgtgcg

SEQ ID NO: 33021 - DNA, 1818 bp, Xylella fastidiosa
gtcaccattgaaattgatggccagaatttagttgtaccgaaaggttcaatgattattcaggctgcagataacgctggtattccgatcccgcgtttttgttaccacgagaagttgccaatcgcggccaattgcagaatgtgtcttgtcgatgtcgagaaggtgccgaagcctttgccagcttgtgctacgccggtgatggaggggatgaaagttcgcacccgcagtgaaaaagccctgcaatatcagcgtagcgtgatggagttcttgctcatcaatcatcccctggattgtccgatttgtgatcagggaggcgagtgcgagttgcaggatgtttcaatgggctatggtcgctcggtcagccgctttcatgagcgtaaacgcgtggtaccggatgaggacattggtccgttggtcgctaccgagatgacccgctgtattcaatgcacgcgttgtgtgcgttttaccgctgacattgctggtacctatgagttgggcggtatgtaccgtggagagaatctgcaaatcggtacttatgacggtaaaccacttattactgagttatctgggaacgtggtcgatgtctgcccggtcggtgcattgacgaacaaggtatttcagtttcgtgctagaccgtgggaattaatggcctaccagtcgttggggtatcacgatgcgatgggttccaacttatttctgcatgtgcgtcagggcgaagtgttacgtacggtgccgcgtgacaatgagtatgtgaacgagtgttggttgtctgatcgtgatcgttattcgcatcaggggttgtacgcggcggaccgtgcggtcaagccgctaaagaaggttggtggccagtggttagaagtgagttgggccgagggtgtgtccgctgccgttgagatcttgagtgcgcatcgtggcgatgcgcttggtgttttggtgcatcctgctacgtcgaacgaagagggggtattgttggcacgtctggcagcgggtctgggcaccggtcatctcgatcatcggatcttcaaccgtgatttttctgatgttgctgtggccgagccgtttgcattgccgttggcagagatcggcaacgccgatctggtcgtcttattcggaagcaacatacgtcaggagttaccgttgttgcatgcacgcctccgcaaagcggtcacttgcaacggcgccaaggtgtacgcggtaaatccggtcgattttgacttcaccttctcgctgactgggaagtccattgttcctccgtcgcagttagccaatgcattgaccgatacggcgttgctcaatgcgacgaaagcggctgcccgtgtggtgattgtggtcggtgcactggctgagaatcacccgcaaggagccacgttgcgggcggcggcgcgtcaatttgctgaggttacaggtgcggcgttgtgtcgcatcccgcaaggagcgaatgcgattggacttacccagcacggtgtgttgccgacaggtcgtgatgctgctgcgatgcttgtcgagccgtgtcaggcttatgtgttgtacggtattgagccgggcttggactttgccgacacggcgaccgcgcgtcaggcactgcatggtgccaaggtggtcgcgttcagtcatttcgcttgtgcctcaacccgtgatgtcgcggatgtcatcttgcctattggtttattacctgagattgatgggacattgactaatcttgatggtcgcactcaggcggctaagccaggcggcaaattaccgcttgaggcccgtgaggggtggcgtgtgctgcgtgccttgggaggtgagttggggctatccggttttgattttctcgat

SEQ ID NO: 33022 - DNA, 735 bp, Xylella fastidiosa
atgacccttcgcatcgcctacgtcaccagcggcatgggcagtatcggaactgcaatctgccagaagttggcacgcaacggccataccgtggtggctggctgtggccccaactcgcctcgcaaagctaactggctgcgtgagcaacgtgaacttggcttcgacttcatcgcctctgaaggcaatgctgccgattgggattcaacggtatccgcctttgccaaggtaaaagccgaggtcggcgagattgacgttttggtcaataacgccggtaacaaccgcgacatgctgttccggcaaatgggccgtgaagactggaacagtgtcatcagcagcaacctcaattcactgttcaatatcactaaacaagtcattgacgccatgaccgcgcgcaattggggacgtatcgtcaacattggttcggttagcgcgcacaaaggtcaaataggccaagtgaactacgccactgcaaaagccgcaatgcacggcttcacgcgtgcacttgcacaagaagtcgctacccgcaacgtcaccgtaaataccatttccccagggtatatcgccagcgctgcaatcagcagtttccccccagatgtccttgaccgtctcgccaactcagtaccaatgcggcgcttgggcaaagccgaagaagtcgctgggctatgcgcttggctggtttcagatgaagctgcctacgtcacaggtgccgactacgcagttaacggtggcttacgcatg

SEQ ID NO: 33023 - DNA, 1269 bp, Xylella fastidiosa
cctttttatttacagttgtatttctgggtgatcatcgcgattatcctgggggcgctgttaggccattgttatcctgctgtgggtcagcaactcaagccgttgggggatgcctttatcaagctggtgaagatgattatctcgccagtgatttttctgacaatcgtgacagggatcgctagcgttgcgcatgtggggacggtggctcgcgtatttggtaaggcgatggtgtatttccttttcttttccacgctagccttgctgctgggtttggtcgttgctcatgtggtgcatccaggtgcgggcatgaacattaatccagtagatctccatcagggggagatcgcaaattatgtggagaaatcacacgatttgacgttggttggctttttgatggacatcatcccgaagacactgttgagtccgtttgttggggacaatattttgcaggtgttgtttgtggcagtgttgttcggtattgcgttggcgcttgctggggaacgtggtaagcctgtgctcaatttactggatgcgttgaccgtaccagtattcaagcttgtccagatgttgatgaaaatggctcctatcggtgcattcggagcgattgcgttcacgattggtaagtatggagttgattcattggtgaatttggggtggttggttggctcgttctatctcacttctctgttgtttgtgttggtgattttgggtgccgtgagttggttgtgtggtttttcaatattaaaactgattcgctatttgaaggcggagctgttgctggtgttggggacttcgtcttcggagtcggcattgccgtcgctaatggaaaagatggtgcaggcggggtgtagaaagtccgtggttggactggttgtgcccactggttactcttttaatctggatggcaccaatatttatatgacgttagcggcgttgtttattgctcaggcaaccaacacggagctgacgccagcgcatcagcttgctttgtttttggtggcgatgttgagttctaaaggggcggccggtgtgtccggtgctggttttattactttggcagcaacgttggcggtggtgccggaagtgccgattgcgggcatggcactaatcctgggtgtagatcgctttatgagtgagtgccgctcactgaccaattttattggcaatgcagtggctacgctggtagtttcgcgttgggagaatgcgttgaactatgagcagctcaaaattgcactggatggcagtgaagctgcataccagtcactacatgcc

SEQ ID NO: 33024 - DNA, 1887 bp, Xylella fastidiosa
ctcgaagcagacaaacagacccacggcttccaaacggaagtcaaacagttactgcaactgatgatccactacctgtactcaaacaaggagattttcctacgcgaattaatctccaatgctgccgatgctgcggacaaactgcgctttgaggcattgagcgccccctcattactggaagaagatcccaacctgcgcatccgcgttgagtttgataaacaagcacacaccatcaccattgatgacaacggcattgggatgagtcgtgatgaggccattgcacacctgggcacgattgccaagtcaggcaccgcggatttcctcaaaacactgtctggcgatcaacgcaaagacgccaatctcattggccaattcggtgtcggcttctacagtgcctttattgtcgccgaccacgtcgacgtctacagccgccgcgccggactgacagcagccgagggcgtgcactggtcgagcaaaggtgaaggcaactttgaagtggccaccattgataaaccgcaacgcggcacccgcgtcgtgctccacctgaaagaaaatgagcaacactttgcagaaggatggaccctgcgcagcaccctgaaaaaatattccgaccacatcggcctccccattgaaatgctcaaggaacaccacggcaaggaggaagaaaaagacaccccccaagaagccgagtgggaagccgtcaacaaagccagcgccctatggacacgccccaaaaacgacatcaaggatgaggaataccaggaattctacaaacacatctcacacgatatgaccaacccgctcgcctggagccataacaaggtcgaaggcaagctggaatacacctccttactctatgtcccaacacgcgcaccatttgacctgtaccaccgcaatgctgccaagggactgaaactgtatgtacaacgtgttttcatcatggatcaagcggaacagttcctgccgctctacctgcgtttcatcaagggcgttgttgactctgccgacctctcgctgaacgtctcccgcgagatcctccaatctggcccagtcgtggactccatgaaagccgcactgagcaaacgcgccctggacatgcttgaaaaactcgccaaagacgccccagaagattacaaaaccttctggaaaaactttggccaggtactgaaagaaggacccgccgaggattacagcaaccgcgagaaagtcgccagcctgctgcgctttgcctcaacctacgacacctccggtgatccctccgtcgcactcaccgattacatcgcacgcatgaaagaaggtcaggacaagctctactacctgaccggagaatcctacgcacaaatcaaggacagcccatacctggaagtattccgtaaaaaaggcattgaagtactgctactggtagaccgcattgacgagtggttgatgaactacttacatgaattcgacggaaaatcctttgtcgacattgcacgcggcgatctggacctcggaaacctcgacagcgaagcagacaaaaaagcacaagaggaaatcgcaaaaacaaaagaagcattagccagccggatcaaagccacactaggagaagatgttgccgaagtgcgcgtctcacatcgcctgaccgattcacccgcagtactcgccatcggcgaaggcgatctcggcctgcaaatgcgtcagttactcgaagctaacggccagaaagttccagaaacaaaacccgtcttcgaattcaacccaagccacccactcatcgagaaactggacgccgaacaagacatggaccgttttgcggacctgagccacatcctgttcgatcaagccgcactcgctgccggagacagtttgaaagacccggccaactacgtgcgccgcctcaacaaactccta

SEQ ID NO: 33025 - DNA, 996 bp, Xylella fastidiosa
acgatggccttgaaacactttttgaatacccaggactggacttgctctgaacttaatgcactgctgacccaagcacgcgcgttcaagcacaacaaactggggaacgccctgaagggcaagtccatcgccttagtatttttcaacccatccatgcgtacccgcagcagctttgaactgggagcatttcagttgggcggtcacgccatcgttttacagcctggcaaagatgcctggccgattgagttcgataccggcaccgtgatggaagcagagaccgaagaacacatctgcgaagttgccagagtcctgggtcactacgttgacctcatcggcgtgcgtgcgttcccgaaatttttagactggacttacgaccgccaggacatcgtactcaacagctttgccaaatattccccagtgccggtgatcaacatggagacaatcacccatccctgccaggaactggcacatatcatggccttgcaggagcactttggcaccacagacttgcgcggcaaaaagtacgtattgacctggacctatcaccccaaacccttgaataccgccgtggccaattccgcactgaccatcgcgactcgcttgggcatggatgtcaccttactgtgcccaacccccgattacgtccttgatgagcgttacattgattgggcgcggcagaacattgcagacactggcagcacctttcaagtgagccacgacatcgacaacgcctaccgtggtgctgatgtgatctacgccaagagttggggcgcactcccgttctttggcaactgggccatggaaaaaccgatacgcgaccaatacagacactttatcgttgacgaagccaaaatggcgttgaccaacaacgccgtcttctcgcattgcttaccactgcgccgtaacgtcaaggcgaccgatgcagtgatggatggatctaactgcattgccatccatgaagctggcaaccgcctgcatgtacaaaaggccatcatggcc

SEQ ID NO: 33026 - DNA, 1158 bp, Xylella fastidiosa
gtcttggccttctccggtggactcgacaccagcttttgcatcccctacctgaaagaacagggctatgccgtacacaccgtatttaccgacaccggcggtgtcgacgaagatgagcgcgacttcattgaaaaacgtgctgccgaattaggcgtagctagccacctcaccgtggatggcggcccttccatctgggatggtttcgtaaaacagcttgtttgggctggcgaagcctaccaaggccagtaccccttacttgtttctgatcgctatttaattgtggatgccgtactacagcgtgccgatgcactgggcacctgcgccgttgcccatgggtgtactggcatgggcaacgaccaagtccgcttcgacctggcgatcaaagcacagggcgactacaccatcattgccccgattcgggaaatccagaaagagcacacccagacccgtctgtacgaacaaaaatacttagaagaacgcggctttggcgtccgtgccaaacagaaaaactacaccatcaatgaaaacctcctgggcatcaccctgtctggtggcgagatcgacaaatgggaagccccgggagaaggtgcccgtggctggtgcgccccgcgcagcgcctggcccaccgaccccctcacggtggctatcaaattcgtcgaaggcgaagccgtcgccgtagatggaaaacccctttccggccctcagattctgatgaaactcaacaaactcttcgcctcctatggcgtgggacgcggtatttacaccggcgataccgtcattggcctaaaaggccgcatcgtatacgaagcccctggactcaccgcactgctgaccgcccaccgtgccctggaagacgccgtgttgaccaaacaacagaaccgcttcaaaccgcacatagcccgtaaatgggttgaactggtgtacgaaggatttttccatgaccccttgaagactgacctagagaccttcttaaaatcctcccaagccaaggtgaatggtgaaatcgtccttgaaacccgaggtggtcgagtcgatgccgtcgcagtacgctcaccgcacatcctcactagcaaaggcgtcacctacgcccaaaccgctgactggggtattgaagaagccgaaggatttatcaaactctttggcatgagctccaccctatac

SEQ ID NO: 33027 - DNA, 2303 bp, Xylella fastidiosa
cccgggcgcgttcgtcccccaaccaccgccaatccaatgcacgccaacctacagactcgacagatcatcatccgcctgctgtcaagcatggcgagcgccaaggaaattagccaatacctcaagcgattctcccaattggatgcaaaacgctttgctgtcgtcaaagttggcggcgccgtgctgcgcgatgatgtggacgcactgacctcttccctctcattcctccaagaggtgggactcaccccgattgtcctacacggcgccggtccccaattggacgaagaactcactgctgtcggcattcaaaaaaagaccgtcaacggcttccgtgtcaccttgccagagacaatggccatcgtccgtaaagtgtttcatgccaccaacctccaactcatcgaagcattacagcgcaacggcgcccgcgccacctccatcaccggcggagtatttgaagcacactaccttgaccaagaaacctacggccttgtgggcggaatctccgccgtcaacatcgcaccgattgaggccagcttgcgtgccgcctctattcccgtcattgccagccttggcgaaactcccagcggccaaattctcaacatcaatgccgatgttgccgccaatgaactcgtacacgtcctccagccctacaaaatcatctttctcaccggcacgggcggcttacttgatgccgatggaaaaatcattaactcaatcaacctatccaccgaatacgaacaactcatccagcagccctgggtctatggcggcatgaaactcaagatcgaacagatcaaacacctcctggaccgactgcccctagaatcctcagtctccatcacccgccccgccgaccttgccaaagaactgtttacccacaaaggctccggcaccctgatacgccgtggcgaacgagtcatccgcgccaccacatggaaagacctagacctcccgcgcctccaacacctcatccaatccagcttcaggcgtaccctgatcccccattacttcgaaaccacccccttactgcgcgcctatgtcagcgaaaactaccgcgctgccgtgatcctgaccaagctgggtaacgtcccatacctagataaattcgccgtattggacgacgcacagggagaaggcctcggccgtgccgtctggagcatcatgcgcgaagaaacaccccaactcttctggcgttcccgccacaacaaccaagccaatgctttttactacgccgaatccgatggctactacaaacaagaccactggaaaatcttttggaatggcctacatcacttccaacagatccaacaatgcgtcgcccactgcacccaacatcccccaaccctgatcgattgaagatgagcaccgccaccttcacccttggcattgttggtgcccgcggctacaccggcgccgcattgatcacccttcttactgcccaccccgcgattgaactcatctttgtttcctcgcgtgaataccatggccagcccgttgccgcacacaaccccacctactgcggtgatctgcgttttgaaaccctcggcccggctgccgttgctgccaaacgtgcagatgtcgtcatcctcgccctacccaatggcaacgccgccccttacgtacacgccattgatgccaccgcaccccccaccatcatcatcgacctatccgcagatacccgctttgacccagactggtactacggcctccccgaactgacccgacacacctacaccggacagaaacgcatcagcaacccaggctgctacgccaccgcaatgcaactagccatcgccccccttcgcgaccaactggctggccccccgcagtgctttggcgtctccggctactccggtgctggcaccaccccctcagacaaaaacaaccaagccctactgcgtgacaacctcatgccatacgcactcaccgaccacctgcatgaacgtgaagttagcgcccaacttggtatccccgtcgaattcatgccccatgtcgccccccactttcgcggcatcaccctcaccgccaacctctggttacaacgccccctgacccgggaacacatcaagaccctctacgcaacccgttatgccaacgacccactgatcgacatcatcgacccacccccctgggttaaccagattgccgcccgccataccgtacagatcggcgccttcaccatggcaccgggcaacaaacgcgttgtgatcgtcgccaccttggataacctcctcaaaggcgccgccacccaagccctacagaacctcaaccgcgcacttggcctggacgaactgaccgccattccc

SEQ ID NO: 33028 - DNA, 1191 bp, Xylella fastidiosa
gcgatcgacgccagcatccaaaccttcctggcagccgatgatgtccttctggaccgcgaattcttcctctacgacatcacagccagcacagcccatgcccaagcattacagcgcatcggcctcctcacccccgacgaactcgacaacatcctccgagaactgcaacacctcagcgacgaataccgcaacggcaccttcctcctagatacacagtacgaagacggccactccgccattgaatcccgcttgaccgaacgcctcggagacaccggccgcaaaattcacaccggccgcagccgcaacgaccaaatcctagtcgccacccgcctatggctgaaagaccgactcacccaactgagcaccttgaaccgtgacattgcccaccatgcattacagcgtgccgctgccgaacaacacctccccatgcctggctacacccacctgcagcgcgccgttgtctcatcggccggcatgtggtgggcaggctgggctgaatccttcatcgacaacgccctacgcgccgccgataccctcgccctgatcgactgcaaccccctcggcaccgccgccggctatggcgtcaacctccccctggatcgcccccacaccaccactgcactgggctttgcacgcctccaagtcaaccccatctgcgcccaactttctcgcggcaaatttgaactggccgcactcgaagcactcggcagcgccaccttagacctccgccgtatcgcctgggatctctccctatttaccaccagcgaatttgcattcatcaccctgccgcccgaatacagcaccggcagctccatcatgcccaacaaacgcaacccagacgtcatcgaactcatgcgcgccacccatgccagcgttgccgccgcccgcaccgaaatcgaacaactcctctccctcccgtccggctaccaccgcgaccttcagaacagtaaaggcgccatcgtccgcggcttcaaccgcggcctggccgccttagaactcttacccgcactcctgtcccgcctacagtggtgcccagacaccctccgtgccgccattgatcccggcatgtatgccaccgatgccgctattgaagccgcaatcgccggcatccccttccgtgacgcctaccagatggccgccaaaaccgctgacaccgccgcccaagaccgcaccccagagaccagcctcaccgca

SEQ ID NO: 33029 - DNA, 1233 bp, Xylella fastidiosa
atccgacaccttgcccaacaatgccgcgacgccgcccgcatcttggcgaccttatccaccgacgccaaacgccgcctccttgaaacaatggcgaccgccttgaacaccgatgctgcaaccatcctcgccgccaatgctgccgacctcgacgccgcccgcacccaacaggttggcaccgccatgctcgacagactcgccctagacccccaacgccttgccgccatggccgatgccttacgtgacattgccgcattgccggaccccgtcggccaagtgacccgcgacgaccggcgccctaacggcatccatatccaaaaaatccgcgtcccactgggcgtcattgccatgatctatgaagcaagacccaatgtgaccgccgatgctgccgcactctgcatcaaagccggcaacggcatcatcttgcgtggcggttccgaagccatccgctccaacatcgccattgccaccgcactacagcgcgccttgcgcctcgcctcactgcctgaaaccgccctgatcctcgtccaagacatggcgcgccacaccatgctggaactcctacaactcagcgacctcattgacctggtgatcccccgtggtggtgaaggcctcatccgcttcgtggccgaacatgcacgcatccccgtcattaaacattacaaaggcgtctgccatcagtttgtcgatgcctcagccgacatcaagatggcaatacgtctgctgattgacggaaaaaccacccgtcccgccgcctgcaacgccctggaaaccttactcgtccataccgacatcgccccacgcttcctccctgccgccgccgctgccttacgtccctatggcgtccaactgcgtggtgaccacgccacctgcaccttgcttcctgatgtgctcttggccacggatgccgactacgccgccgaatatctcgacttaatcctcgcaatacgtattgttcccaacttagatgccgcacttgaacatattcgccgctacggctccgatcacaccgaagtcatcgtcaccgccgaccccgcacatgccgacaccttcgtacaacaactgcattccgccgtcgtcatggtcaacgcctcctcgcgtttttccgatggtggcgccctcggactgggcgcagagattggtatttccaccacacgactccatgcctatggccccatgggattagacgcactcacagtagaacgctttgtcgtccgtggccaaggccaagtccgc

SEQ ID NO: 33030 - DNA, 960 bp, Xylella fastidiosa
ctaagccttccccagattcaatccttcgcagcatcagacatggctgcaatcgatacgctgatccatgaccgcctgacctcagacattgtgctgatcaatcaaattgccgatcacatcatctgctcaggtggcaaacgcctgcgccccatgctaacgatgttagctggccacgccatcggccacacaggccctcatcaccaccaactggctgccatcattgagttcatccacaccgccacactgctacatgatgatgtggtcgacggatcggaactgcgccgcagtagcagtaccgcaaatgcactatggggcaatgcacccagcgttctagtcggtgattttctatattcgcgcagcttccaactgatgaccgaattagccaacctagaagtcatgcagatattggctgaaaccaccaaccgtatctctgaaggcgaagtactgcaattgttgcacgtacacaaccctgataccgacgaaactacctacctaagcgtgatcgagcgcaaaacggcaatattgtttgctgccgcagcacaactcggagcactcgcatcccatgccgatacgcagacacagacacggatgtacgaatatggaatgcaattgggctatgcattccaaatcaccgacgacgtactcgactacaccgccaacaatagccaactgggcaaaaatctcggtgacgatctcgccgaaggcaaagccaccttaccagtgatccatgcgatgacacactcagacgcagccacatgtgaacgtttgcgcatgatcatcagcaaaggcgatagcgatgcaatgccagaagtgctgaacgcgatccgtacaactggcagcttggactacagtcggcaacgcgccagcgcgtatgcggcgaccgccgaacgcgcactagagggcctgcccgaaaccgaagcagttgccgcgttgcgcggcttggcccgctacgctgtccaacga

SEQ ID NO: 33031 - DNA, 1694 bp, Xylella fastidiosa
atgaatgtgcgcctccagggccacggcgcagcacgaggcactgcactggggcgcgcctgggtccgtcagatgaacatcatcgaaatccaggataaatacatcactgacactaacgccgaattacatagcttgtaccaagcaatgagcgcagcacgtcaggaaatacaagtactgcgagaacgcatgcatggcaccttgtcccacgaagtcggcgagtttctcgacctatacacactgttgatcgacgaccctgagctactacggagcctgaacgaactcatcctcactcacaactacagtgccgaatacgccctgaaaatacagcgcgaccgcctcaccacagaattcgaagccatggaagaccactacctgaaaagtcgcatggacgacctgaatcacgtgctaggacgcatccacgcctttctaaaaaaacactcccccgaacccaaagatgctgcaggtgaaatcctcatctgcaacaacatcgccccatccgaattggcccaagtacaagcccaaggcattattggaatcgtcatcgcggctggcaatacactctcgcacagcgccatcctggcgcatagcttgcacctgccactgatcgttggtgcaggagagctgctgctacaaaagatcaccaacggcgacatgctgatcatcgatggcaacagcggagaaatcattgtcaatccatcgccacaagacctgcgtcactaccatagccgactgcgcgaacgcgccaaagaacaacgtgagctggaacaactacgctctaaacacagccgcactcgcgacaacgtcgacattgtcgtacaggccaacgcagaatcaccggacgatgtctcccaagcatacgcactgggcgcggccggtgtgggcctgtaccgcactgaattcctgtttctgcaacgcaacaaactgccggacgaagaagaacagttccaaacataccgcgacactgtactacgtatgaacggacgcccagtcaccatccgcacattagatctgggtgcagataaaaccgactgtaccggcctgactctcagtaacgaagaaaacccagcaatgggcctgcgtgggatacgcctgtcgatggcacaccccgcagtggccaacacacaattacgagcgatcctgcgcacctccacctatgggcatgtccgtatcttggtccccatgattagctgccgagaagagatcatccttctacgcaagcagatcaaagcgctcagcatccaattgcgcaccgaaggccacgacattgccgagcaggttcccctaggagcgatgatcgaagtaccagctgcagcaatcgcactcaacagctttatcaaagaaatcgacttcctatcgatcggtaccaacgacctggtccaatacctattggccgccgaccgcaacaatgcggcaatcagcgaaatatactccccactccaccctggcgtcctggcagtactggctcagatcatcgtcaccgcacatacacatgccacccctgtcgccatctgcggtgaaatcgctggcgatgcacattacgtgcccatgcttctggcattaggtctcacagaattcagccttcacccggccacattacttgaagtacgccgtgtaatccgcaacagcgacctgggcacattgaaaacaagtgtaaccacactgctccgcgcacgcgaccggaagagcatcgaagaatg

SEQ ID NO: 33032 - DNA, 1272 bp, Xylella fastidiosa
atgtcaaaaattgtagttgctggtggtaccccgctatatggggatgttcggatttccggtgccaagaatgctgtccttcctattttatgtgccacgttgctcgctgatgcgccggtggagatcagcaacgtaccctatctgcatgacgtgatcactatgatcaatttgcttcgtgaattgggtgcgggtgtcaccatgaatgaaggcattgaggcgaaaggacgttcgattacgattgatccgcgttgggtacgtcagcgcgtggtgccgtatgacttggtgaagaccatgcgtgcttctgtgttgctgttgggtccgttattggcctgctatggtgccgctgaagttgcacttcctggggggtgtgcgattggttcacgtccggtcgaccagcacatcagaggattgcaatcacttggtgcggagatcacggttgagaatggctacatcaaggcttctgtcagtcagggtcgattgaagggcggtcgtttcgtgttcgacgtggtgagtgtgacaggcactgagaacctgttgatggctgcagctgtggctcaggggacgagcgtcattgagaatgctgccatggagccggaggttgtcgatttagccgagtgtttgatcactctcggtgcgcgtgttgagggtgctggtaccccacgtatcgtggtcgaaggggtggaaaggttaaatagcgggcagtatgcagtgttacctgaccgcattgagacgggtacttttttggtggctacagcgatgacgggggggcggattagtatgcagcaggtgcgcccgcagactctggatgcggtgctgggcaaactgaccgaggccggagcgtgcatcgaaataggtgcagatagtatccgtttggatatgcaggggcggcgcccatgttctgttaatctgacaactgcaccttatcctgggtttcccactgacatgcaggctcagtttatggcgctgaattgtgttgcagaaggtgtcggtgtgatcaaagaaacgatcttcgagaaccgtttcatgcacgttgatgaactgttacggctcggcgccaaaattcagattgagggccataccgcgattgtgcagggcgtcgagcgattgagcggtgcaccggtgatggcgactgaccttcgcgcctcggcctcattgattctggctggtttggtcgcggagggggaaacaatcattgatcgcatttaccacctggatcgtggttacgaaaacattgagagaaaactcggagtgctgggtgcatcaatccggcgtatg

SEQ ID NO: 33033 - DNA, 1167 bp, Xylella fastidiosa
tcgctgtctcgttattatttgccggtctatcgtccatgccaggtggtgttggtgcgtggtcaaggcagccgtgtatgggatgagcaggggcgcgattatcttgatctggctgctgggattgcggtgtgttgtttggggcattgtgatccggatttggtcgctgctttggtggagcaggcaggtcgtctgtggcataccagcaatgtgttttatagcgagccgtcgttgcgcttggcgcaggagttggtggatgtttcacggttcgctgagcgggtgtttctttgcagttccgggactgaagccaacgaggcggcaatcaagttggtgcgtaagtgggctgctgcgcaggggcgtttaccggagcatcgtacgattgtgacgttccgtggcagtttccacgggcgtactttgggtgcagtgacggcgacggcgcagcctaagtatcaggagggctatgagccgttgcctggggggttccgctatgtcgatttcaatcatattgaggcgttggaagcggcgatggtcggtggtgatgtcgctgcggtgatgttggagccgattcaaggagagggtggggtgatgccggtggtgtcaggatatttggcacaggtacgtgcgttgtgcgatcgctatggggcgctgttggtattggatgagattcagtgtggcatggggcgtactggggcgttgttcgcctattggcaagaaaaggtggtgccggacattgtgacgttggccaaggggcttggtgggggttttccaattggtgcgatgttggctggtccgaaggttgctgaggtgatgcagttcggggcgcatgggacgacgtttggtggtaatcctatggctgctgctgtggcgcgggtggcgttgcgtaagttggcttcggttgagattgccgccaatgtgcagcgtcagtcggtcgcgctacgcgctgggttggaagagatcagcgaggcattcggtggggtgtttacgcaggtgcgcggtcgcggtctgatgctgggcgcggtgttggcgccgctgtatgcagggcaagccagtgcgattcttgaggtggcggctgagcacggtgtgttgttgttacaggctggtcctgacgtgctgcgttttgtgccggcgctgaatgtgagtgatgaggagcttgccgatggtttggtccggtta

SEQ ID NO: 33034 - DNA, 2223 bp, Xylella fastidiosa
atgttcagcaaagatctcgagcaaacaataggccagtgctacaagcgaacgcgtgaggcgtgtcatgagttcatgaccgttgagcatctgcttctttcattgttggacaatccattggcgcacgctgtactgaaggcttgcggagcggatgttaccaggctgaagcgtgaccttgagcaggccattgaggtatctattacccgcttggatgccgatgacggccgtgatactcagccgacgcttggtttccagcgagtgctgcagcgtgctgtttaccatgtgcagtcttctggtaagaaggaggtgaccggcgctaatgtactggtggctatctttggtgaaaaggattcgcatgccgtctactttctgaatcagcaggacatcagccgactcgatatcgtcaactatttatcccacggtattacccgtatgggcgaggagagtgacatcgggcaagctgctgagaatgaggctaagggggaaagtgaggcgaataagggggatgctcttgctgaatatgctattaacttgaatgaacatgcacggaatggacgaattgatccattggttgggcgcaaagatgagattgaacgtacgatccaggtgttatgccgacgtcgcaagaataacccgctctatgtaggtgaagcgggcgttggtaaaaccgcaatcgctgagggtttggccaagcgtattgttgatcgtagtgtgccggaggtgcttgccgatgcggtgatctactcgttggatcttggcgctctggtggctggtaccaaatatcgtggtgactttgaaaaacgtctgaagggtgtgttaagtgtgttgcgcaaaacccctaacgtagttttgtttattgatgaaatccataccatcatcggtgctggttccgcttcgggtggcacgatggatgcgtctaatttgatcaagccagccttggcttcaggtgagttacgttgcattggttcgaccacgtttcaagagtatcgcggcatcttcgaaaaggaccgtgctttggcgaggcgttttcagaagatcgatatcgtcgagcctaccgcgggcgaggctttcgagattttacaaggactcaagcctaagtatgaggcacatcacggcgttacctatgctgatgacgcattgcgcgctgcggttgatttatcggtcaagcacatcggtgatcggttgttgccggataaggcgattgatgtgatagatgaggcgggcgcgcgtcagcgcctattgccggagaaagaacgcaaagagctgatcgatattgaggagattgagaccattgttacgaagatggctagggtcccggcgaagcaggtgagtgtgagcgataaggacgttttgaagcacctcgaacgcaatttgaagatggtgatctttggtcaggagccagcgattgagatgctgtcgtcggcaattaagttggcgcgcagtggcctaggtaatccggataagccgattggaaacttcctgcttgctggcccaacgggggttggtaaaactgaggtgactaaacaattagcacaccatcttgggatcgagttggtacgttttgacatgtctgagtacatggagccgcattcggtgagtcgtctgattggcgcgcctccgggctatgttggttttgatcagggagggttgctgactgagaagatcgtcaagactccacactgcgttctgctgttggacgaggtggagaaagcgcatatggatgtcttcaatattctcctacaggtcatggatcgcggtgtgttaacggataccaatggacgtgaggcgagttttaaaaatgtgatcctggtaatgacgaccaatgcaggtgcgtcccaatcttcacggcgtacgattggtttcactaagcaggaccataccagcgatgcgatggaagtgatttgtcgcagcttcagccctgagttccgcaatcgtcttgatgcgattgtgcagtttcagccactgggtttcagtcacattctgcgggttgtcgacaagttcatcattgagttggagatgttacttcaagagaaacgtgttgttttgtcggctacgccgattgctcgcgactggctggctcagcatggttttgatccgcttatgggtgctcgtccgatggcacgtgtgattcaagagaaaatcaaacgcccacttgcagacgaattgttgtttggtaagttgctcaacggtggtcgggtaggcattgatgtgcgtgacaatgagtta

SEQ ID NO: 33035 - DNA, 735 bp, Xylella fastidiosa
atgtcagatccctctaaagtcgctctgatcactggtggcgcacgtcggatcggcaaagcgatcgtgcatcacctgcatgcacatggttatcgcgtcgccgtccacgcacaccagtctggccacgaactgcatgcatttttaactgagctagaacgcaggcgtccatccagcacactcgcattgctcggagacctgcacgaaaacgcagtcccagaaacgctgatcgcacgctgtgctgggcatttcggacggctggacgtgctcatcaacaacgcctccaatttctatccaaccccactgggcgaagtgacaccagcacaatgggatgatttatttgcaatcaatgccaaggcccctttcttcctcgcgcaagcagccacaccactgctgcgcaaacatcgcggggcaatcatcaacctgacagatctacatggcacgcagccactgcgccaacatgctgtctataccgcagccaaagccgctctggagatgttgactcgatcactcgcactggaactggcaccgcaagttcgagtcaatgccatcgcacccggggcgatcctatggccaacgcaaggcatagcggaagcagcgaagcaggcgctgctggcacgcaccccattagcacgtaccggcacagtggaagagatcgccgaagcagtgctatggctactagaaagtgccaatttcatcaccggacataccctgcgcctggatggcggccgcacgctgaca

SEQ ID NO: 33036 - DNA, 1338 bp, Xylella fastidiosa
atgagggtgtccaggtattttggtaccgatggcatccgtggccgcgttggccaggggttgatttctgctgattttgtattgcgcctgggtaacgcgcttggccgagtgcttgctcagggccgtgatacccgtccgatggtgttaattggtaaggacacgcgtatctccggttatatgtttgagtctgctcttgaggcaggtttggtggccgctggcgctgatgtgcagttgatcggcccgatgccaacacctgcgattgctttcctgaccaatacgttgcgggctgatgctggtgtggtgatcagcgcatcccacaatcctcatgatgacaatggcatcaagtttttttccgcgatgggtgaaaagctcgacgatgcgacagaagcggcgattgaagcggcgattgaggcgccattcctgacggttgactctgaatatttggggaaggtcaagcgtacacgtgatgcaattggccgctatatcgaattcagtaaggcaagtgtgccgcgtggttttacgctgcgcgggttgaagttggtattggattgtgcgcatggcgccacgtatcacatcgcaccgatgctgtttcgcgaattaggtgcggagttagtgacgattggtgtcgatccggatggtttgaatatcaatgccggtgttggctctactcacttggagactctcgctgccacagtgcgtgagagcggtgctgatttgggcattgccttcgatggtgacggtgacagggtgctgatgacggatgcccaaggccggactgtggatggagacgacctgttgtatgtgctggcgcgtgcttggcgggctagtggtcgtttaaagggcacagtggttgggacgttgatgagtaactatggtttagagcaggcgttggggacccttgggatcccctttatacgtgcgagggtgggtgaccgttatgtgcatcaggcattggttgagagtggaggggtgctaggcggtgaggcatccggtcacttgttatgtttggatcgcgcaaccacgggtgatggtatcgtcagtgcattacaggtgttggaagtgttgcgtcatgaggggctgacgttgagtcaggcactgctgggtttacataaggtgccgcagaagacggtcaatgtgtgttggtctggtccagccagggctgcagtcgagatgccggaagtacgtcaagcattggtcgaagcgcaagcggcggtacagggtcggggacgggtgtttttgcgcccttccggcaccgagccggtggtgcgtatcaccgtcgaagccgatgacgtcgtactcatgcagcagacgcttgataggcttgccgatgtggtccgtgac

SEQ ID NO: 33037 - DNA, 813 bp, Xylella fastidiosa
ttgcattttaccaagatgcaaggggctggtaatgacttcgtcgttttggatttgcgtgatgggacgccgccaccggatgcggcgttggtcgcttggttggctgatcgccactttggtattgggtgtgatcaggttatcgctattgagccgccgcgtggtgtcggggtgtttgccgcttaccgtatctggaatgcggatggctctgcggcgcagcaatgtggtaatggtgcacgttgcgtcgctgcttggttggtgcgtgatggttccgttgcgaccgagcatttcttgattgacagtccggtacagacgcattcggttcgctgcataggtaaagatgagtatgcggtggagatgggtctgccagtgttcgagcctgagcgtattcctttgtctggatttcccaatgccttgggagagtatgtgttgtcgctacagggtgaggtgctgcgttgtggtgcggtatcaatggggaatccgcatgcagtggttgagatcgatttgattgatgtggcacctgtcgaacggatcgggccgctcttgcagcagcatgctgcgtttccggagtcagtgaatgtcggttttgtccaggtgattgatcctggtttggtacggttgcgtgtgtatgagcgtggtgctggagaaacgttggcgtgtggcagtggtgcttgtgcggcggcagttgtgctgatgcagcgtggcagggttggacgtgatgtgcgtgttgttctaccagggggcacgttgcgtgtgcagtggccagtttccggtgggccagtgacgttgtctggtccggcaaggtgtgtgtttgatgga

SEQ ID NO: 33038 - DNA, 922 bp, Xylella fastidiosa
ttcagagtcgccacaggcctagactcaatggtcctcggggaatcacaaatcctcggccaagtcaaggattcctggtccatggcacgcacccacggcacccttggcaacacacttgaccggctattccaacatagcttctccgtcgccaagcacgcacgcaccaatacacggattggcaccaacccagtctcaatagcctcaaccgcagtgcgactagcacaagacgccttctccccgctgaacgaatcgaccgtattgctcatcggcaccggcgagaccatccaactggcagccaaacacctgagcgaaggacgagtacaacgcctgttaattgccaaccgcacccacgccaagcgcagatgctggccagccagcatggtggctacgcactccccctgaccgaactaaacctccaccttgccgaagccgacatcatcttctcggccactgccgcacctacccccatagtcacccaatccaacgtcgaaagcgcactacacatccgaaaacgaaaacccatgctgctatttgacctagcaataccacgcgatatcgagaccgaagtaggaacactcaccgacgcctacctatacaccattgacgacctggagcgcgccgtggaagaaaaccggcgcagccggcgcgaagcagccgaaaccgctgaggccatcattgaattacaagtgaaacgctacatggatacacttcaagcgcatgcacaccaagccccactacggcgcctacgcaccttcggcacaacgacccgggatgaactgctgacacgcgcacggcaacaactagcaaacggccgtcccgccggagaagtcctggaacaacttgcccatggcctgaccaaccgcctgttacaccctccaactgccgcactgcgcgaagccgcactcgccaacaacaccgagctagt

SEQ ID NO: 33039 - DNA, 1005 bp, Xylella fastidiosa
tattcccttttccgtcccctcctgttcacctgcgacacagagcgtgcccatgacatcagcctgcgcaccttagatatcgcctaccacagtggagcattacctctactgacacgtcacacacgaccgttacccaccacagccttcggtctgaactttcccaaccctgttggcttagccgccggactggacaaaaacgggactcacattgacgctctattcgccttaggctttggctttattgaaatcggtaccaccaccccacgtccacaagcggggaatcccaagcctcgccttttccgcctgacgcaacaacaagcagtgattaaccgcatggggtttaacaacctaggtgtagatgcgctggtacgtaacgttgcaggcgcgcggcgacgcaacggcccgcttgggatcaacattggcaagaacaaagacacccctaacgaacaggccagtaacgactatcggtattgtctggaacgggtctatgcactggcagactatgtcactatcaatctctcctcaccaaatactgctggtctacgagcgctgcaagaggaacagacattgcgtcgcttgatcggagaattacgtgaaacacaagaaacgctggcagcgaaacacggccggcacgtaccgatgctcatcaagatggcaccagatctcagtgacagcgacattgatgcagcagcacgtgtactcaacgagatgagcgtagacggagtgatcgccaccaataccaccgtgacgcgcccgctcctaagacaacatccgctggcaagcgaagcgggggggctgtccggtgcacccctactgggacagtccaccttggtgctacgtcggctacgtacccacttacctgaaactattgatctcatcggcgtgggcggcatctgttgcggtgccgatgccggcgccaaaatggctgccggtgccagcctagtacagtgctacaccggattgatattcaaaggcccacagttggttggagaatgcgtggaagccatt

SEQ ID NO: 33040 - DNA, 861 bp, Xylella fastidiosa
caaatggtcgacgtgttatacaccaagaacattgaaatgacccgacaaaagccttccagcggcccaggcttttggtctctagtattgaatttcctaccagtcatcctaatcattggattctgggtttcatcatgcgccagatgcaaggtggtggcgctaaggtgctatgtcgtttgggaaatcccgtgcaaaattgcaaggcgatgaccagatcaaaatcacttttgctgacgtcgccggttgcgacgaagccaaagaggaagttggtgagctggtcgattttttgcgtgaccccactaaattcaccaagcttggcggcaagattccacgtggagtcttgatggtgggtcctccaggcaccggcaagacgttattagccaaagcaatcgctggggaagcaaaagtacctttcttttcgatttctggatctgacttcgtcgaaatgtttgttggcgtcggtgctagccgtgtccgtgacatgtttgagcaagccaaaaagcatgccccatgcattattttcatcgacgaaatcgacgcggtaggccgtcatcgaggtgcaggcttaggcgggggccatgacgaacgcgaacaaactttgaaccagctcctggtcgaaatggacggctttgaaggcggtgaaggcgtgattgtgatcgccgcgacgaatcgtcctgacgtgctcgaccctgcgctgctgcgctcaggtcgcttcgaccgtcaagttgtggttgctctaccagacgttaaaggccgtgagcagatctctaggtgttctatatgcgtaagttactgttagccaatgacgtcgagccgtctcgtgattgcacgtggaactctctggtttttctggatatgacttag

SEQ ID NO: 33041 - DNA, 861 bp, Xylella fastidiosa
  unsure (1)..(861): unsure at all n locations
ttaataaaattcaaacccacttctccaggtcgccgttctgctgcacgcgtggtcactccaaatattcataagggatctccgcacgcttccttgttggaatcgcaaagtaaaactggtggccgtaatcatcatggtcgtattactgttcgtcacataggtggtggttgcaagcagcgctatcgtgttatcgattttaagcgtgataaagaagctattcctgctcgtgtagagcggatcgaatatgatcctaatcgtactgctcatattgctttattatgttacattgatggcgagcgttgctacattatcgctccgaaggggttaaaggaaggcgataaaataatttctggcccgaatgtgcctattaagcttggtaattctcttcccctgcgtaatatccctgttggtactactgttcacgctgttgaattgaaaccaagaaaaggtgcccaaatggcgcgttctgcgggttcttctgttcaattggtcgcgcgtgaaggtgtatatgcgacgctgcgtttgcgttctgggggaaaatgcgttagagtggctggtctgagttggtcnngagccactaatctggtgaantggttggtatnatgaagaaaactataattnntgcggaaatctnntggtaaggggctggtgtnctaaaaggggtggtcttgggggttnctgtcctactggtgtcgtggntgtcnntgctatgaannntcctgtttgatnctatcctcanntggtggcggtgaagctaagtcaggccagggtaatcctcatcccgttactccttggggcgttcctactaaaggttataaaacgcgtaaaaataagcgtactcagcaattcattattcgtggtcgc

SEQ ID NO: 33042 - DNA, 666 bp, Xylella fastidiosa
gcgcgtaggccgaaagatcctgctattttggctgagcgttcaggggtgataagttttggtaaagacaccaaaggtaagcagcgattgattattaaagatgccgatggaagcgagcacgaagagttgattcctaagtaccgtcaaatcattgtgttcgagggcgagcatgtcaccaagggggagaccattgtggacggtgagccgagtccacaggatattttgcgtttactgggtatcgagccgttagctgcttacttggttaaagaaatacaggatgtgtatcgtttgcagggtgtgaagatcaatgataagcatattgaagtcattacacgccaaatgttgcgcaaagttgagattgttgatcagggaaacagtaagttcctcaatggtgagcaagttgaacgtcagcgtgttatcgatgaaaacgcgaagttaattgcgcgcaatgaattaccagcaaagtacaatccagtgttactaggtattactaaggcttctttggcaacggaatcgttcatctcggcagcttctttccaagaaacgacccgtgtcttaactgaggctgcggtacgagggaccagggataatttgcgtggtttgaaggaaaatgtcatcgttggtcgccttattccggctggtactggccagacgtatcatagccagcgt

SEQ ID NO: 33043 - DNA, 1125 bp, Xylella fastidiosa
ttgacaaatttaaatttttcttcatttgatctgcatccagcgttgcttactgggctgacaagagcaggatttacactctgtactccgatccaggcgcttactcttccggttgcactggctggtagtgatattgccggccaagcccaaacgggaaccgggaaaactttggcgtttttggtggtggtagttaaccgtttacttagccgtccggggctagttaatcgtaacccagaagatccgcgtgcgttgattttggcgccaacccgtgagcttgcgattcaaatctataacgatgcagtgaaatttggtggcaatcttgggttgcgttttgcgttgatttatgggggcgttgattacgataagcagcgcgaaatgttgcgcaaaggtgcggatgtggtcattgcgacgccggggcgcttgattgattaccttaagcagcacgaggtggtttcgttgcgcgtttgtgagatttgcgttcttgatgaagcagatcggatgtttgacctggggtttatcaaggacattcgctttatattgcggcgcttgcccgagcgttgtagccgtcagactttgctgttctcagccactctcagtcaccgcgtgttggagttggcctatgagtatatgaatgagccagagaagctggtggcggaaacggagagtgtcactactacgcgggtccgtcaacgtatttatttccctgccgaggaggagaaaatcccattgctgttgggtttgctctcgcgtagcgaggggatgcgtactatggtatttgtcaatacaaaggtgttcgtcgaaggtgttgcgcgcgcgctggatgaggctggttaccgggtcggtgtgctgtctggagatgtgccacaaaggaagcgagagactttgcttaatcgtttccagaaagggcaattggaaatactggttgccacagatgtggctgcacgtggattgcacattgatggcgttaattacgtatacaactacgacctaccgtttgatgcagaagattacgttcaccgtattggccgcactgcgcgtttgggagctgatggtgatgcgattagttttgcctgtgagcgttacgcgatgagtttgccggacattgaggcatatatcgagcagaagatc

SEQ ID NO: 33044 - DNA, 816 bp, Xylella fastidiosa
ctttccgggattattactgcgctggtcactccgtttgatcgagatggcgcgtttgaccgtgatgcgtggattcgtttgctggatatgcaattagcgggtggcgtgcagggcgtggttattgctggttccaccggcgaagcagcgacgttgaccgatgctgagtatgacgagatgctgtgctcggctgtggtccgggttggtgggcgtgtgccggtgttggcgggtactggtttgtcggggactgcgaaaacgatttctcaaaccaaacgcgcggccgacaatggtgcaggctatgctttggtggtgacccctccgtacatacgtcccaaccaaggtggtctgaaggcgcattatttggctgtggctgaccaggggggattgccagtcgtgctgtacaatgtgcctagccgcaccggctgtgatctgttgccggagactgtcgctgatttggcggagcacactaatattgtcggcattaaggaggcgtgcgctagtcatgagcgtgtccaggcgctgcttgctttgcgtcgtccaggctttgctgtattcagtggtgatgacagtagtgctgcgcgctcgatgttggacggtgccgatggtttggtttcggttgcttccaacgtattgccgtccgcttatcgtcatctatgtgatcttgctcgggcgggtgagcgtggtgctatcgatctgtggaatgcgcgtctgtctgattttcacgcattttgtggtctcgactccaatccgattccaattaaggcattgttacagcgtatcggcattggttatggattgcgtctgccactgctacccttgtcg

SEQ ID NO: 33045 - DNA, 702 bp, Xylella fastidiosa
ctagtgactggcggcagtggtcatttgggtactgccatttgccgtcaattaattgcagatggtgcgcatgtcatcgtccatgcaaaccaccatcggtctcgtgctgataccctagtggaatgcttatgtgccgaaggggggagcgctgaggtaattgttttcgacgtcaccgccgcacaagccagcaaaacggcactggaaaacctgttacaggctggcccaatccagatcatcattaataatgcaggcatccacgacgacgcaccgatggctggcatgtcatctacacaatggcatcgtgtcattgatgtctctctgcacggctttttcaacgtaactcaaccgttgctgctgccgatggcacgcacccgttggggacgtattgtctgcatatcatctgttacggcagttttaggaaaccgcggacagagcaactacgcagcagccaaagccgggttacacggtgcagcacgctcattggcccgtgagatggctaatcgtggcatcaccgttaacgtcgtcgcaccaggtgtgattgaaagtgagatggtggggaaaacgtttactccggaaatgatcaagcaattggtaccaaccggtcgtcccggtcgtcccgaggaagtggctgctctgatcggatttctatgctcagagaaagcaggttatatcaacggtcaagtcatcggcatcaatggtggaatg

SEQ ID NO: 33046 - DNA, 810 bp, Xylella fastidiosa
tggccggcacctgccaagttgaatttgtttttgcaaattaccgggcgacgtgttgatggttaccatgaattgcagactgtttttcgtctgcttgattggggtgatacgatccatctgcgggtgcgtgaagatggtcagattcatcgcattggtgagtcagtgactggggttgttgaggccgacgacttggtggtgcgtgcggcttatttgctaaaacatgcgactaatgtttatttaggggcagatatctttgttgaaaagcgaattccagttggtggcggctttggcggtgggtcctctgatgcggcgactgtgcttcttgtgttgaatgcattgtggcacaccaggcttgacgttgcggttttggcggccttggggttacgtttgggggccgatgtgccggtatttgtacatgggtgtaatgcgtgggctgagggtgtcggtgagtgtttaacgccgatgattctgcctggagcagcttacctgctattggatccaggggtgtgtgtgccgacacgggagctgttccttgatccggatttgacgcgcgatgcgtcccccgcgacaataggcgacttcattgctggtactgcgtttggtaatgcattcgagccagttctgagacggcgcgagtctgcggttgcgggtgctcttgatatgctctcagaggttggttttgcaagggtgactggctctggcagcggttgctttgtggaattcagtacgcgtgatgaggctgaatgtgctttggagcggctgccgtacgggttgtgtgcttgggttgctgatggcgcttcccgttctccgctg

SEQ ID NO: 33047 - DNA, 935 bp, Xylella fastidiosa
aatttgatggtcttttcgggcaatgccaataaaccactgactcaaagtatttgtaaggagttaggggtgcgtatgggtaaatcgttagtgtcgcgtttttccgatggagaggagcaggtcgaaattgaggaaagtgtgcgtcgtcaggaagtatttgtggtgcagccgacctgtgcgccaagtgctgaaaatttgatggaactgttggttatcattgatgcgctcaagcgtgccagtgtttctagtgtcactgccgtgattccgtacttcggttattcgcgtcaggatcgccgcatgcgttctttgcgtgtaccgattaccgcaaaggttgcggcaaaaatgatcagtgtgattggtgctgatcgtgtgttgaccattgatttgcacgctgatcaaatccaggttttttcgatgtgccggtagacaacgtttatgcttcgccgctgttactggctgatatttggcgtgcttatggtactgacaatctaattgtggtttccccggatgtggggggggtggtcagagcccgtgccatggctaagcgtttaggcgataccgatctggcaatcattgataagcgccgtcctcgcgccaatgttgctacggtaatgaatattattggggaggttaacggtaagacctgtgtactggtcgatgatttagtggatactgccggtactttgtgtgcggcggccgtagcacttaagcaaaatggtgctactaaggttgttgcttatatcacgcatccggtgctgtccggtcctgctgtggacaatattaataactctgagcttgacgagcttgtggtgacggataccattccgttgtctgatgccgctcgggaatgcgaaaaattcgccagcttatgtggtgaattgttgtgagactattcgggtatgctttggtgatcagtcagtcatgttgtggatgattgc

SEQ ID NO: 33048 - DNA, 2392 bp, Xylella fastidiosa
gacaatctaatcaagcagtttacccaatcctctcctctggccggcggcaatgccgcctacattgaagatctttacgagcaataccttgtcttgcccaatagcgtcgatcccaagtggaaagcttacttcgacggttttaagggacgtgatgcaggtgacatcccacactcggcggtcatcgctcatatcaccgacacagccaagcaaagtgtcaagcagggcccaagcgacgaacgggaacgcaacatcggccgtctcatcaccgcttatcgctcacgtggccatctcggtgcccgaatcgatccactggggctggctccgccaagtaacccgcctgatctagatctgccatttcataatctatcgcaagccgatctcgacaatgaattcagcacgggtggcatcggtggccagccacggatgaagctgcgcaatctgctcgcacacttaaaagcaacctataccgataccatcggcacagaattcatgcatatctctgaattcgaacagcgccagtggatctatcggcgtctggaaagtgtcagtggcaaaattgctagtaacgcgaccaaccgcaaacgcatcctcgagcgtctgaccgccgcagagggcctggaacgttatctgcatacgaaatatgtaggacagaaacgcttctctctggagggaggtgatgcattgattccgttgatggacaccttggtgcgtcaagccggcaacaatgatgtcaaggatatcgtagtcggtatggcccaccgcggccgactaaacgtgctggtcaacacgttgggcaaaaatccacgcaaattgttcgacgagttcgagggcaagttcgagcacgcccatcacgaccgcgctcacaccggtgacgtgaaataccatatgggcttctcagctgacatcgccgtcggcgatggcaagcaagtacatttggcgctctccttcaatccatcgcaccttgaaatcgttgatccagtcgttgcagggtcagtacgttcgcgtcaagagcgcttcggagacacagaacgcaaaaccgtgctaccaatcctgatccatggcgacgctgcattcgccggccaaggtgtggtcatggaactgctccagatgtcacaggcacgtggcttcgcagtgggcggcactctgcatgtgatcattaataatcaaatcggcttcaccaccagtgcgcgggatgacgctcgctccactccatactgcactgatgtcgccaaaatgattggcgcaccagtgttccacgttaacggtgacgatccagacgccgtcgttttcgtagcgcaactggcctacgaattccgccagcaattcaaaaaagacgtagtcattgatctagtttgctaccgccgctggggacacaatgaggcagatgaaccggctgcaacgcaaccagtgatgtaccagaccatccggaagcacaaaaccacccgcgagctttacgcaaccaagctagagggcgaaggcgtcattgcggcaggcgaagccaaagcaatggtagatgactaccgagccaaactggactcaggccaagttcaccactgagcttgcaagcaaacacacggatgaattcgtcatcgactggtccaagtacctgtccggaaaactagaggatacggtcaagaccagcgtgaagcgtcagacgctgaacaagttggccgcactcatcaataccactccagccactgtggaattgcacccacgtgtcgccaagatctatgaagaccgcatcaaaatggctgctggcgaacagccgggtgactggggctttgccgaaaatctggcctatgccacgttgctggctgaaggccacaagctacgcttggtcggccaagacgccggacgcggcacctttttccaccgccacgccatcctgcacgatcaaaaaaccgacagctattatctgccgctgcgccaactggtcagcaacccggacgatgcgacggtaatcgactcgctgctcagcgaggaagccgttatgggctttgagtatggttactcgaccaccgatcccaacacgctgtgtatctgggaagcgcagttcggcgattttgccaacggtgcccaagtggtcattgatcaattcatcgctgccggtgaggtcaaatggggtcgaattagcggcctgtcgctattcttaccgcacggttatgagggccaaggtccggaacatagttccgcacgtttagaacgtttcctgcaattgtgtgcactggaaaatatgctggtctgcgtgcccaccactccagcgcaagcatttcacatgatccgtcgacagatgcgcatgtccacgcggaaaccgctggtcgtcatgacgcctaaatcactgctacgccacaagctggcagtctctactttggacgaacgggctacgggaagtcca

SEQ ID NO: 33049 - DNA, 891 bp, Xylella fastidiosa
gacgacctccgtatccgaaaaattgaaccactgacacctcctaacaagctcctcttgcaactaccatgcgatgagcaggcatcgctgactgttgcgacctcacgcaacgcactgcacgatatcctgcacggccacaacgaccgtttagccgtcgtgataggcccatgctcaatccatgatccaattgcagccattgattacgcgcaacgtctgcacccattgcgagagatgtacaaggatgcactagagatcgtgatgcgggtttactttcagaaaccgcgcaccactattggttggaaaggattggtcaacgatccggatcttgatggcagcttccagatcaataagggcttgcatatcgcgcgcaacctgctgcgcgatatcaatcatctcggcttacccgccggtgtggaatttctagacacgatttcgccgcaatatctggctgacttagtcgcctggggtgccattggtgcacgcaccactgagagccaaatacaccgtgaaatggcttcaggtttatcgtgcccgattggctttaaaaacagtaccagtggtgatgtgaagattgctgctgacgcgattaaagcagcttcgcatccgcaccatttcctttcagtgacaaagacaggtgttgccgcagtcgtcgccacccagggtaaccccgattgtcacgtgattctgcgtggaggcaaggtcccgaattatgacgcaatcaatgtcgaagctgccagccaaacattgcttaaatccaagctaccggtgcgactgatgattgatgcgagccatgccaatagcggcaaaaatccaaacaatcaacctaaggtgatcgagaacatcgtagaacagcttaaagccggtgaacgccgcatcatcggtgtcatgattgaa

SEQ ID NO: 33050 - DNA, 1243 bp, Xylella fastidiosa
  unsure (1)..(1243): unsure at all n locations
atgaatttccacgaataccaggcaaaacaactatttgccgaatacggcatccctgttccggccggacgcatcgcgtcttcagccgatgaagcggtcacagccgccaaatccttgnnggcaacggggnccccccttgttnnnggggnnacacnttttggtaaaagctcagattcatgcgggcggtcgcgngtaagggccccgggngnccggngnncnggtttgnananannttctgcaagacaaccgacgaagtgaaacaggccgcagcnnaacaagtgctccggnntacccananngnaanntgngcnntacttaccnnagtcagcagggnttggntcnngnncnntttccngtgnnnccggtgaatctggtcctggtcaccgaagccggtgaaatcactaaagaactctatctgtcagtgttagtggatcgcggcacgcgttcaatcacctacatcgcctcatccgagggcggcgtggacattgagcacgttgcagctgaaacccctgaaaaaatccaaacgctcaacgtcgactttgtcgaaggcctacagccataccaaggacgcgatattggatttcacctcggcttagaagcaaaacaggttaatcagctgtccaaaatcatgattagcctctatcaattgttcaacgacaaagatttgtccttgatcgaattaaatccattagcaatcctgagcaatggggatttgtacgcactggatggaaaaattaattccgacgacaacgccacattccgccataaagaattggccgcaatgcgcgataaaactcaggaagacgaaaccgaggttctagcttcagaaaacgatctgaactacgtcaccatggatggcaacatcggctgcatggtcaatggagccggacttgccatggccacgatggatgtgatcaaactcaatggcggcgaaccggcaaacttccttgatgtcggcggcggcgctaccaaagagcgcgtgacgaccgcattcaaactgatcctttcctcaaacaaggtcaaagccatctttgtcaatatcttcggtggcattgtccgctgcgacatgattgccgaaggcatcatcgctgcagtgaaggaagtgggtgtcaaagtgcctgttatcgtacgcttggaaggcaccaatgtagacgctggcaaacaactgctagccacatccggcctcgccatcatcccggctgacgacatcaacgatggcgccaaaaaagccgtggccgctgtcacc

SEQ ID NO: 33051 - DNA, 1659 bp, Xylella fastidiosa
atgaccgaaatcaaggaagcttttgtccccgatatcggtgactacagcaacgtcccagtgattgaagtgctagtcgctgttggcgataccgtctccaagggccaaagtttgatcaccttggaatctgacaaagcaaccatggaagtaccctcgtcaacgaccggtatcatcaaagaaataaaagtgaaggttggcgataccttatcccaaggccatgtcgtcgcattaatcgaagtctccgaagagactgccgaaatcaccacacccatgaccgttaacacgccaaccacgcgtgctcacaacactgcacctccagaagacggaggcagcttaatcgaagtgcgtgtccctgatattggcgattacaccaacgtcccagtgattgaagtcctggtggctgttggcgataccgtctccaaagaccaaagtctaatcaccttagaatctgacaaagcaaccttggaagtaccctcctccgccacaggtgtcatcaaacaacttaaggtcaacattggagacaccttgtcgcaaggcgacatcgtcgttgtgcttcaaagcgcagagagcatcccactcactccagccacaaacaaaccagcattgccacccaattccagccctgcacgcgatgccatctccgccccagcatcccctgcagggacaccgagcaccccaccgattaccttcgatgccaacaccgtgctaccgtccaaggtcccctatgccagccccgcagtacgcctgcttgcacgccagttagacgtggacctgagccgcatcaaaggcagcgagaaaaatggacgcattacccgcgaagacgtacagaaattcgtcaacgccaccttaggtactggtatggctgaaggcagaacaccctccgcttcaatcaccacaaatggtggcctcaacttactcccttggccaaatgtggatttcagcaaattcggcgaaattgaaacccagcctttatctcggatcaaaaagatttccggtgccaatcttgcccgcaattgggcgatgatcccgcacgtcacccaattcgatcaggccgacatcacccaactggaggccctgcgcgtacaaatcaataaagagaatgccgcatccaacaagaacggaaccggcattaaactgactgttctggctttccttatcaaagcaagcgccgcagcactgaaaaaatttccaacattcaacgcctcccttgatgccactggcgaaacgctcacactcaaaaaatacttccatatcggtttcgccgccgacacaccaaacggactcgtcgtcccggtgatccgcaacgtagaccaaaaaggcatcgtagagatcgcacaagaaaccagcgatctcgccaaaaaagcacgcgatggcaaactcaccccagcagacatgagcggtggttgcttctccatcagctcactcggtggcatcggaggtaccgcattcacacccattatcaacgcacctgaagtagcgatcctgggtgtctccaaatccctcatccaacccatctgggatggcacacaattcgcacctaaaatgctgttgccgctgtcactgagctacgatcaccgcgtcattgatggtgccttggccgcacacttcaccacttatctcagccagatactcgccgacatgcggcgcgtactgctgtgacaa

SEQ ID NO: 33052 - DNA, 1167 bp, Xylella fastidiosa
tcgctgtctcgctattatttgccggtctatcgtccatgccaggtggtgttggtgcgtggtcaaggcagccgtgtatgggatgagcaggggcgcgattatcttgatctggctgctgggattgcggtgtgttgtttggggcattgtgatccggatttggtcgctgctttggtggagcaggcaggtcgtctgtggcataccagcaatgtgttttatagcgagccgtcgttgcgcttggcgcaggagttggtggatgtttcacggttcgctgagcgagtgtttctttgcagttccgggactgaagccaacgaggcggcaatcaagttggtgcgtaagtggtctgctgcgcaggggcgtttaccggagcatcgtacgattgtgacgttccgtggcagtttccacggacgtactttgggtgcagtgacggcgacggcgcagcctaagtatcaggagggctatgagccgttgcctggggggttccgctatgtcgatttcaatcatattgaggcgttggaagcggcgatggtcggtggtgatgtcgctgcggtgatgttggagccgattcaaggagagggtggggtgatgccggtggtgccaggatatttggcacaggtacgtgcgttgtgcgatcgctatggggcgctgttggtattggatgagattcagtgtggcatggggcgtactgggacgttgttcgcctattggcaagaagaggtggtgccggacattgtgacgttggccaaggggcttggtggggggtttccaattggtgcgatgttggctggtccgaaggttgctgaggtgatgcagttcggggcgcatgggacgacgtttggcggtaatcctatggctgctgctgtggcgcgggtggcgttgcgtaagttggtttcggttgagattgccgccaatgtgcagcgtcagtcggtcgcgctacgcgctgggttggaagagatcagcgaggcattcggtggggtgtttacgcaggtgcgcggtcgcggtctgatgctgggcgcggtgttggcgccgctgtatgcagggcaagccagtgcgattcttgaggtggcggctgagcacggtgtgttgttgttacaggctggtcctgacgtgctgcgttttgtgccggcgctgaatgtgagtgatgaggagcttgccgatggtttggtccggtta

SEQ ID NO: 33053 - DNA, 756 bp, Xylella fastidiosa
acaaccccagtcaaaattgctacacgtaaccttgagttctactacggtacgttccaggcactaaagcaaattaatttggaaattcctgaaaagcgtgtaactgccctgattggcccatcaggatgtgggaagtcgacgctactacgcattttcaaccggatctatgcgctatatccaaaactggaggcacgcggcgaggtgttcttagacggcgaaaatatcctatcgccgaaatactcgataaaccggctgcgcagcaaggtaggcatggtgtttcaaaaacctgtgccattccccatgacaatttatgagaatgttgcctacggcatccgtcaccatgaggtgatgtgcaaaagtcaaatgaatgaccgcgtcgagcaagcattacaacaaagtgctttgtgggaagaggtcaaggacaagttgaatcaaaatgcactgggcctgtccgggggccaacaacaacggctatgcatcgcacgcgcagtcgcactaacaccatcggtactactgcttgatgaaccgacttcagcattagacccgatctcaaccagtcgcatagaacagctgattgaggaactaaaaaccaaatacaccatcgtgatcgtcacacacaacatgcaacaagctgcgcgcgtatccgattacactggcttcatgtatctaggcgacctgatcgagcacgaccgcaccgaaaccatcttttcacggccatccaaacaacagaccgaagactacatcactggtcgattcggc

SEQ ID NO: 33054 - DNA, 1839 bp, Xylella fastidiosa
tatccacgcttgtcgcgtatccaaactccagaggatctccgcgcttttcaggagtcggagttgcgtgcggttgccgatgagttgcggaattatctgatcgaatcagtaggcctcagtggcggtcactttgctgctgggttgggtgtggtcgaattgacgatcgctttgcattatttgtactgcactcctatcgatcagcttgtctgggacgtgggtcatcaaacgtatccgcataagatattgaccggtcgccgtgacaagattagtacggttaagcatcaaggtggtttggcaccgtttccgaagcgtgaggagagtatctatgacacgttcggtgtcggtcattcttctacttctatttcagctgcgcttgggatggcgattgtggcgcagcgtaatggggatgagcgtaaggtggtggccatcatcggcgatggtgcgatgacagcggggatggcttatgaggcgcttaatcatgctggcgggatgagtcctgcaccgaatcttcttgtgattcttaacgacaatcgtatgtcgatttccgaagcggtcggtgggcttaccaagatgcttggtcgtgcgactggcagcaaagcattgaatgcgatccgtgagggtggcaagagaatttttggggataagaaaaccaatgcaaccgcgcgttttttacgtcgctgggaggagcattggaaggggatgtttgtgccgtcgacgttgttcgaagagatggggttccattataccggcccgatcgatggccatgatttgccggcccttcttggtgcgttgaagacgttgcgtacgttgaagggtccacagttgttgcatgtgatcacaaccaaagggaaggggtatgagctggctgagggagaccagattggttaccacgccgtcgccccgtttgatccgcaaaagggtctgattaaggcgggagcaaagaagcaaacatatacggacgtgtttagtgagtggttgtgtgatatggcagcggtggaaccacgtttgctggctattacaccggcgatgcgtgagggatcggggttggtgcgttttagtcaggagtatccgcagcgttattttgatgtggccattgctgagcagcacgcgataacgttggctgctggtatggcgactcaaggtgctaagcctgtggtggcgatttactcgacctttttgcagcgtggttacgatcaattggttcacgatgttgcgttgcagaagttggatgtgctttttgcagtagatcgcggtggtgtggttggtccagatggtgcgacgcatgcgggtaatttggatctcagtttcctgcgttgcgtgccaaacatgatgttgatggctcctgccgatgaggcagagtgccggaagatgttgagtaccggtttccactattctgggccagtagcggtgcgttatccgcgtggtacgggtcctggggtggtgccgtccgctgagttggatgtgttgccggttggtgtggcgcagttacgtcattctggtacacggatcgctctacttggttttggggtgtgcgttgctcctgctgaacaggtggggcgtaggcttggtttgactgtggtcaatatgcgttttatcaaaccgttggatcgaacgttgctgttggagttggcgcgtactcacgaagtgtttgtcacgattgaagataatgtggttgctggcggagctggctcagggtttgcggaattacttaacgctgaaggcatcgttttgccgattgtgcatcttggtcttccagatgcgttccagcagcacgcttcccgtgaggatttactggctgaggcgggtattgatgcggctggtgtgtacgctgcgctgttaagt

SEQ ID NO: 33055 - DNA, 515 bp, Xylella fastidiosa
  unsure (1)..(515): unsure at all n locations
ttgatcggaccaactgcncaggcgtcataacaccaggagagtgtaagatagccataatgccggccgatatccacaagccaggtcatatcggtattgtgtcccgctccggtaccttgacttacgaagcagtgaagcaaaccactgacgtcggcctcggtcaatcaacctgcatcggtatcggtggggatccaatcaacgggctgaacttcgttgatgcgctaaaactgttcaataacgacccgcagaccaaagggatcatcatggtaggcgagatcggcggggatgctgaggaagccggggctgaatatattaaacaccatgtgaaaaaaccggtggttggctttatcgctggtgcatccgcaccgaaaggcaagcgtatgggtcatgctggcgccatcgcctcaggaggctcaggaacagctgaaggcaagtttgctgcaatggaaaaagcaggcatcaagacagtacgttcaccgggagatttaggtgcagcgattgcttcgctcgtaagatag

SEQ ID NO: 33056 - DNA, 1257 bp, Xylella fastidiosa
gcgcgcatcgccgtggttggactagggtatgtgggattgccgttggcggttgcgtttggtcgacagcgtccgacacttgggttcgacattgatatatgtcgggtacagcagttgtgtgccggtcatgacatcacttgtgaaattgagcttgaggaacttcaagctgcgcgacatttgcgttatagcagtgatcctcgggaattgagtgactgtcagattttcatcattacggtgcctacccctattgatgtggctgagcaaccggatttggggccgcttcgttcggccagcatgttggttgcgtcggtacttaagcctggggatttagtgatctatgagtccacagtttatccgggcacaacggaggaagtctgtgtgccattgctggaggctgggtctgggttgcgctttaatgtcgattttcattgtggttacagtcctgagcggattaaccctggtgatcgtaagcgtcggctacaggacatctgcaagattctttcaggttccacccctgatattacagctgtcgtggacgcgttatattcgcagatcatcgttgctggtacttggtgtgctccgtcgatcagagttgccgaggcagctaaggtggttgagaacattcagcgtgacgtgaatattgcgttggtcaatgagttggcattaatctttgatcggctcggtatcgacaccttggacgttctcgaagcggcagaaaccaagtggaattttttgcctttccgcccgggtttggtgggtggtcattgcatcggtgtggatccttattatttgttgcacaaatccgagagtgtggggtattacccggatttgattcatacggcacgtcgcgttaacagtcgtgttagtcggcatgttgtggaccgtgttgtggctttacttggtgagcttagtgtgccgatgacacgtgcggtggtgcttgtgttgggtgttaccttcaaggaggattgtcccgatttacgtaacagccgtgctttggatttggtgcgcatgttcaggaatttaggtgcgcaagtcgatgtttgcgatccttgtgctgatccgcagcaagcgttggagcatgaggctgtcacgttgtgtacggagcccaaggctggtgcttatgatgcaattgtgctggcggtggcgcatgcccagtaccgaatgtacgatgtagcgactattgcagctctaggtaagccgcaggcggtggtttatgatgtcaaatcagtgtggccgcgtgcagcggtaactgatcgtcta

SEQ ID NO: 33057 - DNA, 1533 bp, Xylella fastidiosa
ctcaacccttccgaaataagcgaattgattaagactcgcatcgaacaggtcaaactatccgcagaatcccgtaacgaaggcaccgtgaccagcgtttccgatggcattgtgcgcatttttggcttagcagatgcgatgcaaggagaaatgatcgaattgcctaacaaaacctatgcactagcactgaatttggagcgtgattcagttggtgccgtgatactgggtgattacaaacatttacgtgaaggagacgtcgctaaaacaaccggacgcatccttgaagtgccggttggcaaatcgctgttgggccgcgttgtcaatgctttaggtgaaccaatcgatggcaaaggtgcactaggccccactcaaactgcaccagtggagcgcgttgctcctggtgtcatctggcgcaaatcagtcgatcaaccagtacagaccggttataagtcagttgatgcgatgatccctatcggccgcggccaacgcgaactcatcatcggagaccgccaaactgggaaaaccgcaatggcaatcgatacagtgatcagccagaaagacaccggtatcaaatgcgtttatgtagcgatcggccaaaaagcttctactatcgccaatatcgttcgaaaactcgaagagaatgatgcgctggaccacactatcgtcgtagccgcaaccgcatctgaatcagccgcacttcagtacatcagtgcctacgctgggtgcaccatgggcgaatatttcatggaccgtggcgaggacgcactcatcatctatgacgatttgtcgaaacaagccgttgcctatcgccaaatctcgctactcctaaaacgtccccctggccgagaagcttacccgggcgacgtattctacctgcactcgcgtctgctggagcgtgccgctcgtgtatctgaagaatatgtcgaaaaattcacccaaggtgaggtgaaaggaaaaacaggatccttaactgcactaccaatcatcgaaacacaagctggcgacgtgtccgcctttgtaccaaccaacgtaatttcaattactgatggccagatcttcctggaaactgatcttttcaatgctggtatacgtccagctgtcaacgccggcatctccgtatcgcgcgtcggtggctcggcacagactaaaattatcaagaaactgtccgggggcatccgcatctcactggcacaataccgtgagctggcagcattcgcgcagtttgcatctgacctagatgaaacaacccgcaagcaactcgagcgcggccaacgtgtcactgaactgatgaagcagaaacagtacacctcaatgtccgtcgccaaccaagcgttatcaatctacgcagtcaacgaaggctaccttgacgacataccagtggacaaagtactcaccttcgaagaaggcctacacgcccatttttccaacactcaaggcgcgctgatcgacaagatcaataactccggtgactgggacaacaacattgaagctgctttcaagcagcacattgaagaatttaagaccacgggcagctgg

SEQ ID NO: 33058 - DNA, 861 bp, Xylella fastidiosa
atggcaagcggacgcgaaatcaaaagcaagatcaaaagtgtgcagaacactcgtaaagtgacacgcgcattagagatggtctcggcctcaaaaatccgcaaagcacaggagcaaatgaaaatctcgcgcccgtatgcgcaggcaatgaaacaaatgattggccatttagctcaagcaaatactgactatctgcatccatttctgatcgcacacaagcaagttaagcgaataggctatatcgtgatctcatctgaccgtggcttggctggtggtctcaacaacaatctgttccgcaagatacttggcgaaatgcgccagtggcaagataagggggtcgaagtcgacatcgtcacgattggtcagaaagcatccgtattctttcgcaggattaaagtcaacatactcggcagcgtgactcacctaggagacacaccacgcctagaacagctcattggtgtcatcaaagttatgcttgatgcatacactgaagaaaagcttgatcgcgtctatttggtctataaccgtttcatcaacacaatggttcagaaagcgagcttcgaccaacttctgccactgctagcagctaaagacaaggtcgcacaccatgattgggattacttatacgaacccgatgctgcaacagtgcttgagcacgtgatgacacgctacatagaatcgcttgtataccaagcgatgctagaaaacatagcatctgagcatgcagcgcgcatggtagcaatgaaggctgctagcgacaacgccaacaagctgattggcacactacaactggtctacaacaaagcacgtcaggcagcgatcacccaagaaatttcagaaatcgtcggcggtgccgccgcagtc

SEQ ID NO: 33059 - DNA, 1434 bp, Xylella fastidiosa
atgagtgaacattacgacgtcgttgttatcggagccggtccagctggctatcacgctgcaatccgcgccgcccaactgggtctgaaggtcgcttgcgtcgatgcagcactcggcaaggacggtaagccagcgcttggaggcacgtgtctacgcgtgggatgcatcccttccaaagcactgctggactcctcccgccagtactggaacatgggacatctattcaacgaacatggcatcagtttcaaagatgccaagatggatgttgccacgatgatcgcccgcaaagacaaaatcgtgaaacagttcacgggtggcattgcgatgctcttcaaagcaaacaaaatcactccctactatggatttgcccaattgcaacctggcaacgtggtcaaagtgaaacaacacgagggtaagaacatcgaactgaaaggcgccaacgtgatcctggcatccggctcggattccgttgaactgccatttgcaacgttcgacggtgaaacgattgtcgacaatatcggtgccctggactttacaaaagtcccaaaacgcttggcagtgatcggtgccggagtcatcggtctggaattaggcagcgtatggaaacgcctaggtgcggaagtcactattcttgaagcaatgccaaactttctagctgcagttgacgccgatgtcgccaaaaccgccgccaaggaattcaagcaacaggggctggacattaagctcggcgctaaggtctcccgaaccgaaatctcaagtaaaaacaacaaaaaagaagtcatcgttacctacactgacgcctccggtaagcagacactcactgtcgacaaactattagtggctgtcgggcgcaaggccgcaaccaagggattgcttgcagatggcacgggggtacagctcaacgaacgtggccagatcgtggtggacgaacactgtcataccggtgtcgacggtgtctgggccattggcgactgtgtacgcggcccgatgttggctcacaaaggcttcgaagaggggatcgcagtagctgaattgatcgcgggcatgccaggccatgtgaactttgaaaccatcccatgggtcatctacacagagccggaaatcgcctgggttggtaagactgagcaagaactcaaagcagacagcattccttacaaagctggatccttcccgttcgccgcagtcggccgcgccgttgcgatggccgagccatctggttttgtgaaagtcctagcgcatgcagaaactgaccgcgtgttaggtttacatctgatcggtgtgaacgtctccgaattggtacatgaaggggtattggctatggaatttagtggctcagctgacgatctcgcccggatctgccacgcccacccaaccttatcggaagcaatccacgacgcagctatggcggtcagcaagcgcgcaatccataaagcaaac

SEQ ID NO: 33060 - DNA, 1115 bp, Xylella fastidiosa
agctggcacaaaaaagccggtgagattgtcaaacgcgatgagaacatcgtcgacctggagacgacaaagttgtattggaagtcccctcccctgtcgacggcgtcttgaaagaaatcaaattcgacaccggcagtactgtcaccagcaatcaagttctggcaatcattgaagaagaaagcatcgttgctgcaccctctccagcaccctctcaggtgattgatcagaaaccggttgctgtatccgctccagccgccaaatccaacgttgacagtctgcctccaggtgctcgtttcacggcaacgaccgaaggtattgacccagcccagatcgaaggaagtgggcgccgtggtgccgtcaccaaagaagatatcatcaactttgctaagcaaaatggagccgcccgcgccagcggtacgcgtttagaagaacgcgtcccaatgacccgtatccggcaacgcatcgccgaacgcctcatgcagtcgaagaactccactgcgatgctgaccacctttaatgaaatcaacctggccaaagtctcaaacatacgcaaagagttacaggaagaattccagaaagcccacggtatcaaattgggcttcatgagctttttcgtgaaagcggtcgccaatgcactgcaacgcttccccttggtcaacgcatcaattgatggtacagacatcatttaccacggatatagcgatatttcgatcgcggtatccaccgataaaggcttagtcacgccagtactgcgcaacgtcgaacggatgtctttcgccgatattgagcatcgcatcgccgattacgccaagaaggcacgcgacggcaaattaagtctagaagagttgcagggaggcaccttcaccgtcaccaacggtggcacctttggttcattgctctcgactccaatcgttaacccgccacaaagcgcgattttagggatgcataccatcaaagagcgccccattgctgagaacggccacattgtgattgcgccaatgatgtacgtggcactgtcatatgatcaccgcatcattgatggcaaagattcggttcaattcttggtggacatcaaaaatcaattggaagcccccgggcggatgctgttcggcttataa

SEQ ID NO: 33061 - DNA, 2571 bp, Xylella fastidiosa
atgcggatggataagcttacttcccgtttccagaatgcgttggctgatgcgcaatcgctggccgtcggtcgtgaccatactattattgagccggtgcatgttttttcggcattgcttgatcagcagggggggagtacacgtccgttgctcgtgcaggccggtgtcaatgtgccattgctgcgtgagcggttgaccgagatacttgaggcattgccgaaagtgagtggtcagacggttaatgtctcacccagcaatgaattgagtcgtttgtttcatcggactgataagttagcgcagcagcatggcgatcagtttatggccagtgagtggttcgtgttggctgtggtcgatgatagtggggggctgggccaggcgttgcgtgctgctggtgcggaaaaaaagaagattgaggctgcgattgataaattgcgtggcggtgaaactgtccagactgagaatgctgaggagcagcgtcaagcgttggaaaagtacacgattgatctgactgccagggctgagagtggcaagcttgatccggtgattggtcgtgatgaggaaattcgccgcacgatacaggtattgcagcggcgtacaaaaaataatcctgtgctgattggtgagccgggtgtgggtaaaactgccattgtagaaggtctggctcagcgcattgtcaatggtgaggttccggaagggttgcgcagtaagcgtctgctctcgctggatttgggggcgttgattgctggggccaagtttcgtggtgagttcgaggagcgcttgaagggggtgcttaacgatctcgctaagaatgaggggcgggtcattttgttcattgacgagctgcataccatggttggtgccggtaaagccgatggtgcgatggatgctggcaatatgctcaagccggcgttagcacgtggtgagttgcattgtatcggtgcgactacgttggatgagtatcgcaagtacattgagaaggatgcggcgttggaacgccgtttccagaaggtgtttgttggggagccgacggtggaggataccatcgcaattcttcgtggacttaaggaaaagtatgcgttgcaccacggtgtggaaatcactgatccggctattgttgctgcggctacgttgtctaatcgctacatcactgatcgtcagttaccagataaagcgattgacttgatggatgaggctgccagtcgtattcgtatggaaattgactccaagccggaagagcttgatcgtttggagcgtcggttgattcagttgaaaattcagcgtgagatgctgaagaaagaaaaggatgaggcgagcaagcagcgtttagccgatcttgagcgtgatattgaggttctggaccgtgaattttccgatctggaggaggtgtggagatcagaaaaagccgcgctacagggggcgactaagatcaaggagtcgatcgagcaggccaagcttgatttggaagccgcgcagcgccgtcaggactacgccaagatgagcgagattcagtatggtgtactccccgcgttggagaagcagctggtggcagcaagtcaggcggaacagcacgattttactttggtgcaggagaaagtgactgctgaggagattgccgaggtagttagtcgttggactggtattccagtgagcaagatgcttgagggcgagcgcgataagttgttgcgtatggaagctgatctaggtcgacgtgtggttggtcaagaggaggcgatcaaggtggtatcggatgcggtgcgccgttcgcgtactggtttgtctgatccaaatcgaccgagcggctcgttcctttttctgggtccgacgggtgttggtaagactgagttatgtaaggcgctggctgaatttttgttcgacagtcaagatgcaatggtccgcattgatatgagtgagttcatggaaaaacattctgtggcgcgcctgattggtgcgcctccgggctatgtgggttatgaggaaggaggttatcttactgaattggtgcgacgtcggccttactctctgattcttttggatgaagtggagaaggcgcatagtgatgtgttcaatattctgctgcaagtacttgatgatggacgcttgactgatggtcagggccgtactgttgattttcgcaatactgttattgtgatgacatcaaacttaggttcacatcagatccaagaactcagtggagacgattctccggaggtgtatacgcaaatgaaggcggcagtgatgggggtggtgcaggcgcattttcgcccagagttcattaacaggttggatgatattgttgttttccacccgttggacaaggcgcaaatcaagcagattgcgcggattcaactgcgggggctagagaagcgtctcgctgaatctgagttgaaactagatttggatgatcgtgcgctggaattgcttggtaatgtcggatttgatcccgtatatggtgcccgcccgctgaagagagcaatccaatctcagctggagaatcccttagcgcagcagatcttagctggagcgttcgtcagtggagatactgtgcaggtgggtgttgatggagggaagcttgta

SEQ ID NO: 33062 - DNA, 507 bp, Xylella fastidiosa
ttattggtagaccgtcccagtattgatggggctattgcgcatatcgccgatgacatcgcccgggactatcagggggatgtgccgttgtttgtcaccatcatgcatggtgggttgccgtttgcgggtcaattagcattggagctgggccagcgtggtcaggacatagagttggattccttacatgcgacgcgttaccgtggtgagcagactggcggttcattggtgtggaggcattatccggtcagtgccatgtctggtcgtcgtgtgattctggttgacgatattctcgacgagggtcataccttgtctgagatacgtcagtggtgcctaaagcagggggctaccgatgtgtcgctagtggtgctgatgatcaaatgtcatgatcgttgtatacccaatatgagggcagattattatggcgtagaggttccggatcgctatgtgtttggttttggaatggacatagcggggcagctgcgcggtatcccggcaatttatgcgatgagg

SEQ ID NO: 33063 - DNA, 1920 bp, Xylella fastidiosa
tacaccattgatccgatgttggccaaagatgcgcacgtagaccgtgctcactacaaaacgctttaccacgaatccatcgaacaaccagaagcattctggagcaaagtcgcacagcggctggagtggttcaaagtgccaaccaaaatcaaaaatgtcagctaccaactggaagatgttcacatccgttggttcgaagacggtgaactcaatgccagcgtcaactgcctggaccgccatctcaccttacgtggcgacaaaacagcactcctgtttgaacctgacgccccagacgccccatcctcacgcatcacctaccgtgaactatacgagcgcgtctgccaactcggtaacgcactgcgccacctcggcatcgaaaagggcgaccgcgtcaccatctacttaccaatgattccagatgcagtcgtcgccatcctcgcttgcgcacgcattggagcaatccactccgtcgtcttcggcggctttgcagcaaactccattgccgaccgagtgaatgactgcggtagcaaactcatcatcaccgcagatgaagggctgcgtggcggcagaaaaattccattgaaagccaacgtcgatgccgcattaaaaatccacggaacccagtccgtcgaaaccgtactcgtcgtgcgtcacaccggcggtacgatcaacatgcataccccgcgcgaccgctggttccatgacctcgtcgacatccaagcaaccgaatgcgccccagaacgcatgaacgctgaagacccccttttcatcctctatacctccggctccacaggcaaacccaaaggagtcctgcacaccaccggcggctacctggtgtacaccagctacactcatgaaaccgtgtttgacctacgcgaaaacgacatctactggtgcactgccgacatcggctggattactggtcacagctacatcgtttacggccccctagccaatggcgccaccgtcttgctgtttgaaggcaccccccactacccgaccgtgtcgcgcttctgggaagtgatcgacaaacatcacgtcaccctcttctacaccgcgccgaccgcaatccgtgccttgatgcgcgaaggcgacactcctgtaaaaaaaacctcccgcaaaagcttgcggttacttggcagcgttggcgaacccatcaaccccgaagcctggcactggtactacaccatcgttggcaacggacgctgccccattgtcgacacctggtggcaaaccgagacaggaggaatcctcatcaccccactgatcggtgcaaccgaccttaaaccaggctcagtcaccctccccttcttcggcatacgccccgccctagtggataccaacggacaaacactggatggccccgcagcaggtaacctagtcctgctcgattcctggccgggtcaaatgcgtaccctctacggtgaccaccaacgttttatagacacttactttcgcacctaccccaatacttacttcaccggcgacggctgccgccgcgatgccgacggctattactggatcactggacgtgtggatgacgtcatcaacatctccggccatcgcatcggcaccgccgaaatcgaaagcacactcgtcgctcaccccaaagtggctgaagccgcggtcgtcggcttccctcacccgatcaaaggccagggcatctacgcatacgtgacattaattaccggcgagacacccagcgaagcactgcaccaagaactgctcacccgggtacgcaaagaaatcggagcaatcgccatacccgatcacgtgcaatggacacccaacctccccaaaacccgctccggaaagatcatgcgccgcatcctgcgcaaaattgcagaaaacgcaccagaccaactcggtgacacctccacactggctgatccgtctatcgtcgacttattgctcaacgaacga

SEQ ID NO: 33064 - DNA, 1317 bp, Xylella fastidiosa
accgaacctgctgacttacagcactatggccgcgactggacccggcgcttcacaccggcacccttagcaatcgcacttcctgccactgtccaagaagtccaggccattgtgcgttgggccaatgatgcccacattgcgatcgtcccttccggcgggcgcaccggcctatccggcggtgccatggccaccaatggcgaactggtgctcagtctggagcggatgaacaaaatgctccggttcgaccccatggatcgcaccatgaccgtgcaagctggcatgccattagaggccgtccaagccgccgcccgccaacacggcctcctgtatcccgtcgactttgccgcccgaggctcatgctccattggcggcacaattgcgaccaatgcaggaggaatccgcgtggtccgttacggcaacacccgcgaatggatcgctggcctcaacgtagtgactgggactggcgaactcctcgagttgaatcatgccctgatcaaaaactccagcggctatgactttcgacatctgatgattggttccgaaggcacattgggcattgtcgtcgaagccaccttgcgtctgaccgacccaccgccaccgaccaaagtcatgctgctggcattgcccacctttgacgtcttgatgcaagtatttgccgcctttcgcgcacaactacagattgaagccttcgaattttttacgcagcgcgcattgccccatgttctagcccacggcgcccaagcaccgtttgaacatccctatccgtactacgtcgtcaccgaattcccctgcgccgacgcagcccaagaaaccaccgcactcactgtctttgaaacctgcatggagcagggctgggtcttggatggtgtcatcagccagagcgacgcacaggcagcccaactatggcgattgcgtgagagcatcaccgaaagcattgccccatataccccgtataaaaacgatattgccgtgcgcattgccgccatgcccgcatttctagaacaagcacaagcattactgagccaagcctacccagaatttgaagtcctctggttcggccatatcggtgacggcaacctacacattaacgtcctcaaaccgcacacagtgccccagactgacttcatccacacctgcgaacacgtcaccgcactgcttgctgacctcctacaacgtttccgcggcagcatctccgcagaacatggcattggcctgataaaaaagccctaccttcacagcacccgcagccttgctgaaattgcattaatgcgtcaaataaaacgcgcattcgacccaaaatggatattgaacccagggaaa

SEQ ID NO: 33065 - DNA, 864 bp, Xylella fastidiosa
atgcaattcaaggactattacgcgactttaggtgttgaaccgagtgcgggtgaggctgagatcaagaccgcttaccgtcggctagcgcgcaaatatcatcctgacgtcagtcaggagccgggggcggaggagagattcaaggccgtcaacgaggcttatgaggcattacgcgatccgaacaagcgtgcggcttatgaccagctccgtgcacaagggtaccggcctggagatgaattccatgctcctcctaattttggtggtgggcatggttttaactttgaagaggtgtttggcaatgcgtcgggggggaatttcagcgatttctttgagagcttatttgctggagcccgtgccggtggtcgtcatgcaggtccaggggggggcgacaaatcgcaacacggtgatacgcgttccaagttgactgtgccactggaagccatttacagcgggggaagtgtgcgggtcacggtcaatgggcgtcagcttgatgtgcgtgtgcctaaaggtatccaacctggcaaggtgattcggttgaacggacaggggagctacgctcgtcatctcttgttagagatcgaatatgctccgcatccgcaatttgaagttgatgggcacaatattctgcacactgtgcaagtgacgccatggcaggccgcattggggacttcgatcagcgtgccgactctcggtggatctgtggagctgaaggtgccacctgattccgatgcgggacgcaagttgcgtctgcgcggtcgtggtttgcctggtcctccgccaggagaccagatcgttgagttggaaatcactgctcctttagctacaaacgagacacagcgcaaggcatatcgggcgcttgccaaagcg

SEQ ID NO: 33066 - DNA, 2196 bp, Xylella fastidiosa
  unsure (1)..(2196): unsure at all n locations
gaagggactcacaataaagactggtggcccaatcagttacgtgtggatttgctgcatcagcattcgaataagtccaatccactgggtgaaacgttcgattacgccaaagtgttccagaaactcgattacgctgcgttgaagcgtgatttacatgcattgatgaccgattcgcaggattggtggcctgctgactttggtcattacggcggtttgtttatccgtatggcttggcatagtgccggcacctatcgtatcggtgatggtcgtggtggtgctggccgtggccagcagcgcttcgcgccgctcaatagctggccggataatgtcagcctggacaaggcacgtcgtctgctttggccgatcaagaaaaagtatggtcagcagatttcttgggccgatctgattgtgcttgccggtaacgttgcgttggaatcaatggggtttaaaacctttggtttcgctggtggtcgtgtggatacctgggaacctgatcaggatgtgtattggggcagggagatgacctggcttggtggggatgttcgttatggagctgtctcggaaggtgtacaccatccagatgaacatagtggagcaaaggagaaggcttccaagaatagcgattcgcgtgtgttggaaaatccgttggctgctgtgcagatgggattgatttatgtcaatcctgaaggtccggatggccgtccagatccgctcgcttctgctcgcgatattcgcgaaacgtttgctcgcatggcaatgaatgatgaggagactgtggcgttgatcgccggtggccacaccttcggaaaaacacacggcgcggctccagcagacaacgtcggtcctgagccggaagccggggagttggagcagcagggcttggggtggcacaaccgctttggtagcggcaaggcgggggatacgattaccagcggtttggaggtgacatggactaagactccaacacaatggagcaacgatttttttgagcacttgtttggttacgaatgggagttgaccaaaagtcctgccggcgcctatcagtgggtggctaaggatgctgcagcgacgatcccgcatgcgcacgatccgtcgaagaaattactgccgatgatgctgacatcggatttagcgttgcgttttgatccggtctacgaaaagatttcgcggcatttccatgcgcatccagaccagttcgccgatgcgtttgctcgggcttggttcaagttgacgcatcgtgatatggggccgcgtgtccgttaccttggcccagaggttccggctgaagaattgatttggcaggacccagttcctaaggtcagccatgtgttagttgatgcgcaggaccttcttgcgttgaagcataaaatttctgcttctgggttaggaatctcgcagctcgtttcgacggcttgggcatcggcctccacgttccgtggctcggataagcgcggcggcgccaatggggggcgtctttgcttggctccgcaaaatcagtgggaggtcaatcagccgcagcaactgagtgtggtgctggaaacattgcggcgtgtccagactgaattcaacgcccaagcaggagacaaacgcatttctttggcagatttgattgtattggctggcggtgtaggcgtggagcaggcggcgaagcgtgtcggtatcgtggtggaggtcccttttgtgccgggacgtaccgacgctttgnnnnnnnnnnnnnnnnnnagttcatttgctcctctggagccgtttgctgatgggttccgaaactatgtcaagggagatgaagttgtcccgtctgagcatcttttgattgatcgtgcccagttactgacattgactgcaccggagatgacggtattgatcggcggtttgcgggtcttgggtgccaacgttggcggtgtgaagcacggtgtgtttacagatcgtctggggacgttgagtaacgatttctttatcaatctactcgacatggggacggagtgggcccccgtttccaaagagcgtcatgtgttcgaaggacgtgatcgtcgcaccggtgtgctgaaatggacgggtacccgtgttgatctggtctttggctcgaatgcactgttacgtgcgttagcagaagtctatgccgcagtggatgctcaagagaagtttgtacgcgattttgtcgcagcttggagcaaagtcatgcatttggatcgctttgatttg

SEQ ID NO: 33067 - DNA, 2094 bp, Xylella fastidiosa
cagcctgacagctcactccacggcttagtcctccttgcccaattccatggcattgcggctgaccccgtacagatagcgcatgacttcgggcgcagtggcgaaccattcgatgaaacaaccttgctactggccgccaaaaaactcggactaaaagccaaagtcgtcacccaaccggtcacccgtatcgcaatggccgcattacctgcactcgcactgatccctggaggaacggcatttatcgtcgccaaagtgacaggcaaccagatactgatccacgacctggcagatcaacgaccacgcacaatctcacacgatgaatttaccgcacgctacgccggccgcttactccaagtcgcctcccgcgcatcggtcctaggaaatctggctaaattcgactttagctggttcatccccgcagtggtcaaatatcgcaaactgctggctgaagtctttgcagtgtcattatttatccagatattcgcactggtgacacccctgttctaccaagtcgtgatggacaaagttctcgtacaccaagcactcagcacccttgaagtcattgtagttggcctaatctccctggccttattcgaagtagtactcaccgcactacgcacccatgtcttcgcacataccaccagcaaaattgatgttgaactgggcgctcgcttattccgccatctattagcactccccttagcgtattttgaatcgcgcagggttggcgacaccatcgcccgcgtacgcgaactagaaaacatccgccacttcctcaccggccaagcactgacctccgtcttagacctcctattcaccgtcgtctttttgtccgtcatgttttggtacagcagctggctcaccctgattgtggtgatctcattacccatatacgtactgatctccgcattcatcaccccagtactccgcaaacgtctggatgaaaaatttgcacgcggcgcagacaaccaagcatttttagtggaaaccgtcagcggcattggcaccgttaaagcaatggccgtagacccacgtgtcacccgcacctgggacaaccaactggcgggatacgttagcgccagctttagcgttaccaaaattgccaccctcggccaacagagcgttcaattagtacagaaactgaccaaggttgccgtattattttggggcgccaaactggtaattgacggacaactgtccctcggacaactaattgccttcaacatgttgtccggccaagtcactgcccccatcatccggctcgcccagctatggcaggattttcaacaagtcggactctccgtcgaacgactcggcgaaattctgaacacccgtaccgaactccccggcagccgcatgacattgccgcccatccaagggcgcatcaccttcgaacgcctcatcttccgctaccgtccagatacccccgacgtgctctccggaatcgacctagacattcaacctggcgaagtcatcggcatcgtaggacgctccggctctgggaaaagcaccctgacaaaactcgtacagcgcatgtacgtcccggaacgcggccgcgtcttggtcgacagccacgacctctcattggccgatcccgcctggctgcgtcgccaaattggcgtcgtactgcaagaaaatttcctgttcaaccgcagcgtccgtgaaaacatcgccatggccgacccgggaatccccctggaacgcgtcatccacgcagcgacattagccggtgcccatcccttcattgctgaactaccagaaggctatgacaccaagattggtgaacacggtacaggactctccggcggccaacgccaacgcatcgccattgcccgcgccctgattggcgacccacgtatccttattttcgatgaagccaccagcgcactcgactacgaatcagaacatgccgtcatgcaaaacatgcgagccatttgcaaaggccgcaccgttctcatcatcgcccaccgcctctccacagtccgtaatgccgatcgtatcgtcgtcattgataaaggaaaaatcgtagaaagcggctcccacgaaacactcctcaaccgcaacaacggtcattacgcccacctctaccgactccaa

SEQ ID NO: 33068 - DNA, 981 bp, Xylella fastidiosa
aagaaaacgattctttgttttggtgaagcattgatcgatatgttggcgcagcctccggtaaagaagggaatgccacgtgcgtttctgcaatgtgctggaggtgcaccggccaacgtcgcggtggcggtcgccaggttaggtggtgcggtgcagtttgttggcatgcttggtagtgacatgttcggtgattttctgttcgacagttttgccgaggcgggtgtggtgactgatggcattgtgcgtaccagtacggcaaaaacagcattggcttttgtggcgctggatgcacatggtgaacgtagtttcagtttctacaggccgccagcggctgacttgttatttcgtgctgagcattttcaagatgcgagtttttccgatgcactgatattccatgcgtgttccaatagcatgacggatgcagacattgccgaagtgacttttgaagggatgcgacgtgcgcaggccgctggtgcaatcgtcagttttgacctgaattttcgtccgatgttatggccgaatggagaaaatccggcatcgcggttgtggaaaggtttgtctttagctgatgtggtcaaactatctagtgaagaattggattatttagccaatacgctcgctgcagatgcgaatgcggtgattcagcaattatggcagggcagggcgcagttgctgttggttactgatgccgctggtccggtacattggtacacgcgtaccgcgggggggcaagtaccgacattccgtgtccaggtacaggacagtaatgcagcgggtgatgctttcgttggaggcatgttgtacacgtttgcacagcagtttgatgatgccgccgcgctgattgatttttgccatgatcccgagtcgattgtgagtacgttgcgttttgctgctgcagtgggtgcgcttgccgtgacgcgtcaaggggctttcactgctatgccgatgctttctgaggttctttctttgattcaagagcaatca

SEQ ID NO: 33069 - DNA, 876 bp, Xylella fastidiosa
gtccgcgattaccttactgccctacaagatcgcatttgcaatgtggtcgagaccatcgatggtcaatcgcattttcacgaagaccactggcagcgtacggaagggggggggggacgtacccgtctcttgcgtgatggtgccgtcttcgaacaggcagctattggcttctccgatgtctgcggtacacatttaccaccatcggccagcgtgcgccgtcctgaactggctggtgccaattggcgtgcctgtggcgtgtcactggtattccatcccaaaaatcctttcgtccctaccacgcatctcaatgtgcgctactttcgtgctgagcgtgagggcaaacaagttgctgcttggtttggcggtggttttgacctcaccccgttttatccctttgatgaagatgtcgtgcactggcacagagttgctcgtgacctatgcgccccatttggcgacgaacgttatgcagcgcataaacggtggtgtgacgaatactttgtactgcgtcaccggaatgaaacacgcggtgttggcggcttattctttgatgaccttgataaggattttgagcgcgattttgattaccagcgtgcggtgggagatggcttcctcgacgcttatttcccgattgtgactcgtcgtcatgacacgccctacggtgatcgtgagcgtgcgtttcagctgtatcgacgtggtcgctacgtagagttcaatttgttatttgatcgcggcacattattcggcttgcagagtggcgggcgtgctgaaagcattttgatcagtctgccgccgttggtacgctgggaatatggttaccaccctttaccaggcagtgccgaggcgcgtttggctgactatctattgccgcgtgactggctg

SEQ ID NO: 33070 - DNA, 933 bp, Xylella fastidiosa
cttatgcattcagtcgtcgtcgtcggctccttcagtattgatcatgtttggcgctgcgacacattgcctacacctggtgcaacaattgccggccgctatagccgtggtccaggaggcaaaggcttcaaccaggccgtagcggcttgccgcgctggtgcacgcacctatttcatatgcgcactcggcaatgacaccgacggcaacatggcacgcgacatcgccacaaaagacggcttcacactgatcggcgaatccagcaccgaacccactggtaccggagggatctatgtcgacagccacggccataacactatcgtcactggcgctggtgccaacgcagtactgagcacccacttcatcacagaacaacgcgccctaattacctcagcatggatcgtcttggcacaactggaatcaccgatagaaacactcgaaacggcgctcagaatggcgcgcgaagctggccgcttgaccatactcaatgctgcccccgccaatgcaaccgccacgatcaacctgctcaaattggccgacgtgctcacactgaacgaaacggaattcgtcgctttgctcagccgtcacgtcggtgaaaggatcagtcccgacaacgtcgccaccaccgatggcaacacactacacgccttatgcaacaaactactgtccagcagtacggttgtcattacattaggctcggctggcgtattcgtttcacactcggaagaaaacctgcgtggtgacacccagccctactatcgcgtggccgccgaacaggcccacaccgtagacaccaccggagctggcgacgcatttaatggtgctttggcagcatccctggcacggcaaccaaacacagcgtttatccagcacatacgcctcgccaatagctatgcagcgcgctcgaccgaaacagaaggtggagccgtatcaatgcca

SEQ ID NO: 33071 - DNA, 2016 bp, Xylella fastidiosa
atgagtaacccactcctcgatttctcagaccttcctcgcttcgacgcgatcctccctgaacacgttggcccggccattgagcagttgctcgcagaggcggaggcagccgtcgcccacgcggaacaggtaacgcctgtgacatgggagaacttcgtagtaccgctggacgataccacagagcggttgtatcgcgcatggggccaggtggcgcatttggaggcggtggtcaacacgccggcgctgcgtgaggcgtataacgtcactctcccgaaagtcactcgattcagcagtacgctcggacagaacctggcgctgtatgcgcagtacaaagcattagcgtgtgcgccggaatgggaccgtgataacgcagtacggtgcaaggttgttgataacgctttgcgtgatttccgtctcggcggtgccgagctggatgccgccgggaaagtccgtctggcagagatcaagcaggagctgtcggcattgtctgcaacgttttcgcaaaatgtgcttgatgcaacagaggcatggtcctacaccaccgaagccgccgctgtgttatccggtctgccgacagagactgtcgctaccgcgcgggcggccgcagaaaagaagggggtatcaggctggacgttcacgttacagatgccctgctatctgtcggtccaaagcgatgctgacaaccgcgcgttacgagagcgctcatatcatgctagtgcgatacgcgcttcggaatttggcgatgccgcgttggataatagtccgcacattcatcagattctcacgctgcgttccgaattggcagcgctgcttggtttctcctgttacgcggcatactcggtcgcaaccaagatggcagaggatccggctgaggtactcagcttcctgcatgacttggcaggacgtgccaagccgcatgctcaacgtgatcgccgtgaactggaaacgttcgcatgcgaggcgctggggcttgagacgctggaagcctgggacattgcatatgccagcgagaagctcaaacaagcccgttacagtttctccgagcaggaagtaaagcagtatttcaccgaacccaaggtcctggctgggttgttcgaggtgatccactccctttatggactgtggatcgaagaagacgccgcgccggtctggcatccagatgttcgcttctaccgtctcattgatatgaatgggcaacgcgtcggccagttttatctggatctgtatgcacgggagggcaagcgcggcggggcatggatggatgattgccgtaaccgccgtgacaaaagcgatggggtgcaaactcctgtggtctatttggtgtgcaatttcggccgtggtaacgacggtgtgctccctacgttccgtcatcaggaggtcattactttatttcacgaaatgggccatggactgcatcagttactgacccggattggggaactgggcgtggctggtattaatggtgtggaatgggatgcggtggagttgcccagtcagttcatggaaaacttttgctgggagtgggagcgcgttcaaaccatgacagcacacgtggagaccggtgcaccgctgccacgcagtctgttcgatcggatggtctgcgcgcgcaattttcagagcggaatgttcaccgtgcgccaacttgagttcgcgctattcgacatgctgctacatagtgacttcgatccagcacaggacagcgtactggggctgttagaacgcgtccgtgatgaagtggccgtcaaccggttaccggactggaatcgttttccgcaccagttcagacatatttttgctggtggttatgcagcgggatactacagttataaatgggccgaagtcctcagcgcagacgcttatgctgcatttgaagaggctccggatcaatttgccgaaataggggcgcgctttctcgacgaaatcctaagtcgtggcggcagtcgcagcgcagcagataatttccaggccttccgcaaacgcgcgcctcgcattgatgccttgctgaagcgcaacgggatg

SEQ ID NO: 33072 - DNA, 2262 bp, Xylella fastidiosa
ccagaacactctgttcaatataacgatggccgccccatcatctacgtgctggaagactatggcctgtgcaatacactgatcctggacaaagcctgccgcaaaaccaagttgccatccccattgataccgctgccagacaatccactacagcgcaagcgtgcttacttggccctgtcgcgacgtagctccagcaactcactgatccctaaccagcgcggcggcaaaacacactccgactcgctagccaatctactccaagcacaccgtatacgtgacacccttgatgtgcatttagtgcccgtatccatcttcattggacgtacaccagatcggcaaagtggctggtttgcagtgcttttctcggaaaattgggcgctcgttggccgcttccgacgcctcctggcggtattactcaatggacgcaacaccattgtgtgcttcgcaccccccatctcagtacgtcaaacactgaacgaaggtttgccacctgaacgtactctgcgcaagctacaacgtgtattacgcacccacttccgccgtattcgggaaacagtgatcggtccagatctgtcaacccgtcgcttactggtagacaatgttctggcaacagaagcagtgcgtgaagccattgccgcccaagccaagcgtgacggtaccgatctgtcggaaacctggcgcaaggcgcaagcttacgcctgggaaatcgctgccgactattccagccctgtcatacgttcggccgattttttgttcagccatgtctggaaccgcatctatgccggcgtactgatccaccacgtggatagcttcaaagaaaccgcaccagggcacgaggttgtgtatgtacccagtcaccgcagccatattgactacatgctactgtcgtactgtttataccaatgcggcatcgtgctcccacacatcgtagcgggcatcaacctcaatctaccgatcgttggcaccctgctgcgcaaatgcggcgcatttttcatccgtcgatccatcaaaggcaatatgctgtattcgatcgtgctcagcgaatacgtagcacaactggtggcaggtggttattcgctggaatattttatcgaagggggacgctcgcgtactggccgcctactacaacccaagggcggaatgatcatgatgacgctgcaagcgttcttgcgccaaccacgcaggccagtgctgttccaaccaatctatatcggctacgagaagctgatagaaggcaccagctacttggatgaactgtccggcgaacccaaaaagaaagaatcgatttggaggctattttggaatattcccaaagtgctcaaacagaagtatggccaggttgtggtgaacttcggcgagccaatcgcactcaacgacgtactcgccgaactagccccagaatgggaaggtcaagcactcaacgaaaatgagaaaccagcttggttatcaagcaccgtcaaccatctcgctcggcaaattcagactcgcatcaacagcgccgctgacgtcaacccaatcaacttattggcacttgcactgctatccacacctaaacatgcgatgggtgaagctgacctgatcgcgcaaattactctgtgcaaaaaaatactgcttgaattgccatattcaaaccgagtgaccgtcactccacacaccccagaacgcatcattgcccacgccgaacaaatcaacatactcacccgtgtccaccatccacttggcgatgtattgagagtcgatggagacaatgcagtcctgctcagttacttccgcaacaacgtgttgcatctatttactgcctccgcgtgggtggcctgttgcttcaaaaacaaccgacgcatgagccgcattgctctgatccgtctgggggttggtatgtatccattcctacaagccgaattattcctaccatggactgaggaccaatttgcccaacacatccaacaggtcattgaattatttgtccgggaagggctgctcctatcagccggcaatgaggaagaagacccactcacacgcaacacaagccagaccgacgaagtcttccgcctacgggcgatcagtcattcattgcaacaagcattcgagcgctactacatcaccatttcaatattggtgaaaaacggccctggaaccctcagtgcatccgaattggagagcctgtgccagctcgctgcacaacgcttaagcctgctctatgcgtcgaccgcaccggagttttttgataaaggactgttccgaggcttcatccaaaaacttcgcgaa

SEQ ID NO: 33073 - DNA, 1404 bp, Xylella fastidiosa
tacaaaatcgcagacatttccttggccgactggggccgcaaagaaatcgacattgccgagcacgaaatgccgggactcatgtccattcgccgcaaatatgccagcaaacaaccactcaaaggcgtacgcgtgaccggctcgcttcatatgaccatccagacagccgtactgatcgagacactaaaagatatcggcgccgatgtacgctgggcgtcgtgcaacatcttttccactcaagatcatgctgctgctgcgatcgccaccagcggcacacccgtgttcgcctggaagggagagacattagaggaatactgggattgcaccctgcaagcactcaccttcaccctggcggatggcacactgaccggcccagaattgattgtggatgatggcggtgacgctaccctcctcatccacaaaggctatgaattagagaacggatcaacctgggtcgatgaacccagcgactcacttgaagaacaggtgattaaacgcctgctcaaacgcatcgccattgagcgccccggctactggacccgagtcgtcaacgactggaagggcgtgtctgaagaaaccaccacaggtgtacaccgcctgtaccaaatcgctgcaaccggtaggctgctcgtacctgcaatcaacgtcaatgattcggtcactaaaagtaaattcgacaacctatatggttgccgcgaatcgctagctgatggtttaaagcgtgcaatggacgtgatgttggccggtaaattagcggtggtatgcggctatggcgatgttggcaaagggtcggcacatagtttgcgcgcctacggtgcccgcgtgattgtgaccgaaatcgatccaatctgtgcgttacaagccgcgatggagggttttgaagtcagaacggttgaggacacactcggtcaggccgacatctatgtcaccaccacaggtaacaaagatgtcatccggatcgaacacatgaccgcaatgaaagaccaagtgatcgtctgcaacatcggccactttgacaatgaaattcaagtcgatgcactcaataccctgactggggtacaaaaaatcaatatcaaaccgcaggtggataaattcatattacccaacggcaatacactctttcttcttgcagaaggacgcctcgtcaacctgggctgcgcaacgggtcatcccagcttcgtcatgtctaacagcttcgccaatcaaactctggcgcagattgatctgtggcaaaacaaagacgtttacgaaaaaaatgtttaccgcttgccaaaaaaattggatgaagaagtcgcacgccttcatctggagaaaatcggcgtgaaactcaccacactcacggctaaccaagccgcctatttaggcatatcagtagaaggaccattcaaacctgagcactatcggtat

SEQ ID NO: 33074 - DNA, 435 bp, Xylella fastidiosa
ctggaattaccaatcgatatcattaaaatccaagcattgctgccacaccgctatccctttctattggtcgaccgaatactggaactagaccagaagcaaaagcgtatcgttgctcagaaaaatgtgtccatcaacgaaccattctttcaaggacatttccctgaacatccagtcatgccaggcgttcttatcattgaagcacttgcgcaagccggcggcgtgatgacccaactagaccttagccataatgggcattccagcctcttgttttatatggttagagtcgacaatgcccgcttcaacaaacaggtggtgcccggcgacatcctgatcctggatatgacgatgaaacgacggatccgcaatatgggctgctactacggcgaagcgcgggttaacggcgaagtcgtcgcttgcgctgatatcatgtgtgct

SEQ ID NO: 33075 - DNA, 573 bp, Xylella fastidiosa
ctggattgggccaagggtgatggcttgttgcccgtgatcgtgcaggacgccgatacgctgcgtgtgctgatgcttggctatatgaacagccatgcattagaggtcacgcagcgcagccgcttggtgacgttttacagccgcagtaagcagcgtttatggaccaagggggagcgttctgggcatgtgctgcatctggtggccattgatgccgattgcgatgccgatacgttattagtgcaggcccgaccccgtggacccacgtgtcatctgggcaggaccagttgttttcctgcagcccctggacagtttcttggtgcgctggatgcgctggtggcggagcgcgaacgtgagcgaccacaagacagttacaccaccgcattgtttgagcagggtgtccgccgtatcgcgcagaaggtcggtgaggaaggggtggagaccgcattggctggcgtggtccaggctgatgatgcactccttgatgaatcagcagacctgctttaccacctgattgtgttgttgcgtgctcgtggtttatcgcttgccgatgccgttaccgtattagaggcacggcat

SEQ ID NO: 33076 - DNA, 765 bp, Xylella fastidiosa
atgttgagccgccgcatcattccatgcttggacgtgcgtgatggacgcgtggtgaaaggcgtgaagtttcgtgaccacgtggatatgggcgatatcgtcgaactggctttgcgttaccgtgatcatggcgctgatgagttggtgttttatgacatcggagccagtccacaagggcgttctgtggattaccgttgggttgaacgcgtcgcgcgcctgatcgacattccattctgtgtggccggtggtatcggcgaggttgagactgcccgtgctgtcttgcatgccggtgccgataagatttcgatcaactcaccggcactgcgccaacctgcgctgattagcgccttagccgaagcctttggggtgcaatgcgtcgtcgtcggcattgactcgatccgtgaggctgatggtcagtggcgcgtccgctgcaataccggggatccggacaaaacccaggccttgccgctgcgcaccctggattggattgttgaggcgcagcgcctaggggcaggggagatcgtattaaattgcatggacagcgacggggtgcgctgtggttacgacattgcacagctgtctcaggcgcgggcactgtgtcaggtgcccttggtggcttctggcggcgccggggacatgcagcactttgcggatgtatttcacaaggctgatgttgatggcgcattggcggccagcgtattccatagcggcgcgattttgattccgggtttaaaacagtttctgcgtgagcagcaaatcgaggtccgt

SEQ ID NO: 33077 - DNA, 1113 bp, Xylella fastidiosa
gtgtttattgaccgtgacggtacgctcattgaagagccgcctgattttcagattgatgcctacgaaaaactgcgccttgtcaacggcgtgatcccggcattgctgaagctccgtgatgccggctatcactttgtgatcgtcaccaaccaagatggattgggcagccccacgtatccccaagccagctttgatggccccaatgcgttgatgctgcaaatttttagtagccaaggcatcgtcttccgcgatgtgctgatcgatcgtagctggccggccgacaacgcgcccactcgtaaaccaggcatcggcttgatggtcgcctaccttcaagatcgcgacattgattgggcgcgctcggcaatggtgggcgaccgccccacagatctgcaatttgccgagaatctcaacattcgcggattccaattgcgtaccccgcaatttggtggtgactgggattgggacggcattgctcacaccttggccgatgcgccgcgccgcgccgtggtacagcgtcacaccaaggagacaaacatccgtgtcgagattgatttggatggcgcaccccaggcgcggatcaccaccggattaccgttttttaatcatatgctcgagcagattgccaaacatgccggcatttccttacagatcagcgctgttggggatctgcatatcgacgaacatcacacgatagaagataccggcttggcgctaggtcaggcagtgcgccaagccttgggggataaacgcggtattggccgctatggattcgatccgccccagctgccgtggcaggtgagcggcgcggcggcacacggtggctttaccctaccgatggatgagacccaagccagcgctgtgttggacttcagcggccgcccgtattttgtctttgaaggaaccttcgtccgtgagcgcgtcggcgatatgcccaccgaactggtaccgcactttttccgctccctgtgcgatgcctccgggatgaacttgcacttgagcgtgcatggcgacaacgaccatcacaaagtagaagcgtgtttcaaggcgctggcgcgtgccttgcgtcaggcgttacaacgccacggccacgtgcttccttctaccaagggggcgtta

SEQ ID NO: 33078 - DNA, 1065 bp, Xylella fastidiosa
acggtccttgacctggtacgtcaagaactacgcagctttgctggctactcctccgcgcgcagtgtcgctttgaccggtgacctctggctcaatgccaacgaatcggcctggcccaatcccgctgactcccacgccaccatgcgacgttatccagaaccgcaaccgcccaagttgcgccagatgctggcggcactctacggctgtcttcccgagcaagtattgattggtcgtggcagtgatgaagggatcgacttactggtacgcgccgtgtgcgaaccgagacgtgatcccgtcctggtcacccccccggtgttcggcatgtatgccgtttccgcacagttgcagaacgccccattgatccaagtccctttagttgatgacgccgcgggcttccatgccgacgtgcctgcgatcatcactgccgcacagacctcccgcgccaaactcgtgttcttgtgctcaccctccaatccggtcggtgccgcgatcccgctacagcagattgagaccatcttgcagacacttgccggcactgctctcgtcgtggtggatgaagcttacggagaattctccgatgtcccttccgtggtgcccctgctggcccgctacccacatcttgtcgtgctgcgtaccttgtccaaagcccatgccctggctgctgtgcgtatcggcagcgtgatcgccgatgcccatttagtcgcggtattacgtcgctgccaagcaccgtatcccttgcccaccccctgcgtgagcttggctgagcaggggctgtcagccgccgcgttacacgttaccgcacagcgtgtggccgagatccgtgctgagcgtgagcgcctgcgtgccgccctggcctgtctgtctggcgtgcgccgcgtctatccctcccaagggaacttcctactggtgcgctttgatgatgccgaggccgcgtttcaggcgctgtacgccgctggcgtcgtcgtgcgcgaccagcgtgccgcaccgcagttgcatgatgccttgcggctgaccgtgggaacccccgaacaaaacacacgtctcctggccgtgttgcgtgacatccag

SEQ ID NO: 33079 - DNA, 830 bp, Xylella fastidiosa
gtcgtcttgtgtacccaccctctaaagatggccgcgccaatccggcggtcctgctggccgcacgtctcaccggagtcacccaggtcttcacactgggcggcgcccaggccatcgcggcgatggcttacggcaccgcaagcgttcccacttgtgacaaagtgtttggccctggaaatagctttgtcaccgaagccaaacaacagcttgcacaagccggcgtcgtcgcaatcgacatgccggcaggcccctcggaggtcctggtgatcgctgatgccgccgccaatcctgcgtttatcgctgctgatctcctctcccaagcagaacacggcccggattcccaagtcctcctgttatctgacagtgatgcactgatgacagcggtacagaatgcccttgctctccaattgcagcagctatcccgtgccgagatagcgcgtcaggccttagcgcagtccaggttgattaaagtggccaccctggagactgcctttgacatcagcaaccgctatgcgcccgaacatttgattttggcattgcgccaaccgcgtgcctggctgcatcgcgtcgcagccgccggttccgtcttccttggcgactacacccccgaagccctgggtgactattgcagcggtactaaccacgtcttgcccaccggcggtgcagcccgcgcctatagcggcgtgagcgtctccagcttccaaaacatgatcagcgtccaagcggccagccgcagcggtattgctgaaattggcggctgtgcattgaccttggcgcgtgccgaaggattggatgcacacgccaatgctgtcgccttacggatgggatcagcc

SEQ ID NO: 33080 - DNA, 1719 bp, Xylella fastidiosa
accgacgcccaagcccaacctgagaagaaagactttatccggcagatcatcagagaagacttagcccacggcacacacactcacatccacacccgtttccccccagaacccaacgggtacctgcacattggccacgccaaagcaatctgcctggattttggcgtcgccgcggaattcggcggacactgcaccctccgcatggacgacaccaatccgagcaaagaagaccccgccttcgccgctgcaatccaggaagacgtctcttggctaggcttccattggaacgcactacgacatacatcggattatttcgaagtgctgtacctagccgcagaaaaactcattgccgatgggaaagcctacgtctgtgacctcaatagcgaacaggtacgcgaataccgcggcaccctgacagaagcgggccgtccctcaccatggcgtgaacgcagccctgatgaaaatttagaactattccgacaaatgcgcgccggcacgtttccagacggaacacgtaccctgcgtgccaaaatcgacatggctagcggcaacatcaacctgcgggacccagcgctctaccgcattaaacacgtcgaacatcaaaacaccggcaacacctggccgatctaccccatgtatgacttcgcacacgcactgagcgatgcgatcgaaggcattacccattcattgtgcaccctcgagttcgaagaccaccgccccctgtacgactggtgtatcaaccatgtcgacctaccaaacaactcacacctactcaaaccgttactggacaaaggcttccctcaagagcccagccaacctcggcaaatcgagttttcgcgcctgaacatcaactacaccgtgatgagcaaacgcaagctcaccgcactggtagacgaaaaactcgtcgaagggtgggacgacccccgcatgtacaccctgcaaggcctacgccgccgtggttacaccccagcggcgatgcgcctattcgtagagcggatcggcatcagcaaacagaactcaatcattgatttttcagtactagaaaactgcttacgcgagaacctggacaccattgcaccacgccggatggcaaccattgcaccaatgaagctcgtgctgaccaacctacccgaagaccatgaagaacaactgatcttccccaaccatcccaaagacgacacacaaggcacccgaacagtgccgttctcacgcgaactatggatcgaacgcgatgatttttccgaagtcccccccaagggctggaaacggctggttccaggcggagaagtacgcctacgcggtgccggcatcgcacgtatagatgaggtggtgaaaaacgcagaaggccacatcatcgcactacacggctggcttgatccgacctcacgtcccggcatggaaggcgctcaccgcaaagtcaaaggcaccatccactgggtcagcgcaccacacgctgtagcagcggaaatccgcctgtacgaccggctgttctccattgaaaaacccgacgacaacaccgacggaaaaacctaccgcgacttcctcaacccagactccaaacgcgtcgtgcatggctacatcgaaccagcggcagcacaaaccgcaccagaacacgcattccaatttgaacgcttgggctacttcgtcacagaccggcatgaccacgatgccacacaccccgtctttaatcgcagcgtcacgctgcgcgacacctggcagcgc

SEQ ID NO: 33081 - DNA, 498 bp, Xylella fastidiosa
atgaatcccgctcccaatcttgtgatgatcggcccgatgggcgccggaaaaagctccatcggacgacgcattgccaaacacttcaacctacacttcgcagatacagatcacgccatcgttgaacgcgccggtacgagcatctccactattttcaaatattccggcgaaccagaatttcgacgcctggagcgtgaagtactgcacgacttgctgaatcacgaaaaccgactcatcgccaccggcggcggtacgatcctggatccagagaaccgccaccgcatgcaagaacgcggcttcgtcgtatttctaaagatcaacgtgaacacccaattggagcgactggcacatgaccgctaccgaccattactgcaacaaatcgaccgcaaacaggtgctgagcgatctctacgccacacgccaaccgctctaccagaaaatcgcagatatgattgtgaccaccgaccacatgtcccctaacacagccaccgcccagctcatt

SEQ ID NO: 33082 - DNA, 939 bp, Xylella fastidiosa
ctgcgcagcgtcaccgtcaacacccccccaccctataccatcgctattggtccctgcctattgcacgatcctccacgcctggccgccaccatccgcggtcggcatgcactcattctcagtgattctgaagtcgccccgcgttatgccgcacaactgcatgaaacgctactgcgcgcccgtcccgatctacacctcaacgtattcaccctgccagccggcgaaacatccaagtccctagagaacttcggcgccgcaatcgcccaactcgccacactgggcgccacgcgtgatgcctgcctctttgcactcggtggcggtgtcatcggagatctaacaggctttaccgccgcctgctggatgcgtggcatcgactacgtacaagtgccaaccaccttattggcgatggtcgactcttccgtcggcggcaaaaccgccgtagacatcccccagggtaaaaacatggtcggtgccttccatccgccacgtgcagtgatcgccgacaccgacacccttgccacactcccgctacgggaactacgcgctggtctgagcgaagtcatcaaatacggcgcaatccgcgaccccgtattcttccactggctccaaaccacacgcgaagcacttctagcacgtgaccccgccgcactggcccaagcaatcgcacgtagctgcgaacacaaagccgatattgtcggacgtgacccactggaaaaaggggaacgcgtcctgctcaatctcggccataccttcggccacgccatcgaaacaacacagggctacagcacaccaggaagcaacaacctcaaccacggtgaagccgtcgccgtcggcatggtacttgccgcacgcttgtcaaacacattaggtctggcacccgcagaagacaccgagacactgaaaaacctactggatgcctacggcttgcccactgtcctgcct

SEQ ID NO: 33083 - DNA, 1356 bp, Xylella fastidiosa
agtcttttccatgaagacgatatccacggtgtggtccctggcgagttgaacccaggtgtggcgaagttgatcggtcaagcgatcggcagtgcgatgcaggccaaaggtttgagtgacattgtgattggccgtgacggccgcgtgtccagttctgagttgtccgcggcattaagtgatggtctacgtcatgccggttgcaatgtggtagacatcggcttggtgccgatcccggtagtgtatttcgctgcctgccatcttggcgttggtagttgcgttgcggtcacaggggggcatcatcctcatgattacaacggtttcaagatcgtgcttggtggtgagtccttatccagtgaggcgatgagcgatttgtatcaatgcatcaccaatggtcgcttatatgcgtccgttgactccggcagtttgagtgagcgtgatgtggttgacgattacattcagcgtattgccgatgatgtgcagttgaatcgtccgctgaagattgttgctgatcctggtcacggtgcggctgaagagatcctgtcacgtttattcaaggcgattggtgcggatctggtgtcactgtacggtgatattgatggtgtttcccttattgtccatcctgattcggacgagccagggaatctgcagaagctgattcagcgggttgagcaggccgatgccgatttgggtcttgcttttgatggggatgcggcaagtctcagagtggtgactcgagaaggtgaggtcattttatcggatagcgtgttgatgttgtttgcgacggatgtgctacagcggaatccgggtgctttggtgatctatgatgctgaatgtactagcaagttgtctgattatgtattgcgcaacggcggcagcccgttgatgtggaagaccgggcattcctccatcaaagctaagatgcgcgagaccggtgccgagttggctggtgaaatgagtggctatttcttcttcaaagaaggctggtatggtttcgaggatgctctgtatgcggcggcgcgtttgctggagatcttagcgcagcgcgaggataatccgtcccaggtgtttgctgcattgccccatgcttatttcactgcgcaaatggagcagtctgtcgagggtgatgcgcaggcatgtgtacagtcctttattgaggaagtgcagcgtagcgttgagggcggtgtgttcgatggtgctcgtttgttcgcctttgatggtttgcgtgctgatttcactgatggttgggggctagtacgcgtttctgacactgcatctgcactggtgttgcgttttgaggctgacacgcaggctggattggagcggattcagagtgcattccgcacgcatctgcaggcatta

SEQ ID NO: 33084 - DNA, 1866 bp, Xylella fastidiosa
acctggtctcaagatctggcccacaagacgtattcgatccggcattgggctgatgggtatttcgaggtgaacgatgctgggcacatggtggtgatgccgctcggtggggatggtgtgcggatctcgctcccagaggttgtggatgctgcgcgtgccgccggtgccaagttaccgctgctgctgcgtttccctgatattttgcggcatcgtctgggtaaattgcaggcggcgttcgttcaggcacagtccgagtgggagtatgcgggtggttacactgctgtttacccgattaaggtcaatcagcatcgcggtgtggcgggtgttctggcgagtcaccagggggatggtttcggtttggaagccggtagcaaaccagaattgatggcggtgttggcgttatcgcgtcagggtgggttgattgtttgtaatgggtataaggatcgggagtacatccgtcttgcgttgatcggacgcaagcttggtttgaagacttttattgtgattgagaagccgtctgaattgagaatggtgcttgaggaggctaaaacgctcggtgtattgcctggtttgggcgtccgggtgcgtttggcgtcgttgggtgccggaaaatggcagaacagcggtggcgataaggcaaagttcggtttgtcgccgcgccaagtgttggatgtatggaaggtgttgcgtggtactgagtatgccgattgtttaaatgtgatgcattttcatatggggtcgcagatctccaatgtgcgcgatatcgctaaggggatgcgtgaggcgacccgttactttgtcgagctttcgcgcttgggtgcgaagatcacgcatgtggatgttggtggcggtcttggcattgattacgagggcacgcgttcgcgtagtgactgttcgatcaattatggtttgcaggcgtatgccagtcatatcgtgcagccgctggcaagtgcgtgtgaggattatgatttggtgccgccacgcattgtcacggagtgtggtcgtgcaatgacggcgcatcatgcggtgctgatcgctaatgtgaccgaggtcgaagcggtgccggagggtcgggtgccagggttgtgtgatgatgagccggcggtggttcgccacatgcgcgagatttacggggagttggatgcgcgtccggcaatagagttgttttatgaagcacagcactttcatgctgaggggttggcggcttacaccctcgggcagattgatttggtgcatcgcgcacgtattgatgatttgttttatgcgatttcgcatggggtgcgggagcgtctcagtcacgaggagaagagtcaccgtccggtgttggatgagctgaatgagcgcttggttgataaatattttgtcaatttcagtgtgtttgagtcgattccggatgtgtgggctatcaatcaaatttttccgattgtccccattgagcgtttgaacgaggcaccgacccgacgtggtgtggtctgtgatttgacctgcgattcagatggtacggtcaagcagtatgtggaaaacgagagtctggacagtgcgttgcctctgcatgtgttgcgtcatggcgaggcttacaggattggctttttccttgtgggtgcttatcaggaaatccttggcgatatccataatttgtttggcgataccgatgcggttgaggttgcagtcgacggcagggggtatcgtattgcgcagcagcgttgtggtgatacgaccgatgtgatgttggactatgtcggttatgcgcttgatgaggtgcgcagggtttatgcgcaacgtattacggcagcggggatgtctgctgcggagtccaaggcattgagcgatatgttggaagccggtctgacgggttatccctatttgtca

SEQ ID NO: 33085 - DNA, 1029 bp, Xylella fastidiosa
ggcttcgctgctctatcggctactggcccgcttgaacggttcgctttcggacggagagctcccagaccggatgacgtcgtcatcgatatcctttactgcggtgtctgccacactgatctgcatcttgcccgtaaccacggcggctttactacttatccaatcgtgcccggccacgagatcatcggttgtgtacgcgagatcggcaagacagtcacccgctttaagcggggcgatctggttggtgttggttgcatggtcgattcttgccagcactgccagccttgtctcaaagggtgggaacaggactgcattgaaggttcgatcttcacctataacagtactgatcggcgggatggcagtatcacctatggtggctattcagatgtcattgtcgtgcgtgataagttcgtgctgtcgttgcctgatggtctcgatccagccggagccgcgccgctgctttgtgcgggcatcacgacatggtcgccgctgcgtcgctggaatgtcggcaaagacagcaaggttgcggtggtcggtcttggcggcctcggacacatggccttgaagctggctaaggctcttggagccgatgtgacgttgttcacgcgttcttccggcaaagagggagatgccttccgtcttggagccgaccgtgttgtgttgtccagcgatctggagcagatgaaagctgtctacagccgctttgacattatcatcgataccgttccttatgatcacgacgtcaatccctatatgcccacccttgtacttgaaggtgtgctcgtactcgtcggctatttgggaccgctcagcatgcctgtgaacgctggaggtgtggtacgtggccgtagggccatttcggggtcgttcattggcggtgtgcctgaaactcagcaaatgctcgatttctgtgggcagcacggcattgtctctgatgtcgagatcatccccatccagaaaattaacgaggcctatgagcgtatgttgaaaagtgacgttaagtatcgtttcgtcattgacatgacttcgctg

SEQ ID NO: 33086 - DNA, 1041 bp, Xylella fastidiosa
atgtttatcaatgcttacggcgcacatgctggagataaacccttggagtcgatgcagattgcccgtcgtgccccgggtgtgcatgatgtgcaaattgacattcattactgtggcgtgtgccattccgatattcatctagtccgctctgaatgggcgggcacgctttttccgtgtgtaccaggacatgaaattgtcggtcgggtctctgccatcgggacgcatgtgcagggctttaaggcgggagatcttgtcgctgttggctgcatggtcgatagctgcaaggattgccaggagtgcgatgcagggttggagaattactgcgatggcatgattggtacctataacttcccgactcaggatgctccgggccacacattgggtggttattctcagaagatcgttgtgcatgagcgttttgtgttgcgcatccgccaccctgaggcacagcttgccgcagttgccccgttattgtgtgccgggattacgacgtactcgccactgcgccattggaatgctggtccgggtaagaaagtcggcattgtcggcattggtggcttgggtcatatggggattaagttggctcatgccatgggggcgtatgtcgttgcattcaccacgtccgaatctaagcgacaggatgccaaggcgctgggagcagatgaggtggtggtgtcacgtgatgaggaaaggatggctgcccatgtaaagagtttcgatttgattttgaatactgtggctgcctcgcattctcttgatccgttcctgactctgctgaagcgggatggtacattgaccttggttggtgcgcctgctacgccgcatccttcaccggaagtcttcaatctgatctttaagcgtcgttccattgctggatcgttgatcggtggtattgcagaaacacagcaaatgctggatttctgtgcgaagcatggcatcgttgcggacattgagttgatccgtgccgacggtatcaatgaggcctacgaacgaatgatgaaaggcgatgtcaagtaccgttttgtgattgacaacgccactttg

SEQ ID NO: 33087 - DNA, 1680 bp, Xylella fastidiosa
atgagtcaaacacgtccttggctgcaacactatccatcgggaatctcaacagagattgatactgacgctttccgtactatcgctgatgtcttcaatacatcagtcatcaaatatcgtcattgtcccgcctatactaatttcgggaaaacacttacctacggcgaagtcgacctattaacaaaacaattcgccagctatctgctcaatgtgttgaaactcaaaaagagcgaccgaatcgcactgatgatgctcaactgtttgcaatatccagtagcgaccttcggcgcgctatgcgccgggttagctgttgtcaatgtcaaccccctctacacagcgcgcgaactcaagcaccaactggttgacgcagggagcactgtattggtggtcatggacaacttctgtacaactgtgcagcacatcattgctgacaccccaatcaaacaggtgattacgactgaattaggcgacctgctcgatttccccaaaagatcactgatcaattttgccgtcaagcacatcaaaaaattagtgccggaataccaactgcctcgctcaatccgcttccgtgaagcactcgcgctgggaagcaagcattccatgcctccaatccacatcgccagtgacgatttagcttttctacaatacaccggcggcacaacggggacacccaaaggcgcaatgctgacccacagaaatatggtcgcgaatatgcagcaggtgtcgcagtggctccaaacaagcaacagtctcaaagaaggctgtgaaacagtgctcactgctctaccgctgtaccacatttttgcgttaaccgcgaacaacttagtctttatgaaaatcggtggttgcaaccatctgattagcaatccacgcaacatgcgagcattcgtcaaagagttgcaacgcgtccgcttcactgtcatcactggagtcaacacactcttcaataaactccttaacaccccgggcttcgacaaacttgatttctcttctctgaagattgccctgggtggcggcatggtgatccagcgctccgtcgccgaacagtggaagcaagttactcatgttccgctgattgaagcttacggacttaccgaggcatcaccagcggcatgcatcaatccgctgaatctgcaagaacataacggttcgatcggtatgccgatccctagtactgatgtctgtattaaagatgacaccaacaccgtattacctataggcgaaattggcgaactgtgtattaaaggtccgcaagtgatgaaaggctactggcaacgcccagaagaaacttcagaagtgttagatgcagacggttggctgcatactggggacattgtcaaaatggacaaacaagggtttctgtacatcattgaccgtaagaaagaaatcattcttgtctctggcttcaacgtctatccgaaggaaatcgaagaagtcatcgcaatgatcccaggcgtggctgaagtcgctgcggtcggagtcccggacgagcagtccggcgaagtcgttaaggtagtgattgtcaaaaaggatcccatgctgaccgctgaggaagtaaaggcgcatgctgcgaccaacctgaccagatacaagctaccacgcatcattgagttccgtgcgacactccctaaaaccgatgttggcaagattttgcggcgcgaattgcgagacgcagcaccggca

SEQ ID NO: 33088 - DNA, 2703 bp, Xylella fastidiosa
atgcgcgattcattctccacccatcgtcaattacacgtcgggaaccagtcttaccactattacagccttacgaaactgggtgagcacttcgacatatcgcaccttccctactcaatgaagatcttgctggagaatctgctccggcatgaagacggcggcgtcaccgtcagcaccgcgcatattgaggcagtggccaaatggaatcccaaagccgagccggacaccgaaattgcattcatgccagcccgtgtgttgctacaggacttcaccggagttccctgcttagtcgacttggcagccatgcgtgacgcagccatcagactcggcggcactgcagagcagatcaacccacacatcccatcagaacttgtcattgaccactccgtacaggttgacgtttttggcaaaccggaggcactagaacgcaacggcaacattgagttccaacgcaacaaagaacgttacggcttcctacgctggggccaaaaagcattcaacaacttcaaggttgtaccgccgaataccggcatcgtccaccaagtcaacttagaacaccttgctcgcgtggtcatgacgaccgaaaaagagggcgccacctgggcctatccagacaccgtgttcggtaccgacagccataccacgatgattaacggaatcggcgtactcggctggggcgtcggtggtatcgaagccgaagcggcaatgctgggtcagccctcttcgatgctgatcccccaggtggtcggcttcaaactcactggcacactccccgagggcgccacagccactgatctggtgctgactgtcacccagatgctacggaaacacggtgtggtcggcaaattcgttgagttctacggcgatggcctagcacatctgccactggctgatcgcgccaccatcggaaacatggcaccggaatatggtgccacctgcggcatcttcccgatcgacacagaatcattgaattacctacgcctgtcaggacgcagcgaatcgcaaatcgcactggtccaagcctacgcaaaagcacaggggctgtggtatgcgcccaacaccccgcctcccagttacagcaccacgctggaactgaacatggacgacatcaaaccatcgttggccggtcccaaacgtccccaagaccgtgtgctactgcaagacatgcaaaacaactaccgcgaacacgttcgcgcactgaccgcacatcgcaccaccaaagccaacgatcacgacacacaccccatcaagggacaagttgacctcgatatcaacggacaaacactgcaactcaaggatggcgccgtcgtcattgcagccatcacttcctgcaccaacacttctaatccggcggtgatgttcggcgctggcctgctggcacgcaatgccgttgccaagggactgcaacgccaaccctgggtcaaaacctcgcttgcccctggttcgcgtgttgtcacggactacctggagaaagccggcctgctcaacgatctggagacactcgggttctacgtggttggctacggctgcactacctgcatcgggaattctgggccactgcccccagaagtgagcgcaggcatcgccaagggcgacttggtagccgccgcggtactgtcgggaaaccgtaactttgaagggcgcatccatccagaagtcaaaatgaactatctcgccagtccagcactggtcgttgcctatgccatcgcaggcacggtcaatagtgatctgacctccgagccattgggcaatggcaacgacggacagccggtttacctgcgcgacatttggccaagcaacaaacagattggagatgccatcgccgccacaatcggtccggagatgttccaacagaactacgccgacgtgtttaaaggtgacacccgctggaacaccatcgcctcaccaaacggagcgttgtacgcctgggacgcccactcaacttacatcaaaaatcccccatatttcgatgggatgacgatgcaaacagagcctgtcaaggacgttcgcggcgcgcgcgtgcttggcctgtttgctgattcgatcaccaccgaccacatctccccagccggcaacatcaaacaggattctcctgccggacgcttcctgcaagaacatggcgtacagcctaccgacttcaacagctacggcagccgccgtgggcatgacgatgtcatggtacgcggcaccttcgccaacatccgcctcaaaaacctcatgctcaacggcgaagaaggtgggaacacatggtatcgccccaaagccggtgggccaccggagaaaatgtcgatctatgacgccgcaatgaagtacaacacagacggcgtcccgctggtggtaatcgctggaaaggagtacggcactggctcctcacgcgactgggcagccaagggaaccaaactccttggggttaaagccgtcattgccgagaatttcgagcgtatccaccgctccaacctcgtcggcatgggcgtactgccactgcaatttctcgacggccagaacgcacagacactgggtctggatggatcggaaatattcgatgtgaccggtttggagggcactatcagcaaacatgccaccgtgagtgcaaaacaatccgatggcagcataaaacagtttcaagtcaaggtcctactgctcaccccgaaggaagtggactacttcacacatggtggactgctccagtatgtgctgcgccatctg

SEQ ID NO: 33089 - DNA, 1827 bp, Xylella fastidiosa
atgtgcggtattgtcggtgctattgctggccgtgatgtggttcctgtgttgattgagggcctcaagcggttggaatatcgagggtatgattcttccggtatcgcggtgcttgagagcgggtcaatccggcgggtgcgtcgtactgggcgggttgctgaaatggctgtcgccgcaacgcaagagggatttacagcatcgcttggtatcggtcatacgcgttgggcaacgcatgggggagtgaccgaggccaatgcgcatccacatgtgagccacggtgttgtgttggtgcacaacgggatcattgagaattacgaggtgcagcgcgagcgtctgtctgccttcggctatgtcttccagtcgcagacggatacggaggtcattgcgcatctgattcattactacatgcagcaaggtggtgatcttctgggggcgttgcagtgtgcggtgaaggcgctgacggggatctatgcgttggcggtgatgagtcaggctgaaccagagcgttttgtctgcgctcggatggggtgcccgttattgattggtataggggatggtgagagttttgttgcttctgacatctctgcgctcatccaagcaacacgtcaggtgatttttttggaggatggcgatactgcggagattcgccgtgatggaatcagtattttcaatgcggaacagtgtctagtggaacgtccattgcatctgtcgaatgtgtcgctgtcttcgttggaattgggggagttccgtcatttcatgcagaaggagattcatgagcaacctcgggtgcttgccgatacgatggaggcggcgatcgatgcggctggatttccacccatgttgttcggtgcgcaggccgagtcggtgttccgtggcattacgggtatccagattttggcgtgtggcaccagttactacgctggtttgaccgcgcgttattggattgaggcgattgctggtttgccatgtcacgtggagattgccagtgagtaccgttaccgtaaggcgtatgtcaatccacagcatttggtggtcacgatttcccagtctggggagacgctggacacattggaggcgttgaagtacgcaaaagcattaggtcaccgtcatacgctgtcgatttgtaatgctcctgacagtgcgattccgcggatcagtgagttgatttgctatacccgtgcaggcccagagattggtgtggcttcgacgaaggcattcaccactcagctagtggtgctgttccagttggctgtggcattgggggtgctgcgtggggctgttgatgccgaggatgaagcggcgtatttggagcaattgcgccaattgccttgcagcgtacagcaagcactcaatctggaaccgcagattgctgggtgggcggagtgttttgcgtcgcgtcatcatgcgttgtttcttggtcgcggtttgcattatccgattgcgttagaaggtgcgctcaaactgaaggaaatctcttatatccatgctgaggcatatccggcgggtgagttgaagcatgggccacttgcgttagtggatgctgatatgccggtcgtggtgattgcaccgaacgatagtctgttggaaaaggtgaagtccaatatgcaggaagtgcgtgcgcgtggtggggagttgtttgtgtttgctgatcaggacagtcactttagtgaatcggaaggtttgcatgtgattcgtacgctgcgccacacgggggtattgtcgccgttagtacacacgattcctgtgcagttgttggcttatcacactgcgttggtacgtggtactgatgtggataagccacgtaatctggcgaagagtgtcacggtggaa

SEQ ID NO: 33090 - DNA, 795 bp, Xylella fastidiosa
atcgcattcatcggcggcggcaatatggcgcgcagcctgatcgcaggcatgatccgccaaggcgcccccagcacgtcaatatgcgtcatcgaaccaatcgccgcactgcgcgacgcacttatggctgacttcaacatcaaggccgtcaccacagccacagaagcggccaccgacaccagcacctgggtgctggccgtgaaaccccaagtgatgcctgacgtgtgtgccaccctgccacttccagtgcaacccaacacaccactggttatctcaatcgctgcaggcatcaccacctgcaaactcaaacactggcttggcgacacctgtgcgattgtgcgcgccatgccgaataccccagccctgctaggtgccggcgtaaccggactattcgccacctcacaaaccacgggcacacaacgcaccctcgctgaagaactctttaacagcgtaggcaagaccctatggatcaccgaagaagcgttaatggacgccgtgactgcagtatcagggagcggtccagcctatgcgtttttgcttgccgaagcgatggaaacagcagccatcatgcaaggcctctccaccgcaaacgcacgcacactcgtccagcaaaccctattgggtgccgcacgcatgatgaccgagtcaggggaaacacctgccgcactgcgccaccgcgtcacctcaccgcatgggaccaccgaagccgcaatcacaacatttcaagaaaacgacttccaagcacttgtcgcaaaagcgatagacgccgccaccctgcgcgcacgcgccctcggaaag

SEQ ID NO: 33091 - DNA, 603 bp, Xylella fastidiosa
cgtatcaagttttgtggtatgacccgcgttggagatgtgcggttagccagcgagcttggtgtcgatgcggtgggactcatttttgcatcgggcagctcgcgtctgctgacagtttccgcggcatgtgcgatacgccgaaccgttgcgccgatggtcaatgtggttgccctcttccaaaataacagcgcagatgagatccacactgtggtgcgcacggtacgtccgacgttactccagttccacggtaaggaggaagacgcattctgtcgtaccttcaacgtgccctacctaaaggcaatcccaatggcgggtgctgaagcaaagcgcatctgtacgcggaccttatatttgaagtacccgaatgctgctggtttcattttcgacagtcatctcaagggtggcaccggccagacgttcgattggtcgcgtctccctatcgatctgcaccatccctttctacttgccggtggtattactccggaaaacgtgtttgatgcgattgctgctacggtcccttggggcgttgatgtttctagtggtatcgaattgcagccgggcatcaaggatggcgacaaaatgcgtcaatttgtcgaagaagtacgg

SEQ ID NO: 33092 - DNA, 960 bp, Xylella fastidiosa
atctacgctagaatcgcaggcacaggcggttatttgccggaaaaagtgctaactaatgacgatctggcccatatcgtcgataccagcgatgaatggatccgcactcgcactggtatccgtgagcggcatattgctgccgaaggcgaaacgaccagcgatttggcttatgaggctgcgatacgtgcacttgaagctgctgaggtgcggtccgctgatttggatttgattgttgtcgggaccacaacgccggacttgatttttccgtctactgcttgcttgttacaggcacgtcttggagctgttggttgtggtgcgttcgacgtgaatgctgcatgttccggttttgtatatgcgttgagcgtggcagaaaaatttgtgtcttcgggttgctccaaaacagtgttagttgtgggggccgataccttgacccgaattatcgattggagtgaccgcacgacttgcgtactattcggggatggtgccggagcggtggtgctcaaggctgatgaagatacagggattctcagtacccatctgcatgctgatgggagcaaaaaagaattgttgtgggatcctgttggtgtgtcagttggttttggtgaaggtaaagattgcggcgcgctgttgatgaagggaaatgaggtgtttaaatatgccgttaaagcccttgatagagtggttgatgagacgttggaagcgaatcatctggataagcacgaactcgattggttaattcctcaccaagccaacttacgcattatcgaagccaccgcaaggcgtttagatatgtcgatggatcaggtggtggtcacggttgatcgtcacggcaacacttccacggcttcggtgccactcgcgcttgacgaggctatccgttctggtcgtgtgcagcgtggtcagttactgctcctggaagcattcggtggtggttttacttggggatcggcgttactgcgctat

SEQ ID NO: 33093 - DNA, 1329 bp, Xylella fastidiosa
ggctcggaaggctggcgccttgatgccatcagtcgccgccagtacagcgaagacgactcgcagtgcttttcctgtgccgatgcagtggcgctgccacgtgacctcaacgaggtagtggcaatcgtacgtgcctgccgtcaacatcgcgtgccagtgatcccacgaggtaccgggactggcaccgtgggtggtgcagtgccgctccatggcggcatcgttctgtcattggcacgtatgaaccgtatcgtcgcgctgctgccagatgatcgctgcgcagtggtacagcctggggtgatcaacaatgacttacaacaagcactggcaccacatgggcttttttggccaccagatccgtccagtacagcgatgtgcagtatcggcggcaatcttgcaacgaatgccggtggcccgcgtacggtgaagtacggtgccacacgagataacgtacttggcgtcgtcgcagtgaccggtgtcggcgatgtgatccgctgtggcggtgcttatacgaagaacgccaccggttacgatctggcacatttgttgattggcagtgaaggcacattagcaatcatcgtcgaagccacgctaaagctggcaccacaaccacaagctatcgctggcctgcgtgcgttctatcaagatacggccgctgccgctgccgcagtgtcacgactgatgtcacaaccggcaataccagcaacgctggagttcatggaccacaaagcaatcgagctgctgtatcgcaatggcagcaatattcctatggccggcgcgatgctgctgattgaaggagacggcaatcacgacacgcttccctatgtattacaagcactggcgcaagccgcttcaggtgaagggctgatggaccttgacgtggccatggatggagccgcacgcgatcagctatgggcggcacgcaagtcactatcgccaatgcttcgcacgattaaacctggaaaactaaacgaagacgttgttgttcccgtctcgcgtattcctgatttggttgctggcatagaagtattggctgccgagagcggattacccattgtcacatttgggcacgccggtaacggaaatctacatgtgaatatcatgtatgacgatcaggatgcggaagacattatgcgggcgcaggcaacgctaccaaagctatttaagttagttttgactcttggaggcaccctgtcaggtgagcacgggattggcgtagccaaacgtgacttcatgacacaagcattcgacacaccaacgctagcagcaatgcgtgcgatcaaggccgcattcgatccagacggtattctcaatccaggtaaagtgctacccaga

SEQ ID NO: 33094 - DNA, 1290 bp, Xylella fastidiosa
atgggtcagtcagttgtcgtgctcggtgcccagtggggcgatgaaggaaagggcaagatcgtcgaccttctcaccgaggaaattggtgctgttgtgcgttttcagggaggtcacaatgctggccacactctggttatcaatggtaagaaaaccgttttgcatcttattccatctggaattttgcggaatggtgtgctctgcctgattggcaacggtgtagttatctcgccagccgcattgcgaaaggagattgaggagctggaagataccggtttggaaatacgttcccgtttgaagatttcgccagctgcgccgttgatcatggaatatcacattgcactggatcaagcacgcgagaaagcggctggcggtagggctattggtacgaccggtcgggggattggtccggcgtacgaggacaaggtcgggcgtcgtggtattcgtgtcgctgaccttcattacccagaccaattggcggaaaagctacgtgctgcgttggattaccacaattttgtgttgactcgatattttggtgtggatgggatggatttccagcggatctatgacgagatgttagtgttcgctgaatacgtcgagccgatgaaatctgatgttgcgggtatcctccatgacctgcgcaagcaaggcaagcgagtgctctttgagggtgcccaagggacattgctggatatcgatcacggcacctatccgtacgtgactagctccagcacgacggttggtggtgctctcagtggtgctggtgttggtgtccaggatatcgactatgtgttgggtattgctaaggcttatgcaactcgtgttggaggtggtccatttccaaccgagttggatgataaaattggtcagggtatccgagatcgtggtgttgagtacggtgcttccactggtcgtccacgccgctgtggttggatggacattgttgcgctcaagcgtgctgttgccatcaatgggattaccggtctgtgtattaccaaattggatgtgctggacggaatggataagcttaagatctgtatcgcttatgagtaccacgataaacgaagtgagtacgctccgttggatgcgcaaggttgggaagaatgcaccccagtgtacttggaatttccaggctggaatgagagcacgcatggcattacttcgtgggagaaactccctccagcagcccgcgcttatctgtgtgcgctggaagagctggctggttgtccgattggtatcgtgagcactggcccagaccgagagcacacgatcatgttgcatgatccttttgct

SEQ ID NO: 33095 - DNA, 933 bp, Xylella fastidiosa
atcaacggtttcggtcgcattggacgcaacatattacgctctgcagtacaaaacttcggcagtaacattgatatcgtagccattaatgacctgctcgaaccagattatttggcatacatgttgcagtacgactcagtgcatggacgctttaaaggagagatcgcaattgagggaactgcactcatccttaacggcaagaagattcgcctaacagccgaacgtgatccgggcaatcttcaatgggctgatgccggtgctgaaatagtgatcgaatctaccggtctattcctgacgcaggaaagtgccgggaaacatctggtagccggcgccaagaaggtcatcatctcagcaccttccaaagacgaaacgcccatgttcgtgtacggcgtcaatcacaacagctacaacggggaaccaatcgtctcgaatgcttcatgcaccaccaattgcttggcaccactggctaaagtcatcaacgacaaatggggcattacgcgcggtttaatgaccactgtacatgcggccactgcgacacaaaaaactgtcgacggcccatccaataaagactggcgcggtggacgcgggattcttgagaacatcatcccatcttcaactggagcagcaaaagctgttgggaaagtgatcccatcactcaacgggaaactcaccgggatgagcttccgcgtccccacctcggatgtttctgtcgtggacttgactgtccaattaaacaccccagcaacttacaaagaaatctgcacagaggtgaagcagcaaagtgaggggccgttgaggggcatcctggactatatagaagacaaagtggtagccaccgacttccgcggtgaaacctgtacctgcgtattcgatgcggatgctggcattgcactagatccgacatttatcaaactcattgcttggtacgacaacgaa

SEQ ID NO: 33096 - DNA, 423 bp, Xylella fastidiosa; identical to SEQ ID NO: 32926

SEQ ID NO: 33097 - DNA, 2517 bp, Xylella fastidiosa
ttgtgcccaggcgcttacgcagcgttgccatatgtcgctcgcgtgtatgcagaaaacgtgttgcgccgcgccgcgccggatcagtggcctgcgtatctgggccagcttattgggcggcgctgtgataccgatatcccgtggtttccagcgcggatcgtctgccatgacatccttggcctgacagcactggttgatttggctggattgcgtgatgcgattgcggcccagggaggggatgcctcccaggtcaaccccacagtgccggtacaactgattgttgaccactcattggcggtggaatacggcggcagcgatccggaggcggttgccaaaaaccgtgcgattgaagcacgccgcaacgcggatcgatttcattttatcgagtggacccgacacgcttttgaaaatgtcacggtgattcctccggggtacggcatcatgcaccaaatcaacctggaggcactgtcgcctgtcgtcgcagtccaggatggcgtggcgttcccagatacctgtatcggtacagatagccataccccgcatgtgaatgctctgggtgtggttgccattggtgttgggggcttagaggcggagagtgtgatgctgggccgtgcggtgtggctgcgctgtccagagagtgtgggcgtggagttacacggacgcccgcgccccgggatcaccgcaacggatattgtgctggcgctgacagcgtttttacgccaggcgcgtgtggtgggtgcgtatctggaattccgtggcgaaggcgtcgctgcgctcaccgtgggtgaccgtgccacgattgccaacatggctccggaatatggcgcaactgcggcgttgttctttattgatgcgcagaccgtggagtatttacggctgaccggacgcgacaaggcacaggtggcgttggtcgatacctacgccaaacaggccggactgtgggccgatacgcttgagggggcacagtacgcgcgcctgctgcatttcgacctctccagcgtcgcacgcaccatggctggcccgtccagcccacatcaccaattgcccacatccgcgttgacggagcgcggcattgctggcggcttggcgcaagcgcgggcagaggaagccgccgggcatctgcccgatggcgcagtcatcattgcggcaatcacctcatgcaccaatacctctaacccgcgtaacctcatcgctgccggtttattggcgcgtaatgctcatgcccggggactacgctgtaaaccttgggtcaaaacctccctagcgccgggttcccaagcggtgccattgtatttggaggcggccggactgttgtacgcgctacagcagcttggctttggcgtcgtcggttttgcttgcaccacctgcaatggcatgagtggtgcactcgatccgctgatccagcacgccatcatggcgcgtcatgtgcacaccgtggccgtgttgtcggggaaccgcaacttcgacggacgcattcatcctgatgccacacaagcttttttggcttcgccgcctctggtgattgcctatgcaatcgctggcaccatccgttttgatattgaacgagatgtgctcggtcatgatgccgatggtaccccggtgatgctcaaagatatttggcccggtgatgccgacattgatgcactggtgcgtcgcagcgttcacccggagcaattccgtcgtgtgtacatgccgctgttgcaagcgtctagacagtggcgtgaatgcgtcccgccgttgtacgcatggcacccccagagtacgtacatccgtcggcccccttattgggaaggcgtcttagccagtgcgcgcaccttgcgcgggttacggccgttggcggtgttgggcgataacatcaccaccgatcatctgtctccgtcgaatgccatcctgcccaatagtgcggctggagagtatctggcccgcatgggggtgccccaagaggactttaatagttatgcaacccgccgcggcgaccatttgaccgcccagcgcgccaccttcgctaatccgatgctgttaaacgagttggtgcgtgatgctgatggcaaggtgcgtcaagggtcgctgacccggcttgagccggatggcaccgtgatgcggatgtgggaagccatcgaaatctacatgcagcgcagccaacctttgatcatcattgctggtgcggattatgggcagggatcctcccgtgactgggcggccaagggcgtgcgtctggctggcgtggaggcgattgtggccgaagggttcgagcgtatccaccgcaccaatgtcattggcatgggcgtgttaccgctgacgtttcaccctggtaccacccgcatcacgttgcgcattgatggcacggaattgttcgatgtatgcggcgtgccgagtgtgggtgcggtgttgatcctgcgtatccagcgccgtgatggtagcgtcgcggaagtgccggtcacatgtcggctcgataccgctgaggagctgtcaatttatgcggccggtggcgtgttgcagcgtgttgcgcagcagatgctt

SEQ ID NO: 33098 - DNA, 1812 bp, Xylella fastidiosa
tacttgaagcagcaggagataaagcctctgctacgcttcatcacatgtggcagtgtcgatgacggtaaaagcacgctgattgggcatctgctgtatggcagtcagtgcttggctgaagatcagttggctgatcttacggtggatagtcagcgttacgggactcagggcgagcatattgattatgcattgttgttggatggtttggccgcagaacgtgagcagggtattacgatcgatgtggcttaccgttactttgatactgagaaacgtaaatttatcgttgccgattgtcctggacatgcgcaatacacgcggaacatggccaccggtgcctccacggcggatgcagcggtggtgctagtcgatgcgcgtaaagggttgttgacccaaacgcgcaggcatagttatatcgttgcgttgttggggatccgccatgtggtgctagcggtgaataagatggacttggttggctacgatcagcagacatttgaagcgattgcctccgattacctggcgctggctgtcaaactgggtatcaatcaggtgcagtgtattccgctgtcggcattggaaggcgacaatctttccaagcgttcggcaaggatgccgtggtatgtcggccccagtctgcttgagtatctggaagcgttggagccagccgatgtcgatctcggggctgcaatgtgcttgcccgtgcagtgggtcaatcgtccggattctcagttccgcggcttcacggggacgttggccgccggtcgcgtgcgctctggagatggggtcgtcgtgttgccttcgggctgtgtttcacgtgtggtacgtgtcttcaatggtgatactgaggtacacgaggctgttgccggccaggcggtgaccttgaccctggccgatgagattgacatcagtcgcggcgatgtcattgccgcgactgatgatcccccagatgtggccgatcaagtcactgcttacgtgttgtggatggacgatactgcgttgttgcctggccgacgttattggttaaagttgggcgcgcggatggtcgctgccagcgtgagtgacatcaagcaccgggttgatgtcaatacacaggaacagcgagtagcgcagcgtttacagctgaatgagctgggttactgccaactgtcgctagatgcgcctgtggcgtttgtaccgtatgcgcgcaaccgtgtgttgggcagttttattctgattgaccgtcagtccaatgctaccgttggtgccgggacgttggattctggggtgcatcgtgccagcaatgtgcattggcagcctccgtatattgatcatgtcgctcgtgccaggatcaaggggcagacacccaaggtactgtggttcaccggtctatccggtgctggtaaatctgtaattgcaaacattgtggacaagcgtttgcatgccttgggttaccacacgtttattttggacggtgataacgtgcgccacggtttaaaccgtgatttgagtttcacggcagaagatagggttgagaacattcgccgtgttgccgaagtcgccagactgatggttgatgctggtttggtggtgctggtgagttttatttctccgttccgggatgaacggcagttggcccgcgagcgcttcgccgctgatgagtttgtagaagtgtttgttgatgtgcccttggcggtggctgaggcgcgcgatgtgaagggcttgtatgcgaaagcccgtgcgggcttgatcatcgattttacggggattgattccccttatgagccgccgcagcacccagaactgcatctgcgtgccgaccaaggaacgcctgaacaactg

SEQ ID NO: 33099 - DNA, 1677 bp, Xylella fastidiosa
agttcctcctccattgaagacatcaagggcaagagccaccgcctgcggggttccctgttggagagtctcgcaaacccaaccaccggcgcgctccgcgaaagcgaccaaacgctgattaaataccacggcagctaccagcaggatgatcgcgatctacgtgaggagcgccgtcggcaaaaactcgaacctgcttaccaattcatgatccgcacccggacacctggcggcgtcatcacgccgcagcagtggttgcagttggatgccatcgccacgcgctacgccaaccattcattgcgcgtcacaacacgtcaggcattccagttccacggagtcatcaaacgcgaattgaaaacaacaatgcaggcaatcaacgcggcattgatcgatacacttgcggcctgcggggatgtcaatcgcaacgtacaggtcgctgccaatccattgatctcgcgtgcccatgcagacctttataccgacgcagcacacctgtctgagcatctgctacctaacacccgcgcttactacgaaatttggctggatgaaaaaaaggtcgctggtgccggtgaggaagaggaaccgatctacggcccacactatctaccgcgtaaattcaaaatcggttttgccgcaccaccaatcaacgatgtcgatgtattcgccaacgacctggggtttatcgcagttatcgttgacaagactttgcttggctataacgtcactatcggcggcggaatggggacaacgcatggtgaccccgacacgtggcctcgcatcggcaacatcatcggcttcatcacccgcgccgatctgatcacaatcagcacggccatcgtgaccacgcaacgcgacttcggcaatcgaacgctacgcaagcgtgcccgcttcaaatacaccattgatgaccgcggtctagattgcatcgtcggcgagatccagcagcgcgccggcatcacactgcaaccagcacgaccgtttgtattcgaacacaatggggaccgttacgggtggattgaaggtgaggacgggcactggcatttgaccttattgctaccagctggccgcatcgccgataccgaaggcagcaccctgctgagtggcttccgagaaatcgcacaacttggcatcggcgaattccgcatgactccgaatcagaatgtcgtgattgctggcatctctcccggacagcgcgccgcaatcgacgcactggtcacccagtacggtctggataccggcaaccgtgcacccacagccctcgcacgtcacgccatggcgtgtgtcgcactcccgacctgcggtctagcgatggccgaagcggaacgttatctgccggacttcaacgcgaagctacagcccatcctggaaaaatatggacttgctgagacacccattctgctgcgcatttccgggtgtccaaacggttgctcccgcccctatctcgccgaaattgcgttggtcggtaaagcccctggacgctataacctcatgctcggaggcgatcaacgcggccagcgcctcaacacgctgtatcgggaaaacatcaccgaaactgaaatccttgcggcactggaaccattgctgggccgctatcaacagaaacgccttccgagcgaaggctttggcgattttctacatcgcaccggcatcatcgcacttcccccataccccacacaccgacac

SEQ ID NO: 33100 - DNA, 2264 bp, Xylella fastidiosa
ggtaagaccctgtatggcaaattgtgggacattcatgaggtggcccgtcgcgacgatgggtcttcgctcatttacattgatcgccatatacttcacgaagtgacttcaccacaggcttttgaaggattgcgtttagctggacggccgttgtggcgggtcaatgccaatattgcgactccggatcataatgtcccgacgaccaaggcggagcgtcaaggcagtttgctatcgattgccgatacggtttcgcgtttgcaggtacagacgttggatgaaaattgcgacgatttcggtatcttcgaattcaagatgaatgatgtgcgtcaagggatcgtccacgtgatcggtccagaacagggagccaccttgcctggtatgacagtagtgtgcggtgattcacacacctccacacacggtgcctttggtgcattggcgcatggcattggtacctctgaagttgagcacgtgttagccacgcagtgcttagtcacccagaagatgaaaaatatgcaagtgcgtgtggaaggcaccttgtcatggggggtgacggccaaagatatcgtattggcgttgattgggaagataggcactgccggaggcaacggttatgcggtggagttttccgggagtaccatccgcgcgttgtcgatggaagggcgcatgaccatttgtaatatggctattgaggctggtgcgcgcgtgggtatggtggcggtggacgagaagaccatacagtatgtgcatggccgcccgtttgcacccaaaggatccgattgggatgctgctgttgcattctggcgtggtttggtttccgatccagatgcgcactttgatcgtgtggttgagttatctgctgaagagattaaacctcaggtcacttggggaacctcgccagagatggtgtcggcagtggatcaatcggtgccagacccagagcgcgaaactgatccagtcaagaaggagtctttgattcgtgccctgaaatatatgggtttgcagcctaatgatccgatcacttcaataaagctggaccgtgtatttattggctcctgtacgaattcccgtattgaagacttacgtgctgctgcggaagttgttaaaggccgtaaagttgcttccacggtgaagcaggcgatggtggtgcctggctcgggattggtaaaggcacaggctgaagttgagggcttggacaagatattcattgaggctggtttcgagtggcgtgaacctggatgttcgatgtgtttggcgatgaatcccgataaattgggcagtggcgagcattgcgcatctacttctaatcgtaacttcgaggggcgccagggcatcggtggtcgtacccatttagtcagccctgcgatggcagccgctgcggccgtggctggtcactttgtcgatgtccgcgaaatgatgcggtgatgaaccttatgttgtctttgtagatgcttggaaataacgtgctaatgaaggtttatattcaatgccgttttttgattgtttcaatacttctagctcatgcttaaagtgtctctaaacggttatttttttcgattccagcagcgtaataaaacggttctgcgatctatgatcgcagcgcacatagaatatttaagcactggtgaagcctgatgaaaccctttacccaacacaccggcttggtctgtccacttgatcgcgtgaatgtcgataccgatcagattattcccaagcaatttttaaagtcgatcaagcggacaggtttcggccctaatctgttcgacgaatggcgctatttggatgcaggtcaacctgggcaagacaatagcaagcgtcccattaattcagattttgtgctcaatttgccccgttatcgtggggcgagtgtgttgctggcgcgcgacaattttggctgtggttcctcccgtgaacatgctgcctgggcgcttgatgaatatggcttccgcacagtaatcgcgccgagctttgctgacatttttttcaacaacagctttaaaaatggtttattgcctcttgtgttgaataaggttgaagtggatgcactgtttgcacagtgtcaagtgactgagggatatacgctaactgtggatttggcggcacagcaagtgattaccccggacggtactacttacgccttccagatcgatacgttccgtaagcattgtctacttaacggcctggatgatatcggtctcaccttacagtatgctgaggccatccgcgcttttgaggccacgcatcgtatacgtcaaccgtggttgtttgcg

SEQ ID NO: 33101 - DNA, 1017 bp, Xylella fastidiosa
ctcgtgaccggtggtgccggtttcatcggcggtaattttgtattgcaagcgattagcctcgggcatcgtgtgattaatcttgatgctctgacgtatgcgggtcatttggagacgctcgctgcgcttgatgggtgcgcggagcatctttttgttcatggtgatattggcgatcgtgcgttggtgagctgtttgctggatacacatcgcccggatgcagtgctgaattttgctgctgagagtcacgttgatcgttcgattgatgctcctgctgcgttcattcagaccaatgtcgttggggcgttgctgttattggaggcggtgtgtgggtactggaaggcgttgccggaggcggcgcgtgctgcgttccgttttctgcatgtatccaccgatgaggtttacggcagtttgggggagacgggcgcatttacagagaggacggcgtatgcgcctaattcgccttattcggcgtcaaaggccgcgtctgatcatttggtccgtgcgtttcaccatacgtacggattgccggtgctgaccacgcattgttcaaataactatggcccatatcattttccggagaagctgattccgctggtcatcaccaaggcgttggcgggtgagccgttgcctgtgtatggcgatgggcggcacgtgcgtgattggctgtttgtcggcgatcactgtaccgcgctgtgtgctgtattggctggagggcgggtgggtgaaacgtacaatatcggggggcaggccgagcgtgagaatcttgaagtggtccgcatgatttgctgtttgcttgatgagcgccgcccgcgtgccgatgggctgagttatcaaagccagattgttcatgttgcagatcgtccggggcatgatcgccgttatgcgatcgacacatccaagttggtgagtcagttaggctgggcgccggtgtatcgctttgagcagggacttgcgctgactgtggattggtatttgcagcatcaggattgggtacgtgcggtgctccaagggcgtgaccgc

SEQ ID NO: 33102 - DNA, 1737 bp, Xylella fastidiosa
tttgcagatctcggcctctccgatgctgtgatgcaagccgtcacaaaaatcggctacgaaactccgtcgcccatccaggcggcgaccatcccagccttgcttgctgggcgcgatgtgctgggccaagcccagaccggcactgggaagactgccgcattcgcgctaccgttgctcacacgcaccgttctgaaccaggtcaagccgcaagtgctcgtactggcacccacccgcgaactggctatccaagttgccgaagcattccagcgctatgctgcctcgatctctggcttccgtgtcctacccgtgtacggcggccaatcctatggccaacaactggccgcactgaaacgcggtgtccatgtgatcgtcggtaccccgggccgggtgattgatcacctagagcgcggcaccctggatctatcggaattaaaaacgctggtcctcgacgaagccgacgaaatgctgcgtatgggtttcattgaggacgttgaagaagtcctacggaagttgcccgcttcacgccaggtcgctctgttctcggcaaccatgccaccacagatccgccgtatcgcacaaacctatctacaagatccgattgaagtcaccatcgccaccaaaaccacgaccgcagccaacatccgccaacgttactggtgggtcagcggcctccacaagctagatgcactcacacgcattcttgaggtggaaaccttcgacgcaatgattatcttcgtgcgcaccaaagctgccaccgaagaattggccgagaaattgcaggcacgtggcctgaccgccgcagcgatcaatggcgatatgcaacaagcgcaacgcgaacgcaccattcaccaactcaaagatggcaagctggatatcctcgttgccaccgacgtcgccgcacgtggtttggacgtagaacgtatcagccacgtgctgaactacgacatcccttacgacgttgagagctacgtccaccgtatcggacgcactgggcgtgccggtcgcagcggcgaagcaatcctctttgtgactccgcgcgaaaaaggcatgctgcgccagattgaacgtgccactcaccaaccgatcgaagccatgcaactgcccagtgtggatgcagtcaacgacacgcgcgtgaccaaatttttcggacgcatcagcaatgctctggtggtcggcgctgaaatcgacttctaccgcaaactgctacaacgtttcgagagcgagcacaatgtccctgccattgagatcgctgctgccctggcacgactccttcagggggatagccccttcctgctgagtgtcccgacgcgcccccaacgcgagcgcagcgagctggcatccgagcatcatgtcaaacgcccctcatccttcaagcagacagagcgtccaaacaacactgaacaccccaagcgcccccaacgcaacgcacctgcccgcaatgtcccagagttcggtatggagtcttaccgcatcgaagtcggccgcatgcacggtgtgaagccagccaatatcgtcggcgctatcgccaacgaagctggattagagagccgctacattggccggattgacatccgtgacgatcactcggttctggatctccccgcagaaatgccacacgagatcctgcaacacctaaaaaaggtctgggtatcaggacagcaactacaaatgcatcggatcgacacaaccgaaacaaccgcacctgcacgggaatttaagtcaaaaccgggtggcgctggc

SEQ ID NO: 33103 - DNA, 813 bp, Xylella fastidiosa
ttgcatttcaccaagatgcaaggggctggtaatgacttcgtcgttttggatttgcgtgatgggacgccgccgccggatgcggcgttggtcgcttggttggctgatcgccactttggtattgggtgtgatcaggttatcgctattgagccgccgcgtggtgtcggggtggttgccgcttaccgtatctggaatgcggatgggtctgcggcgcagcaatgtggtaatggtgcacgttgcgtcgctgcttggttggtgcgagatggttcccttgcggatgagcatttcttgattgacagtccggtacaggcgcattcggttcgctgcataggtaaagatgagtatgcggtggagatgggtctgccagtgttcgaacctgagcgtattcctctgtctggatttcctaatgcttgtgcagagtatgtgttgtcgctacagggtgaggtgttgcgttgtggtgcggtatcaatggggaatccgcatgcagtagttgaggtcgatttgattgatgtggcaccggtcgaacggatcgggccgctcttgcagcagcatgttgcgtttccggagtcagtgaatgtcggttttgtccaggtgattgatcctggtttggtacggttgcgtgtgtatgagcgtggtgctggagaaacgttggcgtgtggcagtggtgcttgtgcggcggcagttgtgctgatgcagcgtggcagggttggacgtgatgtgcgtgttgttctaccagggggcacgttgcgtgtgcagtggccagtttccggtgggccagtgacgttgtctggtccggcaaggtgtgtgtttgatgga

SEQ ID NO: 33104 - DNA, 1620 bp, Xylella fastidiosa
gatgcgaatcaaatcgtgcttgatactcgtgagctgagcattgagaagattgaagctgacgacggccaagggcacttgaatcagcttaagtttgttttattcccagccgacaaaatattgggtagcaaactggttattgagactcccgcgcagcctacccagatccgtgtcacttaccggactgctccgagtgcttctggcttgcaatggatggagccggcgatgacggagggcaaacgcttgccttttatgttcagtcaatctcaagcgatccatgcccgcagttgggtgccgctccaggacactccaggtgtacgttttacctacaaggcccacatcgtttcgcgtccagatgtgatggtgttgatgagtgccgacaacgaccccaacgcagtacgcgatggcgattaccgcttcaaaatggctgagccgatcccctcttatctgttggcgatcgctgcaggtgatttggtcttcaagccgatttctgcgcgttctggtgtttgggccgagccggttatggtggataaggcggcaaaggaatttgaggataccgaaaaaatgatcggtgccgccgagacgctatacggtaagtatcgttggggacgttacgacatgttggtattgccgtcgtcgtttccatttggtgggatggagaatccgcgtctgacctttgtcactccaacggtgattgtgggtgacaaatcgctggtttcgttgattgcacatgagttggcgcacagttggtctggcaatttggtgactaatgcttcgtggaaggatatttggctcaatgaaggtttcactacctatgtgcaagcgcgcattactgaggcgctgtacggtcagacgatggccgatatggagcgtcaagtcgatcaaatggatatttttgcagcgttgaaggatattcccaaagccgatcaaaagttggtgctgtcgacgttgaccaagcgtgatccggatgatgcactgagtcctatcgcttatgtgaaaggggcatggttcctacagtttcttgagcaacgtgttgggcgtgaggtgttcgatccgtttctacgtggttggtttgacagccatgcgtttcaaagtgcgacaagcgaagattttatcgtttatctgaagcagtatttgttatccaaagatcccaatgcgattactgccgaggaattggatagttggctgaacgcgcctggtattccgacaattgctcagaaggtgcgttcgctgagtttcgccaatgtggatggtgcacgtattgcttggagtggtagtggtcttttaccgaataggccggtgactgatggttggggtacccagcagtgggtctattttcttagcagaatgggtgagacgctcaagcttgagcaactcaagcagcttgacgaagcttaccacttcaccggtacaccaaatggcgagattgcgatgcgttggtatccattggcgatccgtagtggttataccgctgcgtggccggaggcgggtgccttcatagggcgtgtgggtcgactcaagctgatattaccgatttacgctgagttgtcgaaaaccccaaagggattactttttgctaaacaaatttttgcaaaatttaaatctctttatcatccaatcacc

SEQ ID NO: 33105 - DNA, 948 bp, Xylella fastidiosa
atgattaagcgtattcgcaaggctgttttccctgtggccggtcttggtacacgttttttgccagcgaccaaaaccatccccaaggaaatgctgccaattatcgataaacccctcatccagtacgcggttgacgaagcgatccaggctggatgcgatacccttgtgtttgtgaccaaccgttacaagcatgcggtggccgattacttcgacaaagcgtatgaattggagcagaagcttgagcgtgccggtaaatatgagcagctggaattagtgcgtcatgtgttgcctgatggagtgcgtacggttttcgtcactcaaactgaagcgctgggtctaggccatgcggtgttgtgcgccaagccggtggtgggtgatgaaccattcgcggtgttgctgccagacgatctcatgtggagtcgtaatggaggtgcactgaaacaaatggctgatgttgctgaagtctccggtagcagtgtcattgcagtagaggatgtccccgtcgataaaaccgttaactatggcatcgtcggaacggatgtgtttgacggatccaagggccgcattactcaaatcgtcgaaaagcctaagcccgacgatgcaccgagcaatcttgctgtggtggggcgctatgtcctgagtggcaagatattcgagatgcttgaaaacacctctatcggtactggcggcgagattcaattgacagatgcgatcgctgaattactgaaatacgagagagtggatgcataccgcttccaaggtcgccgatttgattgtggtgcacacattggtctgattgaggctaccctgcatttagcccttgaacacaagaaacatggccaggcggtgcgtgagatcctgcgtgacacattacttacggtcgacaagagataattatcagtatttgcttcggtttgcgtaaagatgcttatcgtacgtcgtcctttttgg

SEQ ID NO: 33106 - DNA, 834 bp, Xylella fastidiosa
gctcgtatcctcgacgggcgtcgtattgctgatgacctgcttgatgctttgaaaacacgcgtggatgcacgtgtggcggcaggtaaactgcctccaacgttggccgtagtgcttgtcggttccgatccggcatcagtggtgtatgtccgcaacaagcggcgtgctgcagagaaggtggggattaaagcttatgacttcgatcttccagaagcgacgactgaggctgagttggccgcgttgattgaccggcttaatgccgatccaaagatccacggtatcctgatccaattaccattgccgggcattcctgatgcgcatcgattgattcaacgtgttgacccgcgcaaagatgtggatggtttccaccctcaaaatgttgggcacttagcattgcgtgagtttggtctcagaccatgcacgccacggggtattgtcaccttgctcggccataccgaccgaccggtccgagggcgtaatgccaccattgttggagtgagcaaccatgttggccgaccgatgggactggagttgttgatggctggttgtactgtcaccagttgccataaattcaccccaccacagatgctggaagcagcagtgcgtcaagccgatattctgatcgttgcagtgggccgtccgggagtgattcctggagagtgggtgaagctaggtgcagtcgtgattgatgttggcattaatcgacttgatgatggtcagttggtgggtgatgttggttttgagagtgcagtcaagcgcgctagctggattaccccggtgcctggcggagtaggaccgatgactgtagcgacgttgatgcaaaacaccctggaagcc

SEQ ID NO: 33107 - DNA, 1449 bp, Xylella fastidiosa
ctgcgcatcttggccgaagctttgacttacgacgatgtttcactcgtcccttcccattcgaccgtcctgcccaaggatgtcaacctcgaaacccggttgacacgcaatatcaggctcaaattgccgatcctttcagcggcgatggacaccgtcacagaagctcgtttggcgatcgtcatggcgcagcttggcgggattggcatcatccacaaaaaccttaccatcgaacagcaagtcgctgaggtcactaaagtcaagaaatacgaatctggcgtcattcgtgatccgattacagttgatccagagacatcaattcgcgatgtgttagcactgacccgtgccaagaacatttctggtgtccctgtcgtcgataaaggtcaattaattggcctcgtgactcaccgcgatatgcgctttgaaagcgagcttgatgaccccgtgcgccatatcatgactaaaaaagaagccctggtgacagtcaaagaaggggccgactcccaagaggtactccaactgctgcataaacatcgcatcgaaaagatattggttgtgaacgatgcttttgaactgcgcggcctcatcactgttaaagatattcaaaaaaaatccgactatcccaacgcagccaaagatgcggtgacccgcttgctggttggtgctgctgtgggtgtagggggagagactgaaaggcgcgttgagacattggctactgctggagtggatgtgatcattgtcgatactgcgcatggttattctcagggtgtgcttgatcgtgtggcttggatcaagcgttacttcccgcaactacaagtgattggcggcaatattgttactggtgatgctgccttggcactgatggatgtcggtgccgatgcagtgaaggtgggtgtcggtcccggctccatttgtacaacgcgaatggtggcaggtgttggtgtgccgcagatcaccgctgtgcagatggtctccgacgcgctgcaagatcgcattccgctgattgctgacggcggtatccgctattccggtgatattggcaaggcattagctgcaggcgcatcaaccgtcatgatcggtggtttgtttgcagggactgaggaagctcccggtgatgttgagttgttccaggggcgcacttacaaaagctatcgcggcatgggttccttggcggcgatggaaaagggctccaaagaccgctatttccaggaagcgagcgacgttgacaaactggtcccggaaggcattgaagggcgtgtgccttaccgtggttcagtcagtggcatcgtgcatcagctgatgggcggcttgcgtgccaccatggggtatgttggctgcgcaacaatcgaagagatgcgtaccaaaccccagtttgtgaaaatcactggggccggtcaggttgagagtcacgttcatgacgtgcaaatcaccaaagagccgccgaattatcggatg

SEQ ID NO: 33108 - DNA, 990 bp, Xylella fastidiosa
atcaatgacattgaatccctgacagcccaagcattggctgacgtggcggctgcgcagaacttagatcatttggaatttttgcgtgtagctcttcttggtaaaaatggcagcatcaccttgcagctcaagcaactgggtaaattgccagttgagcagcgtaaggcgattggcgaaaagctcaaccgcgtccgggatcttatctcggccgcattaatggatcgcaaagctgcgttggaaagtgcagcgttgagcaagcgcctcattgatgagcgcgttgatgttaccctcccagggcgccgaggtgaacgaggaggcttgcatccagtcacccgtactttggagcgtattaccgagatttttgcccggctgggttacgagcttgttgaaggtccggaaattgaggacgactggcataattttgaggcgctgaacttcccattgcaccatccagcccgtgctatgcatgacaccttttattttggtgacggccgtttgctacggactcatacttctggtgtacaggtgcgttacatgagtgaccaccggccgccgctgcgtatgatcgctgctggcaaggtttatcgcagcgatagtgatcagacgcactcgccaatgttccatcagatagaaggattattgcttgacaagcatgccacttttgttgacttgaaagggaccttgtccgagttcttgagagcgttttttgagcgtgattttgaggtgcgttttcgcccaagttacttcccgtttgtcgaaccgggtgcggaagttgatattgcttggcaacagtccgacagcagcgttcgatggctggaggtgctgggttgcggcatggtacatccgaacgtgctgaagaatgttggcattgattcggaatgttatacaggctttgcatttggactaggtgtggaacgttttgcgatgctgcgttacggcgtcgacgacttacgtgcttttttcgagaatgatgtgagatttttacgccagttt

SEQ ID NO: 33109 - DNA, 1950 bp, Xylella fastidiosa
atgatctctctacgtcattttgcaatgcgccgcggtgggcgcttgttgctgtccaatgttgatatcaccttgcatgcgggggatcgtgttggcgttgttggtcgcaatggtgttggaaagtccagtctgttcgcagcgatacgtggagaattggaagcggacaaaggcaatgttgagttacctggaaaattacgtattgccagtgttgcgcaggaaaccccctccttgtcggatctggccctggactttgtactcagtggtgatgatgtggttgccgaggtcctgcgtgtcgaggcagaggcgaatgcacgcgaggattgggaggcggtagccgctgcccatcagcgcttagccgagatcggcggttacgacgccgaagcacgtgcaggtaaattgctgcatggcttgggttttatcacacagacgcagcggcgtgctgtctcgacgttctctggtggctggcgcgtccgcttgaacctggcacgtgcactgatgatgcccagtgatctgttgttactggacgaaccaaccaaccatctggatatggatgccgtgttctggttagaacaatggttgcagaagtaccctggtacgttgctgctgattagtcatgaccgtgagtttttggataacgttgccacccatatcctgcatttgcatgatggtaacgccaaactatacgtgggcggctacaccgacttcgagcgtcaacgtgccgagcaactacgtcagcaacagattgcttttgagaaagagcaggccgagcgtgttcacttgcagagcttcattgaccgtttcaaggccaaagcatcaaaagccaagcaggcacaaagccggatcaaacgcttagaaaagttggctggaacggaggctatccgtatggagcgtgaattccgtatcacgtttgcaccgccaaccaaactaccgcattccttgattacgctgcgccaggtgaattgcggttattcggtattgtccccgtctacaccctccgatcctccacctgttgatattcatgcggcagcaccttcgcagcatgccgtgattcttcatcgtgttgattttggacttgaggcgggagaccgtattgggttgcttggtcccaatggcgccggaaaatcgaccctggtcaaaacattggtgagtgacctggcccctttgacgggggagcgcatcgctcatcctgatgtgcgtattggttattttgcacagcacacggttgaatcactgcacgagggacaatcgccgattgatcatttccgtacccttgcgccgcaagcaccgatccaatccatacgcgactttttgggtaaatggaattttcctggagatcgtgcctttgaacctgtggatggtttttccggaggtgagcgtgcgcgcttggcattgtcgttgattgcttggcggcagccgaatgttttgttacttgatgaacccaccaaccacctggatctagagatgcgcgaagccttggctgaggcgctgagtgattttgatggagcgattgtgatggtctcgcacgaccgtcacttgattggcttagtgtgcgacacgttttggcgtgttgctgatggtgtggtcgagccgtttgctggtgatcttgaccaatacgctgcttggctgcggacacgtcccgcggcacgcggtgtgcgcgccaagacagaggaggtcaatcagccacaggcttcgttgactgccaaatcgcttgcttctcaactcccagtgaaaaagtcggtcaactcacaaaagctattggttgcggaaaagcatgtgagcgaattggagacgctcttggccgaattggatcgcaagcttgccgatccggtcaattatgccaatggcgaagtgatgaggcgtcttggcgatgagcgcgagcatgctgccagacggttagctgaagccgaacaggcttggttgctgttgatggatgggtgatgaatcatgattatg

SEQ ID NO: 33110 - DNA, 1368 bp, Xylella fastidiosa
ttattgtttggcgccaccggcgacctcgcccaacgctatctcttcccctccttactgcaactgtttactgatggcttattgccacaagacttccgcattcgtgctctggccttgtcgccccataacaccacacaattccgcgacatcctgcgcccgcgcttggaacaagcactacccatcgccaacactgcgcacatccaagccctactacaacgtgtcgactacctttccgtagacttgaacgacccaacatcaatcgccgaagcagtccgagatctgacggaacatccctgcatcagctacttggcaatcccaccaggcctgtacaccaacaccgccctaggattggcacagggaggggcactgcagacaccacaccgattgatgctggaaaaaccgatcggacgcgactcaataaacgcacgcgaaatcctaaacaccatcggcacactgattgacgaagatcgcatcttccgcgtagaccactatctaggcaaagcagcagtgcagaacctcgtcgcactgcgcttcggaaacaccctgctagaagcggtatggaaccgaaaccacattgagtcagtacacatcctcatcgccgaaaccgaaggcgtcgatggccgcaatgcttactacgcacgtgctggcgcactacgcgacatgatgcaaagccacatcctgcaactcctatgcctggtcgccatggaacccccggcctctctggaagccgaccgcatacgcgacgaaaaagtcaaagtcctgcgcgcactacgcccactgaacgcccaaaacgccgcaatgcacagcgtgcgcggacgctacagcgcgggcaccattaacagccaaccagtgccagcctatcaaccaccggaaggcagcaatgtagagacctttgtcggtgtcactgcatacatcgacaactggcgctgggcgggcgtaccgttccatctatgcacaggaaaacgcttggccgaacgctcaacccagatcgtcgtcaccctcaaacccgtcacacactggctatttgaacgtccagaccggaacaatgcagcaccaaaccgcctgtgcttcaaactacagccccaagaaaatatcgaactaaacctgatgagcagcctggccggccccgaatggggaaccctagaactgcaaccgctggaattggagttatcggtcccgaccggaaaacatcgccacatcgcctatgagcgcctgttcctcgacgcattcaacggcaacccggcgctatttgtacgtcacgacgaagtcacagccgcctgggcttggatcgacagcgtcagcaatgcctgggaactgtccgacttaccactgcaaccctaccccgccggcggctggggcccacctcaagcc

SEQ ID NO: 33111 - DNA, 1800 bp, Xylella fastidiosa
actgataattcgatgtccgcttatacaattaccgaacacaaatatgacatggttgtcgttggtgctggcggtgctggtctacgtgccacgttcggtttggctcagaaaggcttacagactgtctgtctgacaaaagtattcccgacgcgttcgcataccgtcgctgcgcaaggtggtatctccgctgcgcttggtaacatgggagaggatgattggcgttaccatttttatgacaccatcaaagggtcagactggctgggtgaccaggatgcgattgagtacatgtgccgtgaggcaatcccggctgtgatcgaactagaacactatggtgttccgttctcgcgtactgcacaaggcaagatttaccagcggccatttggtgggatgacgacacgttacggtgaggggccgcgggcagagcgtacctgcgctgcagctgatcgaaccggccatgcgatgttacataccttgtaccagcaagcattggcgcacgacgcgcgtttcatgattgagtactttgcacttgatctgatcttcgacaacgagggtgtgtgtcgcggcgtgttggcgttggacatggccgagggatccttgcacctgtttcgtgcccatggagtcgtgttggcgacaggtggctacggtcgcacgtacttcagtgcaacttctgctcatacctgtactggtgacggtggtggcttggtgatgcgtgccggtttaccgatgcaggatatggagtttgtgcagttccatcccacaggaatctatggggctggctgcctcatcaccgaaggagtgcgtggtgagggaggaatcttgcgtaactctaacggggagcgcttcatggagcgctatgcaccgcactacaaggatctggcctctcgtgatgtggtgagtcgctcaatgattattgagatccgggaggggcgcggcgttggtgaacacaaagaccatatattgcttgatttgactcacttgggtccgagcatgatccaagaaaaattgcctggcattgccgagagtgcgcgtatcttcgctggcgtggatgtggccaagcagccgattccggtgctgccaacagtgcattacaacatgggtggtattccaaccaattaccatggcgaagtggtgcgtaaagttggtaatgatcctgatgcagtggtgcctgggctatatgcagttggtgaagcggcctgtgtatcggtgcacggtgccaatcgtttgggatcgaattcgttgcttgatttggtggtattcggtcgtgcggttgccaatcgttgcgccgaaacaatcaagcaaagtcagccgcataaggtattgccgtcggatagttgcgacaaggcactgggcttgcttgataaacttcgccatgctgacggttccacgccgacagcggtgattcgtgacaggatgcaacgtaccatgcagtctgatgcttcggtgtttcgtacgagtaagacgttgcaagaagggtgcgaaaagatgaatgaaatctttgccttgtttgatgacatcaaggtttctgatcgttcactcgtttggaattcggatttgatcgaaacctacgagctgcacaatttgctgttaaacgcactggctacgattaactcggctgaacagcgcaaagagagccgtggtgctcatgcgcatgaagattatccagatcgcgatgacgagaattggttgaaacacacattagtcagtgtcgacgaaaagggcacatgcagttttgactaccgcccggtgcacatgtacacgctcagcaaagacgtggatgtgatacctcctaagccgcgcgtctat

SEQ ID NO: 33112 - DNA, 714 bp, Xylella fastidiosa
cccgccaaaagcggtactaaaaatgctcgtacctttaaggtctaccgttggaatccggatgatgatgccaatccgcgtaccgatacctacgagattgatctagatacatgcggcccgatggttttggatgcgttgatcaagattaagaatgagatcgacccgactctgacgttccgtcgttcttgccgcgagggtatttgtggctcatgtgcgatgaacattgatgggaccaacacgttagcttgtaccaaggcgattagtgcctgcaccatatctgagatcccgatctatccactgcctcacatgaacgtgatcaaggatttgatccccgacttgactcacttttatgcgcagtacgcttctattaagccctggatgcgtactcagaccccgccgccgcctgatcgtgagcgattgcagtctcctgtggaccgcaagaagcttgacggtttgtatgagtgcattctatgtgcctgttgttcgacgagttgtccgagttactggtggaatggtgatcgctatttgggtccggcgatcttgctgcaggcttaccgctggattatcgattcacgtgatgaagatactggcgcgcgcttggatgatctcgaggatccattcaagttatatcgttgtcataccatcatgaattgcacgcgaacctgtccgaagggattgaatcccgctcacgccattgccgagatcaaaaaactgatg

SEQ ID NO: 33113 - DNA, 876 bp, Xylella fastidiosa
cggctgcgtattgcgattcaaaaaagtgggcgtttgacagaaccggcccgccgcctcctgacctcttgcggactgagttggcgtcagagccgcgacaaactgttttgctacggtgaatcgctgccggtggatctattgttggtgcgcgatgacgacattcccggcttgattgcccagggcgtgtgcgaccttggcatcgtgggtcgtaatgaactggatgaacaggcagcctcacggcgccgcaacggcctccccgttccctaccaaaccctacgtggactgcactttggccaatgccgactcatgcttgcggtgcctgaagaatgggagtggcaagacatatcgcaattgacaggcaagcgcatcgccaccagctaccccgcaatcttggccgactggctacagacacatcacattgctgcacagatcgtcgaactctccggctcggtcgaaatcgccccacgcctgggtaccgctgacctcatctgtgatttagtgtcctccggcgccacattgactgctcaccaactcaaacccgtcatccagatcatggagagccaagccgtgcttgccggcatgatccgccaacctgccgatgcccgtgccggactcttggccatgctgctgcggcgcattgatggcatggtcaacctgcgtgacagcaacttactgatgttccgtgccttccaagaacacctggacgccttgacccgtttactgcccgatgccgacccattggtacagctacccgatgacggcagcggcaccctacgcgtgcagaccatgtgtcatggcaccatcacctggcagcgtttggaagaactggaacgtgctggtgctcagggcttgatggtattgacagtagagcgatccctc

SEQ ID NO: 33114 - DNA, 2550 bp, Xylella fastidiosa
ggtcaaaccctcagcctgatgagaatggggcctccatcatgaggtctgttgatgtcatcgtctgctgtccggttgtccaccgttgaaactcctgtctacgttccgcgtaccgtcgttcacaaattcggtgggacttcggttgccgatgcggattgctatcgccatgtcgcgtgtctcctattagcacgtgaagagactgtgcaggtcaccattgtttctgcgatgaaaggggtgactgatacgttgattgcactggccgaacaggcagccaatcattctcccgactggcaggtgttgtggcagcaaacccgcacgcgtcattgcgacgccgctcaggcattgcttggagagcatgccgctacgctgcaagattggttgaatacccgttttaatgaactgcatgaaatgctggtggccttgtccgtcatcgggatgcttccatctgaagtgctggaccgcttacaaggcttgggcgaggtgtactccgcacagttgcttgggcagtatttgcaagcccagggtgaggattgtgtcgttctggatgcccgccaagtccttgtggtgagtcctggtgagtttggcgccgaagtcgattgggcaacgagtgcacagcacttagcccattggcgtatgcagcatccacagcggcgtgtggtggtcaccggtttcgttgcctctgatcgtactggacgcgccatcaccctgggtcgcaacggcagtgattattccggtgccatcttcgcggcgttgtttgaggccgatgagcttcacatctggacagatgttgatggagtcatgtccgccgacccccgggtcgtcccggatgcggtgcaactggatgccttgagttacgacgaagcatgtgaattggcctatttcggcgccaaggtagtgcatccacaaaccatgtcgccggtgatgaaacgcggagtgccgatcatcattcgaaacaccttccaacccggacatccagggactcggatcaccgctgatagcgtggtgagtggatctgttaaaggcctgaccctgagtccaggactggccgtgctgaacctggaaggcacgggtctgatcggtgtccctggtaccgctgaacgcgtgtttgccgccctgcgcaatgcacgtttgtctgtcgtgatgatctcacagggatcttcggagcattccatttgctgcctcgtgcaccaaaccgaggccgagcgtgcacgtgatgcgttgttgtataccttcgcccatgaattggcgatagggcatgtccagcgcgtacaactgaccaacaatatcagcgtattggcggcggttggcgacggcatggctggtcacctgggtgtagcggcgcgcttgtttgaatccttaaggcgtgcccatgtcaacatcctggccattgcccaggggtcttcagagcgcaatatttcggtggcaatcgacagtcagcaggcgacgaaggcactgcgcgctgcacacgctgctttctggttatcaccccagacattttcgattggtgtgattggtccaggtcacgttggtgaggccctgttggaccagctatgtactgcacagcagcaattactgtccaaggcaaatctggatctgcgtttgcgtgcgatcgtttcacggcggcgtatgttattggatgagcgtggcctggggagtgactggcgccacgccttcgccgccgcaccagaggcggtcgatctggatgcctttaccgcacacttacaggtcgcccatctgcctcatgcagtcatcattgactgtagcggcagtgctgaggtggctgatcgctatgccgactggctggcagccggtatccatgtcgtgacaccgaataaacaggctggctccggccccctgcatcgctaccacgcgattcgtgcagcagcagatgccagcggcgcacgctttcgctatgaagccacagtgggcgcaggcttgccggtgattacgacattgcgtgacttgatggataccggtgatagcgtcacctcaatcgaagggatcttttccggaactctggcgtggctattcaataaatatgatggcagcgtcccattctcccaattaatcgcccaggcgcgagcgatgggatataccgagccggatccacgcgatgacctgtctggggttgacgtggcgcgtaagctggtgattctggcgcgcgatgcggggcgtgatatcagcctagaagatgttgcggtagaaagcctggtgccggagacattgtgtcaactcagcgttgccgatttcatggaacgactcaatgaaattgatgccacctttgcagagcgtttggctgcggccaaacagcgcggttgcgtattgcgttacgtcgcacaactgtcccctggacacgtccctagtgtcagcttgattgaattgccttctgaccatgccttcgtcaatcttcgtttgaccgataacgtagtgcaatttacaactcgtcgttattccgaaaaccccttgatcgtacagggccctggcgccggtccagaggtcaccgcagccggtgtttttgcggatttactgcgagttgcagcgggcgagggcgca

SEQ ID NO: 33115 - DNA, 921 bp, Xylella fastidiosa
atgcaatttgattcaaatggacgtttgcgtcacctgatcactttggaaggactgtcgcgtgacacattgctgcagttacttgactgtgctgcccagaactgtgcactcggggttgaccctatgggcaagcgcaacgtgttagctggtatggcggtatgcacactcttttttgaaccatccacgcgtacccgtcattcattccacctggccgcgcagcgtttgggagcggatgtattaaatttcgatgcttcgatgtcgtctacgagcaagggtgagagtgcctgcgacacattgaagaatttggaggcaatgggggtgcgcggttttatagtgcgccatcctgaagagatcgttatcgcacagttggctgcagtggttggtgagggtaccgtgctgatcaatgccggtgctggccgtagtacccatccgacgcaggggctgctggatatgctgaccttatgtcaggccaagggcaacgatttttccaagctaaagctactctttgtcggtgacatcaaacattcacgcgttgcacgctccaacctgcatgcgttgcgcaccctgggcgcaggacagatccgggtgtgcggtccgactgcattattgccccatgacggcctcctctctggttgtgttgtcagtcaagattttgatgccatgcttgaagatgtggatgtactgatgatgctgcgtctacagcgtgagcgtatggaggaaggattggtgccctcgttggagcactaccatgccaactatggtttgaccgcagcgcgcctggcgcgtgcagctccggatgcggtggtattacaccctgggccaatcaaccgcggcgtggagattaccgatgaggtggccgatggcccgcagtcatggatcctgcgtcaagccagcaatggcgtgatggtccgtatggccgtgctg

SEQ ID NO: 33116 - DNA, 1692 bp, Xylella fastidiosa
atttcagtgaatgggggtgctgcgcgttacgtgcaggttggagatttggtgatcgttgctgcgtttgcacaaatgagtgaggacgaggcagcagttttcagaccgaatttggtatacgtcgatgctgccaatgcgatgactcataccaaccacagtattcctacacaggtcgcatgacacatgcacaatgggttcgatgctttgcagcttcatgccaatcgcttgcggggggtgacaattccagatctgttggcggctgagctaaaaagaccagagcaatatgccagacaagttggtccgttgtatttcaattttgctcggcagaagtatgactgtgtggcgttggaagcactgtttgcattggcgcgaaaccataatgtgactggtgcgttccagcgcatgttttgtggggagcaggtgaatgtgaccgaggggcgtgccgtgctgcatactgcgctgcgcggtgatcttagtggtacttcggtggcggttgctgcttacacggcggcggctaaagtgcgcgagcgaatgtatgcgttgattgccgggctggatgccagtgaggtgaccgatattgttagtgttggcattgggggctcggatcttgggccacgtttagtggttgatgcgttgcgtccgatttcccaaggacgtttccgagtccattttgtctctaatgttgatggcgctgccatgcggcgtactctggatatgttggatccatcacgtacggcaggcattctcatctccaagacctttggtacgcaggagacgttgctcaacggtcgtattttgtacgattggttaggcggcagcgagcgcttatatgcggtcagtgctaatccggaacgggccgttcatgcgttcgacattgtacccacgcaggttttgccaatctgggattgggtgggtggacgctattctttatggtcagcagttggtttcccgattgcgttggcgattggttcccaacgttttgaggagttgctggctggtgcggctgagtttgatgcgtatgccctgagggtgccgttagaagaaaatgttgcggtgttgcatgggttaactgcggtgtggaaccgtaacttccttggttgcgccacgtatgcggtgatggcttatgaccagcgcttggcattgctccctgcctacttgcagcaactggtgatggaaagtttgggtaagcgggtcaagtgcgacggaacgccagtggatagggatactgttccagtttggtggggtggcgtggggactgatgtgcagcatagttttttccaggcgctgcatcaggggacaaatatcgtacctgctgactttatcggtacgatccgtaatgatgatctgtacactgagaatcattttgctttgaatgccaacttgctggctcagattgaagtgttagcgaacggccagcttagcgatgatccgcatcgtgtttatccaggagggaatccgagtacgttgattttgcttgatgcattgactccacaggcattggggggattgattgcgatgtatgagcatagtgtgtatgtgcagtcagtgatttggggtattaatgcgtttgatcagtttggtgtggagttgggaaagcatttagccgttcaattactacctgcattaaagggggagagtgttgaagtggtggatccggtaacgcgtgcggtgttggtgcgtttgcgtggttgagtg

SEQ ID NO: 33117 - DNA, 2661 bp, Xylella fastidiosa
actattcgtaagcttgccgagctggtcaatacgccggttgagaaactgctagagcagttggctggggctggtatgaagttcagtggtcccgaccaagtcgtgaccagtactgaaaagatgaagctgctcgggttcttacgccgcacacatggtaagtctgatgtgtcggttgggactgtccgtgaggcaccgaaaaagatcacgcttaatcggcgtcggctacaagaagtgaccgttaatgctggccgcaacaagactaccgtaaacgtggaagtgcgccaaaagcgcacttatgtgaagacccccgagagcgaatatcatacgccgacaaaaccacccatagagctggctgatgccgagcgtgttgaaatattgcgtaaacttgaagaatcacgccagcgaaatcttgctgagcagcagcgtttagctgaagttgaccgtcagcgtgttgaggagcaggagcgaaagcgccgtgaagaagaacaggccgagcttgagcgccagaagactgaaagtcgcgtagttgaggagattcttgtcaagacagattccaattccgtcaaaccggtgtctaaaccaatctctgaagagcgcacgcgtgcgttgccacgaacagtccggccaacacctgctgcgcgcccttccgtatcgcgttcggatgaccgtaatagcaatggtggggtgcggcataaacctcgtggttcgcatgtgattgtttcggacgaggatgattctgcacgccgttttgttggtcaaatgcacctgacggctgctgaacgtgctcgccgtggtagcaacacacgaggcaaaggaggtggttctcaccgtggcgctactcatcgaggtaacgagaacagtattcgttctagtggtgctcatggtttcgagcgtcctactgttgcagtggtgcgtgaagtcgctgtcggagacaccatcaccgtagctgatttggctcagaagctcgcgctgaaaagtggtgatatggtgaaggcgttgtttaagatgggcgtgatggtgacaatcacgcagaccattgatcatgacactgcagtactggtaagcgaggaactgggtcacaaggtgactcgtgccagcagcagtgattttgaggatgctttactggcccatactgaggaagtgcatggtgagccggttccgcgtccacctgtggtgacgatcatggggcatgttgaccacggtaaaacttcgttgcttgattacattcgtcgtaccaaaattgcagtgggggaggctggtggcatcacccagcacatcggtgcttaccatgtggagaccccgcgtggagtgatcagctttttggatacgcctggccacgccgccttcacctcaatgcgcgcgcgcggtgccaaaatcacggatattgtggtgctcgtggttgctgccgatgatggtgtgatgccacagaccaaggaggcagtacaacatgctagggcggctggtgtgccgcttattgtagctgtcagcaaaattgataagtctactgctgacccgcagcgtgtaaaaaacgagttgttaaccgagagcgtcgtagccgaggaatttggtggagacacgcagtttgtcgagttgtctgctaaaactggtgttggggttgatgcgttgttggacgcaatttcgattcaagccgaggtgttggagctaaaggctgtgattgaaggtcgtgcgaccggtactgtgatcgagtcttcgctagacaaaggacgtggtccggtagcaacggtattggtgcagcagggacgtctgaaaaagggcgattacttggtatgcggtactcattatggtcgtgtgcgtgctctgttcgatgaagttggtcaccaaccacttgctgcatctccatcaattcctgtacaggtgctgggattgtctggcgtgcctgatgctggagacgatttcgtagttgttgatgatgaacgtcttgctaaagatgtagcgcagcagcgcgaggctaagcgccgtgagtctcgtctagttacttctgctggcaatcgcatggaagacatcttggctcagatgggtaaaggcgagaatcagcaagtgcttaacttgttgattaaggccgacgttcaaggttcgctagaagcgcttaaacaggcattggtcgcactgtcaaacgacgatattagaattaatgtaattcatgttggtgttggaggtattactgagtcggatgccaactctgccgtgacctctaaggctactgtgattggcttcaatgtccgtgccgatgcatctgctcgtaagatcattgaggcgaatggcgtagatttgcgttatttctctatcatttacgatgttattgatcaggtgaagcaggtcgcttctggtttgcttggggttgagattcgtgaggagatcatcggtgttgccgaggtacgggatgtgttccgtagctccaagttcggcgctgttgccggttgtatgatcattgagggtgttgtcaagcgttccaaaccaatccgtgtgctccgtgataacactgtggtgtttgagggtgaattggagtcattgcgtcgctttaaagagaatgttgacgaggtgcgtaacagtactgagtgtggcattggagtgaaggcttacaatgatgtcagggttggtgatagcatagaatgtttcgaacgtattgaggttgcacgtacgttg

SEQ ID NO: 33118 - DNA, 792 bp, Xylella fastidiosa
atcaaatttgagaacgtctgcgtcgattttccaatctataacgcaagcagtagatcactaaaaaaacaactcatccaggccgtcaccggcggtcagttgcgcaaggaagaaagtggtcgtgttgtcgtcagtgtattaaaagagttgacattcacgttgcaagacggcgcgcgcgttggtctgctcggtcacaatggtgcgggaaagagcaccttgctgcgcctattgaataacgtctatttcccttcctcaggccaagcactgatcgaaggaaccaccgggtcgttgatcgacatttcactaggaacggacccagaagccacaggacgagaaaacatctatctacgtggcgcactgcttgggatgaccaagagcgaaataaaccgctccgtgaatgaaatcatcgaattctccgaactcggtaatttcatcgacatgccactacgcacgtattcgacaggcatgcatctacgcttagccttttcagtatccaccatcgtatgtccagagatcctgttgatggatgagtggttatctgttggcgacgaaggcttcaagcaaaaagcggaaaaacgcctgtcagaacttgtacaagcaaccaatattctcgttgtcgccagtcactccaaacaactgattctaaatacatgtaatcgtgtgatttggttggaacatggccagatacggatggatggcgacgcacaggaggtatgtactgcgtactttgggtgaggagtgtgatatgtcactcacgtgttgcgtgttcccatcaatggtagatcccatgtgcag

SEQ ID NO: 33119 - DNA, 3496 bp, Xylella fastidiosa
atgcgcctgtccacgatcaagctgtccggtttcaaatcgtttgttgatcctgccacgctccatctaccaaccaacatgaccggtatcgttggtcccaatggctgcggcaaatccaacattattgatgcagtgcgttgggtgatgggtgaaagctcagctagccggttacgaggcgattcgttgacggacgtgattttttccggatcttccgcccgtaaaccggtggcacaggccaccgttgagctgatctttgataacagcgaccacaccatcagtggagaattcgcggcattcaacgaaatttcggttaaacgtaccgtgagccgtgacggctccagcgtctactccctgaatggcaccaagtgccgccgccgcgatattaccgacttgttcctaggcaccggcttggggccgcgcagctactccatcatcgaacagggcatgatcagtcagattatcgaagcgcgccctgaagatttgcgtatctacctggaagaagccgccggcatatccaaatacaaagaacggcgtaaagagaccgagagccgcatccgtcatactcaagaaaatctggatcgcctgaacgatttgcgtgaagagatcggtaaacagcttgaacacctcaagcgccaagcgcgccaagctgagcaatatcagacattgcaagaagaacgccgcgttaaagatgccgagtgcaaggccttgcagttccgtgaactggacacccgtctccaaggattgcgtcaggcattacttcaagaggaaacccgcttacagcaattgcttgccgaacagcgtgaagccgagatgcggatcgaaacctcccgcgtacggcgtgaagagtctgccgaagccttggcaaccgcacaggccgatgtctatcaagtaggtgccacactggcccgcatcgaacaacagatccaacatcaacgtgaaatgtcgcagcgtttgcacaaagcacgcgatgaagcacagaaacaactgatcgacctgacccgtcacatgggggacgatgccgccacactggcggtgttacgtgaggccgtcgagaacaacgaaccccagttgcacgtgctgcgtgagcagagcgaatttaaacaagacgcactgcgcgacgccgaagcagcgttgacagactggcagcagcgttgggagagccacaaccgagagaccagcgaagcatcgcgtgctggtgaagttgaacgtacccgtgttgactacttggaccgtcaggccctggacgccgagcggcggcgtgacctattgcttgccgaacgtgccggacttgatctggacgcattggccgaagccttcgagcagatcgaagtgcaatacgaaacccagaaagccgcgttggacggcctcaacgaccaacttgaacaacgtaaacagacattggcggacgtacagcaccagcagcgtactgcgcagaccgaactggccgatgtccgtaaacatgcccagaccgcccgtggtcgcctatcttcacttgagaccctgcaacaggccgcccttgggcaggaacaaggcgccgccatgacctggttgcaggcccatggattgagttcggccgcccgcgtcggagaacgtattcgtgtcgagagcggctgggaaaacgcccttgaaagcgcccttggtcacatgattgaaggcgtccttgttgatgacctgcagaccttggttgaagcattgaacagccttaacgaaggccacatcgcattggtggctgacacccagacacagatccaagtggcccccacatccctggccgctaaagtccagggacctgttgcgatccgccgtttactgacccatctgcacggcgctgaagatttagtcgctgcccgcgccctgcaagcaacactgggcgagggcgactgggtgatgacccgcaacggtgaatgcctgggtgaaggatggctacgcgtatcccgttctggagccgctgagcaaggcgcattactgcgtgaacgtgacattcaaaccctgcgcgcccagattgagaccctgcaagagcgcgaagctgaattggaacatcgcttgacgcacttccgcgaccacctattgatggccgaacagcaccgcgaagatgcacaacgccaactctacattgcacatcgtggcgtctccgaactggccggccagcgccaggcccaccacggcaaactagaggcctcccgtggccgtatccagcacattgaagccgagattgcccaattattagaaaccttggataccagccgtgaccaagcccgtactgcgcgcgccacactggatgaggcagtcacccgcatgggtgacttagagagccaacgtcaggcattgcacgctgagcggcaacaacttaacctgacccgtgaccaagcgcgtgaagccgcacgcagcgtccgtgaagctatgcatgccttagccttgaccttagagtcacagcgtacccaaatggtgtccttgagtcagacactgcagcggatgaacaaccagcgcggccagctcgacgcacgcttagaagaactgatgaaccaactcagtgaaggtgattccccggtggagatcctggagcaacaacatcaggcggccctcagcgaacgagtccgtaccgaacacctcttggtccaagcacgtactcatcttgacggcattgatgccgaactgcgccaattcgaacacacccgtcagcagcgcgatgaacaggccttgtcccagcgcgagcgcatctctcaatgccgccttgaccaacaggccctcgccttgggcgctgaacagcggcaggctgcggtggagaaagccggccttcgtcttacagcaccttgtggatgccctgcctgaagctgccaacccggctgactgggaggccgcgatagaacaactggatatacgtatccgtcgtctggaacctgtcaatttggcggccattcacgagtacaacgaagccgcacagcgtgtcgaatacctccaagcccaacatgaggacctgaccgttgccctacagacacttgaggatgccatctccaaaatcgaccgtgaaacccgaggccgctttaaagagaccttcgatcgcgtcaacgcggggttacagacactctacccccgtttatttggtggcggtcacgcctacctggagctgaccagtgaagatttactcgacaccggcatagcgatcatggcccgccctccaggcaagcgcgtctccagcatctccttactgtctggcggtgaaaaagccatgacagcagttgcacttgtgtttgctatcttccaactcaaccccgcacccttctgcctgctcgacgaagtggatgcccccctggacgaagccaatgtcgggcgcttggccagcatggtgaaagaaatgagcgagaaagtgcagttcctgtttgtcagccacaacaaatccaccatggaagccgcccagcaactgtccggtgtcaccatgcgtgaacccggagtgagccgcctagtcagcgtggatttggccgaagcgacccgtttggttgac

SEQ ID NO: 33120 - DNA, 1966 bp, Xylella fastidiosa
ctcaattctcctcaacgtgctgcggtcttataccgtgaaggtcctctgctggtgcttgcgggtgctggcagcggcaagacgcgtgtgattgtggagaagattgcgtacttgattacctcagattgttatcctgctaaacgtattgcagcgattacatttaccaacaagtccgcgaaggaaatgcgtgaacgtgtggcgaagcagatcaaaagtagtcgtgctgatggattgacgatctgcacctttcatgcattgggactgaagtttttgcagattgagcatgatgccgttggactgaagcctggcttctcggtattcgatgcagatgatgctgatgcccagatcaatgacctgttgcatggagccaaacaggatgtgattgatgatacgaaaagacggatatcccgtgcgaagaatgctggcctgtcacctgaacaagcacttgctgctgcacgtaccacacgtgagatggaggtggcaacgttatatgcacgctatcaagcacgcctgatagcgttcaacgccgttgattttgatgacctgatttgcctgccggtacagatccttgaaacgagtgatcaggttgcgatggcttggcgtgaacggattggttacttgttggtcgacgagtgtcaggataccaacgatgcacaatatcgattactaaaggtgctggccagtccgcgtggcaacttcacctgtgtaggggatgatgatcagagtatctatgcttggcgaggtgctaatgctgagaacctactgcaactggagagagattacccacaattgaaggtcatcaagttggaacagaactaccgttgtcctaaccgtgtgctgcgtgctgccaatgcgttgattgcacataacgccacatgcgcatctgaagacgttgtggagtgaccagaaagacggtgagcgcatccgtatttgggagtgccgagacagcgaacatgaggctgaaaagatcacagcggaaatctcttatttgggggatgccaagcaggtaccgtggagtgatttctgcatcttgttccgaggtaactttcaatcgcgtccgctggaaaaggcactgcaattattgcgtatcccttaccacttgacgggtggtaccgcgtttctggaacgtcaagaagtgaagaacctgttgtcttggctacgattgttggtcaaccctgatgacgacgccgcatttctgcgtgcagtgcagtcacccaagcgtgaggttggttccacctcattggctaaattggctgaacttgcggcggcaaagcaaatgccgatgtctcgtgcggctgagtcgctgggcgcgttgcaacaattaccggcgcgcgcagccaatggcctgaataaattcactgatatcttgcgtgagttgcgccagcaagtatcacgtgtgtcggcggctgagttagtgcggcgccttgctgaagtttctggtttacttaccgaattgcgtgagcagtccaatgatgaagcgagttaccaacggcgtaagcgtaatgtagaggaactggccgaatggtttgaaggcggccctttcggtgccagtgttggtgatcttgtttcgcagctagcattgctatcacgaaatgataaggatgatggcggtaaccaggtgcgcatgatgacactgcacgcttccaaaggattggagtttcgttatgtgttcatcgttggttgcgaagatggcgtgctaccgcatgaagtcagcttggaagaaggcaatgtgcaagaggagcggcgcctattatatgttggtatcacccgagccaaagagcagttgtggatgagctatagcaaatgtgcgcgccgcttcggtgaacgtgtgcggtttaagcccagtcgctttttcgatgaactgccagctgaggaattacagcgcgatggtgctgatcccgtggttgatgccgaacgtaaacaggagcgtgctaaggctggtttggcagcaattcaggcgctattggac

SEQ ID NO: 33121 - DNA, 653 bp, Xylella fastidiosa
gaatcttcttggaaggcgcacgttggtaactggttattgcgtccggaaatgcgggatttgtcttccttcctgcgtgcgagaaaggttgctggtgtgagtgtctacccaccaggatctcagatatttgcggcgttcgaagcgaccccattccagcgggtcaaggctgtaatcctttgggtcaagatccttatcacggtcaaggccaagcgcatggtttgtgtttttcagtgcggccaggtatgccgttgccgccttctttgttgaatatttataaagagctcgaagaagatcttgggttgctccgccctgatcatggctgtctgcttccttgggcaaaccgtggtgtattgctacttaatgcggtactgacggtggaggatggtcgtgcaggtgcgcatcagggtaagggctgggaaggctttaccgaccatgtcgttgataccttgaatcgcgagcgtgaaggacttgtattcatgctctggggtagctatgcccaagccaagggtaaggttattgatacgcgtcgccaccttgtactcaaggctccgcacccttcacctttgtcagcgcatcgtggttttctgggttgccgtcatttttctctctgcaaccagtacttgagccaacatggcttggggatggtggattggagc

SEQ ID NO: 33122 - DNA, 627 bp, Xylella fastidiosa
atgacgtcgcaacgcgtccgagaccgcctggtcgaacggctacgcgaatgcggcatccaagacgaacgggtactcagcaccattcgcatcgtgccacgccatttattcattgatgaagccttggcactgcgcgcttacgaagacaccgcattgcccataggccatggacagaccatctcgcaaccctggatcgttgcacggatgaccgaagctgtcatgcaggttgccccaaaaaaaatactcgagatcggtacaggttccggctaccagagcgccattctggcctcactaggattggaggtgtacaccattgagcgtatcggcaaactactgcgtcaagcacgtaagcgtttccgccagcttggcataaaaatacgcagcaaacacgatgacgggagcaccggctggacagagcatgcaccttacaacgccatcttggtcacagcagcagccccgacactgatcgacactctcatcgaacaacttgcaataggcggacgcctggtggctcctgtcggcaccgcttcagagcaagccctagtgcagctcacacgaacaatcgacggtagcatcacacacgagattttagaaccagtcacatttgtatccctgctaccagggatgttg

SEQ ID NO: 33123 - DNA, 1131 bp, Xylella fastidiosa
acttccgcggtgcgtgctgggatcgattccgacactgctcatggggcagtgacgccaccgattgtgctttcatccaacttctcgtttgaacgtttcggtcataagcgtaagtacgattacacacgtagtgctaatccaacgcgggatctgctcggcgaggcgcttgcggagttggagggtggtgccggtggtgtggtcacggcgactgggatcgctgcgattacgttggtgttgcacgcattgctccggccgggggatcgtttggttgtgccacatgatgcttacggtggcagttggcgtttgttcaatgcgttggctcaaaagggacattttgaattgatcacggtcgatttgacggatgcacgatcactggttgaggcattggcactaccaccgaagttggtattgatcgaaactccttccaatccattgttacgtattactgatttgggtgcggtgattgaggcagcgcaccgtgtcggtgctttgactgtggtcgacaatacgtttatgtctccggtgttgcagcgtcctttagagttcggcgctgacttggtattgcattcgacaacgaagtacatcaatggccacagtgatgttgtcggtggcgttgttgtggcacgtgatgttgcgcactatcagcagttggtgtggtgggcgaatgcgctgggtctgaccggctcgccattcgatgcgttcttgacgttgcggggggtgcgcacgctggatgcgcgtttgcgtgtgcatcaggagaatgcgcagatgattgcagcgttactggaggggcatggtgtggtgaagcacgtgcattacccggggttggcttcgcatccggggcatgtgctggcggggcggcagcaaaaagggttcggtgccatgctcagtttcgagttgcagggtggggaagaggcggtgcgggcttttgtcagtggcttgcgttatttcacgctggctgagtcgctgggtggggttgagagtttgatcgctcatccggcttcgatgacgcatgctgccatgacgcccgaggcgcgtgctaaagcgggtatctctgatgggttgttgcgcttgtcggtggggattgaggccggtgaggatttgatcgttgatctggtggctggtttgcggcgtgct

SEQ ID NO: 33124 - DNA, 1578 bp, Xylella fastidiosa
ctgatcctcctgctggagaccgaatacaccaccgcccccccttcaccaatcaacgcggcgacatctgacaccacctcaccgcccccgccatccccccaaccagccgcttccaagccgacagcaccagatcaactacactccgacatcaagtgccgcatggtcgtactcggtgccggtcccggtggctacaccgcagcattccgcgccgctgacctcggcttggatacagtgctcgttgaacgctatcccaacctaggtggcgtctgcctcaatgtcggctgcattccttccaaagcattactgcacgcagccgccgtcatcgacgaagctgcacatgctagcacctttggaattgattttggcaaaccaaaaatcaccctagacacactgcgcgaatacaaacaaaacgtagtcaacaaactgactgccggcttggccgtgatggccaaacaacgcaaggtacgcaccgtcaccggcatcgcgcacttcgtctctcccaacacactggacattaccgctgctgacggcagcacccaacgactccatttccaacaatgcatcattgctaccggctcacacccagtgaagctaccaaacttcccttgggacgacccgcgcatcatggactccactgacgcactggaactggccgaagtgccaaaaaaactgcttgtcgttggtggcggcatcatcggcctagaaatggctaccgtgtacaacgccctgggcagccacgtcaccattgtcgaattcatggatcagatcatccccggcaccgacaaagatctagtgaagccactggcggaccgcatgaaaaaacagggcattgaaatacacctgaacaccaaagcaagccacgtcaaagccgacaaaaaaggcatcaccgtctcattcgaagcacccacccaaggcacacaacccgcattaaaaacatcgacctatgatcgcgtccttgttgccgtcggccgtacaccgacaggcaacaacatcagcgctgaaaaagcaggcgtcaacgtcaccgaacgcggcttcatcccggttgatcgccaaatgcgcagcaacgtaccccatatctttgccattggagacattgttggtaacccaatgctggcgcacaaagccacacatgaaggcaaactggctgccgaagtcgccgctgctgaaacagaatcaggcaaacatcgggaatgggttgcccgcgtgatcccatccgtggcctacaccaacccggaaattgcctggatcggtatgactgaaaccgaagccaaagcgaaaggactcaacatcggcgtcgccaaattcccctgggttgccagcggtcgcgccataggcatcggacgcactgaaggcttcactaaactcatcttcgacgaagacacacaccgcatcattggcggagcgatcgtcggcgtccacgcaggcgacctcttggctgaaatcggactcgccatcgaaatgggtgccgaagccgaagacatcagccacacaatccacgcacaccccacattgagcgaatcgattgccatgagcgccgaagtctacgacggcaccatcaccgacttgtatctccccaaaaaa

SEQ ID NO: 33125 - DNA, 2268 bp, Xylella fastidiosa
atgacaatcgtgaccaacctgggcttcccgcgcatcggcgcacgacgcgaactcaagcgcgcactggaaagccactggcgtggcgagaccgatgccacacaactccaacacactgcacgcgaactacgcgcacggcactggcgactacaacgtgatgcgggcgtggatctgccacccagcaacgacttcagcctctatgaccacgtcctagataccgcattcctgttcgatgccattccacagcgctaccacggcctcgtagatgctgatcctctggccggttacttcgcgatggcgcgtggccgccaagctgacaacattgatctgcatgctctggagatgaccaaatggttcgataccaattaccactacctcgtcccagaactgcaccgtgaccaacacttcgcgctacgcggtaacaaacccatcgccgagtttgaagaagcactggcactgggcatcactaccagaccggtgctccttggaccagtcagctttctcctgctgtctaagacagtggatggcagcaaccggctcgacctactggaacgtttactgccggtctacacccaattgctgcgccaattgcaggaaagcggtgccgaatgggtgcaaattgatgagccaacacttgtgctggacctggatgcacaaacacagcaagccttccgtaaagcctacgccacacttaatcaaggaccacgcccaaaattgctgctgaccagctactttggtccgctcggcgacaacctagaactggccttgcaactgcctgccgatggcttacacatcgacttagtgcgtggcaccgaacagttggatgcggtcctcaacaccttgcccgcgggacgggtactctccgccggactggtgaatggacgcaatatctggcgtaccgcactggacaacgcactgacactggcgcgctacgcgcaaggccgtgttgataaggatcacttatggctggcaccgtcatgctcactcctgcacgtccctgtggacctggaacaagaaaaaaacctggacgccgatgtacgcaattggctcgcatttgccaagcaaaaacttagcgaactgcgcgtactggctgacgcactggacaacaagccagaagcagaaacagcactgacccaaacacgccaagcattggaggcacggcgccaatcacccaaagtccaccgccccgacgtggcacagcgcctggccgcactcacaccggacaccacccggcgcaacaccgcctacccacaacgcagccaggcacaacaacacacactcaacctacccgcttacccaaccaccaccattggctcctttccacagacgctagaagtccgtgaggcccgtgcgcagttcaaatccggcaagttgtccgaaagcgactatgaggcgtttttgaaagcggaaaccgaacgttgcgtacgtacccaggaagagatcgggttggacgtcttggtccatggcgaattcgagcgtaacgacatggtcgaatacttcggggagcaattggacggcttcatcttcaccaagctcggttgggtacagagttacggatcacgctgtgtcaaaccacccatcatttatggcgatgtagtacgtccagcaccgatgaccgtcacctggtcggcttacgcacaatcactcaccgacaaaccaatgaaagggatgctcaccggtccggtgacaatgctgcaatggtcgtttgtacgcgatgatcaggaacgcgcgcagacatgccggcagatcgcactggcacttcgcgacgaagtccaggatttagaaaaagccggaatcaaagtgattcaaatcgacgaaccagccatccgcgaagggctaccgctgcgccgtggtgaatgggcagactatctgaactgggctgtggagagcttccgcattgcctcttcaaacgtccacgacactacacagattcatacccacatgtgctactcggaattcaacgacatcattgaagccgtggctgcattggatgcagacgtgatctcgattgaaacatcccgttcacgcatggaattactggatgccttcgtgaaattccgctatccaaacgccatcggcccaggggtgtacgatattcactccccgcgtgtcccacaggaagaggaaatggtgcttctattgaaaaaagcacgcgcagtacttcccccggaacaattgtgggtcaacccggattgcggcctgaagacgcgcggctggaaagaaacacgtgctgcattgcaaacaatggtgcatgccgcgcagcggctacgt

SEQ ID NO: 33126 - DNA, 1482 bp, Xylella fastidiosa
aaatacatactggccattgaccaaggcaccaccagctcccgggccattctgtttgaccacaaaggccgcatcaccgggatggcacagcgggaattcacccagatatttccccaacctggctgggtcgaacacaacccgcgcgacatcatgaccagtgtgtacaccacgatcaccgaactgctcaacaacacccagattgacgtgcgcgccatcgccggaatcggtattaccaaccaacgcgaaacaaccgtcatctggaatcgtcagaccggccaaccgatctacaacgcaatcgtttggcaatcacgccaaaccaagaacatctgcgaccaactcacgaccgccgggtaccaagatctggttcacgccaaaaccggactcctgatggacgcctatttttcaggcaccaaggtgaaatggattctggaccatgccgaaaacgcacatacacaagcagcacgcggagaactggcattcggcaccatcgacacctggatcatctggaacctgaccggcggccaagtccatgtcaccgattacagcaacgcctcacgcaccctgatgtacgacatccacgccctgcgttgggatccagacctgctgacaatgctcgacataccagcggcgatcctgccggacgtccgttcatccagcgaaatttacggtctcacccaaaccccgtatttccacggagaacagataccgattgccggaatcgccggcgatcagcaagccgcactcttcggccaagcctgtttcgaacctggcatggccaaaaacacctacggcaccggctgtttcatgctgatgcacaccggcaaaaaagccgtggaatccaaaaatggactactcactacgatcgcttggggcctgaatggagaaatcgagtacgcactagaaggctcgatcttcatcgctggctctgtggtgcaatggctgcgcgatggattacgcatgttcggcaaagccagcgattcacaagcctacgccgaccgtgtcagcgacaacggcggcgtgtacgttgtaccggccttcgttggcctgggtgcgccctactggcgtagcgatgtccgcggcgcagtgttcggactgacacgcagcaccaccaaagaacacttcgtccgcgccgcactagaatcgatggcctaccaaacccgcgacgtcctgagcgcaatgcaggcagatgcagacatcgaactcaaagaactacgcactgacggcgcggccatcaccaacgacttcatggcccaattccagagcgatatcctcgccgtgccagtgctgcgctcgcagatcgccgaaaccacagcactcggtgccgcctacctggctggacttgcgaccggattttggtcaagccgcgaagagatgacgcaacactgggcgatcaatcgctgcttcaagccacagatggataaggaacaacgcgagcacctatacgcaggctggaaacaggccgtcgcagccacattaggcttccgt

SEQ ID NO: 33127 - DNA, 1473 bp, Xylella fastidiosa
ttcgacctactagtggtcggtggcggtatcaacggcaccggcattgcccgtgatgccgccggacgtcacctctcagtgtgtctgtgcgaacaacacgacctggcctcccacacctccagcgccagtaccaaactgattcacggcgggctgcgctacttggaatattacgaatttgcgttagtcagcaaagcattggccgaacgcgaaatcttgctacgccaagcaccgcacattgtcaggccactgcattttatcctcccgcaccaaccccatctgcgccccacctggataatccgcgcgggcttgctgctttacgaccaccttggctttagtcgacgcaccctgcctagctcacgtcgcttgaacttggcccaacatcccgctgggcaaccactcaagcaggagctgcacaccggcttcatgtattgcgacgcccaggtccaagacgcacggctggtcgtgctgaatgcaatggatgcagcacaacgtggcgcacgtatcctcacccgcacccgctgcgtgagaacgcgccgtgacggcgcacattggctgactgaactggaagacgctcaaggaagacaccaacaaattcgtacacgggccatcgtcaatgccgccggcccctgggccgtaacgtttctggatcacatcgctcaacagccacatcagcacacactgcgtctggtgaaaggcagccacattgtagtaccccgtctgtttgaacatgagcatgcctatatcttccaagaaccagacagacgcatcgtctttgccattccttacgaacaacatttcacactgattggcactaccgacgtcgactacgtagctgatcccgcgaatccacacattgacgctgccgaaaccatatacctgtgcaatgcagtcaatgcgtatttcagacaacaaatcacaccggaagacgtcctctggagctacagcggagtccgtcccctactgaacgatggacacaacaatgcctcgaaagtcactcgtgattaccaattagaaatacttggaaacagcgcaccattactcaacgtgtttggtggcaaactcaccacctatcgcaagctttccgaagaagcagtgaaccagctatgcgtagcattagaccacccctaccgtgcctggactgccaatgggccacccctgcctggcggcgaacaccacgacatcgcagcgctacaaaacacactgcgccaacaccgcccatggttacctactgccactgcgcaacgcctgatacacaactacggcacctgtgccgaaacgctactcggcaatgccaccaacctacacaccctgggaattcactttggcgctgacctgtatcaagccgaagtagactacctgcgcacccacgaatgggcctgcagtgccgaagatatcctctggcgccgcagcaaactcggcctgcatttagatgcgcatagcacacagcgcctggaagactatctacgctcctgctca

SEQ ID NO: 33128 - DNA, 1284 bp, Xylella fastidiosa
atgaatcattcccgctctcatgccctctttgtccaggcccaaacacgcatccctggtggcgttaattcaccagtccgtgcgttccgctcagttggcggcgaaccgttcttcgttgcacgtgccgacggcccgtatctgtttgacgtcgacggccaccgctacattgattatgtcggctcttgggggccgatgatcgtcggccacaaccatccaggggtgcgtgaagcagtgcaagtggcgattagcaacggcctgtcctacggtgccccatgtgccgccgaggtgaccatggcagaaaccattgcgcggctcgtgccatcatgccaaatggtgcgcatggtcaactctggcactgaagccacattgtcagcgatccgactagcgcgcggtgccactggacgcaattacatcgttaaattcgaaggctgttaccacggccacggcgactcattcctagtcaaaggcggcagcggcatgctgacccttggcctaccaagctcaccaggggtgcctgccgagctgagcaaactaacaatcacgttgacttacaacgatttcgatgcggccacggcactatttgaggagatgggacaccacatcgcggccgtcattgttgaacctgtcatcggcaacgccaactgcattccaccgcgaccaggctatctacaacatttacgcaccctgtgcacccagtacggagtgctgttgatctttgatgaagtcatgaccggctttcgcgtcgcacttggcggcgcgcaagcgctgtacggagtgacaccggacctgaccaccttcggtaagatcatcggtggcggcatgccggtcggtgcctatggtggccgccgcgatctgatgcaacacattgccccagccggtccaatctatcaggcaggcaccctctccggtaacccggtggcaatggcggctggtctggccatgctggagctaatacaggctccggatttctatacgcatctgagcaacgccgccgcagccctgtgtaccggtttgcaacaagcagccagccaggcaggcattgcaatgaccacacaacagattggcggtatgttcggactgttttttaccgatcaacaggtggaaacctatgcccaagcgaccgcctgcaatactgaccgcttcaaccgcttcttccacgcgatgctgcaacgcggcgtgttttttgccccatcagcgtatgaagcaggatttatctccagcgcccattcaccaaacatcatagaggccacgttggaagctgcgcgtacagccttccaaacaatcgcc

SEQ ID NO: 33129 - DNA, 990 bp, Xylella fastidiosa
gcctatccacattaccgtccacggcgtatgcgccgtcatccctttattcgacgactgatacgcgaatacaccttgactgtgaatgacctaatctggcccgtcttcgtgcatggcctaccccggcggacacccatcgcatcaatgcctggtgtagagcggctctcactggatgcactgctccatgaggccgaacacgcattaactttaggtattccactcatcagcttattcccggtcattgatccggcattgaaaagccttgacgccgccgaagcatggaacccagatggcttagtacaacatgcagtacgtgcacttaaaacacgcttcccggagatcggcgtcatgacagatgtcgcactagatccatacaccacacacgggcaagacggaatcatcaactcacaaggctacgtactcaacgacatcaccgtagaagcactggtaaaacaatcactctcgcatgcacaagcaggtgccaacatcatctcaccctctgacatgatggatggccgcatcggtgcgattcgcaaagccctagacactcatccaaacttcgtagataccagcatcatggcttattcggccaaatacgcatcggcattctacaacccgtttcgcgatgcagtaggcagcgcgaccaaccttggtaaagccgacaaaaaaacctatcagatggacccggctaacagtgacgaagcactccgtgagattgccttggacatcgaagaaggcgcagatatggttatagtcaaacctggactgctttgcttggatgtagtacgccgggtaaaagagacattccggatgcccacttacgcctatcaagtcagcggcgagtacgccatgatcaaggctgctgtatccaacggctggttagaagaacgcagcagtgtgttggaaacattaatagcattcaaacgtgccggtgcagatggcatattgacctacttcgcaccacaagtagcaagctggttgcgtgaaggtaaa

SEQ ID NO: 33130 - DNA, 609 bp, Xylella fastidiosa
ttgaccgtccccacttggttaacgctgctacggatcgtgatgatccctgtgctcattgtggtgttctatctaccttatcaatggagcaatattgtcgccacgggagtgtttgcgatcgctgcaattaccgactggcttgatggatggatcgcacgtcgttacgcgcaacattcgttattgggtgcgtttttagacccagttgcggacaaattgatggtggccatcgcattatttctcattgtgcaaggtcacccgacaccgtcgatggcattttgggcagcagtgatcgtcagtcgtgaaattgcagtgtcagcattgcgtgagtggatggccgaaattggtcatcgtgccaaggtgcgtgtagctgtccttggcaaagtgaagactacggctcaaatgattgcggtactgtgtctgctctattcggtaacacccgagaagaaggctatccatcaaatatggtttggccacttgatcttccaagtcggttattggacattgctgatttccgcgttactgacactgtggtctggtttccagtatttgcgcgctgcctggcctagtttacgtaccggaaaacctgtggtgattaaaacgcacatcagcaag

SEQ ID NO: 33131 - DNA, 2472 bp, Xylella fastidiosa
ctgccaattgatgcgctactaccagctataacaacgagcttatccaatcatccacgcctgattttggaagccccaccaggggcaggcaaaaccacccaagtaccgctggccttacttgatgcgccgtggctgaacggacgcagcatcatccttttggaaccacgccgggtcgcagcacgcaatgcggcactgttcatggcccgccaatgcggtgaagaggtcggtgggcttgtcggctatcacatccggtttgaaagtaaagtctctgcacgcacccgcattcacgtcgtgacggaaagaattctgacccggatcatccaggatgacccgctactggatggcatcggcgcgctgctgttcgacgaattccatgagcgccatttggccagcgaccttggcttggcgttggccctggacgtgcagacacagctacgtgaggatctacgcattgtcgtgatgtcagcaaccctgcaagggcaacgcttggcgcaatttctcgatgcaccacgtctgaccagcgaagggcgtgcctaccccattacgatcactcactttcctgcgcgccgtgatgaatcacttgaaacacaggcacgccgcgccattcagcatgctctggacacacaccaaggtgacgtgctgaccttcctccccggccagcgagagatcgccaggttacaagccatactggagaaaacactctccccagaattgcacgtgatgccactgcacggtgaactaccgctgcaagagcaaacacgtgtgctggaaccagatcaacatggcaggcgacgcatcgtgctagccactaatgtcgctgagtcctcaatcaccttaccgggaatatcggtggtgatcgacagcggattagcacgtgaacctgcctacgatccgaataccggcttcacacgcctggatgtggtgagcatcacgcaagcttcggctgaccaacgcgctggacgtgcaggccgcctcgccccaggctgggcctatcggctgtggccgcaatcacaacgactggaagcacaacgccgaccggaaatgatccaaaccgaattatctggtctggccctggaactgacagcttggggcagcagcacactgcgcttcatcgacccccctccctctggcgcgttgagcgctgcacgcgaattactacaacgactgggtgcgatcagtaacacctccaccctcactcccctgggtcagcgcatgctggcactgggcattcatccacgtctggccgccatgttgctggccccacacgatccgcaggaacaggcgctggcctgcgatttggcagcattacttgatgcgcgcgatccactgcgcggcagcggcgacgcgctgattagtcgctggcgtgccttagccgaattacgcagcggctgtctcccccacgacaccagacgcagcacactaagagccatcgacgccgcaacgcaccaatggcgaaggcgcatccgctgtgacaccacaccaccggatgcgatagaagcgcatacgctcggcaacctactcacacatgctttccctgaacgcatcgccgcacgtcattccagtgacccgctgtattacgtattagcgaacggccgccgtatgcgcctgttcgacaacagtgcgctgcatggcgaaccttggatcatcgccagcgagttacatcacgggatcaaagacatccaactgctctgtggtgcccctttggatgagagaaggttgcacgctgacttccccgaacgcttcatccaacacgatgtcatacgctgggaaacagataaacgcgccttggtggcgcagcgtgaatcctgcttcgaccgcatcgtcctcgacgtacgccccgccggacgcattgatccagtacaggctgcaaacgtattaaccggagccgtacgcacgctcggcctggataccctctcgtggacagaacacctacgccagtggcaggcacgcgctgtagcactgcgtcactggatgccggagcttgaacttccagacctttccaatacaacgttactagcaacactggacacgtggttaagaccagcattcgcagggaaaaccagactggatgcactggatgaagcggcattcgagcaagcagtcaaatcgctactttcgtggacacaacacgcactcatcgaccgtcatgtacccgcccacatcatcgtaccgtctgggatgggacgccacattgactatggattagccgacgatggcacgccgcagccgccagtgctttctgtcaaactacaagaattatttggtctgcccgataccccacacatcgcaaaaaaccgtatccctctcaccctacacctactctcacctggcgggcgcccactgcaagtgactcaggatttaaagagtttttggactaacacgtatccggaggtgaagaaagaaatgaaaggacgctatccgaaacacccatggcccgacgatccatggactgcaaccgccacccaccgcacgaaa

SEQ ID NO: 33132 - DNA, 1005 bp, Xylella fastidiosa
cgttgttttaacattgccatcgttggcgctactggcgcagtgggcgaggccatgctttcgatcttggaagagcgtcatttcccggttgcgaagctgattcctcttgcttcggcgcgctcgacgggttctcagatcaccttcaagggcgagagcatcaacgtattggagctggagcactttgatccgcatggtgtagatattgcattgttttctgctggcagcagagtctctgaagcgtatgcgccacagtttgcggctgctggtgtggtggtcatcgataattcttccgcgtttcgttacgaggaggatgtgccgttagtcgtatcggaggtgaaccctcatgcgttgaagcagcggccgcgtggcatcattgctaacccgaattgttcgaccatgcagctcatgccggtgctggcgccaatccaccgggaatatcgcattgagcgtatcaatgttgccacctatcaatccgtgtctggcggtggccgctcggcgcttgaagaattgggacagcagactgcacagttattagcctttcaagagatcaacccaaagcgatttcctgtacaaattgctttcaacttgattccgcatatcgacgattttcagtctaacggctataccaaagaggagatgaaattggtttgggagacaaagaagattcttgaggacagcagcattcaggtgaatccaacggcggtgcgtgtaccagtgttttttggtcattccgaagctgtcaatatcgaaacgcaaaagaaagtcacttctgagcaggcacgtgcgttgctagccagtgcaccaggtgttgaggttgttgatgagtggcagcctggcggttatccgactcctgtgacccacgcttccggcaaagatcctgtgtttgttggtcggattcgtgatgatttatcacatccacgcggcctgaacctgtgggtagttgccgacaacatccgtaagggggctgcgcttaatgcaatacagcttgctgaactagtgacgggcgag

SEQ ID NO: 33133 - DNA, 1083 bp, Xylella fastidiosa
atgggggcgaacacgtttggaaagttactggctgtcacgaccttcggtgaatcgcatggccctgccattggctgtgtgattgatggctgtccccccggattggaactcgctgctgaggagtttgcccacgacttgcagcgtcgcgctaccggtaggagccgtcatacctcggcgcggcgtgaggccgatgaagtcgagattctctccggcgtctacgaaggccgtaccacgggcactcctattgcactgttgatccgcaataccgaccagcgtagtaaggattatgcgacgattgtccggcaattccgtccgggccatgccgattacacctattggcagaaatatggcatccgtgatcctcgtggcggtgggcgttcttcggcccgtgagacaacaatgcgtgtgactgctggggtggttgctaaaaagtggctgaagcagcgttatggtgtgattgtgcgcggttttttatcccagctcggtgagatacgtccggaaggttttgcttgggatgcgattgaggataatccttttttttggccgcatgctgctcaggtgccagcgctggaggcctacatggatgcgctacgcaaatctggcaattcggtcggtgcacgcgtgggtgtggttgccgaaggcgtgccgccaggatggggtgagccgatttacggcaagcttgatggtgaacttgctgctgcgttaatgagcatcaacgcagtaaaaggtgtggagatcggcgctggtttcggcagcgctgtacaaaaaggcaccgagcaccgtgatttgatgacaccgttaggtttcctcagtaaccatgctggcggcatcatcggggggatcgccactggtcagccgattattgtttcgattgctctgaaaccgacgtctagcctacgtttgcctggcgagacggtggatgtggatggctgcgctgtccaagtgatcaccaagggacgtcatgatccttgtgtggggattcgtgcccctcctattgctgaagcgatggtcgcgttagtactgatggatcaggcgctgcgccaccgtgcccagtgtggtgatgtcggtgagatgtctccgtgtatc

SEQ ID NO: 33134 - DNA, 828 bp, Xylella fastidiosa
aatttcgtcaccaccctgacctatcttctgccacatcgcatgctgtcctcgctggcacgccacatcgcctattgccagcatccactgatcaaacagtggttgatcgacacagtcatcgcaaaattcgatgtcaacctgagcgaagcggcggagccggatgcccatgcctacccaagctttaatgcctttttcacccgatcacttaaagccggcatacgcctccctgatccgaatccggacacattgctcatgccagccgacggacgcatcagtcaactcgggccaatccgcgaagggcgcatctttcaagccaagggccagtccttcactgcaaccgagttattgggcgataccgctgctgcttctgccttcaccaacgggctgtttgccactgtctacctatcgccacgtgactaccaccgcgtgcatatgccttgtacgggtcagctgctcaaaacagtgcatgtaccaggccgcttattcagcgtcggcccagatgcagtacgccaaattccacgactgttcgcacgtaacgaacgactggtatgtcattttgacactgcattcgggccgatggtcttagtgatggtcggagcgctgcttgtctctggtgtggaaacggtttggggtggtgtggaaatccccgcttatggcgatcgcatcacacacaaggactaccaaggacgcaatatcgccatagagcgcttcgcagaaatggcacgcttcaactatggttcaacagtcatcgtgctattgccaccaaatgtcttcaccctcgcccctcacctcacagcagaaagcccggtcacactcggtcaagcactagca

SEQ ID NO: 33135 - DNA, 1143 bp, Xylella fastidiosa
gaacgcatactgtcactacgcaaactgcgtctagcacaatgccgcacacgcacacgacgcacgatcgaaaggcgtaacggcgttcggctcgaaatcaacggaagctggctggtcgaattctgttccaacgactacctaggactcgcgcaacacttcgaaatcatcgcggcactacaggatgcagccgcccgcaatggcatcggtgccactgcttcgcatctgatctgcggccaccacgcaatacataaggcactggaatatgaattagccgaatggttgggctacccacgcgcattactgttcggtagcggcttcaccgccaacctggcagtgcaacaagctctgctcaccaaagaaaacgacatctgcgttcaagaccgactcaaccatgccagcctgatagacgctacccgtctggcaggctgccgcctacgccgctacccgcaccttgatgtggatggagcggcacatcaactcaagaacgcacctgaaggtgcagcaatgctagcaaccgatggcatctttagcatggatggtgacatcgctccattacgcgccctcagcctggtcgcacgcacccaacaagcactgatgtatgtcgatgacgcacacggcatcggagtgaccggaccccaagggcgtggctgcatcgcagctgcttggctcagcgtagaggaagtccccttgcaattagtgaccctcagcaaagccctaggtggctacggcgcggccgtactcggctctgccacactgatccaacacttggccgaaaccgcacgcccctacatatacaccactgcactgcctcctgcccaagccgccgccgcactgacagcaatccgtattgcacggcgtgacgaatggcgccgccagcgcctacaggaacttgtggagcgtttccgcgagaatagccgccgtcacggcctggagatcatggattcagagacacctatccaacccttgcaatgcggagatgaaaccacaacgatggcgatgtccgcggcattggaacgcgaagggttcctagtcaacgcaatccggccacccaccgtacccgaggggaaatcacggttgcgcgtgaccctgtccgcactgcataccactgaacaaatcgacacattagtgcaagcgcttgcccgctcc

SEQ ID NO: 33136 - DNA, 1263 bp, Xylella fastidiosa
atgtcaaaaattgtagttgctggtggtaccccgctatatggggatgttcggatttccggtgccaagaatgctgtccttcctattttatgtgccacgttgctcgctgatgcgccggtggagatcagcaacgtaccctatctgcatgacgtgatcaccatgatcaatttgcttcgtgaattgggtgcgggtgtcaccatgaatgaaggcattgaggcgaaaggacgttcgattacggttgatccgcgctgggtacgtcagcgcgtggtgccgtatgacttggtgaagactatgcgtgcttctgtgttgctgttgggtccgttattggcctgctatggtgccgctgaagttgcacttcctggggggtgtgcgattggttcacgtccggtcgaccagcacatcagaggattgcaatcacttggtgcggagatcacggttgagaatggctacatcaaggcttctgtcagtcagggtcgattgaagggaggtcgtttcgtgttcgacgtggtgagtgtgacaggcactgagaacctgttgatggctgcagctgtggctcaggggacgagcgtcattgagaatgctgcgatggagccggaggttgtcgatttagccgagtgtttgatcactctcggtgcgcgtgttgagggtgctggtaccccacgtatcgtggtcgaaggggtggaaaggttaaagagcgggcagtatgcagtgttacctgaccgcattgagacgggtacttttttggtggctacagcgatgacgggggggcggattagtatgcagcaggtgcgcccgcagactctggatgcggtgctgggcaaactgaccgaggccggagcgtgcatcgaaataggtgcagatagtatccgtttggatatgcaggggcggcgcccatgttctgttaatctgacaactgcaccttaccctgggtttcccactgacatgcaggctcagtttatggcgctgaattgtgttgcagaaggcgtcggtgtgatcaaagaaacgatcttcgagaaccgtttcatgcacgttgatgaactgttacggctcggcgccaaaattcagattgagggccataccgcgattgtgcagggtgtcgagcgattgagcggtgcaccggtgatggctactgatcttcgcgcctcggcctcattgattctggctggtttggtcgcggagggggaaacaatcattgatcgcatttaccacctggatcgtggttacgaaaacattgagagaaaactcggagtgctgggtgcatcaatc

SEQ ID NO: 33137 - DNA, 1694 bp, Xylella fastidiosa
atgaatgtgcgcctccagggccacggcgcagcacgaggcactgcactggggcgcgcctgggtccgtcagatgaacatcatcgaaatccaggataaatacatcactgacactaacgccgaattacatagcttgtaccaagccatgagcgcagcacgtcaggaaatacaagtactgcgagaacgcatgcatggcaccttgtcccacgaagtcggcgagtttctcgacctatacacactgttgatcgacgaccctgagctactacggagcctgaacgaactcatcctcactcacaactacagtgccgaatacgccctgaaaatacagcgcgaccacctcaccacagaattcgaagccatggaagaccactacctgaaaagtcgcatggacgacctgaatcacgtgctaggacgcatccacgcctttctaaaaaaacactcccccgaacccaaagatgctgcaggtgaaatcctcatctgcaacaacatcgccccatccgaattggcccaagtacaagcccaaggcattattggaatcgtcatcgcggctggcaatacactctcgcacagcgccatcctggcgcatagcttgcacctgccactgatcgttggtgcaggagacctgctgctacaaaagatcaccaacggcgacatgctgatcatcgatggcaacagcggagaaatcattgtcaatccatcgccacaggacctgcgtcactaccatagccgactgcgcgaacgcgccaaagaacaacgtgagctggaacaactacgctctaaacacagccgcactcgcgacaacgtcgacattgtcgtacaggccaacgcagaatcaccggacgatgtctcccaagcatacacactgggagcggccggtgtgggcctgtaccgcactgaattcctgtttctgcaacgcaacaaactgccggacgaagaagaacagttccaaacataccgcgacactgtactacgtatgaacggacgcccagtcaccatccgcacactagatctgggtgcagataaaaccgactgtaccggcctgactctcagtaacgaagaaaacccagcaatgggcctgcgtgggatacgcctgtcgatggcacaccccgcagtggccaacacacaattacgagcgatcctgcgcacctccacctatgggcatgtccgtatcctggtccccatgattagctgccgagaagagatcatccttctacgcaagcagatcaaagcgctcagcatccaattgcgcaccgaaggccacgacattgccgagcaggttcccctaggagcgatgatcgaagtaccagctgcagcaatcgcactcaacagctttatcaaagaaatcgacttcctatcgatcggtaccaacgacctggtccaatacctattggccgccgaccgcaacaatgcggcaatcagcgaaatatactccccactccaccctggcgtcctggcagtactggctcagatcatcgtcaccgcacatacacatgccacccctgtcgccatctgcggtgaaatcgctggcgatccacattacgtgcccatgcttctggcattaggtctcacagaattcagccttcacccggccacattacttgaagtacgccgtgcaatccgcaacagcgacctgggcacattgaaaacaagtgcaaccacactgctccgcgcacgcgaccggaagagcatcgaagaatg

SEQ ID NO: 33138 - DNA, 960 bp, Xylella fastidiosa
ctaagccttccccagattcaatccttcgcagcatcagacatggctgcaatcgatacgctgatccacgaccgcctgacctcagacattgtgctgatcaatcaaattgccgatcacatcatctgctcaggtggcaaacgcctgcgccccatgctaacgatgttagctggccacgccatcggccccacaggccctcatcaccaccaactggcggccatcattgagttcatccacaccgccacactgctacatgatgatgtggtcgacggatcggaactgcgccgcagtcgcagtacagcaaatgcactatggggcaatgcacccagcgttctagtcggcgattttctatattcgcgcagcttccaactgatgaccgaattggccaacctagaagtcatgcagatattggctgaaaccaccaaccgtatctctgaaggcgaagtactgcaattgttgcacgtacacaacccggataccgacgaaaccacctacctaagcgtgatcgagcgcaaaacggcaatattgtttgctgccgcagcacaactcggagcactcgcatcccatgccgatacgcagacacagacacgcatgtacgaatatggaatgcaattgggctatgcattccaaatcaccgacgatgtactcgactacaccgccaacaatagccaactgggcaaaaatctcggtgacgatctcgccgaaggcaaagccaccttaccagtgatccatgcgatgacacactcagacgcagccacatgtgaacgtttgcgcatgatcatcagcaaaggcgatagcgatgcaatgccagaagtgctgaacgcgatccgtacaactggcagcttggactacagtcggcaacgcgccagcgcgtatgcggcgaccgccgaacgcgcactagacggcctgcccgaaaccgaagcagtggccgcgttgcgcggcttggcccgctacgctgtccaacga

SEQ ID NO: 33139 - DNA, 1201 bp, Xylella fastidiosa
caacatcagcgcgaagttgccgagcgggcctcactggctaaaacgcagtttttggcgacgttgggtcacgaagtacgcaccccgatgaccggagtgcttgggatgagcgaattgttattggaaacaccgcttgatacgcgccagcatggctatgcgacctcgatccaagcggcaggtaagcacctattgcgtttggtcaatgatgccctggatctggccaaaatcgaggctggaaaactgtcgttggaacggcgtgattttgattttcatgccttgttggaacaggtagtggcaatgatccggccgatggtggagcgtaaaggattgcgttttgtctatcgattggatccagaggtgccccagtatgtccatggggatgctgatcgactacagcaaattttgctcaacctgttgatcaatgccaccaaatttaccgagcacggagaggttgtattacaggtcgcgcctgggcaggaacaagcctgccttggtgtgcgtattgacgtggtcgataccggccctgggttgagtgaagaacaatgccagcgcttattccgtcgttttgagcaagtcaatggtgcatccaccgcagcccgctatggtggcagcggacttggtttggccatttgccgtgagttggctaccgtgatggagggggagatccacgtagatagcgagcttggcaaaggcacctgcttccgtgttctgctgcctcttccatgggtgttggcggtgcaacctgcggttgccgttatggatatggaaccctcaccctgctccaatccgttgcacttgctgctgattgaggacgatccgacagtggcggaggtgattgttgaactgttgcgtgtccgtgggcatcgggtgactcatgctttacatgggttggaggccttggtggaggtgacgctgacacgttttgatgcctgtttatgcgatctagatctccctggattggatggtgccggattgattgtgcaactgcgggcacaggggcagtcctttccaatcgtcgtggtcactgcgcgtactgatgccgatgcccagaggcaggcgttccaggttggctgcgatgcgtttttacgcaaaccggtgaccggtgagatgctggagcaggtgctcacccaggtgctgagtgcgcctcgtcaagaggttgatgtgcatacgccaaaaaaaaggaatggaatgggaaggcctagga

SEQ ID NO: 33140 - DNA, 1059 bp, Xylella fastidiosa
ctcaaaaacgatcgcctactgcgtgccctacgacgcgacaccgtggaccgtaccccaatctggctgatgcgccaggccggacgctatctgccggaataccgtgctgcccggcaacacgccggcagcttcctcaaaatggcaaaaactcctgaactggcctgtgaaatcaccctgcaaccactgcgccgcttcccactagacgcggcgattctgttctccgacatcctcatgatccccgacgcgatgggcctagaactgcacttcattgaaggtgaagggccacgcttgggcaaaccaatccgcgacgccgcagccatcacacaactcgccgtgccggatatggaaaccgaactacgctacgtcatggacgccgtacgactgatccgtaaagaactggacaacagcgtcccgctcattggtttctccggcagcccatggacactggcctgctacatgatcgaaggaggaggcagcaaagaatacgcacacattaaagccatggcattcaacgcaccggacgtactgcatcaactgctaaacaccgtcaccgacgcagtgatcagctacttggcggcacagcgcgccgctggcgcacaagcactacaggtcttcgatacctggggaggcatcctgtcgcccacgatgtaccgaacattctcactgccctacttaacgcggattgcacgcgaactagaacgcggcaccggtaccgaacatacccccctggtgttgttcggcaaaggcaatggaccttacatcgcagaactcgccatgagcggtaccgaagccgttggcgtggactggaccatcgaattagaagacgccgcacgccgcagcaacggccaagtggcattacaaggcaacctcgacccagccacactgtacggaaccccaaacaacatcgcacgtgaagtacaacgcaccctggacagctacgcagccggtaacggtggctcacgcgagggacatgtcttcaaccttggccacggcatgacccctggcatggaccctgatcacgtcagcgcgcttgtcgaagccgtgcagcgcttaagccgtcgc

SEQ ID NO: 33141 - DNA, 1362 bp, Xylella fastidiosa
agaattgaacacgacagtatgggtgatctacgggtgccgatcgatgcgttgtggggtgcgcagacgcaacgtgctatcgagaactttccgatttccgggcggtcaatgcctcagggatttatccacgcattggggtttatcaaggcggctgcggcgaaggttaacgctgagctggggttgttaccaaagtcaatggccaaggagattgaggccgctgcattggatgttgctgcgggccgttatgatgcggaatttccagtcgatatttaccagactggctcaggaacctcgtcgaatatgaacgctaatgaggtgattgcgacgctggccatgcgtgccaccaaggggcctatccaccccaacgaccatgtcaaccttggccaaagttctaatgatgtggttccaacagcgattcggatttccgcaacgttggcggttcagggacggttattaccggcgctcaagcatttacgcaaaatgattaacaagcgtgcccgtggtttgggcagtgtggtgaagaccggccgtacccacctgatggatgcgatgccgctgacgttcgctcaagaattcggtgcctggtcggcacaaattgtctctgcagaggcgcgcttgaatgacaccctgaaacggttgcatcggctgccattgggagggacagcaattggtaccggcatcaatacggatccacatttcggccgcaatgcggtgaaggtactgtcagcattgacagggattcactttgagagtgcgaacaataagttcgagggattggcagcgcaagatgatttggttgagttatccggccagttcaatgcgttagcagtggcgttgatgaagattgctaatgatctacgctggatgaacgctggaccgcttgctggcttgggagagattgagttgcccgcgttgcagccgggaagttcgatcatgccaggtaaggtaaacccggtgattccggaagcagtggtgatggtcgccttgcaagtgattggccatcacactgcagtgaccgtggctgggcagagtggcaattttcagttgaatgtgacgttaccgctgattgcttacaacctattggagtctgcgacgttgcttggaaatgtggtgatgctgttggctgataaagtcatcgttggtctgaaggtgcgccaggatcgagtgcaggaggtactggagcggaatccgattttggtgacagcgttgaatccgatcattggctatgagaaagctgcggtgattgctaagcgtgcttataaggagcaccggccagtgcttgaggtggcttgcgaggagagcgacctaaatcctgcggagttggcgcgcttactggatccgactgcgttgactgagggtgggatt

SEQ ID NO: 33142 - DNA, 2188 bp, Xylella fastidiosa
gtgaacgtctctcatgtgcttgatcacttaaatcagaaccagcgcgaggccgttgctgcagctcccggccactacctgatcctcgccggtgccggatcaggaaaaacccgcgttctcactcatcgcatcgtttggctcaacgaggtaaatggggtacccacccacagcatgatggccgtcaccttcacgaacaaggccgccggcgaaatacaacaacggattgatctacaactgcgccacggcaaacgcggcatgtggatcgggaccttccatagcctggcgcatcgcttactgcgcctgcattggaacgacgcaacattacccgaaaacttccaggtcatagacagcgacgatcaattgcgcctcgtcaaacgagtgatccagtccttgggattgaatgacaccctcttccctcccaaacaggcgatgtggtggattaatacacagaaagatgaaggacgccgcccagagcacatccaacccgagtcacacgacgactggatcgagacgcaacgccgcatctataccgagtatcaggagcgctgcaaccgcgctggtttggtcgatttttcggaactgctgctgcgggcacatgaactactacgcgatacacctgcactactgacacactaccgttcgcgcttccgtgagattctgatcgacgaattccaagataccaacgccatccagtacgcgtttgtgcgtgtccttgccaatgacactggccacatcttcgccgtcggcgatgacgatcaagccatctacggctggcgtggtgccaaagttgagcatgtacaacacttcctgaaagattttccaaacgtgcagaccatccgcttggagcaaaattaccgctccagcgccaatatccttgacgctgccaacgcaatcattgcccataacccagaccgaattggcaaacgcctctggactgaatccggtgttggtgaatccatcgacctatacgccgcctacaacgagattgatgaagcccgctacatcgtcgaacgcgcccgccagtgggtacgcgacggcggcagctacggcgagatcgcagtgctttaccgtagtaacgcacagtcccgcgcgtttgaagaagtgctgcaatccgaacatatcccctaccgtgtttacggcggcatgcgcttcttcgagcgtgccgaaatcaaggatgccctagcctatctgcgcctgcttgccaatcgtagcgatgatgctgcgttcgaacgcgttgtaaatacccccgtacgcggcatcggtgagcgcaccttagatgaagtaagacacctagcacgtacccaagggcttagcactatgggatgcggcaatggcatgtacccaatcaaccacgctgaccgcgcgcgcgcgtaacgccttggcgagtttcctcaatttactgcaacaacttgcggtggaaaccaaccagatgggtttagccgaacgaattgaccatatgctgcagcgttcggagttacgccagcactggaagaaagaagcgcgtggttctctggatgccgaatcacgtcaagaaaacttagacgaacttgtttccgtcgcttcacgctttgtccttccgcaaaacgacgaagacacacccatcatgaccgaattagacgcgttcctatcctacgcgtgcctggaaagtggtgatggtcaagtccaagccggggaagaaggcgtacaactgatgaccctacactcagccaaaggcttggaatttcccctagtcttcttggtgggcttggaaaatggattattccccagcgcgcgttccctggatgaacacgaccgactagaggaagaacgccgcttagcgtatgtcggcatcacccgcgcccgtcacaaactcatcctcagctatgcccaagcacggcgtatccacggtaaagataactacaacgtcccctcacgctttttacgcgagatcccgcagaatctattgcatgaagtacgccccaccatccaggtctcacaccagaccccattaggagcagtgcaacgtccagcccatgatgaacgcgacgcagcacctatcaagctcggcgtgaacgtcatgcaccctacatttgggtgcggcgtggttgtcgactacgaaggcagcggcgcgcacacccgcgtacaaatcaaattcgatgacgccggtacaaaatggttggtcatggcatacgccaaactcagcgtggtatag

SEQ ID NO: 33143 - DNA, 1332 bp, Xylella fastidiosa
atgttagacaaagtcgttattgccaaccgtggtgagatcgcgttgcgtattcttcgcgcctgccacacgttgggtatccgcacggttgcggtgcactctaccgttgatcgtaatctgaagcatgtcgcgatggctgatgagtcggtgtgcattggcccggcaccctctgcggagagttatctcaatatcccggcgctgattgccgccgctgaggtcacggatgctcaggccatccaccctggctatggttttttgtcggaaaacgctagttttgctgaacgtgtggaacagtctggtttcattttcattgggccacgggcagagacgattcgtttaatgggcgacaaggtgcaggctatccatgcgatgaaagcggctggtgtgccgtgtgtccctggttcggatggtccattgggtgatgacattgtcgctaacgtcaaaattgcacgtgagatcggttatccggtgatcattaaggctgctggcggcggtggtggacgtgggatgcgtgtggtacataccgaggttggtttaaaggcggctattgaaactacgcagtgtgaagctaaagccgcttttggcaatggccaggtgtatatggaaaagtttctggagaatccgcgtcacgtggagattcaggtgctcgccgatggtcaggggaacgcgatccatttgggggagcgggattgttcgatgcaacgccgccatcagaaggtggtggaggaagcccccgcacccggtatcactgaggcgctgcgcaatgaaatcggtcaagtgtgtgtagatgcctgtattcgtatcggttaccgcggtgctgggacgtttgaatttctgttcgagaatggtcgtttttacttcatcgagatgaatacgcgcatccaggtagagcatccagtgacggagcgtatcactggtattgacttggtatgcgagcagttgcgtattgccgctggtcagccattgagtatcaagcagagcgatgtggtgttgcgtggccatgcgatcgaatgccgtatcaatgctgaggatgcggagacgttcttgcccaatccgggtttgattactgcgttccatccaccaggtggtccgggtgtgcgtatggatacgcatatctacagtggttacaaggtgccgccgaactatgattcgatgatcggcaagctcatcgtgcatggtccggaccgtgagacggcgattgcgcgtatgcatttggcgctgagcgaaatggtcgtggatgggatcaagaccaatatcccattgcagcagcgcattatgtgcgataagggtttccagtccggtggacagaacatccattatttggagaagtgtttg

SEQ ID NO: 33144 - DNA, 432 bp, Xylella fastidiosa
atggctcatttgctgctgttacatggccctaatttgaatttgcttggtacccgtgaacctgagatctacggccgtatcacgttgccgcagattgatgcggccttagccgaacgcgctgcggctgctggtcacggactgagtagtttgcaatcgaatgccgagcatgtgttgattgaacgtattcatgccacgcgggaggatggcactgcgtttatcttgataaatcctggggcgtttacccatacctcagtggcattgcgtgatgcgctgcttgcagtagcgctcccgttcgtcgaaattcacctttctaacccgcatacacgtgagccgttccgccatcacagctatctggctgacaaagccttgggcgtggtgtgtggttttggggtggacagttaccgtattgctttggagggagtgattgccagactc

SEQ ID NO: 33145 - DNA, 1185 bp, Xylella fastidiosa
ttatttacagatgtggaattggttccgggtgatcccattctgagcctcaacgatgcttataacgccgatacgcgtaccaacaaggtcaatttgggtattggtatttattgtgacgagagcggttgtatcccgctgttgcgggctgtccagcaggttgaagagcaacttgcgaagcatccgaaaccacgcggttatctgccgattgatggtttgccagcctatatcaaagccacacaacaattgttgtttggagttgactccctcttgttgacggctggccgtgtggcgacttcacagactgttggaggttctggtgcattgcgggtggctgctgaggtactgaagcaggtgctaccgcatgccactgtggccattagccgtccaagctgggagaaccaccgtgctttgttcaccgctgctggcttcaagattgaggactatacctatttcgatacgctcggccacgcggtggactttactggaatggtggcggacttggcgaagctgcaaccaaagaccgtggtattacttcatggttgctgtcataacccaacgggtgccgatctcagcagggatcagtggaagcagcttgttgccttgttccaggaacgtcaattgctgccctgtattgatctggcttaccaaggattcaatcagggcattgatgcggatgcttatgccatacgtttgcttgccgaagaaggtattagtaactatgtagttgccaactcgtactccaaatcgttctcgttgtatggcgagcgtgttggggggctgtcgatcgttgcttccaatactgagcaagcccaagcaatccagtcacaagtaaagcgtatcatccgtacgatttattccagtccgccggcacacggtgcctacttggtcgcgggtgtgctgaacagtcatgaattgcgcacgctgtgggagcaggagttaactcagatgcgtgaacgtatccacgggttgcgtgcgggtttggttgctcgattgaaggcactgggtgcgccggagtttgatttcatacaacgtcaagcaggcatgttttcgtattcggggttgagcaagatccaggtggatcgtttgcgcgacgagttcgggatttatgcggtcagtagtggacgtatctgtgtggctgcgttgagtcagcacaaattggaatacgtggcccaggctgtggtgaaggtg

SEQ ID NO: 33146 - DNA, 2349 bp, Xylella fastidiosa
atgactcagtcctctcaaaaagcccttgatctgcaggtattgccgctgcgtgacgtggttgtattcccgtacatggtaattccattgttcgtaggtcgtgaaaagtcaatgcgggcgcttgaaaaggcaatggacgctgataagcgcatcttgttggttgcacaaaaaacggctgacattgacgatcctagtgcggttgatttgcataccatcggtacttatgctcaggtgttgcagttgttaaagcttcctgacggcacgattaaggtgttggtcgaaggcctaacccgtgtgagtgtggatcaagtagtcgagcatgatggtgcgttacgaggttgtggtatcgaaattgcctcgactcaggagcgcgaagaacgtgaaattgaggcaattgttcgatctctgttgtcgctcttcgagcagtacgttaagaccaatcgcaagctccctccagaattgttacaaactttgaatggtattgatgatccaggtcgtttagccgataccattgctgcgcacctgagtgtgcgtttggcgtataagcagcgtctgttggaaactatcgaaattggtgaccgacttgaaatactcattggactagtcgatggtgaaatcgacgttcagcagatggaaaagcgtatccgtggtcgagttaagtcgcagatggagaagagtcagcgtgagtactatctcaatgagcaaatgaaggcgatccagaaggagttgggtgacttcgacgatcttccgagtgagttggaggagttggctcgtaaaattgccgaaatcgggatgccaaaatcagtccagagtaaggctaagagcgaactcaacaagcttaaacagatgtctccaatgtcagctgaggcagcagtagtgcgtaattaccttgactggttgttgggggtcccttggaggaagtgcactaaggtacgaaaggacttgaaagtcgctcaatctacactggatgatgaccactatggtcttgataaggtgaaagaacgcatccttgagtatcttgcggtccagtcacgagtcaaacagatgcgaggtccgattttgtgtttagttggccctcctggtgtaggtaaaacttccctcggtcagtctattgctaaggcgaccaatcgtaagttcgtacggatgtctttggggggggtgcgtgacgaagctgaggttcgggggcatcgacgtacttatgttggctcaatgccgggccgggtcgtacagaatctcaacaaggttggcagtaaaaaccctctgtttgtgcttgatgagatcgataagatggctatggacttccgaggtgatccttctgcagcgctcttggaggtgctcgatcctgagcagaataatgcgttcaatgatcattaccttgatgttgacctggatttgtccgaggttatgttcgtggcaacctctaattcgctgaacattcctggtccgttgcttgatcgcatggaagtgattcgtataccaggctatactgaggacgaaaaactcaatattgctacccgttacttggtacctaaacagattagagccaatggtttgggtgttgaggaattggcgattggagaggacgcgattcgcgacattgtgcgctactacacacgtgagtctggagtgcgtaaccttgagcgcgagatctctaaaatttgccgtaaaattgtcaaggagattgccttagttggtgtgaagccttttgctaagaagtcaaccaagtctaaggtattgttcgcggtgacttcgaaaaatcttgaaaagtatcttggggtgcgccgctttgattttggccgtgctgaggaagctaacgagattggcctagtcactggtttggcttggacagaagtcggtggggatttgttgcaaatcgaatctactcttgtcccgggtaagggtaacctgattttgactggtcagcttggtaacgtgatgaaggagtcggcgtcggcggcgttgacggtggtccgttcgcgtgctgatcgcttctgtattgacgtggactttttgcataatcaagatgttcaccttcatgtgcctgacggtgccacgccgaaggatggtccaagtgccggtattgccatggtcacatccttggtgtcaatgcttaccaaggtgccagtgcgtgctgatgtagcgatgactggtgagattactttgcgtggccgagtttctgtgattggtggtttgaaggagaaattgttggctgcattacgtggtggtatccgaacagtattgatccctgaaggaaatcgtagagatttggctgatatcccggctaatgtgacacgtgctttgacgattgttccagtaaagtggattgatgaagtgttggatttagctcttgaa

SEQ ID NO: 33147 - DNA, 2229 bp, Xylella fastidiosa
attcaccaagaattcccacaattggacgtggctgaatataagcgcgcggtgttcgggttcgtcgaacgtaaggatagcgttaatgctgatgacttggttgatctgttgatccgtgaggctgaggcacgtgttgacctgactgcgccggagtgggagtacttcgctgcacgtttgtatctgcgtcgcttatacaagcgtgccagccgcaatcgcttctacgatgccagccagaaatacggctcgtttgtcggtttacaggagagtttggctgaccgcaatatctattccaacgatattttgcgcagctactccaaggaggagttgatcgaggctggtcagatgatcgatcctgagcgcgataagctgtttacttataacggcttgtacttattggccacacgttacttggcgaccgatgcttctcgcggcgtgtttgaattgccacaagaacgttggcttaccatcgccttgtatttgatgcaagacgagtatggcccaggtaaaggtggacgtgagcgccgcatgcaactagttggcgaagcgtactgggcactgtctaacttgtacatgacggtggcgactcccaccctgggcaatgccggaaaaatcaatggccagttgtcttcgtgcttcatcgataccgttgacgacagtttgcagggtatttacgactccaacaccgatattgcgcgtgtgtccaagcatggcggaggcgttggtgcttatttgggttacgtacgctcctctgggtcaatgattcgtggtgtagctaactcttctggtggtgttgtgccgtggatcaaacagctcaacaacaccgctgtctctgtggatcagcttggtcagcgcaagggtgcgattgcggtttatttggatatttggcaccgcgatattgaagcgttcttggatttgcgtctgaataacggcgatcagcgtttacgtgcccatgatgtgtttacctcggtctgcattcccgatttgtttatggaagcggtcgaacgtcgcggcgattggtatttgttcgacccatacgaggtgaagcgcgttaaaggttggtacctgcaggatttctatgacgagaagaggggtgaccccaacggcagcttccgccgtaagtacgaggacgttgttgctgacgagcgtatcagccgtaagacggtcaaggccattgacatctttaaacgcatcatggtcagccaattagagacgggcaatccattcatgttctaccgggatgaagtgaaccggaagaatcccaacaagcatgttggcatggtgtattcgtctaatctctgtactgagatcctgcagaacatgacgccaacccggctcatacaggagatgatcagtggcaatcagatcgttacgaccaagcatgctggtgatttcgtcgtgtgcaatctgtcttcgatcaatcttggtcgtgcaatcacggtacaggctgatttgcttggcgccgatgtattggagcgtctgatcccgattcaggtgcgtatgctcgataatgtcattgatctgaatctgttgcccgtcccacaagccacgattaccaatcagaaataccgtgcgattggtttaggtactttcggttggcatcacttgctggcgcagaaggcgattcactggaattcgcaggaagctgagcaatacagcgacgtgttgtatgaacgcattaattacctgacgattcgagcaagcatggagttggctaaagagaagggcacctatgcagtgtttcccggcagtgactggcagaccggcgagtatttccgcgcgcgtgactacaacagcccacaatggcttgaattagctgcccaggttgctgtcaatggcgtgcgtaatgcctatatggtggcggtagcgccgaacatgagtactgcgcagattgctggttccactgcgtcaatcgaccccgtctatagcgcgttttactacgaagagaaaaaggattaccgccgcccggttgcagcacccggattgtcgctggatacgtggccgtattatgagaagggggcttataagctcgaccagtttgcgagcatacgccagaatgcccgccgccagcgtcacgttgatcaatcgctcagtttcaatttctatgtgccaagtaccatccgtgccagcacgttgttggatctgcacatgaccgcttggcgtgagggcttgaagacgacttactacgtgcgctctaacgacattgacatcagcgaatgcgagtggtgttcaagc

SEQ ID NO: 33148 - DNA, 975 bp, Xylella fastidiosa
attattaacgggaaaaccagcggcatcctgaattggaacgacatcccgtacccatccttctaccgggcgtacaaagagttgtcgaccaacttttggatcccggacgaggttgatatgaagatcgacaagcgccaatacggtgaactgtcggcacgcgagaaaaacgcttatgacgccatcatcggtttgctagctacattggattcaccgcagacacgtttcatctacaacgttgctgagtacatcactgatccggcggcacatgccaatgctgcgattattgggcagcaagaagtcattcacaacgagagctacagctatgtgttggcctctatcactgacttggccaaccagaaccgtgtgtttgagatcgcccggacccatccgaccattctcaagcgcaacgccccaatcatgcaggcctatgacgacttcatgcgtgagaaaactgctgagaccttgctgtattcgctgattcaatcctcgattcttgagggcattaatttttattctggctttgcctatttctacaacttggtgcggcagaaccgcatgactggcactggcaagatcatcagctttatcaaccgcgatgaattggcccacaccaaattcatcagcgaagtgattcgtgccattgttggtgagaatccggaattgcaaaccgatgcattgaccgattacgtgcatcaagcatttgcgcatgcgattgagctggaaacacagtggactggtgaggtacttaatggcattgacggtattgacgtagaggagatgatccgctacgtgaagtaccgggctaataaaatggctggcatgcttggtatcgagacgctgtacaccgagactactgataacgtcatgccctggatcagggcttatgcagacaattttaccgagacaaaaacggatttctttgagatgcgtaatgccagctataagaagaccaatgtagacaactgctttgacgactta

SEQ ID NO: 33149 - DNA, 537 bp, Xylella fastidiosa
atgcccgaggcggtgatcttcgacatggatggtctgatgcttgatagcgagcgcgtgagcatcgaatgtcggtgtcgcgctgcgtttgatcttgagcagcaaattgagccggattactggttacagatggtcggggtgagcgatatcgcttgtcacgcgcagctgagcgcacgcattggtgctgtatcagcgacagcgttgttggcccgcagcgatgcgttatatgaggcggtggttatgaagggggtgccgcatcggccaggaatcgttacgttactggagtggctgttcgcgcgtggtattccgtgtgcggttggtacgtctacgcggcgtccgttggcgctgcgtaaattgaatacggcaggcttgttgtcgcgtttcgatgtggtgtgtactgcgagtgaagttgcgcaagctaagccagcgccagatatttatttattggctgcgcacacgcttggtatcgttccggggcgctgcttggtggtggaggattcaccgattggggtacgtgccgcattggctgcaggtatgaca

SEQ ID NO: 33150 - DNA, 978 bp, Xylella fastidiosa
aaagcacttgttcgtgttgctgtgaccggcgctgcaggccaaatcggctactcattgctatttcgcatcgctgccggagaaatgtttggcaaagacaggtcagtgatactccagatgctggaactccccgacgagaaagcacaggctgcccttaagggcgtgatgatggagcttgaagactgcgcgttcccactactggctggcatggtcgttaccgataatccagacatagcattcaaggatgccgacgccgcattgctggtaggctcccgcccccgtggccctggcatggaacgcaaagatctgctaatggaaaacgctaaaatttttaccgcccaaggtgcggccttaaacaaagtggctcggcgcgatgtcaaagtgctggtcgttggtaatccagcaaacaccaacgcctacatcgcaatgaaatcggctccagatctaaacccgaaacactttactgcgatgctgcgcctcgaccacaatcgcgcattgagccagttatcgaccaagctaagtaagcctgtcgccaacattgaaaaactcattgtatggggcaatcacagtccaaccatgtatcctgattaccgtttcgccaccgccgatggcactccaatcattgaggcgattaacgaccaagcatggaacgctaacagcttcattcccaccgtcagcaagcgtggtgccgcaatcatcgaagcacgtggcttgtcttcagcagcttctgcagccaacgcagccattgaccacatgcgtgattggctgcttggcagcaacggcaagtggatcacaatgggagtgccatcggacggttcctacggcattccggagggaatgatatttggtttcccagtcacgaccaccaatggcgaatacagcatcgtcaaagatctgcccattgacaccttcagcaaaacatacattgacaaaacgctggccgaactggaagaagagcgtgccagtatcgcgcatctgtta

SEQ ID NO: 33151 - DNA, 810 bp, Xylella fastidiosa
gtgatgaagctttgtggttttgaagtcggtcttaaccagccacttttcctgattgccggtccttgtgtgattgagtcgctacagttgcagttggatactgccggtgtactgaaggagatcacttctaagcttggtttgaactttatctttaagtccagttttgataaggcgaaccgaacttcagggagtagttttcgtggccctggcttggaagaggggttgaaggtactggaggcggtgaagacgcagattggggtgccagtactgacggatgtgcacgagtacacgccaatagatgaggtagccactgttgttgatgtgctgcaaacgccagcgtttttggtacgtcagactgatttcatacggaatgtctgtgcggttggtaaaccggtcaacatcaagaagggacagtttttgtcgccatgggatatgaaacctgtggttgagaaagcaaagtcgacgggtaattcgcagattcttgtatgtgaacgcggcgcttcgttcggttacaacaacttggttagcgatatgcgttcactggcggtgatgcgtgagaccggctgtccggtggtattcgacgcgactcattctgtgcaacttccgggtgctcagggtggtcgttccggtgggcaacgcgagttcgtaccggtgttggcgagggcagctgtggcggtgggtatttccggattgttcgctgagactcacccagacccacccaatgcattgtctgatggccccaatgcttggccgttgcgcacaatggcgatgttgctggaaaccttggtggagttggatgcggtcaccaaaaaa

SEQ ID NO: 33152 - DNA, 1284 bp, Xylella fastidiosa
atgaccgctattgtcaaaatttatgctcgtgagattcttgattcccgtggcaaccctactcttgaagcggaggtcactctggagaatgctgtctgtggccgtgccgcagtcccttcaggtgcttcgactggtaccaaggaagcggtggaattacgtgatggtgacaagacacgttacttaggcaagggggtgcgtgcagcggtggataacgtcaatggtgttattgctgcggcgttggtgggtttcgatggagctgaccaaacaggcttggaccatcgtttaatcaatctggacggcaccgagaataaggggcgtttgggggctaacgcgctgctcggtgtttcgttagcaaccgcacatgcggttgccgccgcgcgtaaacagccgctatggatgtatttgtccacccttggtgaatccaagttatcgttgccggtgccaatgatgaacatcatcaatggtggtgcgcatgcggataacaacgttgatttccaggagtttatggtgttgccggttggttttgcttcgttttccgaagcactgcgtgccggtgccgagatctttcatgcgctaaagtcagtgctgaagggacggggtttaagtactgcggtgggtgatgaagggggctttgctccggacttccgcagtaatgttgaggcactggatgccattcttgaggcaatcggtagggctggttatatcgctggagaggatgtgttgttaggtttggatgttgcttcttccgagtttcgcgacaacggtaagtacaacttggttggtgagaacaagcgtctgaccagtgagcagtttgttgatttcttggatgatttggttgcgcagtacccaatcatcagtattgaggatggtttagccgaggatgattgggtgggttggaagcaattgactgaacgtatcggccataaagtacagttggtgggcgatgatctgtttgtgactaatcctaaggttttccaggaaggcatcacttctggcatcgcgaatgcgatccttataaaacttaaccaaatcggtacgttgacggagactctggaatcaattgcgatggctcaccgtgctcagtacgctgctatcgtctcgcatcgatcaggcgagactgaggatacatcgattgcggacattgcggtggcgaccacggcaacccaaatcaagactggctcgttatgccgttctgatcgtgtcgccaagtacaaccagttgttacgcattgagcaggcgcttggtgttggtgtgcgttatgctggtcgtgatgcgttcgtttccctg

SEQ ID NO: 33153 - DNA, 756 bp, Xylella fastidiosa
atgcgactgactccactccccgcattcgacaacaattacatctggacattgattgcccctgacggccgagcaatcatcgtcgatcccggacaagccttgccaatattagaagctcattccaaaggactcatccccactgcaatcctattgacacaccaccacgccgatcacatcggcggagtgccagaactgctagaacgctggccaacacttcccgtctatgccccacacgacacacgcatcgcactgaattaccaccgcattggcgagggagattcattgaacatccttggtctgcgattccaaattatccacaccccaggccatactcacagccacttaaccttcataggtaacgatctactgttctgtggtgatacactattcagcctaggttgtgggcagatctttgaaggaacccccacacagatgctcgcatcattgcaacgattggctgcactgcccatacagacccgcgtatgctgcggtcacgaatacacattgtccaacgctgcattcgcactgcacgtcgaccccaccaacaccgccttacaaaaacgtcgacaacaagcaaacgccatgcgtctcgcaggcctccccacattgcctatttcactcgaaagcgaactaaacaccaacccattcctgcgtacggctgcacctaccatccatgcagcaacagctactcacctgcaacgaacaccaatagatgaagtagaagtattcgctacgctacgccactggaaaaacaacttc

SEQ ID NO: 33154 - DNA, 1887 bp, Xylella fastidiosa
ctcgaagcagacaaacagacccacggcttccaaacggaagtcaaacagttactgcaactgatgatccactccctgtactcaaacaaggagattttcctacgcgaattaatctccaatgctgccgatgctgcggacaaactgcgctttgaggcattgagcgccccctcattactggaagaagatcccaacctgcgcatccgcgttgagtttgataaacaagcacacaccatcaccattgatgacaacggcattggtatgagtcgttatgaggccattgcacacctgggcacgattgccaagtcaggcaccgcggatttcctcaaaacactgtctggagatcaacgcaaagacgccaatctcattggccaattcggtgtcggcttctacagtgcctttattgtcgccgaccacgtcgacgtctacagccgccgcgccggactgacagcagccgagggcgtacactggtcgagcaaaggtgaaggcaactttgaagtggccaccattgataaaccgcaacgcggtacccgcgtcgtgctccacctgaaagaaaatgaacaacactttgcagaaggatggaccctgcgcagcaccctgaaaaaatattccgaccacatcggcctccccattgaaatgctcaaggaacaccacggcaaggaggaagaaaaagacacccccaaagaagccgagtgggaagccgtcaacaaagccagcgccctatggacacgccccaaaaacgacattaaggatgaggaataccaggaattctacaaacacatctcacacgatatgaccaacccgctcgcctggagccataacaaggtcgaaggcaagctggaatacacctccttactctatgtcccaacacgcgcaccatttgacctgtaccaccgcaatgctgccaagggactgaaactgtatgtacaacgtgttttcatcatggatcaagcggaacagttcctgccgctctacctgcgtttcatcaagggcgttgttgactctgccgacctctcgctgaacgtctcccgcgagatcctccaatctggcccagtcgtggactccatgaaagccgcactgagcaaacgcgccctggacatgcttgaaaaactcgccaaagacgccccagaagattacaaaaccttctggaaaaactttggccaggtactgaaagaaggacccgccgaggattacagcaaccgcgagaaagtcgccagcctgctgcgctttgcctcaacctacgacacctccggtgatccctccgtcgcactcaccgattacatcgcacgcatgaaagaaggtcaggacaagctctactacctgaccggagaatcctacgcacaaatcaaggacagcccatacctggaagtattccgtaaaaaaggcattgaagtactgctactggtagaccgcattgacgagtggttgatgaactacttacatgaattcgacggcaaatcctttgtcgacattgcacgcggcgatctggacctcggaaacctcgacagcgaagcagacaaaaaagcacaagaggaaatcgcaaaaaccaaagaagcattagccagccggatcaaagccacactgggagaagatgttgccgaagtgcgcgtctcacatcgcctgaccgattcacccgcagtactcgccatcggcgaaggcgatctcggcctgcaaatgcgtcagttactcgaagctagcggccagaaagttccagaaacaaaacccgtcttcgaattcaacccaagccacccactcatcgagaaactggacgccgaacaagacatggaccgttttgcggacttgagccacatcctgttcgatcaagccgcactcgctgccggagacagtttgaaagacccggccaactacgtgcgccgcctcaacaaactccta

SEQ ID NO: 33155 - DNA, 1269 bp, Xylella fastidiosa
cctttttatttacagttgtatttctgggtgatcatcgcgattatcctgggggcgctgttaggccattgttatcctgctgtgggtcagcaactcaagccattgggggatgcctttatcaagctggtgaagatgattatctcgccagtgatttttctgacaatcgtgaccgggatcgctagcgttgcgcatgtggggacggtggctcgcgtatttggtaaggcgatggtgtatttccttttcttttccacgctagcgttgctgctgggtttggtcgttgctcatgtggtgcatccaggtgcgggcatgaacattaatccagtagatctccatcagggggagatcgcaaattatgtggagaaatcacacgatttgacgttggttggctttttgatggacatcatcccgaagacactgttgagtccgtttgttggggacaatattttgcaggtgttgtttgtggcagtgttgttcggtattgcgttggcgcttgctggggaacgtggtaagcctgtgctcaatttactggatgcgttgaccgtaccagtattcaggcttgtccagatgttgatgaaaatggctccgatcggtgcattcggagcgattgcgttcacgattggtaagtatggagttgattcattggtgaatttggggtggttggttggctcgttctatctcacttcgctgttgtttgtgttggtgattttgggtgccgtgagttggttgtgtggtttttcaatattaaaactgattcgctatttaaaagcggagctgttgcttgtgttggggacttcgtcttcggagtcggcgttgccgtcgctaatggaaaagatggtgcaggcggggtgtagaaagtcggtggttggactggttgtgcccactggttactcttttaatctggatggcaccaatatttatatgacgttagcggcgttgtttattgctcaggcaaccaacacggagctgacgccagcgcatcagcttgctttgtttttggtggcgatgttgagttctaaaggggcggccggtgtgtccggtgctggttttattactttggcagcaacgttggcggtggtgccggaagtgccgattgcgggtatggcactaatcctgggtgtagatcgctttatgagtgagtgccgttcactgaccaattttattggcaatgcagtggctacgctggtagtttcgcgttgggagaatgcgttgaaccatgagcagctcaaaattgcactggatggcaatgaagctgcataccagtcactacatgcc

SEQ ID NO: 33156 - DNA, 739 bp, Xylella fastidiosa
atgacccttcgcatcgcctacgtcaccagcggcatgggcagtatcggaactgcaatctgccagaagttggcacgcaacggccataccgtggtggctggctgtggccccaactcgcctcgcaaagctaactggctgcgtgagcaacgtgaacttggcttcgacttcatcgcctctgaaggcaatgctgccgattgggattcaacggtatccgcctttgccaaggtaaaagccgaagtcggtgagattgacgttttggtcaataacgccggtaacaaccgcgacatgctgttccggcaaatgggccgtgaagactggaacagtgtcatcagcagcaacctcaattcactgttcaatatcactaaacaagtcattgacgccatgaccgcacgcaattggggacgtatcgtcaacattggttcggtgagcgcgcacaaaggtcaaataggccaagtgaactacgccactgcaaaagccgcaatgcacggcttcacgcgtgcacttgcacaagaagtcgctacccgcaacgtcaccgtaaataccatttccccaggggtatatcgccagcgctgcaatcagcagtttccccccagacgtccttgaccgtctcgccaactcagtaccaatgcggcgcctgggcaaagccgaagaagtcgctgggctatgcgcttggctggtttcagatgaagctgcctacgtcacaggtgccgactacgcagttaacggtggcttacgcatggag

SEQ ID NO: 33157 - DNA, 741 bp, Xylella fastidiosa
gacctgtgcggtccctgcgttaccgtagcgaccgcctgctcctctagcgccaaagtattcgcacaagcagcacgcctaattacctcaggcgtagtgagcgccgccctagttggtggtgtggacaccctatgtggcagtgtgctgtttggcttcaacgcacttcaattagtttcaccagaaccatgccgtccgtttgatgtacatcgggccggtctgtcactcggtgaagcaggaggctttgcactactggaaagactcgatctagcacccgatgcggatctgttgctgtgcggttacggcgaatccagcgatgcccaccatatgtccgcaccacaccctgaaggattaggagcccgcatggccatgcaagaagcactgaccagagccaacgtagatgccagtgaagttggctatctgaatttgcatggcaccgccagtcctgccaacgacagcattgaagccgtggcaatagccgcactgttcccaccgacattgcatgccagttcgaccaaagcctggaccggccacaccctcggcgcttctggcatcgttgaatcgaccattgcactcttggctttgcgaggaaacatcctgcccggcactatgaatagcgaacagcttgacccagtgtgcggaccgcagatccgttgcgaaaacgcacatacaccaatcctgtacgcgatgaataactctttcggtttcggaggtaataattgtgcgttgttattcaaaagagcggac

SEQ ID NO: 33158 - DNA, 900 bp, Xylella fastidiosa
ttacttcgtattgctactcgcaaaagtttacttgctatgcggcaaagcgagtatgtcgctgcgcgtttacgtatgctgtgccctgatttagatgtggtgttggtgccgatgagcactcgtggcgatgagatcctggaccgctccctggctgcaattggtggtaaagggctgtttctcaaggagctggaactggcgatgttacgtggtgatgctgattgcgcggtgcattcgctgaaagatgtgcctatggatttggagcccccatttatgcttgcggctgttttgagtcgtgatgacccggccgatgcgctgatttctaatgtctacctttcgctagagtcactcccaattggggcgcgtgtggcgacttcttcgctgcgccgacaagcccagttacgcttttatcggcctgacctgcggttgtttgacttgcggggtaacgttaacacgcgcttggcgaagcttgataacggagattacgatgcgattgtgctggcttgtgcggggttacgtcggctgggattggagcaacgcatgacggctcggctagcaccgccagaatggttacctgcgccaggtcagggggcgattgcggtggagtcactgaccgaggatgctcggatcggtacgttgttggctggtcttgacgatctgccaacgcgccaatgcgtggtggctgagcgtacgatgaatcgtgctcttcatggtagctgccatgtgccagtgggggcttatgcatcctacggagttggtggtatgcgattacagggcttggtgggttgtgttgccgatggtcgtctcgtgcgtgcggagctgtgttcggcaaaggatgagggcgatatgctcggcagggcagtcgcacagtgcttgttggatgctggtgcggctgagttgctagcc

SEQ ID NO: 33159 - DNA, 660 bp, Xylella fastidiosa
atgctggaaacgatagagcacgagactgcccctatgccgcagtggagtgtgttgtggttacatggtttgggggcggatggtcatgatttcatgcccatcattccagagttggtgcgtccacactggccagctttgcgttttgtgtttccgcatgctccggtgaggccgatcacgattaataacggtgtaccgatgcgtgcttggtacgatcttgtcagttttgatttcaatcaacgtgccgaccaggctgggattgaagctgcagttgcgcaggtccaggcactgatgatgcgcgagcagcagcgtggcattgcgtctgaacgcttgtttcttgccggattttcgcagggaggagcggtggtgctcagtatcggtttgcgttgtaaggcctccttagcaggcttgattgcattgtctacgtatctaccggatcctaacgttgtcactaccactacaaggttgcttccaggcagcaatgcgcaacagttttttattgcccacggacattccgatccagtggtgccactggtacatggtcagtgtgctgctgaggtgttgcgtaagctaggtttcgctgtggactggtatacctacccgatggcgcatcaggtttgccaagaggagatccaggccttgggagactggttagagcgccgtttt

SEQ ID NO: 33160 - DNA, 1107 bp, Xylella fastidiosa
atgtcgttttccaaacacttcggcaaactcatgttagccacgtgcctatccttatctacggcgccagcattcagttacagcatcagccatgggaaggtcgtcgatgacaaaggcaaccaaatccaattaaggggcgtcaactggtttggttttgaaaccggagatcatgtggtaaatggactgtgggcacgtaattggaaagaattcatcacacagctacagggcatgggattcaacgcgatacgtttaccgttctgcccagccaatctaaatagcaacacatcaccaagcagcattgattacagccgcaatccggacttgcaaggcttgagttcgctgcaaatcctggacaaggtcgtcaaagaattgagcgaccgcagaatgtatgtgctgctagatcaccatcggtcggactgctcagcaatctctgagttgtggtacacggattcatacggcgaaaaacagtggattgatgatctacgtttcgtcgcacaccgttacaccaacgtacccggcgtcatcggcttggacgtaaagaatgaaccacatggcagagccacttggggcaccggagatccaaaaactgattggaacaccgcagtcgagcatgcggcagcagcgatcttggaggccgcaccaaaatggctgatcggagtcgaggggattggagaaaatcccatctgctccagcaccattgggcatttctggggcgagaacctggaaccgatggactgtacgccactgaaagtccctgccaaccatttgctattgatgccacacgtctacgggccagatgtctacgtacagccgtacttcaatagccctgatttcccaaacaacatggcagcgatctgggatcaacacttcggacgttttgcgaaagccggctatgcgatggcgattggtgagttcggtggtaagtacggtgaaggtgatccacgcgatatcgcttggcaaaacgcttttgtggattacctcatcagtatcggcgtgacggatgccttctattgggcggcaaaccagaacagcggcgataccggcggcatggttggcaatgactggaccaccccacgcgatgacaaggtgaagctgctgaagaagctgtgg

SEQ ID NO: 33161 - DNA, 1404 bp, Xylella fastidiosa
tccattgagccttccatgacgtgccgcacccgctttgcccccagccccaccggttacctacacattgggggcgcccgcaccgcactgtattgctggctggaagcacggcgccgcaacgggcaattcctactgcgcatcgaagacaccgaccgcgaacgcagcacccaagccgcgattgatgccatcctgcatgcaatggactggctgggactggactacgacgaacccccggtctaccaaacccagcgcatcgaacgctacaaccaggtagctgcgcgtctgcttgccgaaggcaaggcgtactacgcttacgactccaaggacacattgaacgccatgcgtgaagcagctctgcgcactggcgaaaaaccacgctataacggggctgcacgtgaagccaacctgccataccgggatgatcccaaccgggtcatccgcttcaaaaatccgcacaccggcaccgtggcgttcgacgatttgatcaaaggtcgcatccagatcgccaacagcgaactggacgacatggtcatcctgcgtcccgatggctacccaacctacaacttcgccgtggttgtggacgactgggacatgaacatcaccgaggtgatccgcggcgacgaccacatcaacaatacgccacggcaaatcaacctctatcacgccctgggcgcaccactacccacatttgcgcatctaccgatgatcctggacgaacaaggcgccaagttgtccaagcgtaccggcgcggctgatgtgatgcagtacagagattctggttacctgccccatgcactgattaactatctggtacggctgggctggtcacacggcgaccaagagctattcaaccggcaagcgctgatcgacctgttccaaatcaacgatgtcaactccaaagcagcgcgccttgacatggcaaaacttggctgggtgaaccagcactatctgaagaccgatgacccggcgacgcttgccccgccattggtctggcatctggaacaacgcggtattgatgtcagcgccggtcctgctccgacggacgtgatcctggccctacgggaacgcgtccagacactgaaagaaatggccgagaaagcagaaatctggtactgcccattacagcgctatgatgaaatagccgttgccaagcatctcaaaccaggtgccgaaacagccctactgcacgcacgtacgctgttagccgcacttcccgcgtggactgtggacaacgtggataccgccttgcgcacgattgcgacaacactagagatcggcatgggcaaagtggcgcaaccattgcgggtagcgatcaccgggacccaagtcagcccggacattgcctataccgtttacctcactggccgcaacgaagccttgaaacgcattgatgcggcactgataaaa

SEQ ID NO: 33162 - DNA, 1170 bp, Xylella fastidiosa
atgtccatcgtccgcatgactgatctcgctttatccggtaaacgcgtactgattcgtcaggacttgaatgtaccgattgatcaaggtcttattacttccgagcagcgcattattgcttcgcttccgacgatccgtgtagcgctggagcgtggtgcggcggtcatggtgacttcgcatctgggccgtccgaaggagggcgtgtggagtgaggaggattcattggcacccgtggcgaagcgcttgtctcaattgttggggattgaggttccgttgcgtcgcgattgggtggatggcgtgcaggttgcgccagggcagttggtgttattggaaaactgccgaatgaatgtcggcgaagctgagaatgacgaggcgttggcaaggaagtatgcggcgttatgtgatgtgttcgtgatggatgcgtttggcactgcgcaccgtgcccaggcatcaacgcatggggtgatctgttgtgctgcgattgctgccggtggtccgttgttgatggctgagttggatgctttgagccggggattgaagcatccggtgaagccgctgctggcgattgtggggggcagtaaggtatcgacgaaattggagttgctttccaatttggtgaataacgttgagcaattgattacggggggaggcattgccaatacgttccttgccgcagccggttactccatcggtaagtcactgtatgaggcggatttgatcgagactgctcgggagattattactgtggcgaaagcgcgtggcgctgagattccgttacccacggatgtggttgttgccaagcagtttttgcctggagtcacggcaacggtgaagacggtggatgcaatcgttgcggatgatcttattttggacattggtccgcagacggcacggcactatgctgccttgattgaaacggcggctacggtggtctggaatggtccagtgggtgtgtttgagttcgatgccttcagcaaggggaccgaggtgttagcgcgggccgttgctgcctcgtctgcgttttcgattgccggtggcggcgataccttggctgctattgataagtatggtgttgcggaccagatcagttacatctccacaggcggcggtgcttttctggagtttttggaaggtaagacgttgccggcggtggctgcgttgcaggcgcgcagc

SEQ ID NO: 33163 - DNA, 1428 bp, Xylella fastidiosa
atgtctgaacgccagcgccgtaccaggattcttgccactcttgggccagcgacagatccgcccggtgtgcttgatgcgctgtttaaggcgggagttaatgtggtgcggctgaatttcagccatggcgatgtttcggatcaggccaggcgtgctgctgaagtgcgtgcggcggcggcgcatgtgggcgttgagattggcattcttgcggatctacccggtccgaagatccgtattggacgttttatcggggggaaagtgcggcttgtggctggtgcgcgctttgatctgcttgccgatagcaatgcgtcgctgggggatgcgactcaagttggggtcagttatctggggttgccgcaggatgtcgtcgccggagatgtgttgttactggatgatggcctcatgcaattgcaagtggtgcaagtgcagggtgcgcggattgtgacgacggttcttaacgatggtgtgttgtccgaccgtaaggggctgaataagcaaggcggcggtttgtcgctgggtgcgctgacggatcgtgatcgcgaactgattggtatcgttgccaggatggggatcgactttattgcagtttcgttttgtcgtcatgctgaagagatgcatgaggcgcgtcgcattgctcgggagtgcggctgtgatgctgcgttggtgtctaagatcgagcgtgctgaggctatcgtgaatcttgccgagattgttgcggcttcggatgtggtgatggttgcgcgtggtgatttaggtgtggagattggtgacgctcaattgccgggcttgcaaaaaaagatcatcaaggaagcgttgttacagaacaaggtggtgattactgccacgcagatgctgcaatcaatggttgaaagtccgatgccgacccgtgctgaggtgctggatgtggctaatgcggtgattgatgggaccgatgcggtgatgctgtcggctgaaacggcgacaggtgattatccagtcaaggcagtagaggcgatggcgcgtatctgtctgggagcggaacaccagtttgagtttgatactgattatgagatggcgcagcgtaatttgcagcgtgcagatcatgcgattgcaatggcaacgatgttcttatctgagcacatttgccttggtggtgtggttgcgttgacggagtccggtacgacgccacggtttctctcgcggttccggtcgcacgtcccgatctatgcgtttacgcgtcacgaggatgtgcggcggcgcatggtgctgatgcgtggtgtatttccgatgcgttttgacagccgtggtttgacgccgcgtgaggcagctagggcgacaatccgtcttttggtggaatgtggttgtatgagtccgggtgatcgtgtggtgttcacgagcggcgagcatatggaaacgcttggcgcaaccaatacactgcgtttacttgaagta

SEQ ID NO: 33164 - DNA, 1032 bp, Xylella fastidiosa
gaacagcttgcagaaaccgctcaagcaatggtcgcctcgggtaaggggatcattgcgattgatgagtccgccggcaccattgccaagcgtttttccagtgtcggtatcgaaaatattgaagagaatcgccgtgcttaccgtgagttgctgctgacgacccctaaattgagtgattacatttctggggcgattctattcgacgagaccattcgtcaatccacgaaggcaggtgtcccgtttccgaagtacatggccgagcatggcatcatcccagggattaaagtggataagggcgcatatccgttagcagggtgtcctggtgagttggtcacggaggggttggatgggttgcgtgcacgactggaggagtattacaagcttggcgcacgctttgccaagtggcgtgctgttatcaacattggtgatgatattccgtcagggatgtgcatcgatgccaatgtacacgcgctagcgcgttatgcggcgttgtgtcaggagcagggcttggtgccgatggtggagccggaggtcattatggatggtaaccatgacatctcggctgcttatgaagtgaccgaggcgacgttgcgttccctgttcaatgcgctgtatgagcagaatgtggtgcttgaaggaaccattctgaaggcgtctatggtgatccctggtaccgactgtgaggagcaggccagtattgatgaagtggctgaatccacggtgatgtgtttgaaatcgacagtgcctgcgatcctgccgggtattgtgttcttatctggtggacagacggatgcgcagtccacggcgcatttgaatgcgatgaatcaatttgatcccttgccgtggccgttgagcttctcttatggccgtgcgatgcagcaggcggcattgaagttgtggtcacaggatatgaagggcaatttcgccaaagcgcagcaggttgtgtacgagcgggccaaggaaaatggtctggccgctcttggtaagtggaaggggtgagcttctttgctcattgtggcgaaggcgctggctgtg

SEQ ID NO: 33165 - DNA, 996 bp, Xylella fastidiosa
acgatggccttgaaaaactttttgaatacccaggactggagttgctctgaacttaatgcactgctgacccaagcacgcgcgttcaagcacaacaaactggggaacgccctgaagggcaagtccatcgccttagtatttttcaacccatccatgcgtacccgcagcagctttgaactgggagcatttcagttgggcggtcacgccatcgttttacagcctggcaaagatgcctggccgatcgagttcgataccggcaccgtgatggaagcagagaccgaagaacacatctgcgaagttgccagagtcctgggtcactacgttgacctcatcggcgtgcgtgcgttcccgaaatttttagactggacttacgaccgccaggacatcgtactcaacagctttgccaaatattccccagtgccggtgatcaacatggagacaatcacccatccctgccaggaactggcgcatatcatggccttgcaggagcactttggcaccacagacttgcgcggcaaaaagtacgtattgacctggacctatcaccccaaacccttgaataccgccgtggccaattccgcactgaccatcgcgactcgcttgggcatggatgtcaccttactgtgcccaacccccgattacgtccttgatgagcgttacattgattgggcgcggcagaacattgcagacactggcagcacctttcaagtgagccacgacatcgacaacgcctaccgtggtgccgatgtgatctacgccaagagttggggcgcactcccgttctttggcaactgggccatggaaaaaccgatacgcgaccaatacagacactttatcgttgacgaagccaaaatggcgttgaccaacaacgccgtcttctcgcattgcttaccactgcgccgtaacgtcaaggcgaccgatgcagtgatggatggatctaactgcattgccatccatgaagctggcaaccgcctgcatgtacaaaaggccgtcatggcc

SEQ ID NO: 33166 - DNA, 1158 bp, Xylella fastidiosa
gtcttggccttctccggtggactcgacaccagcttttgcatcccctacctgaaagaacagggctatgccgtacacaccgtatttgccgacaccggcggtgtcgacgaagatgagcgtgacttcattgaaaaacgtgctgccgaattaggcgtagctagccacctcaccgtggatggcggccctgctatctgggatggtttcgtaaaacagcttgtctgggctggcgaagcctaccaaggccagtaccccttacttgtttctgatcgctatttaattgtggatgccgtactacagcgtgccgatgcactgggcacctgcgccgttgcccatgggtgtactggcatgggcaacgaccaagtccgcttcgacctggcgatcaaagcacagggcgactacaccatcattgccccgattcgggaaatccagaaagagcacacccagacccgtctctacgaacaaaaatacttagaagaacgcggctttggcgtccgtgccaaacagaaaaactacaccatcaatgaaaacctcctgggcatcaccctgtctggtggcgagatcgacaaatgggaagccccgggagaaggtgcccgtggctggtgcgccccgcgcagcgcctggcccaccgaccccctcacggtggctatcaaattcgttgaaggcgaagccgtcgccgtagatgggaaacccctttccggccctcagattctgatgaaactcaacaaactcttcgcctcctatggcgtgggacgcggtatttacaccggcgataccgtcattggcctaaaaggccgcatcgtatacgaagcccctggactcaccgcactgctgaccgcccaccgtgccctggaagacgccgtgttgaccaaacaacagaaccgcttcaaaccgcacatagcccgtaaatgggttgaactggtgtacgaaggatttttccatgaccccttgaagactgacctagagaccttcttaaaatcctcccaagccaacgtgaatggtgaaatcgtccttgaaacccgaggtggtcgagtcgatgccgtcgcagtgcgctcaccgcacatcctcactagcaaaggcgtcacctacgcccaaaccgctgactggggtattgaagaagccgaaggatttatcaaactctttggcatgagctccaccctatac

SEQ ID NO: 33167 - DNA, 2303 bp, Xylella fastidiosa
cccgggcgcgtccgtcccccaaccaccgccaatccaatgcacgccaacctacagactcgacagatcatcatccgcctgctgtcaagcatggcgagcgccaaggaaatcagccaatacctcaagcgattctcccaattggatgcaaaacgctttgctgtcgtcaaagttggcggcgccgtgctgcgcgatgatgtggacgcactgacctcctccctctcattcctccaagaagtgggactcaccccgattgtcctacacggcgccggtccccaattggacgaagaactcactgctgtcggcattcaaaaaaagaccgtcaacggcttccgtgtcaccttgccagagacaatggccatcgtccgcaaagtgtttcatgccaccaacctccaactcatcgaagcattacagcgcaacggcgcccgcgccacctccatcaccggcggagtatttgaagcacactaccttgaccaagaaacctacggccttgtgggcggaatctccgccgtcaacatcgcaccgattgaggccagcttgcgtgccgcctctattcccgtcattgccagcctcggcgaaacccccagcggccaaattctcaacatcaatgccgatgttgccgccaatgaactcgtacacgtcctccagccctacaaaatcatctttctcaccggcacgggcggcttacttgatgccgatggaaaaatcattaactcaatcaacctatccaccgaatacgaacaactcatccagcagccctgggtctatggcggcatgaaactcaagatcgaacagatcaaacacctcctggaccgactgcccctagaatcctcagtctccatcacccgtcccgccgaccttgccaaagaactgtttacccacaaaggctccggcaccctggtacgccgtggcgaacgagtcatccgcgccaccacatggaaagacctagacctcccgcgcctccaacacctcatccaatccagcttcaggcgtaccctgatcccccattacttcgaaactacccccttactgcgcgcctatgtcagcgaaaactaccgcgctgccgtgatactgaccaagctgggtaacgtcccatacctagataaattcgccgtattggacgacgcacagggagaaggcctcggccgtgccgtctggagcatcatgcgcgaagaaacaccccaactcttctggcgttcccgccacaacaaccaagccaatgctttttactacgccgaatccgatggctactacaaacaagaccactggaaaatcttttggaatggcctacatcacttccaacagatccaacaatgcgtcgcccactgcgcccaacatcccccaaccctgatcgattgaagatgagcaccgccaccttcacccttggcattgttggcgcccgcggctacaccggcgccgcattgatcagcctccttactgcccaccccgcgattgaactcatctttgtttcctcgcgtgaataccatggccagcccgttgccgcacacagccccacctactgcggtgatctgcgttttgaaaccctcgacccggctgccgttgctgccaaacgtgccgatgtcgtcatcctcgccctacccaatggcaacgccgccccttacgtacacgccattgatgccaccgccccccccaccatcatcatcgacctatccgcagatacccgctttgacccagactggtactacggcctccccgaactgacccgacacacctacaccggacacaaacgcatcagcaacccaggctgctacgccaccgcaatgcaactagccatcgccccccttcgtgaccaactggctggccccccacagtgctttggcgtctccggctactccggtgctggcaccaccccctcagacaaaaacaaccaagccctactgcgtgacaacctcatgccatacgcactcaccgaccacctgcatgaacgtgaagttagcgcccaacttggtatccccgtcgaattcatgccccatgtcgccccccactttcgcggcatcaccctcaccgccaacctctggttacaacgccccctgacccgggaacacatcaagaccctctacgcaacccgttatgccaacgacccactgatcgacatcatcgacccccccccctgggttaaccagattgccgcccgccataccgtacagatcggcgccttcaccatggcaccgggcaacaaacgcgttgtgatcgtcgccaccttggataacctcctcaaaggcgccgccacccaagccctacagaacctcaaccgcgcacttggcctggacgaacttaccgccatcccc

SEQ ID NO: 33168 - DNA, 1212 bp, Xylella fastidiosa
ctctggaacaaacctggcgtagcgatcgacgccagcatccaaaccttcctggcagccgatgatgtccttctggaccgcgaattcttcctctacgacatcacagccagcacagcccatgcccaagcattacagcgcatcggcctcctcacccccgacgaactcgacaacatcctccgagaactgcaacacctcaccgacgaataccgcaacggcaccttcctcctagatacacagtatgaagacggccactccgccattgaatcccgcttgaccgaacgcctcggagacaccggccgcaaaattcacaccggccgcagccgcaacgaccaaatcctagtcgccacccgcctatggctgaaagaccgactcacccaactgagcaccttgaaccgtgacattgcccaccatgcattacagcgtgccgctgccgaacaacacctccccatgcctggctacacccacctgcagcgcgccgttgtctcatcggtcggcatgtggtgggcaggctgggctgaatccttcatcgacaacgccctacgcgccgccgataccctcgccctgatcgactgcaaccccctcggaaccgccgccggctatggcgtcaacctccccctggatcgcccccacaccaccactgcactgggctttgcacgcctccaagttaaccccatctgcgcccaactttctcgcggcaaatttgaactggccgcactcgaagcactcggcagcgccaccttagacctccgccgtatcgcctgggatctctccctatttaccaccagcgaatttgcattcatcaccctgccgcccgaatacagcaccggcagctccatcatgcccaacaaacgcaacccagacgtcatcgaactcatgcgcgccacccatgccagcgttgccgccgcccgcaccgaaatcgaacaactcctctccctcccgtccggctaccaccgcgaccttcagaacagtaaaggcgccatcgtccgcggcttcaaccgcggcctggccgccttagaactcttacccgcactcctgtcccgcctacagtggcgcccagacaccctccgtgccgccattgatcccggcatgtatgccaccgatgccgccattgaagccgcaatcaccggcatccccttccgtgacgcctaccagatggccgccaaaaccgctgacaccgctgcccaaggccgcaccccagaaaccagcctcaccgcc

SEQ ID NO: 33169 - DNA, 1239 bp, Xylella fastidiosa
ccccacatccgacaccttgcccaacaatgccgcgacgccgcccgcatcttggcgaccttatccaccgacgccaaacgccgcctccttgaaacaatggcgaccgccttgaacaccgatgccgcaaccatcctcgccgccaatgctgccgacctcgacaccgcccgcacccaacaggttggcaccgccatgctcgacagacttgccctagacccccaacgcctcgccgccatggccgatgccttacgtgacattgccgcattgccggaccccgtcggccaagtgacccgcgacgaccggcgtcctaacggcatccatatccaaaaaatccgcgtcccattgggcgtcattgccatgatctatgaagcaagacccaatgtgaccgccgatgctgccgcactctgcatcaaagccggcaacggcatcatcttgcgtggcggctccgaagccatccgctccaacatcgccattgccaccgcactacagcgcgccttgcgcctcgcctcactgcctgaaaccgccctgatcctcgtccaagacatggcgcgccacaccatgctggaactcctacaactcagcgacctcattgacctggtgatcccccgtggcggcgaaggccttatccgcttcgttgccgaacatgcacgcatccccgtcattaaacattacaaaggcgtctgccatcagtttgtcgatgcctcagccgacatcgagatggcaatacgtctgctgattgacggaaaaaccacccgtcccgctgcctgcaacgccctggaaaccttactcgtccataccgacatcgccccacgcttcctccctgccgccgctgccgccttacgtccctatggcgtccaactgcgtggtgaccacgctacctgcaccttgcttcctgatgtgcttctggccacggatgccgactacgccgccgaatatctcgacttaatcctcgcaatacgtattgttcccaacttagatgccgcacttgaacatattcgccgctacggctccgatcacaccgaagtcatcgtcaccgccgaccccgcacatgccgacaccttcgtacaacaactgcattccgccgtcgtcatggtcaacgcctcctcgcgtttttccgatggtggcgccctcggactgggcgcagagattggcatttccaccacacgactccatgcctatggccccatgggattagacgcactcacagtagaacgctttgtcgtccgtggccaaggccaagtccgc

SEQ ID NO: 33170 - DNA, 738 bp, Xylella fastidiosa
aaacttgtattgctacgccatggacagagtcaatggaactcaatgaaccgttttactggctgggtggatatagggctgaccgaacaaggtcatcaagaagccactatggctggtcatctgatgaaagaagaaggactagagtttgatgtcgctcatacttctttacttaagcgggcgatccatacattacaagacgcacttaaagcattggaccaggactggttaccaatttataaaagctggcgtctcaatgagcgtcactacggtgctctacaaggccttgataaaatagataccgcagctaaacatggtgaagagcaagtcaatatttggcgccgctcctatgacatccagccgccgccgattgatctagatgacccaagccatccaatgcgagaccgccgttacgctgctctggaccgcaaagtattacctgtgacggaatcgctgaaaaacacactcgaacgagtattaccgtactggaatgatgctatcgcaccacaactaaatgacaacaagacggtacttattagcgcccacggcaactcattgcgtgcgttgtacaagtaccttaatcaagaaagtgatgagaaaatcctaaatgtcaatatccctactggcattccacttctatttgaactgagcgatacactacaagtagtgagttaccgttaccttggcgatccagatgcagcacaacgcgctgccgaaatggtagcaaaccaaggtaaggcgaaa

SEQ ID NO: 33171 - DNA, 1818 bp, Xylella fastidiosa
gtcaccattgaaattgatggccagaatttagttgtaccgaaaggttcaatgattattcaggctgcagataacgctggtattccgatcccgcgtttttgttaccacgagaagttgccaatcgcggccaattgcagaatgtgtcttgtcgatgtcgagaaggtgccgaagcctttgccagcctgtgctacgccggtgatggaggggatgaaagtccgcacccgcagtgaaaaagccctgcaatatcagcgtagcgtgatggagttcttgctcatcaatcatcccctggattgtccgatttgtgatcagggaggcgagtgcgagttgcaggatgtttcaatgggctatggtcgctcgatcagccgctttcatgagcgtaaacgcgtggtaccggatgaggacattggtccgttggtcgctaccgagatgacccgctgtattcaatgcacgcgttgtgtgcgttttaccgctgacattgctggtacctatgagttgggctgtatgtaccgtggagagaatctgcaaatcggtacttatgacggtaaaccacttattactgagttatctgggaacgtggtcgatgtgtgcccggtcggtgcattgacgaacaaggtatttcagttccgtgctagaccgtgggaattaatggcctaccagtcgttggggtatcacgatgcgatgggttccaacttatttctgcatgtgcgtcagggcgaagtgttacgtacggtgccgcgtggcaatgagtatgtgaacgagtgttggttgtctgatcgtgatcgttattcgcatcaggggttgtacgcggcggaccgtgcggtcaagccgctaaagaaggttggtgaccagtggttggaagtgagttgggccgagggtgtgtccgctgccgctgagatcttgagtgcgcatcgtggcgatgcgcttggtgttttggtgcatcctgctacgtcgaacgaagagggggcattgttggcacgtctggcagcgggtctgggcaccggtcatctcgatcatcggatcttcaaccgtgatttttctgatgttgctgtggccgagccgtttgcattgccgttggcagagatcggcaacgccgatctggtcgtcttattcggaagcaacatacgtcaggagttaccgttgttgcatgcacgcctccgcaaagcggtcacttgcaacggcgccaaggtgtacgcggtaaatccggtagattttgacttcaccttctcgctgactgggaagtccatcgttcctccgtcgcagttagccaatgtattgaccgatacggcgttgctcaatgcggcgaaagcggctgcccgtgtggtgattgtggtcggtgcactggctgagaatcacccgcaaggagccacgttgcgggcggcggcgcgtcaatttgctgaggttacaggtgcggcgttgtgtcgcatcccgcaaggagcgaatgcgattggacttacccagcacggtgtgttgccgacaggtcgtgatgctgctgcgatgcttgtcgagccgtgtcaggcttatgtgttgtacggtattgagccgggcttggactttgccgacacggcgaccgcgcgtcaggcactgcatggtgctaaggtggtcgcgttcagtcacttcgcttgtgcctcaacccgtgatgtcgcggatgtcatcttgcctattggtttattacctgagattgatgggacattgactaatcttgatggtcgcactcaggcggctaagccaggcggcaaattaccgcttgaggcccgtgagggatggcgtgtgctgcgtgccttgggaggtgagttggggctatccggttttgattttctcgat

SEQ ID NO: 33172 - DNA, 741 bp, Xylella fastidiosa
atgcgccccaagattgtggttgggaattggaagttgcatggtagccacgcgttcgcacaggcattggttgcgcaggttgctgctggtttgccgctgcctggagtcagtgtgattatcttgccgccattgctgtatctgagtgatttgacgcagcgcttcaaaggggaaggtttggcgtttggtgcgcagaacgtcagtcaccatgataaaggtgcttacactggggaagtttcggcggcgatggtggctgatgtcggtgctcattacactttggttgggcattctgaacgtcgggagtatcaccatgaggacagtgagttggtggcgcgtaaatttgctgctgctctgagtgctgggttgcgaccaattctatgtgttggggagagtttgccccagcgtgaggctggacaggcagaggttgccattgcgatgcagcttgcgcctgtgttggctctggttggcccgcagggtgttgcccgtggcttgattgcctatgagccggtttgggcgattggtactggccgtcatgcggatccgagccaagtccaagcgatgcacgcttttattcgtggtgaaattgcgaggcaagatgctagaatcggcgattctctgttgattctatacggaggcggcatcaagccttgcaacgctgctgagttgttttcccagcaggatgtcgatggtgggttgattggtggtgcttcgttggttgctgatgatttcttggctatcgctcgtgcg

SEQ ID NO: 33173 - DNA, 1851 bp, Xylella fastidiosa
atgccaatccgtcagctacccgagattttgattaaccagattgccgccggagaggtggttgagcgtcccgcctcggtggttaaagagttggttgagaatgcaatcgatgccggtgcgacgcgtgtggacattgagttggaagcagcaggggtgcgcttgatccgcatccgtgacaatggccacggtatggctgctcaggaattgccgctggcagtcttgcggcacgctaccagcaagattgcctcattggatgatttggaagcggtcgccacactgggtttccgtggtgaggcactgccttcgattgcttcggtgagtcggtttaccttgatgtcgcgtcgtgccacggatgaacacggcgcggtattgcagattgagggaggtacgctgggcgaggtgatcccccatgcgcatgcaccggggaccaccgttgaggtgcgtgagttgttctataacgtgccagcgcggcgtaagttcctccgtgctgagcgtaccgaactggggcatattgaggaatgggcacgttctctggcgctggcgcatccagatttagaattgcgtctctcacataacggtaaactttcgcgtcgctataagccgggtgactggtattcagatgcgcgcttgatcgagattttgggagaagattttgcgcatcaggcattgcgtgtagatcacagtggcgcggggttacgtctgcatgggtgcattgtgcagccgcattactcgcgtttgaatgcggatcagcaatatttgtacgtcaatggacgtccagtccgtgatcgtagtgttgctcacgccgtcaaacaggcttacagcgatgtgctctatcaggggcgacatccggcgtatgtgctgtttctggaacttgacccggcacgtgtggacgtgaacgtacacccggccaaacatgaggtgcgtttccgcgatgcacggctcatccatgactttgtctaccgtactgttcagggcacgttggcacagacgcgtgcgggtacgccgccgctggcggtgggtgtgggtgatgtggagggggagggggagggtgcaaggcctcctggccgtcatgcggtgtcgttttcagggcggcgtggtggtgcctcgcatgtgctggggagctactctaccagcacggctcctctgatgcagggtgtgccaagcgtgtctgttgctgacgcgcccgcagcgtatgcagccctgtatgctgcgccaccgacacaggtaatggatgcagtgccacagatgcagacggggctaccgctggctgctggggcgggcgacgtaccgccacttggctatgccatcgcacagctgcatggcatttatatcctggctgagtgtgccgatgggctgatcgtggtggatatgcatgcggctcacgagcgtattggttacgagcgcctgaagcgagcccatgatggtattgggttacgtacccagccactgttggtgccgatgacgttgatggttgccgagcgtgaggctgatgttgctgagtgtgaagctgagacgttggccagtcttggctttgaagtgacccgcagtggtccaggttcgttacaggtgcgtagcatccctgcgttgctttcccaagcggagccagaaatgttactgcgcgatgtgctcagcgatctgagtgaacatggccacacccggcgtgtggctgaggcgcgtgatacgttgcttgcgacgatggcttgtcatggtgctgtgcgtgctcaccggcgcttgagcatttccgagatgaacgcgttgttgcgtgatatggaggctacggagcgctccggtcaatgtaatcacggacgtcctacctgggcgcgttttagtttggctgagatcgatcgttggttt

SEQ ID NO: 33174 - DNA, 1542 bp, Xylella fastidiosa
ctgtcctcatccgatctttccgagccggtatcggtgaaaacgctctggggcgaggtgcaacgtcccagcctacctacccacgtgtgtacggtattgcctgcgcgcctgactcctaaacatggttccattgacgcactcgatgccaatccacaggcttccaagcctgataccaagcgtttacaggatgccattgatgattgtcccgccggtagcgcggtcaaactagtgatcgacagtcatcgcaaatccggctttttgagcgggccgttgcacttgaaatctagggtgacgttgtggattgacgatggcgtcacgctgtttgcatcgcgcaaccccaaggattacgacaaaggcaatggtacgtgcggtactgcaacgtcaactcatgagttcagttgtatgcctttgatctccgcgatcaacaccaccggtagcggtatcgtgggtgggggtgtgattgatgggcgtggcggtagcattttgactggcggtaagcatgctcggcagcgtacctggtgggacctggcctatcagaacaagcgccatgcactgcatcaacaggtaccacggttgatccaaatcaggggcggtaacgacttcacgttgtaccgtgttgccatcgaaaatgcacctaacttccatgtggttgctgatacggtcagcggtgtcaccgtatggggcatccgcatcctgaccccaagcttggtctataccacgccggggtaccactgtccgcccggtaccacgccggatgttgtgacgccggcgacatgctttaccccggacacggtcaagaacaccgatggctttgatcctgggcaatcaaaccacgtgctgctagcgtactcctacatcagcaccggggatgaccacgttgccatcaaagcgcggggcaagatgccaagctacgctctgagcttcttacacaaccactttggctatggacatggcatgtccatcggtagcgacatcgagtcaggtgtacacgatatggaagtcagtgatttgagtatcgacggttttgacagccctaacagcaatggcttgcatatgaaatctgatgccgatcatggcggagtggtcgaccatgtcacctactccaaaatatgcatgcgtcgtctgaaacgtccgctggcgtttgacaccttctacaaaccttccaacgggaattcttatccactcttcaaaaatatcgtgctgcaagatattcatgtgcttgaaagccctgtctttggtgctggtcagctgcttttcatggggatcctgggcagtgggaataatatgccaatgacgttgagtctggataacgtcgtattcgacggttttttgccaacattgatagcgcctcccagcagtgtcgtatttgccaatccgcaggcagtgcattttcacttcggtcccggtccggtcagtttcgctcctttgattacctcctctgttgcttacgatgtgactgtgagtggaagtccaagtgtgggcaacccatacgattgttcagcggcatttatcaatttttccagcgtatttcctgattcgcctatc

SEQ ID NO: 33175 - DNA, 678 bp, Xylella fastidiosa
gtttccaagaattaccgccaaagtgaactggataaattcgcagccttcaccagtggttggtgggatccacacggcccccagaaacccttacatgccttgaatccggtccgtttggattacatcagcaagcgcgtgtccctgtctggtgcccgtgtccttgatgtcggttgcggtggcggactgctgagtgaagccctggcgcgccaaggcgcacacgtcaccgccattgacctggctccagagctgattaaggccgcccgtctgcatggtttggaatcggggatccaggtcgactaccgcatccaggccattgaagacctgcttgctgaacaaccggccccgtttgatgccatcgcctgcatggaaatgcttgagcatgtccctgatccggcggcgattgtggacgcctgcgcccacctcttaaaacccggaggcagattgtttgtgtccacaatcaaccggaccctggctgcattcatgctggccgtggtgggtgctgaatatgtggtgcgtctcttgcctaaaggcacccatcagtacaaagacttcatcagaccagctgaactggccgcttggttgcgtcacgcaggactgcatctggaagatgtcagcggcatgcggtacgagccgtggcgcaatcgtgcccggctcaccgctcgcactgacatcaactatctt

SEQ ID NO: 33176 - DNA, 1407 bp, Xylella fastidiosa
ttgccatcgtttctaaagcgcaagtccattgatctaatcaccgtgcatgaagaaggacgacgcctggtccctacactgagctggccacatctgatcgcatttgggattggtgcaatcgttggcactgggatctacaccttaatcggggtcggggcagaaaaagcggggccagcagtcctcctctcattcgtcatcgctggggtcatctgtgcctgcgcagcgctggcatatgccgagatggcgacactgatgccagtggcaggcagcacttatacgtacagctatgtggccctcggtgaggggattgcctggatcgtggggtggagtctcatcttagagtactcactggtggtcagcactgttgcggtgggatggtccgggtacatgactgggtttctcaagagcgtaggggtcgatatgccgctggcgctcaccgccggaccgtatgctggcgggataatcaatcttccggcggtagtgatcacctgcgttgtggctggactgctgatcgtcggcacaaaagaaagcaccacactcaacgcggttctggtggtggttaagatcattgcgctctctgtgttcgtcgtgatcgcgctaccacattttgatatggctcatctgaaaccgttcatgccctatgggtttaccaagtcaatcgacaccggaggtgtggaacgcggggttatggccgctgcagcaatcattttttttgctttctatggtttcgatgcaatctccaccgcagccgaggaaactaagaatccaagccgcgatctgtccatcggcatcatcggttctatgatcggatgcaccttaatttacgtattagtggcactagctgcgatcggtgcaatgcactacaccgtgttcggtcccagtactgaaccgctggcgctgattctgcggcaacttgaccagggcaacaccgccaggctcatcggagcagctgcgattatcgcgctacccactgtactgttggcctttttatatggacaaagccgcattttgttcgtgatgtctcgagatgggctgctgccacgtggattgtcgacggtgaatgaacgcacaggaacaccgatcgccacgacactgttcaccgcaattctcgtcgcaacggcagcagggttggtgccattgggcgagattgccgcgctggctaatgctggcacgctgactgcgttcatcgcagtggctttatgcctgctggtaatgcgggtacgtgaaccacagcgcgtgcgtgcattccgtacaccactggcttgggtcgtcgggccaatcgcaattgctggttgtttgtatctgttctggagtctaccaaagatgacacagtctctttttctgctgtggaacgcactgggattgtgtgtgtatctggtctatgggcgccacaccagcctgctatcaaag

SEQ ID NO: 33177 - DNA, 1209 bp, Xylella fastidiosa
atgtccagctacctttttacatccgaatcggtttcggaaggccatccggataaggttgccgaccaaatttctgacgcggtgctcgatgcgatcttggttcaggatccgcgtgcccgtgttgcttgcgagacaatggttaagactggtgtagcgatcatcgctggtgaaattactaccagtgcctgggttgatctggaagcgttaacccgtaaagtgattgttgacatcggctataacagttccgacgttggtttcgatggcgctacttgcggcgtgttgaacttaattggtaagcagtccccagatattaatcagggagtggatcgtaaaaaggctgaggagcagggagcaggtgatcagggcttgatgttcggatatgccaccaacgaaactgatagctatatgccagcggcaattcacatatcacaccggctagttgaacagcaagcaaaaattcgtaaaaaaagcaactcgccattgccgtggttacgtccggatgctaaggctcagattactttgcgttatgaggacggtgtggccagtgcgattgatgctgttgtactatcaacccagcacgatcctggtatcaaacagaaggatcttgttgaagcagtgcgtgaggaaattctcaagcctgtgttgccttccaagtggttgcacaaaggaaccaaattccacattaatccaacgggtaaatttgtgattggtggtccggtgggcgactgtggtctgactggccgcaagatcattgttgacacgtatggcggttcagcccgtcatggcggcggtgctttctctggtaaagatccatcaaaagtagatcgttcggcttcttatgctgtccgttatgttgctaaaaacgtggttgctgctggtttagctgatcgttgcgaagtgcaggtgtcctatgcaattggtgtggctgagcctatttctatctcagtgactacttttggtacaggtaaggtacccgatgataaaatcgagaaactaatccgccagcattttgatctgcgtccctatggcattatcaaaatgctagatttgattcatccgatatatcaaccgagtgctagttacggtcattttggccgtaagccgagagagtttgcttacaccaacagcaacggtggacgtgtggttgcgactgctttctcgtgggagaaaatcgataaggcagaagtactccgtgccgatgctaaactgaag

SEQ ID NO: 33178 - DNA, 1338 bp, Xylella fastidiosa
atgagggtgtccaggtattttggtaccgatggcatccgtggccgcgttggccaggggttgatttctgctgattttgtattgcgcctgggtaacgcgcttggccgagtgcttgctcagggccgtgatacccgtccgatggtgttaattggtaaggacacgcgtatctccggttatatgtttgagtctgctcttgaggcgggtttggtggccgctggcgctgatgtgcagttgatcggcccgatgccaacacctgcgattgctttcctgaccaatacgttgcgggctgatgctggtgtggtgatcagcgcatcccacaatcctcatgatgacaatggcatcaagtttttttccgcgatgggtgaaaagctcgacgatgcgacagaagcggccattgaagcggcgattgaggcgccattcctgacggttgactctgaatatttggggaaggtcaagcgtacacgtgatgcaattggccgctatatcgaattcagtaaggcaagtgtgtcgcgtggttttacgctgcgcgggttgaagttggtattggattgtgcgcatggcgccacgtatcacatcgcaccgatgctgtttcgcgaattaggtgcggagttagtggcgattggtgtcgatccggatggtttgaatatcaatgccggtgttggctctactcacttggagactctcgctgccacagtgcgtgagagcggtgctgatttgggcattgctttcgatggtgacggtgacagggtgctgatgacggatgcccaaggccggactgtggatggagacgacctgttgtatgtgctggcgcgtgcttggcgggctagtggtcgtttaaagggcacggtggttgggacgttgatgagtaactatggtttagagcaggcgttggggacccttgggatcccctttatacgtgcgaaggtgggtgaccgttatgtgcatcaggcattggttgagagtggaggggtgctaggcggtgaggcatccggtcacttgttatgtttggatcgcgcaaccacgggtgatggtatcgtcagtgcattacaggtgttggaagtgttgcgtcatgaggggctgacgttgagtcaggcactgctgggtttacataaggtgccgcagaagacggtcaatgtgtgttggtctggtccagccagggctgcagtcgagatgccggaagtacgtcaagcattggttgaagcgcaagcggcggtgcagggtcggggacgggtgtttttgcgcccttccggcaccgagccggtggtgcgtatcactgtcgaagccgatgacgtcgtactcatgcagcagacgcttgataggcttgccgatgtggtccgtgac

SEQ ID NO: 33179 - DNA, 735 bp, Xylella fastidiosa
atgtcagatccctctaaagtcgctctgatcactggtggcgcacgtcggatcggcaaggcgatcgtgcatcacctgcatgcacatggttatcgcgtcgccgtccacgcacaccagtctggccacgaactacatgcatttttaactgagctagaacgcacgcgtccatccagcacactcgcattgctcggagacctgcacgaaaacgcagtcccagaaacgctgatcgcacgctgtgctgggcacttcggacggctggacgtgctcatcaacaacgcctccaatttctatccaaccccactgggcgaagtgacaccagcacaatgggatgatttatttgcaatcaatgccaaggcccctttcttcctcgcgcaagcagccacaccactgctgcgcaaacatcgcggggcaatcatcaacctgacagatctacatggcacgcagccactgcgccaacatgctgtctataccgcagccaaagccgctctggagatgttgactcgatcactcgcactggaactggcaccgcaagttcgagtcaatgccatcgcacccggggcgatcctatggccaacgcaaggcatagcggaagcagcgaagcaggcgctgctggcacgcaccccattagcacgtaccggcacagtggaagagatcgccgaagcagtgctatggctactagaaagtgctaatttcatcaccggacataccctgcgcctggatggcggccgcacgctgaca

SEQ ID NO: 33180 - DNA, 2223 bp, Xylella fastidiosa
atgttcagcaaagatctcgagcaaacaataggccagtgctacaagcgaacgcgtgaggcgtgtcatgagttcatgaccgttgagcatctgcttctttcattgttggacaatccattggcgcacgctgtgctgaaggcttgcggagcggatgttaccaggctgaagcgtgaccttgagcaggccattgaggtatctattacccgcttggatgccgatgacggccgtgatactcagccgacgcttggtttccagcgagtgctgcagcgtgctgtttaccatgtgcagtcttctggtaagaaggaggtgaccggcgctaatgtactggtggctatctttggtgaaaaggattcgcatgccgtctactttctgaatcagcaggacatcagccgactcgatatcgtcaactatttatcccacggtattacccgtatgggcgaggagagtgacatcgggcaagctgctgagaatgaggctaagggggagagtgaggcgaataagggggatgctcttgctgaatatgctattaacttgaatgaacatgcacggaatggacgaattgatccattggttgggcgcaaagatgagattgaacgtacgatccaggtgttatgccgacgtcgcaagaataacccgctctatgtaggtgaagcgggcgttggtaaaaccgcaatcgctgagggtttggccaagcgtattgttgatcgtagtgttccggaggtgcttgccgatgcggtgatctactcgttggatcttggcgctctggtggctggtacaaaatatcgtggtgactttgaaaaacgtctgaagggtgtgttaagtgcgttgcggaaaacccctaacgtagttttgtttattgatgaaatccataccatcatcggcgctggttccgcttcgggtggcacgatggatgcgtctaatttgatcaagccagccttggcttcaggtgagttacgttgcattggttcgaccacgtttcaagagtatcgcggcatcttcgaaaaggaccgtgctttggcgaggcgttttcagaagatcgatatcgtcgagcccaccgcgggcgaggctttcgagattctacaaggactcaagcctaagtatgaggcacatcacggcgttacctatgctgatgacgcattgcgcgctgcggttgatttatcggtcaagcacatcggtgatcggttgttgccggataaggcgattgatgtgatagatgaggcaggcgcgcgtcagcgtctgttgccggagaaagaacgcaaagagctgatcgatattgaggagattgagaccattgttacgaagatggctagggtcccggcgaagcaggtgagtgtgagcgataaggacattttgaagcacctcgaacgcaatttgaagatggtgatctttggtcaggagccagcgattgagatgctgtcgtcggcaattaagttggcgcgcagtggcctaggtaatccggataagccgattggaaacttcctgcttgctggcccaacgggggttggtaaaactgaggtgactaaacaattagcacaccatcttgggatcgagttggtacgttttgacatgtctgagtgcatggagccgcattcggtgagtcgtctgattggcgcgcctccgggctatgttggttttgatcagggagggttgctgactgagaagatcgtcaagactccacactgcgttctgctgttggacgaggtggagaaagcgcatatagatgtcttcaatattctcctacaggtcatggatcgcggtgtgttaacggataccaatggacgtgaggcgagttttaaaaatgtgattctggtaatgacgaccaatgcaggtgcgtcccaatcttcacggcgtacgattggtttcactaagcaggaccataccagcgatgcgatggaagtgatttgtcgcagtttcagccctgagttccgcaatcgtcttgatgcgattgtgcagtttcagccactgggtttcagtcacattctgcgggttgtcgacaagttcatcattgagttggagatgttacttcaagagaaacgtgttgttttgtcggctacgccgattgctcgcgactggctggctcagcatggttttgatccgctgatgggtgctcgtccgatggcacgtgtgattcaagagaaaatcaaacgcccacttgcagacgaattgttgtttggtaagttgctcaacggtggtcgggtcggcattgatgtgcgtgacaatgagtta

SEQ ID NO: 33181 - DNA, 1677 bp, Xylella fastidiosa
ctgatccctgcacccgttcaaatacaacgcggtcacggccaaatccacattggcccccacaccctgatttccatcccccccaacgataccgacgcacaacacagcgccacctacctagccacactgctacagcacacccgcaacctgacattacacatccacaccgaaaccacccccaccccagacagcatccgcctacaacgcgacccacaatcacccgtcactcagacagaaggctacaccctgcaagccctccccaaccaaggcatgcatatcacggcacgagacggagcaggactgttctacggcgcgatcactgcatggcaactactgactgccgacagcaaccaaggcccaaccgaaatccctaccgtcaccattcacgactggccacgcttcaaatggcgcggccaactccttgacgtcgcccgtcacttccacgacgtagacaccgtcaaacacgtgattgacgccatggcacaacacaaactcaacgtcctgcacctacacctcaccgacgaccaaggctggcgtatcgaaatcaaacgctaccccaaactcactgcaatcggcgccgaacgcatcccaccgggcgccggacgccacggcaccccagaacgctacggcggcttctacacccaagatcaaatccgcgaactcgttgcctacgccaccgaacgacagatcaccatcctccccgaaatcgacatgcccggccatgcacaagccgccgtggcagcctaccccgacatcatcggagtcaccagcaccaccccacccgtcagcgtcgactggggcgtcaacccctacctcttcggcaccagcacacccagcctggacttcatccgcaatgtactcgacgaagtactcaccctattcccctcccagtacatccacatcggcggcgacgaagccgttaaagatcaatgggaagcctcacacaccatccgcgcccaaatgcgcaaactgggcgtgaaagacacacatgccatgcaaggctggctcaacacacaactagcccaatacctcacaacacatgaccgacgcctgatcggctgggatgaaatcatccaaagtggcctaccagagagcgcctccgtgatgtcatggcgcggcgtcgaaggcgccattaccgccgcacaacaaggacacgacgtcgtcctcgcccccgctggctggatgtacctagacaacctgcaaaccgaacgcagcgacgaaccaaacggccgcctcgccaccctgcccctctcccgcgtctacacactggaccccgtccccaaagaactgacccccgaccaagccatccacatcctgggcctacaaagcgccctgtggagcgaatacatcccctcacgctggcacatcgaccacgccctattcccacgcctcgccgccgtcgccgaagtcgcctggtcccccatgaccgcacgcaactgggacaacttcctcaaacgcctccccccacaactacaccgctaccgcaccctgcacatcgactacagcgacggcgcattcgcccccgacatcatgctgcaacaccgctcagcctacgtccttgctggcgaaccccctcacatcacactcagcaaccaaaccaacaccggccaaattcactacaccacaaacggcaacgaaccgaccctacattccccccgctacaccgccccatttcccatc

SEQ ID NO: 33182 - DNA, 1716 bp, Xylella fastidiosa
atgctgcgtcacctgctcacgttgccgctgatattcgcaatcgcgctgcccattggagttagcgccgcgccttggcctgctttttcaactcggggaacgcaattcatccgtgatgggaggccgtatcagttgatctcgggtgccatccacttccaacgcatcccgcgggcgtactggaaggaccgtttgcaaaaagcccgagcaatggggttgaacacggtggaaacctatgttttctggaacctggttgaactccgtgaaggtcaattcgacttcacagggaataacgacattggtgcttttgtgcgtgaagcagcgtcgcaaggtctgaacgtgattctgcgtcccgggccatatgtgtgtgcagaatgggaggcaggggggttcccagcgtggctgttcgccgatccgacgctacgggtgcgcagtcaggatccgcgttttcttgatgccagtcagcgctatctggaggcactcggcacacaggtcaggccgctgctcaatagcaatggcggtcccatcattgcaatgcaggttgagaatgagtacggctcttatggggatgatcatggctatctacaggctgtgcgcgcgctattcatcaaggccggtttgggaggtgcgctgttgtttacctccgacggggctcagatgcttggcaatggcacgctgccggacgtgctagcggcggtgaatgtcgcaccgggtgaggcaaaacaggcgctcgacaagctcgccacattccatcctgggcagccgcagctggtgggtgaatattgggcggggtggttcgaccagtggggcaagccgcacgcgcagaccgatgcaaagcagcaggctgatgagatcgaatggatgctgcggcaaggccattcgatcaatctgtatatgtttgttggcggcaccagttttggttttatgaatggtgctaacttccaaggtggtcccggtgaccattacagccctcaaaccacaagctacgattacgatgcagcgttggacgaagcaggacggccgatgccgaagttcgcgctgttccgcgatgtcatcaccggcgtgaccggtctccagccgccgcctttgccagcggcaacccgttttatcgatctgccggacacgccattgcgcgcatccgcttcgctctgggacaacctgcctgcagcggtcgccacctcagcagatccgcagccgatggagcgctatgggcaggcctacggttacattctgtaccgcaccacgatccacggcccacggaagggcaggctgtatctgggtgaggtgcgggatgacgcccatgtctacgttgatcgtctcttcgtgggtcgggcggaacggcgtcggcagcaggtctgggtggaggttgacattccctccggtactcaccgtctggatgtcttggtagaaaacagtggacgggttaactacggtccgcacctggctgacggccgtgccgggctgattggtccggtgatgctcaatcatgaacgcgtcaacaattgggaaacgtttctgctgccgttgcagacgcccgaagcgatccacggttggacaaccgcaccgatgcaaggacctgcttttcatcgtggcacgttgtttatccgcacgcctggagacacatttttggatatggaggctttcagcaagggagtgacctgggccaatggtcacatgcttggccgctactgggacatcggcccgcagcgggcgctttacttc

SEQ ID NO: 33183 - DNA, 1914 bp, Xylella fastidiosa
atgggcaaaatcattggtatcgacctcggcaccacaaattcgtgcttagcgattattgaaggcggtaaagggcgtgtcatcgaaaactcggagggtgatcggaccactccttccattgttgcttacaccaaggatggtgaagtgcttgttggtgctgcagccaagcgccaagcggtcacaaatccgaaaaacaccttttatgcggttaagcgtttgattggacgtaagttcggtgatgcagaggtccaaaaggaccttgatttggtgccgtataagattactcagcatgacaatggggatgcctgggtggccactgctgatggtaagaagctggcgccgcaggaaatctctgccaaggtgctggagaaaatgaagaagaccgccgaggatttcctgggcgagaaagtcaccgaagcggtgattaccgtgccggcatattttaatgacagtcagcgtcaggcgacgaaagatgctggtcggattgctggcctggatgtcaaacgtattatcaacgagccgactgctgcggcattggcttacggtttggacaagaagggcggagatcgcaagatcgctgtatatgatcttggcggcggtacctttgacgtctcgatcattgaaattgctgaagtggatggtgagaagcagttcgaggtattggcgaccaatggtgataccttcttgggaggtgaggatttcgacaagcgtgttattgattatctggttgatgaattcaataaggatcaggggattgatttgcgcaaggatccgcttgcgttgcaacgtttaaaggatgctgctgagcgcgctaaaatcgaattgtcttcttcccagcaaaccgaagttaacctgccatacattacggcggatgcatcgggtccgaagcacctgaatatcaaactgactcgcgccaagcttgaagccttggtagacgacttggtccgtaagtcaattgagccatgccgcattgcgttgaacgacgccgggttgcgtaccagtgatgttcaagaagtgattttggttggtggccagacccgtatgccgaaggtccagcaagcggttgccgatttctttggtaaagagccgcgtaaggacgttaatccggacgaagcagttgcattgggtgctgcaattcagggtggggtgctggctggtgacgtgaaggatgtgttactgctagatgtgaccccgttatcccttggtattgaaacgatgggtggtgtgtttaccaagattatcgagaagaacacgaccattccgaccaaagcgtcccaggtgttttctactgccgaggatggtcagtccgcagtgactgtccatgtgttgcaaggtgaacgtgagcaggcgcgtttcaataaatcgcttgctaaattcgatttggcgggtatcgaacctgcgccgcgtggccagccgcagattgaggtgtcttttgatattgatgccaacggtattttgcatgtctctgccaaggacaagaaaaccaataaggagcagaaggtcgaggttaaagctggttctggactttcggatagtgagattcaacagatggttgccgatgctgaggcacatcgtgaggaagacaaaaagttccaagagttggtgcaggcaaggaaccatgctgacggtttgatccattcaacccgttcggccattaaggagcatggtagtaaggttgggggtgagctgattgggcgtgtcgaagcctcccttgcagagcttgaggctgccgtcaaaggtgatgataaaaaccagattgaggcgaaatccaaaactcttgaggaagttgcacagtcgttgcacatggcagcaacagcagagcagcagtcagcaagcacgggggctggtgcaggctcttcagccaaggttgacgatgtggttgatgctgaattcacagaagtcaagggcgacaaaaaa

SEQ ID NO: 33184 - DNA, 711 bp, Xylella fastidiosa
atgattaccgctgaacatcttcataagtccttcaagaccaagaaggggctggttaatgcggtaaaggacctcagtttccacgctgctgatggtcgaatcacgggattactcggtcccaacggcgctggaaaaacgacgacgttgcgcatgctctatacgctattggtcccagatcagggctgcatcagcgtcgacggcgtggacgcagtaagcgatccgatgacggttcgtcgtggacttggcgtattgccagatgcatgcggtatttataagcggttgaccgcgcgtgagaatatcgcctatttcggtgaactgcatggtttgtcccgcatagacatcgccgcgcgtctctccatactgtcgaaggcgctggatatggatgacattcttgaccgtcaggctgcgggtttcagccatggccagcgtactaagatcgcaattgcacgtgccttggtgcatgacccacgtaacatcatcttggatgagccgacgaatggtttagatgtgatgaccacacgtaagttgcgggattttctccgtcagttacgcgccgaaggccgctgtattattttctctagccatatcatgcaagaagtggcggcgttgtgtgatcacatcattgtgattgccaagggcacggtagtagtggccggtagtggcgatgagctgcgcgcgcgcactggaaaggacaatctggaggatgccttcatt

SEQ ID NO: 33185 - DNA, 1081 bp, Xylella fastidiosa
atgacgatgcgtatttttaatttcagccccggtccagcgaccttacctgaaccagttttgcgccaagcgcaggctgaaatgcttgaatggaacgcagtgggggcttctgtgatggaaattagccaccgaagtgctgaatttatagcgctggctaaaggtattgagagcgacctgcgttgtttgcttggagtaccagatgactatgcagtattgttcttgtccggtggtgcgacaactcagcaagcgttgttaccgcttaattttgccgccccaggacagactgctgattatgtggtcaccggagcattggagtaagaccgcactgaagcaagccagcccctatgtgaatatcaacgtggtggccgatggggaacgtgatggtttccaagatattccaagccgtgctggctggtgtttgtctaaagatgcggcgtatgtgcacatgactgcgaacgagacgattcacggcgtcgagttccgccagacgccggatgttggcgatgtgccgttgtttgccgactttagctcttcgattgctgctgacctgatcgacgtgtccaagtacgatttaatctatgctggtgcgcaaaagaaccttggtcctgtcggaatttgcgtcgtgatcgtacgccgtactttgcttgaacgtaccggtcagccgcgtgctgatatttttacttacgcctcgcatgccgcacgcgattcgatgctcaataccccgccaaccttcaattggtacctgcttggtcttaccgtcaagtggatgcttgatgaggggggagtgcaggaattcgcgcgtcgtaatcaggccaaggcgcaattggtttatcagacgattgatcaatctgggggtttttatcgtaatggagttgctgcggcagtgcgttcgcgtatgaatattccgttctttttgccgaatgttgagcaagatgctcgtttcgccgccgaggctaaggtcgctggtttattatccttgaaggggcataaagcgcttggcggcatccgtgcttccctctataactccatgccactggctggtgtacaggcgttagtggcatttatgcatgattttcaacagcgc

SEQ ID NO: 33186 - DNA, 1236 bp, Xylella fastidiosa
cagggcaccccactgcatggggtcctgagtattcccggcgataaatcaatctcccatcgtgcagtcatgtttgctgcccttgcggatggcacgtcacgtattgatggctttcttgaggcggaggatacgcgctctacagcagcgatcttggcccgattgggtgtgcgtatcgaaactccctcattcacgcagcgcatcgtccatggtgttggtgtggatggactccaggcatcggatattgccctggattgtggcaatgcaggcactggcatgcgcctgctcgctggtttgctggtagcgcagccttttgacagcgttttagtcggagatgcatcactgtccaagcgaccgatgcgacgtgtgacggatccgctgtcacagatgggcgcacgtatcgataccagcgacgatggtactccaccgctgcgtatttacggtggtcaattactccgcggtatcgattttatctccccgctggccagtgctcagatcaagtcagcggtgttgctggctggattgtatgcacgtaacgaaacggtagtgcgtgaaccgcacccgacgcgtgattacaccgagcgtatgctcactgcgtttggtgtggacattgatgtttccacagggtgtgcgcgcttgcgtggtgggcaacggttatgtgctaccaatattacaatcccggctgatttttcctcagctgcgttttatctggttgcagccagcgtgattcctggctctgatatcaccctgcgtgctgttggactcaatccgcgtcgtattggtttgttaaccgtgttgcggctgatgggggcagatattgttgaatccaatcgccatgaacagggtggtgagccggttgctgacctacgtgtgcgttatgcgccactccagggcacgcgtgttcctgaagatttggtgccggatatgattgacgaattccctgccttgtttgtcgctgcagcggcagccgaaggtcaaacggtagtgagtggtgcggctgaactacgcgttaaagaatcggaccggttggctgcgatggtgacaggcttgcgcgtgcttggcgttcaggtggatgagatcgccgacggggcaacgattcatggagggcccatcggtcatggcaccatcaacagccatggcgatcatcgcatcgccatggcgttttcaattgcagggcagctttccgtcagtacagtacgtattgaagatgtcgccaatgttgcgacttcttttccagactat

SEQ ID NO: 33187 - DNA, 1719 bp, Xylella fastidiosa
acgccctggcggacgtaccgtcgcttgctgtcgtatgcgcgggagtatcgttggttactcgttgttgctgcgtgtggtgctttacttgaggcagttgctggttctacctttctggcgttgatgaagcccatcaccaacgaaacctttatcgagcgaaaccgtgaggtggccctgtggctgcctcttggaattgtcggtttgtttttgttacgcggtattgctggctatatcactgatatggcgatgggccgcgctgcgcgtagcattgctcgggattttcgtgtgtgtgtcctgaccaaatattttcgtttgcctggtggccgttttgacggtgagccagtggcttcgatgttggtgcggctcggttcagacagtgagcaagttgcgcatgcggttatcgacgcgatgaaggtgatggtgcagcagacgcttcaggtgattggtgcgttggttgtgatgttgtggtacagctggacagtcacgctcgccatccttttggtcgctccgttgctggcttgggtcatgcagcgggttgctaagcgttaccgtcgtatcagccatcacatccaagagagtaatgcgcagctcatgcaagctgccgatcaagcgttaagcaactaccaggacgttaaagtgtatgccgcgcaagagagcgagttggagcgctatgctcggttggccaatatcaatttgggtttggcgataaaggttgagtcgacacgtagtatctcttcggcggcggttcagttgcttggtgcggttgggttggcaatgttgttgctcattgctggccatgaagctttggccggtcgcctcagtccaggcgattttgtctcgctgatgacttcaatgatcgcggttattcccgcgttgaaacagttgaccaatgtacagaacatgttgcagagcggtattgcttctgcacaacgtctgttctcggtactagatagtcctgatgagcttgatactggcagacgaccgttggggcgtgccagaggattaatcgagttccgcgggatcaccgcacgctatcctggtcggtctgctcccgtgctggatagtgtcagctttgttgctgcaccgggcacggtcactgcgattgttggtcgttcaggaagcggtaagtcaagtttaatcaagttgattccgcgtttttacgagccggagtctgggcagatattgttggatggccatccattacaggattatcttttagctgatctgcgccgtcagattgcattggtaggacagcaggtcatgttgttcgatggcagcatcgcggaaaatattgcttatggtgagatgcatcaggtcgtttctgagcagattgaacgtgtcgtggttgatgcaaacgctcaggattttgtgaatcaacttccagagggattacagtttcaggttggggttaagggggggcgtctttctgggggacaacgtcagcgtttggccattgcgcgcgcgatgctgaaggatgcgccgattcttatcctggacgaggccacggctgcgcttgataacgaatctgagcgcttagtgcaggatgcgttgcagcgcttgatgccggagcgcaccacacttgtgattgcgcatcgactgtcaacgatcaagcatgcggatcaggtgttggtgatggaccaggggcgcatcattgagtctggtacccatgtcgatctgttggcacgtgatgggttgtacgcttatttgtacagcatgcaattt

SEQ ID NO: 33188 - DNA, 771 bp, Xylella fastidiosa
acccaatcccgttggcgtttggatggtcgtacggctttgatcacgggggctagtacaggtatcggtctggctgttgctcgtgagttgttgggcctgggtgccgatgtgctgttggtagcgcgtgatgctgatttgctgggacgagtacgcgatgaactggcagaggaattccctgagcgtgagttacatggattggctgctgatgttgctgacgatgtggaccgccgtgcgattctggattgggtcgaagattgcagtaatggtttgcatgtgttgatcaacaatgctggtggcaatgtgacgcgtgcagcgcttgaatatacagaagacgagtggcgtgagattttcgagatcaatctgttctctgcgttcgagttgtgtcgttacacgcagccgttgctggcgtgtcatgcaagtacggcgattgtcaatattggcagtgtatctggcttgacgcatgtgcgcagtggagtgccgtatgggatgagcaaggcggcgttgcaccaaatgacccgcaatttggctgtggaatgggctgaggatgggatccgtgtcaatgcggtagcgccttggtatatccgtacgcgtcgtacgtcggagccgctctctgatgtgtgctattacgagcaagtcattgaacgtacgccgatgcgtcgcattggagagccggaggaagtggctgcggcagtggcatttctttgtttgccagcgtccagttatgtgaccggcgaatgtattgcggtggatggcggttttatgcgctatggtttc

SEQ ID NO: 33189 - DNA, 966 bp, Xylella fastidiosa
aaaatcctcgttaccggagggagtgggttcctcggcgaagcactatgccgaggattacttaagcgtggctaccaagtacttagtttccaacgtagtcactaccaagcactgcaagcactaggcgttgtgcagatttgcggcgatctgagcgattttcacgcggtgcggcacgcagtgcgtggtgtggatgcggttttccataatgctgccaaggtaggtgcatggggttcctacactagttaccaccaaatcaatgtgatcggcacacaacacgttctggatgcctgtcgtgctgagaacattagcaagttagtgtacacctcaaccccgagtgtgattcatcgctcaaactaccctgttgagggtttagatgcagatcaagtgccatatagcaacgccgttaaagtgccatacgctgcgactaaagcaatggctgaacaggcggtgttagcagccaacagtgtcgacttaaccaccgtggcactacgcccacgcatgatatggggcccaggcgaccctcacttgatgcctcgcttagtggcgcgcgcccgcgctgggcgactgcgtctgatcggcgatggtcgtaacttggtagatagcacctacattgacaatgccgcacaagcacatttcgatgcgtttgagcatctcatgcctggagcagcgtgtgctggcaaggcttatttcatctccaacggtgagccattgcagatgcgcgaattgatcaacaagctactggccactgccaacgctccaccggtgactcaatcactgtcatttaagacgggttactgcattggtgcattttgcgagatgctatggtcgttactacccctccctggagaaccactgctaacgcgttttctcgttgagcagatgtctactcctcattggtacagcatagaaccagcaaagcgtgacttcgggtacgtgccgcgcgtgtccattgaagagggcttggtacgt

SEQ ID NO: 33190 - DNA, 1260 bp, Xylella fastidiosa
atgaacttcgaaactttgggattgttgccttccttacttcgtgctcttagcgagcaaggttacgaaatcccgaccccaattcagcagcaggcgattccattggcattagctggccacgatttgcttgctgccgcgcaaacagggacaggtaagacggctgcgttcggcttgcctgtattgcaacgattgatggccgcttcatctaatgttggtgccggtaagccgcgtgctttggtgctgacaccgacccgtgagcttgcgactcaggtccacgacagcctacgtggttacgccaagtatcaacgtgtatcaagtgcggtgatttatggtggtgtggggatggggaatcagttggatgtgctgcgccgtggcgtagatttgttgattgcctgcccgggtcgtttgattgatcatattgaacgtcgcagtgtggatttgtcaggcgtcgggattttggtattagatgaggctgatcgcatgcttgacatgggtttcctccactcaattaaacgtatccttggcaaactaccgcggcagaatcgccaaactctgctgttctctgcgacatttgctgagccgattaaacagttggcgttagagtttatgtgccgcccacgcgaggtgatggtggcgtcgcataacaccgttgctgagaccattacgcatcgtgtgcatccggtcgatgttagccgcaagcgtgaattgttgttgtatctgttggctcaagatagcagggagcagacactggtgttcgtgcggaccaagcatggcagtgacaagcttgctacgttcttggagaaatatggaatcaagacagcggcgattcacggtaataagactcagggccagcgtctgcgtgcattaaacagtttcaaagcagggcgagttaccgtgctggtggccactgacattgctgcgcgcggaattgatattgaccaattgccaaaggtgatcaattacgatttgcctatggtggctgaggattatgtgcatcgcatcgggcgtactggacgcaatggtgtgcagggagaggcaatttcattagtcactcaggaggacgctaagttattgcgtcagatcgtgcgtttgcttgatcgtgacatggatattcgcgatgtaccggatttcgaacctcaagtcccgatccgttggggtaacagtgctccgggaaagagtaagcagcctgctggacagcacccaccacgtaagagtcaacatcggcgagcattcggcaaagcatctgtgcatacgacgcctgct

SEQ ID NO: 33191 - DNA, 1365 bp, Xylella fastidiosa
cgacaacgcgatttgcgcgtcctgtggcatccgtgcacgcaaatgcgtgagcatcccgacacactgccattagtgcctatcgtccgtggtgagggtgcgtggttggtcggtcacgatgggcgtcgttacctggatgctgtcagcagttggtggacaaatcttttcggtcatgcagatccccgtatcagtgcagcaatcgccgcacaggccaggacgcttgagcacgtgatgttggctggtttcagccatgagccggcggtgcgtctggccgaggccttgttgcggctcgcgccgcgccaggacgggcgtgagcccttgtcaaaggtgttttacgctgacaatggctcggctggggtggaagtcgcgctgaaaatggctttccattacttccgtaatcgtggtgaagagcaacgtacgcgatttatcgcgttacataacgggtatcacggagaaaccattggtgctctcgcggttggcgatatccccttgtaccggcgtgtttatgctccattgctaacggaggtattgtttgcgccctctcctgatgcctatttggccgaaccaggtcaaagcgccgcagaatatgcattacaggccgccgaagcgttggaagcgctgttcaaacgttactcggggcaaatctgcgcgctgattttagagccacttttacaatgtgcaggtggcatgcgcatgcaccatccggtgtacctacatcgtgtgcgggaactatgcgatgcacacggtgcgttgctgatttgcgatgagattgctacagggttcggacgcactggcacgctcttcgcttgcgagcaggcttgccccgccatctcaacggatactgatgacaaggagcttggcatcatgccggacctgttgtgtctgtccaaggggctgacgggtggtttcctacctctggccgcagtgctgacaacgcagcaattgtacgaggaatttctcgatgacagccgcgaacgcgcttttctgcattcacacagctacacaggaaatccactggcttgtattgcagcgctaacgacactggatatcttcgaaaatgattgcatcatcgaacgcaaccaagtcactgcagcacgtatgacgcaattggctgcgtcactgtcagggcatccgcacgttgctgacgtgcgccagacggggatggtcgtggcatttgagttgactcgtgacggcaacaagcggacaccattcccgccacaggcacggcttggcttgcacgtttaccgtgctgcgctggcgcgtggagtgatcctgcgtccgcttggcgatgtggtgtattggatgcctccctattgcgtggatgaggagcaactgcatctgcttgctgagaccacgcgtgtggcaatt

SEQ ID NO: 33192 - DNA, 387 bp, Xylella fastidiosa
atgagcgatatccctggcgacctcaagttcctcaaatcccacgaatgggtccggatcgaagacaacaatcgtgccatcgttggcatttccgaccatgcacaaaatctgctcggtgatctggtgtatgtcgaattacccaatattggcgatcacctggacgctggcgctaccgctgcagtcattgagtcggtcaaggcagcctcagatatctacagcccagttaccggaaaagtgattgaagtcaatactacgttaagcgacaaacctgagacgatcaatgaagatccctacggtgaaggttggattatggtcattgagatgcaagcccctgaggaaatcagtgatctactttctcccgatgattacaccgaagtgctggaaagtgac

SEQ ID NO: 33193 - DNA, 2060 bp, Xylella fastidiosa
gttactaccagcaatccactgttaacggccagttccttaccgttccaagcgccaccgttcgataaaattaaggacagcgattatttacccgcgttcgaggagggaatgaagcaacatctggctgaaatcaccaagattgctgagaatcccgatgcaccaaccttcgaaaacactatcgaaatgctggagcacagcggcacaaccttggatagggtctcacgaatctttttcggtctagtacatgctgacaccaatgatacgcgccaaaagattcaggaagaaatcgcgcctaagctggctgcacaccaggatgagatttatttgaatcccaagctgttcactcggatcaagtcaatttacgatcagcgtgacacgcttagtttggacccattacagaaacgtttggtcgaacgtgattatgaaggattcgtacatgccggcgctcagttgcctgaagcagataaaacaactttacgtaaaatcaacgtagaagagagcacgctgtccacacagtttcacgctaagctggtcgccgccacagcggcaagtgcaattgtggttgatgaaaaaaataaacttgatggactgagcgagggcgacattgctgcagcagcggaggctgccaaggcgcgtaagctcaatgacaagtacgtactcgcattacaaaataccactcaacaacctatatcagcttcgctgaaggatcgtgagttacgtgctcaggtgttacaagcttcagaaactagggccgaaaaaggtgacgctaacgatacccgccaaatcgtgcagcgcctgactcagttacgtgcacaaaaagccaagttactcggtttcccaaactatgccgcttataacttggcagatcagatggcaaagacccctgaagcagcgttaaaactactcaacgataccgtgcctgcggctactgcgaaagcacgtaaagaggctgccgaaattcaaaaattgattgataagcaacgtgtcaatactaaagcgaatcactttgaattggttgcctctgactgggatttctatgcggagcaggtgcgcaaagccaagtacaatttggatgaagagcaaatcaaaccgtattttgagctcgacaacgtgctgcaaaacggtgttttctacgccgccaatcagctatacgggatcacttttaaggagcgcaaagatataccaacttaccatccggacatgaaggtttacgaggtgtttgaccatgacggcagctcgttggcactgttctacactgattactttaaacgtgacagtaaatccggtggtgcgtggatggatgtgttcgttgaacaaaatgcgatcaccgggaccaaacccgtggtctacaacgtctgcaactttactaagcctgcgcctggccagccggcactattgagcttcaaagacgtgaccatcctcttccacgagtttggccatgcgttacacgggatgttttcgaaagtgaagtatccttcgttggcaggcacctcaacatcacgcgattttgttgaattcccgtcgcaattcaacgaacactgggcctctgatccaaatgtgttttcacattatgccaagcactatccaaaccggtgagtccatgccgcagagtttggtggacagtattcgcaaggcaaaacactttcaaccagggttacgtaactaccgagtacctttcagccgcacttctagacttggcttggcataccttaccagccgatgcgccactagaggatgtggagaaattcgaagccgatgcactgaagaagtacaaggtcaatctgaaagaagtgccgccacgctatcgcactagctattttgaccatatttggagtggaggctattcggcaagctattatgcttacttctggtctgaagtgctgagtgatgacgcattcgagtggtttaagcagcacggtggtctagaccgtaagaatggcgatatattccgcgacaaaattctctcgcgtggcaacagcattgagttgggcgatttgtatcggcagttccgcggccagaacccgagtgtgcaaccactgttagataaccgtgggttaaaataa

SEQ ID NO: 33194 - DNA, 606 bp, Xylella fastidiosa
gatgaatctcgcgtaggacgtactgaaccattgccattggataatcgccattacgtcaatggccatccactatgcgatgccttcacgggtttggcgcagatccaatttggattaggctgtttttggggtgctgaacgtctgttttggcaattgcctggagtattcagtacagcagcaggttatgctggcggcggggtgccatatccgacttatcgtgaagtctgttctggggagacgggtcatgcagaggttgtcttggtagtgtatgaccacactgttatttcatttgagcagttgttgcagacattttgggaatcccatgatcccacccaagggatgcgtcagggcaatgatatcggtacccagtaccgttctgtgatccattgcactacatctgagcaatatgctgcagcatcagccagccgagaggtttaccagcaacaactaaatactgctggttacactgcaattacgacagagatactccatccggcaccacctttctactatgctgagaatgagcaccaacaatatcttgcaaaacatcccaacggctattgcggactgggagggactggagtgacctgcgcgattcgcttgcaggtt

SEQ ID NO: 33195 - DNA, 1110 bp, Xylella fastidiosa
ttttccaagttattcctcaatatgatcttcatgctgattgtgcccttgatgttctcggcactcgtggtcggcgtggccgaaatgggggacatcagcacactcggtcgcatcggttggcgtaccctgggttataccgttgtgctctcatccgtggctgtgttaatcggattggtgcttgtcaacgtactcaaaccaggtgtgggtgtcgatccgcagttggcgcagcagctgcttagtgaaaatgcggagcgtagccgccagatcgtcgcttccacagatacccagatccacggcatggatatgctgttatcaatcgtaccgagcaacgtggtcgcagcggcttccagcaacgatgccattttatcgctgatgttcttcgcgatcatgtttggcattggtatggttctggtgccgcaggagaaggtagagacactgaagcgtgctattgagggtgtatttgaagtttcgatggtcttgattggactggtgatccgtcttgcaccctatgcagtagcctgctttatgttcaacttgacgtcgttattcggcctagagttgttgatacggttggcggcttatgtcggtgttgtggtcctggggttgtcgctgcatatgtttgttacttatggtttagcagtatggtgggcggggcgttcaccgctgcgttttttccgcgaaactcaagaggcaaccttgatggcgttctctacagcctctagcaatgccactttgccaaccgcgctgcgtgttgctgacgatatgaagctaccgaagcaaatttcgcgtttcgtactgaccattggtgcaactgctaatcaaaatggcacggcattgtttgaaggtttgaccgtcattttcctggcgcaatttttcggtgtggacctcagttttagtcagcaagcgatggtcatggcattatgcatcctgggtggcatcggcaccgctggtgtaccgtccggctcgcttccagtggtggcactcatctgtgccatggtcggggttgatcctgtcggtattgggctgattttgggggtgaaccacttcctggacatgtgccgcactgcattaaatgtgactggtgatctagcattgactacattggtgtgcaga

SEQ ID NO: 33196 - DNA, 1986 bp, Xylella fastidiosa
acacgccgccagttggccaacgcaatccgtttccttgcagctgatgcagtacaagctgctcattctgggcacccgggcatgccgatgggaatggcagatatcgctgaagttctttggaacgatttcctacgccataaccctaacaacccgaactggtttaaccgtgaccgcttcgttctttccaacggtcacggctcgatgttgcaatatgcattgctgcatttaagtggctatgacctgccgttagatgaactcaagcgattccgtcagctgcatagcaaaacagctggtcatcctgagcgtagcgagaccccagggattgagacgactactgggccgcttggtcaggggtttgctaacgcagtgggttttgccttggccgagaaacttctagcgcaacgctacaaccgtccggaacatctcattgtcgatcaccgcacctgggtgttcatgggcgacggctgtctcatggaaggtatctcacatgaagcagccgcgctggcgggtacctggaacttaggcaaattgatttgtttctgggatgacaacaacatttctattgatggcaatactgcgggttggtttaccgaagacactccagcacgattcgaagcctatggttggcatgtaatccgcgatattgatggccatgatgcggaaaaaatcgcaaccgcaatccaagccgccgttgctcaagagaacaagccctcattgctatgctgccgtaccgtgatcggatttggctcaccaaataaagcaggtaaagaatcttcgcatggtgccccactaggagcggaggaactggaggccacgcgtaagatgttggattggccatacggcccgttcgagattccgtccgagatttacgatggttggcgtgctaacggcacaggcatgctacgtcaagctgagtgggagcaggcgttcgacaactatgcccgacagtatcctaaggaagcagctgaattaacccggcgctcccacgctgagttacctactgattttctcagccaattggatgcttacattgccaaagttcacgctgcggggccctgcattgcttcccgtaaagcatcgcagatggcgattgaagcatttgcacctttacttcccgagttaattggtggctcggctgacttggcacattccaatctaacgttgtggaaagggagccaaacagttgttggcgacgcccccaacgccaactatgcctattacggcgtacgtgagtttgggatgagtgccatcgcaaatggacttgcattgcatggcggctttatccccttcgacgcgacatttctagtattcagtgattacgcccgcaacgcagtgcgtatgagtgcattgatcccagcacatgtgattcacgtttacacacatgattcaatcggacttggcgaagacggtccaacgcatcagcctgttgaacacttagccgcactgcgctatatccccaacaatgacgtgtggcgtccctgtgacgcagttgaatctgcagtggcatggaaggcggcgatcactcgcaataacggcccgagctgtttggtgttcagccgccaaaacttgccgcaccaaccgcgccatgatgcacaacttgagcagattgcacgcggtggctatatcttggctgacgcggcgagcagcatccccgacatcattttgatcgcgaccggctcggaagtcagcctagcgatcgaagcgaaaaagacacttgatgcgatgcagctaaaaacacgcgtggtctcgatgccatcgaccaatgtgtttgaacgtcagcaccccacctaccgtgagtcggtcctcccatcgaaagtccacaagcgtgttgcaatagaagctggcgtcactggtttttggtggcagtacgtagggttacatggtgccgtgattggcctggacacctttggtgcatcagccccagcggatgtgttgtacaaacattttaatatcactgcagaacacgttgtcgaagtcgcaaaggcactt

SEQ ID NO: 33197 - DNA, 777 bp, Xylella fastidiosa
ttttttaatatgaaaatgcgtattgcaagttggaacgttaattcactcaatgtgcgtttgtctcagttgcagcagtggctggtggaggctgcgcctgatgtgcttggccttcaggaaacgaagttggaggaccatcagtttccaggagcagcgttggcggcattgggctatgtcagtgtgtatgcagggcagaagacgtataacggtgtcgcacttctggcgcgcgtggcgttggaggatgtgcaagtcggtatcccggagttcgaggatgtgcagcgacgggtgatcgctgcaactgtggatgggatacgcgttgtcaatctatacgtggttaatggtcaagaggttgggacagagaagtacgcttacaaattaagctggttagatgcggtgtaccactggctggccgaggagctgcaacgctatccccgccttgtggttctgggtgatttcaatattgctcctgatgcccgggacgtctacgatccgcaggtatggaatgaggatcatattctcacttcgaccacggaacgtgcggcactggataagctgttaggactggggttgcatgatggttttcgcttgcatcaccaggatgcggggatattcagttggtgggattaccggcaagctagtttccggcgtaataggggcttacgtattgatctcacgcttgtttcggaggcgttgcgcgcgcaggcggtggcttctggaatcgaccgcgtgcctagaggctgggaacgacccagtgatcatgctccagcgtggattgaatta

SEQ ID NO: 33198 - DNA, 1443 bp, Xylella fastidiosa
atcatcgttggtagcgggcttgctggtctgatcgcagcactgaccatttctcctgaaccctcagtgcttgtcacgcgcagcgccttgggcgcagaaacatcaagcgcgtgggctcagggaggaatgtcggtcagccttagccccgatgacaaccccagcctgcatcttgccgacaccttggcggctggcgatggtctgtgtgatgcagtagctgcagagagcatcatcttggaagcgcttgacgcttttcatgtcctacaacactttggcatccacttcgaccaagatagcaacggccatctggcgcttggactggaagcagcccattcccgtcgccgtatcgtgcatgttgggggcgatagatcgggcacagcgattgtaaaagcattgactgcctgtgttctcaacgatccctcaatcacggtgcttgagggcctcgaagcacgacacattctgatggctgataacgtggtctgtggcttgctgcttgccaacccgacatccgagattgtgttgccctcctcaagaattcttctgacaacaggcggcattggtgggctttatgacgcgaccaccaacccggtgagcaactttggtcaaggcatcgcgatagctgcacgtgctggcgccgtactggctgatatggaattcgtacagttccatccgacggccctccattgccacaatcgcccgctggcgctcgtcagcgaagctgtccgtggtgaaggtgcagtcctcattaacgaacgtggcgaacgctttatggcggatattcctggtgccgaacttgcagctcgtaacatcgttgcacaggcaatcagcgccgaaataacccgcggcggccaagtatttctcgatgccaggcaagcattgggagcacgcttcagcacccgctttccaaccatcaccgcactctgccacaaagtaggtattgaccctgtacacatgccgattccagtctgtcccgctgctcattaccacatgggcggtatcgcaaccgatcgccaaggccgcagcagcattcctggcttatgggttgcgggtgaagcagcgtctacaggcttacatggagcaaatcggcttgcgagcaattcactgcttgaagccgtcgtcatggggacacgtgcagcccgagatatcacatcccacaacacacacacacccctcggaacaatccctatcacccctaaaaagcctgataccacacttatccggccgattgtctctcagtgccttggcgtacttcgccatgccgcggatatgcatcgtgctattgctgccctattgccttttgtggaaggcgaaaaagagtcttccgatcccgccattgttgcgttgctgatcgccatctttgcacatcttcgcaccgaatcacgcggtgcccatgcacgcaccgatttccctctcaaacatgacacaacacagcggcgcaacatgacactt

SEQ ID NO: 33199 - DNA, 1245 bp, Xylella fastidiosa
gtggtcgcgggttttgtactcggggctctagttggttgggtgatgggaccggccgccaaaacttggtttggaccattgggcacactgtatgtcacgttgatcaagatgatcgcaataccgctggtgttcttcgcggtgattaacgcgattgcggcgctgcacggacaacggtcggtcgccatgttgggcggacgcacgtttctgtggtttatcgtcaccgcagtcttggcggtgtgtgtgggattgggtgtgggcacgttgctgaaacccggtaatggtgacttcactgtgagtgtggatgcggcatgggcgccaccagatgtgccgagtccggtgcatgtgttgctggatgtggtgccatccaatccgttttatgcattgaccggcatcgggactcgcagtaataacacgggggaaacgacgttggcggccggacgtggctcaattcttccagtaatctttttcgcggcgctgttgggcttggccattgtcaagcttggggaacgcgtgacggaggtacgcaagctgatcgggcagatgagcgagatcatgatccaaatcactcgctttgtgctggagatgacgccactggggacctttggattaatcgctgcgttagtcggtagctatggttttcagaagttgctgcctttcggtcactttgtattggcactttatttggcatgtgcgttgcacattgtggtggtgtacagcgggcttctgctggcacatggtttgagtccattgaagtttttcaggggtgtcgcgccagggatgcaggtcgcttttgtcagttcttccagctttgctgcgatgccagtggcgttacgcgcgattacgcacaatctgggggttaacaaggactacgctgcatttgctgtgccgctgggtagtagcatcaagatggacggttgcggggcgatctttccagcgttgtgtgcggtgttcatcgctcagtacaccggggtgccgctgaccacgaatcaatatttcgtcatttttatcgcatcggtactcggcagttttggcacggccggggtgccaggtacggcagtggtgatggcaaccgtggtgctgagtgcagctcatttgccgctggaggtgattggttatctgtatgccatcgatcgcgtgttagacatgatgcgcacaatgacaaacgtcaccggacagatgttggtgccggtgctggtggcaaaagaaacgggattactgaatacagcggtttacgaggcagcgtccagt

SEQ ID NO: 33200 - DNA, 828 bp, Xylella fastidiosa
caacgcaccgacagctacttagaacgaacgttatccatcctcacccaagcgccacagcggctccacgccgcgatgcgatacaccgtactgagtggcggcaaacgcatccgtcccttactggtttacgctgccggccacctgtttcatgtcgatgaacccctactcgacgtaccggctgcggccgtggaactgatccatgcctattccctggtgcatgatgaccttcccgccatggatgacgacctcttacgccgagggcgtcccaccgtccatatcgccttcgacgaagccactgcaatcctcactggcgacgccttgcagaccctggcgtttgaatgcttagccgatgccccagccgacgcctccctgcgtatcgcctggttacagacattgacacacgccgcaggagttgccggcatgtgtggcggccaggcactagatattgacgccactggccaatcccagacactcaaagcactggaagccatgcatgcgttgaagagcggcacattgatgcgagccgccgtgagaatgggtgccctggctggcgacccttccccggaggatctgcactccctggacacctttgcggccacccttggattagcattccaagtgcgtgacgacatcctggatatcgagtctagttccgaacaacttggtaaaacgactggcaaagatgccatacagcagaaatccaccttccccgccctcctgagcgtagaaggtgccaaatgctatttacaagaattggcagaacgcctgtacacccaattgcatccttacggcgaacgtgctgcccccctgaccgcactggcacgcttggct

SEQ ID NO: 33201 - DNA, 915 bp, Xylella fastidiosa
ttcgctttcgtttttccaggtcagggttctcagtctcttggcatgctttccgagtttgctgtgctctatccggagattctcgatactttcgctgaggcatctgagggagctggtgtggatctttggacgttgtcgcaacgtgggcctgaggagatgttgaaccgtactgagtacactcagccagcgttgttggccgccagtgtggcgctatggagactttggcaggctcgcggtggtcgtgcaccggatctgcttgctggtcacagtttgggggagtacagcgctttggtagcggctggtgcattgtcattgaaggatggtgcttatttggtaaggttgcgcggtcagttaatgcaggatgcggttgctgtgggtgtcggtgcgatggccgctgtccttggtgctgaggatgctttggtggctgaggtctgtgcgcaggttgcgggaagcgagattgtcgtcgcagccaattttaattcgccggggcaggtggtgattggtggtcatgccacggcggttgatcgtgcgctggtgttgttggcagaacgtggtgtgtctaaaacagtcaagttggcagtgagtgtgccgtcgcatacgccactgatgcgtgatgctgcgcatcgtctcgctgaggcgatgcttgggttggttttgaaggtgccgcagattccggtagtgcagaatgttgatggcagagtgcatgacggtgttgaagcgatccgtgaggccctggtcaagcagctttatttgccagttcagtggacggattgtgtgagagagttggccacatgtggtgtggtacgtatcgctgagtgtggtcctggtaaggtgctgatgggactcattaggcgtatcgataaaacattggatgtgcgttcgttggcgactccaacggggttctctgatgtcttggac

SEQ ID NO: 33202 - DNA, 726 bp, Xylella fastidiosa
ttacagggtgaggttgcgttagtgactggtgctagccgtggcatcggtgctgcagtggctgatcttttggctgatcatggggctaccgtgattggtacggcaacgtctgcttctggtgcgcagttaattggtgatcgtttggccttgctgggtggtcatggtcgcgctctggatgtgaccgatactgctgcagttggtgcattggtagaggagattgctgaacaattcggttcggtctcgattctggttaataatgctggtatcacacgagacaatctgttgatgcggatgaaggatgaggattgggagtccattgtcgacactaatctgagcagtatttttcgtaccagcagggcggtggttcgcaacatgatgaaggcgcgcaagggccgtatcatcaacattgcttcggttgttggcgtgactggtaatgccggtcaggcaaactatgctgcggccaaagctggtgtgattgggtttaccaagtcactggctaaggaagttggcccacgtgggatcactgtcaacgtggtcgctccggggtttatcgataccgacatgactcgtgtgctgtctgagggtgtacgcaatgatatccttaaccacgtcccgcttggtcatttaggtgatccggtggatattgcgaacgcggtcgcttttctggctgccccagcagcacgctacattactggtgagacattacatgtcaacggtggtatgtatatg

SEQ ID NO: 33203 - DNA, 219 bp, Xylella fastidiosa
atgagtgacatcgaagcgcgcgtcagaaaaattgtcgccgagaaactcaatgtcgatgaagaaaaagtaactaatacctcgacgttcgtcgatgaactgggtgcggattcgttggataccgtcgagttggtgatggccctggaagacgagttccaatgtgagatcggtgacgaggctgctgagaagatgacttcggtgcaacatgctatcgactacatt

SEQ ID NO: 33204 - DNA, 1227 bp, Xylella fastidiosa
cgtcgggttgtcgttactgggatggggatggtgtcgccgttgggcaatgatttgaccacaagttgggatggcatcgttcacggacgttcgggtatcgctcccatcgtccagattgatgcttctaagttccccactcagattgctggcgaaatcaagggattcgatccaatgaagttcgtatccgcaaaggatgcgaagaaaatggattcgttcatttactatggtataggcgcagcatttatggcgctggatgatgctggtttggagattaatgagatcaatgctgagcgtgttggtgccttgattggttctggtattggtggcgtgtttggcattgaagagcagaccatcaagctctatgaggggggcgcacgcaagatatctcctttctatgtgccagcgacgatcatcaacatgctgccaggacagttgagtgttttgaaaggcttgaaaggcccgacgttctctgcggtatctgcctgcgcgacttcaaaccactccattggtatggcaatgcgcatgatccagtatggtgatgctgatgttatgttggctggtggttctgagcgcgcttcttcgccaactgcgattggtggcttttgtgcgatgagggcgatgtctacgcgtaacgatgatccaaccggcgcttcgcggccgtgggacaaggggcgcgatggctttgtgcttggtgatggtgccggcattctagtgctggaagagtatgagtatgctaaagcgcgaggcgcacgcatctatgctgaattggctggtttcggcgccacttccgatgccttccacatgacgatgccggtcgaggatggtgaaggtgcagcgcgttgtatgcgtatagcgttgcaggatgcgaaggtcactccggagcaaattgattatctcaatgcacacggtacctcaactcctttgggcgatctgtgcgaaaccaacgcgatcaaaacggtattaggagatcatgcctacaaagtgatggttagctcgaccaaatcaatgaccggacatctactcggtgcggccggtggtgtggaagcaattttctcagtgatggcgttgcatactggcatcgttccgccgacgattaatctcgaagaaccagacgaaggctgtgatcttgattacgtgccgcatgtggcgcgtgaggccaaactggatgtggtggtttcaaacggttttggttttggtggtactaacggcacattagtgttcaagcgtata

SEQ ID NO: 33205 - DNA, 1668 bp, Xylella fastidiosa
ttctccggatggctgattgcgttggcggtctcctcggcagcaacgctgaccctaccaagcgccttcaaacaaatgattgaccacggtttttccagcgaggggcaaatcaatcgaacctttgctctactgttgttagtcgccgtgattctggcagtaggtacagcagcgcgcctgttctccgtctcgctactgggcgagaagatcatcaccgacctgcgtagccagttatacgcacacctcataggattggatgccagctttcacgatcgtaatcgcagcaacgagctggtgtcgcgtctggccacagacagtgaactgctacgctcaatcattggatccacaatgtcagtagcgacgcgtagcaccgtgactgcaatcggcagtctcatcatgttattcatcaccagtccacgcctcgccagcctttcgctggtggtcatcccactcgtgatacttcccattgtcttaggcgcacaacagctccagaaagccgcccgtaccagccaggatcgcattgccgacaccaatagcttcgctgctgaaacattacgtgctttacgtacagtgcaagcctatgcacgtgaacattacgaacgtacacgcttcgaccgcacactggaaacgagtttgcaggccgcgcgacaacgcattcacatccaaacatgggtcaccgctgcaagcatcgtgttgatattcagtgcaatcgtcggagtgttatgggcaggtgcacatgatgtcattgctggccgtatgagcgcgggcacactcggtgaatttgtcctatacgcactgatcggcggtggttccatcggcgcccttgccgaagtgtggaacgaactacaacgtgccgctggtggcatgggccggattttcgaattactcaaagagaaaaacacgctcaccgtaccagccacacctgccttgccaccccatccattgcggggagaaatccgctttgaacgtgtcggcttccactatccacaacgcccagaaacacctgcacttgatgacattgacctgcatatacgcccgggggaaaccatcgcttttgtcggcccatccggtgctggcaaaagcaccctgatatcactattactacgcttctatgatcccacccatggacgcatcctgattgatggtgtggacctacgccaaaccgatccgaaagtattacggacacacattgcactggtacaacaacaaccaacactgttcaccgcgagcgcaatggaaaatatacgctatggacgactggacgccaccactgccgaaattgagatcgctgcacgctcttccgaagcagatggtttcatccgcgccctgccacagggttatgccaccgagctaggcgagcacggcctgtccctgtccggcggccagcagcaacgtatcgcaatcgctcgcgcactcctcaaggaggcgccgattctactccttgatgaagcgaccaacgcacttgatgcacaaaacgagcaagcagtacaacaggcactggaacgactgatgacagggcgcaccacattgatcattgcacaccgcttggtcaccatcctgaaagctgaccggatcgtggtgatggaccaagggcggatcgtcgctcaaggcacccacagcgaactcatcgccgctggaggcctatacgcaaagctcgcacgcctacaattcata

SEQ ID NO: 33206 - DNA, 1064 bp, Xylella fastidiosa
ccgcgctttggacagctagctggcgctcccccttttcagttcggaattcaactctcatgacgcaaacaattacggtgatccgcggtgatggtattggcccggaaatcatggatgccaccctgtcggtattaaacgcgttacaagcgaatctgaattacgaattcgcagatgcaggcttgagcgcacttgaaaaacacggagacttgctaccggaagccaccctaaattcaatcagcaagaacaaaatcgcgctaaaaagcccgctcacaaccccggtaggtgaaggtttcagctcgatcaatgtcgccctgcgacgtaaattcgacttatacgccaacgttcgccccgcaaaatctttcccaaataccaagtcacgctttagcgataacgtagacctgatcaccgtacgggaaaataccgagggtgcctacctgagcgagggtcaaaccatctctcctgacggagaagttgccacttcaagcgcacgagtgacccgtaaagggtcggaacgcatcgtccgttacgcattcgacttagcccgaacaacgggccgcaaaaaggtcaccgcagtacacaaagccaacatcattaaatcaacctctggactatttctgaaaaccgcccgagacgtcgcaagccagtacccagaaatcgatttccaagaaatgatcgtcgacaacacttgcatgcaacttgtgatgcgcccagaacaattcgacatcattgtcaccacaaacttgttcggtgacatcctctcagatttgtgcgcaggcttggtcggcggtttaggcttggctccgggcgccaacattggtaatgaacaagccatcttcgaagccgtacatggctcggctccagacatcgctggacaaggtaaagccaatccatgcgcgctgctgctaggtgctgtacaaatgctggatcatatcggtcaaccacaaaacgccgaacgcctacgcaacgcaatcgtggccacactgaatgccaaagactcgctgactcccgatctggggggtaacggcaacaccatgggattcgccaaggcaattgccagcagactctaa

SEQ ID NO: 33207 - DNA, 1017 bp, Xylella fastidiosa
atgtgtaataaaagcgcggtcattacgggtattacaggacaggatggtgcttatttagcgcagttgctcctcgaaatgggttatgtggtttatggtacgtatcgtcgttctagctcattgaacttctggcgtattaatgaacttgggattgcacagcatcccaatttacatctggtcgaatatgatttgaccgatctctcttcgagtgtgcgactgctcgaattggccgctcctaaagaggtctataatcttgccgcacagagctttgttggcgtctcttttgaccagccattgaccacgaccgatattaccggagtgggtgcggtcaacctgttggaagccattcggattgttaatcctaagattcgcttctatcaggcatcgacttctgagatgtttggaaaagtccagcagactccgcagattgaggaaacgcctttctatccgcgtagcccatacggtattgccaagttgtatgctcactggatgacggttaattatcgtgagtcgtacggtatctttgctgctagtggtattttgtttaatcacgaatcgccgttgcgagcgcgtgattttgtcactcgtaaaatcactcatgcgattgccatgattaaattagggaagctagacgtattagagcttggtaatttggatgccaaacgtgattggggttttgcgaaggaatatgttgagggaatgtggcgtatgcttcaggctgatgagccagatactttcgtgctggcaaccaaccgaactgaaactgtgcgtgatttcgtcagcttggctgccagtgccgttgatatccagttggagtggaagggacaagccgaacgggaatgtggtgttgatgttgcatcgggaaaaactttagtcacaatcaatcctaagttttatcgaccggctgaggtggatttgttgatcggtaatccggccaaagctagaacgaagctgggttgggaaccaaagaccacacttgaggagctttgtcacatgatgatggaagcagatgtgcgccgc

SEQ ID NO: 33208 - DNA, 1933 bp, Xylella fastidiosa
ctgacctatcgcgatgccggagtcgacatcgacgctggtaatgcacttgtcgaacggatcaagccattggtgaaacgcagcttccggcccgaagtcatgagtggactgggcggctttggtgcattgttcaacctagcaggcaaatacaaagaacctgtgttggtctccggaacggacggagttggcaccaaattgaagttggcacagcaattgaaccgacacaatacgatcggaattgatttagtggcgatgtgcgttaacgacgtcctggtacagggcgccgaacccttgttcttcctggactactttgcaaccggcaaacttgatatagacaccgccacggcagtcatcagcggtatcgcactaggctgcgagcaatccggctgcgcactgatcggcggtgaaaccgccgaaatgccagacatgtatccacccggagaatacgatctagcaggcttctgtgtcgctgctgtcgaaaaatcgcaactcctggatggcagccaagtacgcgaaggcgatgtcctcatcggcattgcctcctcaggtccacactcaaatggctattcattgatccgacgtatctatgagcgtgccggatcacctgccgacctggatatccacggaacccgcctaatcgacacattaatggcgcccaccacgttatacgtcaaaccaatactgaaacttctacacacccacagcgacgcaatccacgcaatggcccacatcaccggcggcggcttgacagagaacatcatccgcgtgattccacccaacctgggtttgcgcatcgatgccaacgcgtggacacaaccgcccgtgttccaatggctacagcgcgaaggcgcgctagccgataccgaaatgtggcgcacttttaactgtggcatcggcttcgtattagtcgccacacccaaccaggtagcccccctaggacaagcacttgacaaccaaggcttggcacactggcagataggccgggtcgttacccctgttggcaatgagcgggtacacatcgactgaagtgacaacaactaaagacatccacaccacaccccactgaggtatccctgctgcctcagcatcgacctcatccctacctcacaacaacacgtgatcttgcttgcactaaaataatactgatcgtcacaccaacggtactcatccatacctgcttgcgttcccctgcatcaacgcagctgagttgcctcaagccattgcgttgctgccttggtgactgcaacaaccagcaaagccattactggacacacactggcacactaccagccacacttggctactcttgccctttaccctaactcaggaaatccactgtttgacctcaccctcctcccctttacgcctcgccatcctggcctcaggacgcggcagcaatctgcaagccatccttgatgccatcgcgaccgaccgactgcatgccgaagtggttggagttttttccgatcgcccagacgcacccgcactcaccaaagtgttacctacgcaccgttggagtgcagatccacacaactcccctgatcgcatcaccttcgacacaacgctcagcgcagcgatcgccgccgtaacaccacactgggtcgtatgcgcaggctacatgcgcatcctcagcgcagcatttatagaacgcttccccaagcgaatccttaacatccacccctcactgcttcccaaacaccgcggcttacacacgcacgcacgcgcactggcagcaggcgacaccgaacacggtgccagcgtccatcttgttataccggagctagatgctggaacggtactggcccaggcagtggttcccatccttaccaatgacaccgccgaaacgttggccaaacgcgtgctagtacgcgagcatccactgctcgtcgccaccttggaactacttgcaaacggtcgcctgacggtcgacggacca

SEQ ID NO: 33209 - DNA, 1926 bp, Xylella fastidiosa
tcggatctagatccgaccggcaacccctgcactgacctgcacacctatgtcaatggcaactggctgaaagccaatcctgtacctagcgaccgcacgagctggggcgcattccaaatgctggacgaacgctctaatgcgatccagcgtcaactgatcgaacacgccgccgccgaccctcaaagcagcggcatcaagaagatcctcagcgacctatggaacactggcatggacgaggccaagatcgaaacccaaggcatagacccactgaaagcggacttggctgcaatcgacgccatcaccaaccaggacaccttggtaaattacctacgcagcaccgctgccaaaggacagggcgagctattcacgctcagcgcatcccccgatttcaaggaccccacccgcaacatcgcctacatcagtcaaagtggactgggccttccagatccggagtactacaccaaaccagccaacaaagacaaactcctcgcctacaaagcacatatcgccaaggtattggaattatccggaatggctgccgccgatgctgcccaacacgccgataagatcatcgcgtttgaaacgcgtttggctaaggtctccaaaacaacacaacaaatcgcacgtgacgtgacgctgcactacaacccagtcaccccaacccaggcaaacaaactcactccacactggtcatggactgaagcattcaaggcccaaggcgtgccactaccagacatgttctcgctggcgattccagcgttccacaaagaagtagaccggatgctggctgataccgacgtcgccatatggcgcgcctatctacgcttccatacagtcgataatgcctcgccctacctgagtcggccattcgtggatgaacacttcgcattctggaacaacaccatgcgcgggcagaaagaaatcaaaccacgctggaaacgagtgttgaacaccatcaatgagcaagcgggtgaagccctaggccaactttatgtcaaggccgccttccccactgaatccaaagtcaagatggaagcattggtcgcccagttgcgtaccgcactcaaagcacgtattgagaagctggactggatgagtccagccactaaatccaaagcactggccaagtgggaaagcttcacagctaagatcggttacccagatcaatggcgatcctgggataacctccacaccagccgcgacagttatctaggcaatgtactgactgcacagcaattcaactacacatggaacctctccaagatcggcaaacctgtagacaagactgaatgggggatgccgccacaaatggtcaatgcctattacgacccgcagaaaaacgagatcgtgttcccagccgctatcctgcaaccaccgttcttcgatccggacgcgccattggaaagcaactacggtggcatcgtggcaatgatcggccatgaaatgacccacggctacgatgaccaaggcagccgctttggaccaacaggcaagttcgagcaatggtggaccaaagccgatgccaaagcgttctcggcacgtaccacaaaactggtcacccagttcaacagctaccgcactgaggatggtaaacaagtcaacggctcactgaccttgggcgagaacattgccgatttgggaggactaaatacagcctacgacgccatgaagaacgctaccgccggtcaagcggatccaaaaaccgacggtattacccgtgagcaacgtttcttctataactgggcaacagtgtggcgtgcacaatacaccccagaagagcaggcaatgcgactgaaaaccgatccacatgccccgccgcatttccgtacgatcggtccgccatcgaatatgcccagcttcgccgaagcattcaattgcaaaccaggcgacgcaatggttcgccataatgatcagcaagtcgtgatctgg

SEQ ID NO: 33210 - DNA, 900 bp, Xylella fastidiosa
tctgatactgctctactgattgttaatcttggtactcctgaggcgccgactgcggcggcggtgcgccgttatctgggcgaattcctgagtgatcgccgcgtggtatccattccgccgttgttttggaagccattgctgcatatggtgattttgccgattcgcggcccgcgttcagccagcaaatacgccaaagtgtggttgcaggaaggctctcccctcagtgtgtatacccgccgtattgctgaagggctgacgcaacatctgcctgattggcgtgtggcttgggcgatgcgttacggtgctccagcattgacaaaggcgctagatgcgctgcaagcgcagcaggtacgccgcatcgtgatactgccattatatcctcaatattcgaccaccaccacggcctcagtacaggatgtggtggaagcgtggtgtaagcgtactccccaagtgcaggttgaatgcattcaagactatgccgaggacccagcgtgggtcgccgcggtggctgcttcgatccgtaggcattggcaagcacatggccgcagtgagaagttgatgttctctttccatggactgccgcagcgtgtggccaataacggtgatccctatccgcagcgctgccaggtgagtgcgtctttgattgccgcagcattgaatttgaatgagagtgagtgggtgctcggttatcagtcgcgctttggtactgagcgttggttacaaccatatgctgagccaacgctctgggcgcttgctgagtctggcatacgtcgctttgatcttgtctgcccaggtttttccgttgattgcctggaaacattggaggaagtggcgctcggtttttcagaaacgctggcagcgcgtggtgcaacgatgcgctacattccctgtctcaatgatgac

SEQ ID NO: 33211 - DNA, 1095 bp, Xylella fastidiosa
atgagagatgaagagggcattggtccttgctacgtctaccatttgccgacagtgcgcgaacgtgcgcggcaattgaattcagtagctgctgtggatcagcgctactacgccatcaaggccaacccgcatccggccattctccgtaccctgattgaagaaggctttggactagagtgcgtgtcattgggtgaattgcgtcacgtgtttgcagtagtgccacacctggttccgtcgcgtgtgttattcactccaagtttcgcctcacgtgtggagtacgagcaggcattcttactaggtgtcaatgtgaccttggacaatgtcgaggccttgcgcttatggccggaggtattccgtgaccggacgttatggttacgtatcgatctgggttacggcgatggacatcacgagaaggtcaccaccggtggtaagacatctaaatttggcctttctgtcaagcggattgatgaatttatcgatgttgccaagacactgaacataaccgtgaccggcctgcatgcccatcttgggagtggcgtggagagaggcaaccattggtctcgcatgtacgatgagctggctggttttgcctcccgcatcgggagtgtgtctaccctggatatcggcggcggcttaccgatcccgtaccggcctgatgatgaaccatttgacgtgggggcgtggggagccagtttggctgaagtcaaagccttgcatcccaaatttcaattggtgattgagccgggccgcttcctggtagccgaagcgggcgtgctcttgaccagggtcacccaagtgattgaaaaagatgacatccttcgggttggcctggaggctggcatgcataccctgattcgtccggccctttacgatgcctggcacggcgtggagaacctcagccgcttggatgagacaccccatgtactgtgcgatgtcgtgggtcctatttgcgagtcatccgacgtgtttggccgtcgccgtcgccttccagccgccaccgcctccggtgatttaatgttgattgcagatgctggcgcctatggtttctcgatggccagcacctacaatctgcgcggcctgccggccgaggtcgtgctt

SEQ ID NO: 33212 - DNA, 1353 bp, Xylella fastidiosa
atcgttctaaaatttggtggtacttccgtatcgcgtcgtcatcgctgggacaccattgcgatggtggtgaggaagcgtcttgaagagcatggaacacgtgtgctgattgttgtttcggcgctgtctggcgtgacgaatgaactgacggcgattgctcaaggtgtcgtggacagcgcccagcgcgtcgctgccttggagcagcgtcatcgcgattttctggctgagcttgggttagatgcgcaagctgtgctcggcacgcgtttcgccatgttgtcggatcttctgcaagatgcgcgtgcggtgacgcggtcactggactggcaggctgagttgttagggcaaggtgaactgttgtcttccacactcggtgcggcctacctgggtgcttcgggtgttgacatcggttggatggatgcgcgtgactggctgaccgctttaccaccacagcccaaccagagtgaatggtcgcaacgtctttctgtctcctgtcaatggaagtcggatgtggagtggcgtacacgtttcgatgctcaacgtgctcaggtattgatcactcaagggtttatctcacgtcatcaagatggtggtaccgccatcctgggacgtggtggttcggacacgtcagcagcgtattttggtgcgctacttggtgcggcgtgtgttgagatctggactgatgtaccagggatgttcagtgcgaacccgaaggaggtccctgatgcgcgtttgctgacgcgcttggattactacgaggcacaggagatcgccacaactggcgcgaaggtgttgcatccgcgttcgatcaaaccatgccgtgatactgatgtgccgatgctgattctggatactgagcggcccgatgtattggggactcgtattgatgctgaagttgagccggtgcttggggtcaaggcgattagccgtcgtgatggcattgtattagtgtcgatggaagggatcggcatgtggcagcaggtgggttttcttgctgacgtatttacattgttcaagaaacacggattgtcggtggacctcatcggatcggcagaaaccaatgtcactgtgtccttggacccctccgagaacctggttaacaccgacgtactgactgcattgtcaaccgatttatcacagatctgcaaagtcaaaattattgtgccttgcgctgcgatcactttggtcgggcgtggcatgcgttccctgctgcataaactctctgaggtatgggctacgttcggtaaagaacgtgtccacatgatctcgcagtcatccaatgatcttaatctcacctttgtgattgatgagactgatgcggacggattattggcggtgctgcatttcaaattgatcgaa

SEQ ID NO: 33213 - DNA, 3225 bp, Xylella fastidiosa
atgccaaagcgtactgaccttcgtaccatacttatcatcggtgctggcccgattgttatcggtcaggcttgtgagtttgactattctggtgcccaagcctgtaaggcgttgcgtgcggaaggcttccgtgtcgtcttggtgaacagtaacccggcgacgattatgaccgatcctgatatggccgacgctgtgtatatcgaaccgattcactggcggacggttgagaagatcatcaccaaagagaagccagatgcgctgttgccaacgatgggtggtcagacggctttgaactgcgctttggacttggccgatcacggtgtgctggagaaatatggtgtcgagttgatcggagccaagcgcgaggcgatccgtatggctgaggatcgtgagttgtttcgtgtggcgatgcaggagatcggcttggagtgtccgaaggccgaagtggctaaaagtttggagcgagctttggagatccaggccaaagtcggttttccgacgatcatccgaccgagcttcaccctgggcggtaccggaggggggattgcttacaatcgccaggagttcgaggaaattatcaagcgcggtctggagctttccccagtacatgaggtgctggtggaggagtccgtcctaggctggaaagagtttgagatggaggtggttcgtgacgcctcggacaattgcatcattgtctgttcaatcgagaacttggatccgatgggggtacataccggggattcgatcacggttgctccggcgcagacattgagtgataaggagtatcagcgtttgcgtgatgcttcgattgcggtactgcgtaagatcggtgtggatactggtggttcgaatgtacagtttggtattgatccgcagaccggccgtgtggtggtgattgagatgaatccgcgcgtgtcgcgttcttcagcgttggcttccaaagcgactggtttcccaatcgctaagattgcggcaaaactggcggtgggctacacccttgatgagcttaagaacgagattaccggcggtaaaacgcctgcttcgtttgagccatccattgattacgtggtgactaaaatcccgcgttttgctttcgagaagtttccgcaagcggatgcacgtctgactacgcagatgaaatctgtgggtgaggtgatggcaatggggcggacctttgcagagtcgttgcagaaggcggtgcgtgggctggagaccggcaaggttggcttggagccgactggtttggatttgagcagcgaagatgatttggttgtcctcaagcgtgagttgaaagcaccgggggccgagcggctattttatgtagccgatgcatttcgtgctgggttcgcagtcgctgatgtttacgcgttgtcttatatcgacccatggtttttggatcagattgaggagattgttgctgctgagggccgactggttaccgatggtcttggttcgatagatggggcacgcttacgtcagctcaagcgtataggtttctctgatgcgcgtatcgcgcagttaaccggcacgaatgaggttgcggtgcggacgttgcgccgtgtgctcaaggtcaagccggtatataagcgtgtcgattcttgcgctggtgagtttgccactggcactgcttacctgtactcaacatatgaggaagagtgtgaggctgcgccgagtgatcgccgcaaaattatgatcttggggggggggccgaatcgcattggccaaggcattgagtttgattactgttgcgtccatgccgctttggcgttacgtgaggatgggtttgaaaccatcatggtcaactgtaatccggagacggtatctacggattacgatacctctgaccgcctttactttgagccattgacgttagaggacgtgttagaaatcgttgaggtcgaacaccctgttggagtgatcgtacagtacggtggacagactcctctgaagctggctaaagcgttggaagccaacggtgtgccggtgatcggcacctctccggaatcgattgacttggccgaggaccgtgaacgtttccagaggctggttcagcaacttggtttgaggcagccgccaaactgtacggcgcgtaccgctgacgaggcattggtattggcccgtgagattggttatcccctggtggtccgtccgagttatgtgcttggtggccgtgcgatggagattgtctacagtgaggccgatttggcgcgttatgtgcgtgatgcggtgaaggtatccaacgattcgcccgtgttgcttgatcgtttccttgacaatgcggttgaggtcgatgtggacatcattgctgatccggagggtcaggtactgatcggtggagtgatggagcacattgaggaggctggtgtccactcaggtgactcctcatgttccttgccgccctattcgttatcggccgcgactcaggacgatttacgtcgccaagtcatcaggttggcgcaggcattgaacgtcattggtttgatgaatacacagtttgcgatccaatccaatgatgatggtagtgacatcgtatatttgctggaagtcaatccacgtgcttcgcgcaccgtgccgttcgtctctaaagcgacgggggtgccgcttgccaagattgccgcgcgttgtatgactggcaagacattggccgagcaaagtgtgacttgtgaggttgtaccggcatattatgcggtgaaggaagcgatctttccgtttgctaaactacagggcgtggacccgattctcggtccggaaatgcgttctacaggtgaagtgatgggggtgggccgtagttttgccgcagcgttcgcccgcgcgcaggaagccggcgatatccgtgccccgcaaccaggcagggcgtttgtttcggtgcgtgatcctgataaaaagcgtgtgttgccagttgtcttggccttggtggagcgcggcttcggtgtggttgctactgctggtacttatgcttggttgcagcagaatggagtggcctgtgaggttgtgaataaagtggccgaagggcgtccgcacatcgtcgacttgattaagaacggcgagattgtttacatcatcaatactacggaagggcgtgcggcgattgccgactctttctcaatccgtcgggaggcactgcaacattgtgtgacctactcgactactattgctggcgctaaggcgttggtgaattcactcgagttccgcggtaccggtccggtttggtcgctacaggaactccac

SEQ ID NO: 33214 - DNA, 1113 bp, Xylella fastidiosa
gtgacagaacccgcaatcctagttctcgaagacggtaccgtattcgagggcgatgctgtaggcgctaatgggctttccgttggtgaggtggtatttaacacagccctcactggttatcaggagatcctgaccgatccttcgtatgcgtaccaattggtcaccctgacttatccgcatattggcaatacgggttgtaccgatcaggatgatgaggcgaataaggtatgggcggctgggctgattgtgcgggatgtgccgcgtcgtccaagcaattggcgcagtcagatttcgttgtcagattggttggccgcacgcggtgtggttgctattgctgggatcgatacgcgcaaactgacccgtattcttcgtgagaaaggcgctcagcatggtgcgttgatggctggtgagattgatgttggcaaggctcaggatgcggcccgtcaatttgcaggtatcaaaggtatggatttagccaaagtggtcagtaccaaacaggggtattcttggtacgaaggccagcttgacttggatcgtaacgaattcaagcgcgccgcgccgcaatatgaggttgtggcctatgattacggtgtgaagctcaatattctgcggatgttggcggagcgtggttgtgatcttacagtggtgcctgcgcagactccggctgacgaggtgttggcgctctgcccggatggggtgtttctttccaatggcccaggtgatccagagccttgtgattatgccgttgcggcgattaagacgttcatcatgcgacgggttccaatcttcggtatttgtttgggtcatcagttgctggcccaggctgttggtgccagggtcgtcaaaatgagccatggtcaccatggtgcgaatcatccggtgcaggacttgcgcagcgggcgggtaatgattacgtcgcagaatcatggctttgctgttgacgaggcaacgttgccaaacaatgtcagggtgacgcatcgttcgttgttcgacgggaccaatcaggggattgagttgcttgatgtgccggcattctcgtttcaagggcatccggaggcttcccctggtccgcacgatgttgatgtgttgtttgacaggttcattacaatgatggcg

SEQ ID NO: 33215 - DNA, 705 bp, Xylella fastidiosa
gattcttttcttagacttcttattcatggcgcttccgggcgcatgggccagtcgctgttgcgactggcctcagaagacccttcgtttcaggtgactgctgcggtggtcgggaatgcaccgcatcgccatgtgagcgatggtgtgccattttttgcggctgctgaattggcagctgtgccggcgtttgatgttgcgattgatttcagtttgccacaggggttttcgtcgttgctggcattgtgtgtagcgcgcgctgtgccgctggtctccgggacgactggtctcgattcgaggcagcatgaggctttggtcatggcaggggcgcggattcctctggtgtgggggtccaatttcagtgtgggtatggcggcgttggtgaatttggttgaacgtgccggtgatgcgttgtcaggttgggattgcgacatcgtcgagtcgcatcacgtccacaagcaggatgctccgtctgggagtgcgctgacgttaggtgaggcggttgcctgcaaggggatcgcgccgcgctatacaagcttgcgtgccggcgacattgttggtgaccatctggtgcagtttacgggcttgggtgagcgcattgagttagtacaccgtgccaccaatcgtgatgtttttgcacgtggtgcgttgcgcgtagcccggcgtgtggtggggcgtgtgcctgggtgttatcgggtgcgtgacttgatt

SEQ ID NO: 33216 - DNA, 1296 bp, Xylella fastidiosa
catacaggcattgcccctgccgaatatgggcgtcgtcgccgtcagttgatgaagatggttggtccccagggcatcgttgtgctgcctgctgcgcctgagcgggtacgtagccgtgatactcattatccgtaccgtcaggattcggatttttggtacctatgcggctttcccgagccagatgcggtgttggtgctggtgccagggcgttgccatggtcaagtcctgctgttctgtcgcgaacgcgatcctgagcgcgaggcatgggatggtccacgtgcagggtacgatggcgcaatcgagcagtacggcatggacgatgcgtatccgattgatgatttggacgaaatcttacccggtctgcttgaaggtaggtcccaggtctattatcatttcggtcgtgatgttgaatttgatctaaggttgattggttgggtcaatcgtgtgcgtgatcaggtgcgctacgctgcggattctccacacgagtttatagacctggggcatctgctgcatgagcagcgtttgttcaaatcttatgatgaaattgtgttgcttcagtgtgcagctgatatcagtgtcgaagcgcatcttgccgcgttgcgctatgcgcatcctggcgtctctgaatatgtgttgcaggctgagcttgagcgtgtgttccgagctgctgacagttgccctgcgtatacaagtattgttgctgctggcgctaatgcgtgcgtattgcattaccgtgccaatgcggaatgcagtcgtgacggggatttagtgttgattgatgccggtgcagagtaccgcggttatgctgctgacattacccgtacttttcctgtcaacggccgtttcagtcctgcccagcgtgcgctatacgatctggtcggtgctgcttatgatgttgcattagcgcaggcgcggcctgggttgccatatgaggctggtcatttggctgcggtgcatacattgactgaggggttgctgcggcttggtctgttgcatggcaggttggaggataatttggctgatcagagttacaagcgcttttatcgtcacaagactgggcattggttgggtttggacgtgcatgatgttggtgactatcgcattgatggtaagtctcgattacttgagcctggcatggtatttacgattgagccagggttatacgttcttccggacgatacgactgtccacccgaagtggcgcggcattggtatacgtaccgaggatgatgtattgattacggaagatgggcattgtgtgctgacaggcgtgttaccacgctcagctgatgaaatcgag

SEQ ID NO: 33217 - DNA, 585 bp, Xylella fastidiosa
atcatggaccattccaaacaacaaaacgcatccatcacccaagcccaggcagaagaagccgtacgcacacttctacgttgggccggcgaagatcccactcgtgaaggcttactcgacacaccacgccgtgtcgttgaagcatacggagattggttcagcggttaccgcgaagatcctcatgactacctgcaacgcactttcgaggaaatctctggctacgacgagatgatcgtactacgtaacattacctatgaaagccactgcgaacatcacatggcacccatcatcggtaaagttcacgttggctacttgccaaacggcaaagtcgtcggcatcagcaaattagcacgcgttgttgaatcctatgcgcgccgcttccagatacaggaaaagatgactgcgcagattgcagcatgtattcaagagacattaagcccacgtggcgtcggtgtcgtgattgaaggtgcacacgcatgtatgactacccgaggcatacacaagcgtggtgtatcaatggtcacctcaaagatgctcggtaccttccgtgaagacgcacgcactcgcgccgagttcttacagttcatc

SEQ ID NO: 33218 - DNA, 924 bp, Xylella fastidiosa
cttgagcggattggcattaaaagcgatgtcttcgccgatattgtcggtatcaatgcacgccggttgtggaataccaacgtacagacctccgatgtcgcaacgatggcagcgcgtaaagcattgcaggatgcaggggtggctgtggaccgtatcggcttggtggtcaacacttcggtgagtcgcgattacctggaaccgtccactgcttcgattgtctccggcaaccttggtgttggcgagcaatgcattgccttcgatgtggccaatgcctgcctggccttcctaaacggcatggacattgcgggacaaatgctggagcgtggcgacattgattatgccttggtggttaacgccgagactgctaaccgtgtttatgaaaaaacgcttgagcggatgagtgccccaggtgttaccgagcaggagttccgcgaggaaatggcggccttaaccctggggtgcggtgcggtggcgatggtactggcgcgtactgctttggtgcctgatgcacctcaatacaaagggggagtgacccgctctgcgactgaatggaacaagctatgttgcgggaatctggatcgcatggttactgacacccgcttgatgctcattgaggggatcaaactagcaaagaaaacctttgttgtcgccaaacaagtgctgggttgggtggtggaggagttggatcagtttgttatccaccaggtcagccgcccacacactgaggcgtttatcaagtcattcggcattgatcctgccaaggtgatgaccattttccgtgagtacggcaacatcggccccgcttctgtgccgattgtgctgagtaagctcaaggaactgggccgtctcaaaaaaggtgaccgcattgccttgctgggtattggttcggggctgaattgttctatggcagaagtggtgtggtgattc

SEQ ID NO: 33219 - DNA, 900 bp, Desulfitobacterium hafniense
attactttcgagccgctgatgattcaggccgcaggtcaggaagtcacgctgatccatgccggccgctcgagccaggacatgcttgcgacggtgcgcgcggcgatgttgcgcgacgaagtcttgtcgctggccgaccagctcaacaagacctccgccaccatcgtcaagctggcgcggcagcatgccgaaaccatcgtgccgaactacacgaacggcgttgctgcgcagcccaatagttatggccactacctgctcggcatcaatgcgggtctggaacgcgatgcccagcgcctgcgggaagcctatcagcgcatcgatcgctcgccgatgggaacgacggtgctgaacggcacgggctggccgctgaaccgcacgcgaatggcgagctacctcggattctccgcgctggtggataacgcttatgatgcgtcgcagatcagcgccgtggacctgccggtggaagtgggcgcgatcgtgaccagcatcgccctgcacaccgggagcttcatcgaggatgtgatgacgcagtatgcgcagccgcgcccctggatcctgctgcaggagggcggcggcaatacctatgtgtccagtgcgatgccgcagaagcgcaatccggggctgctcaactccacgcgcgagaaggcctccacagcgatcacgttggccatggggccggtgattcgtgcgcacaacctgccgccgggcatgtctgatgccaaggatgccgttaccaatggccagatggtgcagagcgcgatcacgacattgaaggggctggaccgcatcatgacagccctggtgatcgatcggccgcgcgcgctggatgaactggacagcgactggacggcatcacaggaactggccgacgaattgatgcgcaagtacaagcaccgttccgcc

SEQ ID NO: 33220 - DNA, 708 bp, Desulfitobacterium hafniense
cagtcggcgctgatcgccgcgggcctgaccgcactgctgtggcgcgccaccgacggcgtggtcgccgggcgcatgagcctgggcgacctggtcctggtcaacgcctacctgctgcagatggccgcgccgctgagctacctgggcgtggtgtatcgcgaaggcaagcagatgctggccaacctggagcgcatgttcgccctgctcgacgagccggtggaagtgcgcgaccgccccggcgcgccggcgctgcgggtcggcgccggcgaagtgcggttcgagaacgtttcgttccgctacggcgagcgcgagatcctgtccggcatcgacctgaccatccccagcggccgcaccgtggcggtggtgggcagcaccggcgccggcaagtcgaccctggcgcggctgctgtaccgccattacgaccccgacggcgggcgggtgctggtcgacggccaggacctgcgcgaggtgaccgccgattcgctgcgccggcgcatcggcgtggtgccgcaggacacggtgttgttcaacgaatcgctgtactacaacatcgcctacggccgccccgacgccagccgtgaggaagtgctggaggccgcgcgcgccgcgcgcatccacgacttcatccaatcgctgccgcagggctacgacaccggcgtgggcgaacgcgggctcaagctctccggcgagagaaacaggcatcgcctcgcc

SEQ ID NO: 33221 - DNA, 735 bp, Desulfitobacterium hafniense
gagtacatgtccggttttgccaatgagttcgccacggaggcgttgcccggcgcgttgccggtaggacgcaactcgccgcagcgcgcgccgtatggcctgtatgccgaacagatatcgggcaccgcgttcaccgcgccgcgcgcccacaatcgccgttcgtggctgtatcgcattcgcccggcagccatgcacaagccgttcacgttgatcgagcaggatcgttggctgagccgcttcgacgaagtggcgccatcgcccaatcagatgcgctggagtgcgccggccatgccgaccgttcccaccgactttgtcgatggcatcgtcacgatggctggtaacggcggtccggaagcgctgtccgggtgcgggatccatctgtatctggccaacgcgtcgatgcgggaccgcttcttctacaacgccgatggcgaaatgctgatcgtgccgcaggagggccgtctgctgatcgtcaccgagatggggcgcctggcggtggagccgcaggagatcgtggtgatcccgcgcggcgtgcgtttccgcgtggaactgcccgacggcgcggcgcgtggctatatctgcgaaaactacggcgcgatgttcaagctgcccgacctcggcgtaatcggctccaacgggctggccaacccgcgtgatttcctgacgccggtcgccagctacgagatcacgaaggcgacttcgaactgtcgcccgttaaacaggacgatcggtacgatg

SEQ ID NO: 33222 - DNA, 843 bp, Desulfitobacterium hafniense
gggtccagcgctctgttcctggctcgccaggcggtggaaagcggcgcggtggaatgcgcgctggcgctgggcttcgagttcatgcagccgggcgcactgacgagcgtctggaccgaccgtgagcgtgcaatggcgcgcttcacggaaatctcggcgccgatggtgcaggatgcgctggatgccggtgtgcccagtgcactgacgatgttcggcggcgccggtcgcgagcatatgcaaaggtacggcacgaagctggagaccttcgcgaagatccgcgccaaggcgagccgccatgccgccaacaacccgctggccgtgttccgcaccgtggtgacggaggaagacgtgatgaacgagaaggttatgtggcctggcgtcatgacccgctcgatggcctgcccacccaccagcggcgccgcggccgcgatcgtctgcacggaagctttcgcgaagaagcacaacctccgcaccgatgtgcgcatcctggcccagtcattgaccaccgatgtggcgcagagcttcgatccaccgtcgatgatcggcctggtcggcttccatatggccgagcgcggcgcgaaggccgtgtacgaggcggctggagtaagcccatcggatatccaggtctgcgaattgcacgactgtttcgcgcagaacgaactgctgacctacgagtcgctgggcttcgcgaagatcggcgaggccgagaagatggtgcaagacggcgacaacacctacggcggaaaggtcgtgatcaacccgtcgggcggtctgctgagcaagggccatccgctgggcgccaccggcctggcgcagggctacgaaatgacccgccaaatccgggga

SEQ ID NO: 33223 - DNA, 387 bp, Desulfitobacterium hafniense
atgagtgaaattcccggcgatctgaagttcatgaagtcccacgagtgggcccgcgtcgaaggcgacggcaaagtcaccgtcggcatctccgaccacgcccagggcctgctcggcgacctggtctacgtcgaactgcccaacgtcggcgaccgcgtcgaggccggcaacgcctccgcggtggtggagtcggtgaaggccgcctcggacgtgtacgcgccggtctcgggcaccgtcaccgcggtcaatgccgcgctggccgacaagccggagaccatcaacgaagacgcctacggcgaaggctggatctacaccgtcgagatcgacgagccggaccagctcaacgagctgctgtcgccggacgactacgccgaactgctcgaagacgac

SEQ ID NO: 33224 - DNA, 564 bp, Desulfitobacterium hafniense
  unsure (1)..(564): unsure at all n locations
cgtcacttttcgatgctccgcgagttccacctcgcggactggttcaccctcgccatacgcccgttgctgcgggcannccgggcgcgggatgcttcgccgcgatgcgcttcctgcaagacggcgaggtgcgcaacctgatgatcggcatggcgctgatcccgctggcgttcgtgttcgacgcgctcgacggtcgggtcgcgcgctggcgcaagtcctcgtccacnggnctcgggacgtcgaactcgattcgctggccgatgtgatctccttcggcgtcgccccggccgcgctggcctacgcctgcggcctgcagggcggctgggactgggtggtgctgagctatttcgtcggctgcggcgtcagccggctggcggncgctacaacgtttcaccgccgaagcgctggccggggatgaaggcaaggtcaaatacttcgaaggcacgccgatcccgaccagcctgctgctggtgatcgtgctggcggtggcggcgtggcagggcgcgatcggcgatcagctgtggttcggcggcgtgcgcatcggcccgtggctgtacaacccgatgg

SEQ ID NO: 33225 - DNA, 474 bp, Desulfitobacterium hafniense
atgaatccggccagcaatctgatcctgatcgggccgatgggctcgggcaaaacctgcatcggcaagcgcctggccgagcgcttcggcctgcgcgcggtcgacgccgaccgcgagctcgagctgcgcgccggcgcgcgcatcgcgcagatcttcgaacacgagggcgaagccggctttcgcgtgcgcgaaagcgcggtgctggccgaactgctgagcggcgacggcctgctgctgtccaccggcggcggcgcggtgctggcggccgacaaccgccggctgctgcgcgaacgcggcttcgtcgtgcacctgcaggtcagcgtcgagcagcagctcgagcgcctggccctggaccgcagccgcccgctgctggcgcgcggcgaccgcgaacaggtgctgcgcgaactggccctggcgcgcgcgccgctgtacgccgagaccgccgacctggccttcgacaccggcgccgccggcgcg

SEQ ID NO: 33226 - DNA, 636 bp, Desulfitobacterium hafniense
gtgagtctatttgataaaacgcatcttgtcgcccaagcggacgcgctgccgggacgcaacacgccgatgccggtggctacgctccacgccgtcaatggtcactcgatgaccaacgttcccgcaggaatggaagtcgctctgtttgctatgggctgcttctggggcgttgaacgcctgttctggcagctgcccggcgtttatagcaccgccgccggctataccggcggctatacgcccaacccgacctaccgcgaagtctgcagcggcgagaccggccatgctgaagccgtgcgcgtggtctacgatccgcaggttatcagctatgagcagctgctccaggtattctgggaaaatcacgacccggcgcagggcatgcagcagggtaacgaccgcggaacgcagtatcgctccgcgatttatccgctaacgcctgagcagagcgaggcggcgaaggccagcctggcgcgtttccaggcggcaatgaatgaagccaacgacccgcgcactatcaccaccgagatcgccacggcgaagccgttctactatgcggaagacgatcatcaacagtatctgcataaaaatccgtacggatactgcggcattggcggaattggggtttgtttgccgccgcaggcc

SEQ ID NO: 33227 - DNA, 569 bp, Desulfitobacterium hafniense
atcggcatcgtcagctcgctggtcaatctcagcgacggcgcggtggagatcttcggcaccgacctgcagcgccgccgcgacgaagcgatgcgcctgatcggcctggtgccgcaggaaatcaacttcaacatgttcgaaaagccgctcgacatcctggtcaactacgccggcttctacggcgtgccgcgcgaacaggcgctggtgcgcgccgaagaggaactcaagcgcgcgcagctgtgggacaaggctgacaagatgagccgcacgctgtccggcggcatgaaacgccggctgatgatcgcccgcgcgatgatgacccggccgcgtttgctgatcctcgacgagcccaccgccggcgtcgacatcgaaatccgccgcggcatgtggaagaccctgcgcgagatcaacgccgccggcaccaccatcatcctcaccacccactacctggaagaagccgagagcctgtgccgcaacctggcgatcatcgaccagggccgcatcgtccagcagggcccgatgaaggcgctgctggcgatgctcgacgtggaaggttcctgctcgatatcgac

SEQ ID NO: 33228 - DNA, 507 bp, Desulfitobacterium hafniense; identical to SEQ ID NO: 32538

SEQ ID NO: 33229 - DNA, 851 bp, Desulfitobacterium hafniense
gccggcattccgaaaggcgtgctgaacttcctgaccggcagcgccgccgaagtgggcccgaccatcgtggaatcgcgcgaggtccgcgcggtctcgttcaccgggtcgacctccgccggcgagcagattcacaagtccgtgccgatgaccacgcgcacgcagatggaactcggcggcaagaatccgctgatcgtcatggaagacgccgatctcgatcgcgcggtggacctggcagtcaagggcggcctgtcgctgtcgggccaggcgtgcacgggcaccagccgcatcctggtgatgcgcgacgtgaagcaggcattcaccgagaagctggtggccaaggtcaaggcgctgaaaattggcagcggcatgacggcggggatggacctcggcccgctggccacgcgcaagcaactggaaacggtgctgagctacatcgccatcggcaagcaggaagcgaccttgctgtgtggtggtgaacagctgtccgacggcgatttcgcgcacggctactacgttgcgccgaccgtgttcaccgacgtgacccagtcgatgcgcattgcccgcgaggaaatcttcgggccggtgctggcgatcatcgaagtcgacagttacgcggacgccatcgcccaggcgaacgacaccgagtacggtctgtccgccgccatcgccacgcgcaatccgcgctacatgcacgacttcacgcgcgatatcgaatcgggcacggtcaagatcaaccgcaccaccacgggcaacctggtcaacgcgccatttggcggtctcaagcgctcgagcacctcgacattccgcgaatcgggacgcgctggcctcgagtttatacgcagatcaaaccg

SEQ ID NO: 33230 - DNA, 858 bp, Desulfitobacterium hafniense
  unsure (1)..(858): unsure at all n locations
tggagcgccctcgacgccgggcagcgcgcgcagggcnngctgcgccgngnnccggcgcaggaaacccgccagaccaccgccgacgcggtcgctgcgatcatcgccgaggtgcgcgccgacggcgacgccgcgctgcgccgcttcggcgaacgcttcgacggcgccgcgccggaggccttcgccgtctccccagccgaattcgccgccgccgaggccgcggtgagcgcgccgctgcgcaacgccattgacgaagccgcgcgccggatcgagcgcttccacgccgccggcatgatgcccggttacgcgctcgacaccgccgagggcgtgcgctgcgagcggatcctgcggccgatcccgcgggtcggcctgtacgtgccggccggctcggcgccgctgccgtcgaccgcgctgatgctgggcgtgccggcgcgtctggccggctgccgcgaagtggtgctgtgcacgccgccgcgcaaggacggcagcgccgatccggcggtgctgtgcgcggcccggcgctgcggcatcggcacggtctacaaggtcggcggcgcccaggcgatcgcggcgatggccttcggcaccgcaaccatcggcaagtgcgacaagttgttcgggccgggcaacgcctatgtcaccgaggccaagcgccaggtcgcgctgctggaaggcggcgcggcgatcgacatgccggccgggccgtcggaggtgctggtgatcgccgacgccggcgcgcgcgccgatttcgtcgccgccgatctgctgtcgcaggccgagcacggcgccgactcgcaagtgatcctgctcagcgacgacgcggccctgctcgatgcggtcgatagcgaactcgaacgccaa

SEQ ID NO: 33231 - DNA, 1161 bp, Desulfitobacterium hafniense
ctcgatctttgccgcgcagccatcggttcgcagaacgtgctgaccgacccggccgacaaggcaccctacctgaccgactggcgccgccgctacaccggcgacgcgctggccgtgctgcgtcccggctcgaccgaggaagtcgcggcggtgatgcgtgcctgccatgcgcacaagctggccgtggtgccccagggtggcaacacaggcctgtgcggcggcgccacccccgaacccggcgatgctgccgcgcgtggcacggtggtgctgtccctgcagcgcatgaaccgcgtgcggcaggtcgacccgctcaataacacgatcaccgtcgaggccggcgtgatcctgcagcaactgcaggaggccgcgcagacacacggccggctgttcccgctctcgctggcggccgaaggcagctgcacgatcggcggcaacctgtcgacgaacgccggcggcaccgccgtgctgcgctacggcaacacgcgcgaactctgcctggggctcgaggtcgtgaacatcaagggcgaggtctgggatggcctgcgcggcctgcgcaaggacaataccggctatgacctgcgcgacctgttcatcggcgccgaaggcacgctcggcatcatcaccgccgcggtcatgaagctgtttccggcgccgcgcgcgcgggtcaccgcgctggccgccgttgaaagcccacgcgccgcgctggcgctgctggccatcgcgcaatcgcacgcgggcgccatgctgaccggtttcgagttgatgtccgcgatgtgcatggatctggtgacgaagcactacccgcagttgcgctacccgttcaccgcccatcatccgcaactcgttctgctggaactgtccgacagcgagagcgaagaacacgcgcggacgatcttcgaaaaaatgatggaggtagcgttcgaagccggcgtggtcaaggatgccgtggtggccgaatcggtacagcagtcacgcgatttctggaacctgcgcgaacacattccgctggcgcaggtcgaggaaggcaagaacatcaagcacgatatcgccgtgccgatctcgcgcgtggcggacttcatcgagaccaccgacacgctgctgcaagacgccttccccggcgcgcgcatggtcacgttcggccatcttggcgatggcaacttgcac

SEQ ID NO: 33232 - DNA, 762 bp, Desulfitobacterium hafniense
caggccaaagccagaatgtatactttaattttggatagcttgcaggggatgccggatatgctggcctttggacagaccggagctgtgttccagaggattcaagaagcccaaagtgaactcagtcactctgagcgaagaatggctaaagtaacaggaacggcaaatgccctgatggggatgagctctcatttgggaatgctggctgtcctggttctgggaataattctcgtagagggaagacagattgacggggttctattgggtatgttggccttgggggtactgagcagtttcgaggctgtagcgaccctgcccgccggccagcagtatttggaggaaaatgaggcggcgggaaggcgtcttaagcacctaatcgatgaaggccgtaatctggagaaggagaaaggcaggctggatgcccctggccttgaacctgagcttgcattcgagaatgtgcgttttcgctatgagccgaatggcccctgggtattggataacatttcggttaagataccaggaggcagacggattggtatcgtgggtcaaagtggagcggggaaaagcaccctagttaatctattggttcgattttgggaacccgctgccggggaaattcgcttagggggagtaaacatcaaagaattaactccccaggttgttcgggaaaacatgggcatagtgtctcaaaaaccctatctttttcatgctacaatcaaagaaaatctcttattggccaagccggaagccactaacgaagagtta

SEQ ID NO: 33233 - DNA, 768 bp, Desulfitobacterium hafniense
caggccatgcgccacgccgtgctgctcggcggcaagcgcatgcgcccgctgctggtctacgccagcggcgcgctgttcgaagtcgcgccgtcggtgctcgacgcgccggccgcggcggtcgaactgatccacgcctattcgctggtccacgacgacctgccggcgatggacgacgacgccctgcgccgcggccagccgaccgtgcatgtggccttcgacgaggccacggcgatcctcgccggcgatgcgctgcagtcgctggccttcgccgtactcgccgacaccgacaccttggacgcgatccgcgtcgacctgctgcgcaccctggcccaggccgccggcgtggccggcatgtgcggcggccaggcgctggacatcgacgccaccggcgccggcgtgcagctgagcctgccggcgctggagcggctgcattcgctcaagaccggcgcgctgatccgcgccagcgtgcgcatgggcgcgctgtgcggcggcgccgacacggccgcgctggcggcgctggaccgctacgcgcgcgcgctcgggctggcgttccaggtgcgcgacgacatcctcgacatcgaaggcgacagccagaccctgggcaagaccgccggcaaggacctggcccaggacaagtcgaccttccccgccctgatcggcctggacgcctcgcgcgcgcgcctggacgaactcggcgcggcgatgcgcgaagcgctggagccgttcggcccgcgcgccgaggagctgcacgcgctggggcggctggcg

SEQ ID NO: 33234 - DNA, 883 bp, Desulfitobacterium hafniense
ctgcatatggtggaagccgtcaacctggccctggcccatgccctcgccaacgatcccgacgtggtgctgctgggcgaggacatcggcgtgaacggcggcgtattccgctcgactgtggggctgcagtcgcgcttcggcgaggcccgcgtcatcgacacgccgctggccgaaggcgccatcgtcggcgcggccatcggcatggcggcgatggggctcaagcccgtcgcggagatccagttcgccggcttcatctatccggcgatcgacaacatcctgaatcacgcgggtcatatgcggcaccgcacacgcggccggatcacgtgcccgatggttgtgcgcgcgccgagcggcgcgggcatccacgcgcccgaacaccattccgaaagcccggaggccctgttcgcgcagatgccgggcatccgcgtggtcatgccttcatcgccggcgcgcgcctacgggctgctgctcgcggcgattcgcgacccggacccggtgatcttcctggagcccacccgcctgtaccggctgttccggcaggaggtcgccgacgacggccaggcgctgcccctcgacgcctgcttcacgctgcgcgagggcacggacctcacgctggtgagctggggcgcgattgttgcgggaaacgctggccgcggccgatgtgctggccgacgacggcgtttccgcgtcagtgatcgacgtggccacgctcaagccgctggacatggagaccatcctggagtcggttgcgcagagcggccgatgcgtgatcgtgcatgaagcaccgcgcaccgccggcctgggcgcagagattgccgccaacctgtccgacgcgggactctattcgctgagcgccccggtgcagcgcgtgacggcgcctgactac

SEQ ID NO: 33235 - DNA, 933 bp, Desulfitobacterium hafniense
ccgctgtcggacaaccagaactcgttgcgcgcgagcgaacgtgggcccaccttgctggaagatttcattcttcgcgagaagatcacccacttcgatcacgagcgaattcccgagcgcatcgtccacgcgcgcggctcggccgcgcacggctatttcgaactgacccgttcgctgaagaagcacaccactgcgcaggtcttgaccgaagtcggcgagcgcactccggtgttcgtgcgtttttccaccgtggccggcggcgccggctcgatcgacacaccgcgcgatgtgcgcgggttcgcggtcaagttctacacccagcaaggcaattgggatctagtcggcaacaacatcccggtgttcttcatccaggatgcgatgaagttccccgacctggtgcactcggtcaagatggagcccgaccgcgggtttccccaggccgccagcgcccacgacacgttctgggacttcatctcgctgacgcccgaagcgatgcacatgatcatgtgggcgatgtccgaccgcgccattccgcggtcgttgcgcatgatcgagggcttcggcgtgcacagcttccgcttgctagacgcgaagggccgctccaccttcgtcaagttccactggcgtcccaagcttggcctgcagtccacgctttgggacgaagcggtcaagctcgccggcgccgatccggacttccaccggcgcgacctgttcgaagcgatcgagcgaggcgattatccggaatgggagctggcggtgcagttgttcgaccaggaacaggccgacgcgctgccgttcgaccacctggacccgaccaaactcatccctgaggaaaccatcccgctgaccgtgatcggccgcatggtgctggaccgctggcccgacaatttcttcgccgaaaccgagcaggtggcgttctgcccttcgcatgtggta

SEQ ID NO: 33236 - DNA, 774 bp, Desulfitobacterium hafniense
atgatcctgccggtcggcgtgccgaacttcgccgaggctctgcgcgccggcgccgaggtgttccacgcgctcaagtcggtgctcaagggccgtggcctgagcaccgcggtcggcgacgagggcggtttcgccccggacctgcgcagcaacgaagaggcgctggaaaccatcctggaagcgatcggcaaggccggctacaaggccggcgaagacatcctgctgggcctggacgtggcttcgaccgagttctacgacaacggcaagtaccacctggtcggcgaaggcaagcgcctgaccagcgaacagttcgtcgacttcctcgccaactgggccgcgcagtacccgatcgtcaccatcgaagacggcatggccgaagacgactggaacggctggaagctgctgaccgacaagatcggcaacaaggtgcagttggtcggcgacgacctgttcgtgaccaacccgaagatcttcgccgaaggcatcgacaagggtgtggccaacgcgatcctgatcaaggtcaaccagatcggcaccctgaccgaaaccctggaagccatcgccatggccgaccgcgccaagtacgccgcggtggtctcgcaccgctccggcgaaaccgaggacaccaccatcgccgacatctccgtcgccaccaccgcgacccagatcaagaccggctcgctgtgccgcagcgaccgcgtggccaagtacaaccagctgctgcgcatcgaagagcagctcggctcggcggcgcgctacgccggccgcgacgcgttc

SEQ ID NO: 33237 - DNA, 648 bp, Desulfitobacterium hafniense
gccaccctgctgcacgacgacgtggtcgacgagtccgacctgcgccgcggccgcaagaccgccaacgcggtgtggggcaacgccgccagcgtgctggtcggcgacttcctctactcgcgcagcttccagctgatggtcgagctggagcagttggaggtgatgaagatcctcgccgacaccaccaaccgcatcgccgaaggcgaagtgctgcagctgttgcacgtgcgcaaccccgacaccgacgagccggcctatctgcgggtgatcgagcgcaagaccgcggtgctgttcgccgccgcgacccgcctgggcgcgctgctgtcgggcgccgacgcgcaggtgcagcagcgcctggacgactacggcatggccctgggctacgccttccagatcgccgacgacgtgctcgactacgcctccgacgcgcagaccctgggcaagaacctcggcgacgacctcgccgaaggcaaggccacgctgccgctgatccacgccatcgcccacagcgacgacgccgtgcgcgcgcgcctgcgcgcagcggtcgagcacggcgacagcgacgccatgccggacgtgctggccgcgatccacgccaccggcggcctggcctacagccgccagcgcgcgcaggactacgccgatgcggcc

SEQ ID NO: 33238 - DNA, 1055 bp, Desulfitobacterium hafniense
ctcagcgctcgcttgttgcgccgcaagtcggtcgaacaactgcaacgccaggcgcaagcgcgcggcgagttgcagcgggtgctggggctgtggcatctcaccgcgatcgggctgggcgggatcatcggcgtcggcatcttcgtgctgaccggcaccgtcgccgccggccaggccggaccggcggtggtgctgtcgttcctcatcgccggggtcgccagcgcggcggcggcgctgtgctacgccgagttcgccgggctgatcccggtctccggcagcgcctacacctacggctacgcggtgctcggcgagttcgccggctggctgatcggctgggacttgctgctggaattcgcgctgatcgccgcggtggtggcggtgggctggtcgggctatgtgcaggcgctgttggccgcggccggggtcgagttgccgctgtgggcgcgcggcgcgtacttcggcgaggtgcccggacaaatcgtcaacctgccggcggtgttcgtggcgttggcgatcaccgctctgctggcgttcggcacccaggccggcgcgcgcttcaatcaccgtggtggtggcgatcaagatcggcgcggccgcgctggtgatcgccgccggcgcggccttcgtcgacccggcgcgctggcagccgttcatgccgttcggcttcggcggcgtggtcgccggcgcgtcgatcgtgttcttcgccgtgttcggctacgaaatgatgaccaccgcggccgaagaagcgatcgacccgcagcgcgacctgccgcgcgcggtggtgctgtcgctggcgatcgcgatgacgctgtatgtcggcatctgcctggtactgaccgggatcgtgccctacgccacgctcgacaacgacgcgccggtggccaatgccttcgccgcgatcggccagccgcgggtgatggtggcgatttcgttggcgtctggtgtgcgggatcaccagcgtgatcttcgccaacctgatggccggcgcgcggatctggttcgcgctggcgcgcgacggcctgctgccgcgctggttcggccagacccatccgagctgg

SEQ ID NO: 33239 - DNA, 663 bp, Desulfitobacterium hafniense
gtggccagcaacagcttcggaaccctcctcaccgtcaccaccttcggcgaaagccacggcccggccatcggctgcgtcgtcgacggctgcccgccgggcctggaactggcgccggaagagttccgccacgacctcgagcgccgcgccaccggccgcagccgccacacctcgcagcggcgcgagaccgatgagatcgaaatcctcagcggcgtctaccagggccgcaccaccggcaccccgatcgccctgctgatccgcaacaccgacgcgcgcagcaaggactacggcaacatcgccgagcagttccgccccggccacgccgactacagctattggcagaagtacggccatcgcgatccgcgcggcggcggccgttcctcggcgcgcgagaccaccatgcgcgtggccgccggcgtgatcgccaagaagtggctggcgcagcgttacggcgtcagcgtgcgcggctacatggcgcagatcggcgaagtcgtgccggccggcttcgacctcgacgcggtcgagggcaatccgttcttctggccgcacgcggcccaggtcgacgagctggagcgctacatggacgcgctgcgcaagtccggcgattcggtcggcgcgcgcgtggaagtggtcgccgacggcgtgccgccgggctggggcgagccg

SEQ ID NO: 33240 - DNA, 531 bp, Desulfitobacterium hafniense
ggcctgttgccggcgcatctgctcggcaacatgtggcagcaggactggggcaacctgtgggacgtgctggcgccgtacagcgagcagcaggccggcagcctcgacatcaacgccgcgctcgcgcgccagtaccaacaggcgctcgacgcgcagcaggccaagggcggcggcgaaggcgccagcgccgcgcagcaggcgcaggtcgaagtcgacgcctcgctggccaacgccaagcgcatgaccgagcgcgcgcaggacttctacgtctcgctgggcatgcccaagctgcctgacagctattgggccaagacccagttcgtcaagccgcgcgaccgcgacgtggtctgccacgccagcgcctgggacatgaacatgagcggcgacgtgcgcaccaagatgtgcatcaagccgaacgaagaagacttcaccacgatctaccacgagctcggccacgtctattactacctggcctacaacaagcagccgccgctgttccagaccggcgcgcacgacggcttccacgaagccatc

SEQ ID NO: 33241 - DNA, 657 bp, Desulfitobacterium hafniense
atgaaggcaatgattctggcggccggcaaaggcgagcgcatgcgcccgctgaccctgaccacccccaaaccgctggtgcgagccggcggcgtgccgctgattgaatatcacctgcgtgccctggccgcggccggtttcaacgagatcgtgatcaaccatgcctggctcggacagcagatcgaagatcatctgggcgatggttcgcaattcggcgtgtcgatccagtactcgcctgaaggggaacctttggaaaccggcggcggaattttccgcgccttgccgctgttgggcgaagacgcgtttctggtggtcaacggtgacatctggaccgattacgacttcagcgtgctgcatcagccgatcaacggcctggcgcatctggtgctggcggacaatccggcgcatcacccgacaggggatttcaccctgaccgacggccaggtgcgtgatggccaggccgatttggcaaccctgacctacagcggcatagccgtactgcatccgcagttgttcgacggctgccgcgacggtgccttcaaactggcgccgctgttgcgtaaagccatggcggacgggcaggtgaccggcgagcggttgaaggggcactgggtcgatgtcggtacgcacgagcgtctggccgaagctgaagccttgata

SEQ ID NO: 33242 - DNA, 464 bp, Desulfitobacterium hafniense
  unsure (1)..(464): unsure at all n locations
gacttcgaccgcgtccgcgactacctctccggcctgcaggaccgcatctgcgccgccatcgaaaccgccgacggcggcgccgggcttcaaagaagatcagtggcagcgnncgccgagggcggtggcggccgcacccgcatcctgcgcggcggccgggtgttcgagcaggccggcatcggcttctccgacgtgtccggcagcaagctgccgccgtcggcgagcgcggcgcggccggagctggccggcgcgtcctggcgcgcggtcggggtgtcgctggtgttccacccgcacaacccctacctgccgaccacccacgccaacgtgcgccacttccgcgccatgcgcgacggtgagacggtggcctggtggttcggcggcggcttcgacctgaccccgttctatcccttcgccgaagacgtgcgccactggcaccgcacggcgcgcgaactgtgcgagccctacgg

SEQ ID NO: 33243 - DNA, 597 bp, Desulfitobacterium hafniense
ctgcagggcaaagtcgccgtagtcaccggcgccggccgcggcctcggccgcgagtgcgcgcgcgccttcgcccgcgaaggcgccgacctggtgctgatcgacgtgagcggcgacatcgacggcgttccgtacccgctcgccaacgccagccagctggcctgctcggaagcgctgtgccgcgaggagggcgcctcggtgttggccgagttcgccgatgtgcgccgcatggaccagatcggccgcgtcgtcgacaaggcgctggcgcgctacggccgcatcgacatcttgttgaacaacgccggcatcgccgcgccctcgggcaaggtcgtgcacgagatttccgaggacgagtggaacctgatggtcgatgtcgacctcaacggcgcgtggcggatgatcaaggcggtcggcaagatcatgacctcgcagcgcgccggcagcatcgtcaacatcgcctccaccgcgggcacggtcggttatcgaaatttctccggctatgtggccgccaagcacggcgtggtcgggctgaccaaggccgcggcgctggattacgggccgggtcaggtgcgggtcaacgcgatctggcccggttcggtg

SEQ ID NO: 33244 - DNA, 772 bp, Desulfitobacterium hafniense
gataccaccgtcaaggcacgcacccagtcgaccccagcaaagcccctcaaccacgcggccggcggcggcacctccaaccgcgactggtggcccaaccagctcaacctcaagatcctgcaccaacaggcgccggcgaccgatccgatgggcgcggacttcgattacgccgaagcgttcaagacgctcgacctcgacgcggtcaagcgcgatctgcacgcgctgatgaccgattcgcaagagtggtggccggccgacttcggccactacggcccgttgttcatccgcatggcctggcatagcgccggcacctaccgcatcttcgacggccgcggcggcgccggcgccgggcagcagcgcttcgctccgctcaacagctggcccgacaacggcaacctcgacaaggcccggcgcctgctgtggccgatcaaacagaaatacggcaacaagatttcctgggccgacctgttggtcctcaccggcaacgtcgcgctggagtcgatgggcttcaagaccttcggcttcgccggcggccgcgccgacgtgtgggaacccgaagaaggcgtgtactggggcgtggaaaccgaatggctcggcgacaagcgctacagcggcgatcgcgtgctggaaaatccgctcggcgcggtgcagatgggcctgatctacgtcaatccgcaaggccccaacggcaatcccgacccgatcgccgccgcgcgcgacatccgcgagaccttcgcgcgcagtggccatggacgacgaagagaccgtcgcctga

SEQ ID NO: 33245 - DNA, 837 bp, Desulfitobacterium hafniense
ctgcgcgaactcggcatcgacgctcaggtgcgcctgctcgacggcgacctgaccgacctgtcgtcgatgatccgcgcgatgcagacctccaaggccgacgaggtctacaacctcggcgcgcagagcttcgtcggcagctcctggcagcagccgctgctgaccgcacaggtcgacggcgtcggcgcgctcaacgtgctggaagcggtgcgcatcgtcaatccgcaggcgcgtttctaccaggcttcgaccagcgagatgttcggcctgatccaggccgaaatgcaggacgaaaagaccccgttctatccgcgcagcccctacggcgtggccaagctgatggcgcactgggccacggtcaactaccgcgagagcttcaagatccacgcctccagcggcatcttgttcaaccacgagtcgccgttgcgcggcatcgagttcgtcacccgcaaggtcaccgacgcggtcgcccggatcaagctgggccagcagaaggaactgcgcctgggcaacgtcgacgccaagcgcgactggggcttcgccggcgattacgtcgaggcgatgtggctgatgacccagcaggccgaagccgacgattacgtcgtcgccaccggccagaccaccaccgtgcgcgacatgtgcgagatcgccttcggccacgtcggcctgaaggtcgaagaccacctggtgatcgacccgaatttcttccgtccggcggaagtcgacgtactgctcggaaacccggccaaggcgcgcgccaaattgggctgggcgcccaagaccagcctgcaggaactgatcacgatgatggtggacgccgacctgcgtcgtctgcgcaag

SEQ ID NO: 33246 - DNA, 432 bp, Desulfitobacterium hafniense
gcaaggttgctggttctgcatggtccgaacctcaatttgctcgggacgcgcgagccgcagacgtacggacacacgacgctggacgatatcaacgaagcgctggccaagcgcgcggccgaagcgggcatcgagttggatacgttccagtcgaatcacgagggagccctcgtggaccgcattcaggcagcgcgtggcgagggggtggacttcatcatcatcaatccggcggcctatacccatacgagtgtggccatgcgcgatgcgctcgctggcgtggccattcccttcgtcgaggtgcatctgtccaatgtgcatcgccgcgagccgttccgtcatcactcctatttctctgatcaggcgatcggggtgatatgcggcctgggctggcagggttatctgctggcgctggattacgcgcttgcacaggaacag

SEQ ID NO: 33247 - DNA, 1002 bp, Desulfitobacterium hafniense
cacgccaacctggcccagagctccaacgacaccatcccgaccgcgatccggggtcgccggcgctggcggtgcacgaaaccctgctgccggcgctcaagcacctgcgcaagaccatcgagcgccgggccaaggaattgaacaagacggtcaagaccggccgcacccatctgatggacgcgatgccgctgaccttcggccaggagttcggcgcctgggccgcgcagctgtattcggcccagcagcgcatcgaagacgcgctcaagcggctgcgccggctgccgatcggcggcaccgcgatcggcaccggcatcaacgccgatccgcgcttcggcaaggtcgtggccaaggcgctcagcgcggtcggcggcgtgcgtttcgaatcagccgccgacaagttcgaaggcctggccgcgcaggacgacgcggtcgagctgtccggccagctcagcgcgctggcggtggcgctgaccaaaatcgccaacgacctgcgctggatgaattccggcccgctggccggtttgggcgagatcgaactgccggcgctgcagccgggcagctcgatcatgccgggcaaggtcaatccggtgattcccgaggcgatggcgatggtctgcgcccaggtcatcggccaccacaccgcgatcaccgtggccgggcagagcggcaatttccagctcaacgtgatgctgccgctgatcgcccagaacctgttgagcagcatcgagttgctggccaactccagccgtctgctggctgacaaggccatcgccagcttcagggtcaacgagtcgcgcctcaaggaagcgctgtcgcgcaacccgattctggtcaccgcactcaacccgatcatcggttaccattatgccgccgatatcgccaagcaggcctacaaacagggtcgcccaatgatcgacgtccgcgctggagcacaccgacctgtcgcgcagccagctggaagagttgctcaatcccgagaagctcaccgccggcggcgtgtaagca

SEQ ID NO: 33248 - DNA, 651 bp, Desulfitobacterium hafniense
gtagaaacccagacccacggcgacatcgtcgaaatcaagctggcgcgcgcgccggtcaacgcgctcaacccggcgctgtgcaacgccgcgcgcgaggcggtcgagcacgccatcggccagggcgcccagggcatcgtgctcagcggcggcccgaaggtgttttcggcgggcctggacgtgccctatctgctttcgctcggcgatcagcgcgatcacctgctgctggcctggcaatcgttcttcggcctggcgcgcgcgctggcctcggcgcaggtgccggtggtcgcggcgatcgccggccacgcgccggctggcggctgcgtgctgacgctgtgctgcgactaccgcgtgatggccgccggcgatttccgcatcggcctcaacgaaacccaggtcggcctggtcgcgccggaaggcatccagcggctgatgcggcgcgtggtcggcacttatcgcgccgagcgcctgctggtggccggagcgatggtcgacgccgataccgcgctgcggatcgggctggtcgacgagctggtggagatcgagcaggtcgccgcgcacgcgcgcgagtggctgcagcaactgctgagcctgccgcgcagcgcgatgctgcagacccgcgcgctggcccgcgccgacctgatcgaagcgctg

SEQ ID NO: 33249 - DNA, 366 bp, Desulfitobacterium hafniense
ctcgagcgcgccgaccaggccatcgcgatggcggcgatgttcctgtccgagcacatcggcgtgcgcgcgatcgtggcgatgaccgaatccggcggcaccgtgcgtttcctttcgcgcttccgctcgaacgcgccgatctacgcgttctcgcgccacgccggcgcgcgccggcgcatggcgctgatgcgcgatgtctatccgatcgatttcgacagccgcggcatggcctcgcgcgacgccgcgcgcaacgtggtcaagcagttgttcgacgcgggcatgctcgaagccggcgagcggatgatcttcaccagcggcgatacgatggaacagcacggcgcgaccaacacgctgcgtctgctgcaggtg

SEQ ID NO: 33250 - DNA, 564 bp, Desulfitobacterium hafniense
gaacagcttgccgaaaccgcccaggcgatggtcgccgcgggcaagggcatcatcgcgatcgacgagtcgacgaccaccatcgccaagcgtttcgccggcgtgggcatcgagaacaccgaagagaatcgccgcgcgtaccgcgagctgctgctggccacgccgaagctcaacgaatacatctccggcgcgatcctgttcgacgaaaccctgcgccagtcgaccaaggccggcgtgccgttcgccaagcacatggccgaccacggcatcatcccgggcatcaaggtcgacaagggcccgcagccgctggccggcttcccgggcgaagtggtcaccgaaggcctcgacggcctgcgcgcgcgcctggaggagtactacaagctcggcgcccgcttcgccaagtggcgcgcggtcatcaacatcagcgacgacatcccgtcgggcacctgcatcgaggccaacagccacgcgctggcgcgctacgccgcgctgtgccaggagcagggcctggtgccgatggtcgagccggaagtgatcatggacggcagccacgacatcgacacctgc

SEQ ID NO: 33251 - DNA, 1284 bp, Desulfitobacterium hafniense
gtcgctgaagtcatgcggatggccgcacctttccaggtaatctctgcacaaggccctgcgcgggttggagaccggcaaggtcgggctcgaccccaccggcctggacctgagcagcgaagccgacctgaccgcgctcaagcgcgagctcaaggaaccgggcccggagcgcatgttctacatcggcgacgccttccgcgccggcctcagcgtcgaggacgtgcacgctctgtcgttcgtcgacccgtggttcctcgaccagatcgaggagctgatcgcgaccgagcgcgaagtcgccgaaggcggcctggccgcgctcgacaaggtccgcatgcgtgcgctcaagcgcatgggcttctccgacgcgcgcctggcccagctgaccggcaccgacgagaccgcgctgcgcaccctgcgccgggcgttcggcgtgcgcccggtgtacaagcgggtggactcctgcgccgccgagttcgccaccaccaccgcctacatgtactcgacctacgaggacgagtgcgaagccaacccgagcaaccgcgacaagatcatcgtgctcggcggcggccccaaccgcatcggccagggcatcgagttcgactactgctgcgtgcacgcggcgctggcgctgcgcgaggacggctatgaaaccatcatggtcaactgcaacccggagaccgtgtcgaccgactacgacacctccgaccgcctgtacttcgagccgctgacgctggaagacgtgctggagatcgccgacctcgaaaagcccaagggcgtgatcgtgcagtacggcggccagaccccgctgaagctggcgcgcgcgctggaagccaacggcgtgccgatcgtcggaacctcgccggacagcatcgatctggccgaagaccgcgagcgcttccagaagctggtgcaggacctgggcctggaccagccgctcaaccgcaccgagcgcaatcccgacgaggcgctggtgctggccgcgcagatcggctacccgatggtggtgcgcccgagctacgtgctcggcggccgggccatggaaatcgtctactccgaagcccacctgtcgcgctaactccgcgacgcgggcaaggtctcgaacgagtccccggtgctgctcgcacgatacctcgagaacgcgtgaaagtcgacgtcgacgtgatcgcgacggaaaggcgatgcgatcgcagagaatgagccaatcaaacgccagatcaatcgcaatcccggccaatcgagcaccgtgcacggcccccgaaacgtgaacagaaaacggcagagaagtca

SEQ ID NO: 33252 - DNA, 747 bp, Desulfitobacterium hafniense
atcgaggtcccggacgacgcttactggggcgctcagacgcaacgctcgctgatcaacttcgccatcggtcaggaacgcatgcccttgccggtactgcacgcgctggccctgatcaagaaagccgcggcccgggtcaacgaccgcaacggcgacctgcccgccgacattgcccgcctgatcgaacaggccgccgacgaagtgctcgacggccagcatgacgaccagttcccgctggtggtctggcagaccggcagcggcacgcaaagcaacatgaacgtcaacgaagtgattgccgggcgcgccaacgaactggccggcaacccgcgcggcggcaagacgccggtgcaccccaacgatcacgtcaaccgctcgcagagctccaacgactgcttccccaccgccatgagtatcgccaccgcgcaagcggtgcagacccaactgctgccagcgatcgccgagctgtcgggcggactggccgaactttcggcgcgacacatgaagctggtgaagaccggccgcacccacatgatggacgccacgccgatcacctttggtcaggagctctccggattcatagcgcagctggattacgccgaacgggcgattcgcgcggcggttccggcggtctgcgaactggcgcacggcggcactggcgtcggcaccgggctctactcgccccacgggttctgggaaacgattggcgctgtactcggcggcgtttccgggctgccggtcgtcacggggccg

SEQ ID NO: 33253 - DNA, 549 bp, Desulfitobacterium hafniense
cgcatcatgctcgcccgccacggagaacccccctggaacgccgaaggccgctaccagggacaggaagacatcgcgctgtcgccggtcggcgaaggccaggcgcgcgcgctcgccgcgcgtctgcgcgaagtgccgatcacccgcgcggtggcctcgccgctgtcgcgcgcgcgccgcaccgccgagctcgcgctcggcgaggagcgcgcgccgatgctcaagctcgacccgggcttgatggaaatcgcccacggcacctgggaaggcctgctcgccagcgaaatccgcgagcgcgacggcgaccgcctgcgcgcctggcgcgacaccccgcacgaagtgctgatgcccggcggcgaatcgatcgtgcacgtgctcgaccgcgcctggcccgcgttcgcgcgcgcctgcgaaggcctgaaggacgacgacaccttgctggtggtcgcccacgacgcggtcaaccgggtgctgctgtgcaagatcctcggcatcccgctggcgaagttgtggacgttccggcaggcgccgaccacgctcaatctgctcgaa

SEQ ID NO: 33254 - DNA, 870 bp, Desulfitobacterium hafniense
ctgagcttcggcgtgcccaacgcgctggaagtggcgatggccgaggagatcgtcaagatcgtgccgagctgcgagatggtgcgcatggtcaactcgggcaccgaggcgaccctgtcggcgatccgcgtcgcccgcggcgctaccggccgcagccgcatcgtcaagttcgaaggctgctatcacggccacggcgacagcttcctggtcaaggccggcagcggcgtgatgaccctgggcctgcccaattcgccgggcgtgccctcggcgctggccgacctcaccctcaccctgccctataacgacttcgacgctgcgacccagctgttcgacgaagtcggcggcgaaatcgccggcctgatcatcgagccgatcgtcggcaacgccaactgcatcctgccgcgcgagggttatctgcagcacctgcgcgcgctgtgcagcaagcacggtgcgctgctgatcttcgacgaagtgatgaccggtttccgcgtcgccctcggcggcgcgcaggctctgtacgggatcgagccggacctgagcaccttcggcaagatcatcggcggcggcatgccggtcggcgcttacggcggccgccgcgaactgatgagccaggtcgcgccggccggcccgatctaccaggccggcacgctcagcggcaatccggtggcgatggcggcggggcttgcgacgctggaactgatccaggcaccgggcttccacgccgacctggagcgccgtacccatgtgctgtgcgacggcctggaagcggccgcgcgcgaggccggcgtagccttccacaccacccgcgcaccgggcatgttcggcctgtatttccgcgaggggccggtggaaaccttcgaggacgccaaggcc

SEQ ID NO: 33255 - DNA, 1206 bp, Desulfitobacterium hafniense
aagaaggagacctccatggctgccaacgccgaattcaactgggctgacccgctgttgctcgaccagcaactgaccgccgacgaacgcatggtgcgtgacgccgccgcggcttactgccaggacaagctgatgccgcgcgtgctgcagtccttccgtaacgagaagaccgatgtggagatcttccgcgagatgggcgaactgggcctgctcggcccgaccatccccgagcagtacggcggccccggcctgaactacgtcagctacggcctgatcgcgcgtgaagtggagcgcgtggattcgggctaccgctcgatgatgagcgtgcagtcgtcgctggtcatggtcccgatctacgagttcggcaccgaagcccagaagcagaagtacctgcccaagctggccaccggcgagtggattggctgcttcggcctgaccgaaccgaaccatggctcggacccgggctcgatggtcacgcgcgccaagaaggtggctggcggctacgagctgaccggcgccaagatgtggatcaccaactcgccgatcgccgacgtgttcgtggtgtgggccaagctgatgggcgacgatggcaaggaagccatccgcggtttcatcctggaaaagggctggaagggtctgtcggccccggccatccacggcaaggttggcctgcgcacgtcgatcaccggtgaaatcgtgctggaccaggtattcgtgccggaagagaacatcatgccgggcgtcagcggcctgaagggtccgttcacctgcctgaactcggcccgatatggcattgcctggggtgcgctcggtgctgccgaattctgctggcataccgcacgccagtacacgctggaccgcaagcagttcggccgcccgctggccgccacccagctggtgcagaagaagctggccgacatgcagaccgagatcacgctgggcctgcaaggctgcctgcgcctgggccgcatgaaggacgaaggcacggccgcggtggaaatcacctcgatcatgaagcgcaactcgtgcggcaagtcgctcgacatcgcccgcgtggcgcgtgacatgctcggcggcaacggtatttccgacgagttcggcgtgatccgccacgtggtcaacctcgaggtggtcaacacctacgaaggcacgcacgacatccacgcgctgatcctgggtcgcgcgcaaactggcctccaggcattctct

SEQ ID NO: 33256 - DNA, 1122 bp, Desulfitobacterium hafniense
gttgattttaacgtacctatggatgaccatggcaatattaccaacgacacgaggattcgggcggctctgcctaccattcactatctgattgacgaaggggctaaaattatcctcgcttcccatttgggacgtcccaagggaaaaccggatccgaactattccctggctccggtggccaaacgtcttggtgaattgctcaagcgaccggtggccatggcgaccgattgtatcggtccggaggtagagaaagcagcagctcagctgcaggaaggtgaagtccttcttctagaaaatgtccgttatcatgccgaggaagaaaagaatgaaccggagtttgtcaagcaattagcccgcttagctgaagtgtatgttaacgatgctttcggtacagcccaccgggctcatgcttccacagaaggaatcgctcatcatcttcccggggtggccggctttctcctccaaaaggaaattgaaagtatgggcaaggctctggagaatccggagcggccttttgtggccatcattggcggagccaaggtcagtgacaaaatcggggtcattgagaacctgctccataaagtggacgctttgatcattggcggcggcatggccaataccttcctgaaagcccagggctattctctgggtaagtccctggtggaaggagataaattatccctggctcaggagattcttgagcaagggcgggaactccaggtggacattcttttgccccaggatgtggttgcggccaaagaatttaaagccgatgccccctatcgggtcacccctgtccgggagatcgccgaggacgaaatggctttggatatcggaccggaaagtgccggactgttcagtgcaagaatacaaaaggcccggactatcgtctggaacggccccatgggtgtctttgaaatggaacaatttgccaaggggacggagaaagttgctcaggctgtggccttatgtccgggtctgaccattgtcggcggtggagattccgtggccgccgtagaaaaaatgggtgtaggggagcaaatgagccatatctccacaggagggggggcttccctgaagctcctgaaaggcaagaacctgcccggtatagcggcactacaaaac

SEQ ID NO: 33257 - DNA, 801 bp, Desulfitobacterium hafniense
gctgtatggtcccggccgggcgcggtttacctgacgctggccgaactgcgcccgcttctggccccgggcgataccatcgtcgacgcggcaattccaactacaaggacaccgtgctccgcgccgtcgaactgcgcgagctcgtcctgcattacgtcgactccggcaccagcggcggcttgtgggtcttgcaggaggtctacagcttgatgatcgtcggcgacgtaggccgcggtcgtacgtcttcggccgatcttcgaataccctggcgccgtcgtccgagcgcggctggggccgggtcgggcccagcggctcgggcctacttcaccaagatgatccacaacggcatcgagtacggaatgtatgcaggcctatgccgagggcttcgccatcctcgggcgcaaggccgagttcggcctggacctgcaccagatcgcgcagatctggcgccacggcagcgtggtgcgttcgtggctgctcgacctcagcgccgatgcgctgggcaagaatccttcgctgcagggcatcgcgccgtacgtggaagattccggcgaaggccgctggaccgtggccgaggcgatcgacctggacgtgtccgcgccggtcatcaccgcttcgttgatggagcgcttgcgttcgcgtgagaaggactccttcgccgacaagctgctggcggcgatgcgcaacgagttcggcgggcacgcgatccgcaaggaatgacctgcgcgcggggcggctcgggtcgctgggcgatctgagccgaaagcgtcgggactgaagtccctcccacaaggaacactcttc

SEQ ID NO: 33258 - DNA, 1631 bp, Desulfitobacterium hafniense
  unsure (1)..(1631): unsure at all n locations
ggccatccggagaacttcgagaccccgggcgtggagaccaccaccggcccgctcggccagggcctggccaatgcggtcggcatggcgctggcggagaagatcctggcccagcgcttcaaccgcgaaggccacgacatcgtcgaccaccgcacctgggtgttcctcggcgacggctgcctgatggaaggcatctcgcacgaagtcgcgtccttnggccggcacctggggcctgggcaagctggtcgcgttctgggacgacaacaagatctccatcgacggcaacaccgacggctggttcaccgacgacaccgcggcgcgcttcgaggcctacggctggcgcgtgatccgcaaggtcaacggccaggatccggtcgagatcaagaccgcgatcgaaaccgcgctcaagcacggcgacaagccgaccttgatctgctgccgcaccaccatcggcttcggctcgccggccaaggcgggcaaggagtcctcgcacggcgcgccgcttggcaaggacgaagtggccgcgacccgcgccgcgctgaactggccttacgccgaattcgaaatcccgcaggacatctatgccggctggcgcaaccgcgaccacgctagcgcgcaggcgcagtggcagcaggccttcgacgcctacgccgcgcagttcccggccgaagccgccgagctcaagcgccgcatcgccggcgagctgccggccgacttcgtcgcccaggccgatgcgtatatcgccaagcagcaggccgacggccagaccatcgcctcgcgcaaggcctcgcagatggccatcgagaccttcgcgccgctgctgccggaactgatcggcggctcggccgacctggcgcactcgaacctgaccctgtggaaggccagcaagtcggtcgccaccagcgatccgaacgcgaactacgtctactacggcgtgcgcgagttcggcatgagcgcgatcagcaacggcctcaacctgcacggcggcttcatcccgttcgacgccaccttcctggtgttcagcgactacgcccgcaacgcggtgcgcatgagcgcgctgatgggcgcacacgtgatccacgtctacacccacgactccatcggcctgggcgaagacggaccgacccaccagccgatcgaacacctcgccagcctgcgctacatcccgcacaacgacgtgtggcgcccgtgcgacgcggtcgaatcggcggcggcgtggaaggcggcgatcacccgcctggacggcccgagctgactggtgttctcgcgccagaacctgacgcaccagacgcgcgacgcgcagcaggtcgcgcagatcgagcgcggcggctacgtgctgcgcgacagcgacggcgcgccggaggtgatcttgctggcgaccggttcggaaatcggcctggccacccaggccgacgaccaactccagcgccgaaggcgtcaaggtgcgcgtggtgtcgatgcactcgagcgacgtgttcgaccgccagccgcaggactaccgcgagatggggcagaccaacgcggtgcgcaagcgcgtggcgaacaaagccggcgtcacgaaatactggccccagtacgtcggcgtggaccgcgaagttggcagcatcaaccgaacggggaccttggccaggcca

SEQ ID NO: 33259 - DNA, 824 bp, Desulfitobacterium hafniense
ggactgagcgtgtcgaactggtgttcaccgcctgggcctcggcctcgaccttccgcggctcggacaagcgcggcggcgccaacggcgcgcgcatccgcctggcgccgcagaaggactgggaggtcaatcagcccgcgcagttggccaaggtgctgacggcgctggaaggcatccagaacgacttcaacgcctccgccggcggcggcaagaaagtctcgctggccgacctgatcgtgctcggcggcgccgtcggcgtcgaacaggcggcgaagaacgccggcgtgtcggtcgaggtgccgttcgcgccgggccgcatggacgccagcgccgagcagaccgacgtcgactccttcgccgtgctcgaaccgctcgccgacggcttccgcaactacctgcaaggccagtacaagccgagcgccgaagcgctgctggtcgaccgcgcgcaactgctcgacctcagcgcgccggagttgaccgcattggtcggcggcctgcgcgtgctcggcgccaacgccggcggcagcaagcacggcgtgttcaccgacaaggtcggcgcgctcagcaacgacttcttcgtcaacctgctcgacatgggcacggtgtggaagccgacctccgatgcgcaagagacgttcgaaggccgcgaccgcaagaccggcgcggccaagtggaccggcacccgcgtcgacctggtgttcggctcgcactcgcaactgcgcgcgatcgccgaggtctatgccagcagcgatgccaaggagaagttcgtgcgcgacttcgtcgcggcctggaacaaggtcatgaacgccgatcgcttcgatctgaag

SEQ ID NO: 33260 - DNA, 1321 bp, Desulfitobacterium hafniense
atgccgcgttccgcgcgcgttcgagcaagtaaaccgctgcatcccgccgtcttcgccacccatcccttccaccccaacctcccacacaccgcgacacccaacggaatcaagcaaatgagcgcctccgaccgcagcaacctccgtgccgtcaaccttcccgccgactggagcccgacctcttggcgcgagcgcaccgcactgcagctgccgacttatccggaccaggccgaactcgagagcgcattggccgaactgcgccatctgccgccgttggtgacctcgtgggagatcctctcgctcaagcagcaactggccgaggcgcaggaaggcaagcgatttttgctgcaaggcggcgactgtgcggagagcttcgactcgtgcacctccgacgtcatctccaaccggctcaaggtgctgctgcagatgagcctggtgctggtgcacggcatgcgcaagccggtggtgcgcgtgggccgtttcgccggccagtacgccaagccgcgctcggccgacagcgagaccatcgacggggtgaccctgccgagctaccgcggcgacatggtcaacggcccggccttcaccgaggccgcgcgcaagcccgagcccgcgccgcatgatcaaggcgcacgcgcgttcgtcgatgacgatgaacttcgtgcgtgcgctgatcgacggcggtttcgccgacctgcaccatcccgagtactggaacctcagctgggtcggccactcgccgctggccgacgaataccggcgcatggtcaacgccatcggcgacgcggtgcgcttcatggagacgctgtcgggctcggaggtgcacaacctcaaccgggtcgacttctacacctcgcacgaagcgctgctgctgccgtacgaggagtcgctgactcggcaggtgccgcgccactggggccacttcaacctcagcacccactacccgtggatcggcatgcgcaccgcggcggtcgacggcgcccacgccgagtatttccgcggcatccgcaatccgatcgcgctcaaggtcggcccgtcggtgacgccggaccagatgctgcgcacgatcgacctgctcaaccccgaggacgagccgggccggctgaccttcatccaccgtatgggcgcgactgcgatcgccgacaagctgccgccgctgctggaggcgatgcgccgcgacggccgccgcgtgctgtgggtgtgcgatccgatgcacgggaaacacgagaagcccagcaacggctacaggaccggcggtaccgaaaatcgcgccgagatcaagcaactttgactggagccggggcggaccggctggggggtgcactga

SEQ ID NO: 33261 - DNA, 1166 bp, Desulfitobacterium hafniense
gtgatctcgacgctacggaccggccggccacagtcctttcgcgtcaagttaacccgagccgtcccgatgacatgtcgtcccatggcgtcaatgcgttgctctcgcgctacgacatcgacccggccagcttcgaggattgcatcgtcggcgccggctctaacgaaggcgctcagggttacaacatcgtccgcaacgtgtcggtgctctcgcaactggtcaccggcaccgccggcatgaccctcaatcgtttctgttcgtcgggtttgcaggcaattgcgattgccgccaaccagatcgcgtcgggttgcagcgacatcatcgtcgccggcggcgtcgagtcgatcagcctgaccctgaaaagcgtcaacaccgatcacctgatcaacccgttgctcaagcagcagacgccgggcatctactacaccatgggccagactgccgaagtggtggcgcgccgttatggcgtcagccgcgaggcgcaggatcgttactcgctgcaaagtcagatccgcaccgcccaggcgcaggcagccggcctgttcaacgatgaaatcgtgccgatggcggtgaagtaccgcgttgaagacaagaacagcggtgacgtgcagatcctcgacggcatcgtcgatcgcgacgactgcaaccgcccggacaccacctatgaaagcctcgccgggttgaaaccggtgttcgccgaggacgggtcggtgaccgccggcaactcgtcgcagttgtccgacggcgcctcgatgacgctggtgatgagcctggaaaaagccctgcaactggggctcaagccgaaagcatttttccgtgggtttaccgtggccgggtgcgagccggacgaaatgggcatcggcccggtgttctcggtgccgaaactgctcaaggccaaaggcttgcaggtggcggatatcgatctgtgggaattgaacgaagcgtttgcctcgcagtgcctgtatgcccgtgatcgtctggaaatcgacaacgagaagtacaacgtcaatggcggctcgatttccatcggccacccgttcggcatgaccgggtcacggcaggtcgggcatctggtgcgcgagttgcagcggcgcaatctgcgctacggaatcgtgaccatgtgtgtgggcggggggatgggcgcgaccgggttgtttgaggccgtacgc

SEQ ID NO: 33262 - DNA, 621 bp, Desulfitobacterium hafniense
caggcgctgatcttcgatctcgacggcgtgctcaccgacaccgcgcaaacccactaccgcgcctggaagcgcatggccgacgaagaaggcctggcgttcgaccaacacgtcaacgagcggctcaagggcgtggaccggatgagctcgctggaaatcatcctgcgccacgccggccgcaccctcagcgccgaacagaaactggcgctggccgaacgcaagaacggttactacgtcgaagccatcgccgaggtcaccccggccgacctgttcccgggcgtgacgcgcgtgctcgaacgcgcgcgcgcgcgcgggctcaagctcggcctggcctcggccagccgcaacgccgccgtcctgctcgaccggctcggcatcgccgaacgcttcgactacatcgccgacgccgcgcggatcgcccgcgccaagccggcgcccgacatcttcctcgacgtcgccgccgcgctcggcgtggcgccggcgcagtgcatcggcatcgaggacgcggccgccggcgtggccgcgatcaagtccgccggcatggccgcgatcggcatcggcgatgcgcgcacgctcgcccaggccgacgcctgcctgccggatatcgccgctttcgacgtagac

SEQ ID NO: 33263 - DNA, 1062 bp, Desulfitobacterium hafniense
tatctggcgactccgccggatctgttcgtgccctgcgccaagggcttgaaagcggccggcctgctcgaaggcgaatcgcggttggtcctggaaaaacccatcggccgcgacctggcctcggcgcgcgagatcaacgccgcgctgcgcgcctgcctggacgagtcgcggatcttccgcatcgaccattacctgggcaaggccgcggtgcagaacctgctggcgctgcgcttcggcaacaccttgctggaggcggtgtggcaacaccgctggatcgagtcggtcgacatcttcgtcggcgagaccgccggcgtggacggccgcgaaggctattacgcgggctatggcgcgctgcgcgacatggtccagaaccacatgctgcagctgctcgccctgatcgcgatggagccgccgtcggcactggacgccgattcgatccgcgacgagaagcgcaaggtgctgcgcgcgctgcgcccggtcagcgcggccgacgcggcgcagcgcacggtgcgcgggcgctatggcgccggcgtggtcgagggccgcgcagttaaagggttcgtgcacgaatcgccggtggaaactttcgtcgcagtcgagaccttcatcgacaactggcgttgggcgggtgtccccttccgtttggtcaccggcaagcgcctggccgagcgcgccaccgaagtggtggtgtcgttccggccgacctcgcactggctgttcgaacgcccgcgccgcggccgcgaacgccccaaccgcctgcgcatgcgcctgcagccggacgagaccatcgagctcggcctgatgggcagcctggccgcgccggaatggggcgcgctggagctcaagccgatgtcgctggacctgtcgatgtcgggctcgccgcagcggcgcatcgcctacgagcgcctgatcgtcgacgcgctgcgcggcaaccagaccctgttcgtgcgcgacgacgaagtcgaagcggcgtggcactggatcgacagcatcgagagcgcgtggagcgaaaccgcgcagcccgcgctggagtatccggccggctcgtggggcccgaccgaagcc

SEQ ID NO: 33264 - DNA, 1227 bp, Desulfitobacterium hafniense
ctggtgaccgcggtgctggtgtggatctacgactggcgcttcgccgcggtcgcgatcggcaccttgctgctctacggcctgtggacggtggcggtgaccgagtggcgcacgcgttactaccgcgccacggtcgaggccgacacccgcgccaacgaacgcgcggtggattcgctgctcaactacgagacggtcaagtacttcaacaacgaagaacacgaagcgcgccgctacgacgagaacctgcgccacctggagaacgcccaggtgatgtcgatcaagaccctggccgtgctcaacctcggccagagcctggtggtggcgctgggcgtgaccgcgatgatgtggctggccgcgcagggcgtggtcgaaggccgcatgaccgtcggcgacctggtgctggtcaacgcctacctgctgcagctgtcggcgccgttgttcatgctcggcatgatgtaccgcgaagtgaagcaggcgctgaccaacatggagcgtctgttcggcctgctcgacgaacgccaggacgtgcgcgacagcgccggcgcggtagcgctggcctcggcgcggccggcggtgcgcttccgcgaggtgcgcttcggctacgacccgcgccgcgagatcctgcgcggcgtggatttcgacatccccgccggggccaccgtcgccgtggtcggccactcaggttcgggcaaatcgacgctggcgcggctgctgtaccgcttctacgacgtcgaaaccggcgcgatcgagatcgacggcaccgacctgcgcgcgctgtcgcaatcgtcgctgcgcggcgccatcggcatcgttccgcaggacacggtgttgttcaacgacaccatcggctacaacatccgctacggccggcccgaagcgagcgaggccgaagtcgaggcagccgcgcgcgcggcgcacatccacgacttcatcaaagggctgcccgacggctacgacaccccggtcggcgagcgcggcctgaagctgtcgggcggcgagaaacagcgcgtggcgatcgcccgcgccctgctcaagaacccgtcgatcctgatcttcgacgaagccacctcggccctggactccaagtccgagcgcgcgatccaggccgaactcgaccgcctggcggtggggcgcaccaccttggtgatcgcgcaccgcctgtcgacggtgatggacgccgaccaaatcctggtgatggacgccggccgcattctcgaacgcggcacgcat

SEQ ID NO: 33265 - DNA, 966 bp, Desulfitobacterium hafniense
atttatgcccgtatcgcgggcaccggcagctacctgccggcccaggtggtgaccaacgacgagctggccaagcgcgtcgagaccagcgacgaatggatccggacccgcaccggcatccgccagcgccacgtcgccgccgaaggcgaaaccaccgtcgacctcgcctatcaggcctcgctgcgcgcgctcgaagccgccggcgtcacgcccgaagagatcgacctgatcgtcctgggcaccaccaccccggacctgatcttcccgtccagcgcctgcctgctgcagcaccgcctgggcgccaacggctgcccggctttcgacgtcaacgcggcctgctcgggcttcgtctacgcgctgaccgtggccgacaagttcatccgttccggcgcggccaagaccgtgctggtcgtaggttcggaaaccctgacccgcatgctcgactggaccgaccgctccacctgcgtgctgttcggcgacggcgccggcgcggtggtgctcaaggccgacagcgagaccggcatcctcagcacccatctgcacgccgacggcggcaagaaggaactgctgtggaatccggtcggcgtctcggccggcttcaagcccgaagagcacaacgccggcgtgcgcgtgctgatgaccggcaacgaagtgttcaagcacgcggtcaaggcgctggattcggtggtcgaagagaccctggaagccaacggcctggaccgccacgagatcgattggctgatcccgcaccaggccaacctgcgcatcatcgaggccacggccaagcgcctggacatgccgatggagcgggtgatcgtcaccgtcgacaagcacggcaacacctcgtcgggttcggtgccgctggcgctggacgaggcggtgcgttcgggcaaggtgcagcgcggccagcttttgctgcttgaggcgttcggcggcggtttcacctggggttcggcgctgctgcgttac

SEQ ID NO: 33266 - DNA, 675 bp, Desulfitobacterium hafniense; identical to SEQ ID NO: 32380

SEQ ID NO: 33267 - DNA, 1083 bp, Desulfitobacterium hafniense
attggaaccggattgttttatggttcggcgacgacgattcagttggtcggtccggcgattatcgtgtcctacctcctgggcggcacggccattttttttattgtcaggcattaggagagatgtgtgtcgatcagcccgttgccggcgctttttcatactttgcctataaatatctgggtgacttccccggattcttttccgggtggaactattggtttaactacatagccgtcagtatggctgagttaaccgttgtgggagtgtatatcaacttttggtatcctaatgtgccccagtgggtaacggccttggctttcctggtgatcatcaccttaatcaatcttatcaatgtgaagccttcggagaatcgaattctggtttgctttgattaaggttgtcgcgattctggcgatgattgcctttggcttggtcatgattttctttggcttaggggaacaaggggctgtaggattcagcaacctttggacccatggaggctttttgcctaatggtgtatgggggctgctcctatccctggtaattgtgatgttttcctttggtggagttgaattgatcgggattacggcagcagaagcagacgatcctaagcgctccattccgaaagccatcaaccaggtcgtctggcggattctcatcttctatatcggtgccttgaccatcctcatgattctttatccctgggatcaaatcggaacctcaggaagccctttcgtggagatcttctccgccatcggaatccccgccgcggctcatatcttaaactttgttgttttaacagcggctctttctgtttataacagcgggatttacagtaatggacgtatgctgcacgggttagccctgcaaggaaacgctcccaagtttttaaccaaagtaagccgcaatggcataccgattaatggggtttttgcctcttctgcagtcaccctaatcgcggttatccttaatttccttgttcccgggaaggttttcctctatttaatttctatcgccaccattgccgggatctttaactgggccatgatcctggtaacccagcttaggttcagaaaagtcgaagca

SEQ ID NO: 33268 - DNA, 915 bp, Desulfitobacterium hafniense
accgccgtggtgctggtcaacctcggcacgcccgaggccgccaacaccgcggccgtgcgccgctacctgtccgaattcctgcacgaccgccgcgtggtcgacatgagccgctggctgtggtgcccgctgctgcatttcgcgatcctgccgctgcgcagcagcaaggtcgcgcacaagtacgccagcgtgtggctgccggaaggctcgccgctggcggtgcacacccgccgcctggccgaagcgttgcagcgcgaactgccgcagctgcgcgtgctacacgcgatgcgctacggccagccgtcgtggaagcagttgctgccgcgcctgcgcgagcaaggcgtcaaacgggtgctggcgctgccgctgtatccgcagtattcgacctccaccaccgcctcggtcggcgacgtgctcgacgcggcgcagggcctggacaagcgcctggtcaacgactatcacaccgatcccgagtgggtcgccgcggttgccgactcggtgcgccgccaccgcttcgccaacggcgccggcgaacacctgctgatgtccttccacggcctgccgcagcgcttcgccgccgccggcgatccgtatccgcagcactgcgaagccagcgcgcgcgccatcgcccagacgctggacctgcccgagcaggcctggagcctgagctaccaatcccgcttcggccgcgaacgctggctggagccgtccaccgccgacaccttgaccgccctggccgcgcgcggcgtgcgccaggtcgacgtgatcgccccgggcttcgccgtggactgcctggaaacgctggaagaagtggcgatgatgctggccgaggacttcgccgcgcgcggcggccggctgcgctacatcccctgcctcaacgaatcgccggcgcacgcgcaggcgctggccggaatcgtg

SEQ ID NO: 33269 - DNA, 765 bp, Desulfitobacterium hafniense
gccgtggacaacggcatcttccgcgcctacgacatccgcggcgtggtcggccagagcctggatccgggcatcgccgagctgatcggccatgccatcggttcggtcatgcacgaccagggcctgaccgaaatcgtggtcggccgcgacggccgcctgtccggcccgagcctgatggccggcctgatcgccggcctgcgcaaggccggccgcaacgtcgtcgacatcggcctggcgccgaccccggtcacctacttcggcgcctaccacctgcgcgccggttcctgcgtgtcgctgaccggcagccacaacccgccggactacaacggcttcaagatcgtggtcggcggcgaaaccctgtcgggcgacgcgatcaccgatctctaccgccgcatcgtcggcggccgcctgcacaccgcggccgagccgggcacgctggccgagcgcgacatctccgaagactacgtccagcgcatcgcctccgacatccagatcgaccgcccgctcaaggtcgtggtcgacgccggcaacggcgtggccggcgacatcggcccgcgcgtgctggccgcgatcggcgccgaggtcactccgctgtactgcgagatcgacggcgagttccccaaccaccatcccgacccgagcgagccgcacaacctggtcgacctgatcaagatggtgcagcgcctggacgcggacctgggcatcgccttcgacggcgacggcgaccgcctcggcgtggtcacccgcgacggccagaacatcttcccc

SEQ ID NO: 33270 - DNA, 525 bp, Desulfitobacterium hafniense
aggtatggaagcgggtatttttacctcacccaaagagaaaatatcgaaatccctggtattctattagataacctgaacgaggtatctcaatctcttgctgaagtcggtttgagcatcggttctacaggacccaggccaagacccataacaacttgtaaaggggctgtgtgcaaattcagtctttatgacaccgagggctacaccagtcaactcaatgaaaaaatttataaaggttattatgatgtgaccctgcccggtaagcttagaattattaccagtggctgttttaataactgttccatgcctcatgtgggctgcattggcatcattggcaagaaaaaagaccaagtcgccatcagtcttggagggatggccgcacgcaagcaatttttaggccaggaaatccaaggtctttatactttagatgaggctaccgggatcattgaaaaagcgattcaatactacaaggagcatggcaataagggcgaacgctttgctcaaatgattgagcgtttgggctttgaa

SEQ ID NO: 33271 - DNA, 762 bp, Desulfitobacterium hafniense
caaaaaaggatgtgctccagcttttacggctggtatcttgatcggcgcatcagccggcgcaagatccacccttttgtttgcaaatttgatctggacttatccattgccgagaaaaacctcaaagatttttcttcatttaatgatttcttttaccgtaagctaaaaccatcagcccgttctatcgacccctgtcaagactccctcatctctttgggggatggtaagttgctggcctacgaagacattaacttggactgcttggtccaggttaaaggccttacttacagtcttaaagaactgattaaagacccggagacggcttcaaaatacaagagaggcacctgcttgattctacggctatgccccacggattatcaccgttttcattttatcgacagcggtatctgtgaaccctctcaccgtattaaaggctcttactactccgttaatccggtggctctgcagaaggtagccaagcttttctgcgagaacaaaagggaatggagcattttccattcagaccattttggagatattctcaccatcgaagtaggcgctacttttgtgggctccatcattcagagctacactccccaccaaccggtggcccggggagatgaaaaaggctatttcaaattcggcggttccacggttctgctctttttcgaagaaaataagattaagatcgatcccgatattgttgaacagacaaaattaggctatgagacttatattcttttcggagaaaaaatcggtgtccgc

SEQ ID NO: 33272 - DNA, 713 bp, Desulfitobacterium hafniense
ctctcccaagattcagccatgtccacgttccccgagttccgtccccgccgcatgcgtcgcgacgacttctcgcgccgcatgatgcgcgagaatcgcctgtcgcctgacaacctgatctatccggtctttatcctggaaggccagaaccagcgacagaccgtggcgtcgatgcccggcgtggaacgtgtgtccgtagacctgctgatgccggtcgcggaagactgcgtgaagctcggcattccggtcatcgcgctgttcccggtgatcgatccgtcgctgaaaacacctgacggcatcgaggccaccaacccggaaggcctggtgcctcgcgccgtgcgagcgctgaaggatcgctttcccgaacttggcgtgctgaccgacgtcgcgctcgatccgtacacgagccatggccaggatggcgtgctcgacgagaacggttacgtgatcaacgacatcaccgtcgagatcctcgtcaagcaggcacttgtccaggcggaagcaggtgtcgacatcgtcgcgccgtcagacatgatggacggccgtatcggcgccgtgcgcaacgcgctggaagaagcgggccacatccacacgcgcatcatggcctactcggccaagtatgcgtccgcgtactacggcccgttccgcgatgcggtgggctcggacagcaatcctgggcaaggcaacaagatgacttacagatggaccgggcaata

SEQ ID NO: 33273 - DNA, 945 bp, Desulfitobacterium hafniense
gtcgccgccgaggccgagcgcgactgcgcgcgctgatggcgattcccgacgactacgccgtgctgttcctgcaaggcggcgccaccgcgcagcaggcgctgatcgcgctgaacttcgccaaccccggccaggccgtggactacgtggtcaccggccactgggggcaagaccgcattgaagcaggtcaagccttatgtgagcgcgaacgtggccgccaacggcgaggccggcggcttccgcgacatcccggcgcgggccgagtggaacctgtccaaggacgcggcctacgtccactacaccgccaacgagaccatccacggcgtcgagttccgcgacatccccgacaccggcgatgtgccgctggtggccgacttctcctcctcgatcgccgccgagccgctggacgtgtccaggttcggcgtgatctacgccggcgcgcagaagaacctcggcccggtcggcgtcagcgtggtgatcgtgcgccgcgacctgctcgaacgcgccggccagccgcgcgcggacatcttcgactaccgctcgcacgtcaagggcgagtccatgctcaacaccccgccgacctggaactggtacctggccggcctggtgttcaagtggatgctggccgaaggcggcgtggaagagttcgccaagcgcaacgcgcgcaaggccggcctgctgtacgaggtgatcgacaactccggcggctattaccgcaacgaagtcgccgccgccgcgcgctcgcgcatgaacgtgccgttcttcctcaaggacgaagcgctggacaagcccttcctcaaggaagccgaagcggccgggctgatctcgctcaagggccaccgggcgctgggcggcatgcgcgcgtcgatctacaacgcgatgccggaggcgggggtccaggccctggcgtccttcatgcgcgacttccaacaaagacacgggtgagcg

SEQ ID NO: 33274 - DNA, 888 bp, Desulfitobacterium hafniense
cggccatcgccctggaaaacggctgatccgcgcgctgcgccgcgatcgccgcggcgcacgcatcgccgacatgcacctcaggaaccaggtacgccaaggaattcaggagaccgcaggatgagccagcagaccccgccgcagtccttcgccgacgaagtgcgcggcacccaggccaagccgatcgacaagaccttgtcgcggctgatggacgacctgtacgaccagggccccggcatcgacggcttcaagccgctcagcgccgatcagctgcgtagcaagggcatcgacccggccggtttggagaacaaggactccggttttctcgcccgcatctacggcgacgaacacggccattacgtggtcgccttttcgggcaccgacgaaggcaaggactggctgaccaatttccgccagggcctgggcttcgaggacgcgcagtacaaccaggccatcgcgctggcgcgcgaggccaaggtcgcgttcggcgacgaggtggtgatcaccggccattcgctcggcggcggcctggccggcgtggcttcgatctccagcggcattccggcggtgaccttcaacgcctcgggcgtgcacgacaagacgctcgagcgcatcggcatcgacgccgacgcggccaagcgcgaagtcgccgacaacggccagatccgccgctatgcggtcaagaacgaaatcctgaccgacctgcaggagcacagcatcccgctgaagtgggcgatgcccgacgcggtcgggcacaagatcgaattgcccgatccggacccgcaatcgttctggcagaaattgattcccggcagcggcatcaagcacggcatcgacatccattacatcgaagcggtgatcaaggcgcaggaacaggcgatgccgggcgag

SEQ ID NO: 33275 - DNA, 872 bp, Desulfitobacterium hafniense
gatgccacagggaggaaatagaacggaccctgatcgctcaagcccttggggaagagcgaatccttgtcaaagaagagcaattcctgctggatctcttaaaaaactcaaagggagaggtcatcggggcgctcagcctcaatgagctgactcatgagctggagatttatctggcccaagccgtcgttttggctacaggaggattaggtcagctctactgttatacgactaaccctgaagtggccacaggggatggtatagcggcggcatatcgggcaggagcccaattgatggatatggagtttgtccaatttcaccccaccgctctgtttattccgggagcaccgcggtttttaatctcagaagctgtccggggggagggagctcagcttctcaatgctcagggagaacggtttatgcaggatgttcccggcaaagagctggcaccccgggatgtggtagcacgggggatttggcgggagcaggctaagggtgaggtaaccttggatttccggcccatcggtgtagcaaaagtgccccggcgtttcccgatgatttatcagacctgcctggactatgggatcaatgtcctggaggagcggcttcctgtagctcccgctgctcattatatgatgggcggagtccgcacggatgaaaggggaaggacaagcctccccaatctttacgccaatggggaatgcgcctgcaatggtgttcatggagcgaaccgattggccagcaactctctgctggatgggctcgtctttggggggcgtatcgtggaagatatgtggacaacgaccagcctaaggctctactaatctcaaggttccgactcaattcgtaatcaggcatacgtttcggtgtgaatgtat

SEQ ID NO: 33276 - DNA, 939 bp, Desulfitobacterium hafniense
aaagtgatgatcgaccaggtgctcagccacacctccaacgagcacgagtggttcaagcgcagccgcgagagccgcgacaacgaattcgccgactggtacgtgtgggccgacgcgcgcgccgacggcaccgcgccgaacaactggatgtcgctgttcggcggcgtggcctggcgctgggaaccgcgccggcagcagtactacctgcacaacttcctgtccgcccagcccgacctcaacttccaccatcccgcggtgcgcgcggcggtgctggacaacgtgcgcttctggctcgagcgcggcgtcgacgggctgcgcctggacgcgatcaacttctgcttccacgacgcgcaactgcgcgacaacccgcccaagccgccggcgcagcgcgtaggccgcggctttagcccggacaacccgtacgcgttccagtaccaccattacaacaacacccagccggaaaacctggccttcctcggcgagctgcgcgcgctgctggaccgctatcccggcgcggtggcgctgggcgagatctcctcggaggactcgctggcgacgatggacgaatacacccgcaacggccgcctgcacatgggctacagcttcgagctgctgaccgaggactataacgtcgagcacatccgcggcaccgtgcagcgggtcgaggcgagcatgcgcgaaggctggccgtgctgggcgatctccaaccacgacgtgcagcgcgtggtcacgcgctggggccggggcgaagcgccgaagcatttcgccaccttggtcagcgcgctggcgtgctcgctgcgcggctcggtgtgcgtgtatcaggacgaggaactcggcctgcccgaggccgaggtaccgttcgaggcgctgcaggatccttacggcaagaacttctgaccgaactttcaggggcgtaacggctgccgcaacccgttgccgtgg

SEQ ID NO: 33277 - DNA, 594 bp, Desulfitobacterium hafniense
ccgcccgggctgctggagcgcctggacctggccgacaagctcaagttcaaggtcgaagagctgtccggcgggcagaagcagcgcctgtcgatcgccctggccttgctcgacgatccgcagatcgtgttcctcgacgagccgaccgcggcgctggacccgcacagccggcgctacacctgggaattcatcgaggagctcaagcgcgaccgcaaccgcaccatcgtgctgaccacgcactacatggaggaagccgagcggctgtgcgacgagatcatgatcatgaaccagggcgagatcgtcgggcagggcatgccgtcgctgctgatcgccgacctcaatgcggcccggcaaacccgcatcaagctcgccgcggacgcgcccggcgaggccatcgcgcgggcggtttgcgcgcgttacccgacggcgtgggacgccttcaccgattcgctggtgatctcctccaacgaagtcgccgaggccctgggcgaggcgatggcgcaggcgcaggcgcacggcgccgccatcgtcgacatccatctggaacggctgagtctggaagacgtgttcttgaacaaaaccggcaaggaattgaag

SEQ ID NO: 33278 - DNA, 957 bp, Desulfitobacterium hafniense
gcgcgcgcggcgatcctggattcgctgcacgcgctgcaccgttatcccgacccgctcggcggcgacctcaagcgcgcgctggcgcacaagcacggcgtcgatacgaagcagatcctgctcggcaacggttcgcacgaactgctgatgcagctcggccaggtgttcgccggccccggcgaagaagtggtgttctcgcgctacggcttcgccgtgttcgcgctgtcgacccaggcggccggcgcgcgcatgaccatcgtcgatgccttgccgcgcgaggccgccatgccgtgcgggcacgacctcgacgccatcgccgcggcggtgggcgccgacaccaagctggtgtacgtggccaatccgaacaatcccaccggcacctggttcggccgcgaggcgctggtcgaattcctcgacaagatcccgccgcaggtgatcgtggtgatggacgaggcctacgccgagatggccgacgcgccggattacgccagcgcgttgagcgtgctggatcgctatcccaacgtcgcggtgacgcgcaccttcagcaaggcctatggtctggccggcctgcgcgtgggctatctgatcgcgcagccgggtttgatcgcggtgatggaccgcctgcgcgagagcttcaacgtcaacggcccggcgctggccgcgtgcgaggccgcgctcggcgacgacgaccatctgcgctgggcctgcgcgcgcaacgccgagcagcgcgccgcgctggccgaggccttgaaccgacgcggcctgcgcgcgttcccgtcgcagaccaatttcgtcctggccgaattcggcgcgcgcacgccgcaggtggaagccgcgctggtcgcgcgcggggtgatcctgcggccgatgggcggctacggcctgggcgactgcatccgcatcagcgtcggctcggccgacgagaaccgtcgcctgctggcggcattggaccaagtgctg

SEQ ID NO: 33279 - DNA, 1359 bp, Desulfitobacterium hafniense
gacgccgatgaagcggcatccgctgcggaaacacctgccgttgccatcgccgtgctcgcgccggtgcgcgaagacatcgccgtcgtcggcatgggcggccgctatcccggcgccgcctcgctcgacgagttctgggacaacctgcgcagcggccgcgacagcgtcggcccgatgccgcgcgaacggctggcgcggcgccagcgcaaggcgcccagccgcgactaccgcggcggtttcctcgactgcgtcgaccgcttcgattcgctgttcttcaacatctccccgcgcgaagccgaggtgctggacccgcaggaacgcctgttcctggaagtggcctgggaaaccctggaagacgccggctattacccggaactgctcgcgcaggatccgcgcacgcgcaaggtcggcgtgttcgtcggcgcggtctgggcgatgtaccagatgctcggggtcgaggaaaaactggccgggcgtccgctgacgccgaactcgttcttgtggagcgtggccaaccgcgtgtcctattggatgaacttcagcggccccagcctcagcgtcgacaccgcctgttcctccagcctgaccgcgctgcacctggcctgcgaggcgatccgcaacggcgattgcacagccgccctggtcggcggcgtcaatctcgacctgcaccagcacaagttcgacatcaataacgccggcggcgcgctctcgcccgacggcgtgtgcagcagcttcggcgccagcgccaacggctatgtggccggcgagggcgtcggcgcgttgttgctcaagccgctgtcgcaggccttggccgatcgcgaccagatctacggggtgatccgcggcgccgtggtcaaccacggcggccgcaccagcggctacaccgtgcccaacccgcgcgcccagggcgaactggtggccgcggcgctggccaaggccggcgtcgatgcggccagcgtcggctacatcgaagcgcacggcaccggcaccgagctcggcgatccgatcgagatcgccggtctgagccaggccttcgccagcgccggcttgccggcgcgcgcgtgcgcggtcggctcggtcaagaccaacatcggccatctggaagccgccgccggcgtggtcggcgtgagcaaggtgctgttgcagatgcggcaccggaaactggtgccgtcgctgcacagcgccgagctcaacccgcatatcgatttcgacgccaccccgttctacgtgcagcgcgagctgcaggactggacgccgcgcggcgccgcgccgctgcgcgcgggcgtcagctcgttcggcgccggcggcgccaacgcgcatgtggtgatcgagcagtacccgtcggccgtcgatgaagagacc

SEQ ID NO: 33280 - DNA, 1089 bp, Desulfitobacterium hafniense
ttctgtctgtctccgcaaggcatttccatcggcgtgatcggcccggtcaaggtcggtcgcgcgctgctcgcgcatttggccgccgcgcaaccgcgtttccagcgcgaatcgcgcccgcagcggcgcctggacctgcgcctgcgcgcgctcgccgacagccggcgcatgcgtctggcgccgcgcgcgctcgagttcgacgacgctcacgcgctcgaggccgagtccgaagcgctggacctgaagcgcttcgccgcgcacgtgcgcgccgagcacatcccgcacgcgctgatcgtcgattgcagcggctccgacgcggtcgccgcgcgctatcccgaatggctcgccgccggcatccacgtggtcaccccgagcaagcacgccggcgccggcccgctggcgcgcttcgaggcgatccgcgaagccgcgcgccacggcggccagttccgctacgaggccacggtcggcgccggcctgccggtgatccagaccctgcgctcgctgctcgacaccggcgacgagctgaccgaggtcgaaggcatcctgtcgggcaccctggcctggctgttcaaccgctacgacggccgcacgccgttctcgcaactggtgcgcgaggcgcacgagctgggctacaccgagccggacccgcgcgacgacctgtccggcaccgacgtcgcgcgcaagctggtgatcctggcgcgcgaagccgggcggccgttgtcgctggagcagatcgaagtcgagagcctggtgccggagtcgttgcgcagcgtgtcgaaggaagagttcttcgcccgcctggacgagctcgacgcgccgctgcagcagcgcttcgacgccgcgcgcgcggccgggctgagcctgcgctatctcgcgcgcctcgaccgcgacggccgcgccagcgtcggcgtggtcaccccgcagccgggccacgcggccttgcacggcgcgctcaccgacaacctgatccagttccgcacgcgccgttacgccgataatccgctggtggtgcaaggcccgggcgccggcccggacgtcaccgccgccggcgtgttcggcgatctgctgaccatcgcccagaccctcggagcc

SEQ ID NO: 33281 - DNA, 1294 bp, Desulfitobacterium hafniense
gaaggcctgcccgacgcgaccatcgtcgaatgggcggtcaaggtcggcgacaccatccgcctcgacgacaccctggatgtcgatggaaaccgccaaggcggtggtcgaagtgccctcgcccgtgtcgggcaaggtgctcaagctcgccggcggcgcgggcgatgtgatcgtcaccggcaccatgctggccgagttcgagatcgatccgaacatgccgcagcgcgcggacggccaggacaccggccaccatcacggcggcggccacgccgcgccggccgcgcccgcaccggcgaaatccgaagaagcgccggccaaggccgaaggcggcgaacgcgccgacagcggcaccgtcgtcggtgcgatgcagtcctccgacgccgtgcgcagcgagcaagccgtcgccgtcggcggcgtcaaggcgatgccggcggtgcgcgcgctggcgcgcaagctcggcgtcgacctgagccgcgtgcgcgccaccggcgccgacggcacggtcagcagcgacgacgtcaagcgcgccgcggccgatggttcggccaaggtcggttccgcgccggccgccgcggtcgcgccgcgcgccgctgcggtggccgaagcgcccgccccggccgctgcgcctgcgcgcagcacgctgtcgcagtcgggccggccgatgcgcacccagccgccgggcgtggccgccaccggccagcccgaacagctcaagggcgtgcgccgcaacatggcgcgggtgatggccgacgcgcacagcaaggtcgtgccgaccacgctcgccgacgacgccgacatccacgcctggctgccgggcaacgacatcaccggccgcctggtgcgcgcgatcgtggtcgcgtgcaagaccgtgccggcgctcaacgcctggttcgacggcgacaagctcacccgcaccctgcatccgcaggtcgacatcggcatcgccgtggacaccgacgacggcctgttcgtgccggcgctgcgcaacgccgacgtgctcgacgcgcgcggcgtgcgcgaggcgatcaaccgcctgcgcgtgcaggtcgaagaccgcagcattccggcctcggagctgaccggctacaccatctcgctgtcgaacttcggcatgttcgccggccgctacgccacgccggtggtggtgccgccgacggtggcgatcgtcgccgccggcaagggccgccaccagatgacgccggtgatgggcgggttcgaatcgcacaaggtcattccgttgtcgctgacgttcgatcaccgcgcttgcacgggcggcgaggcggcgcggtttttgaag

SEQ ID NO: 33282 - DNA, 712 bp, Desulfitobacterium hafniense
gctttaatcacaggaggggcgacaggaattgtccgctccattgctttaaagcttgcccaagagggtgttaatattgctgtcaattattcccgctctcgggaagatgctgaacaaacctctcaggaaatcgataaactgcaaggtagcctgcaggatataccaagccaatgtggcaaaggatcaagaggttcgggaaatgatcggtgcagtggtccgggattttggacaattggatattcttgtcaatagtgcagggatgactcattttgttgagcatgccgatcttgaaggcatgaaagatgagtattgggacgagattttcagtgtcaatgtcaaaggccttttcaatacctgccgtgccgcggccgaagccctcaagaagcaaaaaggctgtatcgttaatattacttctatcgccggtctgaccggattggggagttctatcgcctatagtgcttccaaagccgctgcgatcagtgttaataaatccttggcccgggttctggctcccgatgtccgggttaattcggtggccccaggggtagtgttaacccgctgggtcagcggccaagaggaacatatcacccgcatggctgagggaacccctttacagaaggtgtgtactccggaagatgtggctgaagtcgcctatgctttaatcgcccatgccggatttgtcacaggtcaaacctgggtcgtagacgggggcaat

SEQ ID NO: 33283 - DNA, 595 bp, Desulfitobacterium hafniense
tttcgtttgactggatggaaggcctctgttataattttatttctagaatgacttttagttggcggaggtgttattagggtggaagaaaagattggcaaagtattgctcagccgtgaagaaattcaaaaacgtgtcgcggagctgggtgaggaaatcacccgtgattataaagaccagaatttattagttctagcaattcttaaaggggcagttcccttcatggcggatttgatcagggagattagaattcctttaaagtatgactttatggctgtttccagttacggcgcttctacacattcttccggtgtagtaaggattctcaaggatttggagcgaagtgtagaagatcaccatatattgattgtggaagatatcattgatacaggcttaactctgaagtacttaaaagagaatctggctgcccggaatccgctcagtattaaggtggttactttgctggacaagccggatcgccgtaaagctgaggtagtgccggattatatatgggtttacgattcctgatgaatttgtggtaggatatggacttgattttgatgagcactatcccaatttgccctatgttggtatttaa

SEQ ID NO: 33284 - DNA, 1563 bp, Desulfitobacterium hafniense
  unsure (1)..(1563): unsure at all n locations
accctcggtccgaagggccgcaacgtcgtgctcgagaagagcttcggcgcgccgacgatcaccaaggacggcgtgtccgtcgccaaggaaatcgagctggccgacaagttcgagaacatgggcgcgcagatggtgaaggaagtcgcgtccaagacctccgacaacgccggcgacggcaccaccaccgcgaccgtgctggcccaggcgctgatccgcgaaggcatgaaggcggtcgccgccggcatgaacccgatggacctcaagcgcggcatcgacaaggccgtgaccgaggccgtggtcgagctgaagannangctgtnnncncanangccgnntccctcnngancctcgaagnngaaatncgcccaggtcggcgcgatctcggccaactcggaccacaacatcggcgacctgatcgctcaggcgatggacaaggtcggcaaggaaggcgtgatcaccgtcgaagacggctcgggcctggagaacgaactcgacgtcgtcgagggcatgcagttcgaccgcggctacctgtcgccctacttcatcaacaaccagcagtcgatgcaggccgagctggacgatccgttcatcctgctgcacgacaagaagatctccaacgtgcgcgacctgctgccggtgctggaaggcgtcgccaaggccggcaagccgctgctgatcgtcgccgaggaagtcgaaggcgaagcgctggcgaccctggtggtcaacaccatccgcggcatcgtcaaggtctgcgccgtcaaggcgccgggcttcggcgaccgtcgcaaggcgatgctggaagacatggccgtgctgaccggcggcaccgtgatctccgaggaagtcggcctgcagctcgagaaggccaccatcaaggatctgggccgcgccaagaagatccaggtctcgaaggaaaacaccacgatcatcgacggcgccggcgagagctcgggcatcgaagcgcgcatcaagcagatcaaggcgcagatcgaagagacctcgtcggactacgaccgcgagaagctgcaggagcgcgtggccaagctggccggcggcgttgcggtgatcaaggtcggcgctgcgaccgaagtcgagatgaaggaaaagaaggctcgcgtcgaagacgcgctgcacgccacccgcgctgccgtggaagagggcatcgtcccgggcggcggcgtcgcgctgatccgcgccaaggccgcgatcgccggcctgaagggcatcaacgaagaccagaatcacggcatcgccatcgccctgcgcgcgatggaagcgccgctgcgcgagatcgtgaccaacgccggcgaagagccgtcggtcatcctcaacaaggtcatcgaaggcaagggcgcctacggctacaacgccgccaccggcgagtacgtcgacatgatcgaggccggcatcctggatccgaccaaggtcacccgcaccgcgctgcagaacgcggcgtccatcgccggtctgatgatcacgaccgaagccatggtcgccgagctgccgaagaaggacgagccggcgatgccgggcggcggcggcatgggcggcatgggcggcatg

SEQ ID NO: 33285 - DNA, 930 bp, Desulfitobacterium hafniense
aagcccgtagtgctgctgatcctcgacggctggggccaccgcgacgatccggccgacaatgccctggcccaggccgagctgccgaactggcgcgccctgctcgccagccaggcgcacaccctgatccacaccgaaggccgccatgtcggcctgccggacgggcagatgggcaattccgaagtcggccacatgaacctcggcgccggccgcatcgtctatcaggacctgacccggatcgacgcggcgatcgaagacggcagcttctacgccaacgacgaactgcgcgccgcctgcgccgcggccaaggccgccggcaccaccttgcatctgctcggcctgctctcgcccggcggcgtgcacagccacgagcggcacatcttcgcgatgatcgaactggcccgccgcgaaggcgtggcgaaggtcgccgtgcacgccttcctcgacggccgcgacatgccgcccaagtcggccgcgccgagcctgcagcgcttgcagcaggcctgcgacgaagccggcaacgcgcgcatcgccagcatcggcgggcgctattacgcgatggaccgcgacaagcgctgggaccgccagctgcgcgcctgggacgcgatcgtcgaagccaagagcgagcaccacactgagaccgcgctggaaggcttggacgcggcctatgcgcgcggcgagaccgacgaatacgacgcccccaccgtgatcggcgacgcgcaaccgatggacgaaggcgacgcggtggtgttcatgaacttccgcgccgaccgcgcgcgccagatcaacgacgcgtacgtcgatccgaaatacgatggctatgaggcgcgcaagaccaagctgtcgcgcatcgtctgactgaccgaatacgacgccaggctgccggcgccggtcgagtacggacccgaagagctgagcaacacgctcggagaa

SEQ ID NO: 33286 - DNA, 1125 bp, Desulfitobacterium hafniense
ctcaagccgatcctgttcgtcgaccgcgacggcaccctgatccaggagccggcggatttccagatcgacagctacgccaagctgcgcttcgtgcgcggggtgattccggcgatgctgaagctgcgcgacgccggctacgaattcgtcatggtcaccaaccaggacgggctgggcaccgactcgttcccgcgctggtccttcgacggcccgcacgagctgatgatgcaggtgttcgaaagccagggcatcgtgttccgcgatgtgctcatcgacaccagcttcccggccgaaaacctgcccacgcgcaagcccggcatcggcctggcgctgccgctgctgaaggaccgcggcatcgattgggaacgttcggcgatggtcggcgaccgcgagaccgacaacggcttcgccgccaatctgggcatccgcgcgttccaattgcgcacgaaagaattcggcggcgagtgggactggtccggcatcgcccacgtgctggccgagcgcccgcgcaccgccagcgtgcagcgcaacaccaaggaaacccggatccaggtgcgcgtcgacctcgaccgcgcggccgagccgcaggtcgccaccggcctgggcttcttcgaccacatgctcgaacagctcggcaagcacggcggcttcgccctggagctgagctgccagggcgacctgcacatcgacgagcaccacaccatcgaagacagcgcgctggcgctgggccaggcgctgcgcgaagcgctcggcgacaagcgcggcatcggccgctacggcttcgagccgcgtgcggggcagggcgacgacgtcgccgcgccgatcgcgcacgagttcgtattgccgatggacgagaccctggcgcgcgccgcgctggatttttccgggcgtccgtacttcgtcttcggcggcggcttcgcgcgcgagaaggtcggcgatttcccgaccgaactgctgccgcatttcttccgttcgttgtgcgaaaccgccgggctgaacctgaatctgaacgtagaaggtgataacgatcaccacaaaatagaggcttgtttcaaggtcgtcgcacgcgcgctgcggcaggccatcgcccgtcaagggcgcgaactcccgagtaccacgggagttctg

SEQ ID NO: 33287 - DNA, 942 bp, Desulfitobacterium hafniense
gagcgcttcttctgcctcaactcgggctccgaatcggtctcgctggccgcgcgcatcgccgacgtcaacagcaagctgatgaccgacccgggcgcgcgccacgccggccgcgcgatcaagcgcctggtcatcaagggcagcttccacggccgcaccgagcgcccggcgctgtactcggattcctcgcgcaaggcctacagccagcacctggccagcttccgcggcgaagactcggtgatcgcgatcgagccctacgacgccgacgcgctgaagaaagccttcgccgacgccgacgccaagggctggttcatcgaggcgatgttcctggagccggtgatgggcgaaggcgacccgggccgcggcgtgccggcgagcttctacgcgctggcgcgcgagctcacccgcgaccacggctcgctgctgctggtcgactcgatccaggccggcctgcgcgcccacggcgtgctgtcgatcgtcgactacccgggcttcgaaggcctggaagcgccggacatggagacctactccaaggcgctcaacgccggtcagtacccgctgtcggtgctcgccgtcggcgagcgcgcggcctcgctgtaccgcaagggcctgtacggcaacaccatgaccagcaatccgcgcgcgctcgacgtcgccgtcgccgtgctcgagcaggtcacgccgcagctgcgcgccaacatccgcaaccgcggcgcggaggcgatcgaaaagctcgagaagctcaagcacgagctcggcggcctgatcaccaaggtccagggcaccggcctgctgttctcgtgcgagctggccccgcagttcaagtgcttcggcgccggctccaccgaggaatggctgcgcgagcgcggcatcggcgtgatccacggcggcgccaactcgctgcgcttcacccccaacttcaccatcgccagcgacgagctggag

SEQ ID NO: 33288 - DNA, 1170 bp, Desulfitobacterium hafniense
ggcggcgacgggccgctcagcgtcgccgacctgcgcagtccgcatccgctcgccgcggccttcctcgacgcggccggcgagctggggttgccgcgcaacgacgagttgaacggcggcgatccgttcggcgccggctatctgcaggcgacccagttgcgcggctggcgccacagcgccgcgcgcgcgttcctgcggcccgcgcgccggcggcgcaacctcgacatcgtcaccggcgccctggtcgaacgggtactgatcgccgacgccgccgcacacggcgtggcctatcgccatcgcggacaacgcaaggtcgcgcacgcgcgaggcgagatcatcgtctgcgccggcgcgctggcctcgcccaagctgctgatgctgtcgggcatcggcccggccgaacaactcgagcgccacggcatcggcgtggtccgcgacagtccgggcgtcggcgcgaacctgcaggaacatcccggcgcgctgatcaccgcgcaggtcaatatgcgcacctacaacgtcgagaccggcccgctgtcggtgctgcgccacggtctggatttcctcttgcgcggccgcggccccgggaccacgccgatcggccacgccgtggccttcgcccgcagcgcgccgcaggtcgaacggccggacctgcaactggtgttcacgccgatcggctacaacacctccggcgacggcccggtgctgctgccggtgcctgcggtggtcatcgcggtcaatgtctgccgtccgcgcgcgcgcggcacgttgcggctgcgctcggccgatccggccgagctgccggaaatccgtctggaaatgctcgccgatccgcacgaccgcggcttgctgcgcgaaggcgcgaagctggcccggcagctgtacgcgaccggcacgatgcgcggctacgtcgagcgcgaactgcgcccgggcgcgcaggtcgacagcgacgccgagtgggacgcgttcctgcgcaagcactgcatgcgcttcagccatccggccggcacctgccgcatgggcgtggatgcgctcgcagtggtcggcccggacttgcgcgtgcacggcgtgcagcgcttgcgcgtggccgacgcctcgatcatgccgactctggtcagcgcgaataccaacgccgcggcgatcatgatcggcgagaaggcggcggagctgatcctg

SEQ ID NO: 33289 - DNA, 590 bp, Desulfitobacterium hafniense
ctgttgcgcctgcgcggcagctgatgcaggacgcggcgccggccggaattggcgcgatggccgccgtgctcggcgccgaggacgccctggtcgaggagatctgccaggccgtgtccggcagcgaagtggtagtgccggccaattacaactcgcccggccagatcgtcatcggcggccacgccgtggcggtcgacaaggccctgacccggctggccgaagccggcgtgcgcaaggcggtcaagctggccgtcagcgtgccctcgcacaccccgctgatgcgcgaagccgccaaccgcctggccgaagccatggccgggctggactggcgcgcgccgcagctgccggtggtgcagaacgtcgacggccaggtccacgccagcgtcgaggcgatccgcgaggcgctggtgcgccagctctacctgccggtgcgctggaccgcctgcgtgcaggcgcttgccgcgcacggcgcgcagcgcgccgccgagtgcgggccgggcaaggtcctcaccgggttgatcaagcgcatcgacaaatccatcgacggccgcgccatcggcaccccggcggagttcgaaaccgccctgtccgac

SEQ ID NO: 33290 - DNA, 720 bp, Desulfitobacterium hafniense
ggcgaaatcgcgctggtcaccggcgccagccgcggcatcggcgccgcgatcgccgacgaactggccgcgcagggcgcgaccgtgatcggcaccgccaccagcgaatccggcgctaaggccatcggcgaacgcctggccgcgcacggcggccacggccgcgtggtcgacgtcgccgacccggcctcggtcgagtcgctgctcgacgcggtggccaaggagatcggcgcgatctcgatcctggtcaacaacgccggcatcacccgcgacaacctgctcatgcgcatgaaggacgaggactggcaggccatcctcgacaccaatctcaccagcgtctaccgcaccagcaaggcggtgatgcgttcgatgatgaaggcgcgcaagggtcgcatcatcaacatcgcctcggtggtcggcgtgaccggcaacccgggccaggccaactacgccgccgccaaggccggcgtgatcgccttcagcaagtcgctggcgcgcgagatcggcagccgcggcgtgaccgtgaacgtcgtggcgcccggattcatcgacaccgacatgacccgcgacctgcccgaagacgcgaagaaggccatgttcgaccagatcgcgctgggccgcttcggcgaaccggccgacatcgcccgcgcggtggcgttcctggccggccccggggccggctacatcaccggcgaaacgctgcacgtcaacggcggcatgtacatg

SEQ ID NO: 33291 - DNA, 1123 bp, Desulfitobacterium hafniense
ggccctggtgccctgcgctcggctgttgcggccggctcccagccgcgtttggtccgacgtgcacgtcgagccgcaggatctggcgttcttgctatacaccggcggcaccacctgcgtttccaagggctcgattctgaaccaaatccgcacatgtcgccaatctgcagcaggtttcggcctggttcggcgacaagatccgcccgggccaggaaaccatcgtcaccgcgctgccgctgtaccacgtgttcgcgctgacctgtaactgcctggtgttcctcaaggccggcggccacagcgtgctgatcaccaatccgcgcgacatgcccggtttcgtcgcggagctgcgcaagacgccgttcaccgcgatcactggcgtcaacaccttgttcagcggtttgctcaacacgccgggcttcgaacgcgtggacttctcgcagctgcgcatgtgcttcggcggcggcaccgcggtgcagcgcgcggtggccgagcgctggcagcaggtgaccggcaaggcgttggtggaaggctacggcctgaccgagagctcgccggtggcggtggtcaacccgatcgtcgagggcatgcagttcaacggcgcgatcggcgtgccgattccttcgacctggcctgcgtgatgaacgagcagggcgagcgtctgccggtgggcgaacccggcgagctgtgcctgcagggtccgcaggtgatgaagggctattggcgccagcccgaggaaaccgcgcgcaccatcgaccgcgacggctggctgcacaccggcgacatcgcccgcatcgacgagaagggcttcattttcctggtcgaccgcaagaaggacatgatcctggtgtcgggcttcaacgtgtatcccaacgaagtcgaggacgtgatggcggcgatgccgggcatccgcgaggtggcggcggtgggcgtgcctagcgagaagtcgggcgagacggtcaagctggtggtggtgcgctcggatccggcgctgacggtggagcagatcaaggcgtatgcgaaggccaatctgactgggtacaagcgcccgcacgtgatcgagttccgcaacgagctgcccaagagcaatgtgggcaagattttgcggcgggagttgcgtggggggtaa

SEQ ID NO: 33292 - DNA, 771 bp, Desulfitobacterium hafniense
accggtcgtgtgacgtgggaaccggtgcgctcgctgtggttcagcgcgatgttcgccggcgccgcgatcggcggcgcactgaccttcagctggggcgcgttcgcgctgttcgtcgccagcaccgtcgcggtattgctgctcggccattcgctaggcatgcaccgcaagctgatccacgacagcttcgcctgcccgaagtggctggaatacctgctggtctactgcggcgtgcaggtcgggctggccgggccgatcgcgctggtgcgcacccacgacctgcgcgactacgcccagcgcctgccgcattgccacgattacctcgcccaccgccgcggttttctccaggacgcgtggtggcagctgcactgcgaactgcgcctggacgcgccgccgcggatcgcgctggaaccgcgcatcggcgaggaccgcgtctaccgtttcctgcaacgcacctggatgtggcagcacctgccgtgggcgctggcgttctatgccatcggcggctggggctgggtgttctggggcgtgtgcgcgcgggtgaccgccggcgtgttcggccactggctggtcggctacttcgcccacaaccacggcggcatgcaccacgaagtgcgcggcgccgcagtgcagggccgcaacgtgcgcttcgcctcgctgctgaccatgggcgagtgctggcacaacaaccaccatgcatttccgggttcggcgcggttggggttgtatccgggcgagtgggatccgggctggtggctgctgcgcgcgctcgag

SEQ ID NO: 33293 - DNA, 1206 bp, Desulfitobacterium hafniense
aaaaaagatcaaggtgtggatttggccaaagaccgtgttgccctccaacgcttgaaagaagcagccgagaaagccaaagtggagctttccggagtgagcaccaccaatgtgaacctgccctttatcaccatgactggcgagggaccggctcacttggatatgaatattacacgggctaaatttgaggaattgaccgcggatctggtcgaggctacccttggacctacccgtcaggctttagccgatgccaaactctcttggaacgaagtgaatcaagtcattctcgtaggcggatccacccggattcctgccgtacaggaagctatcaaaaagctgagcggcaaggagccccataaaggtgtcaatccggatgaagtggtagccttgggtgctgccattcaaggcggagttctggccggggaagtgaaggatattattctcgtggacgttactcccctgtccttgggtattgaaaccctgggtggtgtctttacccggattatcgatcgcaataccaccgttcctaccacgaagagccaggttttctctactgcggcggacagccaaacttctgtggatatccacgtcctccaaggagagcgtgaaatggcggcctataacaaaaccttaggccggttccaactttccggaatcccccccgctcctcgtggcatccctcaaatcgaagtgaagttcgatattgatgccaatggtatcgtccatgtttccgctaaggatatggctacaggtaatgaacaaaaggtcaccattaccgcttccacaggcttaagccaggaagaaatcgagaagatgaaaaaagatgccgaagctcatgccgatgaagataaaaagcgcaaagaattgattgacgctaagaaccaagcagactctatggtctaccaaaccgaaaagaccctgaaggattttgaaggcaagatccctgacaatgaagcagagcccatcaagaaagctcttgaagaattaaagaccgcagccgccggggaaaatatcgagctgatcaaagaaaagaccgaaggggtaaccaaggtcctctatcccatcatcgagaagatgtatcagcaaaccggcggagcagcaccgggaccggacatgggagcagaccccggagcgggcggcgctcaaggggatgacaatgtggtggatgccgaatatactgaagtagataaggatcaaaaataatcagag

SEQ ID NO: 33294 - DNA, 1353 bp, Desulfitobacterium hafniense
ctgattttcggagcggcggcccgcttaagccggttgctgcgccaacagctttttaagcattttacccgtatgtcacccagcttttatcaaaagtaccggaccggggatttgatggcccatgctaccaatgatattcaagccattgaaaccactgccgggatgggggtacttaccttggtggactccctggtcacaggcggttttgtcgtcttctccatggccgctttcctaagctggaaattgaccctcattactttgctgcctatgccggttatggcctgggtctccagttattacggcacattgcttcatgagcgtttcttcaaggctcaggaggctttcggcgatcttaatgataaggttcaggaaaatatctccggagtacgtgtcgtgaaagcctttggtcaggaagaagtggagattgagtccttccgcaggctgtccgatgatgtagtcaaaaagaatcaggcggtggctgtggtggattccctctatgatccgtcgattatgctgattgtgggactatccttttttctggccgtttcctttggcgcctatgaagtgatccatctccggctgaccctgggccagcttactcaattcaccctttatctgggacagtttatttggccgatgctggcctttggctggctgttcaatattatggaacggggcagagcttcctatgatcgggtgcaggctttgctgggggtggagtccgaggttcaggatcaggtttccctacagggagcccctgacggaagcagggcagagcttaggcaaagtgttaagggggatatttactgcgctcttgagcaatttacctatcccggtcagaccaagcccgagctgaaaaggatccatttcacccttaaagaagggcagaccctgggcatcgtgggcaagaccggcagcggcaaaaccacccttttccgggtcctccttcgtgagtttgcgggaatgacaggagaaattcgtattggcggtgtctctattgaggagatccctttggatagcttgcggggaatctttggttatgtcccccaggaacactttcttttttccaccaccctggccgaaaatattgctttggggaaaccccaggcccagctctcggaaattgagaaggctgctaaaacagcttgtattcatgaagatatccagcggtttgaagcggcctatgggaccctggtcggggatcggggagtcaccttatcaggagggcaaaaacagcggatttccattgcccgagctttgctgctcgatccaaaaatattgattcttgatgactctttatcggctgtggattgccagaagggaaaacaaatcctccggaaactaaaggcaaccgga

SEQ ID NO: 33295 - DNA, 732 bp, Desulfitobacterium hafniense
aaaagtgtccgtttaaaaatccgtcgccaaaatgccccggaccaacctgctttttgggaagagttcgcggtggattatagtcccaagatgaatattatttcctgcttgatggagattcaaaaaaatcctgtcaatgtccaaggcaaaaagaccaatcccgtggtttgggaatgcaactgtcttgaagaggtctgtggtgcctgcaccatgaatatcaacggtcaagccaggcaggcctgctcagccttagtggatcaattggagcagcctattgtcctggagcctctccggaaattccccatcctccgggatcttatggtggatcgaaccattatgttcgagaatttaaagagggttcatgcctggatcgacattgacggaacctacgatctgggtcccggaccccgtatggctgaagtggatcgagtatgggcctatgagctttccaagtgcatgacctgtgggtgctgcatggaatcctgcccccaagtcaattcccgttcccggttcattggaccggccgccgtttcccaggcccgtctctttaacacccacccttcaggagctatgcataagcatattcgtctatccgccctcatgggtgatggagggatcaccgactgcggcaacgcccaaaactgcgtgcgggcctgtcccaaggagattcctctgaccaccagtcttgccgatatgaacagagaggtcaataaattcgccttgaagcgatggctg

SEQ ID NO: 33296 - DNA, 2374 bp, Desulfitobacterium hafniense
atacgccagtgtatcgtggaagccatgaggtcatcggtggaccatggtcaagtcgcccatgatcccgttgccgaccgggtggtgatcatcgagatctaccgccgtacctcccgctgcctccgctattggcttccaaagccaccgggttccccattgtcctgatctcttccctgctggccgccgggcctgactctggatgaaatcccctactgtcgggagggaacactggataaatatactccctggggtgactatgtagtgatcaagttcgcccgctgggcctttgaaaagttcaagggtgtggaagacaaactgggcacccagatgcggtccgtgggtgaagtcatgagcatcggcaaaaactataaagaagccttccataaagccattcgcagtttggaaataggccgttacggcttaggctttgccaaagatttcaacaccaagaccctccccgagcttctggagctgctgaaaacccctaccagtgaacggcattttatgatgtacgaagccctccgccaaggggctgatccggcggagcttgccgccatcacctatgtcaagacctggttcattgaacaaatgaaggaattggtggacctggaagaaaagatcctggagtatcaaggccgggagctccccgccgagctcctgatccaagccaaaaaggatggttttgccgaccgctatctggcccagctcttaggtatttctgagacgcaagtccgccggcagcgcctggggctggggttgacccaggcctgggatgccgtacctgtaagcggggtaaacaacgcctcctattattactccacctataatgccccggacaaggtcaccaccagccagagggaaaaggtcctcatcctgggcggcggccccaaccgcatcggccagggcatcgaatttgactactgctgcgttcacgccgcttttgccttaaaaaacctgggctatgaaaccatcatgatcaactgcaaccccgagaccgtatccaccgattatgacacctcggataagctatatttcgagcccctgactgtggaggatgtcttaagcatctatgaaaaagaacgccccatcggcgccatcgtccaattcggaggccagacacccctgaatatcgccgcccagctccaggaggcgggagtaagaattctcggtaccgtaccggaagtcatcgaccaggctgaggatcgggatcagttccgcaaaatgatggagaaactggctatccccatgccccaggcaggtatggccagcactctggaggaagctttggcagcggcggagatgatcggttatcccgtcatggttcgtccctcctatgtcctgggaggccggggcatggaaattgtctttgatgaagaacagctgcgggaatatgtggccgccgccgtggacatcaccccggaacgccccattcttatcgataaattcctggagaatgccatcgaagcagaagccgatgccgtctcagacggtactcatgccttcgtccctgccgttatggagcacatcgagctggcggggatccattccggagacagtgcctgcgtcattcctcccctgaaccattgccgaccgccatttgcgcaccattatcgattatacccagcggattgcccaggaactccatgtggtagggcttatgaatatccagtacgccatcgccgaggataaggtctacgtcttagaggccaatcccagagcttcccgcaccgtacccctggtctccaaaatctgcaacacccccatggccaggctggccacggagttgatactggctgattataccgggcaaaagaacgatatcgcaaccaacttcaagcctgctcagatctcccattacggcgtcaaagaagcggtcttcccctttgacaaattccctgaagtagatcccgtcctcggcccggaaatgcgttccaccggagaggttttgggcatggccaattccttcggcctggcctatttcaaggctcaggaagcaacccactcctccctgcccttcagcggaaccgtccttatgagcattgccgaacaggaccgctcttcaggggtcatcgaaatcgcccaggaattcctcaagctgggctttaagatcaaagccactcaggggacccggaaattccttcaggatcatagcattgacgccgaattcatccataaaattgaggaaggccgtcccaatatcactgatggtattatgaacggcgagatccaattggtcattaacacccccatcggcaaacgcagcctcaaagatgattcctacatccgcaagaccgccattaagtataagatcccttatatcaacaacaccccgggcggcttagacagcgccaaaggaattgccgcatctcaagaggcg

SEQ ID NO: 33297 - DNA, 1320 bp, Desulfitobacterium hafniense
  unsure (1)..(1320): unsure at all n locations
ccgatccacccgagcccgcgcatgacccgcacccgcttcgcccccagtcccaccggctacctgcacatcggcggcgcccgcaccgccctgtattgctggctggaagcgcgccgcgcgggcgggcagttcgtcctgcgcatcgaggacaccgaccgcgagcgcagcacccaggcggcgatcgacgcgatcctggaggcgatggactggctcggcctgagctacgacgaaggcccgatctaccagacccagcgcttggaccgttaccgcgaagtggccgagcagatggtcgccgcgggcaccgcgtattacgcctacgagacccgcgacgagctggaagccgtgcgtaacgccgcgctcgcggccaaggagaagccgcgctacaacggcgcctaccgcgagcgcaacgagccgtatcgcgaggatccgaaccgggtgatccgcttcaagaatccgctggacggcacggtggtgttcgaggacaaggtcaagggccggatcgagatcgccaacagcgagctcgacgatctggtgatcttccgcgccgacggctacccgacctacaacttcgcggtcgtggtcgacgacctggacatggccatcaccgatgtcgtgcgcggcgacgaccacgtcaacaacaccccgcgccagatcaacatctaccgcgcgctgggcgcgacggtgccgcatttcgctcatctgccgatgatcctcgacccggagggcgccaagctgtccaagcgcaccggcgcggccgacgtgatgcagtaccgcgacgagggctatctgccgcacgcgctgctgaactatctggtccgcctgggctggtcgcatggcgaccaggagatcttctcgatcgaggagatgacccggctgttccagctgtccgacgtcaattccagcgcttcgcgcctggacaaggcgaagttgggctggatgaaccagcaatacctcaagagcgacgatccggccgaggtgggcaagcacctggaatggcatctgcgccagcagggttacgacctcgccgctggcccggcgccggccgatatcgtgatcgcgctgcgcgaccgcgtgcagacgctcaaggacatggccgagcgcgccgcggtgtggttcgggccgctgacccagtacgacgaggcggccgtggccaagcacctaaacgccgccgcgcgcgcgccgctggccgaggcgcgcgcgcgtctggcgcagttgccggcgtggaccgccgacgcggtcggcgcggccctgcacgagggcgccgaaaccctgnggccgggcatgggcaaggtcgcccagccgctgggcgtggcatcaccggga

SEQ ID NO: 33298 - DNA, 1589 bp, Desulfitobacterium hafniense
ctgtgcgacgctatactgctcgcagctcacggcacaatccaacgcctgttctgtggacggcagcacacccggccgcgacgcggcggcggcatcgtcacacttcgagatcggccggcagcgaagtattctggagcactaccccgagcgcctggaacgcgccggggtcagctggaagctgtaccaggacatggacgacaacttctccgacaacccgctggaaggcttccgccagttccgcgccgcggcgcccggttcggcgctggcggaaaaggcgctgaagacctggacgctggaggatctggcgagcgatgtgcgcagcggcaagctgccgcaggtgtcgtggctggtcgcgccggccaagtattccgagcaccccggcccgtcggcgccgatctggggcgccgactacaccgcgcgcgtgctcgacgcgctcaccgccgatccggcggtgtgggcgcgcaccgtgctgatcgtcaacttcgacgagaacgacggcttcttcgaccacgtgccgccgccggcgccgccgtcgctggacgcgcagcgcaagccgctcggcggctccaccgtggacctgcgcggcgaacaccacttcgcccgcagcggcccctcgcacggcacctcggccgatccggcgatctattacgaccgtccttacggcctgggcccgcgcgtgccgatgtacgtgatctcgccgtggagccgcggcggctggatcaactcgcaggtgttcgaccacacctcggtgatccgcttcctggaaaagcgcttcggcgtcagcgagcccaacatcagtccgtggcggcgcgcggtgtgcggcgatctcaccagcgcgttcaatttcgagaaccccaaccacgagccgatcccgaccctgccctacaccggcgacgccgaccgcatcgtcgccgagcagagcaaactgccggcgccgaaaccgccggcgacgccgagcgcggcgcgccaggaacccggcatcaagccctcgcgcgcgctgccctacgacctgcacgtgggcgagcgcttcgaccgcgacgcgcgctcgttgcggctcaacttcggcaacagcgggcgcgctgcggcggtgttccatgtctacgacttgctcgaccctgaggcgattccgcgtcgctatacggtcgaaccggggcgttcgctcaacggcgactgggcgctgcgcagcggcggggcgcgcgcctatgcgctgcaggtgttcgggccgaacggattctttcgcgagttccgcggttcgctgcacggcgccaatcctggcgccaccacgattcccgacctgcgcttgcgccatcgcaagctgatcctggcgctgcgcaatccggggcgtaagccgctgcggctggagctggccgatcagtacgggttgtatgcgccgcggttggagcggttgggtgcggggtcgttgcgttatcggccggtgcggttggacgagagttgccagtggtacgacttcgtgctgatcgatgccaacgatccggagtattaccgtcggattgcggggcgggtggagatcgggggcgcatggcgtcaccgatcctgggttgatctgaggcggtttgtcgtttgcggcggag

SEQ ID NO: 33299 - DNA, 777 bp, Desulfitobacterium hafniense
accggcaaattggcccagaaaggaatttccgaaggaaaactctacggcaaaatcaaagtcgtcgcctcatcagaagaccagaactactcctatattccggatcttaaggatttgaaattctccgaggaggcagactatgtctacatctgccacaataataccatcttcggcaccaagtttaatgagcttcccgaggtgggagataaacctttaatcgccgatatgtcttccgatttcctatccgaacccatcgatgtcagccaatacggaattatttttgccggagctcagaagaatgtagggcccgccggggtcgtgattgtcattatccgggaagatttgattacagaggacgttttgccgggaactcccactatgctcaagtataaagtccatctggataacaattccgcctataatacaccgccggtttatggaatatacatctgtggtaaagtgttcaaatggctcaaaaagctgggcggactggaagctatgcaaaagatcaacgaggaaaaagccgccatcctttatgattatctggacgccagtgccatgtttaaaggaaccgtagcgaaaaaagaccgctccttaatgaatgttccctttgtgacaggctctgaagaactggatgccaagttcatcaaagaagccaagaccgcaggctttgagaaccttaaaggataccgcacagtaggcgggatgagggccagcatttacaatgccatgcccatccagggggtcaaggatttagtggaattcatgagaaagtttgaa

SEQ ID NO: 33300 - DNA, 1011 bp, Desulfitobacterium hafniense
atccattacggcgtcgccgcctcgctgatggcgctgcaagacgccggcatcgtcgtcgacgactccaacgccgagcgcatcggcgcgctggtcggctcgggcatcggcggcctgctcggcatcgaggagcagacggtcaagtaccacgagggcggcccgcgcaagatctcgccgttctacgtgcccagcaccatcatcaacatgctgccggggcagatctcgctgatcaccggcgccaagggcccgaacttctccgcggtctcggcctgcgccacctcgaaccattccatcggcatggcgatgcgcatgatccagtacggcgacgccgacgtgatggtcgccggtggcgccgagcgcggctcctcgccgacctcggtcggcggcttctgctcgatgaaggcgatgtcgacccgcaacgacgatccgacccgcgcctcgcggccgtgggacaaggaccgcgacggcttcgtgctcggcgacggcgccggcatcctgatcctggaagagtacgagcgggccaaggcgcgcggcgcgcgcatctactgcgaactggccggtttcggcgccagctccgacgccttccacatgaccgcgccgagcgagaacggcgaaggcccggcgcgctgcatggtttctgcgctcaaggacgccggcatcaatcccgaccaggtcggctacctcaacgcgcacggcacctcgaccccgctcggcgatctggccgagaccctggcgatgaagcgcgcgttcggcgatcacgcctacaagatgatggtcagctcgaccaagtcgatgaccgggcacctgctcggcgcggccggcggcgccgaggcgatcttctcggtgctggcgctgcacgacggcatcatcccgccgaccatcaacctcgacgaagcgggcgagggttgcgatctggactacgtgccgaacgtggcgcgcgagacgaagatcgacgtggcggtgtcgaacgggttcggcttcggcgggaccaacggcacgctggtgttcaagcgg

SEQ ID NO: 33301 - DNA, 1284 bp, Desulfitobacterium hafniense
ctcatcgacggcgagttcgtcgaatcgcgcaccgcgcattggcgcgaggtgatcaatcccgccacccaggccgtgctggcgcgcgtgccgatggccacgcccgcggaaatcgacgccgccgtcgccgccgcggcgcgcgcgttcaagacctggcgcaagaccccgatcggcgcgcgcgcgcggatcttcctcaagtaccagcagctcatccgcgagcacatgggcgagctgacggcgatcctcagcgccgaacagggcaagaccctgcccgacgccgaaggcgatgtattccgcggcctggaagtggtcgagcacgccgccgcgatcggcaacctgcagctcggcgaattcgccaacaacgtcgccggcggcgtcgacacctacaccctgctgcagccgctgggcgtgtgcgtcggcatcaccccgttcaatttcccggcgatgatcccgctgtggatgttcccgatggccatcgccaccggcaacaccttcgtgctcaagccgtccgagcaggatccgctggtgaccatgcgcctgtgcgaactggcgctgcaggccggcatccccaagggcgtgctcaacgtcgtgcacggcggcgaggacgcggtcaacgcgctgtgcgaccacgccgacatcaaggcggtgtcgttcgtcggctcgagcaaggtcggcacccacgtctaccgccgcgcctcgctggccggcaagcgcgtgcaatgcatgatgggcgcgaagaaccacgccgtggtgctgcccgacgccaacaaggaacagaccctcaacgcgctcgccggcgccgcgttcggcgccgccgggcagcgctgcatggccgcgtccacggcggtgctggtcggcgccgcgaacgactggattcccgagttggtggccaaggccaagacgctcaaggtcaacgccggcagcgaaccgggcaccgacgtcggcccggtgatttcctgcgccgcgcgcgaacgcgtggaaggcctgatcgcttcgggcgtggagcagggcgcaaccctggagctcgacggccgcgcgccggcggtgccgggcttcgagcgcggcaacttcgtcggcccgacgatcttctccggcgtcgcgccgggcatgcgcatctacgacgaggaaatcttcggcccggtgctggtgatcctgcgcgcgcagacgctcgacgaagcgatcgaactggtccacgccgatcccaacgggcacgggcccgggatcttcccccgttccggcgcgggcgggcggggcttccaggacgacgtcacgttcgcacggtcggga

SEQ ID NO: 33302 - DNA, 1852 bp, Desulfitobacterium hafniense
gcgaagcccgccgcgcagccgcgcgtcgctcatcccagcgcgatcctgccgcgcccggccaagttcgtgcccggccagggcgcgttcgtgttcgggccggacactgcggtggtggtcgccgccgaccagcccggcgcgcgccgggtcggcgaattcttcgcccagcgtgtgcaggcgctgcgcggcttcgcgccgaagctgcaagaaagcagcggtgcggtcaaaggtgcggtggcgctgagcctggaccccaagctgccgatcggcgaggaagcctacgtgctcgacatcggccaggacggcgccaagatcagcgcgcgcagcgaagccggcctgttctacggcgcggtgagcctgtggcagctggccaccgccgacggcgcccaggggcgagacccggatcgccgcgcagcgcatcgaggacgcgccggcgtatcgctggcgcgggctgatgctcgatgtcgcgcgccatttccgcagcgtcgatgaggtcaaggcggtgctcgaccagatggcgctgctcaagctcaacagcttccactggcatctcaccgacgaccagggctggcgcatcgagatcaagaaattcccgcgcctgaccgaagtcggcagctgccgcatccgcgccggcgccaacggccgcgacgcgcagggcaagccggtccagtactgcggctactacacccaggagcagatccgcgaggtggtcgcctacgccgccgcgcgccacatcaacgtggtgccggagatcgagatgcccggccatgcgcaggccgcgatcacgtcctaccccgcgctcggcgtcggcgacgtgctcaagcaggcgccgccggtgtcgccggactggggcgtgcacacctatctgttcaatccgcaggacgagaccttcggtcttcctcaccggcgtcctcgacgaagtgggtcgggctgttcccgtccaagtacatccacatcggcggcgacgaggcggccaaggaccaatggaaggcctcgccgatggtgcagaacaagatcaagtcgctcggcctgaaggacgaggcggcgctgcagagctggttcgtcggccgcatcggcgcgcacctgcagcagcgcggccgggtgctggtgggctgggacgaaatcctcgaaggcggcaagctgccggccgacgccacggtgatgtcctggcgcggcgatgccggcgcgctgcaggccgcgcgcgacggccacgacgtgatcctcgcgcccgaccgcaagctgtacctggactacgcgcaaagcgagcgcgacgacgagcccagcggccgctatccggtcgccaccttgcgcgcgttctacgaattcccgatgaccccgccgggcatggacgccgagcagaccaagcgtgtgatcggcgcgcagggcaacctgtggaccgagcacaagcgcagcttcgatcaggtgcaactggcgctgcacccgcgcctggacgcactggccgaggtggtgtggtcgccggcgcagggccgcgactggaacgacttccagcgccggctggtgccgcagttcgatcgctaccgcgcgctcaaggtcggcttcagcgacgccgcctacgcggtggaaaccaaggccgagcccgacgccggcggcgcccgggtgaccctgtccagccagaccggcttcggcgagatccgctaccgcaccgacggcggcgcgccggacgcgtcctcgccggtgtacgcgcagccgttccaggcggcgctgccgctggacgtggtcgccaccaccttcttcgacggccacccgatgtcggcgccgcgccggttccaggtccagaccgccgccgacctcagcgagcgcggcagcgcccagctcaaggcctgccgcgagggct

SEQ ID NO: 33303 - DNA, 1524 bp, Desulfitobacterium hafniense
  unsure (1)..(1524): unsure at all n locations
ctggcctacgccagtcagggcggcctgggcctgcccgaccgcggctattacttcgacgccgacaagcgcgacaagctcgaggcctaccgcaagcacgtggccaaggtcctggagctggccggcgccagcgccgcggacgcggaaaaacaggccaaggcggtgatcgaattcgaaacccggctggcccaggcttcgctgtcgagcgagcagctttcgcgcgacatcgccctgtactacaacccgatcagcccggcccaggccgacgagctgaccccgaatttctcctggacccagttcttccnagtcgcaangggcgtggccacgccgaagctgttctcgctggccatgcctggcttccacaaggaagtcagcaagatgatcgccgacacgccgatcgaggcctggcgcgcgttcctgcgctaccacgcggtcgatgccgcttcgccgtatctgtccgaagccttcgtgcaggagagcttcgaattccacgccaaggccatgcgcgggcagaaggaacccaaggcgcgctggaagcgcgtgctcggcggcatcgacgaccaggccggcgaagcgatgggccagctctacgtcaaggtcgccttccccgccgaagccaaggcgcagacccaggcgctggtgcagcagttgcgcaccgcattgaaggcgcgcatcgagaacctgtcgtggatgagcgctgagacgaagaagaaagcgttggagaagtgggccagcttcactccgaagatcggctacccggacaagtggcgcgactggagcggcctgaagaccggccacgacagttattacgccaacgtcaaggccgccaacaagttcaactacaagtggagcctgggcaagatcggtcagccggtcgacaagaccgaatggggcatgagcccgcagacggtcaatgcttactacaacccgctgcagaacgagatcgtgttcccggcggcgatcctgcagccgccgttcttcgaccccaaggccgacgaagcggccaactacggcggcatcggcgcggtgatcggccacgagatgatccacggctacgacgaccagggctcgcgcttcgacccgaccggcaacatggccaactggtggacgccggccgacgccaagggcttcgctgcgcgcagccagaagctgatcgagcagttcgacggctacgaagccgcgccggggctcaaggtcaacggcaagctgaccttgggcgagaacatcgccgacctcggcggcttggccaccgcctacgacgcgatgcacctggccgtgggcgacaagcccgatcccaagaccgacggcctgagccgcgaccagcgcttcttcctcaacttcgcggtgagctggcgcgaccgctacacctcggacctgctgaaggtgctggtcgcctccaacccgcacgcgcccagcgacctgcgcgcgatcggcgcgccgtcgaacctgccggccttcgccgccgcgttctcgtgcaagccgggccagccgatggtgcgcgcgggcgacaagcaagtggtgatctgg

SEQ ID NO: 33304 - DNA, 1161 bp, Desulfitobacterium hafniense
gaaataaaggatgagtttctggccagaacatcccatgagctgaaaactcccctccacggtattatcaatatctccggccaccttttgaagggagagacatcttccttaagcctggagcaaagggaaaaccttttgttgctccaggatacttcctccaggctttcgctgctggttaatgatttagttgacataataaagcttcgccatgaggacttgcagctgaatcttatcacggttgatttatatgtggtgattcaactggtatttcaactgttgtcctttgatttgcagggcaaggaagtgaagatgctgaataaagtaaaacctatgaccttcgtagaggctgatgaaaatcgcctgaggcaaattttatataatattacctccaacgccatgaagcatacggaaaaaggagaaattgttgcccaggcaagggaggagggcttggacatagtcctgaccatttccgatacgggaaagggaattccgcaggaacattgggagctggtctttaaggacttcaatcatgattcgctgccgcagcaggactataaacagggtatgggtttggggttatatatcagcaggcagctggccagaaaaatgaagggggaggtatggattgccgattctgttgtcaataaagggacaagtatggcggtacgacttgccaaggggcagtgtttaaacaccgaaatgactgccggatcggtattggaaagaaaagtttggagttcaaaaccaacaagttccggcttaagtgagaaaatgaaaaagatattgattgtcgatgatgaacccaccaatattagagttttatcccttatgttggagggagagtatcaggtgtctgcagcctatagtggggagaaagccctggaatcacttaaaaacgaaaaattccatcttcttttgaccgatctgatgatgcccggcatgtcaggtatcgaactgacccaacaaataagacaaaattactctctgatcgaactgcctattatcattgccacagccaggaacagagagagggaaatagaattggcttatcaaaacggcgctaatgattatattaccaaaccctttacggcagaagaggttcaatggagggtaaggagcctgctgaagctgacggataccatggagaaggcttttgaaagtgag

SEQ ID NO: 33305 - DNA, 516 bp, Desulfitobacterium hafniense
agataaagaaggagggtcaaaatgtattattcaacaacctatctatcacccatatgcacaattacccttgcctgtgacggcgacaatcttatcggcttatggatggagggtcagagatttcatggcggtaccctacccgaaagcatgatcgaaaaggacgatataccgatctttgacgctgccaaagcatggctggacagatattttgcaggtgagaggcctgccacatccgaattgcccctggcccccatgggcggcgaatttcgtcaaggggtatgggatattttatgccaaataccctatggccaggtaatcacctatggcgacattgccaaacagatggctgagaaaatgaacaaaaagtgtatgtccagccaagcaataggcggagccgtaggtcataaccccatatctattatcatcccctgccatcgggtagtaggtgccaagggtaacttgacaggttttggcggaggaatcagcaggaaaatccagctgcttgaacacgaaggggtg

SEQ ID NO: 33306 - DNA, 1128 bp, Desulfitobacterium hafniense
gctaaacatgggggttaaaaggtattcatccatgccttgttggacggccgggatgtgctgccccaaagtgccaaagggttcatgacccaacttaatagcaaatgccgggaattaggccttggccaggtggccaccgtcagcggccgttattatatgatggatcgggataaacgttgggaacgggtggaaaagggttaccgggctttagtgaatggggaaggtctgaaagcgcctaattctttggcagccattgaacaatcctatgatgtcagggtcacggatgagtttgtggcacctacagtcattgtcgactcggcaggggaggctgtgggaccccttcgggacggtgacagttttattttcttcaatttccgctccgatcgggcccgggagatctcttatgctctcttggatgaagaatttaccggctttgaccggggaagacctttgcaactccattatgtgtgtatgaccgaatatgacgataagctgaaaggggcggccgtggcttttccggctcagaacttagacaataccttgggggaggttctggccaaacatcagaaaaagcagctgcgcatcgctgagacagaaaaatacgcccatgtcaccttcttttttaatggtggagtagaggagccttgtcctggggaaacccgctgtcttattccttctcctcaagtccctacctataatctgttgccggaaatgagtgcttatggaattaccgaggagctcttaaagcgtctggaaagagaagaggatgaggtgatcattctgaactttgccaacgcggatatggtgggtcatacaggagagtttgaggctacggtcaaagccatcgcagcggtggatcagtgtatcgggcaaatcgttccccaggttttagagcgccagggaaccgtcattataaccgccgatcatggcaatgcggaagcaaaagtggacctgcaaaccggccagcccttaacggcccataccaccaatccggtgcccttgatcctggttaatgatcagcttaagggtaaaaccctgcgggaaggcggggccctgcgggatgtggcgccgaccatgctccggctgctggagattccgcagccccaggagatgactggaaagtccttgatt

SEQ ID NO: 33307 - DNA, 978 bp, Desulfitobacterium hafniense
ttccacgcgcgcgtgcgcgcaccgacctgcgaagtgcccatgttcgagaagatcttgatcgccaatcgcggcgaaatcgcctgtcgggtgatccgcacctgccgcaagctcggcatccgcaccgtcgcggtgtattccgaagccgacgccgacgcccagcatgtgcgccaggccgatgaggcctatcccatcggcgggccgcgcccggccgagagttatctgcgcggcgatgcgatcctcgaggtcgcccgcctcagcggcgcgcaggcgatccatccgggctacggcttcctcagcgagaacgccgacttcgccgacgcggtcgaggccgccggcatcgccttcatcggtcccaaggccgcctcgatgcgcaagatgggcagcaaggccggcgccaaggaactgatgcaggccgccggcgtgccggtggtgccgggctacaccggcgcggatcaggatcccgccctgctccagcgcgaagccgaccgcatcggctatccgctgatgatcaaggccgcccacggcggcggcggcaagggcatgcgcatcgtgcgcgaggccggcgagttcgccgccaacctggaaagctgccagcgcgaagcgcgcaacgccttcggccgcgaccgggtgctgctggagcgctacgtcgagcgcccgcgccacatcgagatccagatcttcggcgacaacaacggccaggtgatccacctcaacgagcgcgaatgctcggcccagcgccgctaccagaaggtgctggaagaatcgccctcgccgttcctgagccccgagcaacgcgcgcagatgggcgccgccgcggtccaggccggccacgccatcgattacgtcaacgccggcacggtcgagttcatcgtcggccaggacggcgcgttctacttcatggagatcaacacccgcctgcaggtcgagcacccggtgaccgagttggtcaccggtctggacctggtcgaatggcagctg

SEQ ID NO: 33308 - DNA, 706 bp, Desulfitobacterium hafniense
atcgtctttgagcatgtttcttttcattatgagggaaaacccgtcctgaagaatatcaatctgaccatcgaaaaagggaaatccgtggctattgtgggaccttcaggtacaggaaaaaccaccttgatcaacctcatcccccgtttatatgatgtgaccgggggcagggtccttctggatgggcaagatgttcgggaccttgacctgaactttctgcgccaaaatatcggcatggttgctcaggacacctatctcttcaacggaaccattcgcgagaacctccactatgccaatgagcatgcccaagaagaggatttgatcagggtgtgtcgggaagccaatatctatgattttatccgtaccctgcctgacggttttgacacgttggtcggcaaccgggggttaaaactgtccggcggtgaaaagcagcgccttgccatcgcccgggttctcctcaaagaccctaaagtgctgatcatggatgaagccacctcttctttggattccctcagcgaatccctgatccaggaagctatcgaacccatagcttttaaggcagtacctagctgttagttatgcgcccgatctggctcttccacgtattatgtccgtgaatgacattatcgtcttacaagaaggggaaatcgtccaacaagggacccattgggagctgctcaaagaagacggactctacaaattgctctat

SEQ ID NO: 33309 - DNA, 478 bp, Desulfitobacterium hafniense
aaacccgttatatctttcaaggatattactaccctgattaaaggatggagaagcttatcgggcagaggttgatgccatcgttgagcgggtcagggaatctcaaccggatctgattgtgggaccggaagcccgcggctttttgctgggagctccggtagcttatgccttgggcattggctttgttccggtgcgtaaaccgggacaaacttccgggtaaaacagtgagcgaaacctatgaacttgaatatggtagtgatacgttagaagttcacgctgatgccattcaaccgggacaacggatcgcgattgtcgatgatttgctggcgaccggcggcacgacttccgccacagcccgtttaattgaaaagaccggcgcccaggtggcaggaatgagtttttgattgaattgggctttctggaaggccgtaagagactggaagggtatgaggtattttctttaattaagtattaaaagcgg

SEQ ID NO: 33310 - DNA, 942 bp, Desulfitobacterium hafniense
gtggaagtgggagtgctctattcctttatcaattatctggatcgttttatcgacccggtgaatatgatcttaatgcgcctattctcaggcttcagcaggcgattatcgccgcggaaagggtctttgaagtgctggatgacgggcgaaccaccacagcccttggcctgaatgctgttcaggaagccggtgatcctcctgctcctggtatcgaaaaaggtgagattgaatttcgcaatgtcagtatatcctatgatggtgtcactgaagtcttaacaaacatctcctttacggttcaccctgatggagacggtagctttagtcggccataccggcagcgggaaaagcacgatttccaatctcttaatgaaattttacccggttaatcaaggggaaatcttgattgatggtatatccttgcatgacttttcccaggaggagctgcgtacccagattggtcttgtcgctcaggatcctttcctctttgtcggagatattgccaacaatattgccctgaaccgacctgcggtcggggagagagaggtcaacgcggcggcagaatttgtggaggctgatcaattcattaccaagctgccgcagggatatcaggaacctgtcagtgaaaggggctccacactctccagtggtcaacggcagcttatctgctttgcccgcaccattgccggagaacctaaaattcttattctcgatgaagccaccgccagtgtggatacagagacagaggaggctattcaaaccgccttaaacaaaatgcgccaagggcgcagtaccatcgctattgctcatcggctttccaccatacaggatgccgatcttatccttgttttgcatcagggacaaatagtcgagcgaggcaatcataacgaactcctcgctcaaaaaggcctgtattacaaaatgtttctgcttcaacaaggggcaggc

SEQ ID NO: 33311 - DNA, 987 bp, Desulfitobacterium hafniense
cgaattgcaattaacggctttgggcgaatcggtcggctttccatgcgggcaatcctggaacgaaaaagttccctggacattgttgctgttaatgatctggggagtccggatctgttaggtcatttattcaagtatgattcaattcatgatatcctgccttatgatgttgaggtcaaggaaaacacccttgaagttttggaccaaaaggtggcttttttggcggaaaaagatcctgggaaacttccctggcgggagctgggggtagatctggtgattgaagctacggggcgctttaccaagcgggagcaggcggcgttgcatctccaggccggagcgaaaaaggtgatcatttccgctccgggaaaacacgaagatatcacgattgtgatgggggtaaacgaacatctctataaccccgctgagcaccatatcctctccaatgcctcctgtaccaccaatggtttggggcccccctagccaagggttttactcgaagaatttgggatcgagcagggcatgatgaccaccacccattcggtgaccaatgaccagcggattctggatttggagcataaggattggcggcgggcccgggcggcctacgaatcgatgattcctacgaccacaggagcaaccaaggcggtggaactggtgcttcccgacttaaagggcaagctcaaaggattagcggtgagggttcctacccctaatgtctcgcttattgattttgtggctaatttaagccgttccaccaccaaagaagaagtaaatcaaaaacttagggaagccgccgagggaagcctcaaaggctacctggcttattccgagctgcctttagtttcccacgactttaatggcaaccctcacagtgccattgttgacgggttgtctacgctgatgctgggagagcgcatggtcaaggtcctggcctggtatgacaacgagtggggatactccaatcggattgtggacttggtggaatacatc

SEQ ID NO: 33312 - DNA, 900 bp, Desulfitobacterium hafniense
atgcgccgcaccaaaatagtatgtaccatcggaccgtccagtgaatccaatgagaagattcgccaattacttaaggccggcatgaatgtagcccgtttaaatttctctcatggaacccatggtgagcatggcaagcggatacgaaccttaagagaagaagcacagaaactcggtgttcatttaggggttcttctggataccaaaggcccggaaatcagaacgggaacggttccggaggagggagttcaattaaacagcggtgatacctttattcttgataccgatctatcgactctggggtccgcagagcgggtgggtataacctaccttcagctttggcaggaggttcatcagggtacgcatatccttcttgatgatggtctcatcgaccttgaagtcattgccagtgaggaaggaaagatcatcaccaaaatccaaaatggcggagttcttaaatcgaaaaaaggggtcaatgtgccaggtgttccgattcagctgccggcgattacggaaaaagatcgtgatgatatcatctttggcttaagggaaggaatcgactttattgctgcttcttttgcccgcaaggctgccgatattttggccgtaaggcgtttggttgaggaagaaggggccaatgtcaagattatcgctaagattgaaaaccgcgaaggtatcgagcatttagatgagatcctggaggttgccgacggtctgatggtagcccgcggggatctgggagtggaggtgcctgtagaagaggtccccattcatcaaaaggacatgattgaaaaatgccatcatctgggtaaaaccgtcatcgcggctacacagatgctggataccatgatccgcaaaccgcggacgacccgggcggcagccagtgatgtggctcatgcaata

SEQ ID NO: 33313 - DNA, 660 bp, Desulfitobacterium hafniense
ggcaaaaagcatgtcctcaaagagattgacctggaaattccctatggccatatctacggcttgctgggcccttccggctgcggcaaaaccaccatcgtgaaaataattgcagggatactggaagctacttccggcgaagcctatgtcctcggtgaaaggatgccccggctgagcttaatgaacaaggtagggtatatggctcagtccgatgctctctatggtaccttaaccgcagcggaaaatctgcagttttttggggccatttatggcatgggcaagggagagatcaaaaaacggacggcggaagtcatggagttggtcaatcttaccgaacacctccacaaaccggtccaggctttttccggcggaatgaaacggcggctttccctggctatggctgttatgcacaacccgccggtgctggttttggatgaacctacggtagggatcgacccacttttaaggagaacgatctgggcggaattaaacaccttggccaggcaagggattacgatcctggtcacaacccatgtcatggatgaagcggataaatgccacagccttgctatgatgcgggatggacgcctgatcgctaagggcacttcccgggagctgcaggatacgatcggtgtcaacgacatcgaagaagcttccatctat

SEQ ID NO: 33314 - DNA, 769 bp, Desulfitobacterium hafniense
aaaaacatgtttaatctacaaggccgtgtggctgttattaccggagcgtccagcggattaggcacccaaatggctcatgggctggctgaacaaggtgccgatgtggtgctgttggcccgccgggaggagcgactgcgtaaagtggccgaagatattgaaagccaatacggtgtccaagcctatcccttcccttgtgacgtaactcaactggcctctgttcaggccggccgttcaagctgcccgggagcgattcggcaaagtggatatccttattaataacgccggcatcggctccgttgcacctgccgaaacaatggacgatgaagtatgggaacataatctgtccgtggatctgaccggtgtctttcgtatcgcccgcgaatttggcaaagtcatgctggaagccggttatgggcgtattatcaatatttcttccatgtacggcatggtgggaaattcagctacacccgcttccgcctaccatgcagccaaaggcggtgtggtcaatctcacccgggctttggcggcggaatgggccgaccgtggtgtcaccgtcaattgtctctgcccaggctattttgaaacggaattgactgtcgatcttctgaagacggaggaattcaaggcttatatggagcgcaccgtgcccctgaaacgttacggcaattccggtgaattgaattccgctgcctgcttcctggcggctgatgaatcatcctatgtgaccggagccattctacccattgacggcggttacacctgcgtttaa

SEQ ID NO: 33315 - DNA, 1198 bp, Desulfitobacterium hafniense
gagcgctactacctgcccgtctaccggccgcgccggatcgtgctcgaccacggcaaaggctcgcgggtgtgggacctggacgggcgcgaatacgtcgacttcggcgccggcatcgcggtcaacgcgctcggccacgcgcatccggcgctgatcgcggcgctgaccgagcaggccggcaagctgtggcacaccagcaacgtgttcgtcagcgagccgccgctgcgcctggccgaacaactggtgtccgcctcgggtttcgccgagcgcgtgttcctgtgcaactccggcgccgaggccaacgaggcggcgatcaagctggcgcgcaagtgggccaccggcgaaggccgcgagcccgagcgccgggtcatcctgagcttccgcggcagcttccacggccgcaccctggccgcggtcaccgccaccgcccagcccaagtaccacgaaggcttcgaaccgctgccgccgggctttcgctacagcgacttcaacgacctcgccgcggccgaggcggcgatggccgacggcgcggtgtgcgcggtgctggtcgagccggtgcagggcgagggcggggtgacgccggccagcgaggccttcctgcaaggtctgcgcgcgctgtgcgaccgccacggcgcgctgctgatcctcgacgagatccagtgcggcatgggccgcaccggcgagctgttcgcctgccatgcctatggggtgaagcccgacgtggtgaccctggccaagggcgctcggcagcggcttcccgatcggcgcgatgctggtcggccccaagccggcgcagtcgatgcagttcggcgcccacggcaccaccttcggcggcaatccgctggcggcggcggtggccggcgcggcgctgcgcgagctgcgctcgcccgagctgctggccaacgtcgctcgtcaggcacaggcgatccgcgccggcgtcgccgcgctcgacgccgagctggagctgttttccgaagtgcgtggccgcggcctgatgatcggcgcacaactgcgcggcgagcacgccggcaaggccggcgaaatcctcgaccgctgcgtcgaacatggcctgctgctgttgcaggcggggccggacgtgctgcgcttcgtgccggcgctgaacatcggcgatgccgacatcgccgacggcctgcagcgcttgcgcgcggcgctgctgcagttcctcggccgctgaaccggg

SEQ ID NO: 33316 - DNA, 522 bp, Desulfitobacterium hafniense
aagcaattaggttttatgtatgaccaaacaaaatgcattaattgtaagttatgcgcctaagcatgtaaagatacgaacaaatgggagcccggtgccgaatggcgtaaggtatatgtagcagagccggcaagcaacaaggtgtatctctcgatgagctgcaatcactgtgccgatcctgcctgtatggcagtatgccctgtcaaagcctatacgaaacgggataaagacggtattgtagcccataatacgaagaaatgcgtgggctgtgcctattgcctctatgcctgcccttaccatgcaccacagtttgttaagtccggtactggagcagtaactaaatgcagtttctgtgccgagattcaggaccaggggggcaaacctgcctgtgtatccgcatgcccgaccggtgcattaacctatggtgatattactgaactgaggaaaactcccggtgctgtagctccggaagtcaatggtctgccgccggccagcatcaccaatccttcattagtgattattccg

SEQ ID NO: 33317 - DNA, 949 bp, Desulfitobacterium hafniense
aacctaatctactccgatctgcagagggttgagaaagaacttcatgcttatataaatacagattttcctatactggatcaatccgctgttcaactactggaagccggtggaaagcggttgcgcccggcttttacccttttagcaggaaaattctatggctatcccattgacaggctccttccggtggctatggctttagaattgattcacatggccactctggttcatgacgatgtagtggacgcgtcaatgacccggcggggacggccgacagttaaagcaaaatggggaaatgtagtttcgattgctaccggggattacctattggctaaagcgctggagctgcttgctcagattaatcatcctgaagtatccaagattcttgctgaagtcagtgtggaaatgagccagggagagatccaacagattaaagcttccaatgatgtcaatcagaacttgaaacagtattattatcgtattaagcgtaaaacggccatgcttatttcggccagttgcaaactgggtgctctgatttctgctgctccgcggcgggaggtttgggctctgggtgcttacggacacgctctgggtatggcttttcaaatcgtcgatgatgtcctggatgtcaccgctgaagcctccgaactgggcaagcctgtgggaggagatatccgtcaaggaattatgactctgcctttgattcttgcccctgcatcaatccggggagagggagcgtctccatgaattgctggtcaaaccggagaaagatgaggatgacgtcagagaggccattaaaatgatcaaggactccggagcaattgctgactccatgcactatgtggacttatatataagtaaagccaattcttaccttcaagagctgcccaatgtaccgacccggaaggctctcgtggatttggcttattttgtgaaggaacgcaagttttag

SEQ ID NO: 33318 - DNA, 1262 bp, Desulfitobacterium hafniense
  unsure (1)..(1262): unsure at all n locations
cagtatcaggttggcatcttaggcggaggtcccgggggctatgtctgcgccttacgcgctgcccagcttggcttatccgtcgttttggttgagaaagagcgtttgggggggacctgtctgaacaaaggatgcattcccaccaagaccttggtcaaaagcgcggagttatggcgggaaataaagcatgccgaagaattcggcattcagcttgggggcgcgttgcttcattacccgcaaattgccgcaaggaaaaaggaagtggtcaataccttagtaagcggcattgagcagctcatgaaggcgaaaaagattactgtgctaaaagggtggggagaggtaaaagaggccaatcggattgaagtcacgaccgaaacgggtaaggttgagcttcatgtggagaatttggttttggccacgggatccatcccgaccaaaattcctgtacccggtgtggacctcccgggagtggtgaccagcgaagagcttcttgaacaggaaacccttcccgatagcctggtggtcatcggcggtggcgtgattggtttggagtttgcgtccatttaccacgaatttggcgtcaaggtcagtgtggtggaaatgcttccttctcttcttcccaatatcgatgaagagatacccaaacgcttagctcctttgctgaaaagaagcgggctggagattttgacgaaggcttttgtaagggaaatcaaacctaaggaagagggtttggtggttattgttgaggatgggaagggcttgaaggaattaccggcccaacaggtgcttttggctacgggcagaagaccgagtctcagtggcatccatggggatgccttaggacttgagctggaccggggagctatcaaagtcaactctcagatgcaaacctcggtccctaaggtgtatgctcttgggnngatgnntangtgnngngntngngngngnncggaaannttggncttgccnnnaatgtagcctccatgcaggggatggtggcagctgagcatatggcggggcagcaggttagtatggagggaagggcgatacccagtgccatctttacctacccggagattgccgctgtcggtgagactgagcaggctttaaaggcttcaggccaaaactataaggtcagtaagttccctttcagcgccaatggcaaagccttagcattaggggaaatcatgggattggtgaagctgttggctgatgaagagggagttgtaataggcgccagtatcatgggacctcaggccagcagc

SEQ ID NO: 33319 - DNA, 999 bp, Desulfitobacterium hafniense
ttgacaattcgaattgggattaatggatttggtcgaattggacgaaacgtttttcgagcggcttttggaagagaaaacattgaaatcgttgcagtgaataatcgatcgacaggtgagattttacctcatctcttaaaatacgattccgtacatggtatcttccctgctcagatccagcacactgaagatggcttcactgtggatggacaactggttaaagtagtttcccacacagatcccggagatattccttggggtgaattaggtgtggacattgtcattgaatccagcggcaaattcaataatgggccggcctgtcaaaaacacctcaacaatggggcgcgcaaagttattatttctgctcccgccaaagaagaagacattacccttgtcatgggcgtcaatgaagaaatctatgatccgcaaaaacaccatatcatatccaatgcctcatgtacaaccaattgtctggctcctgtagccaaagtgattcacaaaaacttcggactcaaacggggattaatgaccactgttcattcttacaccaatgaccagcaaattttggatcaatctcacaaagatttgcgccgggcccgggcggcgggactttccatcatccccaccactacaggagcggcgagggctgtagcccttgtactgcctgagcttaagggaaaactcaacggtttttccatgcgtgtccctacacccaatgtctctgtgattgatttagtcgccgaaattgagaagaataccacgattgaagaactcaacggagtcttgcgccacgccagcgaaaataaactgaagggaatcctggactacaccgatcttcccctcgtttccagcgatttcaatggcagctccgcctcatccatcgtcgatggtctgtccaccatggttatggaggataaccttattaaggtcatctcttggtatgataatgaatggggttattcctgccgtgtcgtcgaccttgtcgaatatgtcagtcgccag

SEQ ID NO: 33320 - DNA, 744 bp, Desulfitobacterium hafniense
atgagattaatgaataaggtggccattgtaacgggagcagcttccggtatgggcaagtcaattgcccttctctacgctaaagaaggggccaaagtcgttgtatcggatctcaatctggagggtgcccataaggttgccgaagagattacttcggcaggtggcaccgctttggccatcaagaccaatgttgctgtggaagaagatattcaagccttggttgacacagctgtgagtacttatggtaccgtcgatatttttgtcaacaatgcaggaatcatggataattttgaacctgccgctgatatagaagataagaattgggaaagaatatttgccgtaaacaccacaagcgttatgcgtgcaaccagaaaggttcttcccatattcctggaaaaatcaagcggcgtcattgtcaatgtcgcctcggcagggggactaaacggtgccagagcaggggctacatacacggcctccaaacatgccgtgattggttttactaaaaacaccggctttatgtatgcccagcaggggattcgctgcaacgccatcgccccgggagccgtggaaaccaatatcgggtccacaattaccgatcctcataaattcggctccgcacgggcctatgctggtatggccaccaatccccgtatgggcaaacctgaggagattgcccaggtggcattgttcctggctgcggaggagtccagcttcgtcaatggcgctgttatcgtggctgacggaggc

SEQ ID NO: 33321 - DNA, 1581 bp, Desulfitobacterium hafniense
caagtgcaaggatatcttctggccattttgggtgtcatcggtgtacgggggattttccagtattgcagtgaagtaactgcccgtgaggcggccatccgggtaaaggaaagggtaagggtgcggtttctgcacaagatcctggcgctggggcctgtgtatgcccggggggagcggggaggggaactgctcaacacagcggtagagggaattgaagccttggatgattattttgcccgctatgttccccaactcattttagctgttttagtaccgatgcttacgttagcttttgtcctgcctaaggattttcaatctgcccttgtcttaatcataaccggccccctcattcctttcttcatgatcttgattggcaaacttgctgagaaaaagtctttacggcaatggcaaagcttaagccgtatgagcgctcattttcttgatatgcttcaaggcttaaccaccctgaagctgttcgggcggagtaaagaccaagccacagtgatcagccgggtcagcgaggcctttcggaagagtaccatgagcgtcatgaaagtagcttttttatcggcttttgtcctggagtttatggggatgatcagcaccgcaatcattgccgtaaccttgggccttcgtttgattaatggcacggttccctatgctgaggcgcttttcattctgatcttagctccggagttttatttgcccttaaggactcttggtttgtcttttcatgcacgactctccgggagcaatgctgctcagcgcattttcgaagtccttgagctagagaaccagctggaatctgagttgaatggggtggaattgggcggaggggcggaggagcccggtcatttgttcaggggagagcaaggcgcgccttggcttacatttaaacaggtggacctatgctatgagcaagagggagaaagagttttaaaggatattaactttaccctccgccttggtgaacgggtggctttgattggacccagtggcgcgggaaaaagctcccttctgcagattctgcttaggtttgtagaaccgacacaaggaaaggtgctgattaacgatacggtattaaacaggatcccggcggcagcttggcgggagatgatttcttacgttccccagaaaccttatctctttgccgggtcgattatggagaatattcgcttcggcaaccccggggcagcttgggcagacgtggtaagggctgctcaactggccatggcccatgagtttatcagcgaacttccccaaggctatgatacccttgtgggtgagggaggagcccgtttaagcggggggcaggcgcagcgcatagccatcagccgggcctttcttaaggatgcgccgctgctgttgctggacgaagtgaccagcggcttggataacgaaaatgaaaaggatttgctgatagccttggagggcctttgtcaggacaggaccgtaatctttaccacccatcgcatgaggacgacgattgaggcggatcggatcctggtacttgataaggggaggattattgaggagggctctccacagaccttactcaataatcaagggctctacacccatttc

SEQ ID NO: 33322 - DNA, 861 bp, Desulfitobacterium hafniense
aaccgtccttatctgccgggggtggtgctgcccccaacagtgcgccccacaggggacgcaggggcgcttgaggaagcggaaatgctggtgctcagtgtgccctcccatagcgtacgggagacggcccaaaagatcagggcctatctccaaccgggaaccatcgttgtgaacacggccaaagggctggaggagggaagtcacaagcggctttctcaggtcttgactgaagaacttccccatcatcccatcgtggttttgtccggtcccagccacgctgaggaagtaggcaaggatatgccgaccacggttgtggtggcttctcaaaacagtcaggctgcggaagctgttcaggatatgctgatgactcctaaattccgcgtctacaccaatccggataccatcggtgtagaattgggaggagcttttaaaaatattattgctctgtgtgccggctttgccgacggcttaggctttggggataataccaaggctgccctgatgacccgggggattgctgagattacccgcttaggtgcggccatgggagggaacccgctgacctttgccggcctggccggagtgggggatcttattgtaacctgcaccagccggcatagccgcaatcaccgggctggggttgctttgggcgagggtaagcctttggagcaagtcctcaaagaggtgggtatggtggtggagggcgttcgcaccacccgcgttgcctacgagctgagccgtcagtatgaaatctccatgcccatcacagaacaggcttaccaggttctttttcagggtgccgatcccagggcggcagtatctgctctgatgatgagaggcaaaaagcacgagattgaggaagtg

SEQ ID NO: 33323 - DNA, 1599 bp, Desulfitobacterium hafniense
gtctggtataattgttatgaagaaggggtacctaaacgtatcgagatcgagaacatatcgctatacgaaatgttcgagcgcagcgccaaaaactttggccagcggccggctatagtttttggcggcaagacctggacttatacggacatggagcgggatgtcgatcgtttggctaaggcgttaagcagacttggtgtcaagcctaaggaccgaatttctatcaatatgcccaactctgcgacctggatgattagtttctttgccatcatgaaagttggtgctatcgtagttcagaccaacccactctatgtcgaaggcgagctaaaagcacttatgaatgactccggtgcgataggtatgattactgttgcacctctctacccgagagttcagggaatccgtcaagaaacatcgcttaagtgggttcttgtagaaggcctaaaggccatgggcctggatgaaggagaaggaacttgtgacttccacggttgcctcaatgatgactccgaggttgagtggtccaagccggttatcgatccccagacagatattgccgtgttgcaatataccggaggaaccactggcacctcaaagggcgccatgctttcccacggcaatctttatgctaacgcttaccagatttgggagtggattaaagggtcaccaggacaagaaaaatccttatgcgtcattcccttgtttcatatctacgccttatccgtctgtatgaatacctcaattcttgggggaagtgccgtgattcccgttcccaaattcgatgcggatcttatcctaaaacttattaatgatgagaagcccaccctttatccaggaactccaaccatgtatgtagcgttgattaaccatcccaagcttaaagagcatgatgtttcctccatcagggcatgtgtcagtggctcggctcctttgcctgtggaagtcgcactgcgctttggagagttgaccggcgggaagcttgtggagggctatgggttatctgaggcctcgcctgtgactcatattaatcctttccccagtgcccgcgtaggttccatcggcacacctgtctccaatacccaagccaagattgtggatatagagctgggagataaagagcttcctgtaggggaagtcggagaactggctgttaaaggtccccaggtcatgctggggtactggcaaagagaaaatgagaccagagcggtgttgcgggacggatggttgtataccggtgatctggcccgcatggatgaagatgggtacttttatgttgtcgatagaaaaaaagatatgattattaccggtggctataatgtttatccccgtgaaattgaagaagcattatatgctcatcctgccgtcagagaagcgatatgtgcaggagttccggattcatactggggagagaaagtaaaggcttatgtagtgctgagagaagagcagcaagtcacagaggaggagcttcttagtttcttaaagaaagaattagcctcctataaagtgccgaagcaaattgaaatcagggataatctgcctaagacagccgttggtaaggtactgaggagatttttagttgaggaagaaaaacaaaaactggaa

SEQ ID NO: 33324 - DNA, 1140 bp, Desulfitobacterium hafniense
caagtttttaaccctcaaccacaaaaagccttggatcttttggccaaaggcttgagcaaggagcagattctaagcgagaccggcctcaccgtcggtgtaaataatgtcagctttaccgtcaacgaaggagaaatattcgtgatcatgggcctttccggcagcggtaagtccaccattctccgctgtctcaaccgtttaatcgaacccagcgccggagctatccttattgatggagtggatattactcaactaaaaccccaagagctgaggcaaacaagacagaaaaagctgggcatggtcttccagcaatttgccctccttccccatcgcacagttctgcaaaacactgtcttcggtctggaaattcaaggggccgacagggccgctcgtgagcaaaaggcccgggattgtctggcgatggtcggcttggcaggttgggaaaactcctatcctgatgaattgagcggcggcatgaagcaacgggtcggattggcccgggctttagccaatgatccggatattttgctcatggacgaagctttcagcgctttggatcccttgattcgggaagaaatgcaggatgagctgcttaatcttcagcaaaagatgaataagaccatcgtctttattacccatgacctgaacgaagctctgaaaatcggcgaccaaatcgcctttgtccgcgacggttctctggtccaagtgggtacagctgaagaaatcgtcggcagccctgctgatgattatgtggccaaattcgcccgtggtgtggatctcagccggattctcaccttaaaggatattatgaagcgccctcagcctgtagtacagcttaaagacggccctaatgttgcccttaaggttatgaaagagcatggcctgtccagcgtttttgtcgtggacagaagcaagcgtttgcatggacttatcaatgcggacttggccattgaagcccgtcagaaaggtgtccacagccttcaggaagtcgagctgattgaagttctggctctgcagggcaatgtcctcgttcaggatattcttccggtcatcgccaatacaaaggttccactggctgtggtcgatgaagaagagcatttgatcggaatcattgttcgcggtgtcgtgcttgccgccttagca

SEQ ID NO: 33325 - DNA, 1428 bp, Desulfitobacterium hafniense
cttaaagttcgttttgcccccagcccgacgggccccttacatatcggcggtgcacgttccgccctctttaattacctgctcgcccgcaaagaagacggggtttttatcgtccgcagtgaggataccgatctggagcgctccagccgggaatcggaacacaatattatggaggctctgcgctggctcaacattcaatgggatgaaggaatcgaagtcggcggcgacaacggaccttaccgccagaccgagcgtctggctctttatcaggaatatacggacaggcttctcgccagcggagacgcctattattgctattgttcagaagaagagctggagcaggaacgccaggatttgatggctaaaggggaaactccccgctacctgggtaaatgccgtcatctttccgcagcagagcgccaaacatacgaagcggcgggccgtaaacctgtggttcgttttcgggtgcctgaaggccggcagatcctgatcaacgaccgggtgcggggagaagtggtctttgacagcgacggcatcggcgattatgtcatcgttaagtccgatggcattcccacctataattttgccgtggtcatcgacgataccactatgaatatcacccatgtcatccgcggggaagaacatctctccaatactccccgacaagtgctgatttaccaggctttaggcctccccactccggaattcgctcatatctccctgattctcaacactgaaggaaaaaagatgagcaaacgggatggggatacagcggttatcgattatcaggccaaaggatatctgccggaggctgtggtgaatttcattgccctgatgggctggtctcccccgggggaagaagaattctttaccctggaggaaatgacccaagccttctctttggagcgggtctccaagagtccggcggtttttgacttgaataaactaaactatatgaacgctcattatattaagcaggcggaccccgagcgactcacagatttggctgtgccttatctccgggagatgggagctattccccagggaaccctttccgaagaggaacgggcctgggtgactcactacgttcaagccatcattaatcacctatcctatatggctcaggttaaggattttgtccattatgtacaggggggagaagctcccactccggaaggggaagccctggagatcctgcaaggggagcaagtcccggctgttctggacctctttgtggaaaaattaaagagcctggaggcaattcgtgtcgatacggtgaagcctttatttaagcagatcaccaaagaaacgaagctgggcggcaaacaagtctttatgcccattcggatcgcactgaccggacagatgcatggaccggagctctatgacattgtcccgctgctggggctggagaatgtgctgagccgcttg

SEQ ID NO: 33326 - DNA, 533 bp, Desulfitobacterium hafniense
aaaaaggtagtgcttgcgtattccggaggattagatacctcgatcatcatcccttggctgaaagagaattatggctatgaagtcattgctatggccgctgacctgggacaaggagaagagctggagcctctccacgaaaaagcgattaagagcggagccagtaaattatatatcgaagatctgcaagaagaattcgttactgatttcatctaccccaccctaaaagccggagctgtctatgaaggcaaatatcttttgggaacctcctttgcccgtcccctgattgcccaacgtttagtagagattgcggcaaaagagggagctgtggccattgctcacggtgccacgggcaaaaggaaacgaccaggttcgctttgagctggctgtcaaagcccttaatcctgatctggagatcataagtcttgggggatttgggatatcaagtccgggaagatgctatgactatgctgtgagagggaattctgtcctgtatgaaagatgcccttagtatggaccgaagtttggctttcaac

SEQ ID NO: 33327 - DNA, 909 bp, Desulfitobacterium hafniense
ggtcgggattttatctgtctccaggattttacacccgatgaaattctttatatgctcaaggtagctaaagagctgaaagaggaaaaaaaaggggggactccccatcccatcctccaaggcaagtcgttggccatgattttcactaagtcatccacacggacccgggttgcgtttgaagccggcatgcttcagttaggagggcatgctttatttttgagcaaccgggatattcaaattggacgtggggaacctataaaagataccgctcgtgtcttatcccggatggtggatggaattatgatcagaacccatagccatcaggatgtaattgagctggctaagtatgctgatatacccgtcatcaatgggttaagtgattttcttcatcctacccaagtgctggcggatctgctgactatccaggaacataagcactgtctggaaggtttaaagctgacctatattggagatgggaacaatatggcccattctttgatgtttgccggtaaaatgggaatgcatgtggtcatagccactcctgccggatataagcccgatgcccaagtggtagctcaagcacaggcacaagctaaacagtacggcggcctggtggaatgggtggaggatcctcttgcggcagccgagggagccgatgtgctctacaccgatgtctgggccagcatggggcaggaagaagaggccgcaatccgtatgaaagccttccaaagctaccggatcgacagagagaccatggagagggctcaagccaatgccatcgtcatgcattgtcttccggctcaccggggagaagaaatcacggaagaggttcttgaaggacctcaatccgtagtctttgatgaggctgaaaatcgactccacgctcataaagcaatcatggctttattgata

SEQ ID NO: 33328 - DNA, 1074 bp, Desulfitobacterium hafniense
gcagacgaacaagaaatcaaaaaggcctatcgaaaactggcccgccaatatcatcctgatgtgaacccgggagataaagacgcggaagaaaaattcaaagaggcaactgaagcctatgatgttttaagcgatactgaaaaacgtgcccgctacgatcaaatgggccattccgccttcgatcccaaccaacaaggttttggcgggttcggcggagatttcggcggctttggggatatcttcgatatgtttttcggcggcggcggtggcggtggtcagcggcggcagggtcctacccgggggaatgaccttcgctatgacttaaccattacttttgaagaggctgcctttggtaccgagaaagagattcaggttccccgtcaagaaacctgcacggaatgccatggctccggttcagcccccggcacccatcctaccacctgttcccaatgtcacggaacagggcaggttaaagctacccaacggactccttttggcgcgattcaaacagcaagaacttgccctgcctgcaatggctcaggtcaatttatatcttctccatgtaaggaatgcagtggcaagggaaccacacggaaggtcaaaaccattaaagtcactgtccccccagggtcggaggatggccttaaccttcgtttcagcggcaatggggaagcagggctgcggggaggcccatcaggagacctttatgtggtcctcaatgtgaaagcccataaattctttgaaagagaagggaacgacgtctattgcgagattcccataacctttgtacaggccgccctcgggtcggagctcgatgttcccaccttggatggcaaagtcaaaatgaagatacccgaaggcacccagactgctacggtgttccggctgaggggtcatggtattccttaccgccgcggcaacgggagaggggatcagcatgtgagagtagttgtggccactccgactaaactcaccgaccgccaaaaggagctgctgcgtgagttcggggaagtcaccagcgatcagcagcagatgggcaaaaaatccttcttcgagaaggtcaaagaaaatatccgg

SEQ ID NO: 33329 - DNA, 2145 bp, Desulfitobacterium hafniense
aacaaagactggtggccaaatcgattatatctcaacattcgtcatcagaactctgctttgggcaatcccatggatccggacttcaattatgctgaagaatttcagaaacttgacctggcagccgtaaagaaagatctttctgccttaatgaccgattcccaggattggtggcctgccgattacggccactacgggcctctcttcatccggatggcctggcacagtgcgggaacataccgtttgaacgacggacggggcggcgccggagacggaacccagcgctttgctcccctcaacagctggccggacaatgtaaatctggataaggcccgccgtttgctctggcctattaaacagaaatatggaaaaaaaatctcctgggccgatctgatggtcctggccggcaattgtgctttggaatccatgggcttcaagacctttggcttcgccggcggccgcgaggatgtttgggaacctcaggaagatatttattggggctctgaaggagaatggctgggcgaccagcgctattccggggatcgggatcttgagaaccctctcgccgcagtacagatgggcctgatttatgttaacccggaaggtcccaatggacagcccagtgtcctggcttccggccgcgacgtgcgggatacctttaaacgtatggctatgaatgatgaagagactgtggccctggtggccggcgggcacactttcggcaaatgccatggcgccggtcctgcctcccatgttggtccggagccggaagctgctcctctggaagaacaggggctgggctggaaaagcaccttccgcagcggcaaaggtggagataccatcggcagcggcatcgaaggggcctggaaacccaaccccaccacctgggatatgggttatttagagaccttgttcaaatacgactgggacctggtgaaaagccccgccggagcgtggcagtgggttcccactgacccggctgcagcagatacggtgcaggatgcccatgaccctgccaagcggcatgcgcccatgatgaccacagcagacctttccctgcggatggacccgatttttggaccgattgccaagcgattccgggataatcctgaagagttcgccgacgctttcgcacgggcctggttcaagctgactcatcgtgacatgggaccccgctcccgctatttgggcccggaagttcctgaagaagaactgatttggcaggacccggtacctccagtggatcatgaattaatcgacgaacaggatatcgccgatctcaaagctaaacttctggcttccggcctttccgtctcccagctggtctccaccgcctgggcttccgcttccaccttccggggttcggataaacggggcggcgccaacggagcgcggatccgcctggcacctcagaaagattgggaaatcaatcaaccggctcagctggccgaggtattggcggcactggaagggatccagactgagttcaacagctcccaatccggaacaaagaaggtttctctggccgacttaatcgtcctgggcggtgccgccgctattgagcaggctgccaggaacgccggccagactctggtcgttccctttacgccgggccgcaccgacgctactcaggagcagaccgagatctattccttcgctgttatggaaccgaaagccgatggtttccgcaactacctgaaaggcaaatcttctgcaccagcagaggaaatgctggttgaccgggcccaactgctgaccctgaccgctccggaaatgacggttctcctcggcggcctgcgggttttgaatgccaattacggccaatccaagcacggtgtcttcacccaacgtccggaaactctcaccaacgacttctttgttaatctcctcgacatgggtaccgaatggaaagccgtatcggaagaaaaggctctctatgagggccgggaccgggccacaggcgaattgaaatggaccggcacccgggttgatctggtcttcggttccaactcccaactgcgggccctggcggaagtctacgcctgcagcgactctcaggataaattcctccaggatttcgtatccgcctggaataaagtaatgaatgccgatcgcttcgatctggcctaagacaacagcagattagat

SEQ ID NO: 33330 - DNA, 2361 bp, Desulfitobacterium hafniense
aaggtcagtcgccgctcctttttgaaatggagcgcagctgttgccggctcatcgacactggtgggatgcatgcccctaacttcgggagcaggagctgaaccggcagttgctcaagccggaaaccgtcatcttgatgcggaaataaagccttcgatatgttggcataattgcggcgggcgctgtcagattaaagcccaggtgaaggacggtgttgtcctgagttttgtgacggacaatgagggaccggatactccggataatcttcaggccagggcttgtttgaaagggagatcccagcgtcagcgcctctatcatccggatcggctgaaataccccatgaaacgagtgggggagcggggagccgggcaatgggagaagatctcctgggaagaggctctggataccacagcttctgagttaaaacgtattatcaatcaatatggcaatgaatcggtatattttatttatgcttcaggggtaggtggggcatttaaccaaagctatgtagggggagcatctgcgagacttcttaatgcactgggaggatatctgagcttttatggcaactacagccaggccaattatatgtatgccattccttatatgtttggagccggttatggaggaagctcacccaccagtttttcagatgcccagctgatcgtgatgttcggcgataatcccgccagcacaagagtgggtggtcttaattcaacatactatctcaaattagcgaaagaaaacggaaccaaagttattgtcatcgatccccgtcacagtgatacggtaggcacctttgccgaccagtggattcctattcgtccgaccactgatgcggcacttgtggcaggccttgcttatgtcatactgacagaggagcttcatgatcaagcctttctggacaagtattgtataggttttgatgaagagcacatgcctgagggagttccggcaggaaattcctataagagctacttgctgggagtcagcgatggacagccgaaaactccgcaatgggcatcggaaatcacaggtgttcctgtagaaacgattatacaattggccagagagattgccggtgccaagccctgctttattctgcagggacggggcatgcagcgccatgccaacggagaattccaggctctttctgttcctcttttagccctgatgacagggaatatgggcaaactcggcgctaatcccggtatgtatgaaggctttacttccgtaaaaatgggggcataccctgcaggaacaaatccaatacaaaccaaagtatccttctttatgtttaccgatgccattgaaaaaggaggcaaccacaccaaagaaaatggtggcctgcaaggtgcggaccggttgcagcatggcatcaagtttatctggaattatggcggcaatgccttgatcaatcagcattccgataccggacggaccaccgagttattgaaagatacatcgaaatgcgaatttatcctgggcattgagaattttatgacccccagtatggagtatgccgatatcatcctccccgatatcacacaatttgagcaggaggatatcgtcacccgggctttgggacaagggcttgccctgtatgggcaaaaattggtggaccctttgtatgagtgcaagggtgtttatgaaatctgcacagaactggccaaacgcctgggcgtccttgataaatttgatgaaggaaaaagccaggagcaatatttgcgcgaatgtgtcgctgtggctcaggcggctcatcccgacttcccgtctttcgaagcattccgggaaaagggcatttataagacgaaacctaagaaagttattgcttatcaagcctttgtggaggatccggaaaagaacccgctgcaaactccctccggaaaggtggagattttctccaaaactctctacgatatgaataatccggagagaataccggctgttcctaaatatgtagctgttgcagaaggtccgaaaggcgctctgaaagaaaaatatcccctgcaatgcatcggccatcacagcaaacgccgtgtccattccacctttgataatctgccctggatggaggaagcggagcctcagaagctatggctcaaccctcaggacgccgcggcgagaggaattgaagatgacgatacggtcaagatctttaacgatcgagggacggtaaaagtcaaagtgaaggttactccccgtctcatcccaggggtatgctctcttcctcaaggagcttggtatacccctgatgctcagggcgtggataccagaggatgtatcaacaccttgaccacttgggagcccaccgctctggcctggggcaatcctcagcatacgaatttagtccaagtagagaaa

SEQ ID NO: 33331 - DNA, 652 bp, Desulfitobacterium hafniense
cttacgatacaaggacttaccaaacggtataaggataaaaccgccgtaaacaatataaacctgacccttacccccggagtatgggggcttctcggtgccaacggcgcgggtaaaacaaccttgatgcggatggtggccggaattttaacgcctacctccggcaaagtccagtacgacggcatcgcaataaaaacgttgggcgaagcctaccgggatgtctttggctatctgccacagacctttggcttttacccggaatttacggtagcggactatctgcactatatggctgcgctgaaagggctgccccaaaagaaaaccaatcaaaaaatagacgagctgctgcacaggctaaccctatgcggatgttcggaacaaacacatacgcaaactgtcgggcgggatgcaacgcagagtggggattgcccaggcgcttttgaacgacccggatattttgattctggacgaaccgacaagcggccttgaccccggcgagcgcatacgcttccgcaatattttatcggagtttgcccaacagcgtattgtcttgatttctactcatatcgtgtctgatgttgagtatatcgccaaccgcaacgccattatgaaggacgggcacattattgcggccggcaccacagacgagcttgtg

SEQ ID NO: 33332 - DNA, 1001 bp, Desulfitobacterium hafniense
tatgtggatattcccagcacagtaagacaaaccatccgtgaatcggctatacccgggccaaatatggctttgatgccgatacctgtgccgtgctcacctccatcggggagcaatccgccgacattgctttgggagtggatagagctctggaagctaaaaacggggagatgagcgaggaagaaatcgaagccattggcgccggcgaccaagggatgatgttcggctacgccaccaacgaaacggaaagctatatgcccctggccattgatctggcccaccgtctggcccgccgcctcagtgaagtccgcaagtcggatatcctggattacctccgtcccgacggcaagactcaggtgacggtagagtatgaggataatcgccctgtccgtatcgataccatcgtgatctccactcagcatcatccggaagcaactcaggagcggattcgccgggatctcctggagcatgtggtatttcccgtggtcccatcggaattgctggatgagagcacccgttattttattaaccccacaggccgttttgtcatcggcggtccccaaggggatgccggcttaaccggtcgcaagattatcgtcgatacttatggcgggatggcccgccatggcggaggagccttctccggtaaggaccccacaaaggtggaccgttccgccgcctatgccgcccgttatgtagctaaaaacgtggtggctgccggtttagctgagcgctgtgaaatccagctggcttatgccatcggggtagcccagcccgtatccgtcctggtggaaaccttcggaaccgccaaaattgacgaggaaaaaatcggcgaactggtcaaaaataattttgacctccgtccggcagggatcattaagactctgaatctgcgccgtcccatctaccgccaaacggctgcttacggacactttggccgcactgatctggacctgccatgggaaaagaccgataaagccgctgccctgcgggagcaagcaggc

SEQ ID NO: 33333 - DNA, 1185 bp, Desulfitobacterium hafniense
ttgcagaagatcatggaggactatggtaccccttttcatatttatgatgaggaagccattcgcaaaaacgcccaaagactgcaggcagcatttgcctgggcgccggggtttaaggagtattttgccgtcaaagctcttcctaatccctatattctgaagatcctgggggaagagggtttcggagccgactgcagttctttggcggaactgatcctggcggaaaaagcggggatcaccgaggagaacattatgcttacctccaacaatacccctgctgaggaatttcaaaaagcaaaggatttatgggcgatcatcaatttagatgatattacccatattgattatctggaaaagcataccggcctgccggaggtgctctccttccgctataatcccggttcgctgcgggcggggaatgccattatcggcaaccccgaagaatccaaatatggtttgaccaaggaacagttattccaggcttacgagatcgttcgtgacaaaggggtgaagcgtttcggactccatactatgatcatctccaatgaactgaacccggatttcttcatcgagacagcagagatgatgtttgatctggccatagagctgaaagaaaaactgggaatccgcctggaatttgtgaattttggcggcggaatcggcatcccctaccgtccggaacaagagccggtcaatctggaaactatcggagaaggtgtccgcaaagtttacgaagagaagatcgtcgccaaaggcttagatcccctgcgcatctgcctggaatgcggccgcatgataacgggaccttacggctatttggtgaccaaagtccttcatcgcaaggatacgtataaaaattatatcggtgtcgatgccagcatgtccgatctgatgcgcccgggaatctacggcgcctatcaccatatcaccgtcatgggtaaggaagacctgcctgaggaccacatctatgatgtgaccggaagcttatgtgagaacaacgataaatttgccgtggaccgggaactgcccagaatcgagatcggggatactctggtgattcatgatacaggtgctcacgggcatgccatgggcttcaactacaatggcaagctgcgtcatgctgagttattgctgcaggctgatggcagtgtgaagctgatccgccgggcggaaacactggaggattat

SEQ ID NO: 33334 - DNA, 930 bp, Desulfitobacterium hafniense
aaggagttgaaaatcttttgcggcaatgccaaccgggcattagcggaagaaattgttgattatctgggggttcctctgggagaggctaaagtaaaacgcttcaaggacggagaaattaccatcgccattgatgaaagcgtccggggggcggatgtctttgtggttcagcccacctgtaatccgaccaatgataatatcatggaactcttgattatgattgatgccctgaaaagagcgtcggctcgccgcatcactccagttatcccttattacggatatgctcgtcaagaacgcaaatccaaagcccgggatccgatcacagccaagctcatggccaatctgatcaccactgccggtgccgaccgggtggtaaccatggatctccatgctccggccatccagggtttctttgatattccggtggaccatctccccggtgtgcccatcctggcggagtattttaagagcaaagaattagagaacgtggtggttgtttccccggaccatggcggagtacaacgggcccgcaacctggcggagcggatcggagcgcctttggccattatcgacaagcgccgtccggagcccaatgtatcagagattatgaatgttatcggtgatattcaaggcaaacaggtgattatgatcgatgatatcatcgacactgccgggacgattactcaaggagctcaagccttgaaggatcgcggagctcaggatgtctatgcctgctgtactcatcccgtattatccggcccagcctttgagcgcctggagaattccgtcatcaaggaagtggttatcaccaataccattcccgttcatccggaaaaaatgatctccaagattaaagtcctctctgttgctcccctattaggagcggccatcgtgcgtattcatgaggacctttctgtcagtaagctgttcagt

SEQ ID NO: 33335 - DNA, 2094 bp, Desulfitobacterium hafniense
caatatcggattgaaggggagttttgtcctaactgctcggctaaaatggagcaggcgctcagtgcaacagcaggtataggggaaacaacaatcaactatgccatgaaaacagttttactgccccctgggatgatgagcaaagcccaggagattatcgagagaatagaaccaggggtaaaacttatgcccgtggagaaaaaggccgtaaagaacagtattcacgatgcggaagaggaagcaaaggaaacgaagcaaaagctgttaaaaattttcatagcgggtatttttctggtaattgggctgatttttggctcgcgttggcataatacctccctggaggtccttgaataccttgtttttctattggcttatggtttggtcgggtatgaagtcttggccaaagcgttccgaaatattatgcgcggttcggttttcgatgaaaattttctgatgagtatcgccaccctgggggccattgccattcatgaacttccggaggcggtaggggttatgctcttctacgctgtgggagaatactttgaagatcgggcagtcaaccgctcaaggcgttccatccaagcggtgcttaatattcgtccggattatgccaatctggtcaatggattagagacgaaaagggtggatccggatgatgttcatatagggcagctgattctgattcgtcccggggagaaggttccgttggatggggaaattgtccatgggtcttcttatgtggatacatcggctttgacgggtgaatccgtcccgcggtcagtcaaagtcggggattcggttctggcaggaatcatcaatacctcgggggtgctcaccgttcgtgtgacccgggagtttgccgattcttcagttcagaagatccttgatctggtggagaacgccagcgcccggaaggccaaaacagaaaagttcatcacgacttttgcccggtactacacgccggccgtggtgatcatagcattagggattgccttgattccgcctctctttatgggaggggattttcgggaatggctctatcgggccatgacgattctcgtcatctcctgcccttgtgctttggtgatttctgtacctctcggttattttggaggaatcggcggggcttcccgtcatggcattctggttaaaggggccaattatttagaagctttgacctcagtaaaaacagtaatcttcgataagacgggaactttaacccaaggggtatttgaagttaataaaatagaaacaagcgggcattacacggaagcgcagctgctggaaattgctgctgcagctgaagttcattccagccatcccattgccaaatctattcgggataaatggggtaaagagattgattctgtttcgctcactcattatgaagaaatcagcggcaagggaattcgctcagaattcaaaggtaaagtggtattagtgggtaaaaaggacctcctgcttgagaattccatagccgttcctgagctggaaatgagtgaagtggggactcaagtctatattggggtggatggcgaatatgcaggagttctgatgatttccgaccggtccaaagaaggggctaaagaagtggtggctcagttaaatcagagggggattaccacagttatgctcaccggggatcagcgcagcgttgccgaagctgtggctgaacagttaggaatccgggaatatcatggcgatttgcttccggaagataaggtcacctggcttgagcattaccaacagaagcttaaggggaaagggaaagttgtctttgttggggatgggattaatgacgcgccggtcttaagccgggccgatattggagtagcgatgggtggtttgggctctgatgcggctatcgaagcggcggatgtggttctgatggaagaccggccaggtaaattggtcagtgcaatggatattgcacagtttaccaaaaaggtgatctggcagaacattggcttcgcattggttatcaaacttggttttattgggctgggcatgtttggcgtggcaaacatgtgggaagctgttttcgctgatgtgggagtggctttgctggcgattttaaatgctacccgtgtcagacgt

SEQ ID NO: 33336 - DNA, 1110 bp, Desulfitobacterium hafniense
gagtatcaaggtaaagaatggcttgcaaaagcaggaatgccggtacctaagggtcgtccggcatcgacccccgaagaagcaagggaagccgctgaatggattggcggtcctgttgcggtaaaaggtcaggtacaagcgggtggtcgtggtaaagctgggattgttaaactggttaacactcccgatgaggcagcagcagctgctgctgaaattctctccaaaacagtaaaaggcttaccggtgcgcaaagttcttgtggaagaaaaattggatatcaaaaaagagttctattgctcctttgtcgttaacggagcaaaggaagcccgttcaccaatgcttatgttcagcgttgagggcggtatggatattgaaagtgtcccggaagacaaattactgaagatcaatgtggaccccatcaatggactgcagacttatgatgcggtagatttggctgctaaagcaggaatagctccggaagaattaacgaagtttgctaaatttttgacgaaactttctcaaacttataagaaatacgactgtatgacccttgagatcaaccccttcgttatgacagggaatggcaatctcatctgtgccgactgcaagatggaaatcgacaacagttccgtaggccgtcatcccgagttcggctttgacatcgcccgcgacctgcctggtgagcccacagagttggactacatcggctggagcattgaggaaaccgatgcccgtggcacaggcttccttatgaatatgggatacgatgaagtcagccccggatatgttggctatcatcccatcggcggcggttcggcgatgatgggcttggatgctcttaatcaagtaggtctgaagccggccaactatgccgacaccagcggcaaccccgtagcttccaaaatttatcgcgttgccaaatcggtgctttcccagcccaatattgacggctacctacttgggggctttatgatggccaaccaggaacaatggcatcatgctcatgctatagtcaaagtgcttcgtgaaatcctccccactcaaaaaccaggattgccttgtgtgctcctgctttgcggcaaccgggaagatgaatctttggaaattctcaaa

SEQ ID NO: 33337 - DNA, 888 bp, Desulfitobacterium hafniense
atgggcattttgatcaacaaagagaccaaagtggttgtccagggaattaccggacgagaaggctcggtgcggacaaaatatatgaaagactatggtacgaatctgatcggcggcacaagtcccggaaaaatggggcaagaggttcacggtgttccggtgttcaataccgtcaaggagattgtccgcgaacagggtgacattgatttcagtgttatcttcgtaccgggaagcgctttaaagacagctgttatggaagctgccgacgcaggggttaagaacattattccttgtgtggaaggtactcctattcatgacattatggaaatgatcgcctatgcgaaagggaaaggttcaagattgattggaccgggttccattggtatcctcactccgggagaagctgtcgtcggctggctgggcggcaacgtggagtgggctaataagttcttccaaaaaggtcatatcggtgtcttttcacgccaaggcggtcaatcaggtaccattccgtgggtactgagagaaggcggcttcggagtcagcaccgttattcataccggaacagagccggtgcttggcacctccatggccgatctgttacccttcttcgaggaagatcccgatactcatggcgtggctgtctacgcagacctcggcggcacccaggacgacgcatgtgcggacgtgatcgccgctggtcacttcacacagcctctcgtcatctctgtagctggtgcttgggcgccggccggtcaacgcttctcacatgcctccaatatcgttgagcgtggacgcggttcggccaagagccagatggaagcgatcaccaaagctggtggcttagtagcggacagaccgacagaccttccgttgatccttaaagaacagctg

SEQ ID NO: 33338 - DNA, 2070 bp, Desulfitobacterium hafniense
atggctaaaacactcgtgatcgttgaatctccggctaaggctaaatccataagcaaatttttaagcaataattatacggtcaaagcgtccatgggacatttgcgggatttgcccaaaagccaaatgggagttgacgtagacaatgacttcgaacccaaatatatagcgattcgtggacgcggggatttaattaaagagctgcgggccgccgcgaagaccgctaataaaattctcctggcctctgaccccgaccgcgagggggaagctattgcctggcatttaggccatctgctcggtttggatctagcggagaagtgccgcattgaattccatgagattaccaaaccggctattacggctgccattaaacacccccgtcagatcgattccagtaaagtagatgcccaacaagcccgtcgcgtcttagatcgtttggtggggtaccagctgagtccgttcctttggagaaaagtgaaaaagggcttaagtgccggccgggttcaatcggttgctgttcgtttaatttgcgatcgggaagaagagattcgggagttcatcccggaagaatactggacgttgaccgcttccttgaaaagtgagggaggggtattttcggctaagctcgccaggaaaggggagcacaggattgccattgcttcggaagaagagatgcagaaggttctccaagagctggcagatcagacctaccgggttaaagatgttcgcaccaaggagaaaaagaaacaaccttcacccccctttaccaccagcagcctgcaacaggaagctcatcgcaagctgaatatgtcaccgaaaaggaccatgatgctggcccagcagctctatgaagggatcgagctgggtaaggcgggaggcattggtttaattacctatatgcgtaccgactccgtgagaatttcagagactgcccaagaagaagccaaggagtttattgccgagcactatggggcggattattatcctccggaaccccgtcaatttaaaagcaaaggccgggcccaagaagcccatgaggccattcgccctacttccatattgagaacaccggactccgtgaaggagttcttgtccagggatcaactgcgtctttaccggttagtctgggagcgtttcctggccagccaaatgagtgcggctgtccttgataccttaactgttgaagtggaggccggggagtacttattccgtgctaacgcttccaccgtgcgtttccccgggtatcttgccgtttatgaagatggacaggatgagaatgacgaccaggaagaagggaccctcgcggccaatattcaacctgatgagagtctcaatgtccttcagctccaggagaagcagcattttacagaaccacctcccaagtatacggaagcctctttggtacgcaaaatggaggaggagggaatcggccggcccagtacctatgctccgactatcgaaaccattcaatcccggggctatgtggcgaaggaagggaaacagctttctcccactgaattgggagaaatcgtcgtctctattctcaaagagtatttcccggagatcgtggatttggaattcacggccaatatggagaaaaggctggatgatattgaagaaggagctttaccctggaaagccgtcattcgggatttctatggcccctttgcggaatccatagaggaagcggatcaggtgatgggtaaggtacaaatcgaagataaggtatcggaagaaatctgtgaaaactgcggtcgcaatatggtgatcaaaatgggacgctatggtaagtttctggcctgtccgggcttccctgaatgccgtaacaccaaacctctgctggaagaggtgggaaggccctgtcctgactgcgggaacccgctggtgattcggcgcagcaagaagggcagaaagttctatggctgcagcacttacccggaatgtgagtttgtatcatgggagttgccggcgccggagccctgtccgaaatgcggagggttgatggtggttaagacttcgaagcaagggcaaaaatatgtctgcaccaattccgaatgccgttttgacaagcaa

SEQ ID NO: 33339 - DNA, 956 bp, Desulfitobacterium hafniense
gtcaggaagatcgctgttcttaccagcgggggggatgctccgggaatgaatgcggccattcgggcagtggttcgcaagggaatttatcatggacttgaggtttttgggattcgcaaggggtatgaaggcctgattcatggggaattcataaccatgcatctgggagcagtagcggatatcattcataggggcggtaccatgctcatgaccgcacgttcccaggagatgctcaccccggagggacaaaaaaacgccgcggctcaattgcgttatcgcggtatcgatgcgctgattgtgatcgggggggatggttcttttcggggagcacagaccttgtctgctcaaggaatagccatcgtcggtataccgggtaccattgataacgatattaccggcacggatttaactatcggatttgatactgccgtcaataatgtggttcaagcggttagtaaaatccgggatacggcaacatcccatgatcgaacctttttagtggaagtcatgggacgggattgcggcaacatcgccttgcaatccggcgtagcctgcggtgcagaatccatccttgtgccggaaatcgaaccggatctggatgatattgtcgcgaaattggaacgcggccaccaacggggcaaacatcacagtatcattatggtggcagaaggggctatgagtgcttggaatctgggggaagaactccgtcagagaaccggctttgaaacccgggtcaccatcttaggccatatccaaaggggcggcaatccaagtgccctcgatgtggtcctggcctcgcaaatgggcgggaaagcagtggagatactctgcgccggggaaaccgatcggatgacagcctgtgtcaaccaggaaatccaatcctgcctttggaggtggcttatggtgagcgcaaacccttcaacaaagttctctatgatctggccaatcaattggctatc

SEQ ID NO: 33340 - DNA, 981 bp, Desulfitobacterium hafniense
gttagtgttggaatcgtgggcacaggttcctatgtacccgataaggttttgacgaattttgatctggagcagatggtggacaccaatgatcaatggatagtgagcaggacggggattaaggaacggcacatcgcagctcctgagactccggtatccgagctttgctaccaggcggctttgcgggccttagaagatgccaaactcgctccggaagagctggatttagtgattgtcgccaccataacccctgattttgtttttccggccacagcttgcctggtggcggaacgcctgggagccaaaaaggcggccggttttgacctgcaggccgcctgcacgggatttttatacggagtagccactgcggctcaattcatcgctaccggtatctataaaaatgccctggtgattggcggggaaaccttaagcaagatcttaaactgggaagaccgggggacctgcatcctgtttggagacggcgccggtgcggcagttctgcagccggtggaagaggggtacggattcctgggctatgacctgggtatggatggtgcggggggcagccttttgaccatgccgggagggggctccatgcaccctgcttccgcagaaaccgtggccaagaaaatgcacaccatccagatggccggcagtgaagtgttcaaattcgccgtccgcattatgggggagaccgccttaaaagcgctggacaaggcaggtttagggatcggagatgtggattgccttattccccatcaggccaacacccgcattgtggatgcggcagtcaaacggctggggattgatgccgggaaagtcgtggtcaatctggaccgctatgggaatatgtcggcggcttccatcccggtggccctggatgaagcagcacggagcggacgtttaaactatggagacattatggtgatggtgggctttggcggaggcttaacctggggagccgctgttgtgaagtggtccaag

SEQ ID NO: 33341 - DNA, 1808 bp, Desulfitobacterium hafniense
caacggctttaagcggtgcttaaggaagttcaggaacgggaagatattatcctgtttatcgatgaactgcacacggtggtgggagcaggggcagcagaaggggccatggatgccggcaatatgcttaaacccatgctggcccggggtgagctgcatatggtgggagccacaaccctggatgaataccgcaagtatattgaaaaggatgccgctctggaacggcgctttcagccggttacggtgggagctcccagtgttgaggataccatctccattttgcgggggctcaaagaacgctatgaaacccatcatggcgtaagaattaccgatggagcgattatcgccgccgcagttctttctgaccgctatatcagcgatcgtttcctgccggataaagccatcgacctcattgatgaggccgctgcccgcatgcgtatggagatcaccagtgacccctatgaattggatcagatcaagcgccggattctgcagttggagattgagcgggaggccttaaagaaggaaaaagacgaaggcagcaaggaacgcctggaaaagattgaggaagatctggctaacctcaaagaagaacgcagtgccctggaagcccagctgcaaggggaaagagaagttctgaccagaatcaactccctcaaggaagacatcgatcagaaccgccttaagatggaacaagcccagcaggcctttgattataacaaggcggccgagctgcaatatggcatattgccaaagctggagaaggagctcaacgctttggaagagcagcttcgcaaccggaagaacaccttgctcaagcaggaagtaggggaagaggacattgctgaagtagtggccaaatggacccaggttcctgttgctaaacttttggaaagcgaaatggataaactggtccatatggaagcgcgcatccatcagcgggtgatcgggcaggaggaggctgtgaaagcggtagccgatgctgtccgcagatcccgggccggcctgcaggaccccaaccggcccttaggttcgttcctgtttctcggccccacaggggtagggaagacggagttggccaaagccttggctgaatttctctttgatgatgaccagggatcgtgcgcatcgacatgtccgaatatatggagaagcataccgtttcccgcctgatcggcgctcctccggggtacgtaggctatgaagagggaggccagctcacggaagcagtaaggcgcaaaccctatagtgtggtcctctttgatgaagtggaaaaagctcatggggatgtctttaatgtgttgctgcagctcctcgatgacggccgcttaaccgacgggcagggacgggtggttaattttaagaatacagtggtcattctgaccagtaatatcgccagccccttgattcaggaattgacggcctcaggagcggcccaggaagtgttgcgttcccgggttaccgaggaactcaggctgcatttccggccggagtttttgaaccggttggatgaaatcatcgttttccaccctcttggtcaggagcatattggttccatcgtgcagatacagatcaacaagctgcgtgattatctggctccccgcaaaatgactctggagctctcccagggagccttaaataaaatcattcaacaaggttatgatccgatctatggagcaagacccctgaaaagggtgatccagcaaaacctccaaaatcctttggccatgaaaatcctgcagggaatccttcacgaaggggatcatgtcctggtcgaccttgatcctcagggccagcttctgtttaaaaag

SEQ ID NO: 33342 - DNA, 1167 bp, Desulfitobacterium hafniense
cgagaggctggtgatttcaccgtgaatcagtacctttcaccgatcgcggccaatttacccccctcagggattcgcaaattctttgatctggtctcaacgatgaaaaatgtaatctctctcggggtcggagaaccggattttgtcacgccatggaccgtgagagagagcggcatcttttcccttgagcaaggacaaaccatgtacaccagcaactcaggacttctggagctgcggcaggccctctcctggaatatggaaaaaaagctgggcctggaatacaatcctaatgatgaaatcctgatcaccgtaggcgccagcgaagccgtcgatctggcgatgcgcgccctgctcggcccgggagacgccctcttgcttacagaccctgcctatgtctcttacggcccttgtgcaaccctggccggtgcggaagttcattatgttcccacccgggaagaagaagatttccgggtgcgggtagaggatctggagcgggtctatacccccaacgccaaggttctggtgctctcctatcctaataaccctaccggagccatcatgacctgggaagactaccaacccattgccaagttcgtccaggatcatgatttgatcgttgtggctgacgagatctattcggatttgagctacggcggcagccatacagccttcgccagcttgcccaatatgagaaaccgcaccttgcatatcagcggtttttccaaatcttatgccatgaccggctggagaatcggctatgtagccgggcatcatgactttatccaagccatgacccggattcaccaatacacaatgctctgtgctcccatcaccgcccagctggccgctttggaagcggtccgctccgctgaacaggctatgcaggatatggtggccacctatgaccgccgccgccgactgatggtacatggcttccgcaaaatgggcttatcctgtttcgagccactgggcgccttctataccttccccagcatcaaagctaccgggttgacctcggaggaatttgccaatgagcttctccaggaagaaaaagtagccgtggttcccggcacagctttcggcccctcaggagaaggacatatccgctgctcctatgcttattccacggaacagattcaggaagccttaacccggatggagcgattcgtc

SEQ ID NO: 33343 - DNA, 2442 bp, Desulfitobacterium hafniense
aaatatacggaaaaggctctcaaggcgctgcaattcgcctcagacgaagctaagcgcatgggctccaatgtgattggcaccgagcatctgctgcttggtttagtggctgaaggggaaggtatcgccgccaaatcccttcatggcatcggggtgactccggagaaaatccgggaacaaatcggcaacctgactggtatcggccagccttttaccggagaggtaagcctgactccccgggttaaacgggtaatggagctggctcatgaagaagcccgtcgtcatggggtcagctatatcggtactgagcatctgctcctcggtctgctgatggaaggagaaggtgtagcggcccgggtgctgcgcaatctcggtgtgagcccggaaagaatttggaagcaagtggttcagcttttaggaggtcaaccggatgatattcccatgcccggcggtgctcccgggcccggcacagccaagaataacggagctgccaatacgccggctttgaatgaatttggccgggatctgacccagcaagcccgggagggcaggctggacccggtagtgggacgggaagacgagattgagcgtgtagttcaggtcctcagccgccgcaccaaaaataatcctgtgctcatcggcgaaccgggggtagggaaaacggccattgccgaggggctggcccaacggatcatcaataataaagtgcccgaaaccctggcgggcaagcgggtggttaccttagatctctccgctgtggtggctggaagcaagtatcgcggggaatttgaagagcgcctgaaaaaggtcatggaagagattcgggtggacggccgcattatcgttttcatcgatgagcttcacaccttaatcggagccggagcggctgaaggagccatcgatgcggccaatatcctcaaaccggccttagcccggggagagctccaatgcatcggcgcgacgaccttggatgaatatcgtaaatatattgaaaaagatcccgctctggagcggcgtttccagcctattacggtaggagagcctacagtagagcaggctgttcagattctcttgggtttacgggatcgttatgaagcccatcaccggacccagattaccgatgaagcggtggaagcagctgtgaagatgtccgatcgctatatctcggatcgcttccttcccgataaggccattgatttaatggatgaggctgcttcccgtgtgcgcttggcagcctttacagctccccccgatcttaagtctttggaagaaaagatcgaagccttaaagagtgagaaggaagcggctgtcttaggtcaggagtttgaaaaagcggctaaattccgggatgaggagcatcagcttcgggaagagcttgctcagcttcgcaacacctgggagagtaaacgggatataagccaaagtcaggtcaccgccgatgatatcgctcagatcgtggccagttggacaggaattccggtgaagaagctggctcaggaagaaagcgaacggctcctgggcttggaagaaactctccatcaacgggtggtggggcaagaagatgctgtgaaggctgtttcccgcgctgtgcggcgggctcgtgccggattgaaagatcccaaacgcccggtaggttccttcatcttcctcgggcccaccggcgtgggcaagaccgaactggcccgggctttggcagaagctttatttggtgaggaagacgctctgattcgtatcgatatgtccgaatatatggagaagcatgcggtttcccgtctggtgggagcacctcccggatacatcggtcatgatgaagggggccaattgaccgaagccatccgccgtaaaccctatagtgttatcctgctggatgaaatcgaaaaagctcatcctgaggtcttcaatatcctgctgcaggttctggaggatggccgtctcaccgataccaagggcaggacggtggatttccgtaatgcggtgattattatgacctccaatgtgggcgcttccttcatgaagaaagaagctttgggctttgcctcccgccgggatgaggaaaccgagtacaagaatatgagctcacgggtaatggaggaactgaaaaagaccttccgtccggagttcctcaaccgggtggacgaaattgtggtcttccattccctgcaaactgagggactcttgaagattaccgagattttgatgaagcaggttaatggccgtctccaggaacagggctatgatctgcaggtggaaaagagtgctcttgagctgattgccaaagagggcaatgatcctaccttcggcgcccgtcctctgcgccgggctatccaacgcctgatcgaagacagcttgtcggaaaagattctcctcggagaatttaagtccggggacaaaatcaaagttgaggccgtagaggacaagatgaaattcgccaaagtcagagcccgt

SEQ ID NO: 33344 - DNA, 555 bp, Desulfitobacterium hafniense
caagataacaaacaaaaaaaatatggcatggtgattgatctaaggaaatgcgtaggatgcatgtcatgctcagtatcctgcaaaatggaaaatggagttgcctttggtgttttcagatcatgggtgaacatgactgaaaaaggtgatttcccaacggtcaagagatattatcaaccaagactttgcaatcattgcgagaatgctccctgtgtagaggtctgtcccgttaaagcttcttataagcgtgaagatggtatggtattgcttgataagaagaagtgtattggctgtggctactgtgtagcttcatgcccttataatgctcgttatatgagcaaaacccaaaaagttgcagataaatgtaccttctgtgatcatcgtgtagataacggcggtgaaccagcctgtgtaaaaaactgtatgggcaaagctcggatttttggagatctaaatgatcccagcagcgaagtctctcagcttatttctcgaaatgctgttcaagtgattaagccggaaaaaggaacaaaacctcaagtattctatatatcggctgac

SEQ ID NO: 33345 - DNA, 1125 bp, Desulfitobacterium hafniense
tactacatgccgaccgtcaatcttatgggggccggtgcagcccaggaggccggaaaacaggcaaaaatcctgggaggcaaaacagctcttctggtgacggatgctttccttaatcagagcggactggccaaacagatcgcggagattattgaagctgagggcgtaaaggttgtcatctatcccggagcggaacctaatcctaccgataagaatgttcatgatggcgtggccgtgtttgaaaaagaaaactgcaatatgattgtctcactgggaggggggtctgctcacgattgtgccaaaggtgtgggtttggttgccggaaacggcggcaatatccgtgattttgaaggagtggataaatccgcaaaacctatggtaccgatgattgctgtcaacactacggcaggaacagccagcgagatgacccggttctgtattattaccgatacggaccgccatattaaaatggctatcgtggactggcatgctacccccaatgtctccatcaatgaccccttattgatgatcggaaagcctgcccctctgaccgccgccaccggtatggatgccctgactcacgctgttgaggcctacgtctccactgcagctacccctattactgattcagctgccttgatggcgattaagctcatcagcaagtaccttcgccgtgctgttgccaacggccaggattttgaagcccgggaccaaatggcctatgcccaattcctggccggtatggcctttaacaatgccagcttaggttatgttcacgctatggcccatcagttaggcggtttctataatctacctcatggtgtttgcaacgccatccttttacctcgtgtatcccgctttaatctgattggaaaccttgagcgcttcgtagacattgccgaagctctgggtgaggaaataaagaatttatcggccagagatgccgcagaaaaggctttgacggcaatgacaaccttatcccaggatatcagcatacccagcggactcactgagctgggcgtaaaagaagaggatctgcaaaccatggccgtcaatgccatgaaagatgcctgcagtctgaccaacccgcgcctggccaagctggaagatatcattcagatttataag

SEQ ID NO: 33346 - DNA, 813 bp, Desulfitobacterium hafniense
aagcattttgcagtgattggcgatccgattgctcattccttatctccggtgatgcataatgccggatataaggctttaaacttagctgcagattatcaaaaattccaggtgagccctgaggatttgggagaggccgtattgggtcttaaggctctgggcttcagcggctggaatgtaaccgttccccataaggaaaccattcttccttttctggatgaactgacagaggaggcggtcagagcaggcgctgtgaacaccgtaaaagtggacaagggtcggctgatcggccataacaccgatggttccggcttcgttcgttccctgcaggaacatatggagttagatgagcgacaacaaatcgttatcttaggagccggaggtgccgccaaggggattgctatggccctggcgccttttcaagcccagctttgcatcatgaaccgcactcctgagcggggggcggagttggtgggaaaagtactagagtggggcggacaagcgcaccaggaggaatggggaaggggagcctggctggttcaggcggattgcgtgatccaaacaaccagcataggcttaaaaaaggaagaataccctttttctcttgcaggaatacggccaggcactctggtagtggacatcatctttaatccttgggagacacctttcttacattcggctaaagccatgggctgcaagactgtcaacggaatcgatatgcttctttatcaaggggtcaatgcctgggaattctggctggaagataaggcgcctgtagaatccatgaggaaggctttgtatcaggctttggcagtt

SEQ ID NO: 33347 - DNA, 771 bp, Desulfitobacterium hafniense
  unsure (1)..(771): unsure at all n locations
gcctacgccaaaataaatcttgctctggccataacaggccgtcgtcccgatgggtatcatgaattggaaagcgttatgcagtccataggaatctatgatcggatacgggtgactttggcagagggggnaattcagtgctcctgcggagagtggagcggcccggagaatttggcttaccgggcggcggaagcttttttaagcggactgggaagcagccagggtattcacattgacatcgagaagaatatccctgtccaagcgggattgggcgggggaagcgccgatgccgctgcggccttgcaggctctgaataagctttttaaagagccctatactgaagaggaactgaagagctttgccgctcagctgggtgcggatgtggccttttgcctgaaaggcgggacccaatgggcaaccggtgtgggtgaagaattaaaaggcctgcctcatgctccgaaaatcaaccttgttctcattaaacccgaccaaggggtaaatactgctgaagcctatcgggcttttgatcaggaaggaaaattctctcatctggattatgccgggtggcaagaggctttggcatccgggagagcagaaagccttatccctcttctttataatgatttagagccggcttctatgaagcttctcccggaaatagcctgggttaaagaagaattaatgaagcagaacggctgtctgggagctttgatgtccggcagcggctccgcagtgtttggaatcgttcaaactgaagaacaagcggaaaaaatt

SEQ ID NO: 33348 - DNA, 963 bp, Desulfitobacterium hafniense
attgaaattacggacttgagaaagagcttttcggtcaaagcaaaaggcagaatcatcaaagtggaagcggtgcgtggtgtcacgctggcggtgaaacgaggtgagatttttggctttctcggtcctaacggagcgggaaaaaccacaaccctgcgtatgctgacaacacttctgccgattgatgaaggtaaagggactatttgcggatatgatcttgtgggtcagccccaggaagtgcggcgccatattggctatgtcagccagttgggcggggcggactgggaagcaacggggcgcgaaaacctgatcctggccgggcagctatacggaatgaaacggcatgatgctgaacaacgtaccggggagttgctggccgtatttgaattagccgagctggcggatcgggtggtgaggacctattccggaggacaaagacgccggctggaaatcgccctgggcatgatcaaccggccggaagtactgttcctcgatgaaccgacaacggggcttgacccgcagaaccgtgccaatctttgggagcaaatccgcaaactgaaagaaggcggcacgacgatcttcctgacgactcattacctggatgaagcggatgctttaagcgaccggctggctattatggattgcggaatcatcgtggccgaggggaccccccaggagctcaaggagcagatttccggcgacgttattcaaatccggcttgccgacgatcggacccaacaagcaaagagactatttgacaaagtgagctttatcaatgaaatccgtcttgaaggggaggacatctatctttatgctaagaacggagctcaggttctgccccgcatctttgaaatgctggaagccgaaggtgtccaaacccaatcggtcagcatagccaccccatccctggatgatgtgtttcttaaacaaacgggaagactgttgcgtgatggaaaggaggacata

SEQ ID NO: 33349 - DNA, 522 bp, Desulfitobacterium hafniense
atgtttaagagaaagggctttctgttcaatgctaatctctgtatagggtgccgggcttgtgagatggcctgccgcaatgaaaatcatacaccggccaatatccactggcggcatgtcaaggaaatagatctggggacctatctgtccatggcctgcaaccactgcgacagcccggaatgtttccgcgtctgcccccagcatgcctttaataagcgaaaagacggcattgtggagatcgattcttccctttgcaacggctgccgtctctgcgtcaaggcctgcccttatgatgcaccccagtacaacattaataccaataaggtgacccgctgccagatgtgctatccccgtcaggatcacgggctgccgccggcctgtgtggaggcttgcaccacaggggccttgacaaccctggacctcaatgatccccagctgccggaaacggtgcgggtgatcccggggtttaccgatattcgtctgacgaagccttcgattctcttttatccaacccggccgaagcgg

SEQ ID NO: 33350 - DNA, 1286 bp, Desulfitobacterium hafniense
cgcaatacatgtccgcggcattgttatggttcctgcagcatgatttcgcatatgagcggggggaagctgacccgggttgtgggagactccgagcatggctatacccggggaaggctctgtgctaaaggatattccttaattcaatatgccttggacgagtatcgcttgaagtaccctttgcgtcaagtgcgacgggggtcagggagtggcggcggatttcctgggatcaggcttacgaaattatcgcctctaaaatgatcgaactgaatacccgctatggctccaatctgggcttaggatattataaagggaatggcaatgccggcttgctgcatcaggccgtggaaggaatgttcgcaggcctgggtcctcatacccggcccatcggggatatttgttccgctaccggggaaaccgcactgagggagaccgtaaatgaactaagaaatcctgatccggagaagatgagcgacgccggcttgatcgtgatctggggagccaatccggccaataccaatatcaatcaaatgaagtttatctatgaagcacgccaaaagggaactccattggtggttatcgatccgctccttacccatacggccaacagagctgatttatatgttcagatcaatccggggaccgatgcctggctggcatgggggatcgctaaactattgatcgaaagtgacaagatcgataaagagttcattcggcaaaaaaccagagagtttcatcgatataagcaagggcttgaggggattactctggaggaagtttgttcccacaccggtgtccatttaagggtcgttgaagaattagccgatctgtatgcccgctttcatccagccgctaattggctgggtttcggcatgcagcgttatcccactggcggagaatcggtaaaggccgtgagtgctctggccgctctgaccgggagttttggttcggtcggcgggggagtctatttccgccaccggcctcaggaggaatttccactgcatatagccaagcatcagggagtaaagcagcctttgctcacctcctcccgggaggtgccggccaatgatttcccgggcagggcgatgaagcttcaggagccgcctcttaaaatgctgtgggtttcctgcggcaatccgctggcccaggattacaatctacgggcttggcgtgatttgtttcaacagatggagttcatcgtcaccgtggatctctacctgaacagcaccgcccggcagtccgaccttgtcctgcctgctgcgtccttctttgaggaggaagatttgcat

SEQ ID NO: 33351 - DNA, 3168 bp, Desulfitobacterium hafniense
atttctgaagtgcggcggcggatcgctcaaaagctgacccgggttcccatgggctatgtcctggatactccctcaggaaagttcaaaaacagtatggtggaaaaagtggacagtattgaaccgactctggcccatgtgctgccggaaatgacctccaatctgctggtccccctggctattgtgggttacctgttcgtcctggactggcgcatggccctgatctctctgatcactctgcccattggcgcagtctgctatatgggcatgatgaaagactatgaaaagcgctttggggagtatgttggtgtgggccggcatatgaacgccacggctgtggagtatatcaacggcattgaagtgatcaaagctttcgggcaatcggccacttcctataagaaattcgccgatgcggtccataagaatgctacctatgggctggattggatgcgggatgtgcagctgtacttttccatgggcatcggcatttggcccgccgtgctcatcggggtcctgcctttgggctgtgttttttacatgaacggctctctgtccggagccgatttcatcacgatcatgattctggccctgggcatcatggcaccgctgctttccgcgatgtattacaccgacgatcttgccaaaatcaaggttattatcggggaaatcggcgacatcctcgatgaaggggagcaagtgcggccaacggttcttgcccggctggacggtacggacatcgcactcaagggcgttactttcggttatggggaaacggagatcctgcatggggttgatctggccattcccgccgggtccgtaaccgctctggtgggaccttccggcagcggcaaatccaccatcgccaagctcatcgcctctttctgggatgtcaaggacggaaccctctctatcggcggcgtggatgtcaggaacattcccgcccctcagcttatggataagatcgcttatgtagcccaggataatttcctctttgatcagagcatcctggaaaacatccgccttggccgcccagccgccagtgatgaggaggtgcgggaggcggctaaggctgccggctgccacgactttattatgggttaggccgacggatacgacactgtggccggcggggccggtggacatctctccgggggtgaacgccagcggatcaccatcgcccgggccatgctcaaaaatgcccccatcgttattctggatgaagccacagcctataccgacccggaaaacgaatctgtcatccaggatgccgtggccaaactggtggcgggcaaaaccctcatcgtcatcgctcaccggctctccaacatcacggattccgatcagattgccctgattgagaagggccgggtagctgccctgagcacccatgagcaactgctggaaagcagcccattatatcaggagctctggcgggcccacatcaatgctaaggacgctgcgtaaggaggaaataaaatgattggaacgattcgtaaattttttgcctttgccggcaagcgcgggaaactgatgcaaaaaggcattgccctggccctgatcaattccatcttccaggccctgcagattctggccctggcggtggtcttgcaagggatcgtggagggaacgatgaccgccggaacagcctggacctccttcgcgatcatgttcctcagtatgctgggggctattcttacccggcagcgggccaccatggcccaagccgagggcagcttcatgatgtgcgccgacaaacggacggaaatcggcgatcgcctgaaatacatgcctatgggctattttaatgaccatagtctgggagccattaccgccgccgttaccaacaccatggaggacgtacaggatatcgccccccgagtcatggataagatcattcacggctatgtccatgccgccatcatcactctgatgctgctctttttcgattggcgcatcggtctgatcatcctggccggcatcctggtgttcatgggggccaatggactgatgcagaaaaaatcccggaccatttccccggcccgggtagcggcccagtctgccctggtgggtgcagtactggaatatgtgcagggtatcagtgtggtgcgggctttcaatctggcccaggcagccggccatacccttgatcaggccatcgacgaatgcgaaaaaaataatgtgggtctggagatcgccttcattccttatatgttcctgcaaagcctgatccttaaattattcagtattctggtggtaatcgctgccatcgctttttacctgaccggcagcatgaacctcaccacctgcctgctgatgctgatctccgcctttattatctacagtcagctggaaacagccggcagcatgtccgctttgctgcgcgctatcgacatatccatcgaccgggtggaggaaattcatcatactccggtgatggatgagctgggcaaggctatccaccctcagagttatgctattgagggccgcaatgtcagcttctcctatgacaagaaaaaaatcctggatgatgtctctttccgcattcctgccggaaccaccacggcgatcatcggtccttcaggaggaggaaaaaccaccttatgccatctgatcacccgcttctgggatgtggacagcggttccatcactttgggcggcagggatgtgcgggattatagcctggatagtctgctggccaatttcagcatggtctttcaaaaggtctatttgttcaatgacactattcttaacaatatccgtttcggaaagcctgacgcgactctggaggaggtgcgggaagcggccaaaagagcccgctgcgacgactttattatgatgctgccggagggatacgacacgatggtcggtgaggggggcgccaccctttcgggaggggagcgtcaacggatttccatcgcccgggccattttaaaggatgcccccatcgtcattctcgatgaagccaccgccaatgtggatccggaaaatgaaagccggttgcaggaggctatcgccgaaatgaccaaaaacaagaccatcattatgatcgcccaccggctgaaaaccgtgcgcaatgctcagcagattctggtgctggatcagggcaggatcgtccagcggggcggccatgaacagcttatggccgagggcgggctgtatgccgactttatc

SEQ ID NO: 33352 - DNA, 657 bp, Desulfitobacterium hafniense
atcgacgtacataatatgaccaaaacctatggcaagttaaaggctaacgataatatcaatctttcggtgtcggccggggagctggccgttcttctgggccccaacggcgcgggaaaatccacattaataaaatccgtatgcgggctgttgcggtatgagggttccatcactatcggagggcatgaaaatcatacggtggaagcgaagcggctcttggggtatgtgccggaattccccgtactctacccgatgctgacggtgggcgaacacctggagttcatcgccaaggcgtaccggctggaaagctgggaggaaagagcccaggaactgctccgccgctttgaactggatgataagcagctgaagttaggcaaagagctttccaaaggaatgcagcaaaaggtcagtgtctgctgcgcgcttttgccggaacccaagaccgttatttttgatgaaccgctggtcgggcttgatccccatggcattcgtgagctgaaaaacctgattgcccgtctgcgggacagcggctgcgccctgattgtgagcacccatatgattgaaagcatggaagacaattgggacgtgacctatattatggtcaagggcaaaatagagcgggtggtccgccgtggggatatagcaggccaaagcctggag

SEQ ID NO: 33353 - DNA, 695 bp, Desulfitobacterium hafniense
ttgaatttagttcaagccaacatcacgtccggcggatacctaaagaaggacctcatcctcaaggatatttcctttgaggtaaagcccggtgagcttgtcggattaattgggcctaacggtgcgggaaaaagcacgatcctcaaggcgattatgggacagcttccttatctggagggaaaggttgaatttgagaatgcccacacccattatgcctatattccggaacaaccggtcctctatgataatctcaccttgtgggagcatttagagttcgccgcagccgtgggaaaaatgagccaggaaacctttgtgcccagagttgaagaattgctgaagctcttccgcctccataaggagaaacaccaactcctgtcaccttttccaaaggaatgcagcaaaaagtcatgctcatcctcggctttttgctgcgccctcctttatatattgtagatgagcctttcattggcttggatccccacggcatgcgggactttctccagctcgtggaccaagtgcgtcaggatggagcgggtatcctgatgtccacccactccctggatacggcggaaaagatctgcacttctttcatccttattcatgaaggaaccatcatcagtcagggaaatctggaggatatacgccggcagagccgcttgccggaaggctctctcttcgactgctttatcaacctcctg

SEQ ID NO: 33354 - DNA, 912 bp, Desulfitobacterium hafniense
atggataaaataattgaggttgtagatttgcataagagctatggtcatgttcaggcggttaaggggctcaatttttatgtggaaaaaggcaaattatttgcctttctggggcccaatggtgccggaaaatcgacgacaatcgatatcatctgtacttttttaaagccggaccggggacgggtcgttgtggacggctacgaattaggcaaagaggataataaaatccgctccgtgattggtgcggtatttcaggatggcctcctggatccgctgctcacggtagaagagaatttgcagatcaggggcggtttctacgggctgaaaaaggcggttttggctgattccataaaatccattgcggtccttactggggtagctgaatttttgaagcggccctatggcaatctttccgggggccagcgccgccgggcggatatcgcccgggccttggttaacgcaccgaagattttgttcttggatgaacccaccacagggctggatcctcagacccgtaaaaatgtctgggaaaccatccagaaaatgcagaaagaaaaggatatgaccatctttctgaccacccactatatggaggaagctgccgaggccgattatgttatagtgatcgacaacggcgaaatcgccgctaaaggaacacccacagagttgaaacgggactatgccagtgaccggcttaagctttcttatcacgacaaagaaaagctaagcacagctcttcaggaaatgcacatcccttaccaccaggttgccgatcaaatcattatcgagctctcatcaactctggaggctttgccgattctggccggatgccaagcttatctcaccggcttggaagtcagccatggtaccatggacgatgcctttattaagatcaccggaaaggagataagagaa

SEQ ID NO: 33355 - DNA, 1728 bp, Desulfitobacterium hafniense
attttaaagcgttttatcagttactacaaaccctaccgtctgcttttttacacggatatgctgtgtgcgatcatcgtatccgctattgatttatcctttcccatgattctgagctatttaatcaaccgtgtatttatccaggggcgggaagctattctgaacacaatcatggtggtaggtatagccctgctggctatgtacatcattaagtatttttgtcagtactttatcgtttcctacggacatatcatgggtgccaaaatggaaacagatatgcggcgggatctgtttacccatctgcagaaattatccttttcctattatgacaaacggaatacgggagagctgatgtcccggctggttgcggatttattcgatatctccgagttagcacaccacggaccggagaatctctttatatcgatcttaaagattgtcggctcttttgtgatcttaatgactttgaatgtgcaaatgacgctggccctttcgattgtaaccctggtgattattgttttcagcctctataagaataaagtaatgcagcctatcttcagtgataaccgtgtcaaaatcgccaaggtgaattccagtgttcaagatagtctggcaggaatccgggtagtccaatcctttgccaatgaagggatcgagaagaagaaatttgcccacagcaatgaggctttcctggaatcaaaaacaggagcctataaggtcatgggcgggttccacgcctggaactctttctttgaagggctgctctacatcgtagtggtcgtcacagggggcattcatattgccaatgggactttaagaccttctgatctggcggtgtatattctttacatcaatatcttcattaatccgattgatgtgttgatcaactttacggaacaattccaaaagggttatgcaggctttaagcgttttgtcgaggttctggagacccatccggatattaaagatgaacctggggcaaaacctttaacccagatcaaaggggatattgagtatcagagtgtctcttttggctatgatgaggaggaatcccatgttctcgatcaggtcagcttgaagatcaaagcaggggaaaccatcgctttggtaggcccttccggcggcggcaaaaccaccctctgctccttgctgccaagattttacgaggtgacttccggaaccatcaccatcgatggtcaggatatccgcaaggtaaccctggcctccctgcgcaatgccattggggtggtccagcaggatgtctatctgtttgatggcagcattaagcaaaacatcgcctatggcaaagcgggagctaccgatgaagaaatcattgaggcagcgaaaaaagccaatatccatgagtttatcagttctcttgaagaggggtatgacacctatgtgggtgagcggggagtacggctttccggcggtcagaaacagcgcctgtccattgcccgggttttcttgaagaatcctcccatattgattctggatgaagccacttcagctttggacaatgagagtgagcgctatattcaaaaatctctggaggagctggcccagaaccggaccacgattgtgatcgcccaccgtctgagcaccattcgcaatgccgatgaaattatcgtgatcactgatgagggcattaaagaaagaggaaatcatcaggagctcctggaaatagaaggcatatatgcccattactatagaatgcaatttgaaggactg

SEQ ID NO: 33356 - DNA, 1073 bp, Desulfitobacterium hafniense
aagctggcgatcttgaccgggggcggagactgcccggggttgaatgcggtgattcgtgccgctgtaaaaacagcttgtcatcgcggtatagcggtggtgggaattcaagatggttttcggggagctgtggaaggggatttccgtcccttagagcttaaggatgtctccgggatcttaccccggggaggaacgattctgggcaccaccaaccgggataatccctttgcctatcctacacaagtcggggaagaacggcaggttcaggatcgttccgctgaagtgctggacagatttaaagcggaaggaattgatgccctgattgcgattgggggtgatgggagcttaagcatcgcttgggaatttgctaagcaagggcttaaggtggtgggtgttcccaaaaccatcgataatgatctgatgtgcacggatttaacctttggctttcagactgctgtggctactgcccaggacgctttggaccggctccacaccacggctgaatcccaccaccgcattatgatcttagaggtcatgggacgctacgccggttggatcgccctctatgccggagtggcaggggagcggatgtcatcttaatcccggaaattccttatcagctggagagtatcgctgaagctgtccagagacgggcccgtttaggcaagcacttcagcatcattgtggtggctgaaggggctaaacccctgggcggagacatggttgtggaacgcactatgtcagggagaacagatcccattaaattaggaggaatcggtgcaaagctggcggcggatttagagaaggtcaccgatatggagaccagggtgactgtgctgggacatttgcagcggggagggtctcccatcgctgtggatcgggtgctgtccacacgctatggggtggctgccgttgaagccgctttggctggtgattttggcatgatggtcgccctgcaggggcaagacatcgtcagagtgccaatggcagaagccgttcacaagctgaagcaggtggaacctgacgatcctgtcttaaatgccgcccgcagcatggggatcgaattcggggactaa

SEQ ID NO: 33357 - DNA, 522 bp, Desulfitobacterium hafniense
ggattttactttgatgtcaataaatgcatcggctgccgcacctgtcaggtagcctgcaaggatagaaaccgcttggatgtgggcattttgttccgcagagtcaaaagctacgaaacgggtgcctatcccgctgccagagtgtaccattattccggtgcctgtaaccattgccaggaagccaaatgcgttcagggctgtcccaccggcgccttgcatttcgctgatgacgggaccgtccagcacgatcgcaaaaaatgcgtaggctgtaaatactgcacctggaattgtccttacagtgtcccgcagtttattgaagaagccggcgttatcggcaaatgcgacagctgtaaagacctgcgcgacgccggagaaaatccggtgtgtgtcgacgcctgccttatgcgctgcctggagttcggcgatcttgaccaactggccgccaaacatggcgctcacctggtcaaggaattgcctgttttaccctccgctcaggtgacaaacccctctttactgattaacccc

SEQ ID NO: 33358 - DNA, 1374 bp, Desulfitobacterium hafniense
atgttatcgcaaacgattgttgatcgactgaaagagattgtcggagagaaaaacgtggtgaccaaaccaacagaactcttcgcttatggttatgatggtacattgctcagcggcgatgccatcggcgcagtgtttccggaaactacggatcaagtggttgagctggttaactatatgaatgagcaggatatcaagctggtcccacggggtgccggcaccaatgtcagcggcggtacgattccttcggaaaaatccatcgtcattaactttacccgcatgaccaaagtgctggagatcgatacggagaatttcgtcgccgtggttgaacccggagtcgttaactttgaccttcagcaagaactggaaaaggtcggattttactatccccccgatccgtcttcctggaaagcctcgactctcggcggaaatatcggggagtgctccggcggaccccgttgcttcaaatatggagtaacccgtgattctattctgggcttggaagtggttctgcctaacggaaaggtgattcggaccggcgggcggaacttcaaaagcgagcctggttatgatttgacccgcatcatcgtcggttctgaggggacgttaggtttggtcaccaaggcttatctgcgtatcttaccaaagcctgtcaccaagaaaaccatgctggccatttataataaagtcgaagatgcttcccaaacggttgccgatatcgtggccgccggaattatccccacaaccttggaaatgatggataatctgctgattaataccacggaagattattgccatgccggacttccccgggatgcgggagctattctgattattgagattgacggctatccggaagacatggatgagcaaatcgaaaccatccgtgaagtaacgaagaaagccaatgcccgagactttaagattgctcaaacggcggctgaagtggatcaaatctggctttcccgccgggttgctttcggttcggtggctcgtgttaaaccttgttattcgattcaggacattacggtgccgagaagtgaattcccccaagctattgaaggaattcttaagattgccaaagagtatgatatgatcatcggtctggtggctcacgccggagacggcaacctccatcctttggtgctcttcgatcaacggcatgccgacgaggtggaacgggttcatggtgcagaaggagccctgagcaagctggctgtttctctgggtggaaccatgagcggtgaacacggcattggtgtggtcaagaaaaaatatatggatgtggaatttacaccgggagctatggaagctttccgtaaacttaaaaaaacctttgacccggctaaccgttttaaccctgataaaattatttcc

SEQ ID NO: 33359 - DNA, 691 bp, Desulfitobacterium hafniense
ataaaaacccaccaactcaccaaacgctatggcgatgttcctgtggtgaaccagctaaatctggaggtaagggcaggggagatttttggcttcctgggacccaatggggcggggaaaaccactaccatcaaaatcctgaccggacttatggagcccagtgaaggggaagctttgatctgcggttatgatattcgcaagcagcccactcaagccaaagccttgatggcctacgtccccgatcaacccaaattatacggcaagctctcggcctgggaatttctgatagctcatcggcgatctttatcagatacctaaagatgtgtcccgcaaaagagcagagatgcttatggagatgtttggcctgctggacagagctgatgaacttttggagggatattcccacgggatgcgccagaaggtagtgctggcctcagctctgatccaccaaccgaaagtcattctcctggacgaacccaccgtaggcttggatccggccagcgcccgtctcctcaaggatgttttgcaggaattggcacaccagggagcggcggtttttgtctctacgcatatcttggagattgcggaaagaatgtgccacagggtgggcattctggaaaaaggaaaactcatcgctcaaggcagcccggaggaattgcgccaaaacgtaggacatgggggagaaagtttagaa

SEQ ID NO: 33360 - DNA, 1767 bp, Desulfitobacterium hafniense
aaagccagggattttaataaaacactccgcaccttgacgggatatttaactccccataagacaacgatttccatcgtggttttctttgccctcttctccactgtatttacgattgtgggaccaaaattgctgggtaaagtcaccacgaaactggcggaagggttattcgcctggtataaccagacggggcttctgacggatttcaattatatcggtaaaattattggggccttggtggtgctttatgtaatctcctccatctgctcctacgtgcaagggtacctgatgtccggggtggccatggatgtcacttaccggctgcgcaaagagattgcggagaaaatgagccgagttcctttgaattattatgatacgagaagccatggggaggtcctgtccaggatcaccaatgatgtggatctgatcaaccagaccctcaatcagagtttaaatcaaatcatcacttcagcggccagcatcgtcggtattctgatcatgatgctgtccatcagctggatgatgaccgtggccgcattgctggttatccccttatccctggggattgtgggcgtggtgattaaacgctctcagcgcttcttcagggaacagcaacactccctgggcgagcttaacggccatattgaggaaatgtacggcggtcacactattgtgcaggcctttaatggggaagcggagtccgtggctttttttgaacgggtcaacgaccaactctatcattcggcctggaaatcccaatttgtcaccagcattatgatgccggtgatgagtttcgtaggcaacctgggttacgtggtggtcagtattctcggtggctacctggctgttaaacgggtcgtggacatcggggacattcaagctttcattcaatatatgcgttcctttacccagcccatagcccagctctcttccatctccaataccctgcagtccacagcggcagcggcggaacgggtctttgaatttttggcggaaggggaagaaaccccggaaacagctcatccggtcaccttggatcagttcagcggccatgtccgttttgaacatgtgagttttggctacagcaaggataaacaaattattcatgacttctccgcggacatcaaagccggccagagagtcgccattgtcggtcccaccggggctggcaagaccacgattatgaaacttttaatgcgcttttatgaaattgacagtggcagaatcctgatcagcgatcatgacatttatgacttcagccgccatgatctgcgctccttgtttggcatggtgcttcaggatacctggctctataatgcttcgattaaggaaaatattcgctacggtacctttgcggcgacggatgaagaagtcatggaagcagccaaggcggcccattgtgatgagtttatccgtgctttgccggggggctatgatatggttcttaatgaagaatccagcaatatctcccagggacagaagcagttgtttaccattgcccgggccatcctggccgacccgaagattttgatcttagacgaggccaccagctccgtggacacccgaacggagatcctgattcaaaaagccatggaaaacttaatgcgcaaccggaccagcttcgtgattgcccacaggctctccacgatccgggatgcggacatgattttagtattaaaagacggcgatatcgtggaacaaggaaatcacgaggaattgttagcccagaatggattctatgccgatctctatcagagccagtttgaagag

SEQ ID NO: 33361 - DNA, 837 bp, Desulfitobacterium hafniense
ctcgataaagattcttatgttatttttgatggagcaatgggcaccatgctgcaaaagtacgacctagcccccggtcagcccccggaagtattgaatataacgagaccggaggtcattgaagaagtccataggaaatacatcaaggccggtagtaacattatcactaccaatacttttggagctattgaaacaaaattaaatggaactggatatagcgtagaagaagttgtccaatcagctattgccattgcccgcagagcggctggtaagaatttggttgctttagatgtgggaccaaccggtgaactaattgagcctttaggggatttatctttcgaagaggtatacgacttatacgcttgccaaattaaagcagcagccttaacaggaaatgtcgatctggtattaatcgagacattttttgatctaacggaagcgcacgcagccattagagcagctaaagatcattcctccctaccagttatttgcacatttacctttcaacaaaaaggaagaactttaatgggcaaggatatcaagacagtggttacttcactggaggaatatggtgttgatgctgttggcgtcaattgttctttaggtcctggcgagatgctgtccatcgtggaaaccatggtatcttccacccagttacctattttagttcagcccaacgctggtttgccgaaattgatcggtgaccgaactgtctatgatgtggagcctgaggaattcgcccgatatatccaggttatggccaatctaggcgtgaagtggtttggcggatgctgtgggacgactcctgagtttattagtgccataaaggaatcgttgggt

SEQ ID NO: 33362 - DNA, 1197 bp, Desulfitobacterium hafniense
gttcattcctatattatcgatgaaggggaaatggtccccgtacctggccggcttatttatcgcggctatgatattaccgatcttgcccggggctttatggaagataaccgctttggatttgaggagacagcttatcttcttctctttggcaggttgccgaacaggcaggagctcattgattttcacaatctgctcgacatctatcaaaaactccctgataattttgcccgggatatgattctcaacgtacccagtaaagacattatgaacgggatggcccgcagtgtcttaggcttctattgctatgacaccaatcctgatgatacttccataagaaatgtacttaagcaatgcatccgcctgattgccgccttccctgcccttgctgtttattgttatcaagcctatacccattatcatgggaacaaaagcttggttattcacagccctcaacctgaattgagcctggctgaaaatattctttatatgctgcgccctaaccataaatatacagagctggaagccaggcttctggatctggccttggttcttcatgcggaacatggcggaggaaataactcctcttttgttacccatgtggtcacctccaccggaacggatacttattcagccgtagcagcggccttaggctctttacgtggtccaaaacatggcggcgccaaccataaagtcattcagatgttccaggatatcaaagaaaaaatctccgattggcaggatgaagacgaactcagcgcttaccttgacaaattcttcttaggatgcctttgatcgctccggactgatctatggaatcggccatgccgtctactccatctccgatccaagagccgttgtcctgaaacactacgcctcaaagcttgccgctgaaaagggcctggataacgaatttaatctttatgctaaagtggaagaactggcacccaaggtcatcgctaaacacacgaagatttataaaggagtcagtgccaatgtcgacttctattcagggttcgtctatcagatgctcaatctgcctttaaaatgttcactcctatttttgctctctcccgcatcgccggttggagtgctcaccggatcgaagaaatcgtcaatggcggcaaaatcattcgccccgcctataagagcgtggtgccccgtcaaaaatacgttcctcttaataaaagataacaccat

SEQ ID NO: 33363 - DNA, 920 bp, Desulfitobacterium hafniense
atcgaggtgaagaatctggttaagcagtacaaaaacgccaaaaccccgtctgtggatggagtcagctttacggtgaacaagggggagttctttgcctttctcggccccaatggtgcaggcaaaatcaccacgatctctattctcagcaacacccttgccaagacttccggagaagtgaacattgccgggtttgatgtagaaaaagaagcgcggcaggtgcgggaaaaaataggcatcatctttcagaagaccagactggacgtccagcttaacgcggaacagaatatccgcttccacgccgtcctctatggcatgtgcaactatcaaaccagctttaaacttccatgccggtcgcctatcgcaagcgggtgtaggatttaactgaaattgtgggcattgaggatgccttgttcaagccggttaaaaacctttcgggcggaatgcagcgcaagctggaaatcatccgcagcctgatgcacacgccggaggtgctgttccttgacgaaccgacccagggactggatgcggtaagccgcagggggctgtgggattacatcgatagggtgcgccaggaatacggcaccacggtgttcctcaccacccactatattgacgaagcggaaaaggtggataaagtctgtattatcaaccacggcaaaatcgcggcttgccagtccccgacggaactgaagcaaagcctgctccgccaggagctgattgtggacgctgccgacaggaacgctttaaccgctgaactgtccgggttaaatctgtcctataaactcaacggacagattagtgtccccctccaggggcaaagggctcaggaactgatcgccaggctgcaaacaccgctgacggtactcagaatccatgagccgtccttagaggatgcctatatcgaattcttaaacaaatca

SEQ ID NO: 33364 - DNA, 1611 bp, Desulfitobacterium hafniense
  unsure (1)..(1611): unsure at all n locations
gataacgagaataaatcctctaattttttacgcagcattatccttgaggatttacgggagggaaaggtagaagaaatcacgacacggtttccccccgagcccaatggttacctgcatattgggcatgctaaatccatctgtttgaactttggtttggccgacgaattcaaaggaaaaaccaatttgcggtttgatgatacgaatccggtcaaagaagatactgaatatgtagaatccatcaaagaagatgtcaagtggttggggtttgactgggacaacctctttttcgcttccgattattttgcggagatgcataagcgagccgttctgctgatcgaaaagggcaaagcgtatgtttgtgatttatccgctgaggagattagaaaaagccgcggcaccctgactgaggccggtaaggaaagcccttaccgcaaccgcagcgtggccgagaacctggagctctttgagagaatgcgtcaaggtgaatttaaggacggagaaaaggttctccgggctaagatcgatatgggctcacctaacatcaatatgcgggatcctgtcctttatcggattgcccatgccacccaccataatacaggggacacatggtgcatctaccccatgtatgattatgcccatcctttagaggatgctatcgaagggataactcactctatctgtactttagaatttgaagatcaccgtcccctctatgattgggtcgttcgggaatgtgagatggaacatgtcccacatcaatatgaatttgcccgcttaaatatgaccaatacggtgatgagcaagcgcaagctgaagcagctggtggacgaaaaagtggtggatggttgggatgatcccagaatgcccaccatctccgggctgcgccgccggggatatacccctgaagccatccgcaattttgcccaagccattggtgtggccagagcggacagtgtggtggattccaaaatgctggagcactttattcgggaagatctgaagctcaaagtgtcccggcccatggcggtcatccgtcccttgaaggtggtcattaccaattacccggaaggccaagtggaaaggctggatgccgatcacaataaagagaaccctgagatggggaaacgcaagattcctttttccagggagatttacatcgagcaggaagatttcatggaggtcccgccgccgaagtaccaccgcctttacccgggcaatgaagttcgtttgatggatgcctactttattaagtgtgaagaggtcatcaaggatgatgagggcaagatcatcgagattcgttgcacctatgatccggaaacaaaaagcggcacaggatttaccggccgcaaggtcaaggggacgattcattgggtggaagccactcaggcagtgccggcagagtttcgcctctatgagccgttaattcaggatgattatatcaatcccaattctctggaaataaggcaagggtttgtggaaccttatatgaaagaggccaaaccncaggataaattccagtttccccgtcacggctactttaatgtagatccgaactataccaccccggaaagcttagtgttgaatttaattgtttccttaaaaagctctttc

SEQ ID NO: 33365 - DNA, 1002 bp, Desulfitobacterium hafniense
ttaccgccggcggaagaaattattgcccatttgcctttaagcaaagaagtggctgagctccgggacaaacgggtggacgagatgaagaagatcctgaccaatgaagatcaacggttcttattgattgtcggtccttgctccgccgatcatgaagatcccgtttgtgagtatattgaacgattggccaaagtccaggaaaaggtcaaggataccctcctcatcgtgccccggatctataccaacaaaccccggaccacaggggaagggtataaagggatggttcatcagccggacccggaaaaggccccggatatgtgcgagggtattaaagccattcgccgcttgcatatccgcgccatatcggaatttgggatgccggctgctgacgagatgctctatccggagaattacagctatcttgccgatgtcctgggttacgtggccatcggagcccgttccgtggaaaatcaacagcatcgccttaccgtcagcggtgttgaacttccggtgggcatgaaaaaccccaccagcggcgatatgaccgtgatgtttaattcattgattgcagcacacagcaatcattctttcatctacaatggctgggaagttgaaaccactgggaacccttatgctcacgccgtgttaagaggggctgtgaatgccaatggtgaaaatatccccaattatcattttgaagacctgattcggaccgctcgggaatatgaaagactggaattggttaatccggccattatcgtggatgtgaatcatgccaactccatgaagtgcttttatgagcagccccgtatttccggcgaggtgctgtacagccgtaggtatgattccctgctgaagaagatgatcaaagggctgatgatcgagagctatctggaggaaggaaggcagggcatcggggaaaacatctatggaaaatccattacggatgcttgcttaggctgggagagcacggagaagttgatttactctatagctgaaaatgtc

SEQ ID NO: 33366 - DNA, 828 bp, Desulfitobacterium hafniense
atgccagtaaaaggatttaaaccgtattctcctggtcgtcgtcaaatgacagtgtcgacttttgaagaaattacgaaaacaacaccggagcgctctttgctcgcaccgttaaaaagcaaagccggccgcaacaatcaaggtaaactgactgtgcgtcaccaaggcggcggacataaacggaagtatcgtttgattgacttcaaacgcaataaggatagtgtgccggcgaaagtcgcttctatcgaatatgacccgaatcgttccgcgaatattgccctgctccattacttggatggtcataaagcctatatcctggctcctaatggcctgcaagtgggacaaatggtcgtatccggaccggatgccgatattaaagtaggaaatgccctgccgattaaaaacattcccgtgggtaccctgctccataatatcgaaatgaagcctggcaaaggagctcaattggtccgctctgcgggtggttcagctcagctgatggctaaagaaggcaagtatgcgaccttgagacttccttccggtgaaatgcgcatggttcatatcgactgccgggccaccatcggccaggtcggcaatctggaacatgagaacatcaacatcggtaaagcaggtcgttcacgctggttaggaatccgccccacagttcgtggtgctgttatgaaccccaacgatcacccacacggcggtggtgaaggccgtaacccaatcggccgcaaccctgttacaccttggggtaaacctgcccttggagcgaagacccgtaagaagaagaatccttctaaccgcttcatcgtgaaacgacgtggcaagaag

SEQ ID NO: 33367 - DNA, 1821 bp, Desulfitobacterium hafniense
atgtgtggtatcgttggatatattggtaaacgcccggctattcctgttctattggatggattaaagaagcttgaatatcgcgggtatgattcagccggagtagcagtccttgagcaggatgctattacgacctgcaaggctgtaggcaaattagctgttttggaagaaaagctgggaacagatttttctcagacctgtatcggtatcggacatacccggtgggcgacccatggccgcccctctgatctcaatgcacatccccatttggatactgaagcaaaatttgccgtagttcataatgggatcatcgagaactatatcgagttgaaggaatggctggtcgaacaaggtcataccttcgtttcagaaacagatacagaggtattgccccatttagtggaatatttctataagggagacttagtcgcaacagtacgtgaagtgctcaacaagctcaaaggttccttcgctattctggtgatgagccgtcaggatccggatattcttgtggcagcccgtaaagatagtcccatggttgtgggattaggagaagaggaattcttcgtagccagtgatattcctgctatcctcaactacacccgcaaaacctatatcattgaagatggagagatggttattctcactaaaaatggggtagaggttacggattttgaaggaaaagaaaaagaaaaacagctttatgaagtgaaatgggatgccgtagcggctgaaaaggccggctatgatcatttcatgcttaaagaaatttacgaacagcctcgcgctcttcgagatactttgatcagccgcttagaagatgacaaagtcgttcttaatgaagtggacctgactgcggaacaactgagaagtttcaggaaagtctttatcgtggcctgcggtacagcttggcatgcgggtttagtaggcaaaactctcattgaacgttgggttcgtctcccagtagaagtggacatcgcttcagaattccgctatcgttctcccctggtagatgagcatactttagtcgtggttatcagccaatctggtgaaactgccgatactttggcagccctccgggaggccaagagaaacggtgcccgcatagttgccattactaatgtagtaggaagttctgtagctcgtgaagcccatgatgtaatctacacctgggccggcccggaaatcgccgtagcctccactaaagcctatactacccaattagaaggggtggtccttctggggctttatttggctcaaacccgcggtaccctggcaaccgaaaagatccggaagatcatcactgccctgcgcaggctccctgctcaagcccaggagatccttgacgagtctgagcatattaaagacttagcccagtcctttgttgaggtagaagatgctttcttcatcggccgcggcctggattggaatgtggctatggaaggtgctctaaagcttaaagaaatctcatatattcatgcggaagcctatgctgccggagaactcaagcatggcactctggctttaatcaccgacaagacccctgtcattgccttggctactcaaatggatgtctacgaaaagactttatctaatattattgaggtcagagcccgtgatgcccgagtcatcggtatcaccttcaaaagcaataaggatctggacaagtcagtggatcgtgtaatctacctgcccgaaaccatcggcgaactggctcctattctcactgtgattccaatgcagctcctggcttactatgtttccgtggccagaggctgtgacgtggataaaccgaggaatctggctaaaagtgtaacagtcgaa

SEQ ID NO: 33368 - DNA, 1329 bp, Desulfitobacterium hafniense
ttgggtaaattgtttggaacggatggggtacggggtgtggccaataaggagttgacacccgatttagcctttcgtttaggtcaagccggtgcctatgtgttgagcaaggaacacccccatccacgcattgtaatcggcaaagatacccggatctccggggatatgttggaagcggctttaattgccgggatatgctctgtgggagctgatgtattaagagtaggggttttacccactccagggattgcctacttaacacgaaccttaaaagccagtgctggagtcgtcatctcagcatctcataacccggttcaagataatggaataaagtttttttcctccacaggttacaagctgcctgacgcggtagaggaagagattgaagatcttgtccatagtcatgaaaaaccctgggcaatccccgttggcagtgaaatagggcgggtgatagagatccaagatgctcagcgccggtatatggattttttgaaagggacggtgggctcccttgccggaattaaggtggtttatgatggctccaatggtgccgcgtctcacgtggggccccaagttcttcgggagctgggagtggaggtgattcctctatctgttacccctgatggaatcaatatcaatgcaggttgcggctctacccacccggaggtacttcaacaagctgtaatcgagcataaggccgatttggggttggctaatgacggtgatgcggatcgtttaatagctgtagatgaaaacggagaaatcgtcgatggggatttcatcatggttatctgcgctttagcacttaaagccaaagggcagctgatggaagattctgtcgtagttactgtcatgagtaatctgggtttgcatatcgctttaaaagaagctggaattagagtttatgaaacccaggtaggagatcgttatgtcatggaagagctcctcaaaacaggagcgaggctagggggggaacaatccgggcatattatcttcctggatcataacaccaccggggatggcttgcttacagctttgcagctcttagcagtgcttaaagagcaaggaaaacctatttcgaagttggcggccaaaatgcagcgtctacctcaggtactgattaatgtccgagtcaaggataagaagaaagctatggaaaacccttatgttttccaaaaggtggaggaagttaagcgtttcctgggagaaaggggacgggtcctcgtacgctcttccggaactgagtccttggttcgtgttatggtagaaggccaggatcatgagcagctcatgggtctggctcagtccgtggtggatattattaagcgagaa

SEQ ID NO: 33369 - DNA, 1284 bp, Desulfitobacterium hafniense
atgcataatattgccagggagctcaacgatcagataagagcagaaaacccccatgtgtacgaactgctttcagatttagggaggaatttatactatcccaagggaatattgacccagacagatgaggctacggaaaaggcttatcgctttaatgccacaataggtatggctacggaaaaagggcagcccatgtttctgccggttatccaagaaaccttgtcccagtataaccctcaagatatctatacttatgcgcctccggccgggaaatccaaaatcagggctgtctggagagaaaaactgcttaaggacaatccttctttgcagggcaagaccatgagccagcctattgtgaccaacgctttaacccatggtttaagtattgcggcagacctttttttaaatcctcaggacgtattagtgcttcccgataaactctggggcaattacacgatgatttttggaacccgcagaaatgctgaaatgcggaatttcacctttttcacggagaacggtgaattcaatacccaagggatgaaagaagctcttctggcccaaaaagcacaaggcaaagcggtgttgctgcttaatttcccgaataacccgaccggttatacgcctgttgagaaagaggctcaggccattgtggaggcgttgctggaggtggcggagcagggaattaatgtggcggttttagtcgatgatgcttattttgggcttttctacgaggattccatcaaagaatctctgtttggacggcttgccaatatccacccccgcattctggccgttaaggtggatggtccaaccaaggaagagtatgtatggggattccggattgggttcatcacctttggggatgccagctcagtggtttgcgatgttctggagaataaaaccaaggccatcatccgcagcaccatctccaatgcctcccatcctgcccaaaccttcgtccttcatgctttggcatcccctgattttgagaagcaaaaagcggagaagtacaagattatggaaggccgggccttaaaggtcaaagagatcttgaaccggggtgattaccaggacctttgggattattatccttttaactccggctattttatgtgcttgaagcttaaaggtgtgaaggcagaggaattgcgtctgcatttactgcataactatggagtgggtgtcatcgctctgggtgagtccgatatccgggtggcgttctcctgtgtggaagaagaagatttggaagaattgtttaagttgatttatcagggaacgaaagattta

SEQ ID NO: 33370 - DNA, 1778 bp, Desulfitobacterium hafniense
ttcccttatcctgcttatcgcaaaggccaacgagagctggttgtggcggtctataagacgataaaagaaaagcataagctttatgtgcaagctcctacaggtatcggcaaaacactggggacgatttttccggctttaaaatgcctcctcgaagggttggagacaccgatcttttatctgacggctaagaccatcacccgcaccgtagcagaaggctctctcctcatgctccagcagcaaggactgtccctgaagagggtcactcttacggctaaggataaagtatgcttttgtcctgagtgtgaatgcacaccggaagattgcagctatgccaaaggatattatgaccggttaggcccggctctggaggatatttttgagagggatcattggaatcgggagcagatcgagaactgtgcccgcaatcatggggtctgtccctttgaattttccctggaacttaccaattgggctgatttggtgatctgcgactataattacgtctttgatccaagagtgtttctcaaacggttttttctcgaaggcggggattatgcctttctgatcgatgaagctcataacctggtggagcgggcccgggaaatgttttccgcccaattaaacaaggaggaattcctccacttgaagaatctcgtggaggatcaggaaccggttctgggaaaaaggctccaaacggtcaataaaaactttttaaagctcaaaaaacaaggtcttgaagtggaaaaagacgcccccacagccctgtactcttcattggagagggtagtgaacgaagcggagaagtttttcaagaaagaggaaaccccaccctggaaggagaagttaacggagctgtactttaacattcaagccttcctgcacacggctgaaagttatgatgagcattaccttacctattatcaatacccggagcaggatgttcgtgttaagcttttttgtgttgatccctctcagcagctggctcaggtcttaaacaaggggagagcagcagttttcttttcggccaccttaagccctctggagtattttattcaggttttggggggagagaaagaatcttataagctgcagctgccttctccttttcctcacgagaacctttgcctgatgctgcagaaacagatctccaccaaatacaaccagcgctctttatcctggaccccatcgtcgaggggataactcagcttgttcaggggaaaaccggcaattatctggtctattttccttcatatgagtatcttgaacgggttcgggaaaggcttctccaggcccatcccgaatttaaggttttgacccaaactatggggatgactgaggcggatcgggaggagttcctagaagcgtttcaggaggagccccgggagagtctggtgggattggccctgttggggggaatctttggggaaggaatcgatcttacgggagagcgtttgtccggtgccgtaattatcggggtggggctgccccagattggcacggagcgggatataattcgcgctcattttcaggaacgctatgggcaagggtttgaatttgcctatatgtaccctgggatgaataaggtgctccaagcctgtgggagagtgatacggacagaacaggatcggggagcaatcctcttaattgatgaacggtttgcccgtttgtcttacagacgtctattccctaaggaatggcatgctatccatacgctgcaggataatagccggattccttcactattgaaagccttttgggaatcatcataaaataaagaa

SEQ ID NO: 33371 - DNA, 1266 bp, Desulfitobacterium hafniense
gttaagattggactgctgggtctcggaaccgtcggcagtggcgtaattcagatccttgagcaaaatgctaatgatatacagaaccgttccctaagtcagattaaagtctccaaggtcctggtgcggaaccttaaggctccccgctcaatcgcaggggattttactctaaccgatcaagccgccgatgttctcaccgaccccgacatcagtattgtcgtcgaagtgatgggcggcattgaaccggccaaaacctatatattagaagcttttaaacaagggaagaatgtggtgaccgccaataaggaccttttggcccttcatgggcaagagcttttggatgcggctaaagaagctggcaaagatctttattttgaagccagtgtagccggcggcattcctattatcgccgccctgaagcagtctctggccgggaatagaatctctgaagtcctggggattattaacggcaccaccaactatatcctgaccgctatgaccgagcagggccgggattatcaggaagtcctgaaggaagctcaagagttaggttatgcggaagccgacccgaccgcagatgtggacggactggatgccgcccgcaagctggccatcctcgcctccatcgcctttaactcccgggtcaccgtcaatgatgtctatgtggaagggatcgccaagatcacttccgaagacatcgcctatgcccgtgaactcaattccaccatcaaacttctggctgtggctaaagctcaggccgacggcatcgaggttcgtgtccaccctgcctttgtgcccgacaaccatcccctggctgctgtcagcggagtttttaatgctatctatgtggtgggagacgccgttggcgaaaccatgttctatggccggggtgccgggtccctgcccactggaagtgccgttgtctccgatatcattcaagtggtccggaatatcaatgcggattctacggctaacattaattgcacttgttacaatgaattagccatcaaaagcgaacaggattttaaaagcgctttctatatccggctgcgggtcaaggatgaaccccgggttctggctaccctagccctgcttttcgccgaagccggggtgagctttgcttccatcattcaaaaacagaaaaaacgccaggaagcggaaatcgtcctggtcacccaccccactcaggaatcctgcttgcgtgaagctctggattcggtccgggcctacagcaaagtgctctccatccacaatgtgattcgttttgaa

SEQ ID NO: 33372 - DNA, 682 bp, Desulfitobacterium hafniense
gaaaaagtagcgattgtcacaggcggcagttccggaatgggattggccattgccaggaggctgaaagaggcggggatagaggtcattatctttgatattcaaaagccgccggaggagtttcccttctatcatgttgatattcgtgatgatggccagattaagtcagcactatcccatatctctcaactggatattttagtgaataatgccgggatctattttgagagatatttggaggataccactaatgaagaaatagacaacatggtggatatcaatattaaaggaacgtatctgatgacacgcaatgctcttgctaaaatcaaagaaagacaaggctcggtcattatcatcgcttcgtgtatgggacttgtgcccgaattaacatctcctctgtactgcaccacaaaagcgggacttattatgttgacaaaatgccttgccccagcaatatgcagattgcggagtgcgggttaattgcatattgccggggccaatcaatacccctctccttcaaaagagttttcccgatgaagcaaccgctgcccgctgcgcggagcgtgtgcctttaaagcggattggggaaccggaggatattgccaacatggtggcttttcttgtgagcggggaggccgggtatataacaggcggtgcttttcccgttgacggaggagtatcctcg

SEQ ID NO: 33373 - DNA, 1857 bp, Desulfitobacterium hafniense
ggcaaaattcaggaagtcaatgatatggcttgtgagcttattggcttgaccagggcggagattatcgatctaagccgagaggtgatcaaagtcaagagccctctgacactggccaatgagttcacccagaaattattgagcaaaaattacctggtttttgaaggaatgctcttgacccatcaggggaaggagatccctgtggaagtcaaggcccattaccatgttttgaacggccgcaggatgctgctttccattgccagggatatcagcaatcaaaaacggatccataaaatcttattggcaagccataataaataccgccagctttttgataacatcaccgatgcggtttttgtctatgaactgcaaaaggatggctatcccgggctgttgatcgaaataaacgaaaaagccaggaggcttatgggttatcatgaagaaacattcatgttttctgcaggaccctgtatccggccatcctcacctcaattaaccctggacgacgtgtggcaaagcctggaaagaacccattcagcaagtttcgaagggatctgtaccaatctggagggcgaggatattcccgtcgaagtcaattgccataccttccctttaaacggcagcaaggtgatgctgacccttcttcgcgatattaccgagagaaagcaaatcgaacaggaacgcaaacggactgaggcggagtttcagcaggccaaggagaaggctgaagcagccaatcgggccaaaagtgaatttctggccaatatgagtcatgaaattcgtacaccgatcaatgggatcatcggcatgatcgatctcaccctcttaacctccttagagaagacccaaagggagaatctgaagattgccaaaaactgcgcttactctctgttcaaaatcatcaatgatattttggatttttccaaaatcgaagccggaaaactaacggttgaagagattgaatttaaccttaaggaagtcatcgaacagattatcaaaacccatagtcctgaagctgaacgcaaaggtctggatttggcctacaccctctcggccaacctccccgattactataaaggagatccggaacggattaagcaagtcctcaataacctgctgagcaatgctctcaagtttaccgagcggggagaggtttccctggcggtcaaacgcctgcaaggggacgaggacgtttcggatttaaaatttactgtcatggacacgggaatcggcatagccgaagaggatcagctgcatctttttgaagagtttaaccaagtggacggctccattacccgcaaatatggaggaaccggtttagggttagccatatccagaaaactggttgaaatgatggggggaagaatctgggtcgaaagtgaaaaagggaaggggagttcctttggcgttgttttaaggctgaaacatggcgacaaagacacgctgcgcttcaagtccacccagaataacgatcagtcaagggaaggatcaaccgcaaggtcttaccgaatccttttagctgaagatcatatcgtgaattccatcgtcatcacggaaatgctcaaaatccaaggccatcgggtggatatcgccatggatggagaagaggccttagccctttatcaccaaaatccttatgatgtcatcctgatggacattcagttgccccgtctggatgggatcgaagtgacgaaaagaattcgggcaagtgaaggggctcaaagccgcactccgatcattgccttaaccgcctacgccttgcaaggggatcgggaaggatttctccaggccggtatggatgaatacattcccaagcccgtaatgatggaggaactgatcatggtcttggatagagtggtg

SEQ ID NO: 33374 - DNA, 1275 bp, Desulfitobacterium hafniense
taccaggaagccaaggattatctggtgagcctcacgaaatttggcatgaactttggattgggtcggattgaggagttgctgaaacgtatgggtaacccggaagagcgtctcagggtcgttcatatcggaggaaccaatggcaaaggctcgactaccatgatgacggcggaaatccttgaagatgccggatatcgggtaggggtgtttacatctcctcatcttcatgattatcgggagaggataaccattaatggtgagatgattccgaaaggggaagttacccgcctgattcagattctccgtccccatttggaggaacttgtacaaaagggtgtggagcatcctacagagtttgaagtgaatacggccatggccttgatgtattttgccgaccagaaagtggacttggttctcctggaggttggtttgggtggggcgattgattctacgaatgtggttaagcccttgatttcggtgataaccaatgtgggtatggatcatatggattatctgggtgaaacctatgaagagattgccggagtaaaggccggaattatcaaagcaggtgcgattaccgtaacggcggctgatcgccctgaggttttaaatgtcatacgcaagaaggcacaggaaatgaactctcctttatgggtggtgggcgacgatgtgcgctgggagatccgatggagcggggaactggagcaggaatttgatttggctgggctgcggggagcctataacaaactgcgcttacgtcttgtcggagagcatcaagtggttaatgctgccaccgctgtgacagtttgtgagcttttgaaattcgaatacggaatgaatctggagcgcagaaatatttatgaagggcttcgtaaagcagtttggcctggccgcttggagttgctttctctgaaaccgaaggtgctgatcgatggagcccataatgtggatggagcccatgccttggcgaaggctttgaacatttttcagcgtcagcgcctggtgctctgtcttggtatgctgggagataaggagcgggaaaaggttgtggacatccttgttcctttagctgatgaggtgattattaccaagcccaattccccgaggtccggaaactgggagtatctccatgaattagtcaaggaaaaagggaagcctgtcctgaccattgaagagccccgtctggcagttgaagaagcttttagacgattggataaagaggatatgctatgtgtcacggggtctctctatatgattgcggaggcaaggcaggcttta

SEQ ID NO: 33375 - DNA, 582 bp, Desulfitobacterium hafniense
atacgctggaatgctgatggtttaattcctgtcgtggtgcaggatgtggatacgcgagaggtcctgatgctggcttatatgaacgaagaagcactcaggcgcacccttcaggagggaagggcctggtattacagccgcagccgtcaatctctgtggctgaaaggagaaacgtcaggccatacccaggaagttgtggatctccgctttgattgtgaccgggacacgattctgctgacggtcaggcaaaagggtgtggcttgtcatgaagagttttactcctgctttcattatggagtccagggagaaggctatgtaactctgggagcgcctgaagaagttccggcaatacccttgggcaggaccatggagctgctggcggaagtgattcattcacgaaatatggaacgtccggaaggagcctatacaacctatctgtttgataaagggcttgataagatcctcaaaaaagttggggaggaatgcgcggagaccatcattgctgcaaaaaacagttcggctgaggaaattcgctacgaagtctcagacctcatttatcatgttttggtcctgttggaagaacgt

SEQ ID NO: 33376 - DNA, 777 bp, Desulfitobacterium hafniense
atgttagcgaaacggattataccttgtctggatgttcatgaaggtcgcgtagtcaaaggaacaaatttcgtcaatctccgtgatgccggagatccggtggaattggcggctctctatgatcgagaaggggcagatgaattggtttttctcgatatatcggcatcggctgaaggacgggagaccatggtcgaggtggtgcgcagaacggcggaacaagtgtttattccttttaccattggcggggggctgcgcagggtggaagatattcgcaagatgctcagagccggagcggataaagtatccttgaatacatcggctgtccagactcccggactgatcgaggaaggggctcatgcttttggcagccaatgtatcgtcgtagccatcgatgcccggcagacccgtccgggagcctgggaagtctatatccatggcgggcggactcccaccgggaaggatgttttgcagtgggccgaggaagtggagcgcttaggtgccggtgagatcctgctgacttccatgaatcgggacgggacgaaaaatggctatgatttggagctgacccgggctgtaagcagagcagtctctttgccggtcattgccagcggcggggtgggaactctggagcatctggcagaagggctgaccataggggaggcggatgcggtgttggccgcttcgatttttcattatcaggaatacagcattggggaagcgaaagcttatctggaggagcgggggattccggtgaggaagggttagatgggttctcccgca

SEQ ID NO: 33377 - DNA, 582 bp, Desulfitobacterium hafniense
atgcgtgaagcacacattgaacgtcaaaccaaagagaccaggattcgggttaagctgaatcttgacggagccggtacggctcaggtcgatacgggtatcggcttctttgatcatatgctggaagccttggcccggtttggttatcttgatctggaagtagccgctgaaggggatttgcaggtggaccctcatcacaccatcgaagactgcggcattgttttcgggcaggctatcagggaagccttgggggagcgtcgtggcattgagcgggtaggcgatactcttcttcccatggatgaagccttggtgcaggttgctttggatctctccaatcgtccctatctggtttgggatgtggagtgtcccgaggggatggtaggaggattccctgtggaaatggcggaggagtttttccgggcggtatccgttcaggcgggcataaccttgcatatgcggttattctccggcaagaaccgccatcatattctggaggcgatcttcaaaggttttggccgggccttgggcttggctctccgcgagaatcctcgttttcaaggagttttgtcgacaaagggagtactt

SEQ ID NO: 33378 - DNA, 1047 bp, Desulfitobacterium hafniense
atacgaacattaaaagcctatgaaagcaagtccatcccggactgtgtacgcttggatgccaatgaaaatcctctgccttggcccccaggaatgattgagcaattattgggttcagccattgcttttaaccgttatcctgatggtggggctcaagaacttaaggaggccctctcccgctatacaggagtgcccgctgaggggattttaacaggaaacggctctgatgagctgatccagctgctcatgacgacctttggcggcgagaagggagctgtggttattcatccgcccaccttcagtatgtatgaagctgcggccagggtgaccggcacggaggttctggaagttccgcttcttctcaccgaaaccagcagggacttccgcctggatgtggaagggatacttaaggcagcggcccaacctcaggtccatatgattgtcctctgcaatcccaataaccctacgggaaccctgttccctcgggaagagatactgagaatcgtggcagagtcgggcaagatcgtcattgtggatgaagcctacggagagttttccggggagagtgttgtggatcagattccatactgccccaatctcttagtgatgaagaccttttccaagctgtttgccatggctgctctcaggcttggctatcttctgggacaaccctccatcatcggagccttgaaccgggcccggcagcctttcaatgtgaacagcttcagccaaaaagcgggagtgatcgcactgaattatggggaggaatatgctgaacaaggtcggattctgatcgctgaactggccaggatcgctgaggctctgaccgcttttgcttcggtaaaggtttttgcaacccgggctaatttccttctttttcagcccgaggatccggaccgggtctatcaggaattgatcgggaagggtttcttgatccgcactatggggaatctgccgctggtgggcaaggctctgcggcttagcaccggtttgcctgaagagaatgagagacttatcaaagcacttggggagattctaaaatagctcagt

SEQ ID NO: 33379 - DNA, 1272 bp, Desulfitobacterium hafniense
atggagattaagacccttgaggaattggatttgactatgcttacgcgcaaatcctatggcgatgatcaattgctggaacataaggtagcggaaattctttctgagattaagaaagaaggggattcagccctctatgccttaacggaaaaatttgatggagtggatctccgcccatccgggctgcgcgttcgagcagaagaactagtgaaggcatactctcaggtggatgaagaattcctggcagctctgcggcttgctaaggagaagatcacctcttaccacgaaaagcaaaaacgcacctcatggttggatgcccaggaagacggcagtattctggggcagctgttgctaccccttaaacgggttggcatctatgtaccggggggaaccgctgcttatccttcttcagtgctgatgaatgcagtccccgctgtagtagcaggggtcgaagagatcgtgatggtcagtccgccgcgcaaggatggcagcttgctgccggaggtcctggtagccgccgcggaagccggagtcacggaaatctataaggtaggaggggctcaggccattgccgccttagcctttggcacaggggaaatctctcctgtggataaaatcaccggaccggggaacatttatgtcaccctggccaaaaaacaggtctttggcaccgtggatattgatatgctggccggtcccagtgagatactcattttagccgatgagtccgcgcagccggaagagcttgccgccgatctgctttcccaggctgagcatgatcccttggcttcctccattttggtctctcctgatcggaaagtgctggaggagacggtggcggaagtggagcgtcaattaaagctgctgccacggcaggatatcgcccgagcctcatgggagacctatggggcggcgattttggttaaggatctggctgagggcatgaatttagtcaaccagatagctcccgaacattttgaactggtgattaaggaaccctatagctggctgggccgggtaagaaatgccggagctgtctttttgggccgtttctcaccggaacctgtaggcgattattttgccggccccaatcatgtattgcctacgggaggtacggcccgcttttattctccgttaaatgtggatacctttatgaagaaagtcagtgtgatcagttattcggaaaaggccctgcagcgggacggcaagcacatcgctcatttagcccggaaagagggactcgaagcccatgcccgggctgtggaggccaggaag
